United States Patent 12,188,016 (ANTISENSE OLIGONUCLEOTIDES FOR MODULATING THE FUNCTION OF A T CELL) - sequence listing, part 3

SEQ ID NO: 45911 - RNA, 24 nt, Artificial Sequence
  Synthetic Oligonucleotide; REL exon 4; Set C
auuuuggaaacuagcaggaaaaaa

SEQ ID NO: 45912 - RNA, 23 nt, Artificial Sequence
  Synthetic Oligonucleotide; REL exon 4; Set C
auuuuggaaacuagcaggaaaaa

SEQ ID NO: 45913 - RNA, 22 nt, Artificial Sequence
  Synthetic Oligonucleotide; REL exon 4; Set C
auuuuggaaacuagcaggaaaa

SEQ ID NO: 45914 - RNA, 15 nt, Artificial Sequence
  Synthetic Oligonucleotide; REL exon 4; Set C
aaauuuuggaaacua

SEQ ID NO: 45915 - RNA, 16 nt, Artificial Sequence
  Synthetic Oligonucleotide; REL exon 4; Set C
caaauuuuggaaacua

SEQ ID NO: 45916 - RNA, 15 nt, Artificial Sequence
  Synthetic Oligonucleotide; REL exon 4; Set C
caaauuuuggaaacu

SEQ ID NO: 45917 - RNA, 22 nt, Artificial Sequence
  Synthetic Oligonucleotide; REL exon 4; Set C
aauacccaaauuuuggaaacua

SEQ ID NO: 45918 - RNA, 23 nt, Artificial Sequence
  Synthetic Oligonucleotide; REL exon 4; Set C
gaauacccaaauuuuggaaacua

SEQ ID NO: 45919 - RNA, 21 nt, Artificial Sequence
  Synthetic Oligonucleotide; REL exon 4; Set C
aauacccaaauuuuggaaacu

SEQ ID NO: 45920 - RNA, 22 nt, Artificial Sequence
  Synthetic Oligonucleotide; REL exon 4; Set C
gaauacccaaauuuuggaaacu

SEQ ID NO: 45921 - RNA, 20 nt, Artificial Sequence
  Synthetic Oligonucleotide; REL exon 4; Set C
aauacccaaauuuuggaaac

SEQ ID NO: 45922 - RNA, 21 nt, Artificial Sequence
  Synthetic Oligonucleotide; REL exon 4; Set C
gaauacccaaauuuuggaaac

SEQ ID NO: 45923 - RNA, 20 nt, Artificial Sequence
  Synthetic Oligonucleotide; REL exon 4; Set C
gaauacccaaauuuuggaaa

SEQ ID NO: 45924 - RNA, 30 nt, Artificial Sequence
  Synthetic Oligonucleotide; REL exon 4; Set A
acacaucgaauacccaaauuuuggaaacua

SEQ ID NO: 45925 - RNA, 37 nt, Artificial Sequence
  Synthetic Oligonucleotide; REL exon 4; Set C
auuuuggaaacuagcaggaaaaaaacaauauucaaaa

SEQ ID NO: 45926 - RNA, 36 nt, Artificial Sequence
  Synthetic Oligonucleotide; REL exon 4; Set C
auuuuggaaacuagcaggaaaaaaacaauauucaaa

SEQ ID NO: 45927 - RNA, 15 nt, Artificial Sequence
  Synthetic Oligonucleotide; REL exon 4; Set C
acuagcaggaaaaaa

SEQ ID NO: 45928 - RNA, 16 nt, Artificial Sequence
  Synthetic Oligonucleotide; REL exon 4; Set C
aacuagcaggaaaaaa

SEQ ID NO: 45929 - RNA, 15 nt, Artificial Sequence
  Synthetic Oligonucleotide; REL exon 4; Set C
aacuagcaggaaaaa

SEQ ID NO: 45930 - RNA, 17 nt, Artificial Sequence
  Synthetic Oligonucleotide; REL exon 4; Set C
aaacuagcaggaaaaaa

SEQ ID NO: 45931 - RNA, 16 nt, Artificial Sequence
  Synthetic Oligonucleotide; REL exon 4; Set C
aaacuagcaggaaaaa

SEQ ID NO: 45932 - RNA, 15 nt, Artificial Sequence
  Synthetic Oligonucleotide; REL exon 4; Set C
aaacuagcaggaaaa

SEQ ID NO: 45933 - RNA, 16 nt, Artificial Sequence
  Synthetic Oligonucleotide; REL exon 4; Set C
gaaacuagcaggaaaa

SEQ ID NO: 45934 - RNA, 20 nt, Artificial Sequence
  Synthetic Oligonucleotide; REL exon 4; Set C
uggaaacuagcaggaaaaaa

SEQ ID NO: 45935 - RNA, 17 nt, Artificial Sequence
  Synthetic Oligonucleotide; REL exon 4; Set C
ggaaacuagcaggaaaa

SEQ ID NO: 45936 - RNA, 21 nt, Artificial Sequence
  Synthetic Oligonucleotide; REL exon 4; Set C
uuggaaacuagcaggaaaaaa

SEQ ID NO: 45937 - RNA, 19 nt, Artificial Sequence
  Synthetic Oligonucleotide; REL exon 4; Set C
uggaaacuagcaggaaaaa

SEQ ID NO: 45938 - RNA, 18 nt, Artificial Sequence
  Synthetic Oligonucleotide; REL exon 4; Set C
uggaaacuagcaggaaaa

SEQ ID NO: 45939 - RNA, 22 nt, Artificial Sequence
  Synthetic Oligonucleotide; REL exon 4; Set C
uuuggaaacuagcaggaaaaaa

SEQ ID NO: 45940 - RNA, 20 nt, Artificial Sequence
  Synthetic Oligonucleotide; REL exon 4; Set C
uuggaaacuagcaggaaaaa

SEQ ID NO: 45941 - RNA, 19 nt, Artificial Sequence
  Synthetic Oligonucleotide; REL exon 4; Set C
uuggaaacuagcaggaaaa

SEQ ID NO: 45942 - RNA, 23 nt, Artificial Sequence
  Synthetic Oligonucleotide; REL exon 4; Set C
uuuuggaaacuagcaggaaaaaa

SEQ ID NO: 45943 - RNA, 21 nt, Artificial Sequence
  Synthetic Oligonucleotide; REL exon 4; Set C
uuuggaaacuagcaggaaaaa

SEQ ID NO: 45944 - RNA, 20 nt, Artificial Sequence
  Synthetic Oligonucleotide; REL exon 4; Set C
uuuggaaacuagcaggaaaa

SEQ ID NO: 45945 - RNA, 22 nt, Artificial Sequence
  Synthetic Oligonucleotide; REL exon 4; Set C
uuuuggaaacuagcaggaaaaa

SEQ ID NO: 45946 - RNA, 21 nt, Artificial Sequence
  Synthetic Oligonucleotide; REL exon 4; Set C
uuuuggaaacuagcaggaaaa

SEQ ID NO: 45947 - RNA, 23 nt, Artificial Sequence
  Synthetic Oligonucleotide; REL exon 4; Set C
aauuuuggaaacuagcaggaaaa

SEQ ID NO: 45948 - RNA, 33 nt, Artificial Sequence
  Synthetic Oligonucleotide; REL exon 4; Set C
aauacccaaauuuuggaaacuagcaggaaaaaa

SEQ ID NO: 45949 - RNA, 34 nt, Artificial Sequence
  Synthetic Oligonucleotide; REL exon 4; Set C
gaauacccaaauuuuggaaacuagcaggaaaaaa

SEQ ID NO: 45950 - RNA, 32 nt, Artificial Sequence
  Synthetic Oligonucleotide; REL exon 4; Set C
aauacccaaauuuuggaaacuagcaggaaaaa

SEQ ID NO: 45951 - RNA, 31 nt, Artificial Sequence
  Synthetic Oligonucleotide; REL exon 4; Set C
aauacccaaauuuuggaaacuagcaggaaaa

SEQ ID NO: 45952 - RNA, 33 nt, Artificial Sequence
  Synthetic Oligonucleotide; REL exon 4; Set C
gaauacccaaauuuuggaaacuagcaggaaaaa

SEQ ID NO: 45953 - RNA, 32 nt, Artificial Sequence
  Synthetic Oligonucleotide; REL exon 4; Set C
gaauacccaaauuuuggaaacuagcaggaaaa

SEQ ID NO: 45954 - RNA, 40 nt, Artificial Sequence
  Synthetic Oligonucleotide; REL exon 4; Set A
acacaucgaauacccaaauuuuggaaacuagcaggaaaaa

SEQ ID NO: 45955 - RNA, 39 nt, Artificial Sequence
  Synthetic Oligonucleotide; REL exon 4; Set A
acacaucgaauacccaaauuuuggaaacuagcaggaaaa

SEQ ID NO: 45956 - RNA, 19 nt, Artificial Sequence
  Synthetic Oligonucleotide; REL exon 4; Set C
aauacccaaauuuuggaaa

SEQ ID NO: 45957 - RNA, 18 nt, Artificial Sequence
  Synthetic Oligonucleotide; REL exon 4; Set C
aauacccaaauuuuggaa

SEQ ID NO: 45958 - RNA, 19 nt, Artificial Sequence
  Synthetic Oligonucleotide; REL exon 4; Set C
gaauacccaaauuuuggaa

SEQ ID NO: 45959 - RNA, 17 nt, Artificial Sequence
  Synthetic Oligonucleotide; REL exon 4; Set C
aauacccaaauuuugga

SEQ ID NO: 45960 - RNA, 18 nt, Artificial Sequence
  Synthetic Oligonucleotide; REL exon 4; Set C
gaauacccaaauuuugga

SEQ ID NO: 45961 - RNA, 16 nt, Artificial Sequence
  Synthetic Oligonucleotide; REL exon 4; Set C
aauacccaaauuuugg

SEQ ID NO: 45962 - RNA, 17 nt, Artificial Sequence
  Synthetic Oligonucleotide; REL exon 4; Set C
gaauacccaaauuuugg

SEQ ID NO: 45963 - RNA, 15 nt, Artificial Sequence
  Synthetic Oligonucleotide; REL exon 4; Set C
aauacccaaauuuug

SEQ ID NO: 45964 - RNA, 16 nt, Artificial Sequence
  Synthetic Oligonucleotide; REL exon 4; Set C
gaauacccaaauuuug

SEQ ID NO: 45965 - RNA, 29 nt, Artificial Sequence
  Synthetic Oligonucleotide; REL exon 4; Set C
acacaucgaauacccaaauuuuggaaacu

SEQ ID NO: 45966 - RNA, 15 nt, Artificial Sequence
  Synthetic Oligonucleotide; REL exon 4; Set C
gaauacccaaauuuu

SEQ ID NO: 45967 - RNA, 28 nt, Artificial Sequence
  Synthetic Oligonucleotide; REL exon 4; Set C
acacaucgaauacccaaauuuuggaaac

SEQ ID NO: 45968 - RNA, 27 nt, Artificial Sequence
  Synthetic Oligonucleotide; REL exon 4; Set C
acacaucgaauacccaaauuuuggaaa

SEQ ID NO: 45969 - RNA, 26 nt, Artificial Sequence
  Synthetic Oligonucleotide; REL exon 4; Set C
acacaucgaauacccaaauuuuggaa

SEQ ID NO: 45970 - RNA, 25 nt, Artificial Sequence
  Synthetic Oligonucleotide; REL exon 4; Set C
acacaucgaauacccaaauuuugga

SEQ ID NO: 45971 - RNA, 24 nt, Artificial Sequence
  Synthetic Oligonucleotide; REL exon 4; Set C
acacaucgaauacccaaauuuugg

SEQ ID NO: 45972 - RNA, 23 nt, Artificial Sequence
  Synthetic Oligonucleotide; REL exon 4; Set C
acacaucgaauacccaaauuuug

SEQ ID NO: 45973 - RNA, 22 nt, Artificial Sequence
  Synthetic Oligonucleotide; REL exon 4; Set C
acacaucgaauacccaaauuuu

SEQ ID NO: 45974 - RNA, 21 nt, Artificial Sequence
  Synthetic Oligonucleotide; REL exon 4; Set C
acacaucgaauacccaaauuu

SEQ ID NO: 45975 - RNA, 20 nt, Artificial Sequence
  Synthetic Oligonucleotide; REL exon 4; Set C
acacaucgaauacccaaauu

SEQ ID NO: 45976 - RNA, 37 nt, Artificial Sequence
  Synthetic Oligonucleotide; REL exon 4; Set C
cuagcaggaaaaaaacaauauucaaaacugcauuaua

SEQ ID NO: 45977 - RNA, 38 nt, Artificial Sequence
  Synthetic Oligonucleotide; REL exon 4; Set C
acuagcaggaaaaaaacaauauucaaaacugcauuaua

SEQ ID NO: 45978 - RNA, 39 nt, Artificial Sequence
  Synthetic Oligonucleotide; REL exon 4; Set C
aacuagcaggaaaaaaacaauauucaaaacugcauuaua

SEQ ID NO: 45979 - RNA, 27 nt, Artificial Sequence
  Synthetic Oligonucleotide; REL exon 4; Set C
cuagcaggaaaaaaacaauauucaaaa

SEQ ID NO: 45980 - RNA, 26 nt, Artificial Sequence
  Synthetic Oligonucleotide; REL exon 4; Set C
cuagcaggaaaaaaacaauauucaaa

SEQ ID NO: 45981 - RNA, 28 nt, Artificial Sequence
  Synthetic Oligonucleotide; REL exon 4; Set C
acuagcaggaaaaaaacaauauucaaaa

SEQ ID NO: 45982 - RNA, 27 nt, Artificial Sequence
  Synthetic Oligonucleotide; REL exon 4; Set C
acuagcaggaaaaaaacaauauucaaa

SEQ ID NO: 45983 - RNA, 29 nt, Artificial Sequence
  Synthetic Oligonucleotide; REL exon 4; Set C
aacuagcaggaaaaaaacaauauucaaaa

SEQ ID NO: 45984 - RNA, 28 nt, Artificial Sequence
  Synthetic Oligonucleotide; REL exon 4; Set C
aacuagcaggaaaaaaacaauauucaaa

SEQ ID NO: 45985 - RNA, 30 nt, Artificial Sequence
  Synthetic Oligonucleotide; REL exon 4; Set C
aaacuagcaggaaaaaaacaauauucaaaa

SEQ ID NO: 45986 - RNA, 29 nt, Artificial Sequence
  Synthetic Oligonucleotide; REL exon 4; Set C
aaacuagcaggaaaaaaacaauauucaaa

SEQ ID NO: 45987 - RNA, 31 nt, Artificial Sequence
  Synthetic Oligonucleotide; REL exon 4; Set C
gaaacuagcaggaaaaaaacaauauucaaaa

SEQ ID NO: 45988 - RNA, 30 nt, Artificial Sequence
  Synthetic Oligonucleotide; REL exon 4; Set C
gaaacuagcaggaaaaaaacaauauucaaa

SEQ ID NO: 45989 - RNA, 32 nt, Artificial Sequence
  Synthetic Oligonucleotide; REL exon 4; Set C
ggaaacuagcaggaaaaaaacaauauucaaaa

SEQ ID NO: 45990 - RNA, 31 nt, Artificial Sequence
  Synthetic Oligonucleotide; REL exon 4; Set C
ggaaacuagcaggaaaaaaacaauauucaaa

SEQ ID NO: 45991 - RNA, 33 nt, Artificial Sequence
  Synthetic Oligonucleotide; REL exon 4; Set C
uggaaacuagcaggaaaaaaacaauauucaaaa

SEQ ID NO: 45992 - RNA, 32 nt, Artificial Sequence
  Synthetic Oligonucleotide; REL exon 4; Set C
uggaaacuagcaggaaaaaaacaauauucaaa

SEQ ID NO: 45993 - RNA, 34 nt, Artificial Sequence
  Synthetic Oligonucleotide; REL exon 4; Set C
uuggaaacuagcaggaaaaaaacaauauucaaaa

SEQ ID NO: 45994 - RNA, 33 nt, Artificial Sequence
  Synthetic Oligonucleotide; REL exon 4; Set C
uuggaaacuagcaggaaaaaaacaauauucaaa

SEQ ID NO: 45995 - RNA, 35 nt, Artificial Sequence
  Synthetic Oligonucleotide; REL exon 4; Set C
uuuggaaacuagcaggaaaaaaacaauauucaaaa

SEQ ID NO: 45996 - RNA, 34 nt, Artificial Sequence
  Synthetic Oligonucleotide; REL exon 4; Set C
uuuggaaacuagcaggaaaaaaacaauauucaaa

SEQ ID NO: 45997 - RNA, 36 nt, Artificial Sequence
  Synthetic Oligonucleotide; REL exon 4; Set C
uuuuggaaacuagcaggaaaaaaacaauauucaaaa

SEQ ID NO: 45998 - RNA, 35 nt, Artificial Sequence
  Synthetic Oligonucleotide; REL exon 4; Set C
uuuuggaaacuagcaggaaaaaaacaauauucaaa

SEQ ID NO: 45999 - RNA, 38 nt, Artificial Sequence
  Synthetic Oligonucleotide; REL exon 4; Set C
aauuuuggaaacuagcaggaaaaaaacaauauucaaaa

SEQ ID NO: 46000 - RNA, 37 nt, Artificial Sequence
  Synthetic Oligonucleotide; REL exon 4; Set C
aauuuuggaaacuagcaggaaaaaaacaauauucaaa

SEQ ID NO: 46001 - RNA, 39 nt, Artificial Sequence
  Synthetic Oligonucleotide; REL exon 4; Set C
aaauuuuggaaacuagcaggaaaaaaacaauauucaaaa

SEQ ID NO: 46002 - RNA, 38 nt, Artificial Sequence
  Synthetic Oligonucleotide; REL exon 4; Set C
aaauuuuggaaacuagcaggaaaaaaacaauauucaaa

SEQ ID NO: 46003 - RNA, 39 nt, Artificial Sequence
  Synthetic Oligonucleotide; REL exon 4; Set C
caaauuuuggaaacuagcaggaaaaaaacaauauucaaa

SEQ ID NO: 46004 - RNA, 18 nt, Artificial Sequence
  Synthetic Oligonucleotide; REL exon 4; Set C
gaaacuagcaggaaaaaa

SEQ ID NO: 46005 - RNA, 17 nt, Artificial Sequence
  Synthetic Oligonucleotide; REL exon 4; Set C
gaaacuagcaggaaaaa

SEQ ID NO: 46006 - RNA, 19 nt, Artificial Sequence
  Synthetic Oligonucleotide; REL exon 4; Set C
ggaaacuagcaggaaaaaa

SEQ ID NO: 46007 - RNA, 18 nt, Artificial Sequence
  Synthetic Oligonucleotide; REL exon 4; Set C
ggaaacuagcaggaaaaa

SEQ ID NO: 46008 - RNA, 25 nt, Artificial Sequence
  Synthetic Oligonucleotide; REL exon 4; Set C
aauuuuggaaacuagcaggaaaaaa

SEQ ID NO: 46009 - RNA, 24 nt, Artificial Sequence
  Synthetic Oligonucleotide; REL exon 4; Set C
aauuuuggaaacuagcaggaaaaa

SEQ ID NO: 46010 - RNA, 26 nt, Artificial Sequence
  Synthetic Oligonucleotide; REL exon 4; Set C
aaauuuuggaaacuagcaggaaaaaa

SEQ ID NO: 46011 - RNA, 25 nt, Artificial Sequence
  Synthetic Oligonucleotide; REL exon 4; Set C
aaauuuuggaaacuagcaggaaaaa

SEQ ID NO: 46012 - RNA, 27 nt, Artificial Sequence
  Synthetic Oligonucleotide; REL exon 4; Set C
caaauuuuggaaacuagcaggaaaaaa

SEQ ID NO: 46013 - RNA, 24 nt, Artificial Sequence
  Synthetic Oligonucleotide; REL exon 4; Set C
aaauuuuggaaacuagcaggaaaa

SEQ ID NO: 46014 - RNA, 26 nt, Artificial Sequence
  Synthetic Oligonucleotide; REL exon 4; Set C
caaauuuuggaaacuagcaggaaaaa

SEQ ID NO: 46015 - RNA, 25 nt, Artificial Sequence
  Synthetic Oligonucleotide; REL exon 4; Set C
caaauuuuggaaacuagcaggaaaa

SEQ ID NO: 46016 - RNA, 21 nt, Artificial Sequence
  Synthetic Oligonucleotide; REL exon 4; Set C
auacccaaauuuuggaaacua

SEQ ID NO: 46017 - RNA, 20 nt, Artificial Sequence
  Synthetic Oligonucleotide; REL exon 4; Set C
auacccaaauuuuggaaacu

SEQ ID NO: 46018 - RNA, 19 nt, Artificial Sequence
  Synthetic Oligonucleotide; REL exon 4; Set C
auacccaaauuuuggaaac

SEQ ID NO: 46019 - RNA, 28 nt, Artificial Sequence
  Synthetic Oligonucleotide; REL exon 4; Set C
acaucgaauacccaaauuuuggaaacua

SEQ ID NO: 46020 - RNA, 29 nt, Artificial Sequence
  Synthetic Oligonucleotide; REL exon 4; Set C
cacaucgaauacccaaauuuuggaaacua

SEQ ID NO: 46021 - RNA, 27 nt, Artificial Sequence
  Synthetic Oligonucleotide; REL exon 4; Set C
acaucgaauacccaaauuuuggaaacu

SEQ ID NO: 46022 - RNA, 28 nt, Artificial Sequence
  Synthetic Oligonucleotide; REL exon 4; Set C
cacaucgaauacccaaauuuuggaaacu

SEQ ID NO: 46023 - RNA, 26 nt, Artificial Sequence
  Synthetic Oligonucleotide; REL exon 4; Set C
acaucgaauacccaaauuuuggaaac

SEQ ID NO: 46024 - RNA, 27 nt, Artificial Sequence
  Synthetic Oligonucleotide; REL exon 4; Set C
cacaucgaauacccaaauuuuggaaac

SEQ ID NO: 46025 - RNA, 25 nt, Artificial Sequence
  Synthetic Oligonucleotide; REL exon 4; Set C
acaucgaauacccaaauuuuggaaa

SEQ ID NO: 46026 - RNA, 26 nt, Artificial Sequence
  Synthetic Oligonucleotide; REL exon 4; Set C
cacaucgaauacccaaauuuuggaaa

SEQ ID NO: 46027 - RNA, 18 nt, Artificial Sequence
  Synthetic Oligonucleotide; REL exon 4; Set C
acaucgaauacccaaauu

SEQ ID NO: 46028 - RNA, 19 nt, Artificial Sequence
  Synthetic Oligonucleotide; REL exon 4; Set C
cacaucgaauacccaaauu

SEQ ID NO: 46029 - RNA, 19 nt, Artificial Sequence
  Synthetic Oligonucleotide; REL exon 4; Set C
acacaucgaauacccaaau

SEQ ID NO: 46030 - RNA, 18 nt, Artificial Sequence
  Synthetic Oligonucleotide; REL exon 4; Set C
acacaucgaauacccaaa

SEQ ID NO: 46031 - RNA, 17 nt, Artificial Sequence
  Synthetic Oligonucleotide; REL exon 4; Set C
acacaucgaauacccaa

SEQ ID NO: 46032 - RNA, 27 nt, Artificial Sequence
  Synthetic Oligonucleotide; REL exon 4; Set C
aaaaacaauauucaaaacugcauuaua

SEQ ID NO: 46033 - RNA, 28 nt, Artificial Sequence
  Synthetic Oligonucleotide; REL exon 4; Set C
aaaaaacaauauucaaaacugcauuaua

SEQ ID NO: 46034 - RNA, 16 nt, Artificial Sequence
  Synthetic Oligonucleotide; REL exon 4; Set C
aaaacaauauucaaaa

SEQ ID NO: 46035 - RNA, 15 nt, Artificial Sequence
  Synthetic Oligonucleotide; REL exon 4; Set C
aaaacaauauucaaa

SEQ ID NO: 46036 - RNA, 17 nt, Artificial Sequence
  Synthetic Oligonucleotide; REL exon 4; Set C
aaaaacaauauucaaaa

SEQ ID NO: 46037 - RNA, 16 nt, Artificial Sequence
  Synthetic Oligonucleotide; REL exon 4; Set C
aaaaacaauauucaaa

SEQ ID NO: 46038 - RNA, 18 nt, Artificial Sequence
  Synthetic Oligonucleotide; REL exon 4; Set C
aaaaaacaauauucaaaa

SEQ ID NO: 46039 - RNA, 17 nt, Artificial Sequence
  Synthetic Oligonucleotide; REL exon 4; Set C
aaaaaacaauauucaaa

SEQ ID NO: 46040 - RNA, 40 nt, Artificial Sequence
  Synthetic Oligonucleotide; REL exon 4; Set C
aaacuagcaggaaaaaaacaauauucaaaacugcauuaua

SEQ ID NO: 46041 - RNA, 40 nt, Artificial Sequence
  Synthetic Oligonucleotide; REL exon 4; Set C
caaauuuuggaaacuagcaggaaaaaaacaauauucaaaa

SEQ ID NO: 46042 - RNA, 32 nt, Artificial Sequence
  Synthetic Oligonucleotide; REL exon 4; Set C
auacccaaauuuuggaaacuagcaggaaaaaa

SEQ ID NO: 46043 - RNA, 31 nt, Artificial Sequence
  Synthetic Oligonucleotide; REL exon 4; Set C
auacccaaauuuuggaaacuagcaggaaaaa

SEQ ID NO: 46044 - RNA, 30 nt, Artificial Sequence
  Synthetic Oligonucleotide; REL exon 4; Set C
auacccaaauuuuggaaacuagcaggaaaa

SEQ ID NO: 46045 - RNA, 39 nt, Artificial Sequence
  Synthetic Oligonucleotide; REL exon 4; Set A
acaucgaauacccaaauuuuggaaacuagcaggaaaaaa

SEQ ID NO: 46046 - RNA, 40 nt, Artificial Sequence
  Synthetic Oligonucleotide; REL exon 4; Set A
cacaucgaauacccaaauuuuggaaacuagcaggaaaaaa

SEQ ID NO: 46047 - RNA, 38 nt, Artificial Sequence
  Synthetic Oligonucleotide; REL exon 4; Set A
acaucgaauacccaaauuuuggaaacuagcaggaaaaa

SEQ ID NO: 46048 - RNA, 37 nt, Artificial Sequence
  Synthetic Oligonucleotide; REL exon 4; Set A
acaucgaauacccaaauuuuggaaacuagcaggaaaa

SEQ ID NO: 46049 - RNA, 39 nt, Artificial Sequence
  Synthetic Oligonucleotide; REL exon 4; Set A
cacaucgaauacccaaauuuuggaaacuagcaggaaaaa

SEQ ID NO: 46050 - RNA, 38 nt, Artificial Sequence
  Synthetic Oligonucleotide; REL exon 4; Set A
cacaucgaauacccaaauuuuggaaacuagcaggaaaa

SEQ ID NO: 46051 - RNA, 18 nt, Artificial Sequence
  Synthetic Oligonucleotide; REL exon 4; Set C
auacccaaauuuuggaaa

SEQ ID NO: 46052 - RNA, 17 nt, Artificial Sequence
  Synthetic Oligonucleotide; REL exon 4; Set C
auacccaaauuuuggaa

SEQ ID NO: 46053 - RNA, 16 nt, Artificial Sequence
  Synthetic Oligonucleotide; REL exon 4; Set C
auacccaaauuuugga

SEQ ID NO: 46054 - RNA, 27 nt, Artificial Sequence
  Synthetic Oligonucleotide; REL exon 4; Set C
caucgaauacccaaauuuuggaaacua

SEQ ID NO: 46055 - RNA, 15 nt, Artificial Sequence
  Synthetic Oligonucleotide; REL exon 4; Set C
auacccaaauuuugg

SEQ ID NO: 46056 - RNA, 26 nt, Artificial Sequence
  Synthetic Oligonucleotide; REL exon 4; Set C
caucgaauacccaaauuuuggaaacu

SEQ ID NO: 46057 - RNA, 25 nt, Artificial Sequence
  Synthetic Oligonucleotide; REL exon 4; Set C
caucgaauacccaaauuuuggaaac

SEQ ID NO: 46058 - RNA, 24 nt, Artificial Sequence
  Synthetic Oligonucleotide; REL exon 4; Set C
caucgaauacccaaauuuuggaaa

SEQ ID NO: 46059 - RNA, 24 nt, Artificial Sequence
  Synthetic Oligonucleotide; REL exon 4; Set C
acaucgaauacccaaauuuuggaa

SEQ ID NO: 46060 - RNA, 25 nt, Artificial Sequence
  Synthetic Oligonucleotide; REL exon 4; Set C
cacaucgaauacccaaauuuuggaa

SEQ ID NO: 46061 - RNA, 23 nt, Artificial Sequence
  Synthetic Oligonucleotide; REL exon 4; Set C
acaucgaauacccaaauuuugga

SEQ ID NO: 46062 - RNA, 24 nt, Artificial Sequence
  Synthetic Oligonucleotide; REL exon 4; Set C
cacaucgaauacccaaauuuugga

SEQ ID NO: 46063 - RNA, 22 nt, Artificial Sequence
  Synthetic Oligonucleotide; REL exon 4; Set C
acaucgaauacccaaauuuugg

SEQ ID NO: 46064 - RNA, 23 nt, Artificial Sequence
  Synthetic Oligonucleotide; REL exon 4; Set C
cacaucgaauacccaaauuuugg

SEQ ID NO: 46065 - RNA, 21 nt, Artificial Sequence
  Synthetic Oligonucleotide; REL exon 4; Set C
acaucgaauacccaaauuuug

SEQ ID NO: 46066 - RNA, 20 nt, Artificial Sequence
  Synthetic Oligonucleotide; REL exon 4; Set C
acaucgaauacccaaauuuu

SEQ ID NO: 46067 - RNA, 22 nt, Artificial Sequence
  Synthetic Oligonucleotide; REL exon 4; Set C
cacaucgaauacccaaauuuug

SEQ ID NO: 46068 - RNA, 17 nt, Artificial Sequence
  Synthetic Oligonucleotide; REL exon 4; Set C
caucgaauacccaaauu

SEQ ID NO: 46069 - RNA, 19 nt, Artificial Sequence
  Synthetic Oligonucleotide; REL exon 4; Set C
acaucgaauacccaaauuu

SEQ ID NO: 46070 - RNA, 21 nt, Artificial Sequence
  Synthetic Oligonucleotide; REL exon 4; Set C
cacaucgaauacccaaauuuu

SEQ ID NO: 46071 - RNA, 20 nt, Artificial Sequence
  Synthetic Oligonucleotide; REL exon 4; Set C
cacaucgaauacccaaauuu

SEQ ID NO: 46072 - RNA, 17 nt, Artificial Sequence
  Synthetic Oligonucleotide; REL exon 4; Set C
acaucgaauacccaaau

SEQ ID NO: 46073 - RNA, 18 nt, Artificial Sequence
  Synthetic Oligonucleotide; REL exon 4; Set C
cacaucgaauacccaaau

SEQ ID NO: 46074 - RNA, 38 nt, Artificial Sequence
  Synthetic Oligonucleotide; REL exon 4; Set A
auagcuucuuuuacuucuuuuuucuucacacaucgaau

SEQ ID NO: 46075 - RNA, 37 nt, Artificial Sequence
  Synthetic Oligonucleotide; REL exon 4; Set A
auagcuucuuuuacuucuuuuuucuucacacaucgaa

SEQ ID NO: 46076 - RNA, 39 nt, Artificial Sequence
  Synthetic Oligonucleotide; REL exon 4; Set A
aauagcuucuuuuacuucuuuuuucuucacacaucgaau

SEQ ID NO: 46077 - RNA, 38 nt, Artificial Sequence
  Synthetic Oligonucleotide; REL exon 4; Set A
aauagcuucuuuuacuucuuuuuucuucacacaucgaa

SEQ ID NO: 46078 - RNA, 40 nt, Artificial Sequence
  Synthetic Oligonucleotide; REL exon 4; Set A
uaauagcuucuuuuacuucuuuuuucuucacacaucgaau

SEQ ID NO: 46079 - RNA, 39 nt, Artificial Sequence
  Synthetic Oligonucleotide; REL exon 4; Set A
uaauagcuucuuuuacuucuuuuuucuucacacaucgaa

SEQ ID NO: 46080 - RNA, 40 nt, Artificial Sequence
  Synthetic Oligonucleotide; REL exon 4; Set A
auaauagcuucuuuuacuucuuuuuucuucacacaucgaa

SEQ ID NO: 46081 - RNA, 18 nt, Artificial Sequence
  Synthetic Oligonucleotide; REL exon 4; Set C
aaaugauuuuaucaaaca

SEQ ID NO: 46082 - RNA, 17 nt, Artificial Sequence
  Synthetic Oligonucleotide; REL exon 4; Set C
aaaugauuuuaucaaac

SEQ ID NO: 46083 - RNA, 19 nt, Artificial Sequence
  Synthetic Oligonucleotide; REL exon 4; Set C
gaaaugauuuuaucaaaca

SEQ ID NO: 46084 - RNA, 18 nt, Artificial Sequence
  Synthetic Oligonucleotide; REL exon 4; Set C
gaaaugauuuuaucaaac

SEQ ID NO: 46085 - RNA, 15 nt, Artificial Sequence
  Synthetic Oligonucleotide; BTLA exon 2; Set C
guucuucuggaagua

SEQ ID NO: 46086 - RNA, 16 nt, Artificial Sequence
  Synthetic Oligonucleotide; BTLA exon 2; Set C
uguucuucuggaagua

SEQ ID NO: 46087 - RNA, 15 nt, Artificial Sequence
  Synthetic Oligonucleotide; BTLA exon 2; Set C
uguucuucuggaagu

SEQ ID NO: 46088 - RNA, 17 nt, Artificial Sequence
  Synthetic Oligonucleotide; BTLA exon 2; Set C
auguucuucuggaagua

SEQ ID NO: 46089 - RNA, 16 nt, Artificial Sequence
  Synthetic Oligonucleotide; BTLA exon 2; Set C
auguucuucuggaagu

SEQ ID NO: 46090 - RNA, 18 nt, Artificial Sequence
  Synthetic Oligonucleotide; BTLA exon 2; Set C
uauguucuucuggaagua

SEQ ID NO: 46091 - RNA, 17 nt, Artificial Sequence
  Synthetic Oligonucleotide; BTLA exon 2; Set C
uauguucuucuggaagu

SEQ ID NO: 46092 - RNA, 15 nt, Artificial Sequence
  Synthetic Oligonucleotide; BTLA exon 2; Set C
auguucuucuggaag

SEQ ID NO: 46093 - RNA, 18 nt, Artificial Sequence
  Synthetic Oligonucleotide; BTLA exon 2; Set C
auauguucuucuggaagu

SEQ ID NO: 46094 - RNA, 16 nt, Artificial Sequence
  Synthetic Oligonucleotide; BTLA exon 2; Set C
uauguucuucuggaag

SEQ ID NO: 46095 - RNA, 19 nt, Artificial Sequence
  Synthetic Oligonucleotide; BTLA exon 2; Set C
aauauguucuucuggaagu

SEQ ID NO: 46096 - RNA, 20 nt, Artificial Sequence
  Synthetic Oligonucleotide; BTLA exon 2; Set C
aaauauguucuucuggaagu

SEQ ID NO: 46097 - RNA, 26 nt, Artificial Sequence
  Synthetic Oligonucleotide; BTLA exon 2; Set C
aaaaucaaauauguucuucuggaagu

SEQ ID NO: 46098 - RNA, 27 nt, Artificial Sequence
  Synthetic Oligonucleotide; BTLA exon 2; Set C
uaaaaucaaauauguucuucuggaagu

SEQ ID NO: 46099 - RNA, 32 nt, Artificial Sequence
  Synthetic Oligonucleotide; BTLA exon 2; Set C
aaaacuaaaaucaaauauguucuucuggaagu

SEQ ID NO: 46100 - RNA, 19 nt, Artificial Sequence
  Synthetic Oligonucleotide; BTLA exon 2; Set C
aaaaucaaauauguucuuc

SEQ ID NO: 46101 - RNA, 18 nt, Artificial Sequence
  Synthetic Oligonucleotide; BTLA exon 2; Set C
aaaaucaaauauguucuu

SEQ ID NO: 46102 - RNA, 20 nt, Artificial Sequence
  Synthetic Oligonucleotide; BTLA exon 2; Set C
uaaaaucaaauauguucuuc

SEQ ID NO: 46103 - RNA, 17 nt, Artificial Sequence
  Synthetic Oligonucleotide; BTLA exon 2; Set C
aaaaucaaauauguucu

SEQ ID NO: 46104 - RNA, 19 nt, Artificial Sequence
  Synthetic Oligonucleotide; BTLA exon 2; Set C
uaaaaucaaauauguucuu

SEQ ID NO: 46105 - RNA, 16 nt, Artificial Sequence
  Synthetic Oligonucleotide; BTLA exon 2; Set C
aaaaucaaauauguuc

SEQ ID NO: 46106 - RNA, 18 nt, Artificial Sequence
  Synthetic Oligonucleotide; BTLA exon 2; Set C
uaaaaucaaauauguucu

SEQ ID NO: 46107 - RNA, 15 nt, Artificial Sequence
  Synthetic Oligonucleotide; BTLA exon 2; Set C
aaaaucaaauauguu

SEQ ID NO: 46108 - RNA, 17 nt, Artificial Sequence
  Synthetic Oligonucleotide; BTLA exon 2; Set C
uaaaaucaaauauguuc

SEQ ID NO: 46109 - RNA, 16 nt, Artificial Sequence
  Synthetic Oligonucleotide; BTLA exon 2; Set C
uaaaaucaaauauguu

SEQ ID NO: 46110 - RNA, 38 nt, Artificial Sequence
  Synthetic Oligonucleotide; BTLA exon 2; Set C
aaaaacaaaacuaaaaucaaauauguucuucuggaagu

SEQ ID NO: 46111 - RNA, 39 nt, Artificial Sequence
  Synthetic Oligonucleotide; BTLA exon 2; Set C
uaaaaacaaaacuaaaaucaaauauguucuucuggaagu

SEQ ID NO: 46112 - RNA, 15 nt, Artificial Sequence
  Synthetic Oligonucleotide; BTLA exon 2; Set C
uaaaaucaaauaugu

SEQ ID NO: 46113 - RNA, 25 nt, Artificial Sequence
  Synthetic Oligonucleotide; BTLA exon 2; Set C
aaaacuaaaaucaaauauguucuuc

SEQ ID NO: 46114 - RNA, 24 nt, Artificial Sequence
  Synthetic Oligonucleotide; BTLA exon 2; Set C
aaaacuaaaaucaaauauguucuu

SEQ ID NO: 46115 - RNA, 23 nt, Artificial Sequence
  Synthetic Oligonucleotide; BTLA exon 2; Set C
aaaacuaaaaucaaauauguucu

SEQ ID NO: 46116 - RNA, 22 nt, Artificial Sequence
  Synthetic Oligonucleotide; BTLA exon 2; Set C
aaaacuaaaaucaaauauguuc

SEQ ID NO: 46117 - RNA, 21 nt, Artificial Sequence
  Synthetic Oligonucleotide; BTLA exon 2; Set C
aaaacuaaaaucaaauauguu

SEQ ID NO: 46118 - RNA, 20 nt, Artificial Sequence
  Synthetic Oligonucleotide; BTLA exon 2; Set C
aaaacuaaaaucaaauaugu

SEQ ID NO: 46119 - RNA, 30 nt, Artificial Sequence
  Synthetic Oligonucleotide; BTLA exon 2; Set C
aaaacaaaacuaaaaucaaauauguucuuc

SEQ ID NO: 46120 - RNA, 29 nt, Artificial Sequence
  Synthetic Oligonucleotide; BTLA exon 2; Set C
aaaacaaaacuaaaaucaaauauguucuu

SEQ ID NO: 46121 - RNA, 31 nt, Artificial Sequence
  Synthetic Oligonucleotide; BTLA exon 2; Set C
aaaaacaaaacuaaaaucaaauauguucuuc

SEQ ID NO: 46122 - RNA, 28 nt, Artificial Sequence
  Synthetic Oligonucleotide; BTLA exon 2; Set C
aaaacaaaacuaaaaucaaauauguucu

SEQ ID NO: 46123 - RNA, 30 nt, Artificial Sequence
  Synthetic Oligonucleotide; BTLA exon 2; Set C
aaaaacaaaacuaaaaucaaauauguucuu

SEQ ID NO: 46124 - RNA, 32 nt, Artificial Sequence
  Synthetic Oligonucleotide; BTLA exon 2; Set C
uaaaaacaaaacuaaaaucaaauauguucuuc

SEQ ID NO: 46125 - RNA, 29 nt, Artificial Sequence
  Synthetic Oligonucleotide; BTLA exon 2; Set C
aaaaacaaaacuaaaaucaaauauguucu

SEQ ID NO: 46126 - RNA, 27 nt, Artificial Sequence
  Synthetic Oligonucleotide; BTLA exon 2; Set C
aaaacaaaacuaaaaucaaauauguuc

SEQ ID NO: 46127 - RNA, 31 nt, Artificial Sequence
  Synthetic Oligonucleotide; BTLA exon 2; Set C
uaaaaacaaaacuaaaaucaaauauguucuu

SEQ ID NO: 46128 - RNA, 26 nt, Artificial Sequence
  Synthetic Oligonucleotide; BTLA exon 2; Set C
aaaacaaaacuaaaaucaaauauguu

SEQ ID NO: 46129 - RNA, 30 nt, Artificial Sequence
  Synthetic Oligonucleotide; BTLA exon 2; Set C
uaaaaacaaaacuaaaaucaaauauguucu

SEQ ID NO: 46130 - RNA, 28 nt, Artificial Sequence
  Synthetic Oligonucleotide; BTLA exon 2; Set C
aaaaacaaaacuaaaaucaaauauguuc

SEQ ID NO: 46131 - RNA, 27 nt, Artificial Sequence
  Synthetic Oligonucleotide; BTLA exon 2; Set C
aaaaacaaaacuaaaaucaaauauguu

SEQ ID NO: 46132 - RNA, 29 nt, Artificial Sequence
  Synthetic Oligonucleotide; BTLA exon 2; Set C
uaaaaacaaaacuaaaaucaaauauguuc

SEQ ID NO: 46133 - RNA, 28 nt, Artificial Sequence
  Synthetic Oligonucleotide; BTLA exon 2; Set C
uaaaaacaaaacuaaaaucaaauauguu

SEQ ID NO: 46134 - RNA, 27 nt, Artificial Sequence
  Synthetic Oligonucleotide; BTLA exon 2; Set C
uaaaaacaaaacuaaaaucaaauaugu

SEQ ID NO: 46135 - RNA, 15 nt, Artificial Sequence
  Synthetic Oligonucleotide; BTLA exon 2; Set C
gauugucucuuuaua

SEQ ID NO: 46136 - RNA, 16 nt, Artificial Sequence
  Synthetic Oligonucleotide; BTLA exon 2; Set C
agauugucucuuuaua

SEQ ID NO: 46137 - RNA, 17 nt, Artificial Sequence
  Synthetic Oligonucleotide; BTLA exon 2; Set C
cagauugucucuuuaua

SEQ ID NO: 46138 - RNA, 15 nt, Artificial Sequence
  Synthetic Oligonucleotide; BTLA exon 2; Set C
agauugucucuuuau

SEQ ID NO: 46139 - RNA, 18 nt, Artificial Sequence
  Synthetic Oligonucleotide; BTLA exon 2; Set C
ucagauugucucuuuaua

SEQ ID NO: 46140 - RNA, 16 nt, Artificial Sequence
  Synthetic Oligonucleotide; BTLA exon 2; Set C
cagauugucucuuuau

SEQ ID NO: 46141 - RNA, 15 nt, Artificial Sequence
  Synthetic Oligonucleotide; BTLA exon 2; Set C
cagauugucucuuua

SEQ ID NO: 46142 - RNA, 19 nt, Artificial Sequence
  Synthetic Oligonucleotide; BTLA exon 2; Set C
uucagauugucucuuuaua

SEQ ID NO: 46143 - RNA, 17 nt, Artificial Sequence
  Synthetic Oligonucleotide; BTLA exon 2; Set C
ucagauugucucuuuau

SEQ ID NO: 46144 - RNA, 16 nt, Artificial Sequence
  Synthetic Oligonucleotide; BTLA exon 2; Set C
ucagauugucucuuua

SEQ ID NO: 46145 - RNA, 20 nt, Artificial Sequence
  Synthetic Oligonucleotide; BTLA exon 2; Set C
guucagauugucucuuuaua

SEQ ID NO: 46146 - RNA, 18 nt, Artificial Sequence
  Synthetic Oligonucleotide; BTLA exon 2; Set C
uucagauugucucuuuau

SEQ ID NO: 46147 - RNA, 17 nt, Artificial Sequence
  Synthetic Oligonucleotide; BTLA exon 2; Set C
uucagauugucucuuua

SEQ ID NO: 46148 - RNA, 21 nt, Artificial Sequence
  Synthetic Oligonucleotide; BTLA exon 2; Set C
uguucagauugucucuuuaua

SEQ ID NO: 46149 - RNA, 19 nt, Artificial Sequence
  Synthetic Oligonucleotide; BTLA exon 2; Set C
guucagauugucucuuuau

SEQ ID NO: 46150 - RNA, 15 nt, Artificial Sequence
  Synthetic Oligonucleotide; BTLA exon 2; Set C
ucagauugucucuuu

SEQ ID NO: 46151 - RNA, 18 nt, Artificial Sequence
  Synthetic Oligonucleotide; BTLA exon 2; Set C
guucagauugucucuuua

SEQ ID NO: 46152 - RNA, 20 nt, Artificial Sequence
  Synthetic Oligonucleotide; BTLA exon 2; Set C
uguucagauugucucuuuau

SEQ ID NO: 46153 - RNA, 16 nt, Artificial Sequence
  Synthetic Oligonucleotide; BTLA exon 2; Set C
uucagauugucucuuu

SEQ ID NO: 46154 - RNA, 19 nt, Artificial Sequence
  Synthetic Oligonucleotide; BTLA exon 2; Set C
uguucagauugucucuuua

SEQ ID NO: 46155 - RNA, 17 nt, Artificial Sequence
  Synthetic Oligonucleotide; BTLA exon 2; Set C
guucagauugucucuuu

SEQ ID NO: 46156 - RNA, 18 nt, Artificial Sequence
  Synthetic Oligonucleotide; BTLA exon 2; Set C
uguucagauugucucuuu

SEQ ID NO: 46157 - RNA, 29 nt, Artificial Sequence
  Synthetic Oligonucleotide; BTLA exon 2; Set A
agauggaguguucagauugucucuuuaua

SEQ ID NO: 46158 - RNA, 28 nt, Artificial Sequence
  Synthetic Oligonucleotide; BTLA exon 2; Set A
agauggaguguucagauugucucuuuau

SEQ ID NO: 46159 - RNA, 27 nt, Artificial Sequence
  Synthetic Oligonucleotide; BTLA exon 2; Set A
agauggaguguucagauugucucuuua

SEQ ID NO: 46160 - RNA, 26 nt, Artificial Sequence
  Synthetic Oligonucleotide; BTLA exon 2; Set A
agauggaguguucagauugucucuuu

SEQ ID NO: 46161 - RNA, 33 nt, Artificial Sequence
  Synthetic Oligonucleotide; BTLA exon 2; Set A
gcuaagauggaguguucagauugucucuuuaua

SEQ ID NO: 46162 - RNA, 34 nt, Artificial Sequence
  Synthetic Oligonucleotide; BTLA exon 2; Set A
ugcuaagauggaguguucagauugucucuuuaua

SEQ ID NO: 46163 - RNA, 32 nt, Artificial Sequence
  Synthetic Oligonucleotide; BTLA exon 2; Set A
gcuaagauggaguguucagauugucucuuuau

SEQ ID NO: 46164 - RNA, 31 nt, Artificial Sequence
  Synthetic Oligonucleotide; BTLA exon 2; Set A
gcuaagauggaguguucagauugucucuuua

SEQ ID NO: 46165 - RNA, 33 nt, Artificial Sequence
  Synthetic Oligonucleotide; BTLA exon 2; Set A
ugcuaagauggaguguucagauugucucuuuau

SEQ ID NO: 46166 - RNA, 32 nt, Artificial Sequence
  Synthetic Oligonucleotide; BTLA exon 2; Set A
ugcuaagauggaguguucagauugucucuuua

SEQ ID NO: 46167 - RNA, 30 nt, Artificial Sequence
  Synthetic Oligonucleotide; BTLA exon 2; Set A
gcuaagauggaguguucagauugucucuuu

SEQ ID NO: 46168 - RNA, 31 nt, Artificial Sequence
  Synthetic Oligonucleotide; BTLA exon 2; Set A
ugcuaagauggaguguucagauugucucuuu

SEQ ID NO: 46169 - RNA, 21 nt, Artificial Sequence
  Synthetic Oligonucleotide; BTLA exon 2; Set C
agauggaguguucagauuguc

SEQ ID NO: 46170 - RNA, 40 nt, Artificial Sequence
  Synthetic Oligonucleotide; BTLA exon 2; Set C
gaucuccugcuaagauggaguguucagauugucucuuuau

SEQ ID NO: 46171 - RNA, 26 nt, Artificial Sequence
  Synthetic Oligonucleotide; BTLA exon 2; Set A
ugcuaagauggaguguucagauuguc

SEQ ID NO: 46172 - RNA, 39 nt, Artificial Sequence
  Synthetic Oligonucleotide; BTLA exon 2; Set C
gaucuccugcuaagauggaguguucagauugucucuuua

SEQ ID NO: 46173 - RNA, 38 nt, Artificial Sequence
  Synthetic Oligonucleotide; BTLA exon 2; Set C
gaucuccugcuaagauggaguguucagauugucucuuu

SEQ ID NO: 46174 - RNA, 15 nt, Artificial Sequence
  Synthetic Oligonucleotide; BTLA exon 2; Set C
gaucuccugcuaaga

SEQ ID NO: 46175 - RNA, 24 nt, Artificial Sequence
  Synthetic Oligonucleotide; BTLA exon 2; Set A
guucaaagggaucuccugcuaaga

SEQ ID NO: 46176 - RNA, 24 nt, Artificial Sequence
  Synthetic Oligonucleotide; BTLA exon 2; Set A
caugaggccuguuagcacaguauu

SEQ ID NO: 46177 - RNA, 31 nt, Artificial Sequence
  Synthetic Oligonucleotide; BTLA exon 2; Set C
guuguuccauugagcuugcaccaagucacau

SEQ ID NO: 46178 - RNA, 39 nt, Artificial Sequence
  Synthetic Oligonucleotide; BTLA exon 2; Set C
uuacacauguuguuccauugagcuugcaccaagucacau

SEQ ID NO: 46179 - RNA, 40 nt, Artificial Sequence
  Synthetic Oligonucleotide; BTLA exon 2; Set C
uuuacacauguuguuccauugagcuugcaccaagucacau

SEQ ID NO: 46180 - RNA, 19 nt, Artificial Sequence
  Synthetic Oligonucleotide; BTLA exon 2; Set C
caacuuguuugucuaucuu

SEQ ID NO: 46181 - RNA, 18 nt, Artificial Sequence
  Synthetic Oligonucleotide; BTLA exon 2; Set C
caacuuguuugucuaucu

SEQ ID NO: 46182 - RNA, 17 nt, Artificial Sequence
  Synthetic Oligonucleotide; BTLA exon 2; Set C
caacuuguuugucuauc

SEQ ID NO: 46183 - RNA, 16 nt, Artificial Sequence
  Synthetic Oligonucleotide; BTLA exon 2; Set C
caacuuguuugucuau

SEQ ID NO: 46184 - RNA, 15 nt, Artificial Sequence
  Synthetic Oligonucleotide; BTLA exon 2; Set C
caacuuguuugucua

SEQ ID NO: 46185 - RNA, 15 nt, Artificial Sequence
  Synthetic Oligonucleotide; BTLA exon 2; Set C
auuaggaagcacugg

SEQ ID NO: 46186 - RNA, 15 nt, Artificial Sequence
  Synthetic Oligonucleotide; BTLA exon 2; Set C
gcagaacagcgguau

SEQ ID NO: 46187 - RNA, 16 nt, Artificial Sequence
  Synthetic Oligonucleotide; BTLA exon 2; Set C
ugcagaacagcgguau

SEQ ID NO: 46188 - RNA, 15 nt, Artificial Sequence
  Synthetic Oligonucleotide; BTLA exon 2; Set C
ugcagaacagcggua

SEQ ID NO: 46189 - RNA, 17 nt, Artificial Sequence
  Synthetic Oligonucleotide; BTLA exon 2; Set C
uugcagaacagcgguau

SEQ ID NO: 46190 - RNA, 16 nt, Artificial Sequence
  Synthetic Oligonucleotide; BTLA exon 2; Set C
uugcagaacagcggua

SEQ ID NO: 46191 - RNA, 18 nt, Artificial Sequence
  Synthetic Oligonucleotide; BTLA exon 2; Set C
uuugcagaacagcgguau

SEQ ID NO: 46192 - RNA, 17 nt, Artificial Sequence
  Synthetic Oligonucleotide; BTLA exon 2; Set C
uuugcagaacagcggua

SEQ ID NO: 46193 - RNA, 15 nt, Artificial Sequence
  Synthetic Oligonucleotide; BTLA exon 2; Set C
uugcagaacagcggu

SEQ ID NO: 46194 - RNA, 19 nt, Artificial Sequence
  Synthetic Oligonucleotide; BTLA exon 2; Set C
auuugcagaacagcgguau

SEQ ID NO: 46195 - RNA, 16 nt, Artificial Sequence
  Synthetic Oligonucleotide; BTLA exon 2; Set C
uuugcagaacagcggu

SEQ ID NO: 46196 - RNA, 18 nt, Artificial Sequence
  Synthetic Oligonucleotide; BTLA exon 2; Set C
auuugcagaacagcggua

SEQ ID NO: 46197 - RNA, 20 nt, Artificial Sequence
  Synthetic Oligonucleotide; BTLA exon 2; Set C
aauuugcagaacagcgguau

SEQ ID NO: 46198 - RNA, 17 nt, Artificial Sequence
  Synthetic Oligonucleotide; BTLA exon 2; Set C
auuugcagaacagcggu

SEQ ID NO: 46199 - RNA, 19 nt, Artificial Sequence
  Synthetic Oligonucleotide; BTLA exon 2; Set C
aauuugcagaacagcggua

SEQ ID NO: 46200 - RNA, 21 nt, Artificial Sequence
  Synthetic Oligonucleotide; BTLA exon 2; Set C
aaauuugcagaacagcgguau

SEQ ID NO: 46201 - RNA, 20 nt, Artificial Sequence
  Synthetic Oligonucleotide; BTLA exon 2; Set C
aaauuugcagaacagcggua

SEQ ID NO: 46202 - RNA, 18 nt, Artificial Sequence
  Synthetic Oligonucleotide; BTLA exon 2; Set C
aauuugcagaacagcggu

SEQ ID NO: 46203 - RNA, 22 nt, Artificial Sequence
  Synthetic Oligonucleotide; BTLA exon 2; Set C
aaaauuugcagaacagcgguau

SEQ ID NO: 46204 - RNA, 21 nt, Artificial Sequence
  Synthetic Oligonucleotide; BTLA exon 2; Set C
aaaauuugcagaacagcggua

SEQ ID NO: 46205 - RNA, 19 nt, Artificial Sequence
  Synthetic Oligonucleotide; BTLA exon 2; Set C
aaauuugcagaacagcggu

SEQ ID NO: 46206 - RNA, 20 nt, Artificial Sequence
  Synthetic Oligonucleotide; BTLA exon 2; Set C
aaaauuugcagaacagcggu

SEQ ID NO: 46207 - RNA, 29 nt, Artificial Sequence
  Synthetic Oligonucleotide; BTLA exon 2; Set B
uagacugaaaauuugcagaacagcgguau

SEQ ID NO: 46208 - RNA, 28 nt, Artificial Sequence
  Synthetic Oligonucleotide; BTLA exon 2; Set B
uagacugaaaauuugcagaacagcggua

SEQ ID NO: 46209 - RNA, 30 nt, Artificial Sequence
  Synthetic Oligonucleotide; BTLA exon 2; Set B
uuagacugaaaauuugcagaacagcgguau

SEQ ID NO: 46210 - RNA, 29 nt, Artificial Sequence
  Synthetic Oligonucleotide; BTLA exon 2; Set B
uuagacugaaaauuugcagaacagcggua

SEQ ID NO: 46211 - RNA, 27 nt, Artificial Sequence
  Synthetic Oligonucleotide; BTLA exon 2; Set B
uagacugaaaauuugcagaacagcggu

SEQ ID NO: 46212 - RNA, 31 nt, Artificial Sequence
  Synthetic Oligonucleotide; BTLA exon 2; Set B
auuagacugaaaauuugcagaacagcgguau

SEQ ID NO: 46213 - RNA, 30 nt, Artificial Sequence
  Synthetic Oligonucleotide; BTLA exon 2; Set B
auuagacugaaaauuugcagaacagcggua

SEQ ID NO: 46214 - RNA, 28 nt, Artificial Sequence
  Synthetic Oligonucleotide; BTLA exon 2; Set B
uuagacugaaaauuugcagaacagcggu

SEQ ID NO: 46215 - RNA, 29 nt, Artificial Sequence
  Synthetic Oligonucleotide; BTLA exon 2; Set B
auuagacugaaaauuugcagaacagcggu

SEQ ID NO: 46216 - RNA, 20 nt, Artificial Sequence
  Synthetic Oligonucleotide; BTLA exon 2; Set C
uagacugaaaauuugcagaa

SEQ ID NO: 46217 - RNA, 21 nt, Artificial Sequence
  Synthetic Oligonucleotide; BTLA exon 2; Set C
uuagacugaaaauuugcagaa

SEQ ID NO: 46218 - RNA, 19 nt, Artificial Sequence
  Synthetic Oligonucleotide; BTLA exon 2; Set C
uagacugaaaauuugcaga

SEQ ID NO: 46219 - RNA, 22 nt, Artificial Sequence
  Synthetic Oligonucleotide; BTLA exon 2; Set C
auuagacugaaaauuugcagaa

SEQ ID NO: 46220 - RNA, 20 nt, Artificial Sequence
  Synthetic Oligonucleotide; BTLA exon 2; Set C
uuagacugaaaauuugcaga

SEQ ID NO: 46221 - RNA, 18 nt, Artificial Sequence
  Synthetic Oligonucleotide; BTLA exon 2; Set C
uagacugaaaauuugcag

SEQ ID NO: 46222 - RNA, 23 nt, Artificial Sequence
  Synthetic Oligonucleotide; BTLA exon 2; Set C
gauuagacugaaaauuugcagaa

SEQ ID NO: 46223 - RNA, 21 nt, Artificial Sequence
  Synthetic Oligonucleotide; BTLA exon 2; Set C
auuagacugaaaauuugcaga

SEQ ID NO: 46224 - RNA, 19 nt, Artificial Sequence
  Synthetic Oligonucleotide; BTLA exon 2; Set C
uuagacugaaaauuugcag

SEQ ID NO: 46225 - RNA, 17 nt, Artificial Sequence
  Synthetic Oligonucleotide; BTLA exon 2; Set C
uagacugaaaauuugca

SEQ ID NO: 46226 - RNA, 24 nt, Artificial Sequence
  Synthetic Oligonucleotide; BTLA exon 2; Set C
agauuagacugaaaauuugcagaa

SEQ ID NO: 46227 - RNA, 22 nt, Artificial Sequence
  Synthetic Oligonucleotide; BTLA exon 2; Set C
gauuagacugaaaauuugcaga

SEQ ID NO: 46228 - RNA, 20 nt, Artificial Sequence
  Synthetic Oligonucleotide; BTLA exon 2; Set C
auuagacugaaaauuugcag

SEQ ID NO: 46229 - RNA, 18 nt, Artificial Sequence
  Synthetic Oligonucleotide; BTLA exon 2; Set C
uuagacugaaaauuugca

SEQ ID NO: 46230 - RNA, 16 nt, Artificial Sequence
  Synthetic Oligonucleotide; BTLA exon 2; Set C
uagacugaaaauuugc

SEQ ID NO: 46231 - RNA, 25 nt, Artificial Sequence
  Synthetic Oligonucleotide; BTLA exon 2; Set C
gagauuagacugaaaauuugcagaa

SEQ ID NO: 46232 - RNA, 23 nt, Artificial Sequence
  Synthetic Oligonucleotide; BTLA exon 2; Set C
agauuagacugaaaauuugcaga

SEQ ID NO: 46233 - RNA, 15 nt, Artificial Sequence
  Synthetic Oligonucleotide; BTLA exon 2; Set C
uagacugaaaauuug

SEQ ID NO: 46234 - RNA, 19 nt, Artificial Sequence
  Synthetic Oligonucleotide; BTLA exon 2; Set C
auuagacugaaaauuugca

SEQ ID NO: 46235 - RNA, 17 nt, Artificial Sequence
  Synthetic Oligonucleotide; BTLA exon 2; Set C
uuagacugaaaauuugc

SEQ ID NO: 46236 - RNA, 24 nt, Artificial Sequence
  Synthetic Oligonucleotide; BTLA exon 2; Set C
gagauuagacugaaaauuugcaga

SEQ ID NO: 46237 - RNA, 16 nt, Artificial Sequence
  Synthetic Oligonucleotide; BTLA exon 2; Set C
uuagacugaaaauuug

SEQ ID NO: 46238 - RNA, 18 nt, Artificial Sequence
  Synthetic Oligonucleotide; BTLA exon 2; Set C
auuagacugaaaauuugc

SEQ ID NO: 46239 - RNA, 15 nt, Artificial Sequence
  Synthetic Oligonucleotide; BTLA exon 2; Set C
uuagacugaaaauuu

SEQ ID NO: 46240 - RNA, 17 nt, Artificial Sequence
  Synthetic Oligonucleotide; BTLA exon 2; Set C
auuagacugaaaauuug

SEQ ID NO: 46241 - RNA, 16 nt, Artificial Sequence
  Synthetic Oligonucleotide; BTLA exon 2; Set C
auuagacugaaaauuu

SEQ ID NO: 46242 - RNA, 17 nt, Artificial Sequence
  Synthetic Oligonucleotide; BTLA exon 2; Set C
gauuagacugaaaauuu

SEQ ID NO: 46243 - RNA, 15 nt, Artificial Sequence
  Synthetic Oligonucleotide; BTLA exon 2; Set C
auuagacugaaaauu

SEQ ID NO: 46244 - RNA, 19 nt, Artificial Sequence
  Synthetic Oligonucleotide; BTLA exon 2; Set C
gagauuagacugaaaauuu

SEQ ID NO: 46245 - RNA, 18 nt, Artificial Sequence
  Synthetic Oligonucleotide; BTLA exon 2; Set C
gucacauaaagaguuguu

SEQ ID NO: 46246 - RNA, 19 nt, Artificial Sequence
  Synthetic Oligonucleotide; BTLA exon 2; Set C
ugucacauaaagaguuguu

SEQ ID NO: 46247 - RNA, 17 nt, Artificial Sequence
  Synthetic Oligonucleotide; BTLA exon 2; Set C
gucacauaaagaguugu

SEQ ID NO: 46248 - RNA, 18 nt, Artificial Sequence
  Synthetic Oligonucleotide; BTLA exon 2; Set C
ugucacauaaagaguugu

SEQ ID NO: 46249 - RNA, 16 nt, Artificial Sequence
  Synthetic Oligonucleotide; BTLA exon 2; Set C
gucacauaaagaguug

SEQ ID NO: 46250 - RNA, 15 nt, Artificial Sequence
  Synthetic Oligonucleotide; BTLA exon 2; Set C
gucacauaaagaguu

SEQ ID NO: 46251 - RNA, 17 nt, Artificial Sequence
  Synthetic Oligonucleotide; BTLA exon 2; Set C
ugucacauaaagaguug

SEQ ID NO: 46252 - RNA, 16 nt, Artificial Sequence
  Synthetic Oligonucleotide; BTLA exon 2; Set C
ugucacauaaagaguu

SEQ ID NO: 46253 - RNA, 15 nt, Artificial Sequence
  Synthetic Oligonucleotide; BTLA exon 2; Set C
ugucacauaaagagu

SEQ ID NO: 46254 - RNA, 19 nt, Artificial Sequence
  Synthetic Oligonucleotide; BTLA exon 2; Set C
auauguucuucuggaagua

SEQ ID NO: 46255 - RNA, 20 nt, Artificial Sequence
  Synthetic Oligonucleotide; BTLA exon 2; Set C
aauauguucuucuggaagua

SEQ ID NO: 46256 - RNA, 17 nt, Artificial Sequence
  Synthetic Oligonucleotide; BTLA exon 2; Set C
auauguucuucuggaag

SEQ ID NO: 46257 - RNA, 21 nt, Artificial Sequence
  Synthetic Oligonucleotide; BTLA exon 2; Set C
aaauauguucuucuggaagua

SEQ ID NO: 46258 - RNA, 18 nt, Artificial Sequence
  Synthetic Oligonucleotide; BTLA exon 2; Set C
aauauguucuucuggaag

SEQ ID NO: 46259 - RNA, 19 nt, Artificial Sequence
  Synthetic Oligonucleotide; BTLA exon 2; Set C
aaauauguucuucuggaag

SEQ ID NO: 46260 - RNA, 27 nt, Artificial Sequence
  Synthetic Oligonucleotide; BTLA exon 2; Set C
aaaaucaaauauguucuucuggaagua

SEQ ID NO: 46261 - RNA, 28 nt, Artificial Sequence
  Synthetic Oligonucleotide; BTLA exon 2; Set C
uaaaaucaaauauguucuucuggaagua

SEQ ID NO: 46262 - RNA, 25 nt, Artificial Sequence
  Synthetic Oligonucleotide; BTLA exon 2; Set C
aaaaucaaauauguucuucuggaag

SEQ ID NO: 46263 - RNA, 26 nt, Artificial Sequence
  Synthetic Oligonucleotide; BTLA exon 2; Set C
uaaaaucaaauauguucuucuggaag

SEQ ID NO: 46264 - RNA, 33 nt, Artificial Sequence
  Synthetic Oligonucleotide; BTLA exon 2; Set C
aaaacuaaaaucaaauauguucuucuggaagua

SEQ ID NO: 46265 - RNA, 20 nt, Artificial Sequence
  Synthetic Oligonucleotide; BTLA exon 2; Set C
aaaaucaaauauguucuucu

SEQ ID NO: 46266 - RNA, 31 nt, Artificial Sequence
  Synthetic Oligonucleotide; BTLA exon 2; Set C
aaaacuaaaaucaaauauguucuucuggaag

SEQ ID NO: 46267 - RNA, 21 nt, Artificial Sequence
  Synthetic Oligonucleotide; BTLA exon 2; Set C
uaaaaucaaauauguucuucu

SEQ ID NO: 46268 - RNA, 38 nt, Artificial Sequence
  Synthetic Oligonucleotide; BTLA exon 2; Set C
aaaacaaaacuaaaaucaaauauguucuucuggaagua

SEQ ID NO: 46269 - RNA, 37 nt, Artificial Sequence
  Synthetic Oligonucleotide; BTLA exon 2; Set C
aaaacaaaacuaaaaucaaauauguucuucuggaagu

SEQ ID NO: 46270 - RNA, 39 nt, Artificial Sequence
  Synthetic Oligonucleotide; BTLA exon 2; Set C
aaaaacaaaacuaaaaucaaauauguucuucuggaagua

SEQ ID NO: 46271 - RNA, 36 nt, Artificial Sequence
  Synthetic Oligonucleotide; BTLA exon 2; Set C
aaaacaaaacuaaaaucaaauauguucuucuggaag

SEQ ID NO: 46272 - RNA, 40 nt, Artificial Sequence
  Synthetic Oligonucleotide; BTLA exon 2; Set C
uaaaaacaaaacuaaaaucaaauauguucuucuggaagua

SEQ ID NO: 46273 - RNA, 26 nt, Artificial Sequence
  Synthetic Oligonucleotide; BTLA exon 2; Set C
aaaacuaaaaucaaauauguucuucu

SEQ ID NO: 46274 - RNA, 37 nt, Artificial Sequence
  Synthetic Oligonucleotide; BTLA exon 2; Set C
aaaaacaaaacuaaaaucaaauauguucuucuggaag

SEQ ID NO: 46275 - RNA, 40 nt, Artificial Sequence
  Synthetic Oligonucleotide; BTLA exon 2; Set C
auaaaaacaaaacuaaaaucaaauauguucuucuggaagu

SEQ ID NO: 46276 - RNA, 38 nt, Artificial Sequence
  Synthetic Oligonucleotide; BTLA exon 2; Set C
uaaaaacaaaacuaaaaucaaauauguucuucuggaag

SEQ ID NO: 46277 - RNA, 40 nt, Artificial Sequence
  Synthetic Oligonucleotide; BTLA exon 2; Set C
gauaaaaacaaaacuaaaaucaaauauguucuucuggaag

SEQ ID NO: 46278 - RNA, 31 nt, Artificial Sequence
  Synthetic Oligonucleotide; BTLA exon 2; Set C
aaaacaaaacuaaaaucaaauauguucuucu

SEQ ID NO: 46279 - RNA, 32 nt, Artificial Sequence
  Synthetic Oligonucleotide; BTLA exon 2; Set C
aaaaacaaaacuaaaaucaaauauguucuucu

SEQ ID NO: 46280 - RNA, 19 nt, Artificial Sequence
  Synthetic Oligonucleotide; BTLA exon 2; Set C
aaaacuaaaaucaaauaug

SEQ ID NO: 46281 - RNA, 33 nt, Artificial Sequence
  Synthetic Oligonucleotide; BTLA exon 2; Set C
uaaaaacaaaacuaaaaucaaauauguucuucu

SEQ ID NO: 46282 - RNA, 18 nt, Artificial Sequence
  Synthetic Oligonucleotide; BTLA exon 2; Set C
aaaacuaaaaucaaauau

SEQ ID NO: 46283 - RNA, 33 nt, Artificial Sequence
  Synthetic Oligonucleotide; BTLA exon 2; Set C
auaaaaacaaaacuaaaaucaaauauguucuuc

SEQ ID NO: 46284 - RNA, 17 nt, Artificial Sequence
  Synthetic Oligonucleotide; BTLA exon 2; Set C
aaaacuaaaaucaaaua

SEQ ID NO: 46285 - RNA, 32 nt, Artificial Sequence
  Synthetic Oligonucleotide; BTLA exon 2; Set C
auaaaaacaaaacuaaaaucaaauauguucuu

SEQ ID NO: 46286 - RNA, 34 nt, Artificial Sequence
  Synthetic Oligonucleotide; BTLA exon 2; Set C
gauaaaaacaaaacuaaaaucaaauauguucuuc

SEQ ID NO: 46287 - RNA, 16 nt, Artificial Sequence
  Synthetic Oligonucleotide; BTLA exon 2; Set C
aaaacuaaaaucaaau

SEQ ID NO: 46288 - RNA, 31 nt, Artificial Sequence
  Synthetic Oligonucleotide; BTLA exon 2; Set C
auaaaaacaaaacuaaaaucaaauauguucu

SEQ ID NO: 46289 - RNA, 25 nt, Artificial Sequence
  Synthetic Oligonucleotide; BTLA exon 2; Set C
aaaacaaaacuaaaaucaaauaugu

SEQ ID NO: 46290 - RNA, 33 nt, Artificial Sequence
  Synthetic Oligonucleotide; BTLA exon 2; Set C
gauaaaaacaaaacuaaaaucaaauauguucuu

SEQ ID NO: 46291 - RNA, 15 nt, Artificial Sequence
  Synthetic Oligonucleotide; BTLA exon 2; Set C
aaaacuaaaaucaaa

SEQ ID NO: 46292 - RNA, 32 nt, Artificial Sequence
  Synthetic Oligonucleotide; BTLA exon 2; Set C
gauaaaaacaaaacuaaaaucaaauauguucu

SEQ ID NO: 46293 - RNA, 30 nt, Artificial Sequence
  Synthetic Oligonucleotide; BTLA exon 2; Set C
auaaaaacaaaacuaaaaucaaauauguuc

SEQ ID NO: 46294 - RNA, 26 nt, Artificial Sequence
  Synthetic Oligonucleotide; BTLA exon 2; Set C
aaaaacaaaacuaaaaucaaauaugu

SEQ ID NO: 46295 - RNA, 24 nt, Artificial Sequence
  Synthetic Oligonucleotide; BTLA exon 2; Set C
aaaacaaaacuaaaaucaaauaug

SEQ ID NO: 46296 - RNA, 29 nt, Artificial Sequence
  Synthetic Oligonucleotide; BTLA exon 2; Set C
auaaaaacaaaacuaaaaucaaauauguu

SEQ ID NO: 46297 - RNA, 31 nt, Artificial Sequence
  Synthetic Oligonucleotide; BTLA exon 2; Set C
gauaaaaacaaaacuaaaaucaaauauguuc

SEQ ID NO: 46298 - RNA, 25 nt, Artificial Sequence
  Synthetic Oligonucleotide; BTLA exon 2; Set C
aaaaacaaaacuaaaaucaaauaug

SEQ ID NO: 46299 - RNA, 23 nt, Artificial Sequence
  Synthetic Oligonucleotide; BTLA exon 2; Set C
aaaacaaaacuaaaaucaaauau

SEQ ID NO: 46300 - RNA, 30 nt, Artificial Sequence
  Synthetic Oligonucleotide; BTLA exon 2; Set C
gauaaaaacaaaacuaaaaucaaauauguu

SEQ ID NO: 46301 - RNA, 26 nt, Artificial Sequence
  Synthetic Oligonucleotide; BTLA exon 2; Set C
uaaaaacaaaacuaaaaucaaauaug

SEQ ID NO: 46302 - RNA, 24 nt, Artificial Sequence
  Synthetic Oligonucleotide; BTLA exon 2; Set C
aaaaacaaaacuaaaaucaaauau

SEQ ID NO: 46303 - RNA, 22 nt, Artificial Sequence
  Synthetic Oligonucleotide; BTLA exon 2; Set C
aaaacaaaacuaaaaucaaaua

SEQ ID NO: 46304 - RNA, 29 nt, Artificial Sequence
  Synthetic Oligonucleotide; BTLA exon 2; Set C
gauaaaaacaaaacuaaaaucaaauaugu

SEQ ID NO: 46305 - RNA, 25 nt, Artificial Sequence
  Synthetic Oligonucleotide; BTLA exon 2; Set C
uaaaaacaaaacuaaaaucaaauau

SEQ ID NO: 46306 - RNA, 21 nt, Artificial Sequence
  Synthetic Oligonucleotide; BTLA exon 2; Set C
aaaacaaaacuaaaaucaaau

SEQ ID NO: 46307 - RNA, 23 nt, Artificial Sequence
  Synthetic Oligonucleotide; BTLA exon 2; Set C
aaaaacaaaacuaaaaucaaaua

SEQ ID NO: 46308 - RNA, 28 nt, Artificial Sequence
  Synthetic Oligonucleotide; BTLA exon 2; Set C
gauaaaaacaaaacuaaaaucaaauaug

SEQ ID NO: 46309 - RNA, 22 nt, Artificial Sequence
  Synthetic Oligonucleotide; BTLA exon 2; Set C
aaaaacaaaacuaaaaucaaau

SEQ ID NO: 46310 - RNA, 24 nt, Artificial Sequence
  Synthetic Oligonucleotide; BTLA exon 2; Set C
uaaaaacaaaacuaaaaucaaaua

SEQ ID NO: 46311 - RNA, 20 nt, Artificial Sequence
  Synthetic Oligonucleotide; BTLA exon 2; Set C
aaaacaaaacuaaaaucaaa

SEQ ID NO: 46312 - RNA, 23 nt, Artificial Sequence
  Synthetic Oligonucleotide; BTLA exon 2; Set C
uaaaaacaaaacuaaaaucaaau

SEQ ID NO: 46313 - RNA, 21 nt, Artificial Sequence
  Synthetic Oligonucleotide; BTLA exon 2; Set C
aaaaacaaaacuaaaaucaaa

SEQ ID NO: 46314 - RNA, 40 nt, Artificial Sequence
  Synthetic Oligonucleotide; BTLA exon 2; Set C
ccuaaaagauaaaaacaaaacuaaaaucaaauauguucuu

SEQ ID NO: 46315 - RNA, 22 nt, Artificial Sequence
  Synthetic Oligonucleotide; BTLA exon 2; Set C
uaaaaacaaaacuaaaaucaaa

SEQ ID NO: 46316 - RNA, 39 nt, Artificial Sequence
  Synthetic Oligonucleotide; BTLA exon 2; Set C
ccuaaaagauaaaaacaaaacuaaaaucaaauauguucu

SEQ ID NO: 46317 - RNA, 38 nt, Artificial Sequence
  Synthetic Oligonucleotide; BTLA exon 2; Set C
ccuaaaagauaaaaacaaaacuaaaaucaaauauguuc

SEQ ID NO: 46318 - RNA, 37 nt, Artificial Sequence
  Synthetic Oligonucleotide; BTLA exon 2; Set C
ccuaaaagauaaaaacaaaacuaaaaucaaauauguu

SEQ ID NO: 46319 - RNA, 36 nt, Artificial Sequence
  Synthetic Oligonucleotide; BTLA exon 2; Set C
ccuaaaagauaaaaacaaaacuaaaaucaaauaugu

SEQ ID NO: 46320 - RNA, 35 nt, Artificial Sequence
  Synthetic Oligonucleotide; BTLA exon 2; Set C
ccuaaaagauaaaaacaaaacuaaaaucaaauaug

SEQ ID NO: 46321 - RNA, 15 nt, Artificial Sequence
  Synthetic Oligonucleotide; BTLA exon 2; Set C
aaaaacaaaacuaaa

SEQ ID NO: 46322 - RNA, 16 nt, Artificial Sequence
  Synthetic Oligonucleotide; BTLA exon 2; Set C
uaaaaacaaaacuaaa

SEQ ID NO: 46323 - RNA, 34 nt, Artificial Sequence
  Synthetic Oligonucleotide; BTLA exon 2; Set C
ccuaaaagauaaaaacaaaacuaaaaucaaauau

SEQ ID NO: 46324 - RNA, 15 nt, Artificial Sequence
  Synthetic Oligonucleotide; BTLA exon 2; Set C
uaaaaacaaaacuaa

SEQ ID NO: 46325 - RNA, 33 nt, Artificial Sequence
  Synthetic Oligonucleotide; BTLA exon 2; Set C
ccuaaaagauaaaaacaaaacuaaaaucaaaua

SEQ ID NO: 46326 - RNA, 32 nt, Artificial Sequence
  Synthetic Oligonucleotide; BTLA exon 2; Set C
ccuaaaagauaaaaacaaaacuaaaaucaaau

SEQ ID NO: 46327 - RNA, 31 nt, Artificial Sequence
  Synthetic Oligonucleotide; BTLA exon 2; Set C
ccuaaaagauaaaaacaaaacuaaaaucaaa

SEQ ID NO: 46328 - RNA, 25 nt, Artificial Sequence
  Synthetic Oligonucleotide; BTLA exon 2; Set C
ccuaaaagauaaaaacaaaacuaaa

SEQ ID NO: 46329 - RNA, 24 nt, Artificial Sequence
  Synthetic Oligonucleotide; BTLA exon 2; Set C
ccuaaaagauaaaaacaaaacuaa

SEQ ID NO: 46330 - RNA, 40 nt, Artificial Sequence
  Synthetic Oligonucleotide; BTLA exon 2; Set C
auucuuucccuaaaagauaaaaacaaaacuaaaaucaaau

SEQ ID NO: 46331 - RNA, 39 nt, Artificial Sequence
  Synthetic Oligonucleotide; BTLA exon 2; Set C
auucuuucccuaaaagauaaaaacaaaacuaaaaucaaa

SEQ ID NO: 46332 - RNA, 40 nt, Artificial Sequence
  Synthetic Oligonucleotide; BTLA exon 2; Set C
gauucuuucccuaaaagauaaaaacaaaacuaaaaucaaa

SEQ ID NO: 46333 - RNA, 19 nt, Artificial Sequence
  Synthetic Oligonucleotide; BTLA exon 2; Set C
ccuaaaagauaaaaacaaa

SEQ ID NO: 46334 - RNA, 33 nt, Artificial Sequence
  Synthetic Oligonucleotide; BTLA exon 2; Set C
auucuuucccuaaaagauaaaaacaaaacuaaa

SEQ ID NO: 46335 - RNA, 34 nt, Artificial Sequence
  Synthetic Oligonucleotide; BTLA exon 2; Set C
gauucuuucccuaaaagauaaaaacaaaacuaaa

SEQ ID NO: 46336 - RNA, 32 nt, Artificial Sequence
  Synthetic Oligonucleotide; BTLA exon 2; Set C
auucuuucccuaaaagauaaaaacaaaacuaa

SEQ ID NO: 46337 - RNA, 33 nt, Artificial Sequence
  Synthetic Oligonucleotide; BTLA exon 2; Set C
gauucuuucccuaaaagauaaaaacaaaacuaa

SEQ ID NO: 46338 - RNA, 27 nt, Artificial Sequence
  Synthetic Oligonucleotide; BTLA exon 2; Set C
auucuuucccuaaaagauaaaaacaaa

SEQ ID NO: 46339 - RNA, 28 nt, Artificial Sequence
  Synthetic Oligonucleotide; BTLA exon 2; Set C
gauucuuucccuaaaagauaaaaacaaa

SEQ ID NO: 46340 - RNA, 22 nt, Artificial Sequence
  Synthetic Oligonucleotide; BTLA exon 2; Set C
auucuuucccuaaaagauaaaa

SEQ ID NO: 46341 - RNA, 23 nt, Artificial Sequence
  Synthetic Oligonucleotide; BTLA exon 2; Set C
gauucuuucccuaaaagauaaaa

SEQ ID NO: 46342 - RNA, 21 nt, Artificial Sequence
  Synthetic Oligonucleotide; BTLA exon 2; Set C
auucuuucccuaaaagauaaa

SEQ ID NO: 46343 - RNA, 22 nt, Artificial Sequence
  Synthetic Oligonucleotide; BTLA exon 2; Set C
gauucuuucccuaaaagauaaa

SEQ ID NO: 46344 - RNA, 20 nt, Artificial Sequence
  Synthetic Oligonucleotide; BTLA exon 2; Set C
auucuuucccuaaaagauaa

SEQ ID NO: 46345 - RNA, 21 nt, Artificial Sequence
  Synthetic Oligonucleotide; BTLA exon 2; Set C
gauucuuucccuaaaagauaa

SEQ ID NO: 46346 - RNA, 39 nt, Artificial Sequence
  Synthetic Oligonucleotide; BTLA exon 2; Set A
guacaucacaugauucuuucccuaaaagauaaaaacaaa

SEQ ID NO: 46347 - RNA, 40 nt, Artificial Sequence
  Synthetic Oligonucleotide; BTLA exon 2; Set A
uguacaucacaugauucuuucccuaaaagauaaaaacaaa

SEQ ID NO: 46348 - RNA, 34 nt, Artificial Sequence
  Synthetic Oligonucleotide; BTLA exon 2; Set C
guacaucacaugauucuuucccuaaaagauaaaa

SEQ ID NO: 46349 - RNA, 35 nt, Artificial Sequence
  Synthetic Oligonucleotide; BTLA exon 2; Set C
uguacaucacaugauucuuucccuaaaagauaaaa

SEQ ID NO: 46350 - RNA, 33 nt, Artificial Sequence
  Synthetic Oligonucleotide; BTLA exon 2; Set C
guacaucacaugauucuuucccuaaaagauaaa

SEQ ID NO: 46351 - RNA, 34 nt, Artificial Sequence
  Synthetic Oligonucleotide; BTLA exon 2; Set A
uguacaucacaugauucuuucccuaaaagauaaa

SEQ ID NO: 46352 - RNA, 36 nt, Artificial Sequence
  Synthetic Oligonucleotide; BTLA exon 2; Set A
cuguacaucacaugauucuuucccuaaaagauaaaa

SEQ ID NO: 46353 - RNA, 33 nt, Artificial Sequence
  Synthetic Oligonucleotide; BTLA exon 2; Set A
uguacaucacaugauucuuucccuaaaagauaa

SEQ ID NO: 46354 - RNA, 35 nt, Artificial Sequence
  Synthetic Oligonucleotide; BTLA exon 2; Set A
cuguacaucacaugauucuuucccuaaaagauaaa

SEQ ID NO: 46355 - RNA, 34 nt, Artificial Sequence
  Synthetic Oligonucleotide; BTLA exon 2; Set A
cuguacaucacaugauucuuucccuaaaagauaa

SEQ ID NO: 46356 - RNA, 16 nt, Artificial Sequence
  Synthetic Oligonucleotide; BTLA exon 2; Set C
uguacaucacaugauu

SEQ ID NO: 46357 - RNA, 17 nt, Artificial Sequence
  Synthetic Oligonucleotide; BTLA exon 2; Set C
cuguacaucacaugauu

SEQ ID NO: 46358 - RNA, 33 nt, Artificial Sequence
  Synthetic Oligonucleotide; BTLA exon 2; Set A
gucucuuuauauaaagcuguacaucacaugauu

SEQ ID NO: 46359 - RNA, 32 nt, Artificial Sequence
  Synthetic Oligonucleotide; BTLA exon 2; Set A
gucucuuuauauaaagcuguacaucacaugau

SEQ ID NO: 46360 - RNA, 34 nt, Artificial Sequence
  Synthetic Oligonucleotide; BTLA exon 2; Set A
ugucucuuuauauaaagcuguacaucacaugauu

SEQ ID NO: 46361 - RNA, 33 nt, Artificial Sequence
  Synthetic Oligonucleotide; BTLA exon 2; Set A
ugucucuuuauauaaagcuguacaucacaugau

SEQ ID NO: 46362 - RNA, 35 nt, Artificial Sequence
  Synthetic Oligonucleotide; BTLA exon 2; Set A
uugucucuuuauauaaagcuguacaucacaugauu

SEQ ID NO: 46363 - RNA, 34 nt, Artificial Sequence
  Synthetic Oligonucleotide; BTLA exon 2; Set A
uugucucuuuauauaaagcuguacaucacaugau

SEQ ID NO: 46364 - RNA, 36 nt, Artificial Sequence
  Synthetic Oligonucleotide; BTLA exon 2; Set A
auugucucuuuauauaaagcuguacaucacaugauu

SEQ ID NO: 46365 - RNA, 37 nt, Artificial Sequence
  Synthetic Oligonucleotide; BTLA exon 2; Set A
gauugucucuuuauauaaagcuguacaucacaugauu

SEQ ID NO: 46366 - RNA, 35 nt, Artificial Sequence
  Synthetic Oligonucleotide; BTLA exon 2; Set A
auugucucuuuauauaaagcuguacaucacaugau

SEQ ID NO: 46367 - RNA, 38 nt, Artificial Sequence
  Synthetic Oligonucleotide; BTLA exon 2; Set A
agauugucucuuuauauaaagcuguacaucacaugauu

SEQ ID NO: 46368 - RNA, 36 nt, Artificial Sequence
  Synthetic Oligonucleotide; BTLA exon 2; Set A
gauugucucuuuauauaaagcuguacaucacaugau

SEQ ID NO: 46369 - RNA, 39 nt, Artificial Sequence
  Synthetic Oligonucleotide; BTLA exon 2; Set A
cagauugucucuuuauauaaagcuguacaucacaugauu

SEQ ID NO: 46370 - RNA, 37 nt, Artificial Sequence
  Synthetic Oligonucleotide; BTLA exon 2; Set A
agauugucucuuuauauaaagcuguacaucacaugau

SEQ ID NO: 46371 - RNA, 38 nt, Artificial Sequence
  Synthetic Oligonucleotide; BTLA exon 2; Set A
cagauugucucuuuauauaaagcuguacaucacaugau

SEQ ID NO: 46372 - RNA, 16 nt, Artificial Sequence
  Synthetic Oligonucleotide; BTLA exon 2; Set C
uuuauauaaagcugua

SEQ ID NO: 46373 - RNA, 15 nt, Artificial Sequence
  Synthetic Oligonucleotide; BTLA exon 2; Set C
uuuauauaaagcugu

SEQ ID NO: 46374 - RNA, 21 nt, Artificial Sequence
  Synthetic Oligonucleotide; BTLA exon 2; Set C
gucucuuuauauaaagcugua

SEQ ID NO: 46375 - RNA, 20 nt, Artificial Sequence
  Synthetic Oligonucleotide; BTLA exon 2; Set C
gucucuuuauauaaagcugu

SEQ ID NO: 46376 - RNA, 22 nt, Artificial Sequence
  Synthetic Oligonucleotide; BTLA exon 2; Set C
ugucucuuuauauaaagcugua

SEQ ID NO: 46377 - RNA, 21 nt, Artificial Sequence
  Synthetic Oligonucleotide; BTLA exon 2; Set C
ugucucuuuauauaaagcugu

SEQ ID NO: 46378 - RNA, 19 nt, Artificial Sequence
  Synthetic Oligonucleotide; BTLA exon 2; Set C
gucucuuuauauaaagcug

SEQ ID NO: 46379 - RNA, 23 nt, Artificial Sequence
  Synthetic Oligonucleotide; BTLA exon 2; Set C
uugucucuuuauauaaagcugua

SEQ ID NO: 46380 - RNA, 22 nt, Artificial Sequence
  Synthetic Oligonucleotide; BTLA exon 2; Set C
uugucucuuuauauaaagcugu

SEQ ID NO: 46381 - RNA, 20 nt, Artificial Sequence
  Synthetic Oligonucleotide; BTLA exon 2; Set C
ugucucuuuauauaaagcug

SEQ ID NO: 46382 - RNA, 24 nt, Artificial Sequence
  Synthetic Oligonucleotide; BTLA exon 2; Set C
auugucucuuuauauaaagcugua

SEQ ID NO: 46383 - RNA, 23 nt, Artificial Sequence
  Synthetic Oligonucleotide; BTLA exon 2; Set C
auugucucuuuauauaaagcugu

SEQ ID NO: 46384 - RNA, 21 nt, Artificial Sequence
  Synthetic Oligonucleotide; BTLA exon 2; Set C
uugucucuuuauauaaagcug

SEQ ID NO: 46385 - RNA, 25 nt, Artificial Sequence
  Synthetic Oligonucleotide; BTLA exon 2; Set C
gauugucucuuuauauaaagcugua

SEQ ID NO: 46386 - RNA, 24 nt, Artificial Sequence
  Synthetic Oligonucleotide; BTLA exon 2; Set C
gauugucucuuuauauaaagcugu

SEQ ID NO: 46387 - RNA, 22 nt, Artificial Sequence
  Synthetic Oligonucleotide; BTLA exon 2; Set C
auugucucuuuauauaaagcug

SEQ ID NO: 46388 - RNA, 26 nt, Artificial Sequence
  Synthetic Oligonucleotide; BTLA exon 2; Set C
agauugucucuuuauauaaagcugua

SEQ ID NO: 46389 - RNA, 25 nt, Artificial Sequence
  Synthetic Oligonucleotide; BTLA exon 2; Set C
agauugucucuuuauauaaagcugu

SEQ ID NO: 46390 - RNA, 23 nt, Artificial Sequence
  Synthetic Oligonucleotide; BTLA exon 2; Set C
gauugucucuuuauauaaagcug

SEQ ID NO: 46391 - RNA, 27 nt, Artificial Sequence
  Synthetic Oligonucleotide; BTLA exon 2; Set C
cagauugucucuuuauauaaagcugua

SEQ ID NO: 46392 - RNA, 26 nt, Artificial Sequence
  Synthetic Oligonucleotide; BTLA exon 2; Set C
cagauugucucuuuauauaaagcugu

SEQ ID NO: 46393 - RNA, 24 nt, Artificial Sequence
  Synthetic Oligonucleotide; BTLA exon 2; Set C
agauugucucuuuauauaaagcug

SEQ ID NO: 46394 - RNA, 28 nt, Artificial Sequence
  Synthetic Oligonucleotide; BTLA exon 2; Set C
ucagauugucucuuuauauaaagcugua

SEQ ID NO: 46395 - RNA, 27 nt, Artificial Sequence
  Synthetic Oligonucleotide; BTLA exon 2; Set C
ucagauugucucuuuauauaaagcugu

SEQ ID NO: 46396 - RNA, 25 nt, Artificial Sequence
  Synthetic Oligonucleotide; BTLA exon 2; Set C
cagauugucucuuuauauaaagcug

SEQ ID NO: 46397 - RNA, 29 nt, Artificial Sequence
  Synthetic Oligonucleotide; BTLA exon 2; Set C
uucagauugucucuuuauauaaagcugua

SEQ ID NO: 46398 - RNA, 28 nt, Artificial Sequence
  Synthetic Oligonucleotide; BTLA exon 2; Set C
uucagauugucucuuuauauaaagcugu

SEQ ID NO: 46399 - RNA, 26 nt, Artificial Sequence
  Synthetic Oligonucleotide; BTLA exon 2; Set C
ucagauugucucuuuauauaaagcug

SEQ ID NO: 46400 - RNA, 30 nt, Artificial Sequence
  Synthetic Oligonucleotide; BTLA exon 2; Set C
guucagauugucucuuuauauaaagcugua

SEQ ID NO: 46401 - RNA, 29 nt, Artificial Sequence
  Synthetic Oligonucleotide; BTLA exon 2; Set C
guucagauugucucuuuauauaaagcugu

SEQ ID NO: 46402 - RNA, 27 nt, Artificial Sequence
  Synthetic Oligonucleotide; BTLA exon 2; Set C
uucagauugucucuuuauauaaagcug

SEQ ID NO: 46403 - RNA, 31 nt, Artificial Sequence
  Synthetic Oligonucleotide; BTLA exon 2; Set C
uguucagauugucucuuuauauaaagcugua

SEQ ID NO: 46404 - RNA, 30 nt, Artificial Sequence
  Synthetic Oligonucleotide; BTLA exon 2; Set C
uguucagauugucucuuuauauaaagcugu

SEQ ID NO: 46405 - RNA, 28 nt, Artificial Sequence
  Synthetic Oligonucleotide; BTLA exon 2; Set C
guucagauugucucuuuauauaaagcug

SEQ ID NO: 46406 - RNA, 29 nt, Artificial Sequence
  Synthetic Oligonucleotide; BTLA exon 2; Set C
uguucagauugucucuuuauauaaagcug

SEQ ID NO: 46407 - RNA, 38 nt, Artificial Sequence
  Synthetic Oligonucleotide; BTLA exon 2; Set A
gauggaguguucagauugucucuuuauauaaagcugua

SEQ ID NO: 46408 - RNA, 37 nt, Artificial Sequence
  Synthetic Oligonucleotide; BTLA exon 2; Set A
gauggaguguucagauugucucuuuauauaaagcugu

SEQ ID NO: 46409 - RNA, 39 nt, Artificial Sequence
  Synthetic Oligonucleotide; BTLA exon 2; Set A
agauggaguguucagauugucucuuuauauaaagcugua

SEQ ID NO: 46410 - RNA, 38 nt, Artificial Sequence
  Synthetic Oligonucleotide; BTLA exon 2; Set A
agauggaguguucagauugucucuuuauauaaagcugu

SEQ ID NO: 46411 - RNA, 37 nt, Artificial Sequence
  Synthetic Oligonucleotide; BTLA exon 2; Set A
agauggaguguucagauugucucuuuauauaaagcug

SEQ ID NO: 46412 - RNA, 40 nt, Artificial Sequence
  Synthetic Oligonucleotide; BTLA exon 2; Set A
uaagauggaguguucagauugucucuuuauauaaagcugu

SEQ ID NO: 46413 - RNA, 15 nt, Artificial Sequence
  Synthetic Oligonucleotide; BTLA exon 2; Set C
uucagauugucucuu

SEQ ID NO: 46414 - RNA, 16 nt, Artificial Sequence
  Synthetic Oligonucleotide; BTLA exon 2; Set C
guucagauugucucuu

SEQ ID NO: 46415 - RNA, 17 nt, Artificial Sequence
  Synthetic Oligonucleotide; BTLA exon 2; Set C
uguucagauugucucuu

SEQ ID NO: 46416 - RNA, 15 nt, Artificial Sequence
  Synthetic Oligonucleotide; BTLA exon 2; Set C
guucagauugucucu

SEQ ID NO: 46417 - RNA, 16 nt, Artificial Sequence
  Synthetic Oligonucleotide; BTLA exon 2; Set C
uguucagauugucucu

SEQ ID NO: 46418 - RNA, 15 nt, Artificial Sequence
  Synthetic Oligonucleotide; BTLA exon 2; Set C
uguucagauugucuc

SEQ ID NO: 46419 - RNA, 28 nt, Artificial Sequence
  Synthetic Oligonucleotide; BTLA exon 2; Set A
gauggaguguucagauugucucuuuaua

SEQ ID NO: 46420 - RNA, 27 nt, Artificial Sequence
  Synthetic Oligonucleotide; BTLA exon 2; Set A
gauggaguguucagauugucucuuuau

SEQ ID NO: 46421 - RNA, 26 nt, Artificial Sequence
  Synthetic Oligonucleotide; BTLA exon 2; Set A
gauggaguguucagauugucucuuua

SEQ ID NO: 46422 - RNA, 30 nt, Artificial Sequence
  Synthetic Oligonucleotide; BTLA exon 2; Set A
aagauggaguguucagauugucucuuuaua

SEQ ID NO: 46423 - RNA, 31 nt, Artificial Sequence
  Synthetic Oligonucleotide; BTLA exon 2; Set A
uaagauggaguguucagauugucucuuuaua

SEQ ID NO: 46424 - RNA, 29 nt, Artificial Sequence
  Synthetic Oligonucleotide; BTLA exon 2; Set A
aagauggaguguucagauugucucuuuau

SEQ ID NO: 46425 - RNA, 25 nt, Artificial Sequence
  Synthetic Oligonucleotide; BTLA exon 2; Set A
gauggaguguucagauugucucuuu

SEQ ID NO: 46426 - RNA, 28 nt, Artificial Sequence
  Synthetic Oligonucleotide; BTLA exon 2; Set A
aagauggaguguucagauugucucuuua

SEQ ID NO: 46427 - RNA, 32 nt, Artificial Sequence
  Synthetic Oligonucleotide; BTLA exon 2; Set A
cuaagauggaguguucagauugucucuuuaua

SEQ ID NO: 46428 - RNA, 30 nt, Artificial Sequence
  Synthetic Oligonucleotide; BTLA exon 2; Set A
uaagauggaguguucagauugucucuuuau

SEQ ID NO: 46429 - RNA, 24 nt, Artificial Sequence
  Synthetic Oligonucleotide; BTLA exon 2; Set A
gauggaguguucagauugucucuu

SEQ ID NO: 46430 - RNA, 29 nt, Artificial Sequence
  Synthetic Oligonucleotide; BTLA exon 2; Set A
uaagauggaguguucagauugucucuuua

SEQ ID NO: 46431 - RNA, 31 nt, Artificial Sequence
  Synthetic Oligonucleotide; BTLA exon 2; Set A
cuaagauggaguguucagauugucucuuuau

SEQ ID NO: 46432 - RNA, 27 nt, Artificial Sequence
  Synthetic Oligonucleotide; BTLA exon 2; Set A
aagauggaguguucagauugucucuuu

SEQ ID NO: 46433 - RNA, 25 nt, Artificial Sequence
  Synthetic Oligonucleotide; BTLA exon 2; Set A
agauggaguguucagauugucucuu

SEQ ID NO: 46434 - RNA, 30 nt, Artificial Sequence
  Synthetic Oligonucleotide; BTLA exon 2; Set A
cuaagauggaguguucagauugucucuuua

SEQ ID NO: 46435 - RNA, 28 nt, Artificial Sequence
  Synthetic Oligonucleotide; BTLA exon 2; Set A
uaagauggaguguucagauugucucuuu

SEQ ID NO: 46436 - RNA, 24 nt, Artificial Sequence
  Synthetic Oligonucleotide; BTLA exon 2; Set A
agauggaguguucagauugucucu

SEQ ID NO: 46437 - RNA, 29 nt, Artificial Sequence
  Synthetic Oligonucleotide; BTLA exon 2; Set A
cuaagauggaguguucagauugucucuuu

SEQ ID NO: 46438 - RNA, 21 nt, Artificial Sequence
  Synthetic Oligonucleotide; BTLA exon 2; Set C
gauggaguguucagauugucu

SEQ ID NO: 46439 - RNA, 23 nt, Artificial Sequence
  Synthetic Oligonucleotide; BTLA exon 2; Set C
agauggaguguucagauugucuc

SEQ ID NO: 46440 - RNA, 20 nt, Artificial Sequence
  Synthetic Oligonucleotide; BTLA exon 2; Set C
gauggaguguucagauuguc

SEQ ID NO: 46441 - RNA, 22 nt, Artificial Sequence
  Synthetic Oligonucleotide; BTLA exon 2; Set C
agauggaguguucagauugucu

SEQ ID NO: 46442 - RNA, 19 nt, Artificial Sequence
  Synthetic Oligonucleotide; BTLA exon 2; Set C
gauggaguguucagauugu

SEQ ID NO: 46443 - RNA, 29 nt, Artificial Sequence
  Synthetic Oligonucleotide; BTLA exon 2; Set A
gcuaagauggaguguucagauugucucuu

SEQ ID NO: 46444 - RNA, 22 nt, Artificial Sequence
  Synthetic Oligonucleotide; BTLA exon 2; Set C
aagauggaguguucagauuguc

SEQ ID NO: 46445 - RNA, 20 nt, Artificial Sequence
  Synthetic Oligonucleotide; BTLA exon 2; Set C
agauggaguguucagauugu

SEQ ID NO: 46446 - RNA, 18 nt, Artificial Sequence
  Synthetic Oligonucleotide; BTLA exon 2; Set C
gauggaguguucagauug

SEQ ID NO: 46447 - RNA, 30 nt, Artificial Sequence
  Synthetic Oligonucleotide; BTLA exon 2; Set A
ugcuaagauggaguguucagauugucucuu

SEQ ID NO: 46448 - RNA, 28 nt, Artificial Sequence
  Synthetic Oligonucleotide; BTLA exon 2; Set A
gcuaagauggaguguucagauugucucu

SEQ ID NO: 46449 - RNA, 23 nt, Artificial Sequence
  Synthetic Oligonucleotide; BTLA exon 2; Set C
uaagauggaguguucagauuguc

SEQ ID NO: 46450 - RNA, 21 nt, Artificial Sequence
  Synthetic Oligonucleotide; BTLA exon 2; Set C
aagauggaguguucagauugu

SEQ ID NO: 46451 - RNA, 19 nt, Artificial Sequence
  Synthetic Oligonucleotide; BTLA exon 2; Set C
agauggaguguucagauug

SEQ ID NO: 46452 - RNA, 17 nt, Artificial Sequence
  Synthetic Oligonucleotide; BTLA exon 2; Set C
gauggaguguucagauu

SEQ ID NO: 46453 - RNA, 29 nt, Artificial Sequence
  Synthetic Oligonucleotide; BTLA exon 2; Set A
ugcuaagauggaguguucagauugucucu

SEQ ID NO: 46454 - RNA, 27 nt, Artificial Sequence
  Synthetic Oligonucleotide; BTLA exon 2; Set A
gcuaagauggaguguucagauugucuc

SEQ ID NO: 46455 - RNA, 40 nt, Artificial Sequence
  Synthetic Oligonucleotide; BTLA exon 2; Set C
aucuccugcuaagauggaguguucagauugucucuuuaua

SEQ ID NO: 46456 - RNA, 24 nt, Artificial Sequence
  Synthetic Oligonucleotide; BTLA exon 2; Set C
cuaagauggaguguucagauuguc

SEQ ID NO: 46457 - RNA, 22 nt, Artificial Sequence
  Synthetic Oligonucleotide; BTLA exon 2; Set C
uaagauggaguguucagauugu

SEQ ID NO: 46458 - RNA, 20 nt, Artificial Sequence
  Synthetic Oligonucleotide; BTLA exon 2; Set C
aagauggaguguucagauug

SEQ ID NO: 46459 - RNA, 16 nt, Artificial Sequence
  Synthetic Oligonucleotide; BTLA exon 2; Set C
gauggaguguucagau

SEQ ID NO: 46460 - RNA, 18 nt, Artificial Sequence
  Synthetic Oligonucleotide; BTLA exon 2; Set C
agauggaguguucagauu

SEQ ID NO: 46461 - RNA, 26 nt, Artificial Sequence
  Synthetic Oligonucleotide; BTLA exon 2; Set A
gcuaagauggaguguucagauugucu

SEQ ID NO: 46462 - RNA, 28 nt, Artificial Sequence
  Synthetic Oligonucleotide; BTLA exon 2; Set A
ugcuaagauggaguguucagauugucuc

SEQ ID NO: 46463 - RNA, 39 nt, Artificial Sequence
  Synthetic Oligonucleotide; BTLA exon 2; Set C
aucuccugcuaagauggaguguucagauugucucuuuau

SEQ ID NO: 46464 - RNA, 25 nt, Artificial Sequence
  Synthetic Oligonucleotide; BTLA exon 2; Set A
gcuaagauggaguguucagauuguc

SEQ ID NO: 46465 - RNA, 23 nt, Artificial Sequence
  Synthetic Oligonucleotide; BTLA exon 2; Set C
cuaagauggaguguucagauugu

SEQ ID NO: 46466 - RNA, 21 nt, Artificial Sequence
  Synthetic Oligonucleotide; BTLA exon 2; Set C
uaagauggaguguucagauug

SEQ ID NO: 46467 - RNA, 17 nt, Artificial Sequence
  Synthetic Oligonucleotide; BTLA exon 2; Set C
agauggaguguucagau

SEQ ID NO: 46468 - RNA, 15 nt, Artificial Sequence
  Synthetic Oligonucleotide; BTLA exon 2; Set C
gauggaguguucaga

SEQ ID NO: 46469 - RNA, 19 nt, Artificial Sequence
  Synthetic Oligonucleotide; BTLA exon 2; Set C
aagauggaguguucagauu

SEQ ID NO: 46470 - RNA, 27 nt, Artificial Sequence
  Synthetic Oligonucleotide; BTLA exon 2; Set A
ugcuaagauggaguguucagauugucu

SEQ ID NO: 46471 - RNA, 38 nt, Artificial Sequence
  Synthetic Oligonucleotide; BTLA exon 2; Set C
aucuccugcuaagauggaguguucagauugucucuuua

SEQ ID NO: 46472 - RNA, 24 nt, Artificial Sequence
  Synthetic Oligonucleotide; BTLA exon 2; Set C
gcuaagauggaguguucagauugu

SEQ ID NO: 46473 - RNA, 22 nt, Artificial Sequence
  Synthetic Oligonucleotide; BTLA exon 2; Set C
cuaagauggaguguucagauug

SEQ ID NO: 46474 - RNA, 16 nt, Artificial Sequence
  Synthetic Oligonucleotide; BTLA exon 2; Set C
agauggaguguucaga

SEQ ID NO: 46475 - RNA, 18 nt, Artificial Sequence
  Synthetic Oligonucleotide; BTLA exon 2; Set C
aagauggaguguucagau

SEQ ID NO: 46476 - RNA, 20 nt, Artificial Sequence
  Synthetic Oligonucleotide; BTLA exon 2; Set C
uaagauggaguguucagauu

SEQ ID NO: 46477 - RNA, 37 nt, Artificial Sequence
  Synthetic Oligonucleotide; BTLA exon 2; Set C
aucuccugcuaagauggaguguucagauugucucuuu

SEQ ID NO: 46478 - RNA, 25 nt, Artificial Sequence
  Synthetic Oligonucleotide; BTLA exon 2; Set A
ugcuaagauggaguguucagauugu

SEQ ID NO: 46479 - RNA, 23 nt, Artificial Sequence
  Synthetic Oligonucleotide; BTLA exon 2; Set C
gcuaagauggaguguucagauug

SEQ ID NO: 46480 - RNA, 15 nt, Artificial Sequence
  Synthetic Oligonucleotide; BTLA exon 2; Set C
agauggaguguucag

SEQ ID NO: 46481 - RNA, 19 nt, Artificial Sequence
  Synthetic Oligonucleotide; BTLA exon 2; Set C
uaagauggaguguucagau

SEQ ID NO: 46482 - RNA, 17 nt, Artificial Sequence
  Synthetic Oligonucleotide; BTLA exon 2; Set C
aagauggaguguucaga

SEQ ID NO: 46483 - RNA, 21 nt, Artificial Sequence
  Synthetic Oligonucleotide; BTLA exon 2; Set C
cuaagauggaguguucagauu

SEQ ID NO: 46484 - RNA, 24 nt, Artificial Sequence
  Synthetic Oligonucleotide; BTLA exon 2; Set C
ugcuaagauggaguguucagauug

SEQ ID NO: 46485 - RNA, 18 nt, Artificial Sequence
  Synthetic Oligonucleotide; BTLA exon 2; Set C
uaagauggaguguucaga

SEQ ID NO: 46486 - RNA, 16 nt, Artificial Sequence
  Synthetic Oligonucleotide; BTLA exon 2; Set C
aagauggaguguucag

SEQ ID NO: 46487 - RNA, 20 nt, Artificial Sequence
  Synthetic Oligonucleotide; BTLA exon 2; Set C
cuaagauggaguguucagau

SEQ ID NO: 46488 - RNA, 22 nt, Artificial Sequence
  Synthetic Oligonucleotide; BTLA exon 2; Set C
gcuaagauggaguguucagauu

SEQ ID NO: 46489 - RNA, 36 nt, Artificial Sequence
  Synthetic Oligonucleotide; BTLA exon 2; Set C
aucuccugcuaagauggaguguucagauugucucuu

SEQ ID NO: 46490 - RNA, 21 nt, Artificial Sequence
  Synthetic Oligonucleotide; BTLA exon 2; Set C
gcuaagauggaguguucagau

SEQ ID NO: 46491 - RNA, 17 nt, Artificial Sequence
  Synthetic Oligonucleotide; BTLA exon 2; Set C
uaagauggaguguucag

SEQ ID NO: 46492 - RNA, 19 nt, Artificial Sequence
  Synthetic Oligonucleotide; BTLA exon 2; Set C
cuaagauggaguguucaga

SEQ ID NO: 46493 - RNA, 23 nt, Artificial Sequence
  Synthetic Oligonucleotide; BTLA exon 2; Set C
ugcuaagauggaguguucagauu

SEQ ID NO: 46494 - RNA, 37 nt, Artificial Sequence
  Synthetic Oligonucleotide; BTLA exon 2; Set C
gaucuccugcuaagauggaguguucagauugucucuu

SEQ ID NO: 46495 - RNA, 35 nt, Artificial Sequence
  Synthetic Oligonucleotide; BTLA exon 2; Set C
aucuccugcuaagauggaguguucagauugucucu

SEQ ID NO: 46496 - RNA, 22 nt, Artificial Sequence
  Synthetic Oligonucleotide; BTLA exon 2; Set C
ugcuaagauggaguguucagau

SEQ ID NO: 46497 - RNA, 20 nt, Artificial Sequence
  Synthetic Oligonucleotide; BTLA exon 2; Set C
gcuaagauggaguguucaga

SEQ ID NO: 46498 - RNA, 18 nt, Artificial Sequence
  Synthetic Oligonucleotide; BTLA exon 2; Set C
cuaagauggaguguucag

SEQ ID NO: 46499 - RNA, 36 nt, Artificial Sequence
  Synthetic Oligonucleotide; BTLA exon 2; Set C
gaucuccugcuaagauggaguguucagauugucucu

SEQ ID NO: 46500 - RNA, 34 nt, Artificial Sequence
  Synthetic Oligonucleotide; BTLA exon 2; Set A
aucuccugcuaagauggaguguucagauugucuc

SEQ ID NO: 46501 - RNA, 21 nt, Artificial Sequence
  Synthetic Oligonucleotide; BTLA exon 2; Set C
ugcuaagauggaguguucaga

SEQ ID NO: 46502 - RNA, 19 nt, Artificial Sequence
  Synthetic Oligonucleotide; BTLA exon 2; Set C
gcuaagauggaguguucag

SEQ ID NO: 46503 - RNA, 33 nt, Artificial Sequence
  Synthetic Oligonucleotide; BTLA exon 2; Set A
aucuccugcuaagauggaguguucagauugucu

SEQ ID NO: 46504 - RNA, 35 nt, Artificial Sequence
  Synthetic Oligonucleotide; BTLA exon 2; Set C
gaucuccugcuaagauggaguguucagauugucuc

SEQ ID NO: 46505 - RNA, 32 nt, Artificial Sequence
  Synthetic Oligonucleotide; BTLA exon 2; Set A
aucuccugcuaagauggaguguucagauuguc

SEQ ID NO: 46506 - RNA, 20 nt, Artificial Sequence
  Synthetic Oligonucleotide; BTLA exon 2; Set C
ugcuaagauggaguguucag

SEQ ID NO: 46507 - RNA, 34 nt, Artificial Sequence
  Synthetic Oligonucleotide; BTLA exon 2; Set C
gaucuccugcuaagauggaguguucagauugucu

SEQ ID NO: 46508 - RNA, 18 nt, Artificial Sequence
  Synthetic Oligonucleotide; BTLA exon 2; Set C
gcuaagauggaguguuca

SEQ ID NO: 46509 - RNA, 33 nt, Artificial Sequence
  Synthetic Oligonucleotide; BTLA exon 2; Set A
gaucuccugcuaagauggaguguucagauuguc

SEQ ID NO: 46510 - RNA, 31 nt, Artificial Sequence
  Synthetic Oligonucleotide; BTLA exon 2; Set A
aucuccugcuaagauggaguguucagauugu

SEQ ID NO: 46511 - RNA, 17 nt, Artificial Sequence
  Synthetic Oligonucleotide; BTLA exon 2; Set C
gcuaagauggaguguuc

SEQ ID NO: 46512 - RNA, 19 nt, Artificial Sequence
  Synthetic Oligonucleotide; BTLA exon 2; Set C
ugcuaagauggaguguuca

SEQ ID NO: 46513 - RNA, 32 nt, Artificial Sequence
  Synthetic Oligonucleotide; BTLA exon 2; Set A
gaucuccugcuaagauggaguguucagauugu

SEQ ID NO: 46514 - RNA, 30 nt, Artificial Sequence
  Synthetic Oligonucleotide; BTLA exon 2; Set A
aucuccugcuaagauggaguguucagauug

SEQ ID NO: 46515 - RNA, 18 nt, Artificial Sequence
  Synthetic Oligonucleotide; BTLA exon 2; Set C
ugcuaagauggaguguuc

SEQ ID NO: 46516 - RNA, 16 nt, Artificial Sequence
  Synthetic Oligonucleotide; BTLA exon 2; Set C
gcuaagauggaguguu

SEQ ID NO: 46517 - RNA, 31 nt, Artificial Sequence
  Synthetic Oligonucleotide; BTLA exon 2; Set A
gaucuccugcuaagauggaguguucagauug

SEQ ID NO: 46518 - RNA, 29 nt, Artificial Sequence
  Synthetic Oligonucleotide; BTLA exon 2; Set A
aucuccugcuaagauggaguguucagauu

SEQ ID NO: 46519 - RNA, 17 nt, Artificial Sequence
  Synthetic Oligonucleotide; BTLA exon 2; Set C
ugcuaagauggaguguu

SEQ ID NO: 46520 - RNA, 15 nt, Artificial Sequence
  Synthetic Oligonucleotide; BTLA exon 2; Set C
gcuaagauggagugu

SEQ ID NO: 46521 - RNA, 28 nt, Artificial Sequence
  Synthetic Oligonucleotide; BTLA exon 2; Set A
aucuccugcuaagauggaguguucagau

SEQ ID NO: 46522 - RNA, 30 nt, Artificial Sequence
  Synthetic Oligonucleotide; BTLA exon 2; Set A
gaucuccugcuaagauggaguguucagauu

SEQ ID NO: 46523 - RNA, 16 nt, Artificial Sequence
  Synthetic Oligonucleotide; BTLA exon 2; Set C
ugcuaagauggagugu

SEQ ID NO: 46524 - RNA, 29 nt, Artificial Sequence
  Synthetic Oligonucleotide; BTLA exon 2; Set A
gaucuccugcuaagauggaguguucagau

SEQ ID NO: 46525 - RNA, 27 nt, Artificial Sequence
  Synthetic Oligonucleotide; BTLA exon 2; Set A
aucuccugcuaagauggaguguucaga

SEQ ID NO: 46526 - RNA, 28 nt, Artificial Sequence
  Synthetic Oligonucleotide; BTLA exon 2; Set A
gaucuccugcuaagauggaguguucaga

SEQ ID NO: 46527 - RNA, 26 nt, Artificial Sequence
  Synthetic Oligonucleotide; BTLA exon 2; Set A
aucuccugcuaagauggaguguucag

SEQ ID NO: 46528 - RNA, 27 nt, Artificial Sequence
  Synthetic Oligonucleotide; BTLA exon 2; Set A
gaucuccugcuaagauggaguguucag

SEQ ID NO: 46529 - RNA, 24 nt, Artificial Sequence
  Synthetic Oligonucleotide; BTLA exon 2; Set A
aucuccugcuaagauggaguguuc

SEQ ID NO: 46530 - RNA, 26 nt, Artificial Sequence
  Synthetic Oligonucleotide; BTLA exon 2; Set A
gaucuccugcuaagauggaguguuca

SEQ ID NO: 46531 - RNA, 25 nt, Artificial Sequence
  Synthetic Oligonucleotide; BTLA exon 2; Set A
gaucuccugcuaagauggaguguuc

SEQ ID NO: 46532 - RNA, 24 nt, Artificial Sequence
  Synthetic Oligonucleotide; BTLA exon 2; Set A
gaucuccugcuaagauggaguguu

SEQ ID NO: 46533 - RNA, 23 nt, Artificial Sequence
  Synthetic Oligonucleotide; BTLA exon 2; Set A
gaucuccugcuaagauggagugu

SEQ ID NO: 46534 - RNA, 40 nt, Artificial Sequence
  Synthetic Oligonucleotide; BTLA exon 2; Set C
guucaaagggaucuccugcuaagauggaguguucagauug

SEQ ID NO: 46535 - RNA, 39 nt, Artificial Sequence
  Synthetic Oligonucleotide; BTLA exon 2; Set C
guucaaagggaucuccugcuaagauggaguguucagauu

SEQ ID NO: 46536 - RNA, 38 nt, Artificial Sequence
  Synthetic Oligonucleotide; BTLA exon 2; Set C
guucaaagggaucuccugcuaagauggaguguucagau

SEQ ID NO: 46537 - RNA, 40 nt, Artificial Sequence
  Synthetic Oligonucleotide; BTLA exon 2; Set C
aguucaaagggaucuccugcuaagauggaguguucagauu

SEQ ID NO: 46538 - RNA, 37 nt, Artificial Sequence
  Synthetic Oligonucleotide; BTLA exon 2; Set C
guucaaagggaucuccugcuaagauggaguguucaga

SEQ ID NO: 46539 - RNA, 39 nt, Artificial Sequence
  Synthetic Oligonucleotide; BTLA exon 2; Set C
aguucaaagggaucuccugcuaagauggaguguucagau

SEQ ID NO: 46540 - RNA, 36 nt, Artificial Sequence
  Synthetic Oligonucleotide; BTLA exon 2; Set C
guucaaagggaucuccugcuaagauggaguguucag

SEQ ID NO: 46541 - RNA, 38 nt, Artificial Sequence
  Synthetic Oligonucleotide; BTLA exon 2; Set C
aguucaaagggaucuccugcuaagauggaguguucaga

SEQ ID NO: 46542 - RNA, 40 nt, Artificial Sequence
  Synthetic Oligonucleotide; BTLA exon 2; Set C
uaguucaaagggaucuccugcuaagauggaguguucagau

SEQ ID NO: 46543 - RNA, 37 nt, Artificial Sequence
  Synthetic Oligonucleotide; BTLA exon 2; Set C
aguucaaagggaucuccugcuaagauggaguguucag

SEQ ID NO: 46544 - RNA, 39 nt, Artificial Sequence
  Synthetic Oligonucleotide; BTLA exon 2; Set C
uaguucaaagggaucuccugcuaagauggaguguucaga

SEQ ID NO: 46545 - RNA, 15 nt, Artificial Sequence
  Synthetic Oligonucleotide; BTLA exon 2; Set C
aucuccugcuaagau

SEQ ID NO: 46546 - RNA, 35 nt, Artificial Sequence
  Synthetic Oligonucleotide; BTLA exon 2; Set C
guucaaagggaucuccugcuaagauggaguguuca

SEQ ID NO: 46547 - RNA, 38 nt, Artificial Sequence
  Synthetic Oligonucleotide; BTLA exon 2; Set C
uaguucaaagggaucuccugcuaagauggaguguucag

SEQ ID NO: 46548 - RNA, 40 nt, Artificial Sequence
  Synthetic Oligonucleotide; BTLA exon 2; Set C
cuaguucaaagggaucuccugcuaagauggaguguucaga

SEQ ID NO: 46549 - RNA, 34 nt, Artificial Sequence
  Synthetic Oligonucleotide; BTLA exon 2; Set C
guucaaagggaucuccugcuaagauggaguguuc

SEQ ID NO: 46550 - RNA, 16 nt, Artificial Sequence
  Synthetic Oligonucleotide; BTLA exon 2; Set C
gaucuccugcuaagau

SEQ ID NO: 46551 - RNA, 36 nt, Artificial Sequence
  Synthetic Oligonucleotide; BTLA exon 2; Set C
aguucaaagggaucuccugcuaagauggaguguuca

SEQ ID NO: 46552 - RNA, 39 nt, Artificial Sequence
  Synthetic Oligonucleotide; BTLA exon 2; Set C
cuaguucaaagggaucuccugcuaagauggaguguucag

SEQ ID NO: 46553 - RNA, 35 nt, Artificial Sequence
  Synthetic Oligonucleotide; BTLA exon 2; Set C
aguucaaagggaucuccugcuaagauggaguguuc

SEQ ID NO: 46554 - RNA, 37 nt, Artificial Sequence
  Synthetic Oligonucleotide; BTLA exon 2; Set C
uaguucaaagggaucuccugcuaagauggaguguuca

SEQ ID NO: 46555 - RNA, 33 nt, Artificial Sequence
  Synthetic Oligonucleotide; BTLA exon 2; Set A
guucaaagggaucuccugcuaagauggaguguu

SEQ ID NO: 46556 - RNA, 40 nt, Artificial Sequence
  Synthetic Oligonucleotide; BTLA exon 2; Set C
ucuaguucaaagggaucuccugcuaagauggaguguucag

SEQ ID NO: 46557 - RNA, 36 nt, Artificial Sequence
  Synthetic Oligonucleotide; BTLA exon 2; Set C
uaguucaaagggaucuccugcuaagauggaguguuc

SEQ ID NO: 46558 - RNA, 38 nt, Artificial Sequence
  Synthetic Oligonucleotide; BTLA exon 2; Set C
cuaguucaaagggaucuccugcuaagauggaguguuca

SEQ ID NO: 46559 - RNA, 32 nt, Artificial Sequence
  Synthetic Oligonucleotide; BTLA exon 2; Set A
guucaaagggaucuccugcuaagauggagugu

SEQ ID NO: 46560 - RNA, 34 nt, Artificial Sequence
  Synthetic Oligonucleotide; BTLA exon 2; Set A
aguucaaagggaucuccugcuaagauggaguguu

SEQ ID NO: 46561 - RNA, 37 nt, Artificial Sequence
  Synthetic Oligonucleotide; BTLA exon 2; Set C
cuaguucaaagggaucuccugcuaagauggaguguuc

SEQ ID NO: 46562 - RNA, 39 nt, Artificial Sequence
  Synthetic Oligonucleotide; BTLA exon 2; Set C
ucuaguucaaagggaucuccugcuaagauggaguguuca

SEQ ID NO: 46563 - RNA, 33 nt, Artificial Sequence
  Synthetic Oligonucleotide; BTLA exon 2; Set A
aguucaaagggaucuccugcuaagauggagugu

SEQ ID NO: 46564 - RNA, 35 nt, Artificial Sequence
  Synthetic Oligonucleotide; BTLA exon 2; Set A
uaguucaaagggaucuccugcuaagauggaguguu

SEQ ID NO: 46565 - RNA, 38 nt, Artificial Sequence
  Synthetic Oligonucleotide; BTLA exon 2; Set C
ucuaguucaaagggaucuccugcuaagauggaguguuc

SEQ ID NO: 46566 - RNA, 34 nt, Artificial Sequence
  Synthetic Oligonucleotide; BTLA exon 2; Set A
uaguucaaagggaucuccugcuaagauggagugu

SEQ ID NO: 46567 - RNA, 36 nt, Artificial Sequence
  Synthetic Oligonucleotide; BTLA exon 2; Set C
cuaguucaaagggaucuccugcuaagauggaguguu

SEQ ID NO: 46568 - RNA, 37 nt, Artificial Sequence
  Synthetic Oligonucleotide; BTLA exon 2; Set C
ucuaguucaaagggaucuccugcuaagauggaguguu

SEQ ID NO: 46569 - RNA, 35 nt, Artificial Sequence
  Synthetic Oligonucleotide; BTLA exon 2; Set C
cuaguucaaagggaucuccugcuaagauggagugu

SEQ ID NO: 46570 - RNA, 36 nt, Artificial Sequence
  Synthetic Oligonucleotide; BTLA exon 2; Set C
ucuaguucaaagggaucuccugcuaagauggagugu

SEQ ID NO: 46571 - RNA, 25 nt, Artificial Sequence
  Synthetic Oligonucleotide; BTLA exon 2; Set A
guucaaagggaucuccugcuaagau

SEQ ID NO: 46572 - RNA, 26 nt, Artificial Sequence
  Synthetic Oligonucleotide; BTLA exon 2; Set A
aguucaaagggaucuccugcuaagau

SEQ ID NO: 46573 - RNA, 25 nt, Artificial Sequence
  Synthetic Oligonucleotide; BTLA exon 2; Set A
aguucaaagggaucuccugcuaaga

SEQ ID NO: 46574 - RNA, 27 nt, Artificial Sequence
  Synthetic Oligonucleotide; BTLA exon 2; Set A
uaguucaaagggaucuccugcuaagau

SEQ ID NO: 46575 - RNA, 23 nt, Artificial Sequence
  Synthetic Oligonucleotide; BTLA exon 2; Set C
guucaaagggaucuccugcuaag

SEQ ID NO: 46576 - RNA, 26 nt, Artificial Sequence
  Synthetic Oligonucleotide; BTLA exon 2; Set A
uaguucaaagggaucuccugcuaaga

SEQ ID NO: 46577 - RNA, 28 nt, Artificial Sequence
  Synthetic Oligonucleotide; BTLA exon 2; Set A
cuaguucaaagggaucuccugcuaagau

SEQ ID NO: 46578 - RNA, 22 nt, Artificial Sequence
  Synthetic Oligonucleotide; BTLA exon 2; Set C
guucaaagggaucuccugcuaa

SEQ ID NO: 46579 - RNA, 24 nt, Artificial Sequence
  Synthetic Oligonucleotide; BTLA exon 2; Set C
aguucaaagggaucuccugcuaag

SEQ ID NO: 46580 - RNA, 27 nt, Artificial Sequence
  Synthetic Oligonucleotide; BTLA exon 2; Set A
cuaguucaaagggaucuccugcuaaga

SEQ ID NO: 46581 - RNA, 29 nt, Artificial Sequence
  Synthetic Oligonucleotide; BTLA exon 2; Set A
ucuaguucaaagggaucuccugcuaagau

SEQ ID NO: 46582 - RNA, 23 nt, Artificial Sequence
  Synthetic Oligonucleotide; BTLA exon 2; Set C
aguucaaagggaucuccugcuaa

SEQ ID NO: 46583 - RNA, 25 nt, Artificial Sequence
  Synthetic Oligonucleotide; BTLA exon 2; Set C
uaguucaaagggaucuccugcuaag

SEQ ID NO: 46584 - RNA, 21 nt, Artificial Sequence
  Synthetic Oligonucleotide; BTLA exon 2; Set C
guucaaagggaucuccugcua

SEQ ID NO: 46585 - RNA, 28 nt, Artificial Sequence
  Synthetic Oligonucleotide; BTLA exon 2; Set A
ucuaguucaaagggaucuccugcuaaga

SEQ ID NO: 46586 - RNA, 20 nt, Artificial Sequence
  Synthetic Oligonucleotide; BTLA exon 2; Set C
guucaaagggaucuccugcu

SEQ ID NO: 46587 - RNA, 24 nt, Artificial Sequence
  Synthetic Oligonucleotide; BTLA exon 2; Set C
uaguucaaagggaucuccugcuaa

SEQ ID NO: 46588 - RNA, 26 nt, Artificial Sequence
  Synthetic Oligonucleotide; BTLA exon 2; Set A
cuaguucaaagggaucuccugcuaag

SEQ ID NO: 46589 - RNA, 22 nt, Artificial Sequence
  Synthetic Oligonucleotide; BTLA exon 2; Set C
aguucaaagggaucuccugcua

SEQ ID NO: 46590 - RNA, 19 nt, Artificial Sequence
  Synthetic Oligonucleotide; BTLA exon 2; Set C
guucaaagggaucuccugc

SEQ ID NO: 46591 - RNA, 21 nt, Artificial Sequence
  Synthetic Oligonucleotide; BTLA exon 2; Set C
aguucaaagggaucuccugcu

SEQ ID NO: 46592 - RNA, 27 nt, Artificial Sequence
  Synthetic Oligonucleotide; BTLA exon 2; Set A
ucuaguucaaagggaucuccugcuaag

SEQ ID NO: 46593 - RNA, 25 nt, Artificial Sequence
  Synthetic Oligonucleotide; BTLA exon 2; Set A
cuaguucaaagggaucuccugcuaa

SEQ ID NO: 46594 - RNA, 20 nt, Artificial Sequence
  Synthetic Oligonucleotide; BTLA exon 2; Set C
aguucaaagggaucuccugc

SEQ ID NO: 46595 - RNA, 22 nt, Artificial Sequence
  Synthetic Oligonucleotide; BTLA exon 2; Set C
uaguucaaagggaucuccugcu

SEQ ID NO: 46596 - RNA, 26 nt, Artificial Sequence
  Synthetic Oligonucleotide; BTLA exon 2; Set A
ucuaguucaaagggaucuccugcuaa

SEQ ID NO: 46597 - RNA, 24 nt, Artificial Sequence
  Synthetic Oligonucleotide; BTLA exon 2; Set A
cuaguucaaagggaucuccugcua

SEQ ID NO: 46598 - RNA, 21 nt, Artificial Sequence
  Synthetic Oligonucleotide; BTLA exon 2; Set C
uaguucaaagggaucuccugc

SEQ ID NO: 46599 - RNA, 23 nt, Artificial Sequence
  Synthetic Oligonucleotide; BTLA exon 2; Set A
cuaguucaaagggaucuccugcu

SEQ ID NO: 46600 - RNA, 25 nt, Artificial Sequence
  Synthetic Oligonucleotide; BTLA exon 2; Set A
ucuaguucaaagggaucuccugcua

SEQ ID NO: 46601 - RNA, 24 nt, Artificial Sequence
  Synthetic Oligonucleotide; BTLA exon 2; Set A
ucuaguucaaagggaucuccugcu

SEQ ID NO: 46602 - RNA, 22 nt, Artificial Sequence
  Synthetic Oligonucleotide; BTLA exon 2; Set C
cuaguucaaagggaucuccugc

SEQ ID NO: 46603 - RNA, 23 nt, Artificial Sequence
  Synthetic Oligonucleotide; BTLA exon 2; Set A
ucuaguucaaagggaucuccugc

SEQ ID NO: 46604 - RNA, 15 nt, Artificial Sequence
  Synthetic Oligonucleotide; BTLA exon 2; Set C
uaguucaaagggauc

SEQ ID NO: 46605 - RNA, 16 nt, Artificial Sequence
  Synthetic Oligonucleotide; BTLA exon 2; Set C
cuaguucaaagggauc

SEQ ID NO: 46606 - RNA, 15 nt, Artificial Sequence
  Synthetic Oligonucleotide; BTLA exon 2; Set C
cuaguucaaagggau

SEQ ID NO: 46607 - RNA, 17 nt, Artificial Sequence
  Synthetic Oligonucleotide; BTLA exon 2; Set C
ucuaguucaaagggauc

SEQ ID NO: 46608 - RNA, 16 nt, Artificial Sequence
  Synthetic Oligonucleotide; BTLA exon 2; Set C
ucuaguucaaagggau

SEQ ID NO: 46609 - RNA, 38 nt, Artificial Sequence
  Synthetic Oligonucleotide; BTLA exon 2; Set C
auuucacagggcauucuaguucaaagggaucuccugcu

SEQ ID NO: 46610 - RNA, 39 nt, Artificial Sequence
  Synthetic Oligonucleotide; BTLA exon 2; Set C
uauuucacagggcauucuaguucaaagggaucuccugcu

SEQ ID NO: 46611 - RNA, 37 nt, Artificial Sequence
  Synthetic Oligonucleotide; BTLA exon 2; Set C
auuucacagggcauucuaguucaaagggaucuccugc

SEQ ID NO: 46612 - RNA, 38 nt, Artificial Sequence
  Synthetic Oligonucleotide; BTLA exon 2; Set C
uauuucacagggcauucuaguucaaagggaucuccugc

SEQ ID NO: 46613 - RNA, 40 nt, Artificial Sequence
  Synthetic Oligonucleotide; BTLA exon 2; Set C
guauuucacagggcauucuaguucaaagggaucuccugcu

SEQ ID NO: 46614 - RNA, 39 nt, Artificial Sequence
  Synthetic Oligonucleotide; BTLA exon 2; Set C
guauuucacagggcauucuaguucaaagggaucuccugc

SEQ ID NO: 46615 - RNA, 40 nt, Artificial Sequence
  Synthetic Oligonucleotide; BTLA exon 2; Set C
aguauuucacagggcauucuaguucaaagggaucuccugc

SEQ ID NO: 46616 - RNA, 30 nt, Artificial Sequence
  Synthetic Oligonucleotide; BTLA exon 2; Set A
auuucacagggcauucuaguucaaagggau

SEQ ID NO: 46617 - RNA, 31 nt, Artificial Sequence
  Synthetic Oligonucleotide; BTLA exon 2; Set A
uauuucacagggcauucuaguucaaagggau

SEQ ID NO: 46618 - RNA, 32 nt, Artificial Sequence
  Synthetic Oligonucleotide; BTLA exon 2; Set A
guauuucacagggcauucuaguucaaagggau

SEQ ID NO: 46619 - RNA, 33 nt, Artificial Sequence
  Synthetic Oligonucleotide; BTLA exon 2; Set A
aguauuucacagggcauucuaguucaaagggau

SEQ ID NO: 46620 - RNA, 39 nt, Artificial Sequence
  Synthetic Oligonucleotide; BTLA exon 2; Set C
agcacaguauuucacagggcauucuaguucaaagggauc

SEQ ID NO: 46621 - RNA, 38 nt, Artificial Sequence
  Synthetic Oligonucleotide; BTLA exon 2; Set C
agcacaguauuucacagggcauucuaguucaaagggau

SEQ ID NO: 46622 - RNA, 40 nt, Artificial Sequence
  Synthetic Oligonucleotide; BTLA exon 2; Set C
uagcacaguauuucacagggcauucuaguucaaagggauc

SEQ ID NO: 46623 - RNA, 21 nt, Artificial Sequence
  Synthetic Oligonucleotide; BTLA exon 2; Set C
auuucacagggcauucuaguu

SEQ ID NO: 46624 - RNA, 39 nt, Artificial Sequence
  Synthetic Oligonucleotide; BTLA exon 2; Set C
uagcacaguauuucacagggcauucuaguucaaagggau

SEQ ID NO: 46625 - RNA, 22 nt, Artificial Sequence
  Synthetic Oligonucleotide; BTLA exon 2; Set C
uauuucacagggcauucuaguu

SEQ ID NO: 46626 - RNA, 20 nt, Artificial Sequence
  Synthetic Oligonucleotide; BTLA exon 2; Set C
auuucacagggcauucuagu

SEQ ID NO: 46627 - RNA, 40 nt, Artificial Sequence
  Synthetic Oligonucleotide; BTLA exon 2; Set C
uuagcacaguauuucacagggcauucuaguucaaagggau

SEQ ID NO: 46628 - RNA, 23 nt, Artificial Sequence
  Synthetic Oligonucleotide; BTLA exon 2; Set C
guauuucacagggcauucuaguu

SEQ ID NO: 46629 - RNA, 21 nt, Artificial Sequence
  Synthetic Oligonucleotide; BTLA exon 2; Set C
uauuucacagggcauucuagu

SEQ ID NO: 46630 - RNA, 24 nt, Artificial Sequence
  Synthetic Oligonucleotide; BTLA exon 2; Set A
aguauuucacagggcauucuaguu

SEQ ID NO: 46631 - RNA, 22 nt, Artificial Sequence
  Synthetic Oligonucleotide; BTLA exon 2; Set C
guauuucacagggcauucuagu

SEQ ID NO: 46632 - RNA, 23 nt, Artificial Sequence
  Synthetic Oligonucleotide; BTLA exon 2; Set C
aguauuucacagggcauucuagu

SEQ ID NO: 46633 - RNA, 29 nt, Artificial Sequence
  Synthetic Oligonucleotide; BTLA exon 2; Set A
agcacaguauuucacagggcauucuaguu

SEQ ID NO: 46634 - RNA, 30 nt, Artificial Sequence
  Synthetic Oligonucleotide; BTLA exon 2; Set A
uagcacaguauuucacagggcauucuaguu

SEQ ID NO: 46635 - RNA, 28 nt, Artificial Sequence
  Synthetic Oligonucleotide; BTLA exon 2; Set A
agcacaguauuucacagggcauucuagu

SEQ ID NO: 46636 - RNA, 31 nt, Artificial Sequence
  Synthetic Oligonucleotide; BTLA exon 2; Set C
uuagcacaguauuucacagggcauucuaguu

SEQ ID NO: 46637 - RNA, 29 nt, Artificial Sequence
  Synthetic Oligonucleotide; BTLA exon 2; Set A
uagcacaguauuucacagggcauucuagu

SEQ ID NO: 46638 - RNA, 27 nt, Artificial Sequence
  Synthetic Oligonucleotide; BTLA exon 2; Set A
agcacaguauuucacagggcauucuag

SEQ ID NO: 46639 - RNA, 32 nt, Artificial Sequence
  Synthetic Oligonucleotide; BTLA exon 2; Set C
guuagcacaguauuucacagggcauucuaguu

SEQ ID NO: 46640 - RNA, 30 nt, Artificial Sequence
  Synthetic Oligonucleotide; BTLA exon 2; Set A
uuagcacaguauuucacagggcauucuagu

SEQ ID NO: 46641 - RNA, 28 nt, Artificial Sequence
  Synthetic Oligonucleotide; BTLA exon 2; Set A
uagcacaguauuucacagggcauucuag

SEQ ID NO: 46642 - RNA, 26 nt, Artificial Sequence
  Synthetic Oligonucleotide; BTLA exon 2; Set A
agcacaguauuucacagggcauucua

SEQ ID NO: 46643 - RNA, 31 nt, Artificial Sequence
  Synthetic Oligonucleotide; BTLA exon 2; Set C
guuagcacaguauuucacagggcauucuagu

SEQ ID NO: 46644 - RNA, 25 nt, Artificial Sequence
  Synthetic Oligonucleotide; BTLA exon 2; Set A
agcacaguauuucacagggcauucu

SEQ ID NO: 46645 - RNA, 29 nt, Artificial Sequence
  Synthetic Oligonucleotide; BTLA exon 2; Set A
uuagcacaguauuucacagggcauucuag

SEQ ID NO: 46646 - RNA, 27 nt, Artificial Sequence
  Synthetic Oligonucleotide; BTLA exon 2; Set A
uagcacaguauuucacagggcauucua

SEQ ID NO: 46647 - RNA, 26 nt, Artificial Sequence
  Synthetic Oligonucleotide; BTLA exon 2; Set A
uagcacaguauuucacagggcauucu

SEQ ID NO: 46648 - RNA, 30 nt, Artificial Sequence
  Synthetic Oligonucleotide; BTLA exon 2; Set A
guuagcacaguauuucacagggcauucuag

SEQ ID NO: 46649 - RNA, 28 nt, Artificial Sequence
  Synthetic Oligonucleotide; BTLA exon 2; Set A
uuagcacaguauuucacagggcauucua

SEQ ID NO: 46650 - RNA, 27 nt, Artificial Sequence
  Synthetic Oligonucleotide; BTLA exon 2; Set A
uuagcacaguauuucacagggcauucu

SEQ ID NO: 46651 - RNA, 29 nt, Artificial Sequence
  Synthetic Oligonucleotide; BTLA exon 2; Set C
guuagcacaguauuucacagggcauucua

SEQ ID NO: 46652 - RNA, 28 nt, Artificial Sequence
  Synthetic Oligonucleotide; BTLA exon 2; Set A
guuagcacaguauuucacagggcauucu

SEQ ID NO: 46653 - RNA, 40 nt, Artificial Sequence
  Synthetic Oligonucleotide; BTLA exon 2; Set C
augaggccuguuagcacaguauuucacagggcauucuagu

SEQ ID NO: 46654 - RNA, 40 nt, Artificial Sequence
  Synthetic Oligonucleotide; BTLA exon 2; Set C
caugaggccuguuagcacaguauuucacagggcauucuag

SEQ ID NO: 46655 - RNA, 39 nt, Artificial Sequence
  Synthetic Oligonucleotide; BTLA exon 2; Set C
caugaggccuguuagcacaguauuucacagggcauucua

SEQ ID NO: 46656 - RNA, 38 nt, Artificial Sequence
  Synthetic Oligonucleotide; BTLA exon 2; Set C
caugaggccuguuagcacaguauuucacagggcauucu

SEQ ID NO: 46657 - RNA, 40 nt, Artificial Sequence
  Synthetic Oligonucleotide; BTLA exon 2; Set C
acaugaggccuguuagcacaguauuucacagggcauucua

SEQ ID NO: 46658 - RNA, 39 nt, Artificial Sequence
  Synthetic Oligonucleotide; BTLA exon 2; Set C
acaugaggccuguuagcacaguauuucacagggcauucu

SEQ ID NO: 46659 - RNA, 40 nt, Artificial Sequence
  Synthetic Oligonucleotide; BTLA exon 2; Set C
cacaugaggccuguuagcacaguauuucacagggcauucu

SEQ ID NO: 46660 - RNA, 23 nt, Artificial Sequence
  Synthetic Oligonucleotide; BTLA exon 2; Set A
augaggccuguuagcacaguauu

SEQ ID NO: 46661 - RNA, 22 nt, Artificial Sequence
  Synthetic Oligonucleotide; BTLA exon 2; Set A
augaggccuguuagcacaguau

SEQ ID NO: 46662 - RNA, 23 nt, Artificial Sequence
  Synthetic Oligonucleotide; BTLA exon 2; Set A
caugaggccuguuagcacaguau

SEQ ID NO: 46663 - RNA, 25 nt, Artificial Sequence
  Synthetic Oligonucleotide; BTLA exon 2; Set A
acaugaggccuguuagcacaguauu

SEQ ID NO: 46664 - RNA, 21 nt, Artificial Sequence
  Synthetic Oligonucleotide; BTLA exon 2; Set A
augaggccuguuagcacagua

SEQ ID NO: 46665 - RNA, 24 nt, Artificial Sequence
  Synthetic Oligonucleotide; BTLA exon 2; Set A
acaugaggccuguuagcacaguau

SEQ ID NO: 46666 - RNA, 26 nt, Artificial Sequence
  Synthetic Oligonucleotide; BTLA exon 2; Set A
cacaugaggccuguuagcacaguauu

SEQ ID NO: 46667 - RNA, 22 nt, Artificial Sequence
  Synthetic Oligonucleotide; BTLA exon 2; Set A
caugaggccuguuagcacagua

SEQ ID NO: 46668 - RNA, 20 nt, Artificial Sequence
  Synthetic Oligonucleotide; BTLA exon 2; Set A
augaggccuguuagcacagu

SEQ ID NO: 46669 - RNA, 25 nt, Artificial Sequence
  Synthetic Oligonucleotide; BTLA exon 2; Set A
cacaugaggccuguuagcacaguau

SEQ ID NO: 46670 - RNA, 27 nt, Artificial Sequence
  Synthetic Oligonucleotide; BTLA exon 2; Set A
ucacaugaggccuguuagcacaguauu

SEQ ID NO: 46671 - RNA, 23 nt, Artificial Sequence
  Synthetic Oligonucleotide; BTLA exon 2; Set A
acaugaggccuguuagcacagua

SEQ ID NO: 46672 - RNA, 21 nt, Artificial Sequence
  Synthetic Oligonucleotide; BTLA exon 2; Set A
caugaggccuguuagcacagu

SEQ ID NO: 46673 - RNA, 26 nt, Artificial Sequence
  Synthetic Oligonucleotide; BTLA exon 2; Set A
ucacaugaggccuguuagcacaguau

SEQ ID NO: 46674 - RNA, 24 nt, Artificial Sequence
  Synthetic Oligonucleotide; BTLA exon 2; Set A
cacaugaggccuguuagcacagua

SEQ ID NO: 46675 - RNA, 22 nt, Artificial Sequence
  Synthetic Oligonucleotide; BTLA exon 2; Set A
acaugaggccuguuagcacagu

SEQ ID NO: 46676 - RNA, 25 nt, Artificial Sequence
  Synthetic Oligonucleotide; BTLA exon 2; Set A
ucacaugaggccuguuagcacagua

SEQ ID NO: 46677 - RNA, 23 nt, Artificial Sequence
  Synthetic Oligonucleotide; BTLA exon 2; Set A
cacaugaggccuguuagcacagu

SEQ ID NO: 46678 - RNA, 24 nt, Artificial Sequence
  Synthetic Oligonucleotide; BTLA exon 2; Set A
ucacaugaggccuguuagcacagu

SEQ ID NO: 46679 - RNA, 15 nt, Artificial Sequence
  Synthetic Oligonucleotide; BTLA exon 2; Set C
augaggccuguuagc

SEQ ID NO: 46680 - RNA, 16 nt, Artificial Sequence
  Synthetic Oligonucleotide; BTLA exon 2; Set C
caugaggccuguuagc

SEQ ID NO: 46681 - RNA, 15 nt, Artificial Sequence
  Synthetic Oligonucleotide; BTLA exon 2; Set C
caugaggccuguuag

SEQ ID NO: 46682 - RNA, 17 nt, Artificial Sequence
  Synthetic Oligonucleotide; BTLA exon 2; Set C
acaugaggccuguuagc

SEQ ID NO: 46683 - RNA, 16 nt, Artificial Sequence
  Synthetic Oligonucleotide; BTLA exon 2; Set C
acaugaggccuguuag

SEQ ID NO: 46684 - RNA, 18 nt, Artificial Sequence
  Synthetic Oligonucleotide; BTLA exon 2; Set C
cacaugaggccuguuagc

SEQ ID NO: 46685 - RNA, 35 nt, Artificial Sequence
  Synthetic Oligonucleotide; BTLA exon 2; Set C
gcaccaagucacaugaggccuguuagcacaguauu

SEQ ID NO: 46686 - RNA, 17 nt, Artificial Sequence
  Synthetic Oligonucleotide; BTLA exon 2; Set C
cacaugaggccuguuag

SEQ ID NO: 46687 - RNA, 15 nt, Artificial Sequence
  Synthetic Oligonucleotide; BTLA exon 2; Set C
acaugaggccuguua

SEQ ID NO: 46688 - RNA, 34 nt, Artificial Sequence
  Synthetic Oligonucleotide; BTLA exon 2; Set C
gcaccaagucacaugaggccuguuagcacaguau

SEQ ID NO: 46689 - RNA, 36 nt, Artificial Sequence
  Synthetic Oligonucleotide; BTLA exon 2; Set C
ugcaccaagucacaugaggccuguuagcacaguauu

SEQ ID NO: 46690 - RNA, 16 nt, Artificial Sequence
  Synthetic Oligonucleotide; BTLA exon 2; Set C
cacaugaggccuguua

SEQ ID NO: 46691 - RNA, 35 nt, Artificial Sequence
  Synthetic Oligonucleotide; BTLA exon 2; Set C
ugcaccaagucacaugaggccuguuagcacaguau

SEQ ID NO: 46692 - RNA, 37 nt, Artificial Sequence
  Synthetic Oligonucleotide; BTLA exon 2; Set C
uugcaccaagucacaugaggccuguuagcacaguauu

SEQ ID NO: 46693 - RNA, 33 nt, Artificial Sequence
  Synthetic Oligonucleotide; BTLA exon 2; Set C
gcaccaagucacaugaggccuguuagcacagua

SEQ ID NO: 46694 - RNA, 15 nt, Artificial Sequence
  Synthetic Oligonucleotide; BTLA exon 2; Set C
cacaugaggccuguu

SEQ ID NO: 46695 - RNA, 36 nt, Artificial Sequence
  Synthetic Oligonucleotide; BTLA exon 2; Set C
uugcaccaagucacaugaggccuguuagcacaguau

SEQ ID NO: 46696 - RNA, 34 nt, Artificial Sequence
  Synthetic Oligonucleotide; BTLA exon 2; Set C
ugcaccaagucacaugaggccuguuagcacagua

SEQ ID NO: 46697 - RNA, 32 nt, Artificial Sequence
  Synthetic Oligonucleotide; BTLA exon 2; Set C
gcaccaagucacaugaggccuguuagcacagu

SEQ ID NO: 46698 - RNA, 35 nt, Artificial Sequence
  Synthetic Oligonucleotide; BTLA exon 2; Set C
uugcaccaagucacaugaggccuguuagcacagua

SEQ ID NO: 46699 - RNA, 33 nt, Artificial Sequence
  Synthetic Oligonucleotide; BTLA exon 2; Set C
ugcaccaagucacaugaggccuguuagcacagu

SEQ ID NO: 46700 - RNA, 27 nt, Artificial Sequence
  Synthetic Oligonucleotide; BTLA exon 2; Set C
gcaccaagucacaugaggccuguuagc

SEQ ID NO: 46701 - RNA, 26 nt, Artificial Sequence
  Synthetic Oligonucleotide; BTLA exon 2; Set C
gcaccaagucacaugaggccuguuag

SEQ ID NO: 46702 - RNA, 28 nt, Artificial Sequence
  Synthetic Oligonucleotide; BTLA exon 2; Set C
ugcaccaagucacaugaggccuguuagc

SEQ ID NO: 46703 - RNA, 40 nt, Artificial Sequence
  Synthetic Oligonucleotide; BTLA exon 2; Set C
ugagcuugcaccaagucacaugaggccuguuagcacagua

SEQ ID NO: 46704 - RNA, 27 nt, Artificial Sequence
  Synthetic Oligonucleotide; BTLA exon 2; Set C
ugcaccaagucacaugaggccuguuag

SEQ ID NO: 46705 - RNA, 39 nt, Artificial Sequence
  Synthetic Oligonucleotide; BTLA exon 2; Set C
ugagcuugcaccaagucacaugaggccuguuagcacagu

SEQ ID NO: 46706 - RNA, 25 nt, Artificial Sequence
  Synthetic Oligonucleotide; BTLA exon 2; Set C
gcaccaagucacaugaggccuguua

SEQ ID NO: 46707 - RNA, 40 nt, Artificial Sequence
  Synthetic Oligonucleotide; BTLA exon 2; Set C
uugagcuugcaccaagucacaugaggccuguuagcacagu

SEQ ID NO: 46708 - RNA, 26 nt, Artificial Sequence
  Synthetic Oligonucleotide; BTLA exon 2; Set C
ugcaccaagucacaugaggccuguua

SEQ ID NO: 46709 - RNA, 24 nt, Artificial Sequence
  Synthetic Oligonucleotide; BTLA exon 2; Set C
gcaccaagucacaugaggccuguu

SEQ ID NO: 46710 - RNA, 25 nt, Artificial Sequence
  Synthetic Oligonucleotide; BTLA exon 2; Set C
ugcaccaagucacaugaggccuguu

SEQ ID NO: 46711 - RNA, 34 nt, Artificial Sequence
  Synthetic Oligonucleotide; BTLA exon 2; Set C
ugagcuugcaccaagucacaugaggccuguuagc

SEQ ID NO: 46712 - RNA, 33 nt, Artificial Sequence
  Synthetic Oligonucleotide; BTLA exon 2; Set C
ugagcuugcaccaagucacaugaggccuguuag

SEQ ID NO: 46713 - RNA, 35 nt, Artificial Sequence
  Synthetic Oligonucleotide; BTLA exon 2; Set C
uugagcuugcaccaagucacaugaggccuguuagc

SEQ ID NO: 46714 - RNA, 34 nt, Artificial Sequence
  Synthetic Oligonucleotide; BTLA exon 2; Set C
uugagcuugcaccaagucacaugaggccuguuag

SEQ ID NO: 46715 - RNA, 32 nt, Artificial Sequence
  Synthetic Oligonucleotide; BTLA exon 2; Set C
ugagcuugcaccaagucacaugaggccuguua

SEQ ID NO: 46716 - RNA, 33 nt, Artificial Sequence
  Synthetic Oligonucleotide; BTLA exon 2; Set C
uugagcuugcaccaagucacaugaggccuguua

SEQ ID NO: 46717 - RNA, 31 nt, Artificial Sequence
  Synthetic Oligonucleotide; BTLA exon 2; Set C
ugagcuugcaccaagucacaugaggccuguu

SEQ ID NO: 46718 - RNA, 32 nt, Artificial Sequence
  Synthetic Oligonucleotide; BTLA exon 2; Set C
uugagcuugcaccaagucacaugaggccuguu

SEQ ID NO: 46719 - RNA, 15 nt, Artificial Sequence
  Synthetic Oligonucleotide; BTLA exon 2; Set C
gcaccaagucacaug

SEQ ID NO: 46720 - RNA, 40 nt, Artificial Sequence
  Synthetic Oligonucleotide; BTLA exon 2; Set C
uuccauugagcuugcaccaagucacaugaggccuguuagc

SEQ ID NO: 46721 - RNA, 16 nt, Artificial Sequence
  Synthetic Oligonucleotide; BTLA exon 2; Set C
ugcaccaagucacaug

SEQ ID NO: 46722 - RNA, 39 nt, Artificial Sequence
  Synthetic Oligonucleotide; BTLA exon 2; Set C
uuccauugagcuugcaccaagucacaugaggccuguuag

SEQ ID NO: 46723 - RNA, 15 nt, Artificial Sequence
  Synthetic Oligonucleotide; BTLA exon 2; Set C
ugcaccaagucacau

SEQ ID NO: 46724 - RNA, 17 nt, Artificial Sequence
  Synthetic Oligonucleotide; BTLA exon 2; Set C
uugcaccaagucacaug

SEQ ID NO: 46725 - RNA, 40 nt, Artificial Sequence
  Synthetic Oligonucleotide; BTLA exon 2; Set C
guuccauugagcuugcaccaagucacaugaggccuguuag

SEQ ID NO: 46726 - RNA, 16 nt, Artificial Sequence
  Synthetic Oligonucleotide; BTLA exon 2; Set C
uugcaccaagucacau

SEQ ID NO: 46727 - RNA, 38 nt, Artificial Sequence
  Synthetic Oligonucleotide; BTLA exon 2; Set C
uuccauugagcuugcaccaagucacaugaggccuguua

SEQ ID NO: 46728 - RNA, 37 nt, Artificial Sequence
  Synthetic Oligonucleotide; BTLA exon 2; Set C
uuccauugagcuugcaccaagucacaugaggccuguu

SEQ ID NO: 46729 - RNA, 15 nt, Artificial Sequence
  Synthetic Oligonucleotide; BTLA exon 2; Set C
uugcaccaagucaca

SEQ ID NO: 46730 - RNA, 22 nt, Artificial Sequence
  Synthetic Oligonucleotide; BTLA exon 2; Set A
ugagcuugcaccaagucacaug

SEQ ID NO: 46731 - RNA, 21 nt, Artificial Sequence
  Synthetic Oligonucleotide; BTLA exon 2; Set A
ugagcuugcaccaagucacau

SEQ ID NO: 46732 - RNA, 23 nt, Artificial Sequence
  Synthetic Oligonucleotide; BTLA exon 2; Set A
uugagcuugcaccaagucacaug

SEQ ID NO: 46733 - RNA, 22 nt, Artificial Sequence
  Synthetic Oligonucleotide; BTLA exon 2; Set A
uugagcuugcaccaagucacau

SEQ ID NO: 46734 - RNA, 20 nt, Artificial Sequence
  Synthetic Oligonucleotide; BTLA exon 2; Set A
ugagcuugcaccaagucaca

SEQ ID NO: 46735 - RNA, 19 nt, Artificial Sequence
  Synthetic Oligonucleotide; BTLA exon 2; Set C
ugagcuugcaccaagucac

SEQ ID NO: 46736 - RNA, 21 nt, Artificial Sequence
  Synthetic Oligonucleotide; BTLA exon 2; Set A
uugagcuugcaccaagucaca

SEQ ID NO: 46737 - RNA, 20 nt, Artificial Sequence
  Synthetic Oligonucleotide; BTLA exon 2; Set A
uugagcuugcaccaagucac

SEQ ID NO: 46738 - RNA, 18 nt, Artificial Sequence
  Synthetic Oligonucleotide; BTLA exon 2; Set C
ugagcuugcaccaaguca

SEQ ID NO: 46739 - RNA, 28 nt, Artificial Sequence
  Synthetic Oligonucleotide; BTLA exon 2; Set A
uuccauugagcuugcaccaagucacaug

SEQ ID NO: 46740 - RNA, 27 nt, Artificial Sequence
  Synthetic Oligonucleotide; BTLA exon 2; Set A
uuccauugagcuugcaccaagucacau

SEQ ID NO: 46741 - RNA, 28 nt, Artificial Sequence
  Synthetic Oligonucleotide; BTLA exon 2; Set C
guuccauugagcuugcaccaagucacau

SEQ ID NO: 46742 - RNA, 26 nt, Artificial Sequence
  Synthetic Oligonucleotide; BTLA exon 2; Set A
uuccauugagcuugcaccaagucaca

SEQ ID NO: 46743 - RNA, 30 nt, Artificial Sequence
  Synthetic Oligonucleotide; BTLA exon 2; Set C
uguuccauugagcuugcaccaagucacaug

SEQ ID NO: 46744 - RNA, 29 nt, Artificial Sequence
  Synthetic Oligonucleotide; BTLA exon 2; Set C
uguuccauugagcuugcaccaagucacau

SEQ ID NO: 46745 - RNA, 25 nt, Artificial Sequence
  Synthetic Oligonucleotide; BTLA exon 2; Set A
uuccauugagcuugcaccaagucac

SEQ ID NO: 46746 - RNA, 27 nt, Artificial Sequence
  Synthetic Oligonucleotide; BTLA exon 2; Set C
guuccauugagcuugcaccaagucaca

SEQ ID NO: 46747 - RNA, 31 nt, Artificial Sequence
  Synthetic Oligonucleotide; BTLA exon 2; Set C
uuguuccauugagcuugcaccaagucacaug

SEQ ID NO: 46748 - RNA, 30 nt, Artificial Sequence
  Synthetic Oligonucleotide; BTLA exon 2; Set C
uuguuccauugagcuugcaccaagucacau

SEQ ID NO: 46749 - RNA, 26 nt, Artificial Sequence
  Synthetic Oligonucleotide; BTLA exon 2; Set A
guuccauugagcuugcaccaagucac

SEQ ID NO: 46750 - RNA, 28 nt, Artificial Sequence
  Synthetic Oligonucleotide; BTLA exon 2; Set C
uguuccauugagcuugcaccaagucaca

SEQ ID NO: 46751 - RNA, 32 nt, Artificial Sequence
  Synthetic Oligonucleotide; BTLA exon 2; Set C
guuguuccauugagcuugcaccaagucacaug

SEQ ID NO: 46752 - RNA, 27 nt, Artificial Sequence
  Synthetic Oligonucleotide; BTLA exon 2; Set A
uguuccauugagcuugcaccaagucac

SEQ ID NO: 46753 - RNA, 29 nt, Artificial Sequence
  Synthetic Oligonucleotide; BTLA exon 2; Set C
uuguuccauugagcuugcaccaagucaca

SEQ ID NO: 46754 - RNA, 28 nt, Artificial Sequence
  Synthetic Oligonucleotide; BTLA exon 2; Set A
uuguuccauugagcuugcaccaagucac

SEQ ID NO: 46755 - RNA, 30 nt, Artificial Sequence
  Synthetic Oligonucleotide; BTLA exon 2; Set C
guuguuccauugagcuugcaccaagucaca

SEQ ID NO: 46756 - RNA, 29 nt, Artificial Sequence
  Synthetic Oligonucleotide; BTLA exon 2; Set C
guuguuccauugagcuugcaccaagucac

SEQ ID NO: 46757 - RNA, 28 nt, Artificial Sequence
  Synthetic Oligonucleotide; BTLA exon 2; Set C
guuguuccauugagcuugcaccaaguca

SEQ ID NO: 46758 - RNA, 40 nt, Artificial Sequence
  Synthetic Oligonucleotide; BTLA exon 2; Set C
uuacacauguuguuccauugagcuugcaccaagucacaug

SEQ ID NO: 46759 - RNA, 38 nt, Artificial Sequence
  Synthetic Oligonucleotide; BTLA exon 2; Set C
uuacacauguuguuccauugagcuugcaccaagucaca

SEQ ID NO: 46760 - RNA, 37 nt, Artificial Sequence
  Synthetic Oligonucleotide; BTLA exon 2; Set C
uuacacauguuguuccauugagcuugcaccaagucac

SEQ ID NO: 46761 - RNA, 39 nt, Artificial Sequence
  Synthetic Oligonucleotide; BTLA exon 2; Set C
uuuacacauguuguuccauugagcuugcaccaagucaca

SEQ ID NO: 46762 - RNA, 38 nt, Artificial Sequence
  Synthetic Oligonucleotide; BTLA exon 2; Set C
uuuacacauguuguuccauugagcuugcaccaagucac

SEQ ID NO: 46763 - RNA, 20 nt, Artificial Sequence
  Synthetic Oligonucleotide; BTLA exon 2; Set C
guuguuccauugagcuugca

SEQ ID NO: 46764 - RNA, 36 nt, Artificial Sequence
  Synthetic Oligonucleotide; BTLA exon 2; Set C
uuacacauguuguuccauugagcuugcaccaaguca

SEQ ID NO: 46765 - RNA, 19 nt, Artificial Sequence
  Synthetic Oligonucleotide; BTLA exon 2; Set C
guuguuccauugagcuugc

SEQ ID NO: 46766 - RNA, 37 nt, Artificial Sequence
  Synthetic Oligonucleotide; BTLA exon 2; Set C
uuuacacauguuguuccauugagcuugcaccaaguca

SEQ ID NO: 46767 - RNA, 18 nt, Artificial Sequence
  Synthetic Oligonucleotide; BTLA exon 2; Set C
guuguuccauugagcuug

SEQ ID NO: 46768 - RNA, 28 nt, Artificial Sequence
  Synthetic Oligonucleotide; BTLA exon 2; Set A
uuacacauguuguuccauugagcuugca

SEQ ID NO: 46769 - RNA, 29 nt, Artificial Sequence
  Synthetic Oligonucleotide; BTLA exon 2; Set A
uuuacacauguuguuccauugagcuugca

SEQ ID NO: 46770 - RNA, 27 nt, Artificial Sequence
  Synthetic Oligonucleotide; BTLA exon 2; Set A
uuacacauguuguuccauugagcuugc

SEQ ID NO: 46771 - RNA, 28 nt, Artificial Sequence
  Synthetic Oligonucleotide; BTLA exon 2; Set A
uuuacacauguuguuccauugagcuugc

SEQ ID NO: 46772 - RNA, 26 nt, Artificial Sequence
  Synthetic Oligonucleotide; BTLA exon 2; Set A
uuacacauguuguuccauugagcuug

SEQ ID NO: 46773 - RNA, 27 nt, Artificial Sequence
  Synthetic Oligonucleotide; BTLA exon 2; Set A
uuuacacauguuguuccauugagcuug

SEQ ID NO: 46774 - RNA, 21 nt, Artificial Sequence
  Synthetic Oligonucleotide; BTLA exon 2; Set C
uuacacauguuguuccauuga

SEQ ID NO: 46775 - RNA, 22 nt, Artificial Sequence
  Synthetic Oligonucleotide; BTLA exon 2; Set C
uuuacacauguuguuccauuga

SEQ ID NO: 46776 - RNA, 20 nt, Artificial Sequence
  Synthetic Oligonucleotide; BTLA exon 2; Set C
uuacacauguuguuccauug

SEQ ID NO: 46777 - RNA, 21 nt, Artificial Sequence
  Synthetic Oligonucleotide; BTLA exon 2; Set C
uuuacacauguuguuccauug

SEQ ID NO: 46778 - RNA, 39 nt, Artificial Sequence
  Synthetic Oligonucleotide; BTLA exon 2; Set C
aucuucaaguuuuacacauguuguuccauugagcuugca

SEQ ID NO: 46779 - RNA, 40 nt, Artificial Sequence
  Synthetic Oligonucleotide; BTLA exon 2; Set C
uaucuucaaguuuuacacauguuguuccauugagcuugca

SEQ ID NO: 46780 - RNA, 39 nt, Artificial Sequence
  Synthetic Oligonucleotide; BTLA exon 2; Set C
uaucuucaaguuuuacacauguuguuccauugagcuugc

SEQ ID NO: 46781 - RNA, 15 nt, Artificial Sequence
  Synthetic Oligonucleotide; BTLA exon 2; Set C
uuacacauguuguuc

SEQ ID NO: 46782 - RNA, 40 nt, Artificial Sequence
  Synthetic Oligonucleotide; BTLA exon 2; Set C
cuaucuucaaguuuuacacauguuguuccauugagcuugc

SEQ ID NO: 46783 - RNA, 16 nt, Artificial Sequence
  Synthetic Oligonucleotide; BTLA exon 2; Set C
uuuacacauguuguuc

SEQ ID NO: 46784 - RNA, 15 nt, Artificial Sequence
  Synthetic Oligonucleotide; BTLA exon 2; Set C
uuuacacauguuguu

SEQ ID NO: 46785 - RNA, 30 nt, Artificial Sequence
  Synthetic Oligonucleotide; BTLA exon 2; Set A
cuucaaguuuuacacauguuguuccauuga

SEQ ID NO: 46786 - RNA, 31 nt, Artificial Sequence
  Synthetic Oligonucleotide; BTLA exon 2; Set A
ucuucaaguuuuacacauguuguuccauuga

SEQ ID NO: 46787 - RNA, 32 nt, Artificial Sequence
  Synthetic Oligonucleotide; BTLA exon 2; Set A
aucuucaaguuuuacacauguuguuccauuga

SEQ ID NO: 46788 - RNA, 33 nt, Artificial Sequence
  Synthetic Oligonucleotide; BTLA exon 2; Set A
uaucuucaaguuuuacacauguuguuccauuga

SEQ ID NO: 46789 - RNA, 34 nt, Artificial Sequence
  Synthetic Oligonucleotide; BTLA exon 2; Set A
cuaucuucaaguuuuacacauguuguuccauuga

SEQ ID NO: 46790 - RNA, 35 nt, Artificial Sequence
  Synthetic Oligonucleotide; BTLA exon 2; Set A
ucuaucuucaaguuuuacacauguuguuccauuga

SEQ ID NO: 46791 - RNA, 33 nt, Artificial Sequence
  Synthetic Oligonucleotide; BTLA exon 2; Set A
cuaucuucaaguuuuacacauguuguuccauug

SEQ ID NO: 46792 - RNA, 36 nt, Artificial Sequence
  Synthetic Oligonucleotide; BTLA exon 2; Set A
gucuaucuucaaguuuuacacauguuguuccauuga

SEQ ID NO: 46793 - RNA, 34 nt, Artificial Sequence
  Synthetic Oligonucleotide; BTLA exon 2; Set A
ucuaucuucaaguuuuacacauguuguuccauug

SEQ ID NO: 46794 - RNA, 37 nt, Artificial Sequence
  Synthetic Oligonucleotide; BTLA exon 2; Set A
ugucuaucuucaaguuuuacacauguuguuccauuga

SEQ ID NO: 46795 - RNA, 35 nt, Artificial Sequence
  Synthetic Oligonucleotide; BTLA exon 2; Set A
gucuaucuucaaguuuuacacauguuguuccauug

SEQ ID NO: 46796 - RNA, 38 nt, Artificial Sequence
  Synthetic Oligonucleotide; BTLA exon 2; Set A
uugucuaucuucaaguuuuacacauguuguuccauuga

SEQ ID NO: 46797 - RNA, 36 nt, Artificial Sequence
  Synthetic Oligonucleotide; BTLA exon 2; Set A
ugucuaucuucaaguuuuacacauguuguuccauug

SEQ ID NO: 46798 - RNA, 39 nt, Artificial Sequence
  Synthetic Oligonucleotide; BTLA exon 2; Set A
uuugucuaucuucaaguuuuacacauguuguuccauuga

SEQ ID NO: 46799 - RNA, 37 nt, Artificial Sequence
  Synthetic Oligonucleotide; BTLA exon 2; Set A
uugucuaucuucaaguuuuacacauguuguuccauug

SEQ ID NO: 46800 - RNA, 20 nt, Artificial Sequence
  Synthetic Oligonucleotide; BTLA exon 2; Set C
cuucaaguuuuacacauguu

SEQ ID NO: 46801 - RNA, 40 nt, Artificial Sequence
  Synthetic Oligonucleotide; BTLA exon 2; Set C
guuugucuaucuucaaguuuuacacauguuguuccauuga

SEQ ID NO: 46802 - RNA, 38 nt, Artificial Sequence
  Synthetic Oligonucleotide; BTLA exon 2; Set A
uuugucuaucuucaaguuuuacacauguuguuccauug

SEQ ID NO: 46803 - RNA, 28 nt, Artificial Sequence
  Synthetic Oligonucleotide; BTLA exon 2; Set C
cuaucuucaaguuuuacacauguuguuc

SEQ ID NO: 46804 - RNA, 21 nt, Artificial Sequence
  Synthetic Oligonucleotide; BTLA exon 2; Set C
ucuucaaguuuuacacauguu

SEQ ID NO: 46805 - RNA, 29 nt, Artificial Sequence
  Synthetic Oligonucleotide; BTLA exon 2; Set C
ucuaucuucaaguuuuacacauguuguuc

SEQ ID NO: 46806 - RNA, 22 nt, Artificial Sequence
  Synthetic Oligonucleotide; BTLA exon 2; Set C
aucuucaaguuuuacacauguu

SEQ ID NO: 46807 - RNA, 30 nt, Artificial Sequence
  Synthetic Oligonucleotide; BTLA exon 2; Set A
gucuaucuucaaguuuuacacauguuguuc

SEQ ID NO: 46808 - RNA, 23 nt, Artificial Sequence
  Synthetic Oligonucleotide; BTLA exon 2; Set C
uaucuucaaguuuuacacauguu

SEQ ID NO: 46809 - RNA, 31 nt, Artificial Sequence
  Synthetic Oligonucleotide; BTLA exon 2; Set A
ugucuaucuucaaguuuuacacauguuguuc

SEQ ID NO: 46810 - RNA, 24 nt, Artificial Sequence
  Synthetic Oligonucleotide; BTLA exon 2; Set C
cuaucuucaaguuuuacacauguu

SEQ ID NO: 46811 - RNA, 32 nt, Artificial Sequence
  Synthetic Oligonucleotide; BTLA exon 2; Set A
uugucuaucuucaaguuuuacacauguuguuc

SEQ ID NO: 46812 - RNA, 25 nt, Artificial Sequence
  Synthetic Oligonucleotide; BTLA exon 2; Set C
ucuaucuucaaguuuuacacauguu

SEQ ID NO: 46813 - RNA, 33 nt, Artificial Sequence
  Synthetic Oligonucleotide; BTLA exon 2; Set A
uuugucuaucuucaaguuuuacacauguuguuc

SEQ ID NO: 46814 - RNA, 31 nt, Artificial Sequence
  Synthetic Oligonucleotide; BTLA exon 2; Set A
uugucuaucuucaaguuuuacacauguuguu

SEQ ID NO: 46815 - RNA, 26 nt, Artificial Sequence
  Synthetic Oligonucleotide; BTLA exon 2; Set C
gucuaucuucaaguuuuacacauguu

SEQ ID NO: 46816 - RNA, 32 nt, Artificial Sequence
  Synthetic Oligonucleotide; BTLA exon 2; Set A
uuugucuaucuucaaguuuuacacauguuguu

SEQ ID NO: 46817 - RNA, 30 nt, Artificial Sequence
  Synthetic Oligonucleotide; BTLA exon 2; Set A
uugucuaucuucaaguuuuacacauguugu

SEQ ID NO: 46818 - RNA, 27 nt, Artificial Sequence
  Synthetic Oligonucleotide; BTLA exon 2; Set C
ugucuaucuucaaguuuuacacauguu

SEQ ID NO: 46819 - RNA, 31 nt, Artificial Sequence
  Synthetic Oligonucleotide; BTLA exon 2; Set A
uuugucuaucuucaaguuuuacacauguugu

SEQ ID NO: 46820 - RNA, 29 nt, Artificial Sequence
  Synthetic Oligonucleotide; BTLA exon 2; Set C
uugucuaucuucaaguuuuacacauguug

SEQ ID NO: 46821 - RNA, 28 nt, Artificial Sequence
  Synthetic Oligonucleotide; BTLA exon 2; Set C
uugucuaucuucaaguuuuacacauguu

SEQ ID NO: 46822 - RNA, 30 nt, Artificial Sequence
  Synthetic Oligonucleotide; BTLA exon 2; Set C
uuugucuaucuucaaguuuuacacauguug

SEQ ID NO: 46823 - RNA, 29 nt, Artificial Sequence
  Synthetic Oligonucleotide; BTLA exon 2; Set C
uuugucuaucuucaaguuuuacacauguu

SEQ ID NO: 46824 - RNA, 30 nt, Artificial Sequence
  Synthetic Oligonucleotide; BTLA exon 2; Set A
guuugucuaucuucaaguuuuacacauguu

SEQ ID NO: 46825 - RNA, 15 nt, Artificial Sequence
  Synthetic Oligonucleotide; BTLA exon 2; Set C
uaucuucaaguuuua

SEQ ID NO: 46826 - RNA, 31 nt, Artificial Sequence
  Synthetic Oligonucleotide; BTLA exon 2; Set A
uguuugucuaucuucaaguuuuacacauguu

SEQ ID NO: 46827 - RNA, 16 nt, Artificial Sequence
  Synthetic Oligonucleotide; BTLA exon 2; Set C
cuaucuucaaguuuua

SEQ ID NO: 46828 - RNA, 40 nt, Artificial Sequence
  Synthetic Oligonucleotide; BTLA exon 2; Set A
caacuuguuugucuaucuucaaguuuuacacauguuguuc

SEQ ID NO: 46829 - RNA, 15 nt, Artificial Sequence
  Synthetic Oligonucleotide; BTLA exon 2; Set C
cuaucuucaaguuuu

SEQ ID NO: 46830 - RNA, 17 nt, Artificial Sequence
  Synthetic Oligonucleotide; BTLA exon 2; Set C
ucuaucuucaaguuuua

SEQ ID NO: 46831 - RNA, 39 nt, Artificial Sequence
  Synthetic Oligonucleotide; BTLA exon 2; Set A
caacuuguuugucuaucuucaaguuuuacacauguuguu

SEQ ID NO: 46832 - RNA, 16 nt, Artificial Sequence
  Synthetic Oligonucleotide; BTLA exon 2; Set C
ucuaucuucaaguuuu

SEQ ID NO: 46833 - RNA, 18 nt, Artificial Sequence
  Synthetic Oligonucleotide; BTLA exon 2; Set C
gucuaucuucaaguuuua

SEQ ID NO: 46834 - RNA, 38 nt, Artificial Sequence
  Synthetic Oligonucleotide; BTLA exon 2; Set A
caacuuguuugucuaucuucaaguuuuacacauguugu

SEQ ID NO: 46835 - RNA, 17 nt, Artificial Sequence
  Synthetic Oligonucleotide; BTLA exon 2; Set C
gucuaucuucaaguuuu

SEQ ID NO: 46836 - RNA, 19 nt, Artificial Sequence
  Synthetic Oligonucleotide; BTLA exon 2; Set C
ugucuaucuucaaguuuua

SEQ ID NO: 46837 - RNA, 37 nt, Artificial Sequence
  Synthetic Oligonucleotide; BTLA exon 2; Set A
caacuuguuugucuaucuucaaguuuuacacauguug

SEQ ID NO: 46838 - RNA, 18 nt, Artificial Sequence
  Synthetic Oligonucleotide; BTLA exon 2; Set C
ugucuaucuucaaguuuu

SEQ ID NO: 46839 - RNA, 20 nt, Artificial Sequence
  Synthetic Oligonucleotide; BTLA exon 2; Set C
uugucuaucuucaaguuuua

SEQ ID NO: 46840 - RNA, 36 nt, Artificial Sequence
  Synthetic Oligonucleotide; BTLA exon 2; Set A
caacuuguuugucuaucuucaaguuuuacacauguu

SEQ ID NO: 46841 - RNA, 19 nt, Artificial Sequence
  Synthetic Oligonucleotide; BTLA exon 2; Set C
uugucuaucuucaaguuuu

SEQ ID NO: 46842 - RNA, 21 nt, Artificial Sequence
  Synthetic Oligonucleotide; BTLA exon 2; Set C
uuugucuaucuucaaguuuua

SEQ ID NO: 46843 - RNA, 20 nt, Artificial Sequence
  Synthetic Oligonucleotide; BTLA exon 2; Set C
uuugucuaucuucaaguuuu

SEQ ID NO: 46844 - RNA, 22 nt, Artificial Sequence
  Synthetic Oligonucleotide; BTLA exon 2; Set C
guuugucuaucuucaaguuuua

SEQ ID NO: 46845 - RNA, 21 nt, Artificial Sequence
  Synthetic Oligonucleotide; BTLA exon 2; Set C
guuugucuaucuucaaguuuu

SEQ ID NO: 46846 - RNA, 23 nt, Artificial Sequence
  Synthetic Oligonucleotide; BTLA exon 2; Set C
uguuugucuaucuucaaguuuua

SEQ ID NO: 46847 - RNA, 22 nt, Artificial Sequence
  Synthetic Oligonucleotide; BTLA exon 2; Set C
uguuugucuaucuucaaguuuu

SEQ ID NO: 46848 - RNA, 28 nt, Artificial Sequence
  Synthetic Oligonucleotide; BTLA exon 2; Set C
caacuuguuugucuaucuucaaguuuua

SEQ ID NO: 46849 - RNA, 27 nt, Artificial Sequence
  Synthetic Oligonucleotide; BTLA exon 2; Set C
caacuuguuugucuaucuucaaguuuu

SEQ ID NO: 46850 - RNA, 15 nt, Artificial Sequence
  Synthetic Oligonucleotide; BTLA exon 2; Set C
uuguuugucuaucuu

SEQ ID NO: 46851 - RNA, 16 nt, Artificial Sequence
  Synthetic Oligonucleotide; BTLA exon 2; Set C
cuuguuugucuaucuu

SEQ ID NO: 46852 - RNA, 15 nt, Artificial Sequence
  Synthetic Oligonucleotide; BTLA exon 2; Set C
cuuguuugucuaucu

SEQ ID NO: 46853 - RNA, 17 nt, Artificial Sequence
  Synthetic Oligonucleotide; BTLA exon 2; Set C
acuuguuugucuaucuu

SEQ ID NO: 46854 - RNA, 16 nt, Artificial Sequence
  Synthetic Oligonucleotide; BTLA exon 2; Set C
acuuguuugucuaucu

SEQ ID NO: 46855 - RNA, 18 nt, Artificial Sequence
  Synthetic Oligonucleotide; BTLA exon 2; Set C
aacuuguuugucuaucuu

SEQ ID NO: 46856 - RNA, 17 nt, Artificial Sequence
  Synthetic Oligonucleotide; BTLA exon 2; Set C
aacuuguuugucuaucu

SEQ ID NO: 46857 - RNA, 15 nt, Artificial Sequence
  Synthetic Oligonucleotide; BTLA exon 2; Set C
acuuguuugucuauc

SEQ ID NO: 46858 - RNA, 16 nt, Artificial Sequence
  Synthetic Oligonucleotide; BTLA exon 2; Set C
aacuuguuugucuauc

SEQ ID NO: 46859 - RNA, 15 nt, Artificial Sequence
  Synthetic Oligonucleotide; BTLA exon 2; Set C
aacuuguuugucuau

SEQ ID NO: 46860 - RNA, 33 nt, Artificial Sequence
  Synthetic Oligonucleotide; BTLA exon 2; Set A
ucuucucuuccuuccaacuuguuugucuaucuu

SEQ ID NO: 46861 - RNA, 32 nt, Artificial Sequence
  Synthetic Oligonucleotide; BTLA exon 2; Set A
ucuucucuuccuuccaacuuguuugucuaucu

SEQ ID NO: 46862 - RNA, 34 nt, Artificial Sequence
  Synthetic Oligonucleotide; BTLA exon 2; Set A
uucuucucuuccuuccaacuuguuugucuaucuu

SEQ ID NO: 46863 - RNA, 33 nt, Artificial Sequence
  Synthetic Oligonucleotide; BTLA exon 2; Set A
uucuucucuuccuuccaacuuguuugucuaucu

SEQ ID NO: 46864 - RNA, 35 nt, Artificial Sequence
  Synthetic Oligonucleotide; BTLA exon 2; Set A
guucuucucuuccuuccaacuuguuugucuaucuu

SEQ ID NO: 46865 - RNA, 31 nt, Artificial Sequence
  Synthetic Oligonucleotide; BTLA exon 2; Set A
ucuucucuuccuuccaacuuguuugucuauc

SEQ ID NO: 46866 - RNA, 30 nt, Artificial Sequence
  Synthetic Oligonucleotide; BTLA exon 2; Set A
ucuucucuuccuuccaacuuguuugucuau

SEQ ID NO: 46867 - RNA, 34 nt, Artificial Sequence
  Synthetic Oligonucleotide; BTLA exon 2; Set A
guucuucucuuccuuccaacuuguuugucuaucu

SEQ ID NO: 46868 - RNA, 36 nt, Artificial Sequence
  Synthetic Oligonucleotide; BTLA exon 2; Set A
uguucuucucuuccuuccaacuuguuugucuaucuu

SEQ ID NO: 46869 - RNA, 32 nt, Artificial Sequence
  Synthetic Oligonucleotide; BTLA exon 2; Set A
uucuucucuuccuuccaacuuguuugucuauc

SEQ ID NO: 46870 - RNA, 29 nt, Artificial Sequence
  Synthetic Oligonucleotide; BTLA exon 2; Set A
ucuucucuuccuuccaacuuguuugucua

SEQ ID NO: 46871 - RNA, 31 nt, Artificial Sequence
  Synthetic Oligonucleotide; BTLA exon 2; Set A
uucuucucuuccuuccaacuuguuugucuau

SEQ ID NO: 46872 - RNA, 35 nt, Artificial Sequence
  Synthetic Oligonucleotide; BTLA exon 2; Set A
uguucuucucuuccuuccaacuuguuugucuaucu

SEQ ID NO: 46873 - RNA, 33 nt, Artificial Sequence
  Synthetic Oligonucleotide; BTLA exon 2; Set A
guucuucucuuccuuccaacuuguuugucuauc

SEQ ID NO: 46874 - RNA, 37 nt, Artificial Sequence
  Synthetic Oligonucleotide; BTLA exon 2; Set A
auguucuucucuuccuuccaacuuguuugucuaucuu

SEQ ID NO: 46875 - RNA, 28 nt, Artificial Sequence
  Synthetic Oligonucleotide; BTLA exon 2; Set A
ucuucucuuccuuccaacuuguuugucu

SEQ ID NO: 46876 - RNA, 30 nt, Artificial Sequence
  Synthetic Oligonucleotide; BTLA exon 2; Set A
uucuucucuuccuuccaacuuguuugucua

SEQ ID NO: 46877 - RNA, 32 nt, Artificial Sequence
  Synthetic Oligonucleotide; BTLA exon 2; Set A
guucuucucuuccuuccaacuuguuugucuau

SEQ ID NO: 46878 - RNA, 36 nt, Artificial Sequence
  Synthetic Oligonucleotide; BTLA exon 2; Set A
auguucuucucuuccuuccaacuuguuugucuaucu

SEQ ID NO: 46879 - RNA, 34 nt, Artificial Sequence
  Synthetic Oligonucleotide; BTLA exon 2; Set A
uguucuucucuuccuuccaacuuguuugucuauc

SEQ ID NO: 46880 - RNA, 38 nt, Artificial Sequence
  Synthetic Oligonucleotide; BTLA exon 2; Set A
aauguucuucucuuccuuccaacuuguuugucuaucuu

SEQ ID NO: 46881 - RNA, 29 nt, Artificial Sequence
  Synthetic Oligonucleotide; BTLA exon 2; Set A
uucuucucuuccuuccaacuuguuugucu

SEQ ID NO: 46882 - RNA, 31 nt, Artificial Sequence
  Synthetic Oligonucleotide; BTLA exon 2; Set A
guucuucucuuccuuccaacuuguuugucua

SEQ ID NO: 46883 - RNA, 33 nt, Artificial Sequence
  Synthetic Oligonucleotide; BTLA exon 2; Set A
uguucuucucuuccuuccaacuuguuugucuau

SEQ ID NO: 46884 - RNA, 37 nt, Artificial Sequence
  Synthetic Oligonucleotide; BTLA exon 2; Set A
aauguucuucucuuccuuccaacuuguuugucuaucu

SEQ ID NO: 46885 - RNA, 39 nt, Artificial Sequence
  Synthetic Oligonucleotide; BTLA exon 2; Set A
aaauguucuucucuuccuuccaacuuguuugucuaucuu

SEQ ID NO: 46886 - RNA, 35 nt, Artificial Sequence
  Synthetic Oligonucleotide; BTLA exon 2; Set A
auguucuucucuuccuuccaacuuguuugucuauc

SEQ ID NO: 46887 - RNA, 30 nt, Artificial Sequence
  Synthetic Oligonucleotide; BTLA exon 2; Set A
guucuucucuuccuuccaacuuguuugucu

SEQ ID NO: 46888 - RNA, 28 nt, Artificial Sequence
  Synthetic Oligonucleotide; BTLA exon 2; Set A
uucuucucuuccuuccaacuuguuuguc

SEQ ID NO: 46889 - RNA, 32 nt, Artificial Sequence
  Synthetic Oligonucleotide; BTLA exon 2; Set A
uguucuucucuuccuuccaacuuguuugucua

SEQ ID NO: 46890 - RNA, 34 nt, Artificial Sequence
  Synthetic Oligonucleotide; BTLA exon 2; Set A
auguucuucucuuccuuccaacuuguuugucuau

SEQ ID NO: 46891 - RNA, 38 nt, Artificial Sequence
  Synthetic Oligonucleotide; BTLA exon 2; Set A
aaauguucuucucuuccuuccaacuuguuugucuaucu

SEQ ID NO: 46892 - RNA, 36 nt, Artificial Sequence
  Synthetic Oligonucleotide; BTLA exon 2; Set A
aauguucuucucuuccuuccaacuuguuugucuauc

SEQ ID NO: 46893 - RNA, 40 nt, Artificial Sequence
  Synthetic Oligonucleotide; BTLA exon 2; Set A
gaaauguucuucucuuccuuccaacuuguuugucuaucuu

SEQ ID NO: 46894 - RNA, 31 nt, Artificial Sequence
  Synthetic Oligonucleotide; BTLA exon 2; Set A
uguucuucucuuccuuccaacuuguuugucu

SEQ ID NO: 46895 - RNA, 29 nt, Artificial Sequence
  Synthetic Oligonucleotide; BTLA exon 2; Set A
guucuucucuuccuuccaacuuguuuguc

SEQ ID NO: 46896 - RNA, 33 nt, Artificial Sequence
  Synthetic Oligonucleotide; BTLA exon 2; Set A
auguucuucucuuccuuccaacuuguuugucua

SEQ ID NO: 46897 - RNA, 35 nt, Artificial Sequence
  Synthetic Oligonucleotide; BTLA exon 2; Set A
aauguucuucucuuccuuccaacuuguuugucuau

SEQ ID NO: 46898 - RNA, 39 nt, Artificial Sequence
  Synthetic Oligonucleotide; BTLA exon 2; Set A
gaaauguucuucucuuccuuccaacuuguuugucuaucu

SEQ ID NO: 46899 - RNA, 37 nt, Artificial Sequence
  Synthetic Oligonucleotide; BTLA exon 2; Set A
aaauguucuucucuuccuuccaacuuguuugucuauc

SEQ ID NO: 46900 - RNA, 26 nt, Artificial Sequence
  Synthetic Oligonucleotide; BTLA exon 2; Set A
uucuucucuuccuuccaacuuguuug

SEQ ID NO: 46901 - RNA, 30 nt, Artificial Sequence
  Synthetic Oligonucleotide; BTLA exon 2; Set A
uguucuucucuuccuuccaacuuguuuguc

SEQ ID NO: 46902 - RNA, 28 nt, Artificial Sequence
  Synthetic Oligonucleotide; BTLA exon 2; Set A
guucuucucuuccuuccaacuuguuugu

SEQ ID NO: 46903 - RNA, 32 nt, Artificial Sequence
  Synthetic Oligonucleotide; BTLA exon 2; Set A
auguucuucucuuccuuccaacuuguuugucu

SEQ ID NO: 46904 - RNA, 34 nt, Artificial Sequence
  Synthetic Oligonucleotide; BTLA exon 2; Set A
aauguucuucucuuccuuccaacuuguuugucua

SEQ ID NO: 46905 - RNA, 36 nt, Artificial Sequence
  Synthetic Oligonucleotide; BTLA exon 2; Set A
aaauguucuucucuuccuuccaacuuguuugucuau

SEQ ID NO: 46906 - RNA, 40 nt, Artificial Sequence
  Synthetic Oligonucleotide; BTLA exon 2; Set A
ugaaauguucuucucuuccuuccaacuuguuugucuaucu

SEQ ID NO: 46907 - RNA, 38 nt, Artificial Sequence
  Synthetic Oligonucleotide; BTLA exon 2; Set A
gaaauguucuucucuuccuuccaacuuguuugucuauc

SEQ ID NO: 46908 - RNA, 27 nt, Artificial Sequence
  Synthetic Oligonucleotide; BTLA exon 2; Set A
guucuucucuuccuuccaacuuguuug

SEQ ID NO: 46909 - RNA, 29 nt, Artificial Sequence
  Synthetic Oligonucleotide; BTLA exon 2; Set A
uguucuucucuuccuuccaacuuguuugu

SEQ ID NO: 46910 - RNA, 33 nt, Artificial Sequence
  Synthetic Oligonucleotide; BTLA exon 2; Set A
aauguucuucucuuccuuccaacuuguuugucu

SEQ ID NO: 46911 - RNA, 31 nt, Artificial Sequence
  Synthetic Oligonucleotide; BTLA exon 2; Set A
auguucuucucuuccuuccaacuuguuuguc

SEQ ID NO: 46912 - RNA, 35 nt, Artificial Sequence
  Synthetic Oligonucleotide; BTLA exon 2; Set A
aaauguucuucucuuccuuccaacuuguuugucua

SEQ ID NO: 46913 - RNA, 37 nt, Artificial Sequence
  Synthetic Oligonucleotide; BTLA exon 2; Set A
gaaauguucuucucuuccuuccaacuuguuugucuau

SEQ ID NO: 46914 - RNA, 39 nt, Artificial Sequence
  Synthetic Oligonucleotide; BTLA exon 2; Set A
ugaaauguucuucucuuccuuccaacuuguuugucuauc

SEQ ID NO: 46915 - RNA, 28 nt, Artificial Sequence
  Synthetic Oligonucleotide; BTLA exon 2; Set A
uguucuucucuuccuuccaacuuguuug

SEQ ID NO: 46916 - RNA, 26 nt, Artificial Sequence
  Synthetic Oligonucleotide; BTLA exon 2; Set A
guucuucucuuccuuccaacuuguuu

SEQ ID NO: 46917 - RNA, 34 nt, Artificial Sequence
  Synthetic Oligonucleotide; BTLA exon 2; Set A
aaauguucuucucuuccuuccaacuuguuugucu

SEQ ID NO: 46918 - RNA, 32 nt, Artificial Sequence
  Synthetic Oligonucleotide; BTLA exon 2; Set A
aauguucuucucuuccuuccaacuuguuuguc

SEQ ID NO: 46919 - RNA, 30 nt, Artificial Sequence
  Synthetic Oligonucleotide; BTLA exon 2; Set A
auguucuucucuuccuuccaacuuguuugu

SEQ ID NO: 46920 - RNA, 36 nt, Artificial Sequence
  Synthetic Oligonucleotide; BTLA exon 2; Set A
gaaauguucuucucuuccuuccaacuuguuugucua

SEQ ID NO: 46921 - RNA, 38 nt, Artificial Sequence
  Synthetic Oligonucleotide; BTLA exon 2; Set A
ugaaauguucuucucuuccuuccaacuuguuugucuau

SEQ ID NO: 46922 - RNA, 40 nt, Artificial Sequence
  Synthetic Oligonucleotide; BTLA exon 2; Set A
augaaauguucuucucuuccuuccaacuuguuugucuauc

SEQ ID NO: 46923 - RNA, 27 nt, Artificial Sequence
  Synthetic Oligonucleotide; BTLA exon 2; Set A
uguucuucucuuccuuccaacuuguuu

SEQ ID NO: 46924 - RNA, 29 nt, Artificial Sequence
  Synthetic Oligonucleotide; BTLA exon 2; Set A
auguucuucucuuccuuccaacuuguuug

SEQ ID NO: 46925 - RNA, 33 nt, Artificial Sequence
  Synthetic Oligonucleotide; BTLA exon 2; Set A
aaauguucuucucuuccuuccaacuuguuuguc

SEQ ID NO: 46926 - RNA, 31 nt, Artificial Sequence
  Synthetic Oligonucleotide; BTLA exon 2; Set A
aauguucuucucuuccuuccaacuuguuugu

SEQ ID NO: 46927 - RNA, 35 nt, Artificial Sequence
  Synthetic Oligonucleotide; BTLA exon 2; Set A
gaaauguucuucucuuccuuccaacuuguuugucu

SEQ ID NO: 46928 - RNA, 37 nt, Artificial Sequence
  Synthetic Oligonucleotide; BTLA exon 2; Set A
ugaaauguucuucucuuccuuccaacuuguuugucua

SEQ ID NO: 46929 - RNA, 39 nt, Artificial Sequence
  Synthetic Oligonucleotide; BTLA exon 2; Set A
augaaauguucuucucuuccuuccaacuuguuugucuau

SEQ ID NO: 46930 - RNA, 30 nt, Artificial Sequence
  Synthetic Oligonucleotide; BTLA exon 2; Set A
aauguucuucucuuccuuccaacuuguuug

SEQ ID NO: 46931 - RNA, 28 nt, Artificial Sequence
  Synthetic Oligonucleotide; BTLA exon 2; Set A
auguucuucucuuccuuccaacuuguuu

SEQ ID NO: 46932 - RNA, 32 nt, Artificial Sequence
  Synthetic Oligonucleotide; BTLA exon 2; Set A
aaauguucuucucuuccuuccaacuuguuugu

SEQ ID NO: 46933 - RNA, 34 nt, Artificial Sequence
  Synthetic Oligonucleotide; BTLA exon 2; Set A
gaaauguucuucucuuccuuccaacuuguuuguc

SEQ ID NO: 46934 - RNA, 36 nt, Artificial Sequence
  Synthetic Oligonucleotide; BTLA exon 2; Set A
ugaaauguucuucucuuccuuccaacuuguuugucu

SEQ ID NO: 46935 - RNA, 38 nt, Artificial Sequence
  Synthetic Oligonucleotide; BTLA exon 2; Set A
augaaauguucuucucuuccuuccaacuuguuugucua

SEQ ID NO: 46936 - RNA, 40 nt, Artificial Sequence
  Synthetic Oligonucleotide; BTLA exon 2; Set A
aaugaaauguucuucucuuccuuccaacuuguuugucuau

SEQ ID NO: 46937 - RNA, 31 nt, Artificial Sequence
  Synthetic Oligonucleotide; BTLA exon 2; Set A
aaauguucuucucuuccuuccaacuuguuug

SEQ ID NO: 46938 - RNA, 29 nt, Artificial Sequence
  Synthetic Oligonucleotide; BTLA exon 2; Set A
aauguucuucucuuccuuccaacuuguuu

SEQ ID NO: 46939 - RNA, 33 nt, Artificial Sequence
  Synthetic Oligonucleotide; BTLA exon 2; Set A
gaaauguucuucucuuccuuccaacuuguuugu

SEQ ID NO: 46940 - RNA, 35 nt, Artificial Sequence
  Synthetic Oligonucleotide; BTLA exon 2; Set A
ugaaauguucuucucuuccuuccaacuuguuuguc

SEQ ID NO: 46941 - RNA, 37 nt, Artificial Sequence
  Synthetic Oligonucleotide; BTLA exon 2; Set A
augaaauguucuucucuuccuuccaacuuguuugucu

SEQ ID NO: 46942 - RNA, 39 nt, Artificial Sequence
  Synthetic Oligonucleotide; BTLA exon 2; Set A
aaugaaauguucuucucuuccuuccaacuuguuugucua

SEQ ID NO: 46943 - RNA, 30 nt, Artificial Sequence
  Synthetic Oligonucleotide; BTLA exon 2; Set A
aaauguucuucucuuccuuccaacuuguuu

SEQ ID NO: 46944 - RNA, 32 nt, Artificial Sequence
  Synthetic Oligonucleotide; BTLA exon 2; Set A
gaaauguucuucucuuccuuccaacuuguuug

SEQ ID NO: 46945 - RNA, 34 nt, Artificial Sequence
  Synthetic Oligonucleotide; BTLA exon 2; Set A
ugaaauguucuucucuuccuuccaacuuguuugu

SEQ ID NO: 46946 - RNA, 38 nt, Artificial Sequence
  Synthetic Oligonucleotide; BTLA exon 2; Set A
aaugaaauguucuucucuuccuuccaacuuguuugucu

SEQ ID NO: 46947 - RNA, 36 nt, Artificial Sequence
  Synthetic Oligonucleotide; BTLA exon 2; Set A
augaaauguucuucucuuccuuccaacuuguuuguc

SEQ ID NO: 46948 - RNA, 40 nt, Artificial Sequence
  Synthetic Oligonucleotide; BTLA exon 2; Set A
aaaugaaauguucuucucuuccuuccaacuuguuugucua

SEQ ID NO: 46949 - RNA, 31 nt, Artificial Sequence
  Synthetic Oligonucleotide; BTLA exon 2; Set A
gaaauguucuucucuuccuuccaacuuguuu

SEQ ID NO: 46950 - RNA, 33 nt, Artificial Sequence
  Synthetic Oligonucleotide; BTLA exon 2; Set A
ugaaauguucuucucuuccuuccaacuuguuug

SEQ ID NO: 46951 - RNA, 37 nt, Artificial Sequence
  Synthetic Oligonucleotide; BTLA exon 2; Set A
aaugaaauguucuucucuuccuuccaacuuguuuguc

SEQ ID NO: 46952 - RNA, 35 nt, Artificial Sequence
  Synthetic Oligonucleotide; BTLA exon 2; Set A
augaaauguucuucucuuccuuccaacuuguuugu

SEQ ID NO: 46953 - RNA, 39 nt, Artificial Sequence
  Synthetic Oligonucleotide; BTLA exon 2; Set A
aaaugaaauguucuucucuuccuuccaacuuguuugucu

SEQ ID NO: 46954 - RNA, 32 nt, Artificial Sequence
  Synthetic Oligonucleotide; BTLA exon 2; Set A
ugaaauguucuucucuuccuuccaacuuguuu

SEQ ID NO: 46955 - RNA, 34 nt, Artificial Sequence
  Synthetic Oligonucleotide; BTLA exon 2; Set A
augaaauguucuucucuuccuuccaacuuguuug

SEQ ID NO: 46956 - RNA, 36 nt, Artificial Sequence
  Synthetic Oligonucleotide; BTLA exon 2; Set A
aaugaaauguucuucucuuccuuccaacuuguuugu

SEQ ID NO: 46957 - RNA, 38 nt, Artificial Sequence
  Synthetic Oligonucleotide; BTLA exon 2; Set A
aaaugaaauguucuucucuuccuuccaacuuguuuguc

SEQ ID NO: 46958 - RNA, 35 nt, Artificial Sequence
  Synthetic Oligonucleotide; BTLA exon 2; Set A
aaugaaauguucuucucuuccuuccaacuuguuug

SEQ ID NO: 46959 - RNA, 33 nt, Artificial Sequence
  Synthetic Oligonucleotide; BTLA exon 2; Set A
augaaauguucuucucuuccuuccaacuuguuu

SEQ ID NO: 46960 - RNA, 37 nt, Artificial Sequence
  Synthetic Oligonucleotide; BTLA exon 2; Set A
aaaugaaauguucuucucuuccuuccaacuuguuugu

SEQ ID NO: 46961 - RNA, 34 nt, Artificial Sequence
  Synthetic Oligonucleotide; BTLA exon 2; Set A
aaugaaauguucuucucuuccuuccaacuuguuu

SEQ ID NO: 46962 - RNA, 36 nt, Artificial Sequence
  Synthetic Oligonucleotide; BTLA exon 2; Set A
aaaugaaauguucuucucuuccuuccaacuuguuug

SEQ ID NO: 46963 - RNA, 35 nt, Artificial Sequence
  Synthetic Oligonucleotide; BTLA exon 2; Set A
aaaugaaauguucuucucuuccuuccaacuuguuu

SEQ ID NO: 46964 - RNA, 15 nt, Artificial Sequence
  Synthetic Oligonucleotide; BTLA exon 2; Set C
aaaugaaauguucuu

SEQ ID NO: 46965 - RNA, 20 nt, Artificial Sequence
  Synthetic Oligonucleotide; BTLA exon 2; Set C
aaugaaaaaugaaauguucu

SEQ ID NO: 46966 - RNA, 21 nt, Artificial Sequence
  Synthetic Oligonucleotide; BTLA exon 2; Set C
gaaugaaaaaugaaauguucu

SEQ ID NO: 46967 - RNA, 19 nt, Artificial Sequence
  Synthetic Oligonucleotide; BTLA exon 2; Set C
aaugaaaaaugaaauguuc

SEQ ID NO: 46968 - RNA, 18 nt, Artificial Sequence
  Synthetic Oligonucleotide; BTLA exon 2; Set C
aaugaaaaaugaaauguu

SEQ ID NO: 46969 - RNA, 20 nt, Artificial Sequence
  Synthetic Oligonucleotide; BTLA exon 2; Set C
gaaugaaaaaugaaauguuc

SEQ ID NO: 46970 - RNA, 17 nt, Artificial Sequence
  Synthetic Oligonucleotide; BTLA exon 2; Set C
aaugaaaaaugaaaugu

SEQ ID NO: 46971 - RNA, 19 nt, Artificial Sequence
  Synthetic Oligonucleotide; BTLA exon 2; Set C
gaaugaaaaaugaaauguu

SEQ ID NO: 46972 - RNA, 18 nt, Artificial Sequence
  Synthetic Oligonucleotide; BTLA exon 2; Set C
gaaugaaaaaugaaaugu

SEQ ID NO: 46973 - RNA, 16 nt, Artificial Sequence
  Synthetic Oligonucleotide; BTLA exon 2; Set C
aaugaaaaaugaaaug

SEQ ID NO: 46974 - RNA, 17 nt, Artificial Sequence
  Synthetic Oligonucleotide; BTLA exon 2; Set C
gaaugaaaaaugaaaug

SEQ ID NO: 46975 - RNA, 15 nt, Artificial Sequence
  Synthetic Oligonucleotide; BTLA exon 2; Set C
aaugaaaaaugaaau

SEQ ID NO: 46976 - RNA, 16 nt, Artificial Sequence
  Synthetic Oligonucleotide; BTLA exon 2; Set C
gaaugaaaaaugaaau

SEQ ID NO: 46977 - RNA, 15 nt, Artificial Sequence
  Synthetic Oligonucleotide; BTLA exon 2; Set C
gaaugaaaaaugaaa

SEQ ID NO: 46978 - RNA, 34 nt, Artificial Sequence
  Synthetic Oligonucleotide; BTLA exon 2; Set C
gguucaaaauguagaaugaaaaaugaaauguucu

SEQ ID NO: 46979 - RNA, 31 nt, Artificial Sequence
  Synthetic Oligonucleotide; BTLA exon 2; Set C
guucaaaauguagaaugaaaaaugaaauguu

SEQ ID NO: 46980 - RNA, 35 nt, Artificial Sequence
  Synthetic Oligonucleotide; BTLA exon 2; Set C
ugguucaaaauguagaaugaaaaaugaaauguucu

SEQ ID NO: 46981 - RNA, 33 nt, Artificial Sequence
  Synthetic Oligonucleotide; BTLA exon 2; Set C
gguucaaaauguagaaugaaaaaugaaauguuc

SEQ ID NO: 46982 - RNA, 30 nt, Artificial Sequence
  Synthetic Oligonucleotide; BTLA exon 2; Set C
guucaaaauguagaaugaaaaaugaaaugu

SEQ ID NO: 46983 - RNA, 32 nt, Artificial Sequence
  Synthetic Oligonucleotide; BTLA exon 2; Set C
gguucaaaauguagaaugaaaaaugaaauguu

SEQ ID NO: 46984 - RNA, 36 nt, Artificial Sequence
  Synthetic Oligonucleotide; BTLA exon 2; Set C
cugguucaaaauguagaaugaaaaaugaaauguucu

SEQ ID NO: 46985 - RNA, 34 nt, Artificial Sequence
  Synthetic Oligonucleotide; BTLA exon 2; Set C
ugguucaaaauguagaaugaaaaaugaaauguuc

SEQ ID NO: 46986 - RNA, 31 nt, Artificial Sequence
  Synthetic Oligonucleotide; BTLA exon 2; Set C
gguucaaaauguagaaugaaaaaugaaaugu

SEQ ID NO: 46987 - RNA, 33 nt, Artificial Sequence
  Synthetic Oligonucleotide; BTLA exon 2; Set C
ugguucaaaauguagaaugaaaaaugaaauguu

SEQ ID NO: 46988 - RNA, 37 nt, Artificial Sequence
  Synthetic Oligonucleotide; BTLA exon 2; Set C
acugguucaaaauguagaaugaaaaaugaaauguucu

SEQ ID NO: 46989 - RNA, 35 nt, Artificial Sequence
  Synthetic Oligonucleotide; BTLA exon 2; Set C
cugguucaaaauguagaaugaaaaaugaaauguuc

SEQ ID NO: 46990 - RNA, 32 nt, Artificial Sequence
  Synthetic Oligonucleotide; BTLA exon 2; Set C
ugguucaaaauguagaaugaaaaaugaaaugu

SEQ ID NO: 46991 - RNA, 34 nt, Artificial Sequence
  Synthetic Oligonucleotide; BTLA exon 2; Set C
cugguucaaaauguagaaugaaaaaugaaauguu

SEQ ID NO: 46992 - RNA, 30 nt, Artificial Sequence
  Synthetic Oligonucleotide; BTLA exon 2; Set C
gguucaaaauguagaaugaaaaaugaaaug

SEQ ID NO: 46993 - RNA, 36 nt, Artificial Sequence
  Synthetic Oligonucleotide; BTLA exon 2; Set C
acugguucaaaauguagaaugaaaaaugaaauguuc

SEQ ID NO: 46994 - RNA, 38 nt, Artificial Sequence
  Synthetic Oligonucleotide; BTLA exon 2; Set C
cacugguucaaaauguagaaugaaaaaugaaauguucu

SEQ ID NO: 46995 - RNA, 33 nt, Artificial Sequence
  Synthetic Oligonucleotide; BTLA exon 2; Set C
cugguucaaaauguagaaugaaaaaugaaaugu

SEQ ID NO: 46996 - RNA, 35 nt, Artificial Sequence
  Synthetic Oligonucleotide; BTLA exon 2; Set C
acugguucaaaauguagaaugaaaaaugaaauguu

SEQ ID NO: 46997 - RNA, 31 nt, Artificial Sequence
  Synthetic Oligonucleotide; BTLA exon 2; Set C
ugguucaaaauguagaaugaaaaaugaaaug

SEQ ID NO: 46998 - RNA, 29 nt, Artificial Sequence
  Synthetic Oligonucleotide; BTLA exon 2; Set C
gguucaaaauguagaaugaaaaaugaaau

SEQ ID NO: 46999 - RNA, 37 nt, Artificial Sequence
  Synthetic Oligonucleotide; BTLA exon 2; Set C
cacugguucaaaauguagaaugaaaaaugaaauguuc

SEQ ID NO: 47000 - RNA, 34 nt, Artificial Sequence
  Synthetic Oligonucleotide; BTLA exon 2; Set C
acugguucaaaauguagaaugaaaaaugaaaugu

SEQ ID NO: 47001 - RNA, 36 nt, Artificial Sequence
  Synthetic Oligonucleotide; BTLA exon 2; Set C
cacugguucaaaauguagaaugaaaaaugaaauguu

SEQ ID NO: 47002 - RNA, 32 nt, Artificial Sequence
  Synthetic Oligonucleotide; BTLA exon 2; Set C
cugguucaaaauguagaaugaaaaaugaaaug

SEQ ID NO: 47003 - RNA, 30 nt, Artificial Sequence
  Synthetic Oligonucleotide; BTLA exon 2; Set C
ugguucaaaauguagaaugaaaaaugaaau

SEQ ID NO: 47004 - RNA, 28 nt, Artificial Sequence
  Synthetic Oligonucleotide; BTLA exon 2; Set C
gguucaaaauguagaaugaaaaaugaaa

SEQ ID NO: 47005 - RNA, 35 nt, Artificial Sequence
  Synthetic Oligonucleotide; BTLA exon 2; Set C
cacugguucaaaauguagaaugaaaaaugaaaugu

SEQ ID NO: 47006 - RNA, 33 nt, Artificial Sequence
  Synthetic Oligonucleotide; BTLA exon 2; Set C
acugguucaaaauguagaaugaaaaaugaaaug

SEQ ID NO: 47007 - RNA, 31 nt, Artificial Sequence
  Synthetic Oligonucleotide; BTLA exon 2; Set C
cugguucaaaauguagaaugaaaaaugaaau

SEQ ID NO: 47008 - RNA, 29 nt, Artificial Sequence
  Synthetic Oligonucleotide; BTLA exon 2; Set C
ugguucaaaauguagaaugaaaaaugaaa

SEQ ID NO: 47009 - RNA, 27 nt, Artificial Sequence
  Synthetic Oligonucleotide; BTLA exon 2; Set C
gguucaaaauguagaaugaaaaaugaa

SEQ ID NO: 47010 - RNA, 32 nt, Artificial Sequence
  Synthetic Oligonucleotide; BTLA exon 2; Set C
acugguucaaaauguagaaugaaaaaugaaau

SEQ ID NO: 47011 - RNA, 30 nt, Artificial Sequence
  Synthetic Oligonucleotide; BTLA exon 2; Set C
cugguucaaaauguagaaugaaaaaugaaa

SEQ ID NO: 47012 - RNA, 34 nt, Artificial Sequence
  Synthetic Oligonucleotide; BTLA exon 2; Set C
cacugguucaaaauguagaaugaaaaaugaaaug

SEQ ID NO: 47013 - RNA, 28 nt, Artificial Sequence
  Synthetic Oligonucleotide; BTLA exon 2; Set C
ugguucaaaauguagaaugaaaaaugaa

SEQ ID NO: 47014 - RNA, 26 nt, Artificial Sequence
  Synthetic Oligonucleotide; BTLA exon 2; Set C
gguucaaaauguagaaugaaaaauga

SEQ ID NO: 47015 - RNA, 31 nt, Artificial Sequence
  Synthetic Oligonucleotide; BTLA exon 2; Set C
acugguucaaaauguagaaugaaaaaugaaa

SEQ ID NO: 47016 - RNA, 33 nt, Artificial Sequence
  Synthetic Oligonucleotide; BTLA exon 2; Set C
cacugguucaaaauguagaaugaaaaaugaaau

SEQ ID NO: 47017 - RNA, 29 nt, Artificial Sequence
  Synthetic Oligonucleotide; BTLA exon 2; Set C
cugguucaaaauguagaaugaaaaaugaa

SEQ ID NO: 47018 - RNA, 27 nt, Artificial Sequence
  Synthetic Oligonucleotide; BTLA exon 2; Set C
ugguucaaaauguagaaugaaaaauga

SEQ ID NO: 47019 - RNA, 32 nt, Artificial Sequence
  Synthetic Oligonucleotide; BTLA exon 2; Set C
cacugguucaaaauguagaaugaaaaaugaaa

SEQ ID NO: 47020 - RNA, 30 nt, Artificial Sequence
  Synthetic Oligonucleotide; BTLA exon 2; Set C
acugguucaaaauguagaaugaaaaaugaa

SEQ ID NO: 47021 - RNA, 28 nt, Artificial Sequence
  Synthetic Oligonucleotide; BTLA exon 2; Set C
cugguucaaaauguagaaugaaaaauga

SEQ ID NO: 47022 - RNA, 26 nt, Artificial Sequence
  Synthetic Oligonucleotide; BTLA exon 2; Set C
ugguucaaaauguagaaugaaaaaug

SEQ ID NO: 47023 - RNA, 31 nt, Artificial Sequence
  Synthetic Oligonucleotide; BTLA exon 2; Set C
cacugguucaaaauguagaaugaaaaaugaa

SEQ ID NO: 47024 - RNA, 29 nt, Artificial Sequence
  Synthetic Oligonucleotide; BTLA exon 2; Set C
acugguucaaaauguagaaugaaaaauga

SEQ ID NO: 47025 - RNA, 27 nt, Artificial Sequence
  Synthetic Oligonucleotide; BTLA exon 2; Set C
cugguucaaaauguagaaugaaaaaug

SEQ ID NO: 47026 - RNA, 25 nt, Artificial Sequence
  Synthetic Oligonucleotide; BTLA exon 2; Set C
ugguucaaaauguagaaugaaaaau

SEQ ID NO: 47027 - RNA, 30 nt, Artificial Sequence
  Synthetic Oligonucleotide; BTLA exon 2; Set C
cacugguucaaaauguagaaugaaaaauga

SEQ ID NO: 47028 - RNA, 28 nt, Artificial Sequence
  Synthetic Oligonucleotide; BTLA exon 2; Set C
acugguucaaaauguagaaugaaaaaug

SEQ ID NO: 47029 - RNA, 26 nt, Artificial Sequence
  Synthetic Oligonucleotide; BTLA exon 2; Set C
cugguucaaaauguagaaugaaaaau

SEQ ID NO: 47030 - RNA, 27 nt, Artificial Sequence
  Synthetic Oligonucleotide; BTLA exon 2; Set C
acugguucaaaauguagaaugaaaaau

SEQ ID NO: 47031 - RNA, 29 nt, Artificial Sequence
  Synthetic Oligonucleotide; BTLA exon 2; Set C
cacugguucaaaauguagaaugaaaaaug

SEQ ID NO: 47032 - RNA, 28 nt, Artificial Sequence
  Synthetic Oligonucleotide; BTLA exon 2; Set C
cacugguucaaaauguagaaugaaaaau

SEQ ID NO: 47033 - RNA, 17 nt, Artificial Sequence
  Synthetic Oligonucleotide; BTLA exon 2; Set C
gguucaaaauguagaau

SEQ ID NO: 47034 - RNA, 40 nt, Artificial Sequence
  Synthetic Oligonucleotide; BTLA exon 2; Set C
uuaggaagcacugguucaaaauguagaaugaaaaaugaaa

SEQ ID NO: 47035 - RNA, 18 nt, Artificial Sequence
  Synthetic Oligonucleotide; BTLA exon 2; Set C
ugguucaaaauguagaau

SEQ ID NO: 47036 - RNA, 39 nt, Artificial Sequence
  Synthetic Oligonucleotide; BTLA exon 2; Set A
uuaggaagcacugguucaaaauguagaaugaaaaaugaa

SEQ ID NO: 47037 - RNA, 17 nt, Artificial Sequence
  Synthetic Oligonucleotide; BTLA exon 2; Set C
ugguucaaaauguagaa

SEQ ID NO: 47038 - RNA, 19 nt, Artificial Sequence
  Synthetic Oligonucleotide; BTLA exon 2; Set C
cugguucaaaauguagaau

SEQ ID NO: 47039 - RNA, 40 nt, Artificial Sequence
  Synthetic Oligonucleotide; BTLA exon 2; Set A
auuaggaagcacugguucaaaauguagaaugaaaaaugaa

SEQ ID NO: 47040 - RNA, 38 nt, Artificial Sequence
  Synthetic Oligonucleotide; BTLA exon 2; Set A
uuaggaagcacugguucaaaauguagaaugaaaaauga

SEQ ID NO: 47041 - RNA, 18 nt, Artificial Sequence
  Synthetic Oligonucleotide; BTLA exon 2; Set C
cugguucaaaauguagaa

SEQ ID NO: 47042 - RNA, 20 nt, Artificial Sequence
  Synthetic Oligonucleotide; BTLA exon 2; Set C
acugguucaaaauguagaau

SEQ ID NO: 47043 - RNA, 39 nt, Artificial Sequence
  Synthetic Oligonucleotide; BTLA exon 2; Set A
auuaggaagcacugguucaaaauguagaaugaaaaauga

SEQ ID NO: 47044 - RNA, 37 nt, Artificial Sequence
  Synthetic Oligonucleotide; BTLA exon 2; Set C
uuaggaagcacugguucaaaauguagaaugaaaaaug

SEQ ID NO: 47045 - RNA, 19 nt, Artificial Sequence
  Synthetic Oligonucleotide; BTLA exon 2; Set C
acugguucaaaauguagaa

SEQ ID NO: 47046 - RNA, 21 nt, Artificial Sequence
  Synthetic Oligonucleotide; BTLA exon 2; Set C
cacugguucaaaauguagaau

SEQ ID NO: 47047 - RNA, 36 nt, Artificial Sequence
  Synthetic Oligonucleotide; BTLA exon 2; Set C
uuaggaagcacugguucaaaauguagaaugaaaaau

SEQ ID NO: 47048 - RNA, 38 nt, Artificial Sequence
  Synthetic Oligonucleotide; BTLA exon 2; Set C
auuaggaagcacugguucaaaauguagaaugaaaaaug

SEQ ID NO: 47049 - RNA, 20 nt, Artificial Sequence
  Synthetic Oligonucleotide; BTLA exon 2; Set C
cacugguucaaaauguagaa

SEQ ID NO: 47050 - RNA, 37 nt, Artificial Sequence
  Synthetic Oligonucleotide; BTLA exon 2; Set C
auuaggaagcacugguucaaaauguagaaugaaaaau

SEQ ID NO: 47051 - RNA, 29 nt, Artificial Sequence
  Synthetic Oligonucleotide; BTLA exon 2; Set C
uuaggaagcacugguucaaaauguagaau

SEQ ID NO: 47052 - RNA, 28 nt, Artificial Sequence
  Synthetic Oligonucleotide; BTLA exon 2; Set C
uuaggaagcacugguucaaaauguagaa

SEQ ID NO: 47053 - RNA, 30 nt, Artificial Sequence
  Synthetic Oligonucleotide; BTLA exon 2; Set C
auuaggaagcacugguucaaaauguagaau

SEQ ID NO: 47054 - RNA, 29 nt, Artificial Sequence
  Synthetic Oligonucleotide; BTLA exon 2; Set C
auuaggaagcacugguucaaaauguagaa

SEQ ID NO: 47055 - RNA, 16 nt, Artificial Sequence
  Synthetic Oligonucleotide; BTLA exon 2; Set C
uuaggaagcacugguu

SEQ ID NO: 47056 - RNA, 15 nt, Artificial Sequence
  Synthetic Oligonucleotide; BTLA exon 2; Set C
uuaggaagcacuggu

SEQ ID NO: 47057 - RNA, 17 nt, Artificial Sequence
  Synthetic Oligonucleotide; BTLA exon 2; Set C
auuaggaagcacugguu

SEQ ID NO: 47058 - RNA, 16 nt, Artificial Sequence
  Synthetic Oligonucleotide; BTLA exon 2; Set C
auuaggaagcacuggu

SEQ ID NO: 47059 - RNA, 23 nt, Artificial Sequence
  Synthetic Oligonucleotide; BTLA exon 2; Set C
auugucauuaggaagcacugguu

SEQ ID NO: 47060 - RNA, 22 nt, Artificial Sequence
  Synthetic Oligonucleotide; BTLA exon 2; Set C
auugucauuaggaagcacuggu

SEQ ID NO: 47061 - RNA, 21 nt, Artificial Sequence
  Synthetic Oligonucleotide; BTLA exon 2; Set C
auugucauuaggaagcacugg

SEQ ID NO: 47062 - RNA, 23 nt, Artificial Sequence
  Synthetic Oligonucleotide; BTLA exon 2; Set A
cauugucauuaggaagcacuggu

SEQ ID NO: 47063 - RNA, 20 nt, Artificial Sequence
  Synthetic Oligonucleotide; BTLA exon 2; Set C
auugucauuaggaagcacug

SEQ ID NO: 47064 - RNA, 22 nt, Artificial Sequence
  Synthetic Oligonucleotide; BTLA exon 2; Set C
cauugucauuaggaagcacugg

SEQ ID NO: 47065 - RNA, 24 nt, Artificial Sequence
  Synthetic Oligonucleotide; BTLA exon 2; Set A
ccauugucauuaggaagcacuggu

SEQ ID NO: 47066 - RNA, 19 nt, Artificial Sequence
  Synthetic Oligonucleotide; BTLA exon 2; Set C
auugucauuaggaagcacu

SEQ ID NO: 47067 - RNA, 21 nt, Artificial Sequence
  Synthetic Oligonucleotide; BTLA exon 2; Set C
cauugucauuaggaagcacug

SEQ ID NO: 47068 - RNA, 23 nt, Artificial Sequence
  Synthetic Oligonucleotide; BTLA exon 2; Set A
ccauugucauuaggaagcacugg

SEQ ID NO: 47069 - RNA, 20 nt, Artificial Sequence
  Synthetic Oligonucleotide; BTLA exon 2; Set C
cauugucauuaggaagcacu

SEQ ID NO: 47070 - RNA, 22 nt, Artificial Sequence
  Synthetic Oligonucleotide; BTLA exon 2; Set C
ccauugucauuaggaagcacug

SEQ ID NO: 47071 - RNA, 18 nt, Artificial Sequence
  Synthetic Oligonucleotide; BTLA exon 2; Set C
auugucauuaggaagcac

SEQ ID NO: 47072 - RNA, 21 nt, Artificial Sequence
  Synthetic Oligonucleotide; BTLA exon 2; Set C
ccauugucauuaggaagcacu

SEQ ID NO: 47073 - RNA, 19 nt, Artificial Sequence
  Synthetic Oligonucleotide; BTLA exon 2; Set C
cauugucauuaggaagcac

SEQ ID NO: 47074 - RNA, 20 nt, Artificial Sequence
  Synthetic Oligonucleotide; BTLA exon 2; Set C
ccauugucauuaggaagcac

SEQ ID NO: 47075 - RNA, 31 nt, Artificial Sequence
  Synthetic Oligonucleotide; BTLA exon 2; Set C
uaugacccauugucauuaggaagcacugguu

SEQ ID NO: 47076 - RNA, 30 nt, Artificial Sequence
  Synthetic Oligonucleotide; BTLA exon 2; Set C
uaugacccauugucauuaggaagcacuggu

SEQ ID NO: 47077 - RNA, 32 nt, Artificial Sequence
  Synthetic Oligonucleotide; BTLA exon 2; Set C
guaugacccauugucauuaggaagcacugguu

SEQ ID NO: 47078 - RNA, 29 nt, Artificial Sequence
  Synthetic Oligonucleotide; BTLA exon 2; Set A
uaugacccauugucauuaggaagcacugg

SEQ ID NO: 47079 - RNA, 31 nt, Artificial Sequence
  Synthetic Oligonucleotide; BTLA exon 2; Set C
guaugacccauugucauuaggaagcacuggu

SEQ ID NO: 47080 - RNA, 33 nt, Artificial Sequence
  Synthetic Oligonucleotide; BTLA exon 2; Set C
gguaugacccauugucauuaggaagcacugguu

SEQ ID NO: 47081 - RNA, 30 nt, Artificial Sequence
  Synthetic Oligonucleotide; BTLA exon 2; Set C
guaugacccauugucauuaggaagcacugg

SEQ ID NO: 47082 - RNA, 28 nt, Artificial Sequence
  Synthetic Oligonucleotide; BTLA exon 2; Set A
uaugacccauugucauuaggaagcacug

SEQ ID NO: 47083 - RNA, 32 nt, Artificial Sequence
  Synthetic Oligonucleotide; BTLA exon 2; Set C
gguaugacccauugucauuaggaagcacuggu

SEQ ID NO: 47084 - RNA, 27 nt, Artificial Sequence
  Synthetic Oligonucleotide; BTLA exon 2; Set A
uaugacccauugucauuaggaagcacu

SEQ ID NO: 47085 - RNA, 31 nt, Artificial Sequence
  Synthetic Oligonucleotide; BTLA exon 2; Set C
gguaugacccauugucauuaggaagcacugg

SEQ ID NO: 47086 - RNA, 29 nt, Artificial Sequence
  Synthetic Oligonucleotide; BTLA exon 2; Set A
guaugacccauugucauuaggaagcacug

SEQ ID NO: 47087 - RNA, 28 nt, Artificial Sequence
  Synthetic Oligonucleotide; BTLA exon 2; Set A
guaugacccauugucauuaggaagcacu

SEQ ID NO: 47088 - RNA, 30 nt, Artificial Sequence
  Synthetic Oligonucleotide; BTLA exon 2; Set C
gguaugacccauugucauuaggaagcacug

SEQ ID NO: 47089 - RNA, 26 nt, Artificial Sequence
  Synthetic Oligonucleotide; BTLA exon 2; Set A
uaugacccauugucauuaggaagcac

SEQ ID NO: 47090 - RNA, 29 nt, Artificial Sequence
  Synthetic Oligonucleotide; BTLA exon 2; Set C
gguaugacccauugucauuaggaagcacu

SEQ ID NO: 47091 - RNA, 27 nt, Artificial Sequence
  Synthetic Oligonucleotide; BTLA exon 2; Set A
guaugacccauugucauuaggaagcac

SEQ ID NO: 47092 - RNA, 28 nt, Artificial Sequence
  Synthetic Oligonucleotide; BTLA exon 2; Set A
gguaugacccauugucauuaggaagcac

SEQ ID NO: 47093 - RNA, 40 nt, Artificial Sequence
  Synthetic Oligonucleotide; BTLA exon 2; Set C
gaacagcgguaugacccauugucauuaggaagcacugguu

SEQ ID NO: 47094 - RNA, 39 nt, Artificial Sequence
  Synthetic Oligonucleotide; BTLA exon 2; Set C
gaacagcgguaugacccauugucauuaggaagcacuggu

SEQ ID NO: 47095 - RNA, 38 nt, Artificial Sequence
  Synthetic Oligonucleotide; BTLA exon 2; Set C
gaacagcgguaugacccauugucauuaggaagcacugg

SEQ ID NO: 47096 - RNA, 40 nt, Artificial Sequence
  Synthetic Oligonucleotide; BTLA exon 2; Set C
agaacagcgguaugacccauugucauuaggaagcacuggu

SEQ ID NO: 47097 - RNA, 37 nt, Artificial Sequence
  Synthetic Oligonucleotide; BTLA exon 2; Set C
gaacagcgguaugacccauugucauuaggaagcacug

SEQ ID NO: 47098 - RNA, 39 nt, Artificial Sequence
  Synthetic Oligonucleotide; BTLA exon 2; Set C
agaacagcgguaugacccauugucauuaggaagcacugg

SEQ ID NO: 47099 - RNA, 36 nt, Artificial Sequence
  Synthetic Oligonucleotide; BTLA exon 2; Set C
gaacagcgguaugacccauugucauuaggaagcacu

SEQ ID NO: 47100 - RNA, 38 nt, Artificial Sequence
  Synthetic Oligonucleotide; BTLA exon 2; Set C
agaacagcgguaugacccauugucauuaggaagcacug

SEQ ID NO: 47101 - RNA, 40 nt, Artificial Sequence
  Synthetic Oligonucleotide; BTLA exon 2; Set C
cagaacagcgguaugacccauugucauuaggaagcacugg

SEQ ID NO: 47102 - RNA, 18 nt, Artificial Sequence
  Synthetic Oligonucleotide; BTLA exon 2; Set C
uaugacccauugucauua

SEQ ID NO: 47103 - RNA, 37 nt, Artificial Sequence
  Synthetic Oligonucleotide; BTLA exon 2; Set C
agaacagcgguaugacccauugucauuaggaagcacu

SEQ ID NO: 47104 - RNA, 39 nt, Artificial Sequence
  Synthetic Oligonucleotide; BTLA exon 2; Set C
cagaacagcgguaugacccauugucauuaggaagcacug

SEQ ID NO: 47105 - RNA, 35 nt, Artificial Sequence
  Synthetic Oligonucleotide; BTLA exon 2; Set C
gaacagcgguaugacccauugucauuaggaagcac

SEQ ID NO: 47106 - RNA, 19 nt, Artificial Sequence
  Synthetic Oligonucleotide; BTLA exon 2; Set C
guaugacccauugucauua

SEQ ID NO: 47107 - RNA, 17 nt, Artificial Sequence
  Synthetic Oligonucleotide; BTLA exon 2; Set C
uaugacccauugucauu

SEQ ID NO: 47108 - RNA, 38 nt, Artificial Sequence
  Synthetic Oligonucleotide; BTLA exon 2; Set C
cagaacagcgguaugacccauugucauuaggaagcacu

SEQ ID NO: 47109 - RNA, 40 nt, Artificial Sequence
  Synthetic Oligonucleotide; BTLA exon 2; Set C
gcagaacagcgguaugacccauugucauuaggaagcacug

SEQ ID NO: 47110 - RNA, 36 nt, Artificial Sequence
  Synthetic Oligonucleotide; BTLA exon 2; Set C
agaacagcgguaugacccauugucauuaggaagcac

SEQ ID NO: 47111 - RNA, 20 nt, Artificial Sequence
  Synthetic Oligonucleotide; BTLA exon 2; Set C
gguaugacccauugucauua

SEQ ID NO: 47112 - RNA, 18 nt, Artificial Sequence
  Synthetic Oligonucleotide; BTLA exon 2; Set C
guaugacccauugucauu

SEQ ID NO: 47113 - RNA, 39 nt, Artificial Sequence
  Synthetic Oligonucleotide; BTLA exon 2; Set C
gcagaacagcgguaugacccauugucauuaggaagcacu

SEQ ID NO: 47114 - RNA, 37 nt, Artificial Sequence
  Synthetic Oligonucleotide; BTLA exon 2; Set C
cagaacagcgguaugacccauugucauuaggaagcac

SEQ ID NO: 47115 - RNA, 19 nt, Artificial Sequence
  Synthetic Oligonucleotide; BTLA exon 2; Set C
gguaugacccauugucauu

SEQ ID NO: 47116 - RNA, 40 nt, Artificial Sequence
  Synthetic Oligonucleotide; BTLA exon 2; Set C
ugcagaacagcgguaugacccauugucauuaggaagcacu

SEQ ID NO: 47117 - RNA, 38 nt, Artificial Sequence
  Synthetic Oligonucleotide; BTLA exon 2; Set C
gcagaacagcgguaugacccauugucauuaggaagcac

SEQ ID NO: 47118 - RNA, 39 nt, Artificial Sequence
  Synthetic Oligonucleotide; BTLA exon 2; Set C
ugcagaacagcgguaugacccauugucauuaggaagcac

SEQ ID NO: 47119 - RNA, 40 nt, Artificial Sequence
  Synthetic Oligonucleotide; BTLA exon 2; Set C
uugcagaacagcgguaugacccauugucauuaggaagcac

SEQ ID NO: 47120 - RNA, 28 nt, Artificial Sequence
  Synthetic Oligonucleotide; BTLA exon 2; Set B
gaacagcgguaugacccauugucauuag

SEQ ID NO: 47121 - RNA, 27 nt, Artificial Sequence
  Synthetic Oligonucleotide; BTLA exon 2; Set B
gaacagcgguaugacccauugucauua

SEQ ID NO: 47122 - RNA, 29 nt, Artificial Sequence
  Synthetic Oligonucleotide; BTLA exon 2; Set B
agaacagcgguaugacccauugucauuag

SEQ ID NO: 47123 - RNA, 28 nt, Artificial Sequence
  Synthetic Oligonucleotide; BTLA exon 2; Set B
agaacagcgguaugacccauugucauua

SEQ ID NO: 47124 - RNA, 26 nt, Artificial Sequence
  Synthetic Oligonucleotide; BTLA exon 2; Set B
gaacagcgguaugacccauugucauu

SEQ ID NO: 47125 - RNA, 29 nt, Artificial Sequence
  Synthetic Oligonucleotide; BTLA exon 2; Set C
cagaacagcgguaugacccauugucauua

SEQ ID NO: 47126 - RNA, 27 nt, Artificial Sequence
  Synthetic Oligonucleotide; BTLA exon 2; Set B
agaacagcgguaugacccauugucauu

SEQ ID NO: 47127 - RNA, 30 nt, Artificial Sequence
  Synthetic Oligonucleotide; BTLA exon 2; Set C
gcagaacagcgguaugacccauugucauua

SEQ ID NO: 47128 - RNA, 28 nt, Artificial Sequence
  Synthetic Oligonucleotide; BTLA exon 2; Set B
cagaacagcgguaugacccauugucauu

SEQ ID NO: 47129 - RNA, 31 nt, Artificial Sequence
  Synthetic Oligonucleotide; BTLA exon 2; Set C
ugcagaacagcgguaugacccauugucauua

SEQ ID NO: 47130 - RNA, 29 nt, Artificial Sequence
  Synthetic Oligonucleotide; BTLA exon 2; Set C
gcagaacagcgguaugacccauugucauu

SEQ ID NO: 47131 - RNA, 33 nt, Artificial Sequence
  Synthetic Oligonucleotide; BTLA exon 2; Set C
uugcagaacagcgguaugacccauugucauuag

SEQ ID NO: 47132 - RNA, 35 nt, Artificial Sequence
  Synthetic Oligonucleotide; BTLA exon 2; Set C
uuugcagaacagcgguaugacccauugucauuagg

SEQ ID NO: 47133 - RNA, 32 nt, Artificial Sequence
  Synthetic Oligonucleotide; BTLA exon 2; Set C
uugcagaacagcgguaugacccauugucauua

SEQ ID NO: 47134 - RNA, 30 nt, Artificial Sequence
  Synthetic Oligonucleotide; BTLA exon 2; Set C
ugcagaacagcgguaugacccauugucauu

SEQ ID NO: 47135 - RNA, 34 nt, Artificial Sequence
  Synthetic Oligonucleotide; BTLA exon 2; Set C
uuugcagaacagcgguaugacccauugucauuag

SEQ ID NO: 47136 - RNA, 36 nt, Artificial Sequence
  Synthetic Oligonucleotide; BTLA exon 2; Set C
auuugcagaacagcgguaugacccauugucauuagg

SEQ ID NO: 47137 - RNA, 33 nt, Artificial Sequence
  Synthetic Oligonucleotide; BTLA exon 2; Set C
uuugcagaacagcgguaugacccauugucauua

SEQ ID NO: 47138 - RNA, 31 nt, Artificial Sequence
  Synthetic Oligonucleotide; BTLA exon 2; Set C
uugcagaacagcgguaugacccauugucauu

SEQ ID NO: 47139 - RNA, 35 nt, Artificial Sequence
  Synthetic Oligonucleotide; BTLA exon 2; Set C
auuugcagaacagcgguaugacccauugucauuag

SEQ ID NO: 47140 - RNA, 37 nt, Artificial Sequence
  Synthetic Oligonucleotide; BTLA exon 2; Set C
aauuugcagaacagcgguaugacccauugucauuagg

SEQ ID NO: 47141 - RNA, 34 nt, Artificial Sequence
  Synthetic Oligonucleotide; BTLA exon 2; Set C
auuugcagaacagcgguaugacccauugucauua

SEQ ID NO: 47142 - RNA, 32 nt, Artificial Sequence
  Synthetic Oligonucleotide; BTLA exon 2; Set C
uuugcagaacagcgguaugacccauugucauu

SEQ ID NO: 47143 - RNA, 20 nt, Artificial Sequence
  Synthetic Oligonucleotide; BTLA exon 2; Set B
gaacagcgguaugacccauu

SEQ ID NO: 47144 - RNA, 36 nt, Artificial Sequence
  Synthetic Oligonucleotide; BTLA exon 2; Set C
aauuugcagaacagcgguaugacccauugucauuag

SEQ ID NO: 47145 - RNA, 38 nt, Artificial Sequence
  Synthetic Oligonucleotide; BTLA exon 2; Set C
aaauuugcagaacagcgguaugacccauugucauuagg

SEQ ID NO: 47146 - RNA, 35 nt, Artificial Sequence
  Synthetic Oligonucleotide; BTLA exon 2; Set C
aauuugcagaacagcgguaugacccauugucauua

SEQ ID NO: 47147 - RNA, 33 nt, Artificial Sequence
  Synthetic Oligonucleotide; BTLA exon 2; Set C
auuugcagaacagcgguaugacccauugucauu

SEQ ID NO: 47148 - RNA, 21 nt, Artificial Sequence
  Synthetic Oligonucleotide; BTLA exon 2; Set B
agaacagcgguaugacccauu

SEQ ID NO: 47149 - RNA, 19 nt, Artificial Sequence
  Synthetic Oligonucleotide; BTLA exon 2; Set B
gaacagcgguaugacccau

SEQ ID NO: 47150 - RNA, 37 nt, Artificial Sequence
  Synthetic Oligonucleotide; BTLA exon 2; Set C
aaauuugcagaacagcgguaugacccauugucauuag

SEQ ID NO: 47151 - RNA, 39 nt, Artificial Sequence
  Synthetic Oligonucleotide; BTLA exon 2; Set C
aaaauuugcagaacagcgguaugacccauugucauuagg

SEQ ID NO: 47152 - RNA, 36 nt, Artificial Sequence
  Synthetic Oligonucleotide; BTLA exon 2; Set C
aaauuugcagaacagcgguaugacccauugucauua

SEQ ID NO: 47153 - RNA, 34 nt, Artificial Sequence
  Synthetic Oligonucleotide; BTLA exon 2; Set C
aauuugcagaacagcgguaugacccauugucauu

SEQ ID NO: 47154 - RNA, 22 nt, Artificial Sequence
  Synthetic Oligonucleotide; BTLA exon 2; Set B
cagaacagcgguaugacccauu

SEQ ID NO: 47155 - RNA, 20 nt, Artificial Sequence
  Synthetic Oligonucleotide; BTLA exon 2; Set B
agaacagcgguaugacccau

SEQ ID NO: 47156 - RNA, 38 nt, Artificial Sequence
  Synthetic Oligonucleotide; BTLA exon 2; Set C
aaaauuugcagaacagcgguaugacccauugucauuag

SEQ ID NO: 47157 - RNA, 37 nt, Artificial Sequence
  Synthetic Oligonucleotide; BTLA exon 2; Set C
aaaauuugcagaacagcgguaugacccauugucauua

SEQ ID NO: 47158 - RNA, 35 nt, Artificial Sequence
  Synthetic Oligonucleotide; BTLA exon 2; Set C
aaauuugcagaacagcgguaugacccauugucauu

SEQ ID NO: 47159 - RNA, 23 nt, Artificial Sequence
  Synthetic Oligonucleotide; BTLA exon 2; Set B
gcagaacagcgguaugacccauu

SEQ ID NO: 47160 - RNA, 36 nt, Artificial Sequence
  Synthetic Oligonucleotide; BTLA exon 2; Set C
aaaauuugcagaacagcgguaugacccauugucauu

SEQ ID NO: 47161 - RNA, 24 nt, Artificial Sequence
  Synthetic Oligonucleotide; BTLA exon 2; Set B
ugcagaacagcgguaugacccauu

SEQ ID NO: 47162 - RNA, 25 nt, Artificial Sequence
  Synthetic Oligonucleotide; BTLA exon 2; Set B
uugcagaacagcgguaugacccauu

SEQ ID NO: 47163 - RNA, 23 nt, Artificial Sequence
  Synthetic Oligonucleotide; BTLA exon 2; Set B
ugcagaacagcgguaugacccau

SEQ ID NO: 47164 - RNA, 26 nt, Artificial Sequence
  Synthetic Oligonucleotide; BTLA exon 2; Set B
uuugcagaacagcgguaugacccauu

SEQ ID NO: 47165 - RNA, 24 nt, Artificial Sequence
  Synthetic Oligonucleotide; BTLA exon 2; Set B
uugcagaacagcgguaugacccau

SEQ ID NO: 47166 - RNA, 27 nt, Artificial Sequence
  Synthetic Oligonucleotide; BTLA exon 2; Set B
auuugcagaacagcgguaugacccauu

SEQ ID NO: 47167 - RNA, 25 nt, Artificial Sequence
  Synthetic Oligonucleotide; BTLA exon 2; Set B
uuugcagaacagcgguaugacccau

SEQ ID NO: 47168 - RNA, 28 nt, Artificial Sequence
  Synthetic Oligonucleotide; BTLA exon 2; Set B
aauuugcagaacagcgguaugacccauu

SEQ ID NO: 47169 - RNA, 26 nt, Artificial Sequence
  Synthetic Oligonucleotide; BTLA exon 2; Set B
auuugcagaacagcgguaugacccau

SEQ ID NO: 47170 - RNA, 24 nt, Artificial Sequence
  Synthetic Oligonucleotide; BTLA exon 2; Set B
uuugcagaacagcgguaugaccca

SEQ ID NO: 47171 - RNA, 29 nt, Artificial Sequence
  Synthetic Oligonucleotide; BTLA exon 2; Set B
aaauuugcagaacagcgguaugacccauu

SEQ ID NO: 47172 - RNA, 27 nt, Artificial Sequence
  Synthetic Oligonucleotide; BTLA exon 2; Set B
aauuugcagaacagcgguaugacccau

SEQ ID NO: 47173 - RNA, 25 nt, Artificial Sequence
  Synthetic Oligonucleotide; BTLA exon 2; Set B
auuugcagaacagcgguaugaccca

SEQ ID NO: 47174 - RNA, 30 nt, Artificial Sequence
  Synthetic Oligonucleotide; BTLA exon 2; Set B
aaaauuugcagaacagcgguaugacccauu

SEQ ID NO: 47175 - RNA, 28 nt, Artificial Sequence
  Synthetic Oligonucleotide; BTLA exon 2; Set B
aaauuugcagaacagcgguaugacccau

SEQ ID NO: 47176 - RNA, 26 nt, Artificial Sequence
  Synthetic Oligonucleotide; BTLA exon 2; Set B
aauuugcagaacagcgguaugaccca

SEQ ID NO: 47177 - RNA, 29 nt, Artificial Sequence
  Synthetic Oligonucleotide; BTLA exon 2; Set B
aaaauuugcagaacagcgguaugacccau

SEQ ID NO: 47178 - RNA, 27 nt, Artificial Sequence
  Synthetic Oligonucleotide; BTLA exon 2; Set B
aaauuugcagaacagcgguaugaccca

SEQ ID NO: 47179 - RNA, 28 nt, Artificial Sequence
  Synthetic Oligonucleotide; BTLA exon 2; Set B
aaaauuugcagaacagcgguaugaccca

SEQ ID NO: 47180 - RNA, 37 nt, Artificial Sequence
  Synthetic Oligonucleotide; BTLA exon 2; Set C
uagacugaaaauuugcagaacagcgguaugacccauu

SEQ ID NO: 47181 - RNA, 38 nt, Artificial Sequence
  Synthetic Oligonucleotide; BTLA exon 2; Set C
uuagacugaaaauuugcagaacagcgguaugacccauu

SEQ ID NO: 47182 - RNA, 36 nt, Artificial Sequence
  Synthetic Oligonucleotide; BTLA exon 2; Set C
uagacugaaaauuugcagaacagcgguaugacccau

SEQ ID NO: 47183 - RNA, 23 nt, Artificial Sequence
  Synthetic Oligonucleotide; BTLA exon 2; Set C
gaaaauuugcagaacagcgguau

SEQ ID NO: 47184 - RNA, 39 nt, Artificial Sequence
  Synthetic Oligonucleotide; BTLA exon 2; Set C
auuagacugaaaauuugcagaacagcgguaugacccauu

SEQ ID NO: 47185 - RNA, 37 nt, Artificial Sequence
  Synthetic Oligonucleotide; BTLA exon 2; Set C
uuagacugaaaauuugcagaacagcgguaugacccau

SEQ ID NO: 47186 - RNA, 35 nt, Artificial Sequence
  Synthetic Oligonucleotide; BTLA exon 2; Set C
uagacugaaaauuugcagaacagcgguaugaccca

SEQ ID NO: 47187 - RNA, 22 nt, Artificial Sequence
  Synthetic Oligonucleotide; BTLA exon 2; Set C
gaaaauuugcagaacagcggua

SEQ ID NO: 47188 - RNA, 24 nt, Artificial Sequence
  Synthetic Oligonucleotide; BTLA exon 2; Set C
ugaaaauuugcagaacagcgguau

SEQ ID NO: 47189 - RNA, 40 nt, Artificial Sequence
  Synthetic Oligonucleotide; BTLA exon 2; Set C
gauuagacugaaaauuugcagaacagcgguaugacccauu

SEQ ID NO: 47190 - RNA, 38 nt, Artificial Sequence
  Synthetic Oligonucleotide; BTLA exon 2; Set C
auuagacugaaaauuugcagaacagcgguaugacccau

SEQ ID NO: 47191 - RNA, 36 nt, Artificial Sequence
  Synthetic Oligonucleotide; BTLA exon 2; Set C
uuagacugaaaauuugcagaacagcgguaugaccca

SEQ ID NO: 47192 - RNA, 21 nt, Artificial Sequence
  Synthetic Oligonucleotide; BTLA exon 2; Set C
gaaaauuugcagaacagcggu

SEQ ID NO: 47193 - RNA, 23 nt, Artificial Sequence
  Synthetic Oligonucleotide; BTLA exon 2; Set C
ugaaaauuugcagaacagcggua

SEQ ID NO: 47194 - RNA, 37 nt, Artificial Sequence
  Synthetic Oligonucleotide; BTLA exon 2; Set C
auuagacugaaaauuugcagaacagcgguaugaccca

SEQ ID NO: 47195 - RNA, 22 nt, Artificial Sequence
  Synthetic Oligonucleotide; BTLA exon 2; Set C
ugaaaauuugcagaacagcggu

SEQ ID NO: 47196 - RNA, 15 nt, Artificial Sequence
  Synthetic Oligonucleotide; BTLA exon 2; Set C
aaaauuugcagaaca

SEQ ID NO: 47197 - RNA, 32 nt, Artificial Sequence
  Synthetic Oligonucleotide; BTLA exon 2; Set B
gauuagacugaaaauuugcagaacagcgguau

SEQ ID NO: 47198 - RNA, 15 nt, Artificial Sequence
  Synthetic Oligonucleotide; BTLA exon 2; Set C
ugaaaauuugcagaa

SEQ ID NO: 47199 - RNA, 31 nt, Artificial Sequence
  Synthetic Oligonucleotide; BTLA exon 2; Set B
gauuagacugaaaauuugcagaacagcggua

SEQ ID NO: 47200 - RNA, 33 nt, Artificial Sequence
  Synthetic Oligonucleotide; BTLA exon 2; Set B
agauuagacugaaaauuugcagaacagcgguau

SEQ ID NO: 47201 - RNA, 30 nt, Artificial Sequence
  Synthetic Oligonucleotide; BTLA exon 2; Set B
gauuagacugaaaauuugcagaacagcggu

SEQ ID NO: 47202 - RNA, 32 nt, Artificial Sequence
  Synthetic Oligonucleotide; BTLA exon 2; Set B
agauuagacugaaaauuugcagaacagcggua

SEQ ID NO: 47203 - RNA, 34 nt, Artificial Sequence
  Synthetic Oligonucleotide; BTLA exon 2; Set B
gagauuagacugaaaauuugcagaacagcgguau

SEQ ID NO: 47204 - RNA, 33 nt, Artificial Sequence
  Synthetic Oligonucleotide; BTLA exon 2; Set B
gagauuagacugaaaauuugcagaacagcggua

SEQ ID NO: 47205 - RNA, 31 nt, Artificial Sequence
  Synthetic Oligonucleotide; BTLA exon 2; Set B
agauuagacugaaaauuugcagaacagcggu

SEQ ID NO: 47206 - RNA, 35 nt, Artificial Sequence
  Synthetic Oligonucleotide; BTLA exon 2; Set B
ugagauuagacugaaaauuugcagaacagcgguau

SEQ ID NO: 47207 - RNA, 32 nt, Artificial Sequence
  Synthetic Oligonucleotide; BTLA exon 2; Set B
gagauuagacugaaaauuugcagaacagcggu

SEQ ID NO: 47208 - RNA, 34 nt, Artificial Sequence
  Synthetic Oligonucleotide; BTLA exon 2; Set B
ugagauuagacugaaaauuugcagaacagcggua

SEQ ID NO: 47209 - RNA, 22 nt, Artificial Sequence
  Synthetic Oligonucleotide; BTLA exon 2; Set C
uagacugaaaauuugcagaaca

SEQ ID NO: 47210 - RNA, 33 nt, Artificial Sequence
  Synthetic Oligonucleotide; BTLA exon 2; Set B
ugagauuagacugaaaauuugcagaacagcggu

SEQ ID NO: 47211 - RNA, 21 nt, Artificial Sequence
  Synthetic Oligonucleotide; BTLA exon 2; Set C
uagacugaaaauuugcagaac

SEQ ID NO: 47212 - RNA, 23 nt, Artificial Sequence
  Synthetic Oligonucleotide; BTLA exon 2; Set C
uuagacugaaaauuugcagaaca

SEQ ID NO: 47213 - RNA, 22 nt, Artificial Sequence
  Synthetic Oligonucleotide; BTLA exon 2; Set C
uuagacugaaaauuugcagaac

SEQ ID NO: 47214 - RNA, 24 nt, Artificial Sequence
  Synthetic Oligonucleotide; BTLA exon 2; Set C
auuagacugaaaauuugcagaaca

SEQ ID NO: 47215 - RNA, 23 nt, Artificial Sequence
  Synthetic Oligonucleotide; BTLA exon 2; Set C
auuagacugaaaauuugcagaac

SEQ ID NO: 47216 - RNA, 25 nt, Artificial Sequence
  Synthetic Oligonucleotide; BTLA exon 2; Set C
gauuagacugaaaauuugcagaaca

SEQ ID NO: 47217 - RNA, 24 nt, Artificial Sequence
  Synthetic Oligonucleotide; BTLA exon 2; Set C
gauuagacugaaaauuugcagaac

SEQ ID NO: 47218 - RNA, 25 nt, Artificial Sequence
  Synthetic Oligonucleotide; BTLA exon 2; Set C
agauuagacugaaaauuugcagaac

SEQ ID NO: 47219 - RNA, 27 nt, Artificial Sequence
  Synthetic Oligonucleotide; BTLA exon 2; Set C
gagauuagacugaaaauuugcagaaca

SEQ ID NO: 47220 - RNA, 26 nt, Artificial Sequence
  Synthetic Oligonucleotide; BTLA exon 2; Set C
gagauuagacugaaaauuugcagaac

SEQ ID NO: 47221 - RNA, 21 nt, Artificial Sequence
  Synthetic Oligonucleotide; BTLA exon 2; Set C
gauuagacugaaaauuugcag

SEQ ID NO: 47222 - RNA, 26 nt, Artificial Sequence
  Synthetic Oligonucleotide; BTLA exon 2; Set C
ugagauuagacugaaaauuugcagaa

SEQ ID NO: 47223 - RNA, 20 nt, Artificial Sequence
  Synthetic Oligonucleotide; BTLA exon 2; Set C
gauuagacugaaaauuugca

SEQ ID NO: 47224 - RNA, 22 nt, Artificial Sequence
  Synthetic Oligonucleotide; BTLA exon 2; Set C
agauuagacugaaaauuugcag

SEQ ID NO: 47225 - RNA, 25 nt, Artificial Sequence
  Synthetic Oligonucleotide; BTLA exon 2; Set C
ugagauuagacugaaaauuugcaga

SEQ ID NO: 47226 - RNA, 23 nt, Artificial Sequence
  Synthetic Oligonucleotide; BTLA exon 2; Set C
gagauuagacugaaaauuugcag

SEQ ID NO: 47227 - RNA, 19 nt, Artificial Sequence
  Synthetic Oligonucleotide; BTLA exon 2; Set C
gauuagacugaaaauuugc

SEQ ID NO: 47228 - RNA, 21 nt, Artificial Sequence
  Synthetic Oligonucleotide; BTLA exon 2; Set C
agauuagacugaaaauuugca

SEQ ID NO: 47229 - RNA, 18 nt, Artificial Sequence
  Synthetic Oligonucleotide; BTLA exon 2; Set C
gauuagacugaaaauuug

SEQ ID NO: 47230 - RNA, 22 nt, Artificial Sequence
  Synthetic Oligonucleotide; BTLA exon 2; Set C
gagauuagacugaaaauuugca

SEQ ID NO: 47231 - RNA, 20 nt, Artificial Sequence
  Synthetic Oligonucleotide; BTLA exon 2; Set C
agauuagacugaaaauuugc

SEQ ID NO: 47232 - RNA, 24 nt, Artificial Sequence
  Synthetic Oligonucleotide; BTLA exon 2; Set C
ugagauuagacugaaaauuugcag

SEQ ID NO: 47233 - RNA, 19 nt, Artificial Sequence
  Synthetic Oligonucleotide; BTLA exon 2; Set C
agauuagacugaaaauuug

SEQ ID NO: 47234 - RNA, 21 nt, Artificial Sequence
  Synthetic Oligonucleotide; BTLA exon 2; Set C
gagauuagacugaaaauuugc

SEQ ID NO: 47235 - RNA, 23 nt, Artificial Sequence
  Synthetic Oligonucleotide; BTLA exon 2; Set C
ugagauuagacugaaaauuugca

SEQ ID NO: 47236 - RNA, 18 nt, Artificial Sequence
  Synthetic Oligonucleotide; BTLA exon 2; Set C
agauuagacugaaaauuu

SEQ ID NO: 47237 - RNA, 16 nt, Artificial Sequence
  Synthetic Oligonucleotide; BTLA exon 2; Set C
gauuagacugaaaauu

SEQ ID NO: 47238 - RNA, 20 nt, Artificial Sequence
  Synthetic Oligonucleotide; BTLA exon 2; Set C
gagauuagacugaaaauuug

SEQ ID NO: 47239 - RNA, 22 nt, Artificial Sequence
  Synthetic Oligonucleotide; BTLA exon 2; Set C
ugagauuagacugaaaauuugc

SEQ ID NO: 47240 - RNA, 17 nt, Artificial Sequence
  Synthetic Oligonucleotide; BTLA exon 2; Set C
agauuagacugaaaauu

SEQ ID NO: 47241 - RNA, 15 nt, Artificial Sequence
  Synthetic Oligonucleotide; BTLA exon 2; Set C
gauuagacugaaaau

SEQ ID NO: 47242 - RNA, 21 nt, Artificial Sequence
  Synthetic Oligonucleotide; BTLA exon 2; Set C
ugagauuagacugaaaauuug

SEQ ID NO: 47243 - RNA, 20 nt, Artificial Sequence
  Synthetic Oligonucleotide; BTLA exon 2; Set C
ugagauuagacugaaaauuu

SEQ ID NO: 47244 - RNA, 18 nt, Artificial Sequence
  Synthetic Oligonucleotide; BTLA exon 2; Set C
gagauuagacugaaaauu

SEQ ID NO: 47245 - RNA, 16 nt, Artificial Sequence
  Synthetic Oligonucleotide; BTLA exon 2; Set C
agauuagacugaaaau

SEQ ID NO: 47246 - RNA, 19 nt, Artificial Sequence
  Synthetic Oligonucleotide; BTLA exon 2; Set C
ugagauuagacugaaaauu

SEQ ID NO: 47247 - RNA, 17 nt, Artificial Sequence
  Synthetic Oligonucleotide; BTLA exon 2; Set C
gagauuagacugaaaau

SEQ ID NO: 47248 - RNA, 15 nt, Artificial Sequence
  Synthetic Oligonucleotide; BTLA exon 2; Set C
agauuagacugaaaa

SEQ ID NO: 47249 - RNA, 16 nt, Artificial Sequence
  Synthetic Oligonucleotide; BTLA exon 2; Set C
gagauuagacugaaaa

SEQ ID NO: 47250 - RNA, 18 nt, Artificial Sequence
  Synthetic Oligonucleotide; BTLA exon 2; Set C
ugagauuagacugaaaau

SEQ ID NO: 47251 - RNA, 15 nt, Artificial Sequence
  Synthetic Oligonucleotide; BTLA exon 2; Set C
gagauuagacugaaa

SEQ ID NO: 47252 - RNA, 17 nt, Artificial Sequence
  Synthetic Oligonucleotide; BTLA exon 2; Set C
ugagauuagacugaaaa

SEQ ID NO: 47253 - RNA, 16 nt, Artificial Sequence
  Synthetic Oligonucleotide; BTLA exon 2; Set C
ugagauuagacugaaa

SEQ ID NO: 47254 - RNA, 40 nt, Artificial Sequence
  Synthetic Oligonucleotide; BTLA exon 2; Set B
uugaguggcuuucaaugagauuagacugaaaauuugcaga

SEQ ID NO: 47255 - RNA, 40 nt, Artificial Sequence
  Synthetic Oligonucleotide; BTLA exon 2; Set B
guugaguggcuuucaaugagauuagacugaaaauuugcag

SEQ ID NO: 47256 - RNA, 39 nt, Artificial Sequence
  Synthetic Oligonucleotide; BTLA exon 2; Set B
guugaguggcuuucaaugagauuagacugaaaauuugca

SEQ ID NO: 47257 - RNA, 38 nt, Artificial Sequence
  Synthetic Oligonucleotide; BTLA exon 2; Set B
guugaguggcuuucaaugagauuagacugaaaauuugc

SEQ ID NO: 47258 - RNA, 40 nt, Artificial Sequence
  Synthetic Oligonucleotide; BTLA exon 2; Set B
uguugaguggcuuucaaugagauuagacugaaaauuugca

SEQ ID NO: 47259 - RNA, 37 nt, Artificial Sequence
  Synthetic Oligonucleotide; BTLA exon 2; Set B
guugaguggcuuucaaugagauuagacugaaaauuug

SEQ ID NO: 47260 - RNA, 39 nt, Artificial Sequence
  Synthetic Oligonucleotide; BTLA exon 2; Set B
uguugaguggcuuucaaugagauuagacugaaaauuugc

SEQ ID NO: 47261 - RNA, 36 nt, Artificial Sequence
  Synthetic Oligonucleotide; BTLA exon 2; Set B
guugaguggcuuucaaugagauuagacugaaaauuu

SEQ ID NO: 47262 - RNA, 38 nt, Artificial Sequence
  Synthetic Oligonucleotide; BTLA exon 2; Set B
uguugaguggcuuucaaugagauuagacugaaaauuug

SEQ ID NO: 47263 - RNA, 40 nt, Artificial Sequence
  Synthetic Oligonucleotide; BTLA exon 2; Set B
uuguugaguggcuuucaaugagauuagacugaaaauuugc

SEQ ID NO: 47264 - RNA, 37 nt, Artificial Sequence
  Synthetic Oligonucleotide; BTLA exon 2; Set B
uguugaguggcuuucaaugagauuagacugaaaauuu

SEQ ID NO: 47265 - RNA, 35 nt, Artificial Sequence
  Synthetic Oligonucleotide; BTLA exon 2; Set B
guugaguggcuuucaaugagauuagacugaaaauu

SEQ ID NO: 47266 - RNA, 39 nt, Artificial Sequence
  Synthetic Oligonucleotide; BTLA exon 2; Set B
uuguugaguggcuuucaaugagauuagacugaaaauuug

SEQ ID NO: 47267 - RNA, 38 nt, Artificial Sequence
  Synthetic Oligonucleotide; BTLA exon 2; Set B
uuguugaguggcuuucaaugagauuagacugaaaauuu

SEQ ID NO: 47268 - RNA, 36 nt, Artificial Sequence
  Synthetic Oligonucleotide; BTLA exon 2; Set B
uguugaguggcuuucaaugagauuagacugaaaauu

SEQ ID NO: 47269 - RNA, 34 nt, Artificial Sequence
  Synthetic Oligonucleotide; BTLA exon 2; Set B
guugaguggcuuucaaugagauuagacugaaaau

SEQ ID NO: 47270 - RNA, 40 nt, Artificial Sequence
  Synthetic Oligonucleotide; BTLA exon 2; Set B
guuguugaguggcuuucaaugagauuagacugaaaauuug

SEQ ID NO: 47271 - RNA, 39 nt, Artificial Sequence
  Synthetic Oligonucleotide; BTLA exon 2; Set B
guuguugaguggcuuucaaugagauuagacugaaaauuu

SEQ ID NO: 47272 - RNA, 37 nt, Artificial Sequence
  Synthetic Oligonucleotide; BTLA exon 2; Set B
uuguugaguggcuuucaaugagauuagacugaaaauu

SEQ ID NO: 47273 - RNA, 33 nt, Artificial Sequence
  Synthetic Oligonucleotide; BTLA exon 2; Set B
guugaguggcuuucaaugagauuagacugaaaa

SEQ ID NO: 47274 - RNA, 35 nt, Artificial Sequence
  Synthetic Oligonucleotide; BTLA exon 2; Set B
uguugaguggcuuucaaugagauuagacugaaaau

SEQ ID NO: 47275 - RNA, 40 nt, Artificial Sequence
  Synthetic Oligonucleotide; BTLA exon 2; Set B
aguuguugaguggcuuucaaugagauuagacugaaaauuu

SEQ ID NO: 47276 - RNA, 38 nt, Artificial Sequence
  Synthetic Oligonucleotide; BTLA exon 2; Set B
guuguugaguggcuuucaaugagauuagacugaaaauu

SEQ ID NO: 47277 - RNA, 32 nt, Artificial Sequence
  Synthetic Oligonucleotide; BTLA exon 2; Set B
guugaguggcuuucaaugagauuagacugaaa

SEQ ID NO: 47278 - RNA, 36 nt, Artificial Sequence
  Synthetic Oligonucleotide; BTLA exon 2; Set B
uuguugaguggcuuucaaugagauuagacugaaaau

SEQ ID NO: 47279 - RNA, 34 nt, Artificial Sequence
  Synthetic Oligonucleotide; BTLA exon 2; Set B
uguugaguggcuuucaaugagauuagacugaaaa

SEQ ID NO: 47280 - RNA, 39 nt, Artificial Sequence
  Synthetic Oligonucleotide; BTLA exon 2; Set B
aguuguugaguggcuuucaaugagauuagacugaaaauu

SEQ ID NO: 47281 - RNA, 37 nt, Artificial Sequence
  Synthetic Oligonucleotide; BTLA exon 2; Set B
guuguugaguggcuuucaaugagauuagacugaaaau

SEQ ID NO: 47282 - RNA, 35 nt, Artificial Sequence
  Synthetic Oligonucleotide; BTLA exon 2; Set B
uuguugaguggcuuucaaugagauuagacugaaaa

SEQ ID NO: 47283 - RNA, 33 nt, Artificial Sequence
  Synthetic Oligonucleotide; BTLA exon 2; Set B
uguugaguggcuuucaaugagauuagacugaaa

SEQ ID NO: 47284 - RNA, 40 nt, Artificial Sequence
  Synthetic Oligonucleotide; BTLA exon 2; Set B
gaguuguugaguggcuuucaaugagauuagacugaaaauu

SEQ ID NO: 47285 - RNA, 38 nt, Artificial Sequence
  Synthetic Oligonucleotide; BTLA exon 2; Set B
aguuguugaguggcuuucaaugagauuagacugaaaau

SEQ ID NO: 47286 - RNA, 36 nt, Artificial Sequence
  Synthetic Oligonucleotide; BTLA exon 2; Set B
guuguugaguggcuuucaaugagauuagacugaaaa

SEQ ID NO: 47287 - RNA, 34 nt, Artificial Sequence
  Synthetic Oligonucleotide; BTLA exon 2; Set B
uuguugaguggcuuucaaugagauuagacugaaa

SEQ ID NO: 47288 - RNA, 37 nt, Artificial Sequence
  Synthetic Oligonucleotide; BTLA exon 2; Set B
aguuguugaguggcuuucaaugagauuagacugaaaa

SEQ ID NO: 47289 - RNA, 39 nt, Artificial Sequence
  Synthetic Oligonucleotide; BTLA exon 2; Set B
gaguuguugaguggcuuucaaugagauuagacugaaaau

SEQ ID NO: 47290 - RNA, 35 nt, Artificial Sequence
  Synthetic Oligonucleotide; BTLA exon 2; Set B
guuguugaguggcuuucaaugagauuagacugaaa

SEQ ID NO: 47291 - RNA, 36 nt, Artificial Sequence
  Synthetic Oligonucleotide; BTLA exon 2; Set B
aguuguugaguggcuuucaaugagauuagacugaaa

SEQ ID NO: 47292 - RNA, 38 nt, Artificial Sequence
  Synthetic Oligonucleotide; BTLA exon 2; Set B
gaguuguugaguggcuuucaaugagauuagacugaaaa

SEQ ID NO: 47293 - RNA, 40 nt, Artificial Sequence
  Synthetic Oligonucleotide; BTLA exon 2; Set B
agaguuguugaguggcuuucaaugagauuagacugaaaau

SEQ ID NO: 47294 - RNA, 37 nt, Artificial Sequence
  Synthetic Oligonucleotide; BTLA exon 2; Set B
gaguuguugaguggcuuucaaugagauuagacugaaa

SEQ ID NO: 47295 - RNA, 39 nt, Artificial Sequence
  Synthetic Oligonucleotide; BTLA exon 2; Set B
agaguuguugaguggcuuucaaugagauuagacugaaaa

SEQ ID NO: 47296 - RNA, 40 nt, Artificial Sequence
  Synthetic Oligonucleotide; BTLA exon 2; Set B
aagaguuguugaguggcuuucaaugagauuagacugaaaa

SEQ ID NO: 47297 - RNA, 38 nt, Artificial Sequence
  Synthetic Oligonucleotide; BTLA exon 2; Set B
agaguuguugaguggcuuucaaugagauuagacugaaa

SEQ ID NO: 47298 - RNA, 39 nt, Artificial Sequence
  Synthetic Oligonucleotide; BTLA exon 2; Set B
aagaguuguugaguggcuuucaaugagauuagacugaaa

SEQ ID NO: 47299 - RNA, 25 nt, Artificial Sequence
  Synthetic Oligonucleotide; BTLA exon 2; Set C
guugaguggcuuucaaugagauuag

SEQ ID NO: 47300 - RNA, 40 nt, Artificial Sequence
  Synthetic Oligonucleotide; BTLA exon 2; Set B
aaagaguuguugaguggcuuucaaugagauuagacugaaa

SEQ ID NO: 47301 - RNA, 24 nt, Artificial Sequence
  Synthetic Oligonucleotide; BTLA exon 2; Set C
guugaguggcuuucaaugagauua

SEQ ID NO: 47302 - RNA, 26 nt, Artificial Sequence
  Synthetic Oligonucleotide; BTLA exon 2; Set C
uguugaguggcuuucaaugagauuag

SEQ ID NO: 47303 - RNA, 23 nt, Artificial Sequence
  Synthetic Oligonucleotide; BTLA exon 2; Set C
guugaguggcuuucaaugagauu

SEQ ID NO: 47304 - RNA, 25 nt, Artificial Sequence
  Synthetic Oligonucleotide; BTLA exon 2; Set C
uguugaguggcuuucaaugagauua

SEQ ID NO: 47305 - RNA, 27 nt, Artificial Sequence
  Synthetic Oligonucleotide; BTLA exon 2; Set C
uuguugaguggcuuucaaugagauuag

SEQ ID NO: 47306 - RNA, 24 nt, Artificial Sequence
  Synthetic Oligonucleotide; BTLA exon 2; Set C
uguugaguggcuuucaaugagauu

SEQ ID NO: 47307 - RNA, 26 nt, Artificial Sequence
  Synthetic Oligonucleotide; BTLA exon 2; Set C
uuguugaguggcuuucaaugagauua

SEQ ID NO: 47308 - RNA, 28 nt, Artificial Sequence
  Synthetic Oligonucleotide; BTLA exon 2; Set B
guuguugaguggcuuucaaugagauuag

SEQ ID NO: 47309 - RNA, 22 nt, Artificial Sequence
  Synthetic Oligonucleotide; BTLA exon 2; Set C
guugaguggcuuucaaugagau

SEQ ID NO: 47310 - RNA, 25 nt, Artificial Sequence
  Synthetic Oligonucleotide; BTLA exon 2; Set C
uuguugaguggcuuucaaugagauu

SEQ ID NO: 47311 - RNA, 27 nt, Artificial Sequence
  Synthetic Oligonucleotide; BTLA exon 2; Set B
guuguugaguggcuuucaaugagauua

SEQ ID NO: 47312 - RNA, 29 nt, Artificial Sequence
  Synthetic Oligonucleotide; BTLA exon 2; Set B
aguuguugaguggcuuucaaugagauuag

SEQ ID NO: 47313 - RNA, 23 nt, Artificial Sequence
  Synthetic Oligonucleotide; BTLA exon 2; Set C
uguugaguggcuuucaaugagau

SEQ ID NO: 47314 - RNA, 26 nt, Artificial Sequence
  Synthetic Oligonucleotide; BTLA exon 2; Set B
guuguugaguggcuuucaaugagauu

SEQ ID NO: 47315 - RNA, 28 nt, Artificial Sequence
  Synthetic Oligonucleotide; BTLA exon 2; Set B
aguuguugaguggcuuucaaugagauua

SEQ ID NO: 47316 - RNA, 30 nt, Artificial Sequence
  Synthetic Oligonucleotide; BTLA exon 2; Set B
gaguuguugaguggcuuucaaugagauuag

SEQ ID NO: 47317 - RNA, 24 nt, Artificial Sequence
  Synthetic Oligonucleotide; BTLA exon 2; Set C
uuguugaguggcuuucaaugagau

SEQ ID NO: 47318 - RNA, 27 nt, Artificial Sequence
  Synthetic Oligonucleotide; BTLA exon 2; Set B
aguuguugaguggcuuucaaugagauu

SEQ ID NO: 47319 - RNA, 29 nt, Artificial Sequence
  Synthetic Oligonucleotide; BTLA exon 2; Set B
gaguuguugaguggcuuucaaugagauua

SEQ ID NO: 47320 - RNA, 31 nt, Artificial Sequence
  Synthetic Oligonucleotide; BTLA exon 2; Set B
agaguuguugaguggcuuucaaugagauuag

SEQ ID NO: 47321 - RNA, 25 nt, Artificial Sequence
  Synthetic Oligonucleotide; BTLA exon 2; Set B
guuguugaguggcuuucaaugagau

SEQ ID NO: 47322 - RNA, 28 nt, Artificial Sequence
  Synthetic Oligonucleotide; BTLA exon 2; Set B
gaguuguugaguggcuuucaaugagauu

SEQ ID NO: 47323 - RNA, 30 nt, Artificial Sequence
  Synthetic Oligonucleotide; BTLA exon 2; Set B
agaguuguugaguggcuuucaaugagauua

SEQ ID NO: 47324 - RNA, 32 nt, Artificial Sequence
  Synthetic Oligonucleotide; BTLA exon 2; Set B
aagaguuguugaguggcuuucaaugagauuag

SEQ ID NO: 47325 - RNA, 26 nt, Artificial Sequence
  Synthetic Oligonucleotide; BTLA exon 2; Set B
aguuguugaguggcuuucaaugagau

SEQ ID NO: 47326 - RNA, 24 nt, Artificial Sequence
  Synthetic Oligonucleotide; BTLA exon 2; Set B
guuguugaguggcuuucaaugaga

SEQ ID NO: 47327 - RNA, 29 nt, Artificial Sequence
  Synthetic Oligonucleotide; BTLA exon 2; Set B
agaguuguugaguggcuuucaaugagauu

SEQ ID NO: 47328 - RNA, 31 nt, Artificial Sequence
  Synthetic Oligonucleotide; BTLA exon 2; Set B
aagaguuguugaguggcuuucaaugagauua

SEQ ID NO: 47329 - RNA, 33 nt, Artificial Sequence
  Synthetic Oligonucleotide; BTLA exon 2; Set B
aaagaguuguugaguggcuuucaaugagauuag

SEQ ID NO: 47330 - RNA, 23 nt, Artificial Sequence
  Synthetic Oligonucleotide; BTLA exon 2; Set C
guuguugaguggcuuucaaugag

SEQ ID NO: 47331 - RNA, 27 nt, Artificial Sequence
  Synthetic Oligonucleotide; BTLA exon 2; Set B
gaguuguugaguggcuuucaaugagau

SEQ ID NO: 47332 - RNA, 25 nt, Artificial Sequence
  Synthetic Oligonucleotide; BTLA exon 2; Set B
aguuguugaguggcuuucaaugaga

SEQ ID NO: 47333 - RNA, 30 nt, Artificial Sequence
  Synthetic Oligonucleotide; BTLA exon 2; Set B
aagaguuguugaguggcuuucaaugagauu

SEQ ID NO: 47334 - RNA, 32 nt, Artificial Sequence
  Synthetic Oligonucleotide; BTLA exon 2; Set B
aaagaguuguugaguggcuuucaaugagauua

SEQ ID NO: 47335 - RNA, 34 nt, Artificial Sequence
  Synthetic Oligonucleotide; BTLA exon 2; Set B
uaaagaguuguugaguggcuuucaaugagauuag

SEQ ID NO: 47336 - RNA, 24 nt, Artificial Sequence
  Synthetic Oligonucleotide; BTLA exon 2; Set C
aguuguugaguggcuuucaaugag

SEQ ID NO: 47337 - RNA, 28 nt, Artificial Sequence
  Synthetic Oligonucleotide; BTLA exon 2; Set B
agaguuguugaguggcuuucaaugagau

SEQ ID NO: 47338 - RNA, 26 nt, Artificial Sequence
  Synthetic Oligonucleotide; BTLA exon 2; Set B
gaguuguugaguggcuuucaaugaga

SEQ ID NO: 47339 - RNA, 31 nt, Artificial Sequence
  Synthetic Oligonucleotide; BTLA exon 2; Set B
aaagaguuguugaguggcuuucaaugagauu

SEQ ID NO: 47340 - RNA, 33 nt, Artificial Sequence
  Synthetic Oligonucleotide; BTLA exon 2; Set B
uaaagaguuguugaguggcuuucaaugagauua

SEQ ID NO: 47341 - RNA, 25 nt, Artificial Sequence
  Synthetic Oligonucleotide; BTLA exon 2; Set B
gaguuguugaguggcuuucaaugag

SEQ ID NO: 47342 - RNA, 29 nt, Artificial Sequence
  Synthetic Oligonucleotide; BTLA exon 2; Set B
aagaguuguugaguggcuuucaaugagau

SEQ ID NO: 47343 - RNA, 27 nt, Artificial Sequence
  Synthetic Oligonucleotide; BTLA exon 2; Set B
agaguuguugaguggcuuucaaugaga

SEQ ID NO: 47344 - RNA, 32 nt, Artificial Sequence
  Synthetic Oligonucleotide; BTLA exon 2; Set B
uaaagaguuguugaguggcuuucaaugagauu

SEQ ID NO: 47345 - RNA, 26 nt, Artificial Sequence
  Synthetic Oligonucleotide; BTLA exon 2; Set B
agaguuguugaguggcuuucaaugag

SEQ ID NO: 47346 - RNA, 30 nt, Artificial Sequence
  Synthetic Oligonucleotide; BTLA exon 2; Set B
aaagaguuguugaguggcuuucaaugagau

SEQ ID NO: 47347 - RNA, 28 nt, Artificial Sequence
  Synthetic Oligonucleotide; BTLA exon 2; Set B
aagaguuguugaguggcuuucaaugaga

SEQ ID NO: 47348 - RNA, 27 nt, Artificial Sequence
  Synthetic Oligonucleotide; BTLA exon 2; Set C
aagaguuguugaguggcuuucaaugag

SEQ ID NO: 47349 - RNA, 31 nt, Artificial Sequence
  Synthetic Oligonucleotide; BTLA exon 2; Set B
uaaagaguuguugaguggcuuucaaugagau

SEQ ID NO: 47350 - RNA, 29 nt, Artificial Sequence
  Synthetic Oligonucleotide; BTLA exon 2; Set B
aaagaguuguugaguggcuuucaaugaga

SEQ ID NO: 47351 - RNA, 28 nt, Artificial Sequence
  Synthetic Oligonucleotide; BTLA exon 2; Set C
aaagaguuguugaguggcuuucaaugag

SEQ ID NO: 47352 - RNA, 30 nt, Artificial Sequence
  Synthetic Oligonucleotide; BTLA exon 2; Set B
uaaagaguuguugaguggcuuucaaugaga

SEQ ID NO: 47353 - RNA, 29 nt, Artificial Sequence
  Synthetic Oligonucleotide; BTLA exon 2; Set C
uaaagaguuguugaguggcuuucaaugag

SEQ ID NO: 47354 - RNA, 40 nt, Artificial Sequence
  Synthetic Oligonucleotide; BTLA exon 2; Set B
gucacauaaagaguuguugaguggcuuucaaugagauuag

SEQ ID NO: 47355 - RNA, 39 nt, Artificial Sequence
  Synthetic Oligonucleotide; BTLA exon 2; Set B
gucacauaaagaguuguugaguggcuuucaaugagauua

SEQ ID NO: 47356 - RNA, 38 nt, Artificial Sequence
  Synthetic Oligonucleotide; BTLA exon 2; Set B
gucacauaaagaguuguugaguggcuuucaaugagauu

SEQ ID NO: 47357 - RNA, 40 nt, Artificial Sequence
  Synthetic Oligonucleotide; BTLA exon 2; Set B
ugucacauaaagaguuguugaguggcuuucaaugagauua

SEQ ID NO: 47358 - RNA, 39 nt, Artificial Sequence
  Synthetic Oligonucleotide; BTLA exon 2; Set B
ugucacauaaagaguuguugaguggcuuucaaugagauu

SEQ ID NO: 47359 - RNA, 37 nt, Artificial Sequence
  Synthetic Oligonucleotide; BTLA exon 2; Set B
gucacauaaagaguuguugaguggcuuucaaugagau

SEQ ID NO: 47360 - RNA, 38 nt, Artificial Sequence
  Synthetic Oligonucleotide; BTLA exon 2; Set B
ugucacauaaagaguuguugaguggcuuucaaugagau

SEQ ID NO: 47361 - RNA, 36 nt, Artificial Sequence
  Synthetic Oligonucleotide; BTLA exon 2; Set B
gucacauaaagaguuguugaguggcuuucaaugaga

SEQ ID NO: 47362 - RNA, 35 nt, Artificial Sequence
  Synthetic Oligonucleotide; BTLA exon 2; Set B
gucacauaaagaguuguugaguggcuuucaaugag

SEQ ID NO: 47363 - RNA, 37 nt, Artificial Sequence
  Synthetic Oligonucleotide; BTLA exon 2; Set B
ugucacauaaagaguuguugaguggcuuucaaugaga

SEQ ID NO: 47364 - RNA, 36 nt, Artificial Sequence
  Synthetic Oligonucleotide; BTLA exon 2; Set B
ugucacauaaagaguuguugaguggcuuucaaugag

SEQ ID NO: 47365 - RNA, 19 nt, Artificial Sequence
  Synthetic Oligonucleotide; BTLA exon 2; Set C
gucacauaaagaguuguug

SEQ ID NO: 47366 - RNA, 20 nt, Artificial Sequence
  Synthetic Oligonucleotide; BTLA exon 2; Set C
ugucacauaaagaguuguug

SEQ ID NO: 47367 - RNA, 26 nt, Artificial Sequence
  Synthetic Oligonucleotide; BTLA exon 2; Set B
acucaccugucacauaaagaguuguu

SEQ ID NO: 47368 - RNA, 25 nt, Artificial Sequence
  Synthetic Oligonucleotide; BTLA exon 2; Set B
acucaccugucacauaaagaguugu

SEQ ID NO: 47369 - RNA, 24 nt, Artificial Sequence
  Synthetic Oligonucleotide; BTLA exon 2; Set C
acucaccugucacauaaagaguug

SEQ ID NO: 47370 - RNA, 23 nt, Artificial Sequence
  Synthetic Oligonucleotide; BTLA exon 2; Set C
acucaccugucacauaaagaguu

SEQ ID NO: 47371 - RNA, 22 nt, Artificial Sequence
  Synthetic Oligonucleotide; BTLA exon 2; Set C
acucaccugucacauaaagagu

SEQ ID NO: 47372 - RNA, 21 nt, Artificial Sequence
  Synthetic Oligonucleotide; BTLA exon 2; Set C
acucaccugucacauaaagag

SEQ ID NO: 47373 - RNA, 20 nt, Artificial Sequence
  Synthetic Oligonucleotide; BTLA exon 2; Set C
acucaccugucacauaaaga

SEQ ID NO: 47374 - RNA, 19 nt, Artificial Sequence
  Synthetic Oligonucleotide; BTLA exon 2; Set C
acucaccugucacauaaag

SEQ ID NO: 47375 - RNA, 18 nt, Artificial Sequence
  Synthetic Oligonucleotide; BTLA exon 2; Set C
acucaccugucacauaaa

SEQ ID NO: 47376 - RNA, 38 nt, Artificial Sequence
  Synthetic Oligonucleotide; BTLA exon 2; Set C
uagguguugagaacucaccugucacauaaagaguuguu

SEQ ID NO: 47377 - RNA, 39 nt, Artificial Sequence
  Synthetic Oligonucleotide; BTLA exon 2; Set C
cuagguguugagaacucaccugucacauaaagaguuguu

SEQ ID NO: 47378 - RNA, 40 nt, Artificial Sequence
  Synthetic Oligonucleotide; BTLA exon 2; Set C
ucuagguguugagaacucaccugucacauaaagaguuguu

SEQ ID NO: 47379 - RNA, 39 nt, Artificial Sequence
  Synthetic Oligonucleotide; BTLA exon 2; Set C
ucuagguguugagaacucaccugucacauaaagaguugu

SEQ ID NO: 47380 - RNA, 38 nt, Artificial Sequence
  Synthetic Oligonucleotide; BTLA exon 2; Set C
ucuagguguugagaacucaccugucacauaaagaguug

SEQ ID NO: 47381 - RNA, 40 nt, Artificial Sequence
  Synthetic Oligonucleotide; BTLA exon 2; Set C
gucuagguguugagaacucaccugucacauaaagaguugu

SEQ ID NO: 47382 - RNA, 37 nt, Artificial Sequence
  Synthetic Oligonucleotide; BTLA exon 2; Set C
ucuagguguugagaacucaccugucacauaaagaguu

SEQ ID NO: 47383 - RNA, 39 nt, Artificial Sequence
  Synthetic Oligonucleotide; BTLA exon 2; Set C
gucuagguguugagaacucaccugucacauaaagaguug

SEQ ID NO: 47384 - RNA, 36 nt, Artificial Sequence
  Synthetic Oligonucleotide; BTLA exon 2; Set C
ucuagguguugagaacucaccugucacauaaagagu

SEQ ID NO: 47385 - RNA, 38 nt, Artificial Sequence
  Synthetic Oligonucleotide; BTLA exon 2; Set C
gucuagguguugagaacucaccugucacauaaagaguu

SEQ ID NO: 47386 - RNA, 40 nt, Artificial Sequence
  Synthetic Oligonucleotide; BTLA exon 2; Set C
ggucuagguguugagaacucaccugucacauaaagaguug

SEQ ID NO: 47387 - RNA, 37 nt, Artificial Sequence
  Synthetic Oligonucleotide; BTLA exon 2; Set C
gucuagguguugagaacucaccugucacauaaagagu

SEQ ID NO: 47388 - RNA, 35 nt, Artificial Sequence
  Synthetic Oligonucleotide; BTLA exon 2; Set B
ucuagguguugagaacucaccugucacauaaagag

SEQ ID NO: 47389 - RNA, 39 nt, Artificial Sequence
  Synthetic Oligonucleotide; BTLA exon 2; Set C
ggucuagguguugagaacucaccugucacauaaagaguu

SEQ ID NO: 47390 - RNA, 38 nt, Artificial Sequence
  Synthetic Oligonucleotide; BTLA exon 2; Set C
ggucuagguguugagaacucaccugucacauaaagagu

SEQ ID NO: 47391 - RNA, 36 nt, Artificial Sequence
  Synthetic Oligonucleotide; BTLA exon 2; Set C
gucuagguguugagaacucaccugucacauaaagag

SEQ ID NO: 47392 - RNA, 34 nt, Artificial Sequence
  Synthetic Oligonucleotide; BTLA exon 2; Set B
ucuagguguugagaacucaccugucacauaaaga

SEQ ID NO: 47393 - RNA, 40 nt, Artificial Sequence
  Synthetic Oligonucleotide; BTLA exon 2; Set C
uggucuagguguugagaacucaccugucacauaaagaguu

SEQ ID NO: 47394 - RNA, 39 nt, Artificial Sequence
  Synthetic Oligonucleotide; BTLA exon 2; Set C
uggucuagguguugagaacucaccugucacauaaagagu

SEQ ID NO: 47395 - RNA, 37 nt, Artificial Sequence
  Synthetic Oligonucleotide; BTLA exon 2; Set C
ggucuagguguugagaacucaccugucacauaaagag

SEQ ID NO: 47396 - RNA, 33 nt, Artificial Sequence
  Synthetic Oligonucleotide; BTLA exon 2; Set B
ucuagguguugagaacucaccugucacauaaag

SEQ ID NO: 47397 - RNA, 35 nt, Artificial Sequence
  Synthetic Oligonucleotide; BTLA exon 2; Set C
gucuagguguugagaacucaccugucacauaaaga

SEQ ID NO: 47398 - RNA, 38 nt, Artificial Sequence
  Synthetic Oligonucleotide; BTLA exon 2; Set C
uggucuagguguugagaacucaccugucacauaaagag

SEQ ID NO: 47399 - RNA, 32 nt, Artificial Sequence
  Synthetic Oligonucleotide; BTLA exon 2; Set B
ucuagguguugagaacucaccugucacauaaa

SEQ ID NO: 47400 - RNA, 34 nt, Artificial Sequence
  Synthetic Oligonucleotide; BTLA exon 2; Set B
gucuagguguugagaacucaccugucacauaaag

SEQ ID NO: 47401 - RNA, 36 nt, Artificial Sequence
  Synthetic Oligonucleotide; BTLA exon 2; Set C
ggucuagguguugagaacucaccugucacauaaaga

SEQ ID NO: 47402 - RNA, 31 nt, Artificial Sequence
  Synthetic Oligonucleotide; BTLA exon 2; Set B
ucuagguguugagaacucaccugucacauaa

SEQ ID NO: 47403 - RNA, 37 nt, Artificial Sequence
  Synthetic Oligonucleotide; BTLA exon 2; Set C
uggucuagguguugagaacucaccugucacauaaaga

SEQ ID NO: 47404 - RNA, 33 nt, Artificial Sequence
  Synthetic Oligonucleotide; BTLA exon 2; Set B
gucuagguguugagaacucaccugucacauaaa

SEQ ID NO: 47405 - RNA, 35 nt, Artificial Sequence
  Synthetic Oligonucleotide; BTLA exon 2; Set C
ggucuagguguugagaacucaccugucacauaaag

SEQ ID NO: 47406 - RNA, 36 nt, Artificial Sequence
  Synthetic Oligonucleotide; BTLA exon 2; Set C
uggucuagguguugagaacucaccugucacauaaag

SEQ ID NO: 47407 - RNA, 32 nt, Artificial Sequence
  Synthetic Oligonucleotide; BTLA exon 2; Set C
gucuagguguugagaacucaccugucacauaa

SEQ ID NO: 47408 - RNA, 34 nt, Artificial Sequence
  Synthetic Oligonucleotide; BTLA exon 2; Set C
ggucuagguguugagaacucaccugucacauaaa

SEQ ID NO: 47409 - RNA, 35 nt, Artificial Sequence
  Synthetic Oligonucleotide; BTLA exon 2; Set C
uggucuagguguugagaacucaccugucacauaaa

SEQ ID NO: 47410 - RNA, 33 nt, Artificial Sequence
  Synthetic Oligonucleotide; BTLA exon 2; Set C
ggucuagguguugagaacucaccugucacauaa

SEQ ID NO: 47411 - RNA, 34 nt, Artificial Sequence
  Synthetic Oligonucleotide; BTLA exon 2; Set C
uggucuagguguugagaacucaccugucacauaa

SEQ ID NO: 47412 - RNA, 25 nt, Artificial Sequence
  Synthetic Oligonucleotide; BTLA exon 2; Set B
ucuagguguugagaacucaccuguc

SEQ ID NO: 47413 - RNA, 24 nt, Artificial Sequence
  Synthetic Oligonucleotide; BTLA exon 2; Set B
ucuagguguugagaacucaccugu

SEQ ID NO: 47414 - RNA, 26 nt, Artificial Sequence
  Synthetic Oligonucleotide; BTLA exon 2; Set B
gucuagguguugagaacucaccuguc

SEQ ID NO: 47415 - RNA, 25 nt, Artificial Sequence
  Synthetic Oligonucleotide; BTLA exon 2; Set B
gucuagguguugagaacucaccugu

SEQ ID NO: 47416 - RNA, 26 nt, Artificial Sequence
  Synthetic Oligonucleotide; BTLA exon 2; Set B
ggucuagguguugagaacucaccugu

SEQ ID NO: 47417 - RNA, 28 nt, Artificial Sequence
  Synthetic Oligonucleotide; BTLA exon 2; Set B
uggucuagguguugagaacucaccuguc

SEQ ID NO: 47418 - RNA, 27 nt, Artificial Sequence
  Synthetic Oligonucleotide; BTLA exon 2; Set B
uggucuagguguugagaacucaccugu

SEQ ID NO: 47419 - RNA, 35 nt, Artificial Sequence
  Synthetic Oligonucleotide; BTLA exon 2; Set C
uaucagauggucuagguguugagaacucaccuguc

SEQ ID NO: 47420 - RNA, 34 nt, Artificial Sequence
  Synthetic Oligonucleotide; BTLA exon 2; Set C
uaucagauggucuagguguugagaacucaccugu

SEQ ID NO: 47421 - RNA, 36 nt, Artificial Sequence
  Synthetic Oligonucleotide; BTLA exon 2; Set C
auaucagauggucuagguguugagaacucaccuguc

SEQ ID NO: 47422 - RNA, 35 nt, Artificial Sequence
  Synthetic Oligonucleotide; BTLA exon 2; Set C
auaucagauggucuagguguugagaacucaccugu

SEQ ID NO: 47423 - RNA, 37 nt, Artificial Sequence
  Synthetic Oligonucleotide; BTLA exon 2; Set C
aauaucagauggucuagguguugagaacucaccuguc

SEQ ID NO: 47424 - RNA, 36 nt, Artificial Sequence
  Synthetic Oligonucleotide; BTLA exon 2; Set C
aauaucagauggucuagguguugagaacucaccugu

SEQ ID NO: 47425 - RNA, 38 nt, Artificial Sequence
  Synthetic Oligonucleotide; BTLA exon 2; Set C
aaauaucagauggucuagguguugagaacucaccuguc

SEQ ID NO: 47426 - RNA, 37 nt, Artificial Sequence
  Synthetic Oligonucleotide; BTLA exon 2; Set C
aaauaucagauggucuagguguugagaacucaccugu

SEQ ID NO: 47427 - RNA, 39 nt, Artificial Sequence
  Synthetic Oligonucleotide; BTLA exon 2; Set B
aaaauaucagauggucuagguguugagaacucaccuguc

SEQ ID NO: 47428 - RNA, 38 nt, Artificial Sequence
  Synthetic Oligonucleotide; BTLA exon 2; Set B
aaaauaucagauggucuagguguugagaacucaccugu

SEQ ID NO: 47429 - RNA, 36 nt, Artificial Sequence
  Synthetic Oligonucleotide; BTLA exon 2; Set B
uaagaaaaauaucagauggucuagguguugagaacu

SEQ ID NO: 47430 - RNA, 37 nt, Artificial Sequence
  Synthetic Oligonucleotide; BTLA exon 2; Set B
auaagaaaaauaucagauggucuagguguugagaacu

SEQ ID NO: 47431 - RNA, 38 nt, Artificial Sequence
  Synthetic Oligonucleotide; BTLA exon 2; Set B
uauaagaaaaauaucagauggucuagguguugagaacu

SEQ ID NO: 47432 - RNA, 39 nt, Artificial Sequence
  Synthetic Oligonucleotide; BTLA exon 2; Set B
uuauaagaaaaauaucagauggucuagguguugagaacu

SEQ ID NO: 47433 - RNA, 15 nt, Artificial Sequence
  Synthetic Oligonucleotide; BTLA exon 2; Set C
aauaucagauggucu

SEQ ID NO: 47434 - RNA, 29 nt, Artificial Sequence
  Synthetic Oligonucleotide; BTLA exon 2; Set C
uaagaaaaauaucagauggucuagguguu

SEQ ID NO: 47435 - RNA, 16 nt, Artificial Sequence
  Synthetic Oligonucleotide; BTLA exon 2; Set C
aaauaucagauggucu

SEQ ID NO: 47436 - RNA, 30 nt, Artificial Sequence
  Synthetic Oligonucleotide; BTLA exon 2; Set C
auaagaaaaauaucagauggucuagguguu

SEQ ID NO: 47437 - RNA, 17 nt, Artificial Sequence
  Synthetic Oligonucleotide; BTLA exon 2; Set C
aaaauaucagauggucu

SEQ ID NO: 47438 - RNA, 15 nt, Artificial Sequence
  Synthetic Oligonucleotide; BTLA exon 2; Set C
aaauaucagaugguc

SEQ ID NO: 47439 - RNA, 31 nt, Artificial Sequence
  Synthetic Oligonucleotide; BTLA exon 2; Set C
uauaagaaaaauaucagauggucuagguguu

SEQ ID NO: 47440 - RNA, 29 nt, Artificial Sequence
  Synthetic Oligonucleotide; BTLA exon 2; Set C
auaagaaaaauaucagauggucuaggugu

SEQ ID NO: 47441 - RNA, 18 nt, Artificial Sequence
  Synthetic Oligonucleotide; BTLA exon 2; Set C
aaaaauaucagauggucu

SEQ ID NO: 47442 - RNA, 16 nt, Artificial Sequence
  Synthetic Oligonucleotide; BTLA exon 2; Set C
aaaauaucagaugguc

SEQ ID NO: 47443 - RNA, 32 nt, Artificial Sequence
  Synthetic Oligonucleotide; BTLA exon 2; Set C
uuauaagaaaaauaucagauggucuagguguu

SEQ ID NO: 47444 - RNA, 28 nt, Artificial Sequence
  Synthetic Oligonucleotide; BTLA exon 2; Set C
auaagaaaaauaucagauggucuaggug

SEQ ID NO: 47445 - RNA, 30 nt, Artificial Sequence
  Synthetic Oligonucleotide; BTLA exon 2; Set C
uauaagaaaaauaucagauggucuaggugu

SEQ ID NO: 47446 - RNA, 19 nt, Artificial Sequence
  Synthetic Oligonucleotide; BTLA exon 2; Set C
gaaaaauaucagauggucu

SEQ ID NO: 47447 - RNA, 29 nt, Artificial Sequence
  Synthetic Oligonucleotide; BTLA exon 2; Set C
uauaagaaaaauaucagauggucuaggug

SEQ ID NO: 47448 - RNA, 31 nt, Artificial Sequence
  Synthetic Oligonucleotide; BTLA exon 2; Set C
uuauaagaaaaauaucagauggucuaggugu

SEQ ID NO: 47449 - RNA, 20 nt, Artificial Sequence
  Synthetic Oligonucleotide; BTLA exon 2; Set C
agaaaaauaucagauggucu

SEQ ID NO: 47450 - RNA, 24 nt, Artificial Sequence
  Synthetic Oligonucleotide; BTLA exon 2; Set C
uaagaaaaauaucagauggucuag

SEQ ID NO: 47451 - RNA, 30 nt, Artificial Sequence
  Synthetic Oligonucleotide; BTLA exon 2; Set C
uuauaagaaaaauaucagauggucuaggug

SEQ ID NO: 47452 - RNA, 28 nt, Artificial Sequence
  Synthetic Oligonucleotide; BTLA exon 2; Set C
uauaagaaaaauaucagauggucuaggu

SEQ ID NO: 47453 - RNA, 21 nt, Artificial Sequence
  Synthetic Oligonucleotide; BTLA exon 2; Set C
aagaaaaauaucagauggucu

SEQ ID NO: 47454 - RNA, 15 nt, Artificial Sequence
  Synthetic Oligonucleotide; BTLA exon 2; Set C
aaaaauaucagaugg

SEQ ID NO: 47455 - RNA, 25 nt, Artificial Sequence
  Synthetic Oligonucleotide; BTLA exon 2; Set C
auaagaaaaauaucagauggucuag

SEQ ID NO: 47456 - RNA, 23 nt, Artificial Sequence
  Synthetic Oligonucleotide; BTLA exon 2; Set C
uaagaaaaauaucagauggucua

SEQ ID NO: 47457 - RNA, 29 nt, Artificial Sequence
  Synthetic Oligonucleotide; BTLA exon 2; Set C
uuauaagaaaaauaucagauggucuaggu

SEQ ID NO: 47458 - RNA, 22 nt, Artificial Sequence
  Synthetic Oligonucleotide; BTLA exon 2; Set C
uaagaaaaauaucagauggucu

SEQ ID NO: 47459 - RNA, 26 nt, Artificial Sequence
  Synthetic Oligonucleotide; BTLA exon 2; Set C
uauaagaaaaauaucagauggucuag

SEQ ID NO: 47460 - RNA, 24 nt, Artificial Sequence
  Synthetic Oligonucleotide; BTLA exon 2; Set C
auaagaaaaauaucagauggucua

SEQ ID NO: 47461 - RNA, 23 nt, Artificial Sequence
  Synthetic Oligonucleotide; BTLA exon 2; Set C
auaagaaaaauaucagauggucu

SEQ ID NO: 47462 - RNA, 17 nt, Artificial Sequence
  Synthetic Oligonucleotide; BTLA exon 2; Set C
agaaaaauaucagaugg

SEQ ID NO: 47463 - RNA, 21 nt, Artificial Sequence
  Synthetic Oligonucleotide; BTLA exon 2; Set C
uaagaaaaauaucagaugguc

SEQ ID NO: 47464 - RNA, 27 nt, Artificial Sequence
  Synthetic Oligonucleotide; BTLA exon 2; Set C
uuauaagaaaaauaucagauggucuag

SEQ ID NO: 47465 - RNA, 25 nt, Artificial Sequence
  Synthetic Oligonucleotide; BTLA exon 2; Set C
uauaagaaaaauaucagauggucua

SEQ ID NO: 47466 - RNA, 24 nt, Artificial Sequence
  Synthetic Oligonucleotide; BTLA exon 2; Set C
uauaagaaaaauaucagauggucu

SEQ ID NO: 47467 - RNA, 18 nt, Artificial Sequence
  Synthetic Oligonucleotide; BTLA exon 2; Set C
aagaaaaauaucagaugg

SEQ ID NO: 47468 - RNA, 22 nt, Artificial Sequence
  Synthetic Oligonucleotide; BTLA exon 2; Set C
auaagaaaaauaucagaugguc

SEQ ID NO: 47469 - RNA, 20 nt, Artificial Sequence
  Synthetic Oligonucleotide; BTLA exon 2; Set C
uaagaaaaauaucagauggu

SEQ ID NO: 47470 - RNA, 26 nt, Artificial Sequence
  Synthetic Oligonucleotide; BTLA exon 2; Set C
uuauaagaaaaauaucagauggucua

SEQ ID NO: 47471 - RNA, 25 nt, Artificial Sequence
  Synthetic Oligonucleotide; BTLA exon 2; Set C
uuauaagaaaaauaucagauggucu

SEQ ID NO: 47472 - RNA, 19 nt, Artificial Sequence
  Synthetic Oligonucleotide; BTLA exon 2; Set C
uaagaaaaauaucagaugg

SEQ ID NO: 47473 - RNA, 23 nt, Artificial Sequence
  Synthetic Oligonucleotide; BTLA exon 2; Set C
uauaagaaaaauaucagaugguc

SEQ ID NO: 47474 - RNA, 21 nt, Artificial Sequence
  Synthetic Oligonucleotide; BTLA exon 2; Set C
auaagaaaaauaucagauggu

SEQ ID NO: 47475 - RNA, 26 nt, Artificial Sequence
  Synthetic Oligonucleotide; BTLA exon 2; Set C
auuauaagaaaaauaucagauggucu

SEQ ID NO: 47476 - RNA, 20 nt, Artificial Sequence
  Synthetic Oligonucleotide; BTLA exon 2; Set C
auaagaaaaauaucagaugg

SEQ ID NO: 47477 - RNA, 24 nt, Artificial Sequence
  Synthetic Oligonucleotide; BTLA exon 2; Set C
uuauaagaaaaauaucagaugguc

SEQ ID NO: 47478 - RNA, 22 nt, Artificial Sequence
  Synthetic Oligonucleotide; BTLA exon 2; Set C
uauaagaaaaauaucagauggu

SEQ ID NO: 47479 - RNA, 21 nt, Artificial Sequence
  Synthetic Oligonucleotide; BTLA exon 2; Set C
uauaagaaaaauaucagaugg

SEQ ID NO: 47480 - RNA, 25 nt, Artificial Sequence
  Synthetic Oligonucleotide; BTLA exon 2; Set C
auuauaagaaaaauaucagaugguc

SEQ ID NO: 47481 - RNA, 23 nt, Artificial Sequence
  Synthetic Oligonucleotide; BTLA exon 2; Set C
uuauaagaaaaauaucagauggu

SEQ ID NO: 47482 - RNA, 22 nt, Artificial Sequence
  Synthetic Oligonucleotide; BTLA exon 2; Set C
uuauaagaaaaauaucagaugg

SEQ ID NO: 47483 - RNA, 24 nt, Artificial Sequence
  Synthetic Oligonucleotide; BTLA exon 2; Set C
auuauaagaaaaauaucagauggu

SEQ ID NO: 47484 - RNA, 20 nt, Artificial Sequence
  Synthetic Oligonucleotide; BTLA exon 2; Set C
uauaagaaaaauaucagaug

SEQ ID NO: 47485 - RNA, 23 nt, Artificial Sequence
  Synthetic Oligonucleotide; BTLA exon 2; Set C
auuauaagaaaaauaucagaugg

SEQ ID NO: 47486 - RNA, 21 nt, Artificial Sequence
  Synthetic Oligonucleotide; BTLA exon 2; Set C
uuauaagaaaaauaucagaug

SEQ ID NO: 47487 - RNA, 19 nt, Artificial Sequence
  Synthetic Oligonucleotide; BTLA exon 2; Set C
uauaagaaaaauaucagau

SEQ ID NO: 47488 - RNA, 20 nt, Artificial Sequence
  Synthetic Oligonucleotide; BTLA exon 2; Set C
uuauaagaaaaauaucagau

SEQ ID NO: 47489 - RNA, 15 nt, Artificial Sequence
  Synthetic Oligonucleotide; BTLA exon 2; Set C
uauaagaaaaauauc

SEQ ID NO: 47490 - RNA, 16 nt, Artificial Sequence
  Synthetic Oligonucleotide; BTLA exon 2; Set C
uuauaagaaaaauauc

SEQ ID NO: 47491 - RNA, 15 nt, Artificial Sequence
  Synthetic Oligonucleotide; BTLA exon 2; Set C
uuauaagaaaaauau

SEQ ID NO: 47492 - RNA, 16 nt, Artificial Sequence
  Synthetic Oligonucleotide; BTLA exon 2; Set C
auuauaagaaaaauau

SEQ ID NO: 47493 - RNA, 15 nt, Artificial Sequence
  Synthetic Oligonucleotide; BTLA exon 2; Set C
auuauaagaaaaaua

SEQ ID NO: 47494 - RNA, 15 nt, Artificial Sequence
  Synthetic Oligonucleotide; BTLA exon 2; Set C
uauguucuucuggaa

SEQ ID NO: 47495 - RNA, 16 nt, Artificial Sequence
  Synthetic Oligonucleotide; BTLA exon 2; Set C
auauguucuucuggaa

SEQ ID NO: 47496 - RNA, 17 nt, Artificial Sequence
  Synthetic Oligonucleotide; BTLA exon 2; Set C
aauauguucuucuggaa

SEQ ID NO: 47497 - RNA, 18 nt, Artificial Sequence
  Synthetic Oligonucleotide; BTLA exon 2; Set C
aaauauguucuucuggaa

SEQ ID NO: 47498 - RNA, 25 nt, Artificial Sequence
  Synthetic Oligonucleotide; BTLA exon 2; Set C
aaucaaauauguucuucuggaagua

SEQ ID NO: 47499 - RNA, 24 nt, Artificial Sequence
  Synthetic Oligonucleotide; BTLA exon 2; Set C
aaucaaauauguucuucuggaagu

SEQ ID NO: 47500 - RNA, 26 nt, Artificial Sequence
  Synthetic Oligonucleotide; BTLA exon 2; Set C
aaaucaaauauguucuucuggaagua

SEQ ID NO: 47501 - RNA, 25 nt, Artificial Sequence
  Synthetic Oligonucleotide; BTLA exon 2; Set C
aaaucaaauauguucuucuggaagu

SEQ ID NO: 47502 - RNA, 23 nt, Artificial Sequence
  Synthetic Oligonucleotide; BTLA exon 2; Set C
aaucaaauauguucuucuggaag

SEQ ID NO: 47503 - RNA, 24 nt, Artificial Sequence
  Synthetic Oligonucleotide; BTLA exon 2; Set C
aaaucaaauauguucuucuggaag

SEQ ID NO: 47504 - RNA, 24 nt, Artificial Sequence
  Synthetic Oligonucleotide; BTLA exon 2; Set C
aaaaucaaauauguucuucuggaa

SEQ ID NO: 47505 - RNA, 25 nt, Artificial Sequence
  Synthetic Oligonucleotide; BTLA exon 2; Set C
uaaaaucaaauauguucuucuggaa

SEQ ID NO: 47506 - RNA, 32 nt, Artificial Sequence
  Synthetic Oligonucleotide; BTLA exon 2; Set C
aaacuaaaaucaaauauguucuucuggaagua

SEQ ID NO: 47507 - RNA, 18 nt, Artificial Sequence
  Synthetic Oligonucleotide; BTLA exon 2; Set C
aaucaaauauguucuucu

SEQ ID NO: 47508 - RNA, 31 nt, Artificial Sequence
  Synthetic Oligonucleotide; BTLA exon 2; Set C
aaacuaaaaucaaauauguucuucuggaagu

SEQ ID NO: 47509 - RNA, 17 nt, Artificial Sequence
  Synthetic Oligonucleotide; BTLA exon 2; Set C
aaucaaauauguucuuc

SEQ ID NO: 47510 - RNA, 19 nt, Artificial Sequence
  Synthetic Oligonucleotide; BTLA exon 2; Set C
aaaucaaauauguucuucu

SEQ ID NO: 47511 - RNA, 16 nt, Artificial Sequence
  Synthetic Oligonucleotide; BTLA exon 2; Set C
aaucaaauauguucuu

SEQ ID NO: 47512 - RNA, 18 nt, Artificial Sequence
  Synthetic Oligonucleotide; BTLA exon 2; Set C
aaaucaaauauguucuuc

SEQ ID NO: 47513 - RNA, 30 nt, Artificial Sequence
  Synthetic Oligonucleotide; BTLA exon 2; Set C
aaacuaaaaucaaauauguucuucuggaag

SEQ ID NO: 47514 - RNA, 15 nt, Artificial Sequence
  Synthetic Oligonucleotide; BTLA exon 2; Set C
aaucaaauauguucu

SEQ ID NO: 47515 - RNA, 17 nt, Artificial Sequence
  Synthetic Oligonucleotide; BTLA exon 2; Set C
aaaucaaauauguucuu

SEQ ID NO: 47516 - RNA, 16 nt, Artificial Sequence
  Synthetic Oligonucleotide; BTLA exon 2; Set C
aaaucaaauauguucu

SEQ ID NO: 47517 - RNA, 30 nt, Artificial Sequence
  Synthetic Oligonucleotide; BTLA exon 2; Set C
aaaacuaaaaucaaauauguucuucuggaa

SEQ ID NO: 47518 - RNA, 15 nt, Artificial Sequence
  Synthetic Oligonucleotide; BTLA exon 2; Set C
aaaucaaauauguuc

SEQ ID NO: 47519 - RNA, 37 nt, Artificial Sequence
  Synthetic Oligonucleotide; BTLA exon 2; Set C
aaacaaaacuaaaaucaaauauguucuucuggaagua

SEQ ID NO: 47520 - RNA, 36 nt, Artificial Sequence
  Synthetic Oligonucleotide; BTLA exon 2; Set C
aaacaaaacuaaaaucaaauauguucuucuggaagu

SEQ ID NO: 47521 - RNA, 35 nt, Artificial Sequence
  Synthetic Oligonucleotide; BTLA exon 2; Set C
aaacaaaacuaaaaucaaauauguucuucuggaag

SEQ ID NO: 47522 - RNA, 25 nt, Artificial Sequence
  Synthetic Oligonucleotide; BTLA exon 2; Set C
aaacuaaaaucaaauauguucuucu

SEQ ID NO: 47523 - RNA, 24 nt, Artificial Sequence
  Synthetic Oligonucleotide; BTLA exon 2; Set C
aaacuaaaaucaaauauguucuuc

SEQ ID NO: 47524 - RNA, 23 nt, Artificial Sequence
  Synthetic Oligonucleotide; BTLA exon 2; Set C
aaacuaaaaucaaauauguucuu

SEQ ID NO: 47525 - RNA, 35 nt, Artificial Sequence
  Synthetic Oligonucleotide; BTLA exon 2; Set C
aaaacaaaacuaaaaucaaauauguucuucuggaa

SEQ ID NO: 47526 - RNA, 22 nt, Artificial Sequence
  Synthetic Oligonucleotide; BTLA exon 2; Set C
aaacuaaaaucaaauauguucu

SEQ ID NO: 47527 - RNA, 36 nt, Artificial Sequence
  Synthetic Oligonucleotide; BTLA exon 2; Set C
aaaaacaaaacuaaaaucaaauauguucuucuggaa

SEQ ID NO: 47528 - RNA, 21 nt, Artificial Sequence
  Synthetic Oligonucleotide; BTLA exon 2; Set C
aaacuaaaaucaaauauguuc

SEQ ID NO: 47529 - RNA, 39 nt, Artificial Sequence
  Synthetic Oligonucleotide; BTLA exon 2; Set C
auaaaaacaaaacuaaaaucaaauauguucuucuggaag

SEQ ID NO: 47530 - RNA, 37 nt, Artificial Sequence
  Synthetic Oligonucleotide; BTLA exon 2; Set C
uaaaaacaaaacuaaaaucaaauauguucuucuggaa

SEQ ID NO: 47531 - RNA, 20 nt, Artificial Sequence
  Synthetic Oligonucleotide; BTLA exon 2; Set C
aaacuaaaaucaaauauguu

SEQ ID NO: 47532 - RNA, 30 nt, Artificial Sequence
  Synthetic Oligonucleotide; BTLA exon 2; Set C
aaacaaaacuaaaaucaaauauguucuucu

SEQ ID NO: 47533 - RNA, 19 nt, Artificial Sequence
  Synthetic Oligonucleotide; BTLA exon 2; Set C
aaacuaaaaucaaauaugu

SEQ ID NO: 47534 - RNA, 29 nt, Artificial Sequence
  Synthetic Oligonucleotide; BTLA exon 2; Set C
aaacaaaacuaaaaucaaauauguucuuc

SEQ ID NO: 47535 - RNA, 28 nt, Artificial Sequence
  Synthetic Oligonucleotide; BTLA exon 2; Set C
aaacaaaacuaaaaucaaauauguucuu

SEQ ID NO: 47536 - RNA, 18 nt, Artificial Sequence
  Synthetic Oligonucleotide; BTLA exon 2; Set C
aaacuaaaaucaaauaug

SEQ ID NO: 47537 - RNA, 27 nt, Artificial Sequence
  Synthetic Oligonucleotide; BTLA exon 2; Set C
aaacaaaacuaaaaucaaauauguucu

SEQ ID NO: 47538 - RNA, 17 nt, Artificial Sequence
  Synthetic Oligonucleotide; BTLA exon 2; Set C
aaacuaaaaucaaauau

SEQ ID NO: 47539 - RNA, 26 nt, Artificial Sequence
  Synthetic Oligonucleotide; BTLA exon 2; Set C
aaacaaaacuaaaaucaaauauguuc

SEQ ID NO: 47540 - RNA, 16 nt, Artificial Sequence
  Synthetic Oligonucleotide; BTLA exon 2; Set C
aaacuaaaaucaaaua

SEQ ID NO: 47541 - RNA, 34 nt, Artificial Sequence
  Synthetic Oligonucleotide; BTLA exon 2; Set C
auaaaaacaaaacuaaaaucaaauauguucuucu

SEQ ID NO: 47542 - RNA, 25 nt, Artificial Sequence
  Synthetic Oligonucleotide; BTLA exon 2; Set C
aaacaaaacuaaaaucaaauauguu

SEQ ID NO: 47543 - RNA, 15 nt, Artificial Sequence
  Synthetic Oligonucleotide; BTLA exon 2; Set C
aaacuaaaaucaaau

SEQ ID NO: 47544 - RNA, 35 nt, Artificial Sequence
  Synthetic Oligonucleotide; BTLA exon 2; Set C
gauaaaaacaaaacuaaaaucaaauauguucuucu

SEQ ID NO: 47545 - RNA, 24 nt, Artificial Sequence
  Synthetic Oligonucleotide; BTLA exon 2; Set C
aaacaaaacuaaaaucaaauaugu

SEQ ID NO: 47546 - RNA, 36 nt, Artificial Sequence
  Synthetic Oligonucleotide; BTLA exon 2; Set C
agauaaaaacaaaacuaaaaucaaauauguucuucu

SEQ ID NO: 47547 - RNA, 23 nt, Artificial Sequence
  Synthetic Oligonucleotide; BTLA exon 2; Set C
aaacaaaacuaaaaucaaauaug

SEQ ID NO: 47548 - RNA, 35 nt, Artificial Sequence
  Synthetic Oligonucleotide; BTLA exon 2; Set C
agauaaaaacaaaacuaaaaucaaauauguucuuc

SEQ ID NO: 47549 - RNA, 37 nt, Artificial Sequence
  Synthetic Oligonucleotide; BTLA exon 2; Set C
aagauaaaaacaaaacuaaaaucaaauauguucuucu

SEQ ID NO: 47550 - RNA, 34 nt, Artificial Sequence
  Synthetic Oligonucleotide; BTLA exon 2; Set C
agauaaaaacaaaacuaaaaucaaauauguucuu

SEQ ID NO: 47551 - RNA, 36 nt, Artificial Sequence
  Synthetic Oligonucleotide; BTLA exon 2; Set C
aagauaaaaacaaaacuaaaaucaaauauguucuuc

SEQ ID NO: 47552 - RNA, 22 nt, Artificial Sequence
  Synthetic Oligonucleotide; BTLA exon 2; Set C
aaacaaaacuaaaaucaaauau

SEQ ID NO: 47553 - RNA, 38 nt, Artificial Sequence
  Synthetic Oligonucleotide; BTLA exon 2; Set C
aaagauaaaaacaaaacuaaaaucaaauauguucuucu

SEQ ID NO: 47554 - RNA, 33 nt, Artificial Sequence
  Synthetic Oligonucleotide; BTLA exon 2; Set C
agauaaaaacaaaacuaaaaucaaauauguucu

SEQ ID NO: 47555 - RNA, 35 nt, Artificial Sequence
  Synthetic Oligonucleotide; BTLA exon 2; Set C
aagauaaaaacaaaacuaaaaucaaauauguucuu

SEQ ID NO: 47556 - RNA, 37 nt, Artificial Sequence
  Synthetic Oligonucleotide; BTLA exon 2; Set C
aaagauaaaaacaaaacuaaaaucaaauauguucuuc

SEQ ID NO: 47557 - RNA, 21 nt, Artificial Sequence
  Synthetic Oligonucleotide; BTLA exon 2; Set C
aaacaaaacuaaaaucaaaua

SEQ ID NO: 47558 - RNA, 34 nt, Artificial Sequence
  Synthetic Oligonucleotide; BTLA exon 2; Set C
aagauaaaaacaaaacuaaaaucaaauauguucu

SEQ ID NO: 47559 - RNA, 32 nt, Artificial Sequence
  Synthetic Oligonucleotide; BTLA exon 2; Set C
agauaaaaacaaaacuaaaaucaaauauguuc

SEQ ID NO: 47560 - RNA, 28 nt, Artificial Sequence
  Synthetic Oligonucleotide; BTLA exon 2; Set C
auaaaaacaaaacuaaaaucaaauaugu

SEQ ID NO: 47561 - RNA, 36 nt, Artificial Sequence
  Synthetic Oligonucleotide; BTLA exon 2; Set C
aaagauaaaaacaaaacuaaaaucaaauauguucuu

SEQ ID NO: 47562 - RNA, 20 nt, Artificial Sequence
  Synthetic Oligonucleotide; BTLA exon 2; Set C
aaacaaaacuaaaaucaaau

SEQ ID NO: 47563 - RNA, 31 nt, Artificial Sequence
  Synthetic Oligonucleotide; BTLA exon 2; Set C
agauaaaaacaaaacuaaaaucaaauauguu

SEQ ID NO: 47564 - RNA, 35 nt, Artificial Sequence
  Synthetic Oligonucleotide; BTLA exon 2; Set C
aaagauaaaaacaaaacuaaaaucaaauauguucu

SEQ ID NO: 47565 - RNA, 33 nt, Artificial Sequence
  Synthetic Oligonucleotide; BTLA exon 2; Set C
aagauaaaaacaaaacuaaaaucaaauauguuc

SEQ ID NO: 47566 - RNA, 27 nt, Artificial Sequence
  Synthetic Oligonucleotide; BTLA exon 2; Set C
auaaaaacaaaacuaaaaucaaauaug

SEQ ID NO: 47567 - RNA, 19 nt, Artificial Sequence
  Synthetic Oligonucleotide; BTLA exon 2; Set C
aaacaaaacuaaaaucaaa

SEQ ID NO: 47568 - RNA, 32 nt, Artificial Sequence
  Synthetic Oligonucleotide; BTLA exon 2; Set C
aagauaaaaacaaaacuaaaaucaaauauguu

SEQ ID NO: 47569 - RNA, 34 nt, Artificial Sequence
  Synthetic Oligonucleotide; BTLA exon 2; Set C
aaagauaaaaacaaaacuaaaaucaaauauguuc

SEQ ID NO: 47570 - RNA, 30 nt, Artificial Sequence
  Synthetic Oligonucleotide; BTLA exon 2; Set C
agauaaaaacaaaacuaaaaucaaauaugu

SEQ ID NO: 47571 - RNA, 26 nt, Artificial Sequence
  Synthetic Oligonucleotide; BTLA exon 2; Set C
auaaaaacaaaacuaaaaucaaauau

SEQ ID NO: 47572 - RNA, 33 nt, Artificial Sequence
  Synthetic Oligonucleotide; BTLA exon 2; Set C
aaagauaaaaacaaaacuaaaaucaaauauguu

SEQ ID NO: 47573 - RNA, 31 nt, Artificial Sequence
  Synthetic Oligonucleotide; BTLA exon 2; Set C
aagauaaaaacaaaacuaaaaucaaauaugu

SEQ ID NO: 47574 - RNA, 29 nt, Artificial Sequence
  Synthetic Oligonucleotide; BTLA exon 2; Set C
agauaaaaacaaaacuaaaaucaaauaug

SEQ ID NO: 47575 - RNA, 27 nt, Artificial Sequence
  Synthetic Oligonucleotide; BTLA exon 2; Set C
gauaaaaacaaaacuaaaaucaaauau

SEQ ID NO: 47576 - RNA, 25 nt, Artificial Sequence
  Synthetic Oligonucleotide; BTLA exon 2; Set C
auaaaaacaaaacuaaaaucaaaua

SEQ ID NO: 47577 - RNA, 32 nt, Artificial Sequence
  Synthetic Oligonucleotide; BTLA exon 2; Set C
aaagauaaaaacaaaacuaaaaucaaauaugu

SEQ ID NO: 47578 - RNA, 30 nt, Artificial Sequence
  Synthetic Oligonucleotide; BTLA exon 2; Set C
aagauaaaaacaaaacuaaaaucaaauaug

SEQ ID NO: 47579 - RNA, 28 nt, Artificial Sequence
  Synthetic Oligonucleotide; BTLA exon 2; Set C
agauaaaaacaaaacuaaaaucaaauau

SEQ ID NO: 47580 - RNA, 24 nt, Artificial Sequence
  Synthetic Oligonucleotide; BTLA exon 2; Set C
auaaaaacaaaacuaaaaucaaau

SEQ ID NO: 47581 - RNA, 26 nt, Artificial Sequence
  Synthetic Oligonucleotide; BTLA exon 2; Set C
gauaaaaacaaaacuaaaaucaaaua

SEQ ID NO: 47582 - RNA, 31 nt, Artificial Sequence
  Synthetic Oligonucleotide; BTLA exon 2; Set C
aaagauaaaaacaaaacuaaaaucaaauaug

SEQ ID NO: 47583 - RNA, 29 nt, Artificial Sequence
  Synthetic Oligonucleotide; BTLA exon 2; Set C
aagauaaaaacaaaacuaaaaucaaauau

SEQ ID NO: 47584 - RNA, 25 nt, Artificial Sequence
  Synthetic Oligonucleotide; BTLA exon 2; Set C
gauaaaaacaaaacuaaaaucaaau

SEQ ID NO: 47585 - RNA, 27 nt, Artificial Sequence
  Synthetic Oligonucleotide; BTLA exon 2; Set C
agauaaaaacaaaacuaaaaucaaaua

SEQ ID NO: 47586 - RNA, 23 nt, Artificial Sequence
  Synthetic Oligonucleotide; BTLA exon 2; Set C
auaaaaacaaaacuaaaaucaaa

SEQ ID NO: 47587 - RNA, 30 nt, Artificial Sequence
  Synthetic Oligonucleotide; BTLA exon 2; Set C
aaagauaaaaacaaaacuaaaaucaaauau

SEQ ID NO: 47588 - RNA, 26 nt, Artificial Sequence
  Synthetic Oligonucleotide; BTLA exon 2; Set C
agauaaaaacaaaacuaaaaucaaau

SEQ ID NO: 47589 - RNA, 28 nt, Artificial Sequence
  Synthetic Oligonucleotide; BTLA exon 2; Set C
aagauaaaaacaaaacuaaaaucaaaua

SEQ ID NO: 47590 - RNA, 24 nt, Artificial Sequence
  Synthetic Oligonucleotide; BTLA exon 2; Set C
gauaaaaacaaaacuaaaaucaaa

SEQ ID NO: 47591 - RNA, 16 nt, Artificial Sequence
  Synthetic Oligonucleotide; BTLA exon 2; Set C
aaaacaaaacuaaaau

SEQ ID NO: 47592 - RNA, 27 nt, Artificial Sequence
  Synthetic Oligonucleotide; BTLA exon 2; Set C
aagauaaaaacaaaacuaaaaucaaau

SEQ ID NO: 47593 - RNA, 29 nt, Artificial Sequence
  Synthetic Oligonucleotide; BTLA exon 2; Set C
aaagauaaaaacaaaacuaaaaucaaaua

SEQ ID NO: 47594 - RNA, 25 nt, Artificial Sequence
  Synthetic Oligonucleotide; BTLA exon 2; Set C
agauaaaaacaaaacuaaaaucaaa

SEQ ID NO: 47595 - RNA, 17 nt, Artificial Sequence
  Synthetic Oligonucleotide; BTLA exon 2; Set C
aaaaacaaaacuaaaau

SEQ ID NO: 47596 - RNA, 15 nt, Artificial Sequence
  Synthetic Oligonucleotide; BTLA exon 2; Set C
aaaacaaaacuaaaa

SEQ ID NO: 47597 - RNA, 28 nt, Artificial Sequence
  Synthetic Oligonucleotide; BTLA exon 2; Set C
aaagauaaaaacaaaacuaaaaucaaau

SEQ ID NO: 47598 - RNA, 26 nt, Artificial Sequence
  Synthetic Oligonucleotide; BTLA exon 2; Set C
aagauaaaaacaaaacuaaaaucaaa

SEQ ID NO: 47599 - RNA, 18 nt, Artificial Sequence
  Synthetic Oligonucleotide; BTLA exon 2; Set C
uaaaaacaaaacuaaaau

SEQ ID NO: 47600 - RNA, 16 nt, Artificial Sequence
  Synthetic Oligonucleotide; BTLA exon 2; Set C
aaaaacaaaacuaaaa

SEQ ID NO: 47601 - RNA, 27 nt, Artificial Sequence
  Synthetic Oligonucleotide; BTLA exon 2; Set C
aaagauaaaaacaaaacuaaaaucaaa

SEQ ID NO: 47602 - RNA, 17 nt, Artificial Sequence
  Synthetic Oligonucleotide; BTLA exon 2; Set C
uaaaaacaaaacuaaaa

SEQ ID NO: 47603 - RNA, 17 nt, Artificial Sequence
  Synthetic Oligonucleotide; BTLA exon 2; Set C
auaaaaacaaaacuaaa

SEQ ID NO: 47604 - RNA, 18 nt, Artificial Sequence
  Synthetic Oligonucleotide; BTLA exon 2; Set C
gauaaaaacaaaacuaaa

SEQ ID NO: 47605 - RNA, 16 nt, Artificial Sequence
  Synthetic Oligonucleotide; BTLA exon 2; Set C
auaaaaacaaaacuaa

SEQ ID NO: 47606 - RNA, 19 nt, Artificial Sequence
  Synthetic Oligonucleotide; BTLA exon 2; Set C
agauaaaaacaaaacuaaa

SEQ ID NO: 47607 - RNA, 17 nt, Artificial Sequence
  Synthetic Oligonucleotide; BTLA exon 2; Set C
gauaaaaacaaaacuaa

SEQ ID NO: 47608 - RNA, 20 nt, Artificial Sequence
  Synthetic Oligonucleotide; BTLA exon 2; Set C
aagauaaaaacaaaacuaaa

SEQ ID NO: 47609 - RNA, 18 nt, Artificial Sequence
  Synthetic Oligonucleotide; BTLA exon 2; Set C
agauaaaaacaaaacuaa

SEQ ID NO: 47610 - RNA, 21 nt, Artificial Sequence
  Synthetic Oligonucleotide; BTLA exon 2; Set C
aaagauaaaaacaaaacuaaa

SEQ ID NO: 47611 - RNA, 19 nt, Artificial Sequence
  Synthetic Oligonucleotide; BTLA exon 2; Set C
aagauaaaaacaaaacuaa

SEQ ID NO: 47612 - RNA, 20 nt, Artificial Sequence
  Synthetic Oligonucleotide; BTLA exon 2; Set C
aaagauaaaaacaaaacuaa

SEQ ID NO: 47613 - RNA, 27 nt, Artificial Sequence
  Synthetic Oligonucleotide; BTLA exon 2; Set C
ccuaaaagauaaaaacaaaacuaaaau

SEQ ID NO: 47614 - RNA, 26 nt, Artificial Sequence
  Synthetic Oligonucleotide; BTLA exon 2; Set C
ccuaaaagauaaaaacaaaacuaaaa

SEQ ID NO: 47615 - RNA, 15 nt, Artificial Sequence
  Synthetic Oligonucleotide; BTLA exon 2; Set C
aaagauaaaaacaaa

SEQ ID NO: 47616 - RNA, 20 nt, Artificial Sequence
  Synthetic Oligonucleotide; BTLA exon 2; Set C
ccuaaaagauaaaaacaaaa

SEQ ID NO: 47617 - RNA, 35 nt, Artificial Sequence
  Synthetic Oligonucleotide; BTLA exon 2; Set C
auucuuucccuaaaagauaaaaacaaaacuaaaau

SEQ ID NO: 47618 - RNA, 36 nt, Artificial Sequence
  Synthetic Oligonucleotide; BTLA exon 2; Set C
gauucuuucccuaaaagauaaaaacaaaacuaaaau

SEQ ID NO: 47619 - RNA, 34 nt, Artificial Sequence
  Synthetic Oligonucleotide; BTLA exon 2; Set C
auucuuucccuaaaagauaaaaacaaaacuaaaa

SEQ ID NO: 47620 - RNA, 35 nt, Artificial Sequence
  Synthetic Oligonucleotide; BTLA exon 2; Set C
gauucuuucccuaaaagauaaaaacaaaacuaaaa

SEQ ID NO: 47621 - RNA, 15 nt, Artificial Sequence
  Synthetic Oligonucleotide; BTLA exon 2; Set C
ccuaaaagauaaaaa

SEQ ID NO: 47622 - RNA, 28 nt, Artificial Sequence
  Synthetic Oligonucleotide; BTLA exon 2; Set C
auucuuucccuaaaagauaaaaacaaaa

SEQ ID NO: 47623 - RNA, 29 nt, Artificial Sequence
  Synthetic Oligonucleotide; BTLA exon 2; Set C
gauucuuucccuaaaagauaaaaacaaaa

SEQ ID NO: 47624 - RNA, 23 nt, Artificial Sequence
  Synthetic Oligonucleotide; BTLA exon 2; Set C
auucuuucccuaaaagauaaaaa

SEQ ID NO: 47625 - RNA, 24 nt, Artificial Sequence
  Synthetic Oligonucleotide; BTLA exon 2; Set C
gauucuuucccuaaaagauaaaaa

SEQ ID NO: 47626 - RNA, 19 nt, Artificial Sequence
  Synthetic Oligonucleotide; BTLA exon 2; Set C
auucuuucccuaaaagaua

SEQ ID NO: 47627 - RNA, 18 nt, Artificial Sequence
  Synthetic Oligonucleotide; BTLA exon 2; Set C
auucuuucccuaaaagau

SEQ ID NO: 47628 - RNA, 20 nt, Artificial Sequence
  Synthetic Oligonucleotide; BTLA exon 2; Set C
gauucuuucccuaaaagaua

SEQ ID NO: 47629 - RNA, 19 nt, Artificial Sequence
  Synthetic Oligonucleotide; BTLA exon 2; Set C
gauucuuucccuaaaagau

SEQ ID NO: 47630 - RNA, 18 nt, Artificial Sequence
  Synthetic Oligonucleotide; BTLA exon 2; Set C
gauucuuucccuaaaaga

SEQ ID NO: 47631 - RNA, 17 nt, Artificial Sequence
  Synthetic Oligonucleotide; BTLA exon 2; Set C
gauucuuucccuaaaag

SEQ ID NO: 47632 - RNA, 33 nt, Artificial Sequence
  Synthetic Oligonucleotide; BTLA exon 2; Set C
uacaucacaugauucuuucccuaaaagauaaaa

SEQ ID NO: 47633 - RNA, 36 nt, Artificial Sequence
  Synthetic Oligonucleotide; BTLA exon 2; Set C
uguacaucacaugauucuuucccuaaaagauaaaaa

SEQ ID NO: 47634 - RNA, 32 nt, Artificial Sequence
  Synthetic Oligonucleotide; BTLA exon 2; Set A
guacaucacaugauucuuucccuaaaagauaa

SEQ ID NO: 47635 - RNA, 32 nt, Artificial Sequence
  Synthetic Oligonucleotide; BTLA exon 2; Set A
uguacaucacaugauucuuucccuaaaagaua

SEQ ID NO: 47636 - RNA, 31 nt, Artificial Sequence
  Synthetic Oligonucleotide; BTLA exon 2; Set A
uguacaucacaugauucuuucccuaaaagau

SEQ ID NO: 47637 - RNA, 33 nt, Artificial Sequence
  Synthetic Oligonucleotide; BTLA exon 2; Set A
cuguacaucacaugauucuuucccuaaaagaua

SEQ ID NO: 47638 - RNA, 32 nt, Artificial Sequence
  Synthetic Oligonucleotide; BTLA exon 2; Set A
cuguacaucacaugauucuuucccuaaaagau

SEQ ID NO: 47639 - RNA, 23 nt, Artificial Sequence
  Synthetic Oligonucleotide; BTLA exon 2; Set C
guacaucacaugauucuuucccu

SEQ ID NO: 47640 - RNA, 24 nt, Artificial Sequence
  Synthetic Oligonucleotide; BTLA exon 2; Set A
uguacaucacaugauucuuucccu

SEQ ID NO: 47641 - RNA, 25 nt, Artificial Sequence
  Synthetic Oligonucleotide; BTLA exon 2; Set A
cuguacaucacaugauucuuucccu

SEQ ID NO: 47642 - RNA, 15 nt, Artificial Sequence
  Synthetic Oligonucleotide; BTLA exon 2; Set C
guacaucacaugauu

SEQ ID NO: 47643 - RNA, 15 nt, Artificial Sequence
  Synthetic Oligonucleotide; BTLA exon 2; Set C
uguacaucacaugau

SEQ ID NO: 47644 - RNA, 33 nt, Artificial Sequence
  Synthetic Oligonucleotide; BTLA exon 2; Set A
auauaaagcuguacaucacaugauucuuucccu

SEQ ID NO: 47645 - RNA, 16 nt, Artificial Sequence
  Synthetic Oligonucleotide; BTLA exon 2; Set C
cuguacaucacaugau

SEQ ID NO: 47646 - RNA, 34 nt, Artificial Sequence
  Synthetic Oligonucleotide; BTLA exon 2; Set A
uauauaaagcuguacaucacaugauucuuucccu

SEQ ID NO: 47647 - RNA, 35 nt, Artificial Sequence
  Synthetic Oligonucleotide; BTLA exon 2; Set A
uuauauaaagcuguacaucacaugauucuuucccu

SEQ ID NO: 47648 - RNA, 36 nt, Artificial Sequence
  Synthetic Oligonucleotide; BTLA exon 2; Set A
uuuauauaaagcuguacaucacaugauucuuucccu

SEQ ID NO: 47649 - RNA, 37 nt, Artificial Sequence
  Synthetic Oligonucleotide; BTLA exon 2; Set A
cuuuauauaaagcuguacaucacaugauucuuucccu

SEQ ID NO: 47650 - RNA, 38 nt, Artificial Sequence
  Synthetic Oligonucleotide; BTLA exon 2; Set A
ucuuuauauaaagcuguacaucacaugauucuuucccu

SEQ ID NO: 47651 - RNA, 39 nt, Artificial Sequence
  Synthetic Oligonucleotide; BTLA exon 2; Set A
cucuuuauauaaagcuguacaucacaugauucuuucccu

SEQ ID NO: 47652 - RNA, 40 nt, Artificial Sequence
  Synthetic Oligonucleotide; BTLA exon 2; Set A
ucucuuuauauaaagcuguacaucacaugauucuuucccu

SEQ ID NO: 47653 - RNA, 25 nt, Artificial Sequence
  Synthetic Oligonucleotide; BTLA exon 2; Set C
auauaaagcuguacaucacaugauu

SEQ ID NO: 47654 - RNA, 24 nt, Artificial Sequence
  Synthetic Oligonucleotide; BTLA exon 2; Set C
auauaaagcuguacaucacaugau

SEQ ID NO: 47655 - RNA, 26 nt, Artificial Sequence
  Synthetic Oligonucleotide; BTLA exon 2; Set C
uauauaaagcuguacaucacaugauu

SEQ ID NO: 47656 - RNA, 27 nt, Artificial Sequence
  Synthetic Oligonucleotide; BTLA exon 2; Set C
uuauauaaagcuguacaucacaugauu

SEQ ID NO: 47657 - RNA, 25 nt, Artificial Sequence
  Synthetic Oligonucleotide; BTLA exon 2; Set C
uauauaaagcuguacaucacaugau

SEQ ID NO: 47658 - RNA, 26 nt, Artificial Sequence
  Synthetic Oligonucleotide; BTLA exon 2; Set C
uuauauaaagcuguacaucacaugau

SEQ ID NO: 47659 - RNA, 28 nt, Artificial Sequence
  Synthetic Oligonucleotide; BTLA exon 2; Set C
uuuauauaaagcuguacaucacaugauu

SEQ ID NO: 47660 - RNA, 27 nt, Artificial Sequence
  Synthetic Oligonucleotide; BTLA exon 2; Set C
uuuauauaaagcuguacaucacaugau

SEQ ID NO: 47661 - RNA, 29 nt, Artificial Sequence
  Synthetic Oligonucleotide; BTLA exon 2; Set C
cuuuauauaaagcuguacaucacaugauu

SEQ ID NO: 47662 - RNA, 28 nt, Artificial Sequence
  Synthetic Oligonucleotide; BTLA exon 2; Set C
cuuuauauaaagcuguacaucacaugau

SEQ ID NO: 47663 - RNA, 30 nt, Artificial Sequence
  Synthetic Oligonucleotide; BTLA exon 2; Set C
ucuuuauauaaagcuguacaucacaugauu

SEQ ID NO: 47664 - RNA, 31 nt, Artificial Sequence
  Synthetic Oligonucleotide; BTLA exon 2; Set C
cucuuuauauaaagcuguacaucacaugauu

SEQ ID NO: 47665 - RNA, 29 nt, Artificial Sequence
  Synthetic Oligonucleotide; BTLA exon 2; Set C
ucuuuauauaaagcuguacaucacaugau

SEQ ID NO: 47666 - RNA, 32 nt, Artificial Sequence
  Synthetic Oligonucleotide; BTLA exon 2; Set A
ucucuuuauauaaagcuguacaucacaugauu

SEQ ID NO: 47667 - RNA, 30 nt, Artificial Sequence
  Synthetic Oligonucleotide; BTLA exon 2; Set C
cucuuuauauaaagcuguacaucacaugau

SEQ ID NO: 47668 - RNA, 31 nt, Artificial Sequence
  Synthetic Oligonucleotide; BTLA exon 2; Set A
ucucuuuauauaaagcuguacaucacaugau

SEQ ID NO: 47669 - RNA, 17 nt, Artificial Sequence
  Synthetic Oligonucleotide; BTLA exon 2; Set C
uuauauaaagcuguaca

SEQ ID NO: 47670 - RNA, 16 nt, Artificial Sequence
  Synthetic Oligonucleotide; BTLA exon 2; Set C
uuauauaaagcuguac

SEQ ID NO: 47671 - RNA, 18 nt, Artificial Sequence
  Synthetic Oligonucleotide; BTLA exon 2; Set C
uuuauauaaagcuguaca

SEQ ID NO: 47672 - RNA, 15 nt, Artificial Sequence
  Synthetic Oligonucleotide; BTLA exon 2; Set C
uuauauaaagcugua

SEQ ID NO: 47673 - RNA, 17 nt, Artificial Sequence
  Synthetic Oligonucleotide; BTLA exon 2; Set C
uuuauauaaagcuguac

SEQ ID NO: 47674 - RNA, 40 nt, Artificial Sequence
  Synthetic Oligonucleotide; BTLA exon 2; Set A
ucagauugucucuuuauauaaagcuguacaucacaugauu

SEQ ID NO: 47675 - RNA, 39 nt, Artificial Sequence
  Synthetic Oligonucleotide; BTLA exon 2; Set A
ucagauugucucuuuauauaaagcuguacaucacaugau

SEQ ID NO: 47676 - RNA, 17 nt, Artificial Sequence
  Synthetic Oligonucleotide; BTLA exon 2; Set C
cuuuauauaaagcugua

SEQ ID NO: 47677 - RNA, 16 nt, Artificial Sequence
  Synthetic Oligonucleotide; BTLA exon 2; Set C
cuuuauauaaagcugu

SEQ ID NO: 47678 - RNA, 40 nt, Artificial Sequence
  Synthetic Oligonucleotide; BTLA exon 2; Set A
uucagauugucucuuuauauaaagcuguacaucacaugau

SEQ ID NO: 47679 - RNA, 18 nt, Artificial Sequence
  Synthetic Oligonucleotide; BTLA exon 2; Set C
ucuuuauauaaagcugua

SEQ ID NO: 47680 - RNA, 17 nt, Artificial Sequence
  Synthetic Oligonucleotide; BTLA exon 2; Set C
ucuuuauauaaagcugu

SEQ ID NO: 47681 - RNA, 15 nt, Artificial Sequence
  Synthetic Oligonucleotide; BTLA exon 2; Set C
cuuuauauaaagcug

SEQ ID NO: 47682 - RNA, 19 nt, Artificial Sequence
  Synthetic Oligonucleotide; BTLA exon 2; Set C
cucuuuauauaaagcugua

SEQ ID NO: 47683 - RNA, 23 nt, Artificial Sequence
  Synthetic Oligonucleotide; BTLA exon 2; Set C
gucucuuuauauaaagcuguaca

SEQ ID NO: 47684 - RNA, 18 nt, Artificial Sequence
  Synthetic Oligonucleotide; BTLA exon 2; Set C
cucuuuauauaaagcugu

SEQ ID NO: 47685 - RNA, 16 nt, Artificial Sequence
  Synthetic Oligonucleotide; BTLA exon 2; Set C
ucuuuauauaaagcug

SEQ ID NO: 47686 - RNA, 20 nt, Artificial Sequence
  Synthetic Oligonucleotide; BTLA exon 2; Set C
ucucuuuauauaaagcugua

SEQ ID NO: 47687 - RNA, 22 nt, Artificial Sequence
  Synthetic Oligonucleotide; BTLA exon 2; Set C
gucucuuuauauaaagcuguac

SEQ ID NO: 47688 - RNA, 24 nt, Artificial Sequence
  Synthetic Oligonucleotide; BTLA exon 2; Set C
ugucucuuuauauaaagcuguaca

SEQ ID NO: 47689 - RNA, 19 nt, Artificial Sequence
  Synthetic Oligonucleotide; BTLA exon 2; Set C
ucucuuuauauaaagcugu

SEQ ID NO: 47690 - RNA, 17 nt, Artificial Sequence
  Synthetic Oligonucleotide; BTLA exon 2; Set C
cucuuuauauaaagcug

SEQ ID NO: 47691 - RNA, 23 nt, Artificial Sequence
  Synthetic Oligonucleotide; BTLA exon 2; Set C
ugucucuuuauauaaagcuguac

SEQ ID NO: 47692 - RNA, 25 nt, Artificial Sequence
  Synthetic Oligonucleotide; BTLA exon 2; Set C
uugucucuuuauauaaagcuguaca

SEQ ID NO: 47693 - RNA, 18 nt, Artificial Sequence
  Synthetic Oligonucleotide; BTLA exon 2; Set C
ucucuuuauauaaagcug

SEQ ID NO: 47694 - RNA, 24 nt, Artificial Sequence
  Synthetic Oligonucleotide; BTLA exon 2; Set C
uugucucuuuauauaaagcuguac

SEQ ID NO: 47695 - RNA, 26 nt, Artificial Sequence
  Synthetic Oligonucleotide; BTLA exon 2; Set C
auugucucuuuauauaaagcuguaca

SEQ ID NO: 47696 - RNA, 25 nt, Artificial Sequence
  Synthetic Oligonucleotide; BTLA exon 2; Set C
auugucucuuuauauaaagcuguac

SEQ ID NO: 47697 - RNA, 27 nt, Artificial Sequence
  Synthetic Oligonucleotide; BTLA exon 2; Set C
gauugucucuuuauauaaagcuguaca

SEQ ID NO: 47698 - RNA, 26 nt, Artificial Sequence
  Synthetic Oligonucleotide; BTLA exon 2; Set C
gauugucucuuuauauaaagcuguac

SEQ ID NO: 47699 - RNA, 28 nt, Artificial Sequence
  Synthetic Oligonucleotide; BTLA exon 2; Set C
agauugucucuuuauauaaagcuguaca

SEQ ID NO: 47700 - RNA, 27 nt, Artificial Sequence
  Synthetic Oligonucleotide; BTLA exon 2; Set C
agauugucucuuuauauaaagcuguac

SEQ ID NO: 47701 - RNA, 29 nt, Artificial Sequence
  Synthetic Oligonucleotide; BTLA exon 2; Set C
cagauugucucuuuauauaaagcuguaca

SEQ ID NO: 47702 - RNA, 28 nt, Artificial Sequence
  Synthetic Oligonucleotide; BTLA exon 2; Set C
cagauugucucuuuauauaaagcuguac

SEQ ID NO: 47703 - RNA, 30 nt, Artificial Sequence
  Synthetic Oligonucleotide; BTLA exon 2; Set C
ucagauugucucuuuauauaaagcuguaca

SEQ ID NO: 47704 - RNA, 29 nt, Artificial Sequence
  Synthetic Oligonucleotide; BTLA exon 2; Set C
ucagauugucucuuuauauaaagcuguac

SEQ ID NO: 47705 - RNA, 31 nt, Artificial Sequence
  Synthetic Oligonucleotide; BTLA exon 2; Set A
uucagauugucucuuuauauaaagcuguaca

SEQ ID NO: 47706 - RNA, 30 nt, Artificial Sequence
  Synthetic Oligonucleotide; BTLA exon 2; Set C
uucagauugucucuuuauauaaagcuguac

SEQ ID NO: 47707 - RNA, 32 nt, Artificial Sequence
  Synthetic Oligonucleotide; BTLA exon 2; Set A
guucagauugucucuuuauauaaagcuguaca

SEQ ID NO: 47708 - RNA, 31 nt, Artificial Sequence
  Synthetic Oligonucleotide; BTLA exon 2; Set A
guucagauugucucuuuauauaaagcuguac

SEQ ID NO: 47709 - RNA, 33 nt, Artificial Sequence
  Synthetic Oligonucleotide; BTLA exon 2; Set A
uguucagauugucucuuuauauaaagcuguaca

SEQ ID NO: 47710 - RNA, 32 nt, Artificial Sequence
  Synthetic Oligonucleotide; BTLA exon 2; Set A
uguucagauugucucuuuauauaaagcuguac

SEQ ID NO: 47711 - RNA, 40 nt, Artificial Sequence
  Synthetic Oligonucleotide; BTLA exon 2; Set A
gauggaguguucagauugucucuuuauauaaagcuguaca

SEQ ID NO: 47712 - RNA, 39 nt, Artificial Sequence
  Synthetic Oligonucleotide; BTLA exon 2; Set A
gauggaguguucagauugucucuuuauauaaagcuguac

SEQ ID NO: 47713 - RNA, 40 nt, Artificial Sequence
  Synthetic Oligonucleotide; BTLA exon 2; Set A
agauggaguguucagauugucucuuuauauaaagcuguac

SEQ ID NO: 47714 - RNA, 36 nt, Artificial Sequence
  Synthetic Oligonucleotide; BTLA exon 2; Set A
gauggaguguucagauugucucuuuauauaaagcug

SEQ ID NO: 47715 - RNA, 40 nt, Artificial Sequence
  Synthetic Oligonucleotide; BTLA exon 2; Set A
aagauggaguguucagauugucucuuuauauaaagcugua

SEQ ID NO: 47716 - RNA, 39 nt, Artificial Sequence
  Synthetic Oligonucleotide; BTLA exon 2; Set A
aagauggaguguucagauugucucuuuauauaaagcugu

SEQ ID NO: 47717 - RNA, 38 nt, Artificial Sequence
  Synthetic Oligonucleotide; BTLA exon 2; Set A
aagauggaguguucagauugucucuuuauauaaagcug

SEQ ID NO: 47718 - RNA, 39 nt, Artificial Sequence
  Synthetic Oligonucleotide; BTLA exon 2; Set A
uaagauggaguguucagauugucucuuuauauaaagcug

SEQ ID NO: 47719 - RNA, 40 nt, Artificial Sequence
  Synthetic Oligonucleotide; BTLA exon 2; Set A
cuaagauggaguguucagauugucucuuuauauaaagcug

SEQ ID NO: 47720 - RNA, 23 nt, Artificial Sequence
  Synthetic Oligonucleotide; BTLA exon 2; Set C
gauggaguguucagauugucucu

SEQ ID NO: 47721 - RNA, 26 nt, Artificial Sequence
  Synthetic Oligonucleotide; BTLA exon 2; Set C
aagauggaguguucagauugucucuu

SEQ ID NO: 47722 - RNA, 22 nt, Artificial Sequence
  Synthetic Oligonucleotide; BTLA exon 2; Set C
gauggaguguucagauugucuc

SEQ ID NO: 47723 - RNA, 35 nt, Artificial Sequence
  Synthetic Oligonucleotide; BTLA exon 2; Set A
cugcuaagauggaguguucagauugucucuuuaua

SEQ ID NO: 47724 - RNA, 27 nt, Artificial Sequence
  Synthetic Oligonucleotide; BTLA exon 2; Set A
uaagauggaguguucagauugucucuu

SEQ ID NO: 47725 - RNA, 25 nt, Artificial Sequence
  Synthetic Oligonucleotide; BTLA exon 2; Set C
aagauggaguguucagauugucucu

SEQ ID NO: 47726 - RNA, 36 nt, Artificial Sequence
  Synthetic Oligonucleotide; BTLA exon 2; Set A
ccugcuaagauggaguguucagauugucucuuuaua

SEQ ID NO: 47727 - RNA, 34 nt, Artificial Sequence
  Synthetic Oligonucleotide; BTLA exon 2; Set A
cugcuaagauggaguguucagauugucucuuuau

SEQ ID NO: 47728 - RNA, 28 nt, Artificial Sequence
  Synthetic Oligonucleotide; BTLA exon 2; Set A
cuaagauggaguguucagauugucucuu

SEQ ID NO: 47729 - RNA, 26 nt, Artificial Sequence
  Synthetic Oligonucleotide; BTLA exon 2; Set C
uaagauggaguguucagauugucucu

SEQ ID NO: 47730 - RNA, 24 nt, Artificial Sequence
  Synthetic Oligonucleotide; BTLA exon 2; Set C
aagauggaguguucagauugucuc

SEQ ID NO: 47731 - RNA, 33 nt, Artificial Sequence
  Synthetic Oligonucleotide; BTLA exon 2; Set A
cugcuaagauggaguguucagauugucucuuua

SEQ ID NO: 47732 - RNA, 35 nt, Artificial Sequence
  Synthetic Oligonucleotide; BTLA exon 2; Set A
ccugcuaagauggaguguucagauugucucuuuau

SEQ ID NO: 47733 - RNA, 23 nt, Artificial Sequence
  Synthetic Oligonucleotide; BTLA exon 2; Set C
aagauggaguguucagauugucu

SEQ ID NO: 47734 - RNA, 25 nt, Artificial Sequence
  Synthetic Oligonucleotide; BTLA exon 2; Set C
uaagauggaguguucagauugucuc

SEQ ID NO: 47735 - RNA, 27 nt, Artificial Sequence
  Synthetic Oligonucleotide; BTLA exon 2; Set A
cuaagauggaguguucagauugucucu

SEQ ID NO: 47736 - RNA, 34 nt, Artificial Sequence
  Synthetic Oligonucleotide; BTLA exon 2; Set A
ccugcuaagauggaguguucagauugucucuuua

SEQ ID NO: 47737 - RNA, 32 nt, Artificial Sequence
  Synthetic Oligonucleotide; BTLA exon 2; Set A
cugcuaagauggaguguucagauugucucuuu

SEQ ID NO: 47738 - RNA, 24 nt, Artificial Sequence
  Synthetic Oligonucleotide; BTLA exon 2; Set C
uaagauggaguguucagauugucu

SEQ ID NO: 47739 - RNA, 26 nt, Artificial Sequence
  Synthetic Oligonucleotide; BTLA exon 2; Set C
cuaagauggaguguucagauugucuc

SEQ ID NO: 47740 - RNA, 39 nt, Artificial Sequence
  Synthetic Oligonucleotide; BTLA exon 2; Set C
ucuccugcuaagauggaguguucagauugucucuuuaua

SEQ ID NO: 47741 - RNA, 33 nt, Artificial Sequence
  Synthetic Oligonucleotide; BTLA exon 2; Set A
ccugcuaagauggaguguucagauugucucuuu

SEQ ID NO: 47742 - RNA, 25 nt, Artificial Sequence
  Synthetic Oligonucleotide; BTLA exon 2; Set C
cuaagauggaguguucagauugucu

SEQ ID NO: 47743 - RNA, 31 nt, Artificial Sequence
  Synthetic Oligonucleotide; BTLA exon 2; Set A
cugcuaagauggaguguucagauugucucuu

SEQ ID NO: 47744 - RNA, 38 nt, Artificial Sequence
  Synthetic Oligonucleotide; BTLA exon 2; Set C
ucuccugcuaagauggaguguucagauugucucuuuau

SEQ ID NO: 47745 - RNA, 32 nt, Artificial Sequence
  Synthetic Oligonucleotide; BTLA exon 2; Set A
ccugcuaagauggaguguucagauugucucuu

SEQ ID NO: 47746 - RNA, 30 nt, Artificial Sequence
  Synthetic Oligonucleotide; BTLA exon 2; Set A
cugcuaagauggaguguucagauugucucu

SEQ ID NO: 47747 - RNA, 37 nt, Artificial Sequence
  Synthetic Oligonucleotide; BTLA exon 2; Set C
ucuccugcuaagauggaguguucagauugucucuuua

SEQ ID NO: 47748 - RNA, 29 nt, Artificial Sequence
  Synthetic Oligonucleotide; BTLA exon 2; Set A
cugcuaagauggaguguucagauugucuc

SEQ ID NO: 47749 - RNA, 28 nt, Artificial Sequence
  Synthetic Oligonucleotide; BTLA exon 2; Set A
cugcuaagauggaguguucagauugucu

SEQ ID NO: 47750 - RNA, 27 nt, Artificial Sequence
  Synthetic Oligonucleotide; BTLA exon 2; Set A
cugcuaagauggaguguucagauuguc

SEQ ID NO: 47751 - RNA, 29 nt, Artificial Sequence
  Synthetic Oligonucleotide; BTLA exon 2; Set A
ccugcuaagauggaguguucagauugucu

SEQ ID NO: 47752 - RNA, 28 nt, Artificial Sequence
  Synthetic Oligonucleotide; BTLA exon 2; Set A
ccugcuaagauggaguguucagauuguc

SEQ ID NO: 47753 - RNA, 26 nt, Artificial Sequence
  Synthetic Oligonucleotide; BTLA exon 2; Set A
cugcuaagauggaguguucagauugu

SEQ ID NO: 47754 - RNA, 27 nt, Artificial Sequence
  Synthetic Oligonucleotide; BTLA exon 2; Set A
ccugcuaagauggaguguucagauugu

SEQ ID NO: 47755 - RNA, 25 nt, Artificial Sequence
  Synthetic Oligonucleotide; BTLA exon 2; Set C
cugcuaagauggaguguucagauug

SEQ ID NO: 47756 - RNA, 15 nt, Artificial Sequence
  Synthetic Oligonucleotide; BTLA exon 2; Set C
aagauggaguguuca

SEQ ID NO: 47757 - RNA, 26 nt, Artificial Sequence
  Synthetic Oligonucleotide; BTLA exon 2; Set A
ccugcuaagauggaguguucagauug

SEQ ID NO: 47758 - RNA, 24 nt, Artificial Sequence
  Synthetic Oligonucleotide; BTLA exon 2; Set C
cugcuaagauggaguguucagauu

SEQ ID NO: 47759 - RNA, 16 nt, Artificial Sequence
  Synthetic Oligonucleotide; BTLA exon 2; Set C
uaagauggaguguuca

SEQ ID NO: 47760 - RNA, 23 nt, Artificial Sequence
  Synthetic Oligonucleotide; BTLA exon 2; Set C
cugcuaagauggaguguucagau

SEQ ID NO: 47761 - RNA, 25 nt, Artificial Sequence
  Synthetic Oligonucleotide; BTLA exon 2; Set A
ccugcuaagauggaguguucagauu

SEQ ID NO: 47762 - RNA, 15 nt, Artificial Sequence
  Synthetic Oligonucleotide; BTLA exon 2; Set C
uaagauggaguguuc

SEQ ID NO: 47763 - RNA, 17 nt, Artificial Sequence
  Synthetic Oligonucleotide; BTLA exon 2; Set C
cuaagauggaguguuca

SEQ ID NO: 47764 - RNA, 22 nt, Artificial Sequence
  Synthetic Oligonucleotide; BTLA exon 2; Set C
cugcuaagauggaguguucaga

SEQ ID NO: 47765 - RNA, 24 nt, Artificial Sequence
  Synthetic Oligonucleotide; BTLA exon 2; Set A
ccugcuaagauggaguguucagau

SEQ ID NO: 47766 - RNA, 16 nt, Artificial Sequence
  Synthetic Oligonucleotide; BTLA exon 2; Set C
cuaagauggaguguuc

SEQ ID NO: 47767 - RNA, 21 nt, Artificial Sequence
  Synthetic Oligonucleotide; BTLA exon 2; Set C
cugcuaagauggaguguucag

SEQ ID NO: 47768 - RNA, 23 nt, Artificial Sequence
  Synthetic Oligonucleotide; BTLA exon 2; Set A
ccugcuaagauggaguguucaga

SEQ ID NO: 47769 - RNA, 15 nt, Artificial Sequence
  Synthetic Oligonucleotide; BTLA exon 2; Set C
cuaagauggaguguu

SEQ ID NO: 47770 - RNA, 22 nt, Artificial Sequence
  Synthetic Oligonucleotide; BTLA exon 2; Set C
ccugcuaagauggaguguucag

SEQ ID NO: 47771 - RNA, 20 nt, Artificial Sequence
  Synthetic Oligonucleotide; BTLA exon 2; Set C
cugcuaagauggaguguuca

SEQ ID NO: 47772 - RNA, 19 nt, Artificial Sequence
  Synthetic Oligonucleotide; BTLA exon 2; Set C
cugcuaagauggaguguuc

SEQ ID NO: 47773 - RNA, 25 nt, Artificial Sequence
  Synthetic Oligonucleotide; BTLA exon 2; Set A
aucuccugcuaagauggaguguuca

SEQ ID NO: 47774 - RNA, 23 nt, Artificial Sequence
  Synthetic Oligonucleotide; BTLA exon 2; Set A
aucuccugcuaagauggaguguu

SEQ ID NO: 47775 - RNA, 22 nt, Artificial Sequence
  Synthetic Oligonucleotide; BTLA exon 2; Set C
aucuccugcuaagauggagugu

SEQ ID NO: 47776 - RNA, 23 nt, Artificial Sequence
  Synthetic Oligonucleotide; BTLA exon 2; Set C
uaguucaaagggaucuccugcua

SEQ ID NO: 47777 - RNA, 18 nt, Artificial Sequence
  Synthetic Oligonucleotide; BTLA exon 2; Set C
guucaaagggaucuccug

SEQ ID NO: 47778 - RNA, 19 nt, Artificial Sequence
  Synthetic Oligonucleotide; BTLA exon 2; Set C
aguucaaagggaucuccug

SEQ ID NO: 47779 - RNA, 17 nt, Artificial Sequence
  Synthetic Oligonucleotide; BTLA exon 2; Set C
guucaaagggaucuccu

SEQ ID NO: 47780 - RNA, 20 nt, Artificial Sequence
  Synthetic Oligonucleotide; BTLA exon 2; Set C
uaguucaaagggaucuccug

SEQ ID NO: 47781 - RNA, 18 nt, Artificial Sequence
  Synthetic Oligonucleotide; BTLA exon 2; Set C
aguucaaagggaucuccu

SEQ ID NO: 47782 - RNA, 21 nt, Artificial Sequence
  Synthetic Oligonucleotide; BTLA exon 2; Set C
cuaguucaaagggaucuccug

SEQ ID NO: 47783 - RNA, 19 nt, Artificial Sequence
  Synthetic Oligonucleotide; BTLA exon 2; Set C
uaguucaaagggaucuccu

SEQ ID NO: 47784 - RNA, 22 nt, Artificial Sequence
  Synthetic Oligonucleotide; BTLA exon 2; Set C
ucuaguucaaagggaucuccug

SEQ ID NO: 47785 - RNA, 20 nt, Artificial Sequence
  Synthetic Oligonucleotide; BTLA exon 2; Set C
cuaguucaaagggaucuccu

SEQ ID NO: 47786 - RNA, 21 nt, Artificial Sequence
  Synthetic Oligonucleotide; BTLA exon 2; Set C
ucuaguucaaagggaucuccu

SEQ ID NO: 47787 - RNA, 40 nt, Artificial Sequence
  Synthetic Oligonucleotide; BTLA exon 2; Set C
auuucacagggcauucuaguucaaagggaucuccugcuaa

SEQ ID NO: 47788 - RNA, 39 nt, Artificial Sequence
  Synthetic Oligonucleotide; BTLA exon 2; Set C
auuucacagggcauucuaguucaaagggaucuccugcua

SEQ ID NO: 47789 - RNA, 40 nt, Artificial Sequence
  Synthetic Oligonucleotide; BTLA exon 2; Set C
uauuucacagggcauucuaguucaaagggaucuccugcua

SEQ ID NO: 47790 - RNA, 36 nt, Artificial Sequence
  Synthetic Oligonucleotide; BTLA exon 2; Set C
auuucacagggcauucuaguucaaagggaucuccug

SEQ ID NO: 47791 - RNA, 37 nt, Artificial Sequence
  Synthetic Oligonucleotide; BTLA exon 2; Set C
uauuucacagggcauucuaguucaaagggaucuccug

SEQ ID NO: 47792 - RNA, 38 nt, Artificial Sequence
  Synthetic Oligonucleotide; BTLA exon 2; Set C
guauuucacagggcauucuaguucaaagggaucuccug

SEQ ID NO: 47793 - RNA, 39 nt, Artificial Sequence
  Synthetic Oligonucleotide; BTLA exon 2; Set C
aguauuucacagggcauucuaguucaaagggaucuccug

SEQ ID NO: 47794 - RNA, 31 nt, Artificial Sequence
  Synthetic Oligonucleotide; BTLA exon 2; Set A
auuucacagggcauucuaguucaaagggauc

SEQ ID NO: 47795 - RNA, 32 nt, Artificial Sequence
  Synthetic Oligonucleotide; BTLA exon 2; Set A
uauuucacagggcauucuaguucaaagggauc

SEQ ID NO: 47796 - RNA, 33 nt, Artificial Sequence
  Synthetic Oligonucleotide; BTLA exon 2; Set A
guauuucacagggcauucuaguucaaagggauc

SEQ ID NO: 47797 - RNA, 34 nt, Artificial Sequence
  Synthetic Oligonucleotide; BTLA exon 2; Set A
aguauuucacagggcauucuaguucaaagggauc

SEQ ID NO: 47798 - RNA, 34 nt, Artificial Sequence
  Synthetic Oligonucleotide; BTLA exon 2; Set A
caguauuucacagggcauucuaguucaaagggau

SEQ ID NO: 47799 - RNA, 35 nt, Artificial Sequence
  Synthetic Oligonucleotide; BTLA exon 2; Set C
acaguauuucacagggcauucuaguucaaagggau

SEQ ID NO: 47800 - RNA, 37 nt, Artificial Sequence
  Synthetic Oligonucleotide; BTLA exon 2; Set C
cacaguauuucacagggcauucuaguucaaagggauc

SEQ ID NO: 47801 - RNA, 36 nt, Artificial Sequence
  Synthetic Oligonucleotide; BTLA exon 2; Set C
cacaguauuucacagggcauucuaguucaaagggau

SEQ ID NO: 47802 - RNA, 38 nt, Artificial Sequence
  Synthetic Oligonucleotide; BTLA exon 2; Set C
gcacaguauuucacagggcauucuaguucaaagggauc

SEQ ID NO: 47803 - RNA, 37 nt, Artificial Sequence
  Synthetic Oligonucleotide; BTLA exon 2; Set C
gcacaguauuucacagggcauucuaguucaaagggau

SEQ ID NO: 47804 - RNA, 19 nt, Artificial Sequence
  Synthetic Oligonucleotide; BTLA exon 2; Set C
auuucacagggcauucuag

SEQ ID NO: 47805 - RNA, 20 nt, Artificial Sequence
  Synthetic Oligonucleotide; BTLA exon 2; Set C
uauuucacagggcauucuag

SEQ ID NO: 47806 - RNA, 18 nt, Artificial Sequence
  Synthetic Oligonucleotide; BTLA exon 2; Set C
auuucacagggcauucua

SEQ ID NO: 47807 - RNA, 25 nt, Artificial Sequence
  Synthetic Oligonucleotide; BTLA exon 2; Set A
caguauuucacagggcauucuaguu

SEQ ID NO: 47808 - RNA, 17 nt, Artificial Sequence
  Synthetic Oligonucleotide; BTLA exon 2; Set C
auuucacagggcauucu

SEQ ID NO: 47809 - RNA, 21 nt, Artificial Sequence
  Synthetic Oligonucleotide; BTLA exon 2; Set C
guauuucacagggcauucuag

SEQ ID NO: 47810 - RNA, 19 nt, Artificial Sequence
  Synthetic Oligonucleotide; BTLA exon 2; Set C
uauuucacagggcauucua

SEQ ID NO: 47811 - RNA, 26 nt, Artificial Sequence
  Synthetic Oligonucleotide; BTLA exon 2; Set A
acaguauuucacagggcauucuaguu

SEQ ID NO: 47812 - RNA, 24 nt, Artificial Sequence
  Synthetic Oligonucleotide; BTLA exon 2; Set A
caguauuucacagggcauucuagu

SEQ ID NO: 47813 - RNA, 18 nt, Artificial Sequence
  Synthetic Oligonucleotide; BTLA exon 2; Set C
uauuucacagggcauucu

SEQ ID NO: 47814 - RNA, 22 nt, Artificial Sequence
  Synthetic Oligonucleotide; BTLA exon 2; Set C
aguauuucacagggcauucuag

SEQ ID NO: 47815 - RNA, 20 nt, Artificial Sequence
  Synthetic Oligonucleotide; BTLA exon 2; Set C
guauuucacagggcauucua

SEQ ID NO: 47816 - RNA, 27 nt, Artificial Sequence
  Synthetic Oligonucleotide; BTLA exon 2; Set A
cacaguauuucacagggcauucuaguu

SEQ ID NO: 47817 - RNA, 25 nt, Artificial Sequence
  Synthetic Oligonucleotide; BTLA exon 2; Set A
acaguauuucacagggcauucuagu

SEQ ID NO: 47818 - RNA, 19 nt, Artificial Sequence
  Synthetic Oligonucleotide; BTLA exon 2; Set C
guauuucacagggcauucu

SEQ ID NO: 47819 - RNA, 23 nt, Artificial Sequence
  Synthetic Oligonucleotide; BTLA exon 2; Set C
caguauuucacagggcauucuag

SEQ ID NO: 47820 - RNA, 21 nt, Artificial Sequence
  Synthetic Oligonucleotide; BTLA exon 2; Set C
aguauuucacagggcauucua

SEQ ID NO: 47821 - RNA, 28 nt, Artificial Sequence
  Synthetic Oligonucleotide; BTLA exon 2; Set A
gcacaguauuucacagggcauucuaguu

SEQ ID NO: 47822 - RNA, 26 nt, Artificial Sequence
  Synthetic Oligonucleotide; BTLA exon 2; Set A
cacaguauuucacagggcauucuagu

SEQ ID NO: 47823 - RNA, 20 nt, Artificial Sequence
  Synthetic Oligonucleotide; BTLA exon 2; Set C
aguauuucacagggcauucu

SEQ ID NO: 47824 - RNA, 24 nt, Artificial Sequence
  Synthetic Oligonucleotide; BTLA exon 2; Set A
acaguauuucacagggcauucuag

SEQ ID NO: 47825 - RNA, 27 nt, Artificial Sequence
  Synthetic Oligonucleotide; BTLA exon 2; Set A
gcacaguauuucacagggcauucuagu

SEQ ID NO: 47826 - RNA, 25 nt, Artificial Sequence
  Synthetic Oligonucleotide; BTLA exon 2; Set A
cacaguauuucacagggcauucuag

SEQ ID NO: 47827 - RNA, 26 nt, Artificial Sequence
  Synthetic Oligonucleotide; BTLA exon 2; Set A
gcacaguauuucacagggcauucuag

SEQ ID NO: 47828 - RNA, 24 nt, Artificial Sequence
  Synthetic Oligonucleotide; BTLA exon 2; Set A
cacaguauuucacagggcauucua

SEQ ID NO: 47829 - RNA, 23 nt, Artificial Sequence
  Synthetic Oligonucleotide; BTLA exon 2; Set A
cacaguauuucacagggcauucu

SEQ ID NO: 47830 - RNA, 25 nt, Artificial Sequence
  Synthetic Oligonucleotide; BTLA exon 2; Set A
gcacaguauuucacagggcauucua

SEQ ID NO: 47831 - RNA, 24 nt, Artificial Sequence
  Synthetic Oligonucleotide; BTLA exon 2; Set A
gcacaguauuucacagggcauucu

SEQ ID NO: 47832 - RNA, 39 nt, Artificial Sequence
  Synthetic Oligonucleotide; BTLA exon 2; Set C
augaggccuguuagcacaguauuucacagggcauucuag

SEQ ID NO: 47833 - RNA, 38 nt, Artificial Sequence
  Synthetic Oligonucleotide; BTLA exon 2; Set C
augaggccuguuagcacaguauuucacagggcauucua

SEQ ID NO: 47834 - RNA, 37 nt, Artificial Sequence
  Synthetic Oligonucleotide; BTLA exon 2; Set C
augaggccuguuagcacaguauuucacagggcauucu

SEQ ID NO: 47835 - RNA, 15 nt, Artificial Sequence
  Synthetic Oligonucleotide; BTLA exon 2; Set C
uguuagcacaguauu

SEQ ID NO: 47836 - RNA, 19 nt, Artificial Sequence
  Synthetic Oligonucleotide; BTLA exon 2; Set C
augaggccuguuagcacag

SEQ ID NO: 47837 - RNA, 28 nt, Artificial Sequence
  Synthetic Oligonucleotide; BTLA exon 2; Set C
gucacaugaggccuguuagcacaguauu

SEQ ID NO: 47838 - RNA, 20 nt, Artificial Sequence
  Synthetic Oligonucleotide; BTLA exon 2; Set A
caugaggccuguuagcacag

SEQ ID NO: 47839 - RNA, 18 nt, Artificial Sequence
  Synthetic Oligonucleotide; BTLA exon 2; Set C
augaggccuguuagcaca

SEQ ID NO: 47840 - RNA, 27 nt, Artificial Sequence
  Synthetic Oligonucleotide; BTLA exon 2; Set C
gucacaugaggccuguuagcacaguau

SEQ ID NO: 47841 - RNA, 29 nt, Artificial Sequence
  Synthetic Oligonucleotide; BTLA exon 2; Set C
agucacaugaggccuguuagcacaguauu

SEQ ID NO: 47842 - RNA, 21 nt, Artificial Sequence
  Synthetic Oligonucleotide; BTLA exon 2; Set A
acaugaggccuguuagcacag

SEQ ID NO: 47843 - RNA, 19 nt, Artificial Sequence
  Synthetic Oligonucleotide; BTLA exon 2; Set A
caugaggccuguuagcaca

SEQ ID NO: 47844 - RNA, 17 nt, Artificial Sequence
  Synthetic Oligonucleotide; BTLA exon 2; Set C
augaggccuguuagcac

SEQ ID NO: 47845 - RNA, 28 nt, Artificial Sequence
  Synthetic Oligonucleotide; BTLA exon 2; Set C
agucacaugaggccuguuagcacaguau

SEQ ID NO: 47846 - RNA, 30 nt, Artificial Sequence
  Synthetic Oligonucleotide; BTLA exon 2; Set C
aagucacaugaggccuguuagcacaguauu

SEQ ID NO: 47847 - RNA, 26 nt, Artificial Sequence
  Synthetic Oligonucleotide; BTLA exon 2; Set C
gucacaugaggccuguuagcacagua

SEQ ID NO: 47848 - RNA, 16 nt, Artificial Sequence
  Synthetic Oligonucleotide; BTLA exon 2; Set C
augaggccuguuagca

SEQ ID NO: 47849 - RNA, 22 nt, Artificial Sequence
  Synthetic Oligonucleotide; BTLA exon 2; Set A
cacaugaggccuguuagcacag

SEQ ID NO: 47850 - RNA, 20 nt, Artificial Sequence
  Synthetic Oligonucleotide; BTLA exon 2; Set A
acaugaggccuguuagcaca

SEQ ID NO: 47851 - RNA, 18 nt, Artificial Sequence
  Synthetic Oligonucleotide; BTLA exon 2; Set C
caugaggccuguuagcac

SEQ ID NO: 47852 - RNA, 29 nt, Artificial Sequence
  Synthetic Oligonucleotide; BTLA exon 2; Set C
aagucacaugaggccuguuagcacaguau

SEQ ID NO: 47853 - RNA, 27 nt, Artificial Sequence
  Synthetic Oligonucleotide; BTLA exon 2; Set C
agucacaugaggccuguuagcacagua

SEQ ID NO: 47854 - RNA, 25 nt, Artificial Sequence
  Synthetic Oligonucleotide; BTLA exon 2; Set C
gucacaugaggccuguuagcacagu

SEQ ID NO: 47855 - RNA, 17 nt, Artificial Sequence
  Synthetic Oligonucleotide; BTLA exon 2; Set C
caugaggccuguuagca

SEQ ID NO: 47856 - RNA, 23 nt, Artificial Sequence
  Synthetic Oligonucleotide; BTLA exon 2; Set A
ucacaugaggccuguuagcacag

SEQ ID NO: 47857 - RNA, 21 nt, Artificial Sequence
  Synthetic Oligonucleotide; BTLA exon 2; Set A
cacaugaggccuguuagcaca

SEQ ID NO: 47858 - RNA, 19 nt, Artificial Sequence
  Synthetic Oligonucleotide; BTLA exon 2; Set A
acaugaggccuguuagcac

SEQ ID NO: 47859 - RNA, 28 nt, Artificial Sequence
  Synthetic Oligonucleotide; BTLA exon 2; Set C
aagucacaugaggccuguuagcacagua

SEQ ID NO: 47860 - RNA, 26 nt, Artificial Sequence
  Synthetic Oligonucleotide; BTLA exon 2; Set C
agucacaugaggccuguuagcacagu

SEQ ID NO: 47861 - RNA, 18 nt, Artificial Sequence
  Synthetic Oligonucleotide; BTLA exon 2; Set C
acaugaggccuguuagca

SEQ ID NO: 47862 - RNA, 22 nt, Artificial Sequence
  Synthetic Oligonucleotide; BTLA exon 2; Set A
ucacaugaggccuguuagcaca

SEQ ID NO: 47863 - RNA, 20 nt, Artificial Sequence
  Synthetic Oligonucleotide; BTLA exon 2; Set A
cacaugaggccuguuagcac

SEQ ID NO: 47864 - RNA, 27 nt, Artificial Sequence
  Synthetic Oligonucleotide; BTLA exon 2; Set C
aagucacaugaggccuguuagcacagu

SEQ ID NO: 47865 - RNA, 19 nt, Artificial Sequence
  Synthetic Oligonucleotide; BTLA exon 2; Set A
cacaugaggccuguuagca

SEQ ID NO: 47866 - RNA, 20 nt, Artificial Sequence
  Synthetic Oligonucleotide; BTLA exon 2; Set A
ucacaugaggccuguuagca

SEQ ID NO: 47867 - RNA, 19 nt, Artificial Sequence
  Synthetic Oligonucleotide; BTLA exon 2; Set A
ucacaugaggccuguuagc

SEQ ID NO: 47868 - RNA, 18 nt, Artificial Sequence
  Synthetic Oligonucleotide; BTLA exon 2; Set C
ucacaugaggccuguuag

SEQ ID NO: 47869 - RNA, 20 nt, Artificial Sequence
  Synthetic Oligonucleotide; BTLA exon 2; Set A
gucacaugaggccuguuagc

SEQ ID NO: 47870 - RNA, 19 nt, Artificial Sequence
  Synthetic Oligonucleotide; BTLA exon 2; Set C
gucacaugaggccuguuag

SEQ ID NO: 47871 - RNA, 21 nt, Artificial Sequence
  Synthetic Oligonucleotide; BTLA exon 2; Set A
agucacaugaggccuguuagc

SEQ ID NO: 47872 - RNA, 17 nt, Artificial Sequence
  Synthetic Oligonucleotide; BTLA exon 2; Set C
ucacaugaggccuguua

SEQ ID NO: 47873 - RNA, 20 nt, Artificial Sequence
  Synthetic Oligonucleotide; BTLA exon 2; Set C
agucacaugaggccuguuag

SEQ ID NO: 47874 - RNA, 22 nt, Artificial Sequence
  Synthetic Oligonucleotide; BTLA exon 2; Set A
aagucacaugaggccuguuagc

SEQ ID NO: 47875 - RNA, 18 nt, Artificial Sequence
  Synthetic Oligonucleotide; BTLA exon 2; Set C
gucacaugaggccuguua

SEQ ID NO: 47876 - RNA, 16 nt, Artificial Sequence
  Synthetic Oligonucleotide; BTLA exon 2; Set C
ucacaugaggccuguu

SEQ ID NO: 47877 - RNA, 21 nt, Artificial Sequence
  Synthetic Oligonucleotide; BTLA exon 2; Set C
aagucacaugaggccuguuag

SEQ ID NO: 47878 - RNA, 17 nt, Artificial Sequence
  Synthetic Oligonucleotide; BTLA exon 2; Set C
gucacaugaggccuguu

SEQ ID NO: 47879 - RNA, 31 nt, Artificial Sequence
  Synthetic Oligonucleotide; BTLA exon 2; Set C
gcaccaagucacaugaggccuguuagcacag

SEQ ID NO: 47880 - RNA, 34 nt, Artificial Sequence
  Synthetic Oligonucleotide; BTLA exon 2; Set C
uugcaccaagucacaugaggccuguuagcacagu

SEQ ID NO: 47881 - RNA, 20 nt, Artificial Sequence
  Synthetic Oligonucleotide; BTLA exon 2; Set C
aagucacaugaggccuguua

SEQ ID NO: 47882 - RNA, 32 nt, Artificial Sequence
  Synthetic Oligonucleotide; BTLA exon 2; Set C
ugcaccaagucacaugaggccuguuagcacag

SEQ ID NO: 47883 - RNA, 30 nt, Artificial Sequence
  Synthetic Oligonucleotide; BTLA exon 2; Set C
gcaccaagucacaugaggccuguuagcaca

SEQ ID NO: 47884 - RNA, 19 nt, Artificial Sequence
  Synthetic Oligonucleotide; BTLA exon 2; Set C
aagucacaugaggccuguu

SEQ ID NO: 47885 - RNA, 33 nt, Artificial Sequence
  Synthetic Oligonucleotide; BTLA exon 2; Set C
uugcaccaagucacaugaggccuguuagcacag

SEQ ID NO: 47886 - RNA, 31 nt, Artificial Sequence
  Synthetic Oligonucleotide; BTLA exon 2; Set C
ugcaccaagucacaugaggccuguuagcaca

SEQ ID NO: 47887 - RNA, 29 nt, Artificial Sequence
  Synthetic Oligonucleotide; BTLA exon 2; Set C
gcaccaagucacaugaggccuguuagcac

SEQ ID NO: 47888 - RNA, 40 nt, Artificial Sequence
  Synthetic Oligonucleotide; BTLA exon 2; Set C
gagcuugcaccaagucacaugaggccuguuagcacaguau

SEQ ID NO: 47889 - RNA, 28 nt, Artificial Sequence
  Synthetic Oligonucleotide; BTLA exon 2; Set C
gcaccaagucacaugaggccuguuagca

SEQ ID NO: 47890 - RNA, 30 nt, Artificial Sequence
  Synthetic Oligonucleotide; BTLA exon 2; Set C
ugcaccaagucacaugaggccuguuagcac

SEQ ID NO: 47891 - RNA, 39 nt, Artificial Sequence
  Synthetic Oligonucleotide; BTLA exon 2; Set C
gagcuugcaccaagucacaugaggccuguuagcacagua

SEQ ID NO: 47892 - RNA, 29 nt, Artificial Sequence
  Synthetic Oligonucleotide; BTLA exon 2; Set C
ugcaccaagucacaugaggccuguuagca

SEQ ID NO: 47893 - RNA, 38 nt, Artificial Sequence
  Synthetic Oligonucleotide; BTLA exon 2; Set C
gagcuugcaccaagucacaugaggccuguuagcacagu

SEQ ID NO: 47894 - RNA, 30 nt, Artificial Sequence
  Synthetic Oligonucleotide; BTLA exon 2; Set C
uugcaccaagucacaugaggccuguuagca

SEQ ID NO: 47895 - RNA, 29 nt, Artificial Sequence
  Synthetic Oligonucleotide; BTLA exon 2; Set C
uugcaccaagucacaugaggccuguuagc

SEQ ID NO: 47896 - RNA, 28 nt, Artificial Sequence
  Synthetic Oligonucleotide; BTLA exon 2; Set C
uugcaccaagucacaugaggccuguuag

SEQ ID NO: 47897 - RNA, 38 nt, Artificial Sequence
  Synthetic Oligonucleotide; BTLA exon 2; Set C
ugagcuugcaccaagucacaugaggccuguuagcacag

SEQ ID NO: 47898 - RNA, 27 nt, Artificial Sequence
  Synthetic Oligonucleotide; BTLA exon 2; Set C
uugcaccaagucacaugaggccuguua

SEQ ID NO: 47899 - RNA, 39 nt, Artificial Sequence
  Synthetic Oligonucleotide; BTLA exon 2; Set C
uugagcuugcaccaagucacaugaggccuguuagcacag

SEQ ID NO: 47900 - RNA, 37 nt, Artificial Sequence
  Synthetic Oligonucleotide; BTLA exon 2; Set C
ugagcuugcaccaagucacaugaggccuguuagcaca

SEQ ID NO: 47901 - RNA, 26 nt, Artificial Sequence
  Synthetic Oligonucleotide; BTLA exon 2; Set C
uugcaccaagucacaugaggccuguu

SEQ ID NO: 47902 - RNA, 38 nt, Artificial Sequence
  Synthetic Oligonucleotide; BTLA exon 2; Set C
uugagcuugcaccaagucacaugaggccuguuagcaca

SEQ ID NO: 47903 - RNA, 36 nt, Artificial Sequence
  Synthetic Oligonucleotide; BTLA exon 2; Set C
ugagcuugcaccaagucacaugaggccuguuagcac

SEQ ID NO: 47904 - RNA, 33 nt, Artificial Sequence
  Synthetic Oligonucleotide; BTLA exon 2; Set C
gagcuugcaccaagucacaugaggccuguuagc

SEQ ID NO: 47905 - RNA, 35 nt, Artificial Sequence
  Synthetic Oligonucleotide; BTLA exon 2; Set C
ugagcuugcaccaagucacaugaggccuguuagca

SEQ ID NO: 47906 - RNA, 37 nt, Artificial Sequence
  Synthetic Oligonucleotide; BTLA exon 2; Set C
uugagcuugcaccaagucacaugaggccuguuagcac

SEQ ID NO: 47907 - RNA, 32 nt, Artificial Sequence
  Synthetic Oligonucleotide; BTLA exon 2; Set C
gagcuugcaccaagucacaugaggccuguuag

SEQ ID NO: 47908 - RNA, 36 nt, Artificial Sequence
  Synthetic Oligonucleotide; BTLA exon 2; Set C
uugagcuugcaccaagucacaugaggccuguuagca

SEQ ID NO: 47909 - RNA, 31 nt, Artificial Sequence
  Synthetic Oligonucleotide; BTLA exon 2; Set C
gagcuugcaccaagucacaugaggccuguua

SEQ ID NO: 47910 - RNA, 30 nt, Artificial Sequence
  Synthetic Oligonucleotide; BTLA exon 2; Set C
gagcuugcaccaagucacaugaggccuguu

SEQ ID NO: 47911 - RNA, 39 nt, Artificial Sequence
  Synthetic Oligonucleotide; BTLA exon 2; Set C
guuccauugagcuugcaccaagucacaugaggccuguua

SEQ ID NO: 47912 - RNA, 40 nt, Artificial Sequence
  Synthetic Oligonucleotide; BTLA exon 2; Set C
uguuccauugagcuugcaccaagucacaugaggccuguua

SEQ ID NO: 47913 - RNA, 38 nt, Artificial Sequence
  Synthetic Oligonucleotide; BTLA exon 2; Set C
guuccauugagcuugcaccaagucacaugaggccuguu

SEQ ID NO: 47914 - RNA, 39 nt, Artificial Sequence
  Synthetic Oligonucleotide; BTLA exon 2; Set C
uguuccauugagcuugcaccaagucacaugaggccuguu

SEQ ID NO: 47915 - RNA, 21 nt, Artificial Sequence
  Synthetic Oligonucleotide; BTLA exon 2; Set A
gagcuugcaccaagucacaug

SEQ ID NO: 47916 - RNA, 20 nt, Artificial Sequence
  Synthetic Oligonucleotide; BTLA exon 2; Set A
gagcuugcaccaagucacau

SEQ ID NO: 47917 - RNA, 40 nt, Artificial Sequence
  Synthetic Oligonucleotide; BTLA exon 2; Set C
uuguuccauugagcuugcaccaagucacaugaggccuguu

SEQ ID NO: 47918 - RNA, 19 nt, Artificial Sequence
  Synthetic Oligonucleotide; BTLA exon 2; Set A
gagcuugcaccaagucaca

SEQ ID NO: 47919 - RNA, 18 nt, Artificial Sequence
  Synthetic Oligonucleotide; BTLA exon 2; Set C
gagcuugcaccaagucac

SEQ ID NO: 47920 - RNA, 19 nt, Artificial Sequence
  Synthetic Oligonucleotide; BTLA exon 2; Set C
uugagcuugcaccaaguca

SEQ ID NO: 47921 - RNA, 17 nt, Artificial Sequence
  Synthetic Oligonucleotide; BTLA exon 2; Set C
ugagcuugcaccaaguc

SEQ ID NO: 47922 - RNA, 18 nt, Artificial Sequence
  Synthetic Oligonucleotide; BTLA exon 2; Set C
uugagcuugcaccaaguc

SEQ ID NO: 47923 - RNA, 16 nt, Artificial Sequence
  Synthetic Oligonucleotide; BTLA exon 2; Set C
ugagcuugcaccaagu

SEQ ID NO: 47924 - RNA, 29 nt, Artificial Sequence
  Synthetic Oligonucleotide; BTLA exon 2; Set C
guuccauugagcuugcaccaagucacaug

SEQ ID NO: 47925 - RNA, 15 nt, Artificial Sequence
  Synthetic Oligonucleotide; BTLA exon 2; Set C
ugagcuugcaccaag

SEQ ID NO: 47926 - RNA, 16 nt, Artificial Sequence
  Synthetic Oligonucleotide; BTLA exon 2; Set C
uugagcuugcaccaag

SEQ ID NO: 47927 - RNA, 24 nt, Artificial Sequence
  Synthetic Oligonucleotide; BTLA exon 2; Set A
uuccauugagcuugcaccaaguca

SEQ ID NO: 47928 - RNA, 25 nt, Artificial Sequence
  Synthetic Oligonucleotide; BTLA exon 2; Set A
guuccauugagcuugcaccaaguca

SEQ ID NO: 47929 - RNA, 23 nt, Artificial Sequence
  Synthetic Oligonucleotide; BTLA exon 2; Set A
uuccauugagcuugcaccaaguc

SEQ ID NO: 47930 - RNA, 26 nt, Artificial Sequence
  Synthetic Oligonucleotide; BTLA exon 2; Set A
uguuccauugagcuugcaccaaguca

SEQ ID NO: 47931 - RNA, 27 nt, Artificial Sequence
  Synthetic Oligonucleotide; BTLA exon 2; Set A
uuguuccauugagcuugcaccaaguca

SEQ ID NO: 47932 - RNA, 26 nt, Artificial Sequence
  Synthetic Oligonucleotide; BTLA exon 2; Set A
uuguuccauugagcuugcaccaaguc

SEQ ID NO: 47933 - RNA, 27 nt, Artificial Sequence
  Synthetic Oligonucleotide; BTLA exon 2; Set A
guuguuccauugagcuugcaccaaguc

SEQ ID NO: 47934 - RNA, 26 nt, Artificial Sequence
  Synthetic Oligonucleotide; BTLA exon 2; Set A
guuguuccauugagcuugcaccaagu

SEQ ID NO: 47935 - RNA, 25 nt, Artificial Sequence
  Synthetic Oligonucleotide; BTLA exon 2; Set A
guuguuccauugagcuugcaccaag

SEQ ID NO: 47936 - RNA, 16 nt, Artificial Sequence
  Synthetic Oligonucleotide; BTLA exon 2; Set C
uuccauugagcuugca

SEQ ID NO: 47937 - RNA, 17 nt, Artificial Sequence
  Synthetic Oligonucleotide; BTLA exon 2; Set C
guuccauugagcuugca

SEQ ID NO: 47938 - RNA, 15 nt, Artificial Sequence
  Synthetic Oligonucleotide; BTLA exon 2; Set C
uuccauugagcuugc

SEQ ID NO: 47939 - RNA, 18 nt, Artificial Sequence
  Synthetic Oligonucleotide; BTLA exon 2; Set C
uguuccauugagcuugca

SEQ ID NO: 47940 - RNA, 16 nt, Artificial Sequence
  Synthetic Oligonucleotide; BTLA exon 2; Set C
guuccauugagcuugc

SEQ ID NO: 47941 - RNA, 19 nt, Artificial Sequence
  Synthetic Oligonucleotide; BTLA exon 2; Set C
uuguuccauugagcuugca

SEQ ID NO: 47942 - RNA, 17 nt, Artificial Sequence
  Synthetic Oligonucleotide; BTLA exon 2; Set C
uguuccauugagcuugc

SEQ ID NO: 47943 - RNA, 15 nt, Artificial Sequence
  Synthetic Oligonucleotide; BTLA exon 2; Set C
guuccauugagcuug

SEQ ID NO: 47944 - RNA, 18 nt, Artificial Sequence
  Synthetic Oligonucleotide; BTLA exon 2; Set C
uuguuccauugagcuugc

SEQ ID NO: 47945 - RNA, 16 nt, Artificial Sequence
  Synthetic Oligonucleotide; BTLA exon 2; Set C
uguuccauugagcuug

SEQ ID NO: 47946 - RNA, 17 nt, Artificial Sequence
  Synthetic Oligonucleotide; BTLA exon 2; Set C
uuguuccauugagcuug

SEQ ID NO: 47947 - RNA, 35 nt, Artificial Sequence
  Synthetic Oligonucleotide; BTLA exon 2; Set C
uuacacauguuguuccauugagcuugcaccaaguc

SEQ ID NO: 47948 - RNA, 36 nt, Artificial Sequence
  Synthetic Oligonucleotide; BTLA exon 2; Set C
uuuacacauguuguuccauugagcuugcaccaaguc

SEQ ID NO: 47949 - RNA, 34 nt, Artificial Sequence
  Synthetic Oligonucleotide; BTLA exon 2; Set C
uuacacauguuguuccauugagcuugcaccaagu

SEQ ID NO: 47950 - RNA, 33 nt, Artificial Sequence
  Synthetic Oligonucleotide; BTLA exon 2; Set C
uuacacauguuguuccauugagcuugcaccaag

SEQ ID NO: 47951 - RNA, 35 nt, Artificial Sequence
  Synthetic Oligonucleotide; BTLA exon 2; Set C
uuuacacauguuguuccauugagcuugcaccaagu

SEQ ID NO: 47952 - RNA, 34 nt, Artificial Sequence
  Synthetic Oligonucleotide; BTLA exon 2; Set C
uuuacacauguuguuccauugagcuugcaccaag

SEQ ID NO: 47953 - RNA, 22 nt, Artificial Sequence
  Synthetic Oligonucleotide; BTLA exon 2; Set C
uuacacauguuguuccauugag

SEQ ID NO: 47954 - RNA, 23 nt, Artificial Sequence
  Synthetic Oligonucleotide; BTLA exon 2; Set C
uuuacacauguuguuccauugag

SEQ ID NO: 47955 - RNA, 37 nt, Artificial Sequence
  Synthetic Oligonucleotide; BTLA exon 2; Set C
cuucaaguuuuacacauguuguuccauugagcuugca

SEQ ID NO: 47956 - RNA, 38 nt, Artificial Sequence
  Synthetic Oligonucleotide; BTLA exon 2; Set C
ucuucaaguuuuacacauguuguuccauugagcuugca

SEQ ID NO: 47957 - RNA, 36 nt, Artificial Sequence
  Synthetic Oligonucleotide; BTLA exon 2; Set C
cuucaaguuuuacacauguuguuccauugagcuugc

SEQ ID NO: 47958 - RNA, 37 nt, Artificial Sequence
  Synthetic Oligonucleotide; BTLA exon 2; Set C
ucuucaaguuuuacacauguuguuccauugagcuugc

SEQ ID NO: 47959 - RNA, 35 nt, Artificial Sequence
  Synthetic Oligonucleotide; BTLA exon 2; Set A
cuucaaguuuuacacauguuguuccauugagcuug

SEQ ID NO: 47960 - RNA, 38 nt, Artificial Sequence
  Synthetic Oligonucleotide; BTLA exon 2; Set C
aucuucaaguuuuacacauguuguuccauugagcuugc

SEQ ID NO: 47961 - RNA, 36 nt, Artificial Sequence
  Synthetic Oligonucleotide; BTLA exon 2; Set A
ucuucaaguuuuacacauguuguuccauugagcuug

SEQ ID NO: 47962 - RNA, 37 nt, Artificial Sequence
  Synthetic Oligonucleotide; BTLA exon 2; Set A
aucuucaaguuuuacacauguuguuccauugagcuug

SEQ ID NO: 47963 - RNA, 38 nt, Artificial Sequence
  Synthetic Oligonucleotide; BTLA exon 2; Set A
uaucuucaaguuuuacacauguuguuccauugagcuug

SEQ ID NO: 47964 - RNA, 39 nt, Artificial Sequence
  Synthetic Oligonucleotide; BTLA exon 2; Set A
cuaucuucaaguuuuacacauguuguuccauugagcuug

SEQ ID NO: 47965 - RNA, 40 nt, Artificial Sequence
  Synthetic Oligonucleotide; BTLA exon 2; Set C
ucuaucuucaaguuuuacacauguuguuccauugagcuug

SEQ ID NO: 47966 - RNA, 29 nt, Artificial Sequence
  Synthetic Oligonucleotide; BTLA exon 2; Set A
cuucaaguuuuacacauguuguuccauug

SEQ ID NO: 47967 - RNA, 30 nt, Artificial Sequence
  Synthetic Oligonucleotide; BTLA exon 2; Set A
ucuucaaguuuuacacauguuguuccauug

SEQ ID NO: 47968 - RNA, 31 nt, Artificial Sequence
  Synthetic Oligonucleotide; BTLA exon 2; Set A
aucuucaaguuuuacacauguuguuccauug

SEQ ID NO: 47969 - RNA, 32 nt, Artificial Sequence
  Synthetic Oligonucleotide; BTLA exon 2; Set A
uaucuucaaguuuuacacauguuguuccauug

SEQ ID NO: 47970 - RNA, 36 nt, Artificial Sequence
  Synthetic Oligonucleotide; BTLA exon 2; Set A
ucuaucuucaaguuuuacacauguuguuccauugag

SEQ ID NO: 47971 - RNA, 37 nt, Artificial Sequence
  Synthetic Oligonucleotide; BTLA exon 2; Set A
gucuaucuucaaguuuuacacauguuguuccauugag

SEQ ID NO: 47972 - RNA, 24 nt, Artificial Sequence
  Synthetic Oligonucleotide; BTLA exon 2; Set C
cuucaaguuuuacacauguuguuc

SEQ ID NO: 47973 - RNA, 38 nt, Artificial Sequence
  Synthetic Oligonucleotide; BTLA exon 2; Set A
ugucuaucuucaaguuuuacacauguuguuccauugag

SEQ ID NO: 47974 - RNA, 25 nt, Artificial Sequence
  Synthetic Oligonucleotide; BTLA exon 2; Set C
ucuucaaguuuuacacauguuguuc

SEQ ID NO: 47975 - RNA, 23 nt, Artificial Sequence
  Synthetic Oligonucleotide; BTLA exon 2; Set C
cuucaaguuuuacacauguuguu

SEQ ID NO: 47976 - RNA, 39 nt, Artificial Sequence
  Synthetic Oligonucleotide; BTLA exon 2; Set A
uugucuaucuucaaguuuuacacauguuguuccauugag

SEQ ID NO: 47977 - RNA, 26 nt, Artificial Sequence
  Synthetic Oligonucleotide; BTLA exon 2; Set C
aucuucaaguuuuacacauguuguuc

SEQ ID NO: 47978 - RNA, 24 nt, Artificial Sequence
  Synthetic Oligonucleotide; BTLA exon 2; Set C
ucuucaaguuuuacacauguuguu

SEQ ID NO: 47979 - RNA, 22 nt, Artificial Sequence
  Synthetic Oligonucleotide; BTLA exon 2; Set C
cuucaaguuuuacacauguugu

SEQ ID NO: 47980 - RNA, 40 nt, Artificial Sequence
  Synthetic Oligonucleotide; BTLA exon 2; Set A
uuugucuaucuucaaguuuuacacauguuguuccauugag

SEQ ID NO: 47981 - RNA, 27 nt, Artificial Sequence
  Synthetic Oligonucleotide; BTLA exon 2; Set C
uaucuucaaguuuuacacauguuguuc

SEQ ID NO: 47982 - RNA, 23 nt, Artificial Sequence
  Synthetic Oligonucleotide; BTLA exon 2; Set C
ucuucaaguuuuacacauguugu

SEQ ID NO: 47983 - RNA, 25 nt, Artificial Sequence
  Synthetic Oligonucleotide; BTLA exon 2; Set C
aucuucaaguuuuacacauguuguu

SEQ ID NO: 47984 - RNA, 21 nt, Artificial Sequence
  Synthetic Oligonucleotide; BTLA exon 2; Set C
cuucaaguuuuacacauguug

SEQ ID NO: 47985 - RNA, 26 nt, Artificial Sequence
  Synthetic Oligonucleotide; BTLA exon 2; Set C
uaucuucaaguuuuacacauguuguu

SEQ ID NO: 47986 - RNA, 22 nt, Artificial Sequence
  Synthetic Oligonucleotide; BTLA exon 2; Set C
ucuucaaguuuuacacauguug

SEQ ID NO: 47987 - RNA, 24 nt, Artificial Sequence
  Synthetic Oligonucleotide; BTLA exon 2; Set C
aucuucaaguuuuacacauguugu

SEQ ID NO: 47988 - RNA, 39 nt, Artificial Sequence
  Synthetic Oligonucleotide; BTLA exon 2; Set A
guuugucuaucuucaaguuuuacacauguuguuccauug

SEQ ID NO: 47989 - RNA, 27 nt, Artificial Sequence
  Synthetic Oligonucleotide; BTLA exon 2; Set C
cuaucuucaaguuuuacacauguuguu

SEQ ID NO: 47990 - RNA, 25 nt, Artificial Sequence
  Synthetic Oligonucleotide; BTLA exon 2; Set C
uaucuucaaguuuuacacauguugu

SEQ ID NO: 47991 - RNA, 23 nt, Artificial Sequence
  Synthetic Oligonucleotide; BTLA exon 2; Set C
aucuucaaguuuuacacauguug

SEQ ID NO: 47992 - RNA, 40 nt, Artificial Sequence
  Synthetic Oligonucleotide; BTLA exon 2; Set A
uguuugucuaucuucaaguuuuacacauguuguuccauug

SEQ ID NO: 47993 - RNA, 28 nt, Artificial Sequence
  Synthetic Oligonucleotide; BTLA exon 2; Set C
ucuaucuucaaguuuuacacauguuguu

SEQ ID NO: 47994 - RNA, 26 nt, Artificial Sequence
  Synthetic Oligonucleotide; BTLA exon 2; Set C
cuaucuucaaguuuuacacauguugu

SEQ ID NO: 47995 - RNA, 24 nt, Artificial Sequence
  Synthetic Oligonucleotide; BTLA exon 2; Set C
uaucuucaaguuuuacacauguug

SEQ ID NO: 47996 - RNA, 29 nt, Artificial Sequence
  Synthetic Oligonucleotide; BTLA exon 2; Set A
gucuaucuucaaguuuuacacauguuguu

SEQ ID NO: 47997 - RNA, 27 nt, Artificial Sequence
  Synthetic Oligonucleotide; BTLA exon 2; Set C
ucuaucuucaaguuuuacacauguugu

SEQ ID NO: 47998 - RNA, 25 nt, Artificial Sequence
  Synthetic Oligonucleotide; BTLA exon 2; Set C
cuaucuucaaguuuuacacauguug

SEQ ID NO: 47999 - RNA, 30 nt, Artificial Sequence
  Synthetic Oligonucleotide; BTLA exon 2; Set A
ugucuaucuucaaguuuuacacauguuguu

SEQ ID NO: 48000 - RNA, 28 nt, Artificial Sequence
  Synthetic Oligonucleotide; BTLA exon 2; Set A
gucuaucuucaaguuuuacacauguugu

SEQ ID NO: 48001 - RNA, 26 nt, Artificial Sequence
  Synthetic Oligonucleotide; BTLA exon 2; Set C
ucuaucuucaaguuuuacacauguug

SEQ ID NO: 48002 - RNA, 29 nt, Artificial Sequence
  Synthetic Oligonucleotide; BTLA exon 2; Set A
ugucuaucuucaaguuuuacacauguugu

SEQ ID NO: 48003 - RNA, 27 nt, Artificial Sequence
  Synthetic Oligonucleotide; BTLA exon 2; Set C
gucuaucuucaaguuuuacacauguug

SEQ ID NO: 48004 - RNA, 34 nt, Artificial Sequence
  Synthetic Oligonucleotide; BTLA exon 2; Set A
guuugucuaucuucaaguuuuacacauguuguuc

SEQ ID NO: 48005 - RNA, 28 nt, Artificial Sequence
  Synthetic Oligonucleotide; BTLA exon 2; Set C
ugucuaucuucaaguuuuacacauguug

SEQ ID NO: 48006 - RNA, 35 nt, Artificial Sequence
  Synthetic Oligonucleotide; BTLA exon 2; Set A
uguuugucuaucuucaaguuuuacacauguuguuc

SEQ ID NO: 48007 - RNA, 33 nt, Artificial Sequence
  Synthetic Oligonucleotide; BTLA exon 2; Set A
guuugucuaucuucaaguuuuacacauguuguu

SEQ ID NO: 48008 - RNA, 36 nt, Artificial Sequence
  Synthetic Oligonucleotide; BTLA exon 2; Set A
uuguuugucuaucuucaaguuuuacacauguuguuc

SEQ ID NO: 48009 - RNA, 32 nt, Artificial Sequence
  Synthetic Oligonucleotide; BTLA exon 2; Set A
guuugucuaucuucaaguuuuacacauguugu

SEQ ID NO: 48010 - RNA, 34 nt, Artificial Sequence
  Synthetic Oligonucleotide; BTLA exon 2; Set A
uguuugucuaucuucaaguuuuacacauguuguu

SEQ ID NO: 48011 - RNA, 37 nt, Artificial Sequence
  Synthetic Oligonucleotide; BTLA exon 2; Set A
cuuguuugucuaucuucaaguuuuacacauguuguuc

SEQ ID NO: 48012 - RNA, 31 nt, Artificial Sequence
  Synthetic Oligonucleotide; BTLA exon 2; Set A
guuugucuaucuucaaguuuuacacauguug

SEQ ID NO: 48013 - RNA, 33 nt, Artificial Sequence
  Synthetic Oligonucleotide; BTLA exon 2; Set A
uguuugucuaucuucaaguuuuacacauguugu

SEQ ID NO: 48014 - RNA, 35 nt, Artificial Sequence
  Synthetic Oligonucleotide; BTLA exon 2; Set A
uuguuugucuaucuucaaguuuuacacauguuguu

SEQ ID NO: 48015 - RNA, 38 nt, Artificial Sequence
  Synthetic Oligonucleotide; BTLA exon 2; Set A
acuuguuugucuaucuucaaguuuuacacauguuguuc

SEQ ID NO: 48016 - RNA, 32 nt, Artificial Sequence
  Synthetic Oligonucleotide; BTLA exon 2; Set A
uguuugucuaucuucaaguuuuacacauguug

SEQ ID NO: 48017 - RNA, 34 nt, Artificial Sequence
  Synthetic Oligonucleotide; BTLA exon 2; Set A
uuguuugucuaucuucaaguuuuacacauguugu

SEQ ID NO: 48018 - RNA, 36 nt, Artificial Sequence
  Synthetic Oligonucleotide; BTLA exon 2; Set A
cuuguuugucuaucuucaaguuuuacacauguuguu

SEQ ID NO: 48019 - RNA, 39 nt, Artificial Sequence
  Synthetic Oligonucleotide; BTLA exon 2; Set A
aacuuguuugucuaucuucaaguuuuacacauguuguuc

SEQ ID NO: 48020 - RNA, 33 nt, Artificial Sequence
  Synthetic Oligonucleotide; BTLA exon 2; Set A
uuguuugucuaucuucaaguuuuacacauguug

SEQ ID NO: 48021 - RNA, 37 nt, Artificial Sequence
  Synthetic Oligonucleotide; BTLA exon 2; Set A
acuuguuugucuaucuucaaguuuuacacauguuguu

SEQ ID NO: 48022 - RNA, 32 nt, Artificial Sequence
  Synthetic Oligonucleotide; BTLA exon 2; Set A
uuguuugucuaucuucaaguuuuacacauguu

SEQ ID NO: 48023 - RNA, 36 nt, Artificial Sequence
  Synthetic Oligonucleotide; BTLA exon 2; Set A
acuuguuugucuaucuucaaguuuuacacauguugu

SEQ ID NO: 48024 - RNA, 38 nt, Artificial Sequence
  Synthetic Oligonucleotide; BTLA exon 2; Set A
aacuuguuugucuaucuucaaguuuuacacauguuguu

SEQ ID NO: 48025 - RNA, 33 nt, Artificial Sequence
  Synthetic Oligonucleotide; BTLA exon 2; Set A
cuuguuugucuaucuucaaguuuuacacauguu

SEQ ID NO: 48026 - RNA, 35 nt, Artificial Sequence
  Synthetic Oligonucleotide; BTLA exon 2; Set A
acuuguuugucuaucuucaaguuuuacacauguug

SEQ ID NO: 48027 - RNA, 37 nt, Artificial Sequence
  Synthetic Oligonucleotide; BTLA exon 2; Set A
aacuuguuugucuaucuucaaguuuuacacauguugu

SEQ ID NO: 48028 - RNA, 34 nt, Artificial Sequence
  Synthetic Oligonucleotide; BTLA exon 2; Set A
acuuguuugucuaucuucaaguuuuacacauguu

SEQ ID NO: 48029 - RNA, 36 nt, Artificial Sequence
  Synthetic Oligonucleotide; BTLA exon 2; Set A
aacuuguuugucuaucuucaaguuuuacacauguug

SEQ ID NO: 48030 - RNA, 35 nt, Artificial Sequence
  Synthetic Oligonucleotide; BTLA exon 2; Set A
aacuuguuugucuaucuucaaguuuuacacauguu

SEQ ID NO: 48031 - RNA, 24 nt, Artificial Sequence
  Synthetic Oligonucleotide; BTLA exon 2; Set C
uuguuugucuaucuucaaguuuua

SEQ ID NO: 48032 - RNA, 23 nt, Artificial Sequence
  Synthetic Oligonucleotide; BTLA exon 2; Set C
uuguuugucuaucuucaaguuuu

SEQ ID NO: 48033 - RNA, 25 nt, Artificial Sequence
  Synthetic Oligonucleotide; BTLA exon 2; Set C
cuuguuugucuaucuucaaguuuua

SEQ ID NO: 48034 - RNA, 24 nt, Artificial Sequence
  Synthetic Oligonucleotide; BTLA exon 2; Set C
cuuguuugucuaucuucaaguuuu

SEQ ID NO: 48035 - RNA, 26 nt, Artificial Sequence
  Synthetic Oligonucleotide; BTLA exon 2; Set C
acuuguuugucuaucuucaaguuuua

SEQ ID NO: 48036 - RNA, 25 nt, Artificial Sequence
  Synthetic Oligonucleotide; BTLA exon 2; Set C
acuuguuugucuaucuucaaguuuu

SEQ ID NO: 48037 - RNA, 27 nt, Artificial Sequence
  Synthetic Oligonucleotide; BTLA exon 2; Set C
aacuuguuugucuaucuucaaguuuua

SEQ ID NO: 48038 - RNA, 26 nt, Artificial Sequence
  Synthetic Oligonucleotide; BTLA exon 2; Set C
aacuuguuugucuaucuucaaguuuu

SEQ ID NO: 48039 - RNA, 40 nt, Artificial Sequence
  Synthetic Oligonucleotide; BTLA exon 2; Set A
cuucucuuccuuccaacuuguuugucuaucuucaaguuuu

SEQ ID NO: 48040 - RNA, 32 nt, Artificial Sequence
  Synthetic Oligonucleotide; BTLA exon 2; Set A
cuucucuuccuuccaacuuguuugucuaucuu

SEQ ID NO: 48041 - RNA, 31 nt, Artificial Sequence
  Synthetic Oligonucleotide; BTLA exon 2; Set A
cuucucuuccuuccaacuuguuugucuaucu

SEQ ID NO: 48042 - RNA, 30 nt, Artificial Sequence
  Synthetic Oligonucleotide; BTLA exon 2; Set A
cuucucuuccuuccaacuuguuugucuauc

SEQ ID NO: 48043 - RNA, 29 nt, Artificial Sequence
  Synthetic Oligonucleotide; BTLA exon 2; Set A
cuucucuuccuuccaacuuguuugucuau

SEQ ID NO: 48044 - RNA, 28 nt, Artificial Sequence
  Synthetic Oligonucleotide; BTLA exon 2; Set A
cuucucuuccuuccaacuuguuugucua

SEQ ID NO: 48045 - RNA, 27 nt, Artificial Sequence
  Synthetic Oligonucleotide; BTLA exon 2; Set A
cuucucuuccuuccaacuuguuugucu

SEQ ID NO: 48046 - RNA, 26 nt, Artificial Sequence
  Synthetic Oligonucleotide; BTLA exon 2; Set A
cuucucuuccuuccaacuuguuuguc

SEQ ID NO: 48047 - RNA, 27 nt, Artificial Sequence
  Synthetic Oligonucleotide; BTLA exon 2; Set A
ucuucucuuccuuccaacuuguuuguc

SEQ ID NO: 48048 - RNA, 25 nt, Artificial Sequence
  Synthetic Oligonucleotide; BTLA exon 2; Set A
cuucucuuccuuccaacuuguuugu

SEQ ID NO: 48049 - RNA, 24 nt, Artificial Sequence
  Synthetic Oligonucleotide; BTLA exon 2; Set C
cuucucuuccuuccaacuuguuug

SEQ ID NO: 48050 - RNA, 26 nt, Artificial Sequence
  Synthetic Oligonucleotide; BTLA exon 2; Set A
ucuucucuuccuuccaacuuguuugu

SEQ ID NO: 48051 - RNA, 25 nt, Artificial Sequence
  Synthetic Oligonucleotide; BTLA exon 2; Set C
ucuucucuuccuuccaacuuguuug

SEQ ID NO: 48052 - RNA, 23 nt, Artificial Sequence
  Synthetic Oligonucleotide; BTLA exon 2; Set C
cuucucuuccuuccaacuuguuu

SEQ ID NO: 48053 - RNA, 27 nt, Artificial Sequence
  Synthetic Oligonucleotide; BTLA exon 2; Set A
uucuucucuuccuuccaacuuguuugu

SEQ ID NO: 48054 - RNA, 24 nt, Artificial Sequence
  Synthetic Oligonucleotide; BTLA exon 2; Set C
ucuucucuuccuuccaacuuguuu

SEQ ID NO: 48055 - RNA, 25 nt, Artificial Sequence
  Synthetic Oligonucleotide; BTLA exon 2; Set C
uucuucucuuccuuccaacuuguuu

SEQ ID NO: 48056 - RNA, 23 nt, Artificial Sequence
  Synthetic Oligonucleotide; BTLA exon 2; Set C
ucuucucuuccuuccaacuuguu

SEQ ID NO: 48057 - RNA, 24 nt, Artificial Sequence
  Synthetic Oligonucleotide; BTLA exon 2; Set C
uucuucucuuccuuccaacuuguu

SEQ ID NO: 48058 - RNA, 22 nt, Artificial Sequence
  Synthetic Oligonucleotide; BTLA exon 2; Set C
ucuucucuuccuuccaacuugu

SEQ ID NO: 48059 - RNA, 25 nt, Artificial Sequence
  Synthetic Oligonucleotide; BTLA exon 2; Set A
guucuucucuuccuuccaacuuguu

SEQ ID NO: 48060 - RNA, 23 nt, Artificial Sequence
  Synthetic Oligonucleotide; BTLA exon 2; Set C
uucuucucuuccuuccaacuugu

SEQ ID NO: 48061 - RNA, 26 nt, Artificial Sequence
  Synthetic Oligonucleotide; BTLA exon 2; Set A
uguucuucucuuccuuccaacuuguu

SEQ ID NO: 48062 - RNA, 24 nt, Artificial Sequence
  Synthetic Oligonucleotide; BTLA exon 2; Set A
guucuucucuuccuuccaacuugu

SEQ ID NO: 48063 - RNA, 27 nt, Artificial Sequence
  Synthetic Oligonucleotide; BTLA exon 2; Set A
auguucuucucuuccuuccaacuuguu

SEQ ID NO: 48064 - RNA, 25 nt, Artificial Sequence
  Synthetic Oligonucleotide; BTLA exon 2; Set A
uguucuucucuuccuuccaacuugu

SEQ ID NO: 48065 - RNA, 23 nt, Artificial Sequence
  Synthetic Oligonucleotide; BTLA exon 2; Set C
guucuucucuuccuuccaacuug

SEQ ID NO: 48066 - RNA, 28 nt, Artificial Sequence
  Synthetic Oligonucleotide; BTLA exon 2; Set A
aauguucuucucuuccuuccaacuuguu

SEQ ID NO: 48067 - RNA, 26 nt, Artificial Sequence
  Synthetic Oligonucleotide; BTLA exon 2; Set A
auguucuucucuuccuuccaacuugu

SEQ ID NO: 48068 - RNA, 24 nt, Artificial Sequence
  Synthetic Oligonucleotide; BTLA exon 2; Set C
uguucuucucuuccuuccaacuug

SEQ ID NO: 48069 - RNA, 17 nt, Artificial Sequence
  Synthetic Oligonucleotide; BTLA exon 2; Set C
ucuucucuuccuuccaa

SEQ ID NO: 48070 - RNA, 29 nt, Artificial Sequence
  Synthetic Oligonucleotide; BTLA exon 2; Set A
aaauguucuucucuuccuuccaacuuguu

SEQ ID NO: 48071 - RNA, 27 nt, Artificial Sequence
  Synthetic Oligonucleotide; BTLA exon 2; Set A
aauguucuucucuuccuuccaacuugu

SEQ ID NO: 48072 - RNA, 25 nt, Artificial Sequence
  Synthetic Oligonucleotide; BTLA exon 2; Set C
auguucuucucuuccuuccaacuug

SEQ ID NO: 48073 - RNA, 18 nt, Artificial Sequence
  Synthetic Oligonucleotide; BTLA exon 2; Set C
uucuucucuuccuuccaa

SEQ ID NO: 48074 - RNA, 30 nt, Artificial Sequence
  Synthetic Oligonucleotide; BTLA exon 2; Set A
gaaauguucuucucuuccuuccaacuuguu

SEQ ID NO: 48075 - RNA, 28 nt, Artificial Sequence
  Synthetic Oligonucleotide; BTLA exon 2; Set A
aaauguucuucucuuccuuccaacuugu

SEQ ID NO: 48076 - RNA, 26 nt, Artificial Sequence
  Synthetic Oligonucleotide; BTLA exon 2; Set C
aauguucuucucuuccuuccaacuug

SEQ ID NO: 48077 - RNA, 19 nt, Artificial Sequence
  Synthetic Oligonucleotide; BTLA exon 2; Set C
guucuucucuuccuuccaa

SEQ ID NO: 48078 - RNA, 31 nt, Artificial Sequence
  Synthetic Oligonucleotide; BTLA exon 2; Set A
ugaaauguucuucucuuccuuccaacuuguu

SEQ ID NO: 48079 - RNA, 29 nt, Artificial Sequence
  Synthetic Oligonucleotide; BTLA exon 2; Set A
gaaauguucuucucuuccuuccaacuugu

SEQ ID NO: 48080 - RNA, 27 nt, Artificial Sequence
  Synthetic Oligonucleotide; BTLA exon 2; Set C
aaauguucuucucuuccuuccaacuug

SEQ ID NO: 48081 - RNA, 20 nt, Artificial Sequence
  Synthetic Oligonucleotide; BTLA exon 2; Set C
uguucuucucuuccuuccaa

SEQ ID NO: 48082 - RNA, 32 nt, Artificial Sequence
  Synthetic Oligonucleotide; BTLA exon 2; Set A
augaaauguucuucucuuccuuccaacuuguu

SEQ ID NO: 48083 - RNA, 30 nt, Artificial Sequence
  Synthetic Oligonucleotide; BTLA exon 2; Set A
ugaaauguucuucucuuccuuccaacuugu

SEQ ID NO: 48084 - RNA, 28 nt, Artificial Sequence
  Synthetic Oligonucleotide; BTLA exon 2; Set A
gaaauguucuucucuuccuuccaacuug

SEQ ID NO: 48085 - RNA, 26 nt, Artificial Sequence
  Synthetic Oligonucleotide; BTLA exon 2; Set C
aaauguucuucucuuccuuccaacuu

SEQ ID NO: 48086 - RNA, 21 nt, Artificial Sequence
  Synthetic Oligonucleotide; BTLA exon 2; Set C
auguucuucucuuccuuccaa

SEQ ID NO: 48087 - RNA, 33 nt, Artificial Sequence
  Synthetic Oligonucleotide; BTLA exon 2; Set A
aaugaaauguucuucucuuccuuccaacuuguu

SEQ ID NO: 48088 - RNA, 31 nt, Artificial Sequence
  Synthetic Oligonucleotide; BTLA exon 2; Set A
augaaauguucuucucuuccuuccaacuugu

SEQ ID NO: 48089 - RNA, 29 nt, Artificial Sequence
  Synthetic Oligonucleotide; BTLA exon 2; Set A
ugaaauguucuucucuuccuuccaacuug

SEQ ID NO: 48090 - RNA, 27 nt, Artificial Sequence
  Synthetic Oligonucleotide; BTLA exon 2; Set C
gaaauguucuucucuuccuuccaacuu

SEQ ID NO: 48091 - RNA, 22 nt, Artificial Sequence
  Synthetic Oligonucleotide; BTLA exon 2; Set C
aauguucuucucuuccuuccaa

SEQ ID NO: 48092 - RNA, 34 nt, Artificial Sequence
  Synthetic Oligonucleotide; BTLA exon 2; Set A
aaaugaaauguucuucucuuccuuccaacuuguu

SEQ ID NO: 48093 - RNA, 32 nt, Artificial Sequence
  Synthetic Oligonucleotide; BTLA exon 2; Set A
aaugaaauguucuucucuuccuuccaacuugu

SEQ ID NO: 48094 - RNA, 30 nt, Artificial Sequence
  Synthetic Oligonucleotide; BTLA exon 2; Set A
augaaauguucuucucuuccuuccaacuug

SEQ ID NO: 48095 - RNA, 26 nt, Artificial Sequence
  Synthetic Oligonucleotide; BTLA exon 2; Set C
gaaauguucuucucuuccuuccaacu

SEQ ID NO: 48096 - RNA, 28 nt, Artificial Sequence
  Synthetic Oligonucleotide; BTLA exon 2; Set A
ugaaauguucuucucuuccuuccaacuu

SEQ ID NO: 48097 - RNA, 23 nt, Artificial Sequence
  Synthetic Oligonucleotide; BTLA exon 2; Set C
aaauguucuucucuuccuuccaa

SEQ ID NO: 48098 - RNA, 33 nt, Artificial Sequence
  Synthetic Oligonucleotide; BTLA exon 2; Set A
aaaugaaauguucuucucuuccuuccaacuugu

SEQ ID NO: 48099 - RNA, 31 nt, Artificial Sequence
  Synthetic Oligonucleotide; BTLA exon 2; Set A
aaugaaauguucuucucuuccuuccaacuug

SEQ ID NO: 48100 - RNA, 27 nt, Artificial Sequence
  Synthetic Oligonucleotide; BTLA exon 2; Set C
ugaaauguucuucucuuccuuccaacu

SEQ ID NO: 48101 - RNA, 29 nt, Artificial Sequence
  Synthetic Oligonucleotide; BTLA exon 2; Set A
augaaauguucuucucuuccuuccaacuu

SEQ ID NO: 48102 - RNA, 24 nt, Artificial Sequence
  Synthetic Oligonucleotide; BTLA exon 2; Set C
gaaauguucuucucuuccuuccaa

SEQ ID NO: 48103 - RNA, 32 nt, Artificial Sequence
  Synthetic Oligonucleotide; BTLA exon 2; Set C
aaaugaaauguucuucucuuccuuccaacuug

SEQ ID NO: 48104 - RNA, 28 nt, Artificial Sequence
  Synthetic Oligonucleotide; BTLA exon 2; Set C
augaaauguucuucucuuccuuccaacu

SEQ ID NO: 48105 - RNA, 26 nt, Artificial Sequence
  Synthetic Oligonucleotide; BTLA exon 2; Set C
ugaaauguucuucucuuccuuccaac

SEQ ID NO: 48106 - RNA, 30 nt, Artificial Sequence
  Synthetic Oligonucleotide; BTLA exon 2; Set C
aaugaaauguucuucucuuccuuccaacuu

SEQ ID NO: 48107 - RNA, 25 nt, Artificial Sequence
  Synthetic Oligonucleotide; BTLA exon 2; Set C
ugaaauguucuucucuuccuuccaa

SEQ ID NO: 48108 - RNA, 29 nt, Artificial Sequence
  Synthetic Oligonucleotide; BTLA exon 2; Set C
aaugaaauguucuucucuuccuuccaacu

SEQ ID NO: 48109 - RNA, 26 nt, Artificial Sequence
  Synthetic Oligonucleotide; BTLA exon 2; Set C
augaaauguucuucucuuccuuccaa

SEQ ID NO: 48110 - RNA, 28 nt, Artificial Sequence
  Synthetic Oligonucleotide; BTLA exon 2; Set C
aaugaaauguucuucucuuccuuccaac

SEQ ID NO: 48111 - RNA, 27 nt, Artificial Sequence
  Synthetic Oligonucleotide; BTLA exon 2; Set C
aaugaaauguucuucucuuccuuccaa

SEQ ID NO: 48112 - RNA, 28 nt, Artificial Sequence
  Synthetic Oligonucleotide; BTLA exon 2; Set C
aaaugaaauguucuucucuuccuuccaa

SEQ ID NO: 48113 - RNA, 40 nt, Artificial Sequence
  Synthetic Oligonucleotide; BTLA exon 2; Set A
aaugaaaaaugaaauguucuucucuuccuuccaacuuguu

SEQ ID NO: 48114 - RNA, 39 nt, Artificial Sequence
  Synthetic Oligonucleotide; BTLA exon 2; Set A
aaugaaaaaugaaauguucuucucuuccuuccaacuugu

SEQ ID NO: 48115 - RNA, 40 nt, Artificial Sequence
  Synthetic Oligonucleotide; BTLA exon 2; Set A
gaaugaaaaaugaaauguucuucucuuccuuccaacuugu

SEQ ID NO: 48116 - RNA, 39 nt, Artificial Sequence
  Synthetic Oligonucleotide; BTLA exon 2; Set A
gaaugaaaaaugaaauguucuucucuuccuuccaacuug

SEQ ID NO: 48117 - RNA, 34 nt, Artificial Sequence
  Synthetic Oligonucleotide; BTLA exon 2; Set C
aaugaaaaaugaaauguucuucucuuccuuccaa

SEQ ID NO: 48118 - RNA, 35 nt, Artificial Sequence
  Synthetic Oligonucleotide; BTLA exon 2; Set C
gaaugaaaaaugaaauguucuucucuuccuuccaa

SEQ ID NO: 48119 - RNA, 40 nt, Artificial Sequence
  Synthetic Oligonucleotide; BTLA exon 2; Set A
auguagaaugaaaaaugaaauguucuucucuuccuuccaa

SEQ ID NO: 48120 - RNA, 21 nt, Artificial Sequence
  Synthetic Oligonucleotide; BTLA exon 2; Set C
aaugaaaaaugaaauguucuu

SEQ ID NO: 48121 - RNA, 22 nt, Artificial Sequence
  Synthetic Oligonucleotide; BTLA exon 2; Set C
gaaugaaaaaugaaauguucuu

SEQ ID NO: 48122 - RNA, 24 nt, Artificial Sequence
  Synthetic Oligonucleotide; BTLA exon 2; Set C
guagaaugaaaaaugaaauguucu

SEQ ID NO: 48123 - RNA, 25 nt, Artificial Sequence
  Synthetic Oligonucleotide; BTLA exon 2; Set C
uguagaaugaaaaaugaaauguucu

SEQ ID NO: 48124 - RNA, 23 nt, Artificial Sequence
  Synthetic Oligonucleotide; BTLA exon 2; Set C
guagaaugaaaaaugaaauguuc

SEQ ID NO: 48125 - RNA, 22 nt, Artificial Sequence
  Synthetic Oligonucleotide; BTLA exon 2; Set C
guagaaugaaaaaugaaauguu

SEQ ID NO: 48126 - RNA, 26 nt, Artificial Sequence
  Synthetic Oligonucleotide; BTLA exon 2; Set C
auguagaaugaaaaaugaaauguucu

SEQ ID NO: 48127 - RNA, 24 nt, Artificial Sequence
  Synthetic Oligonucleotide; BTLA exon 2; Set C
uguagaaugaaaaaugaaauguuc

SEQ ID NO: 48128 - RNA, 21 nt, Artificial Sequence
  Synthetic Oligonucleotide; BTLA exon 2; Set C
guagaaugaaaaaugaaaugu

SEQ ID NO: 48129 - RNA, 23 nt, Artificial Sequence
  Synthetic Oligonucleotide; BTLA exon 2; Set C
uguagaaugaaaaaugaaauguu

SEQ ID NO: 48130 - RNA, 27 nt, Artificial Sequence
  Synthetic Oligonucleotide; BTLA exon 2; Set C
aauguagaaugaaaaaugaaauguucu

SEQ ID NO: 48131 - RNA, 25 nt, Artificial Sequence
  Synthetic Oligonucleotide; BTLA exon 2; Set C
auguagaaugaaaaaugaaauguuc

SEQ ID NO: 48132 - RNA, 22 nt, Artificial Sequence
  Synthetic Oligonucleotide; BTLA exon 2; Set C
uguagaaugaaaaaugaaaugu

SEQ ID NO: 48133 - RNA, 24 nt, Artificial Sequence
  Synthetic Oligonucleotide; BTLA exon 2; Set C
auguagaaugaaaaaugaaauguu

SEQ ID NO: 48134 - RNA, 26 nt, Artificial Sequence
  Synthetic Oligonucleotide; BTLA exon 2; Set C
aauguagaaugaaaaaugaaauguuc

SEQ ID NO: 48135 - RNA, 28 nt, Artificial Sequence
  Synthetic Oligonucleotide; BTLA exon 2; Set C
aaauguagaaugaaaaaugaaauguucu

SEQ ID NO: 48136 - RNA, 23 nt, Artificial Sequence
  Synthetic Oligonucleotide; BTLA exon 2; Set C
auguagaaugaaaaaugaaaugu

SEQ ID NO: 48137 - RNA, 25 nt, Artificial Sequence
  Synthetic Oligonucleotide; BTLA exon 2; Set C
aauguagaaugaaaaaugaaauguu

SEQ ID NO: 48138 - RNA, 27 nt, Artificial Sequence
  Synthetic Oligonucleotide; BTLA exon 2; Set C
aaauguagaaugaaaaaugaaauguuc

SEQ ID NO: 48139 - RNA, 24 nt, Artificial Sequence
  Synthetic Oligonucleotide; BTLA exon 2; Set C
aauguagaaugaaaaaugaaaugu

SEQ ID NO: 48140 - RNA, 26 nt, Artificial Sequence
  Synthetic Oligonucleotide; BTLA exon 2; Set C
aaauguagaaugaaaaaugaaauguu

SEQ ID NO: 48141 - RNA, 22 nt, Artificial Sequence
  Synthetic Oligonucleotide; BTLA exon 2; Set C
auguagaaugaaaaaugaaaug

SEQ ID NO: 48142 - RNA, 25 nt, Artificial Sequence
  Synthetic Oligonucleotide; BTLA exon 2; Set C
aaauguagaaugaaaaaugaaaugu

SEQ ID NO: 48143 - RNA, 23 nt, Artificial Sequence
  Synthetic Oligonucleotide; BTLA exon 2; Set C
aauguagaaugaaaaaugaaaug

SEQ ID NO: 48144 - RNA, 21 nt, Artificial Sequence
  Synthetic Oligonucleotide; BTLA exon 2; Set C
auguagaaugaaaaaugaaau

SEQ ID NO: 48145 - RNA, 22 nt, Artificial Sequence
  Synthetic Oligonucleotide; BTLA exon 2; Set C
aauguagaaugaaaaaugaaau

SEQ ID NO: 48146 - RNA, 20 nt, Artificial Sequence
  Synthetic Oligonucleotide; BTLA exon 2; Set C
auguagaaugaaaaaugaaa

SEQ ID NO: 48147 - RNA, 24 nt, Artificial Sequence
  Synthetic Oligonucleotide; BTLA exon 2; Set C
aaauguagaaugaaaaaugaaaug

SEQ ID NO: 48148 - RNA, 34 nt, Artificial Sequence
  Synthetic Oligonucleotide; BTLA exon 2; Set C
guucaaaauguagaaugaaaaaugaaauguucuu

SEQ ID NO: 48149 - RNA, 21 nt, Artificial Sequence
  Synthetic Oligonucleotide; BTLA exon 2; Set C
aauguagaaugaaaaaugaaa

SEQ ID NO: 48150 - RNA, 23 nt, Artificial Sequence
  Synthetic Oligonucleotide; BTLA exon 2; Set C
aaauguagaaugaaaaaugaaau

SEQ ID NO: 48151 - RNA, 19 nt, Artificial Sequence
  Synthetic Oligonucleotide; BTLA exon 2; Set C
auguagaaugaaaaaugaa

SEQ ID NO: 48152 - RNA, 33 nt, Artificial Sequence
  Synthetic Oligonucleotide; BTLA exon 2; Set C
guucaaaauguagaaugaaaaaugaaauguucu

SEQ ID NO: 48153 - RNA, 35 nt, Artificial Sequence
  Synthetic Oligonucleotide; BTLA exon 2; Set C
gguucaaaauguagaaugaaaaaugaaauguucuu

SEQ ID NO: 48154 - RNA, 22 nt, Artificial Sequence
  Synthetic Oligonucleotide; BTLA exon 2; Set C
aaauguagaaugaaaaaugaaa

SEQ ID NO: 48155 - RNA, 20 nt, Artificial Sequence
  Synthetic Oligonucleotide; BTLA exon 2; Set C
aauguagaaugaaaaaugaa

SEQ ID NO: 48156 - RNA, 18 nt, Artificial Sequence
  Synthetic Oligonucleotide; BTLA exon 2; Set C
auguagaaugaaaaauga

SEQ ID NO: 48157 - RNA, 32 nt, Artificial Sequence
  Synthetic Oligonucleotide; BTLA exon 2; Set C
guucaaaauguagaaugaaaaaugaaauguuc

SEQ ID NO: 48158 - RNA, 36 nt, Artificial Sequence
  Synthetic Oligonucleotide; BTLA exon 2; Set C
ugguucaaaauguagaaugaaaaaugaaauguucuu

SEQ ID NO: 48159 - RNA, 21 nt, Artificial Sequence
  Synthetic Oligonucleotide; BTLA exon 2; Set C
aaauguagaaugaaaaaugaa

SEQ ID NO: 48160 - RNA, 19 nt, Artificial Sequence
  Synthetic Oligonucleotide; BTLA exon 2; Set C
aauguagaaugaaaaauga

SEQ ID NO: 48161 - RNA, 17 nt, Artificial Sequence
  Synthetic Oligonucleotide; BTLA exon 2; Set C
auguagaaugaaaaaug

SEQ ID NO: 48162 - RNA, 37 nt, Artificial Sequence
  Synthetic Oligonucleotide; BTLA exon 2; Set C
cugguucaaaauguagaaugaaaaaugaaauguucuu

SEQ ID NO: 48163 - RNA, 20 nt, Artificial Sequence
  Synthetic Oligonucleotide; BTLA exon 2; Set C
aaauguagaaugaaaaauga

SEQ ID NO: 48164 - RNA, 18 nt, Artificial Sequence
  Synthetic Oligonucleotide; BTLA exon 2; Set C
aauguagaaugaaaaaug

SEQ ID NO: 48165 - RNA, 16 nt, Artificial Sequence
  Synthetic Oligonucleotide; BTLA exon 2; Set C
auguagaaugaaaaau

SEQ ID NO: 48166 - RNA, 38 nt, Artificial Sequence
  Synthetic Oligonucleotide; BTLA exon 2; Set C
acugguucaaaauguagaaugaaaaaugaaauguucuu

SEQ ID NO: 48167 - RNA, 29 nt, Artificial Sequence
  Synthetic Oligonucleotide; BTLA exon 2; Set C
guucaaaauguagaaugaaaaaugaaaug

SEQ ID NO: 48168 - RNA, 17 nt, Artificial Sequence
  Synthetic Oligonucleotide; BTLA exon 2; Set C
aauguagaaugaaaaau

SEQ ID NO: 48169 - RNA, 19 nt, Artificial Sequence
  Synthetic Oligonucleotide; BTLA exon 2; Set C
aaauguagaaugaaaaaug

SEQ ID NO: 48170 - RNA, 39 nt, Artificial Sequence
  Synthetic Oligonucleotide; BTLA exon 2; Set C
cacugguucaaaauguagaaugaaaaaugaaauguucuu

SEQ ID NO: 48171 - RNA, 28 nt, Artificial Sequence
  Synthetic Oligonucleotide; BTLA exon 2; Set C
guucaaaauguagaaugaaaaaugaaau

SEQ ID NO: 48172 - RNA, 18 nt, Artificial Sequence
  Synthetic Oligonucleotide; BTLA exon 2; Set C
aaauguagaaugaaaaau

SEQ ID NO: 48173 - RNA, 27 nt, Artificial Sequence
  Synthetic Oligonucleotide; BTLA exon 2; Set C
guucaaaauguagaaugaaaaaugaaa

SEQ ID NO: 48174 - RNA, 26 nt, Artificial Sequence
  Synthetic Oligonucleotide; BTLA exon 2; Set C
guucaaaauguagaaugaaaaaugaa

SEQ ID NO: 48175 - RNA, 25 nt, Artificial Sequence
  Synthetic Oligonucleotide; BTLA exon 2; Set C
guucaaaauguagaaugaaaaauga

SEQ ID NO: 48176 - RNA, 24 nt, Artificial Sequence
  Synthetic Oligonucleotide; BTLA exon 2; Set C
guucaaaauguagaaugaaaaaug

SEQ ID NO: 48177 - RNA, 25 nt, Artificial Sequence
  Synthetic Oligonucleotide; BTLA exon 2; Set C
gguucaaaauguagaaugaaaaaug

SEQ ID NO: 48178 - RNA, 23 nt, Artificial Sequence
  Synthetic Oligonucleotide; BTLA exon 2; Set C
guucaaaauguagaaugaaaaau

SEQ ID NO: 48179 - RNA, 24 nt, Artificial Sequence
  Synthetic Oligonucleotide; BTLA exon 2; Set C
gguucaaaauguagaaugaaaaau

SEQ ID NO: 48180 - RNA, 22 nt, Artificial Sequence
  Synthetic Oligonucleotide; BTLA exon 2; Set C
guucaaaauguagaaugaaaaa

SEQ ID NO: 48181 - RNA, 23 nt, Artificial Sequence
  Synthetic Oligonucleotide; BTLA exon 2; Set C
gguucaaaauguagaaugaaaaa

SEQ ID NO: 48182 - RNA, 24 nt, Artificial Sequence
  Synthetic Oligonucleotide; BTLA exon 2; Set C
ugguucaaaauguagaaugaaaaa

SEQ ID NO: 48183 - RNA, 25 nt, Artificial Sequence
  Synthetic Oligonucleotide; BTLA exon 2; Set C
cugguucaaaauguagaaugaaaaa

SEQ ID NO: 48184 - RNA, 40 nt, Artificial Sequence
  Synthetic Oligonucleotide; BTLA exon 2; Set C
aggaagcacugguucaaaauguagaaugaaaaaugaaaug

SEQ ID NO: 48185 - RNA, 26 nt, Artificial Sequence
  Synthetic Oligonucleotide; BTLA exon 2; Set C
acugguucaaaauguagaaugaaaaa

SEQ ID NO: 48186 - RNA, 39 nt, Artificial Sequence
  Synthetic Oligonucleotide; BTLA exon 2; Set C
aggaagcacugguucaaaauguagaaugaaaaaugaaau

SEQ ID NO: 48187 - RNA, 27 nt, Artificial Sequence
  Synthetic Oligonucleotide; BTLA exon 2; Set C
cacugguucaaaauguagaaugaaaaa

SEQ ID NO: 48188 - RNA, 40 nt, Artificial Sequence
  Synthetic Oligonucleotide; BTLA exon 2; Set C
uaggaagcacugguucaaaauguagaaugaaaaaugaaau

SEQ ID NO: 48189 - RNA, 38 nt, Artificial Sequence
  Synthetic Oligonucleotide; BTLA exon 2; Set C
aggaagcacugguucaaaauguagaaugaaaaaugaaa

SEQ ID NO: 48190 - RNA, 16 nt, Artificial Sequence
  Synthetic Oligonucleotide; BTLA exon 2; Set C
guucaaaauguagaau

SEQ ID NO: 48191 - RNA, 39 nt, Artificial Sequence
  Synthetic Oligonucleotide; BTLA exon 2; Set C
uaggaagcacugguucaaaauguagaaugaaaaaugaaa

SEQ ID NO: 48192 - RNA, 37 nt, Artificial Sequence
  Synthetic Oligonucleotide; BTLA exon 2; Set C
aggaagcacugguucaaaauguagaaugaaaaaugaa

SEQ ID NO: 48193 - RNA, 15 nt, Artificial Sequence
  Synthetic Oligonucleotide; BTLA exon 2; Set C
guucaaaauguagaa

SEQ ID NO: 48194 - RNA, 38 nt, Artificial Sequence
  Synthetic Oligonucleotide; BTLA exon 2; Set A
uaggaagcacugguucaaaauguagaaugaaaaaugaa

SEQ ID NO: 48195 - RNA, 36 nt, Artificial Sequence
  Synthetic Oligonucleotide; BTLA exon 2; Set A
aggaagcacugguucaaaauguagaaugaaaaauga

SEQ ID NO: 48196 - RNA, 16 nt, Artificial Sequence
  Synthetic Oligonucleotide; BTLA exon 2; Set C
gguucaaaauguagaa

SEQ ID NO: 48197 - RNA, 37 nt, Artificial Sequence
  Synthetic Oligonucleotide; BTLA exon 2; Set A
uaggaagcacugguucaaaauguagaaugaaaaauga

SEQ ID NO: 48198 - RNA, 35 nt, Artificial Sequence
  Synthetic Oligonucleotide; BTLA exon 2; Set C
aggaagcacugguucaaaauguagaaugaaaaaug

SEQ ID NO: 48199 - RNA, 36 nt, Artificial Sequence
  Synthetic Oligonucleotide; BTLA exon 2; Set C
uaggaagcacugguucaaaauguagaaugaaaaaug

SEQ ID NO: 48200 - RNA, 34 nt, Artificial Sequence
  Synthetic Oligonucleotide; BTLA exon 2; Set C
aggaagcacugguucaaaauguagaaugaaaaau

SEQ ID NO: 48201 - RNA, 35 nt, Artificial Sequence
  Synthetic Oligonucleotide; BTLA exon 2; Set C
uaggaagcacugguucaaaauguagaaugaaaaau

SEQ ID NO: 48202 - RNA, 40 nt, Artificial Sequence
  Synthetic Oligonucleotide; BTLA exon 2; Set A
cauuaggaagcacugguucaaaauguagaaugaaaaauga

SEQ ID NO: 48203 - RNA, 34 nt, Artificial Sequence
  Synthetic Oligonucleotide; BTLA exon 2; Set C
uaggaagcacugguucaaaauguagaaugaaaaa

SEQ ID NO: 48204 - RNA, 35 nt, Artificial Sequence
  Synthetic Oligonucleotide; BTLA exon 2; Set C
uuaggaagcacugguucaaaauguagaaugaaaaa

SEQ ID NO: 48205 - RNA, 36 nt, Artificial Sequence
  Synthetic Oligonucleotide; BTLA exon 2; Set C
auuaggaagcacugguucaaaauguagaaugaaaaa

SEQ ID NO: 48206 - RNA, 27 nt, Artificial Sequence
  Synthetic Oligonucleotide; BTLA exon 2; Set C
aggaagcacugguucaaaauguagaau

SEQ ID NO: 48207 - RNA, 15 nt, Artificial Sequence
  Synthetic Oligonucleotide; BTLA exon 2; Set C
cacugguucaaaaug

SEQ ID NO: 48208 - RNA, 26 nt, Artificial Sequence
  Synthetic Oligonucleotide; BTLA exon 2; Set C
aggaagcacugguucaaaauguagaa

SEQ ID NO: 48209 - RNA, 28 nt, Artificial Sequence
  Synthetic Oligonucleotide; BTLA exon 2; Set C
uaggaagcacugguucaaaauguagaau

SEQ ID NO: 48210 - RNA, 27 nt, Artificial Sequence
  Synthetic Oligonucleotide; BTLA exon 2; Set C
uaggaagcacugguucaaaauguagaa

SEQ ID NO: 48211 - RNA, 31 nt, Artificial Sequence
  Synthetic Oligonucleotide; BTLA exon 2; Set A
cauuaggaagcacugguucaaaauguagaau

SEQ ID NO: 48212 - RNA, 30 nt, Artificial Sequence
  Synthetic Oligonucleotide; BTLA exon 2; Set A
cauuaggaagcacugguucaaaauguagaa

SEQ ID NO: 48213 - RNA, 23 nt, Artificial Sequence
  Synthetic Oligonucleotide; BTLA exon 2; Set C
uuaggaagcacugguucaaaaug

SEQ ID NO: 48214 - RNA, 36 nt, Artificial Sequence
  Synthetic Oligonucleotide; BTLA exon 2; Set A
auugucauuaggaagcacugguucaaaauguagaau

SEQ ID NO: 48215 - RNA, 22 nt, Artificial Sequence
  Synthetic Oligonucleotide; BTLA exon 2; Set C
uuaggaagcacugguucaaaau

SEQ ID NO: 48216 - RNA, 24 nt, Artificial Sequence
  Synthetic Oligonucleotide; BTLA exon 2; Set C
auuaggaagcacugguucaaaaug

SEQ ID NO: 48217 - RNA, 35 nt, Artificial Sequence
  Synthetic Oligonucleotide; BTLA exon 2; Set A
auugucauuaggaagcacugguucaaaauguagaa

SEQ ID NO: 48218 - RNA, 37 nt, Artificial Sequence
  Synthetic Oligonucleotide; BTLA exon 2; Set A
cauugucauuaggaagcacugguucaaaauguagaau

SEQ ID NO: 48219 - RNA, 23 nt, Artificial Sequence
  Synthetic Oligonucleotide; BTLA exon 2; Set C
auuaggaagcacugguucaaaau

SEQ ID NO: 48220 - RNA, 21 nt, Artificial Sequence
  Synthetic Oligonucleotide; BTLA exon 2; Set C
uuaggaagcacugguucaaaa

SEQ ID NO: 48221 - RNA, 36 nt, Artificial Sequence
  Synthetic Oligonucleotide; BTLA exon 2; Set A
cauugucauuaggaagcacugguucaaaauguagaa

SEQ ID NO: 48222 - RNA, 38 nt, Artificial Sequence
  Synthetic Oligonucleotide; BTLA exon 2; Set A
ccauugucauuaggaagcacugguucaaaauguagaau

SEQ ID NO: 48223 - RNA, 22 nt, Artificial Sequence
  Synthetic Oligonucleotide; BTLA exon 2; Set C
auuaggaagcacugguucaaaa

SEQ ID NO: 48224 - RNA, 37 nt, Artificial Sequence
  Synthetic Oligonucleotide; BTLA exon 2; Set A
ccauugucauuaggaagcacugguucaaaauguagaa

SEQ ID NO: 48225 - RNA, 15 nt, Artificial Sequence
  Synthetic Oligonucleotide; BTLA exon 2; Set C
uaggaagcacugguu

SEQ ID NO: 48226 - RNA, 30 nt, Artificial Sequence
  Synthetic Oligonucleotide; BTLA exon 2; Set A
auugucauuaggaagcacugguucaaaaug

SEQ ID NO: 48227 - RNA, 29 nt, Artificial Sequence
  Synthetic Oligonucleotide; BTLA exon 2; Set C
auugucauuaggaagcacugguucaaaau

SEQ ID NO: 48228 - RNA, 18 nt, Artificial Sequence
  Synthetic Oligonucleotide; BTLA exon 2; Set C
cauuaggaagcacugguu

SEQ ID NO: 48229 - RNA, 30 nt, Artificial Sequence
  Synthetic Oligonucleotide; BTLA exon 2; Set A
cauugucauuaggaagcacugguucaaaau

SEQ ID NO: 48230 - RNA, 28 nt, Artificial Sequence
  Synthetic Oligonucleotide; BTLA exon 2; Set C
auugucauuaggaagcacugguucaaaa

SEQ ID NO: 48231 - RNA, 17 nt, Artificial Sequence
  Synthetic Oligonucleotide; BTLA exon 2; Set C
cauuaggaagcacuggu

SEQ ID NO: 48232 - RNA, 19 nt, Artificial Sequence
  Synthetic Oligonucleotide; BTLA exon 2; Set C
ucauuaggaagcacugguu

SEQ ID NO: 48233 - RNA, 16 nt, Artificial Sequence
  Synthetic Oligonucleotide; BTLA exon 2; Set C
cauuaggaagcacugg

SEQ ID NO: 48234 - RNA, 18 nt, Artificial Sequence
  Synthetic Oligonucleotide; BTLA exon 2; Set C
ucauuaggaagcacuggu

SEQ ID NO: 48235 - RNA, 15 nt, Artificial Sequence
  Synthetic Oligonucleotide; BTLA exon 2; Set C
cauuaggaagcacug

SEQ ID NO: 48236 - RNA, 17 nt, Artificial Sequence
  Synthetic Oligonucleotide; BTLA exon 2; Set C
ucauuaggaagcacugg

SEQ ID NO: 48237 - RNA, 16 nt, Artificial Sequence
  Synthetic Oligonucleotide; BTLA exon 2; Set C
ucauuaggaagcacug

SEQ ID NO: 48238 - RNA, 20 nt, Artificial Sequence
  Synthetic Oligonucleotide; BTLA exon 2; Set C
ugucauuaggaagcacuggu

SEQ ID NO: 48239 - RNA, 15 nt, Artificial Sequence
  Synthetic Oligonucleotide; BTLA exon 2; Set C
ucauuaggaagcacu

SEQ ID NO: 48240 - RNA, 19 nt, Artificial Sequence
  Synthetic Oligonucleotide; BTLA exon 2; Set C
ugucauuaggaagcacugg

SEQ ID NO: 48241 - RNA, 18 nt, Artificial Sequence
  Synthetic Oligonucleotide; BTLA exon 2; Set C
ugucauuaggaagcacug

SEQ ID NO: 48242 - RNA, 24 nt, Artificial Sequence
  Synthetic Oligonucleotide; BTLA exon 2; Set A
cauugucauuaggaagcacugguu

SEQ ID NO: 48243 - RNA, 38 nt, Artificial Sequence
  Synthetic Oligonucleotide; BTLA exon 2; Set A
uaugacccauugucauuaggaagcacugguucaaaaug

SEQ ID NO: 48244 - RNA, 17 nt, Artificial Sequence
  Synthetic Oligonucleotide; BTLA exon 2; Set C
ugucauuaggaagcacu

SEQ ID NO: 48245 - RNA, 25 nt, Artificial Sequence
  Synthetic Oligonucleotide; BTLA exon 2; Set A
ccauugucauuaggaagcacugguu

SEQ ID NO: 48246 - RNA, 37 nt, Artificial Sequence
  Synthetic Oligonucleotide; BTLA exon 2; Set C
uaugacccauugucauuaggaagcacugguucaaaau

SEQ ID NO: 48247 - RNA, 39 nt, Artificial Sequence
  Synthetic Oligonucleotide; BTLA exon 2; Set C
guaugacccauugucauuaggaagcacugguucaaaaug

SEQ ID NO: 48248 - RNA, 38 nt, Artificial Sequence
  Synthetic Oligonucleotide; BTLA exon 2; Set C
guaugacccauugucauuaggaagcacugguucaaaau

SEQ ID NO: 48249 - RNA, 40 nt, Artificial Sequence
  Synthetic Oligonucleotide; BTLA exon 2; Set C
gguaugacccauugucauuaggaagcacugguucaaaaug

SEQ ID NO: 48250 - RNA, 36 nt, Artificial Sequence
  Synthetic Oligonucleotide; BTLA exon 2; Set C
uaugacccauugucauuaggaagcacugguucaaaa

SEQ ID NO: 48251 - RNA, 39 nt, Artificial Sequence
  Synthetic Oligonucleotide; BTLA exon 2; Set C
gguaugacccauugucauuaggaagcacugguucaaaau

SEQ ID NO: 48252 - RNA, 37 nt, Artificial Sequence
  Synthetic Oligonucleotide; BTLA exon 2; Set C
guaugacccauugucauuaggaagcacugguucaaaa

SEQ ID NO: 48253 - RNA, 38 nt, Artificial Sequence
  Synthetic Oligonucleotide; BTLA exon 2; Set C
gguaugacccauugucauuaggaagcacugguucaaaa

SEQ ID NO: 48254 - RNA, 32 nt, Artificial Sequence
  Synthetic Oligonucleotide; BTLA exon 2; Set C
cgguaugacccauugucauuaggaagcacugg

SEQ ID NO: 48255 - RNA, 31 nt, Artificial Sequence
  Synthetic Oligonucleotide; BTLA exon 2; Set C
cgguaugacccauugucauuaggaagcacug

SEQ ID NO: 48256 - RNA, 30 nt, Artificial Sequence
  Synthetic Oligonucleotide; BTLA exon 2; Set C
cgguaugacccauugucauuaggaagcacu

SEQ ID NO: 48257 - RNA, 38 nt, Artificial Sequence
  Synthetic Oligonucleotide; BTLA exon 2; Set C
acagcgguaugacccauugucauuaggaagcacugguu

SEQ ID NO: 48258 - RNA, 37 nt, Artificial Sequence
  Synthetic Oligonucleotide; BTLA exon 2; Set C
acagcgguaugacccauugucauuaggaagcacuggu

SEQ ID NO: 48259 - RNA, 39 nt, Artificial Sequence
  Synthetic Oligonucleotide; BTLA exon 2; Set C
aacagcgguaugacccauugucauuaggaagcacugguu

SEQ ID NO: 48260 - RNA, 36 nt, Artificial Sequence
  Synthetic Oligonucleotide; BTLA exon 2; Set C
acagcgguaugacccauugucauuaggaagcacugg

SEQ ID NO: 48261 - RNA, 38 nt, Artificial Sequence
  Synthetic Oligonucleotide; BTLA exon 2; Set C
aacagcgguaugacccauugucauuaggaagcacuggu

SEQ ID NO: 48262 - RNA, 37 nt, Artificial Sequence
  Synthetic Oligonucleotide; BTLA exon 2; Set C
aacagcgguaugacccauugucauuaggaagcacugg

SEQ ID NO: 48263 - RNA, 35 nt, Artificial Sequence
  Synthetic Oligonucleotide; BTLA exon 2; Set C
acagcgguaugacccauugucauuaggaagcacug

SEQ ID NO: 48264 - RNA, 34 nt, Artificial Sequence
  Synthetic Oligonucleotide; BTLA exon 2; Set C
acagcgguaugacccauugucauuaggaagcacu

SEQ ID NO: 48265 - RNA, 36 nt, Artificial Sequence
  Synthetic Oligonucleotide; BTLA exon 2; Set C
aacagcgguaugacccauugucauuaggaagcacug

SEQ ID NO: 48266 - RNA, 20 nt, Artificial Sequence
  Synthetic Oligonucleotide; BTLA exon 2; Set C
uaugacccauugucauuagg

SEQ ID NO: 48267 - RNA, 35 nt, Artificial Sequence
  Synthetic Oligonucleotide; BTLA exon 2; Set C
aacagcgguaugacccauugucauuaggaagcacu

SEQ ID NO: 48268 - RNA, 33 nt, Artificial Sequence
  Synthetic Oligonucleotide; BTLA exon 2; Set C
acagcgguaugacccauugucauuaggaagcac

SEQ ID NO: 48269 - RNA, 19 nt, Artificial Sequence
  Synthetic Oligonucleotide; BTLA exon 2; Set C
uaugacccauugucauuag

SEQ ID NO: 48270 - RNA, 21 nt, Artificial Sequence
  Synthetic Oligonucleotide; BTLA exon 2; Set C
guaugacccauugucauuagg

SEQ ID NO: 48271 - RNA, 34 nt, Artificial Sequence
  Synthetic Oligonucleotide; BTLA exon 2; Set C
aacagcgguaugacccauugucauuaggaagcac

SEQ ID NO: 48272 - RNA, 20 nt, Artificial Sequence
  Synthetic Oligonucleotide; BTLA exon 2; Set C
guaugacccauugucauuag

SEQ ID NO: 48273 - RNA, 22 nt, Artificial Sequence
  Synthetic Oligonucleotide; BTLA exon 2; Set C
gguaugacccauugucauuagg

SEQ ID NO: 48274 - RNA, 21 nt, Artificial Sequence
  Synthetic Oligonucleotide; BTLA exon 2; Set C
gguaugacccauugucauuag

SEQ ID NO: 48275 - RNA, 16 nt, Artificial Sequence
  Synthetic Oligonucleotide; BTLA exon 2; Set C
uaugacccauugucau

SEQ ID NO: 48276 - RNA, 17 nt, Artificial Sequence
  Synthetic Oligonucleotide; BTLA exon 2; Set C
guaugacccauugucau

SEQ ID NO: 48277 - RNA, 18 nt, Artificial Sequence
  Synthetic Oligonucleotide; BTLA exon 2; Set C
gguaugacccauugucau

SEQ ID NO: 48278 - RNA, 25 nt, Artificial Sequence
  Synthetic Oligonucleotide; BTLA exon 2; Set B
acagcgguaugacccauugucauua

SEQ ID NO: 48279 - RNA, 29 nt, Artificial Sequence
  Synthetic Oligonucleotide; BTLA exon 2; Set C
gaacagcgguaugacccauugucauuagg

SEQ ID NO: 48280 - RNA, 26 nt, Artificial Sequence
  Synthetic Oligonucleotide; BTLA exon 2; Set B
aacagcgguaugacccauugucauua

SEQ ID NO: 48281 - RNA, 24 nt, Artificial Sequence
  Synthetic Oligonucleotide; BTLA exon 2; Set B
acagcgguaugacccauugucauu

SEQ ID NO: 48282 - RNA, 30 nt, Artificial Sequence
  Synthetic Oligonucleotide; BTLA exon 2; Set C
agaacagcgguaugacccauugucauuagg

SEQ ID NO: 48283 - RNA, 25 nt, Artificial Sequence
  Synthetic Oligonucleotide; BTLA exon 2; Set B
aacagcgguaugacccauugucauu

SEQ ID NO: 48284 - RNA, 31 nt, Artificial Sequence
  Synthetic Oligonucleotide; BTLA exon 2; Set C
cagaacagcgguaugacccauugucauuagg

SEQ ID NO: 48285 - RNA, 30 nt, Artificial Sequence
  Synthetic Oligonucleotide; BTLA exon 2; Set B
cagaacagcgguaugacccauugucauuag

SEQ ID NO: 48286 - RNA, 32 nt, Artificial Sequence
  Synthetic Oligonucleotide; BTLA exon 2; Set C
gcagaacagcgguaugacccauugucauuagg

SEQ ID NO: 48287 - RNA, 31 nt, Artificial Sequence
  Synthetic Oligonucleotide; BTLA exon 2; Set C
gcagaacagcgguaugacccauugucauuag

SEQ ID NO: 48288 - RNA, 33 nt, Artificial Sequence
  Synthetic Oligonucleotide; BTLA exon 2; Set C
ugcagaacagcgguaugacccauugucauuagg

SEQ ID NO: 48289 - RNA, 25 nt, Artificial Sequence
  Synthetic Oligonucleotide; BTLA exon 2; Set B
gaacagcgguaugacccauugucau

SEQ ID NO: 48290 - RNA, 32 nt, Artificial Sequence
  Synthetic Oligonucleotide; BTLA exon 2; Set C
ugcagaacagcgguaugacccauugucauuag

SEQ ID NO: 48291 - RNA, 34 nt, Artificial Sequence
  Synthetic Oligonucleotide; BTLA exon 2; Set C
uugcagaacagcgguaugacccauugucauuagg

SEQ ID NO: 48292 - RNA, 26 nt, Artificial Sequence
  Synthetic Oligonucleotide; BTLA exon 2; Set B
agaacagcgguaugacccauugucau

SEQ ID NO: 48293 - RNA, 24 nt, Artificial Sequence
  Synthetic Oligonucleotide; BTLA exon 2; Set B
gaacagcgguaugacccauuguca

SEQ ID NO: 48294 - RNA, 27 nt, Artificial Sequence
  Synthetic Oligonucleotide; BTLA exon 2; Set B
cagaacagcgguaugacccauugucau

SEQ ID NO: 48295 - RNA, 25 nt, Artificial Sequence
  Synthetic Oligonucleotide; BTLA exon 2; Set B
agaacagcgguaugacccauuguca

SEQ ID NO: 48296 - RNA, 28 nt, Artificial Sequence
  Synthetic Oligonucleotide; BTLA exon 2; Set C
gcagaacagcgguaugacccauugucau

SEQ ID NO: 48297 - RNA, 26 nt, Artificial Sequence
  Synthetic Oligonucleotide; BTLA exon 2; Set C
cagaacagcgguaugacccauuguca

SEQ ID NO: 48298 - RNA, 19 nt, Artificial Sequence
  Synthetic Oligonucleotide; BTLA exon 2; Set C
aacagcgguaugacccauu

SEQ ID NO: 48299 - RNA, 29 nt, Artificial Sequence
  Synthetic Oligonucleotide; BTLA exon 2; Set C
ugcagaacagcgguaugacccauugucau

SEQ ID NO: 48300 - RNA, 27 nt, Artificial Sequence
  Synthetic Oligonucleotide; BTLA exon 2; Set C
gcagaacagcgguaugacccauuguca

SEQ ID NO: 48301 - RNA, 30 nt, Artificial Sequence
  Synthetic Oligonucleotide; BTLA exon 2; Set C
uugcagaacagcgguaugacccauugucau

SEQ ID NO: 48302 - RNA, 28 nt, Artificial Sequence
  Synthetic Oligonucleotide; BTLA exon 2; Set C
ugcagaacagcgguaugacccauuguca

SEQ ID NO: 48303 - RNA, 31 nt, Artificial Sequence
  Synthetic Oligonucleotide; BTLA exon 2; Set C
uuugcagaacagcgguaugacccauugucau

SEQ ID NO: 48304 - RNA, 29 nt, Artificial Sequence
  Synthetic Oligonucleotide; BTLA exon 2; Set C
uugcagaacagcgguaugacccauuguca

SEQ ID NO: 48305 - RNA, 18 nt, Artificial Sequence
  Synthetic Oligonucleotide; BTLA exon 2; Set B
gaacagcgguaugaccca

SEQ ID NO: 48306 - RNA, 32 nt, Artificial Sequence
  Synthetic Oligonucleotide; BTLA exon 2; Set C
auuugcagaacagcgguaugacccauugucau

SEQ ID NO: 48307 - RNA, 30 nt, Artificial Sequence
  Synthetic Oligonucleotide; BTLA exon 2; Set C
uuugcagaacagcgguaugacccauuguca

SEQ ID NO: 48308 - RNA, 21 nt, Artificial Sequence
  Synthetic Oligonucleotide; BTLA exon 2; Set B
cagaacagcgguaugacccau

SEQ ID NO: 48309 - RNA, 39 nt, Artificial Sequence
  Synthetic Oligonucleotide; BTLA exon 2; Set C
gaaaauuugcagaacagcgguaugacccauugucauuag

SEQ ID NO: 48310 - RNA, 19 nt, Artificial Sequence
  Synthetic Oligonucleotide; BTLA exon 2; Set B
agaacagcgguaugaccca

SEQ ID NO: 48311 - RNA, 33 nt, Artificial Sequence
  Synthetic Oligonucleotide; BTLA exon 2; Set C
aauuugcagaacagcgguaugacccauugucau

SEQ ID NO: 48312 - RNA, 31 nt, Artificial Sequence
  Synthetic Oligonucleotide; BTLA exon 2; Set C
auuugcagaacagcgguaugacccauuguca

SEQ ID NO: 48313 - RNA, 38 nt, Artificial Sequence
  Synthetic Oligonucleotide; BTLA exon 2; Set C
gaaaauuugcagaacagcgguaugacccauugucauua

SEQ ID NO: 48314 - RNA, 22 nt, Artificial Sequence
  Synthetic Oligonucleotide; BTLA exon 2; Set B
gcagaacagcgguaugacccau

SEQ ID NO: 48315 - RNA, 20 nt, Artificial Sequence
  Synthetic Oligonucleotide; BTLA exon 2; Set B
cagaacagcgguaugaccca

SEQ ID NO: 48316 - RNA, 34 nt, Artificial Sequence
  Synthetic Oligonucleotide; BTLA exon 2; Set C
aaauuugcagaacagcgguaugacccauugucau

SEQ ID NO: 48317 - RNA, 32 nt, Artificial Sequence
  Synthetic Oligonucleotide; BTLA exon 2; Set C
aauuugcagaacagcgguaugacccauuguca

SEQ ID NO: 48318 - RNA, 39 nt, Artificial Sequence
  Synthetic Oligonucleotide; BTLA exon 2; Set C
ugaaaauuugcagaacagcgguaugacccauugucauua

SEQ ID NO: 48319 - RNA, 37 nt, Artificial Sequence
  Synthetic Oligonucleotide; BTLA exon 2; Set C
gaaaauuugcagaacagcgguaugacccauugucauu

SEQ ID NO: 48320 - RNA, 21 nt, Artificial Sequence
  Synthetic Oligonucleotide; BTLA exon 2; Set B
gcagaacagcgguaugaccca

SEQ ID NO: 48321 - RNA, 35 nt, Artificial Sequence
  Synthetic Oligonucleotide; BTLA exon 2; Set C
aaaauuugcagaacagcgguaugacccauugucau

SEQ ID NO: 48322 - RNA, 33 nt, Artificial Sequence
  Synthetic Oligonucleotide; BTLA exon 2; Set C
aaauuugcagaacagcgguaugacccauuguca

SEQ ID NO: 48323 - RNA, 40 nt, Artificial Sequence
  Synthetic Oligonucleotide; BTLA exon 2; Set C
cugaaaauuugcagaacagcgguaugacccauugucauua

SEQ ID NO: 48324 - RNA, 38 nt, Artificial Sequence
  Synthetic Oligonucleotide; BTLA exon 2; Set C
ugaaaauuugcagaacagcgguaugacccauugucauu

SEQ ID NO: 48325 - RNA, 22 nt, Artificial Sequence
  Synthetic Oligonucleotide; BTLA exon 2; Set B
ugcagaacagcgguaugaccca

SEQ ID NO: 48326 - RNA, 34 nt, Artificial Sequence
  Synthetic Oligonucleotide; BTLA exon 2; Set C
aaaauuugcagaacagcgguaugacccauuguca

SEQ ID NO: 48327 - RNA, 39 nt, Artificial Sequence
  Synthetic Oligonucleotide; BTLA exon 2; Set C
cugaaaauuugcagaacagcgguaugacccauugucauu

SEQ ID NO: 48328 - RNA, 23 nt, Artificial Sequence
  Synthetic Oligonucleotide; BTLA exon 2; Set B
uugcagaacagcgguaugaccca

SEQ ID NO: 48329 - RNA, 32 nt, Artificial Sequence
  Synthetic Oligonucleotide; BTLA exon 2; Set B
aaaauuugcagaacagcgguaugacccauugu

SEQ ID NO: 48330 - RNA, 31 nt, Artificial Sequence
  Synthetic Oligonucleotide; BTLA exon 2; Set B
gaaaauuugcagaacagcgguaugacccauu

SEQ ID NO: 48331 - RNA, 32 nt, Artificial Sequence
  Synthetic Oligonucleotide; BTLA exon 2; Set B
ugaaaauuugcagaacagcgguaugacccauu

SEQ ID NO: 48332 - RNA, 30 nt, Artificial Sequence
  Synthetic Oligonucleotide; BTLA exon 2; Set B
gaaaauuugcagaacagcgguaugacccau

SEQ ID NO: 48333 - RNA, 15 nt, Artificial Sequence
  Synthetic Oligonucleotide; BTLA exon 2; Set C
uuugcagaacagcgg

SEQ ID NO: 48334 - RNA, 16 nt, Artificial Sequence
  Synthetic Oligonucleotide; BTLA exon 2; Set C
auuugcagaacagcgg

SEQ ID NO: 48335 - RNA, 17 nt, Artificial Sequence
  Synthetic Oligonucleotide; BTLA exon 2; Set C
aauuugcagaacagcgg

SEQ ID NO: 48336 - RNA, 15 nt, Artificial Sequence
  Synthetic Oligonucleotide; BTLA exon 2; Set C
auuugcagaacagcg

SEQ ID NO: 48337 - RNA, 18 nt, Artificial Sequence
  Synthetic Oligonucleotide; BTLA exon 2; Set C
aaauuugcagaacagcgg

SEQ ID NO: 48338 - RNA, 16 nt, Artificial Sequence
  Synthetic Oligonucleotide; BTLA exon 2; Set C
aauuugcagaacagcg

SEQ ID NO: 48339 - RNA, 25 nt, Artificial Sequence
  Synthetic Oligonucleotide; BTLA exon 2; Set C
cugaaaauuugcagaacagcgguau

SEQ ID NO: 48340 - RNA, 39 nt, Artificial Sequence
  Synthetic Oligonucleotide; BTLA exon 2; Set C
gauuagacugaaaauuugcagaacagcgguaugacccau

SEQ ID NO: 48341 - RNA, 19 nt, Artificial Sequence
  Synthetic Oligonucleotide; BTLA exon 2; Set C
aaaauuugcagaacagcgg

SEQ ID NO: 48342 - RNA, 17 nt, Artificial Sequence
  Synthetic Oligonucleotide; BTLA exon 2; Set C
aaauuugcagaacagcg

SEQ ID NO: 48343 - RNA, 15 nt, Artificial Sequence
  Synthetic Oligonucleotide; BTLA exon 2; Set C
aauuugcagaacagc

SEQ ID NO: 48344 - RNA, 24 nt, Artificial Sequence
  Synthetic Oligonucleotide; BTLA exon 2; Set C
cugaaaauuugcagaacagcggua

SEQ ID NO: 48345 - RNA, 26 nt, Artificial Sequence
  Synthetic Oligonucleotide; BTLA exon 2; Set C
acugaaaauuugcagaacagcgguau

SEQ ID NO: 48346 - RNA, 40 nt, Artificial Sequence
  Synthetic Oligonucleotide; BTLA exon 2; Set C
agauuagacugaaaauuugcagaacagcgguaugacccau

SEQ ID NO: 48347 - RNA, 38 nt, Artificial Sequence
  Synthetic Oligonucleotide; BTLA exon 2; Set C
gauuagacugaaaauuugcagaacagcgguaugaccca

SEQ ID NO: 48348 - RNA, 18 nt, Artificial Sequence
  Synthetic Oligonucleotide; BTLA exon 2; Set C
aaaauuugcagaacagcg

SEQ ID NO: 48349 - RNA, 16 nt, Artificial Sequence
  Synthetic Oligonucleotide; BTLA exon 2; Set C
aaauuugcagaacagc

SEQ ID NO: 48350 - RNA, 23 nt, Artificial Sequence
  Synthetic Oligonucleotide; BTLA exon 2; Set C
cugaaaauuugcagaacagcggu

SEQ ID NO: 48351 - RNA, 25 nt, Artificial Sequence
  Synthetic Oligonucleotide; BTLA exon 2; Set C
acugaaaauuugcagaacagcggua

SEQ ID NO: 48352 - RNA, 27 nt, Artificial Sequence
  Synthetic Oligonucleotide; BTLA exon 2; Set B
gacugaaaauuugcagaacagcgguau

SEQ ID NO: 48353 - RNA, 39 nt, Artificial Sequence
  Synthetic Oligonucleotide; BTLA exon 2; Set C
agauuagacugaaaauuugcagaacagcgguaugaccca

SEQ ID NO: 48354 - RNA, 17 nt, Artificial Sequence
  Synthetic Oligonucleotide; BTLA exon 2; Set C
aaaauuugcagaacagc

SEQ ID NO: 48355 - RNA, 15 nt, Artificial Sequence
  Synthetic Oligonucleotide; BTLA exon 2; Set C
aaauuugcagaacag

SEQ ID NO: 48356 - RNA, 24 nt, Artificial Sequence
  Synthetic Oligonucleotide; BTLA exon 2; Set C
acugaaaauuugcagaacagcggu

SEQ ID NO: 48357 - RNA, 26 nt, Artificial Sequence
  Synthetic Oligonucleotide; BTLA exon 2; Set B
gacugaaaauuugcagaacagcggua

SEQ ID NO: 48358 - RNA, 28 nt, Artificial Sequence
  Synthetic Oligonucleotide; BTLA exon 2; Set B
agacugaaaauuugcagaacagcgguau

SEQ ID NO: 48359 - RNA, 40 nt, Artificial Sequence
  Synthetic Oligonucleotide; BTLA exon 2; Set C
gagauuagacugaaaauuugcagaacagcgguaugaccca

SEQ ID NO: 48360 - RNA, 16 nt, Artificial Sequence
  Synthetic Oligonucleotide; BTLA exon 2; Set C
aaaauuugcagaacag

SEQ ID NO: 48361 - RNA, 27 nt, Artificial Sequence
  Synthetic Oligonucleotide; BTLA exon 2; Set B
agacugaaaauuugcagaacagcggua

SEQ ID NO: 48362 - RNA, 25 nt, Artificial Sequence
  Synthetic Oligonucleotide; BTLA exon 2; Set B
gacugaaaauuugcagaacagcggu

SEQ ID NO: 48363 - RNA, 26 nt, Artificial Sequence
  Synthetic Oligonucleotide; BTLA exon 2; Set B
agacugaaaauuugcagaacagcggu

SEQ ID NO: 48364 - RNA, 16 nt, Artificial Sequence
  Synthetic Oligonucleotide; BTLA exon 2; Set C
gaaaauuugcagaaca

SEQ ID NO: 48365 - RNA, 15 nt, Artificial Sequence
  Synthetic Oligonucleotide; BTLA exon 2; Set C
gaaaauuugcagaac

SEQ ID NO: 48366 - RNA, 17 nt, Artificial Sequence
  Synthetic Oligonucleotide; BTLA exon 2; Set C
ugaaaauuugcagaaca

SEQ ID NO: 48367 - RNA, 16 nt, Artificial Sequence
  Synthetic Oligonucleotide; BTLA exon 2; Set C
ugaaaauuugcagaac

SEQ ID NO: 48368 - RNA, 26 nt, Artificial Sequence
  Synthetic Oligonucleotide; BTLA exon 2; Set C
uagacugaaaauuugcagaacagcgg

SEQ ID NO: 48369 - RNA, 27 nt, Artificial Sequence
  Synthetic Oligonucleotide; BTLA exon 2; Set C
uuagacugaaaauuugcagaacagcgg

SEQ ID NO: 48370 - RNA, 25 nt, Artificial Sequence
  Synthetic Oligonucleotide; BTLA exon 2; Set C
uagacugaaaauuugcagaacagcg

SEQ ID NO: 48371 - RNA, 16 nt, Artificial Sequence
  Synthetic Oligonucleotide; BTLA exon 2; Set C
cugaaaauuugcagaa

SEQ ID NO: 48372 - RNA, 28 nt, Artificial Sequence
  Synthetic Oligonucleotide; BTLA exon 2; Set C
auuagacugaaaauuugcagaacagcgg

SEQ ID NO: 48373 - RNA, 26 nt, Artificial Sequence
  Synthetic Oligonucleotide; BTLA exon 2; Set C
uuagacugaaaauuugcagaacagcg

SEQ ID NO: 48374 - RNA, 24 nt, Artificial Sequence
  Synthetic Oligonucleotide; BTLA exon 2; Set C
uagacugaaaauuugcagaacagc

SEQ ID NO: 48375 - RNA, 17 nt, Artificial Sequence
  Synthetic Oligonucleotide; BTLA exon 2; Set C
acugaaaauuugcagaa

SEQ ID NO: 48376 - RNA, 15 nt, Artificial Sequence
  Synthetic Oligonucleotide; BTLA exon 2; Set C
cugaaaauuugcaga

SEQ ID NO: 48377 - RNA, 29 nt, Artificial Sequence
  Synthetic Oligonucleotide; BTLA exon 2; Set B
gauuagacugaaaauuugcagaacagcgg

SEQ ID NO: 48378 - RNA, 27 nt, Artificial Sequence
  Synthetic Oligonucleotide; BTLA exon 2; Set C
auuagacugaaaauuugcagaacagcg

SEQ ID NO: 48379 - RNA, 25 nt, Artificial Sequence
  Synthetic Oligonucleotide; BTLA exon 2; Set C
uuagacugaaaauuugcagaacagc

SEQ ID NO: 48380 - RNA, 23 nt, Artificial Sequence
  Synthetic Oligonucleotide; BTLA exon 2; Set C
uagacugaaaauuugcagaacag

SEQ ID NO: 48381 - RNA, 18 nt, Artificial Sequence
  Synthetic Oligonucleotide; BTLA exon 2; Set C
gacugaaaauuugcagaa

SEQ ID NO: 48382 - RNA, 16 nt, Artificial Sequence
  Synthetic Oligonucleotide; BTLA exon 2; Set C
acugaaaauuugcaga

SEQ ID NO: 48383 - RNA, 30 nt, Artificial Sequence
  Synthetic Oligonucleotide; BTLA exon 2; Set B
agauuagacugaaaauuugcagaacagcgg

SEQ ID NO: 48384 - RNA, 28 nt, Artificial Sequence
  Synthetic Oligonucleotide; BTLA exon 2; Set C
gauuagacugaaaauuugcagaacagcg

SEQ ID NO: 48385 - RNA, 26 nt, Artificial Sequence
  Synthetic Oligonucleotide; BTLA exon 2; Set C
auuagacugaaaauuugcagaacagc

SEQ ID NO: 48386 - RNA, 24 nt, Artificial Sequence
  Synthetic Oligonucleotide; BTLA exon 2; Set C
uuagacugaaaauuugcagaacag

SEQ ID NO: 48387 - RNA, 19 nt, Artificial Sequence
  Synthetic Oligonucleotide; BTLA exon 2; Set C
agacugaaaauuugcagaa

SEQ ID NO: 48388 - RNA, 17 nt, Artificial Sequence
  Synthetic Oligonucleotide; BTLA exon 2; Set C
gacugaaaauuugcaga

SEQ ID NO: 48389 - RNA, 15 nt, Artificial Sequence
  Synthetic Oligonucleotide; BTLA exon 2; Set C
acugaaaauuugcag

SEQ ID NO: 48390 - RNA, 31 nt, Artificial Sequence
  Synthetic Oligonucleotide; BTLA exon 2; Set B
gagauuagacugaaaauuugcagaacagcgg

SEQ ID NO: 48391 - RNA, 29 nt, Artificial Sequence
  Synthetic Oligonucleotide; BTLA exon 2; Set C
agauuagacugaaaauuugcagaacagcg

SEQ ID NO: 48392 - RNA, 25 nt, Artificial Sequence
  Synthetic Oligonucleotide; BTLA exon 2; Set C
auuagacugaaaauuugcagaacag

SEQ ID NO: 48393 - RNA, 18 nt, Artificial Sequence
  Synthetic Oligonucleotide; BTLA exon 2; Set C
agacugaaaauuugcaga

SEQ ID NO: 48394 - RNA, 16 nt, Artificial Sequence
  Synthetic Oligonucleotide; BTLA exon 2; Set C
gacugaaaauuugcag

SEQ ID NO: 48395 - RNA, 30 nt, Artificial Sequence
  Synthetic Oligonucleotide; BTLA exon 2; Set B
gagauuagacugaaaauuugcagaacagcg

SEQ ID NO: 48396 - RNA, 17 nt, Artificial Sequence
  Synthetic Oligonucleotide; BTLA exon 2; Set C
agacugaaaauuugcag

SEQ ID NO: 48397 - RNA, 15 nt, Artificial Sequence
  Synthetic Oligonucleotide; BTLA exon 2; Set C
gacugaaaauuugca

SEQ ID NO: 48398 - RNA, 16 nt, Artificial Sequence
  Synthetic Oligonucleotide; BTLA exon 2; Set C
agacugaaaauuugca

SEQ ID NO: 48399 - RNA, 26 nt, Artificial Sequence
  Synthetic Oligonucleotide; BTLA exon 2; Set C
agauuagacugaaaauuugcagaaca

SEQ ID NO: 48400 - RNA, 15 nt, Artificial Sequence
  Synthetic Oligonucleotide; BTLA exon 2; Set C
agacugaaaauuugc

SEQ ID NO: 48401 - RNA, 28 nt, Artificial Sequence
  Synthetic Oligonucleotide; BTLA exon 2; Set C
ugagauuagacugaaaauuugcagaaca

SEQ ID NO: 48402 - RNA, 27 nt, Artificial Sequence
  Synthetic Oligonucleotide; BTLA exon 2; Set C
ugagauuagacugaaaauuugcagaac

SEQ ID NO: 48403 - RNA, 38 nt, Artificial Sequence
  Synthetic Oligonucleotide; BTLA exon 2; Set B
aguggcuuucaaugagauuagacugaaaauuugcagaa

SEQ ID NO: 48404 - RNA, 39 nt, Artificial Sequence
  Synthetic Oligonucleotide; BTLA exon 2; Set B
gaguggcuuucaaugagauuagacugaaaauuugcagaa

SEQ ID NO: 48405 - RNA, 37 nt, Artificial Sequence
  Synthetic Oligonucleotide; BTLA exon 2; Set B
aguggcuuucaaugagauuagacugaaaauuugcaga

SEQ ID NO: 48406 - RNA, 40 nt, Artificial Sequence
  Synthetic Oligonucleotide; BTLA exon 2; Set B
ugaguggcuuucaaugagauuagacugaaaauuugcagaa

SEQ ID NO: 48407 - RNA, 38 nt, Artificial Sequence
  Synthetic Oligonucleotide; BTLA exon 2; Set B
gaguggcuuucaaugagauuagacugaaaauuugcaga

SEQ ID NO: 48408 - RNA, 39 nt, Artificial Sequence
  Synthetic Oligonucleotide; BTLA exon 2; Set B
ugaguggcuuucaaugagauuagacugaaaauuugcaga

SEQ ID NO: 48409 - RNA, 38 nt, Artificial Sequence
  Synthetic Oligonucleotide; BTLA exon 2; Set B
ugaguggcuuucaaugagauuagacugaaaauuugcag

SEQ ID NO: 48410 - RNA, 39 nt, Artificial Sequence
  Synthetic Oligonucleotide; BTLA exon 2; Set B
uugaguggcuuucaaugagauuagacugaaaauuugcag

SEQ ID NO: 48411 - RNA, 37 nt, Artificial Sequence
  Synthetic Oligonucleotide; BTLA exon 2; Set B
ugaguggcuuucaaugagauuagacugaaaauuugca

SEQ ID NO: 48412 - RNA, 32 nt, Artificial Sequence
  Synthetic Oligonucleotide; BTLA exon 2; Set C
aguggcuuucaaugagauuagacugaaaauuu

SEQ ID NO: 48413 - RNA, 38 nt, Artificial Sequence
  Synthetic Oligonucleotide; BTLA exon 2; Set B
uugaguggcuuucaaugagauuagacugaaaauuugca

SEQ ID NO: 48414 - RNA, 36 nt, Artificial Sequence
  Synthetic Oligonucleotide; BTLA exon 2; Set B
ugaguggcuuucaaugagauuagacugaaaauuugc

SEQ ID NO: 48415 - RNA, 35 nt, Artificial Sequence
  Synthetic Oligonucleotide; BTLA exon 2; Set B
ugaguggcuuucaaugagauuagacugaaaauuug

SEQ ID NO: 48416 - RNA, 37 nt, Artificial Sequence
  Synthetic Oligonucleotide; BTLA exon 2; Set B
uugaguggcuuucaaugagauuagacugaaaauuugc

SEQ ID NO: 48417 - RNA, 34 nt, Artificial Sequence
  Synthetic Oligonucleotide; BTLA exon 2; Set B
ugaguggcuuucaaugagauuagacugaaaauuu

SEQ ID NO: 48418 - RNA, 36 nt, Artificial Sequence
  Synthetic Oligonucleotide; BTLA exon 2; Set B
uugaguggcuuucaaugagauuagacugaaaauuug

SEQ ID NO: 48419 - RNA, 35 nt, Artificial Sequence
  Synthetic Oligonucleotide; BTLA exon 2; Set B
uugaguggcuuucaaugagauuagacugaaaauuu

SEQ ID NO: 48420 - RNA, 33 nt, Artificial Sequence
  Synthetic Oligonucleotide; BTLA exon 2; Set B
ugaguggcuuucaaugagauuagacugaaaauu

SEQ ID NO: 48421 - RNA, 34 nt, Artificial Sequence
  Synthetic Oligonucleotide; BTLA exon 2; Set B
uugaguggcuuucaaugagauuagacugaaaauu

SEQ ID NO: 48422 - RNA, 32 nt, Artificial Sequence
  Synthetic Oligonucleotide; BTLA exon 2; Set B
ugaguggcuuucaaugagauuagacugaaaau

SEQ ID NO: 48423 - RNA, 33 nt, Artificial Sequence
  Synthetic Oligonucleotide; BTLA exon 2; Set B
uugaguggcuuucaaugagauuagacugaaaau

SEQ ID NO: 48424 - RNA, 32 nt, Artificial Sequence
  Synthetic Oligonucleotide; BTLA exon 2; Set B
uugaguggcuuucaaugagauuagacugaaaa

SEQ ID NO: 48425 - RNA, 31 nt, Artificial Sequence
  Synthetic Oligonucleotide; BTLA exon 2; Set B
uugaguggcuuucaaugagauuagacugaaa

SEQ ID NO: 48426 - RNA, 31 nt, Artificial Sequence
  Synthetic Oligonucleotide; BTLA exon 2; Set B
guugaguggcuuucaaugagauuagacugaa

SEQ ID NO: 48427 - RNA, 32 nt, Artificial Sequence
  Synthetic Oligonucleotide; BTLA exon 2; Set B
uguugaguggcuuucaaugagauuagacugaa

SEQ ID NO: 48428 - RNA, 30 nt, Artificial Sequence
  Synthetic Oligonucleotide; BTLA exon 2; Set B
guugaguggcuuucaaugagauuagacuga

SEQ ID NO: 48429 - RNA, 33 nt, Artificial Sequence
  Synthetic Oligonucleotide; BTLA exon 2; Set B
uuguugaguggcuuucaaugagauuagacugaa

SEQ ID NO: 48430 - RNA, 31 nt, Artificial Sequence
  Synthetic Oligonucleotide; BTLA exon 2; Set B
uguugaguggcuuucaaugagauuagacuga

SEQ ID NO: 48431 - RNA, 34 nt, Artificial Sequence
  Synthetic Oligonucleotide; BTLA exon 2; Set B
guuguugaguggcuuucaaugagauuagacugaa

SEQ ID NO: 48432 - RNA, 32 nt, Artificial Sequence
  Synthetic Oligonucleotide; BTLA exon 2; Set B
uuguugaguggcuuucaaugagauuagacuga

SEQ ID NO: 48433 - RNA, 35 nt, Artificial Sequence
  Synthetic Oligonucleotide; BTLA exon 2; Set B
aguuguugaguggcuuucaaugagauuagacugaa

SEQ ID NO: 48434 - RNA, 33 nt, Artificial Sequence
  Synthetic Oligonucleotide; BTLA exon 2; Set B
guuguugaguggcuuucaaugagauuagacuga

SEQ ID NO: 48435 - RNA, 24 nt, Artificial Sequence
  Synthetic Oligonucleotide; BTLA exon 2; Set C
uugaguggcuuucaaugagauuag

SEQ ID NO: 48436 - RNA, 36 nt, Artificial Sequence
  Synthetic Oligonucleotide; BTLA exon 2; Set B
gaguuguugaguggcuuucaaugagauuagacugaa

SEQ ID NO: 48437 - RNA, 34 nt, Artificial Sequence
  Synthetic Oligonucleotide; BTLA exon 2; Set B
aguuguugaguggcuuucaaugagauuagacuga

SEQ ID NO: 48438 - RNA, 26 nt, Artificial Sequence
  Synthetic Oligonucleotide; BTLA exon 2; Set B
guugaguggcuuucaaugagauuaga

SEQ ID NO: 48439 - RNA, 23 nt, Artificial Sequence
  Synthetic Oligonucleotide; BTLA exon 2; Set C
uugaguggcuuucaaugagauua

SEQ ID NO: 48440 - RNA, 37 nt, Artificial Sequence
  Synthetic Oligonucleotide; BTLA exon 2; Set B
agaguuguugaguggcuuucaaugagauuagacugaa

SEQ ID NO: 48441 - RNA, 35 nt, Artificial Sequence
  Synthetic Oligonucleotide; BTLA exon 2; Set B
gaguuguugaguggcuuucaaugagauuagacuga

SEQ ID NO: 48442 - RNA, 27 nt, Artificial Sequence
  Synthetic Oligonucleotide; BTLA exon 2; Set B
uguugaguggcuuucaaugagauuaga

SEQ ID NO: 48443 - RNA, 33 nt, Artificial Sequence
  Synthetic Oligonucleotide; BTLA exon 2; Set B
aguuguugaguggcuuucaaugagauuagacug

SEQ ID NO: 48444 - RNA, 22 nt, Artificial Sequence
  Synthetic Oligonucleotide; BTLA exon 2; Set C
uugaguggcuuucaaugagauu

SEQ ID NO: 48445 - RNA, 38 nt, Artificial Sequence
  Synthetic Oligonucleotide; BTLA exon 2; Set B
aagaguuguugaguggcuuucaaugagauuagacugaa

SEQ ID NO: 48446 - RNA, 36 nt, Artificial Sequence
  Synthetic Oligonucleotide; BTLA exon 2; Set B
agaguuguugaguggcuuucaaugagauuagacuga

SEQ ID NO: 48447 - RNA, 28 nt, Artificial Sequence
  Synthetic Oligonucleotide; BTLA exon 2; Set B
uuguugaguggcuuucaaugagauuaga

SEQ ID NO: 48448 - RNA, 34 nt, Artificial Sequence
  Synthetic Oligonucleotide; BTLA exon 2; Set B
gaguuguugaguggcuuucaaugagauuagacug

SEQ ID NO: 48449 - RNA, 21 nt, Artificial Sequence
  Synthetic Oligonucleotide; BTLA exon 2; Set C
uugaguggcuuucaaugagau

SEQ ID NO: 48450 - RNA, 39 nt, Artificial Sequence
  Synthetic Oligonucleotide; BTLA exon 2; Set B
aaagaguuguugaguggcuuucaaugagauuagacugaa

SEQ ID NO: 48451 - RNA, 37 nt, Artificial Sequence
  Synthetic Oligonucleotide; BTLA exon 2; Set B
aagaguuguugaguggcuuucaaugagauuagacuga

SEQ ID NO: 48452 - RNA, 29 nt, Artificial Sequence
  Synthetic Oligonucleotide; BTLA exon 2; Set B
guuguugaguggcuuucaaugagauuaga

SEQ ID NO: 48453 - RNA, 35 nt, Artificial Sequence
  Synthetic Oligonucleotide; BTLA exon 2; Set B
agaguuguugaguggcuuucaaugagauuagacug

SEQ ID NO: 48454 - RNA, 20 nt, Artificial Sequence
  Synthetic Oligonucleotide; BTLA exon 2; Set C
uugaguggcuuucaaugaga

SEQ ID NO: 48455 - RNA, 40 nt, Artificial Sequence
  Synthetic Oligonucleotide; BTLA exon 2; Set B
uaaagaguuguugaguggcuuucaaugagauuagacugaa

SEQ ID NO: 48456 - RNA, 38 nt, Artificial Sequence
  Synthetic Oligonucleotide; BTLA exon 2; Set B
aaagaguuguugaguggcuuucaaugagauuagacuga

SEQ ID NO: 48457 - RNA, 30 nt, Artificial Sequence
  Synthetic Oligonucleotide; BTLA exon 2; Set B
aguuguugaguggcuuucaaugagauuaga

SEQ ID NO: 48458 - RNA, 36 nt, Artificial Sequence
  Synthetic Oligonucleotide; BTLA exon 2; Set B
aagaguuguugaguggcuuucaaugagauuagacug

SEQ ID NO: 48459 - RNA, 21 nt, Artificial Sequence
  Synthetic Oligonucleotide; BTLA exon 2; Set C
guugaguggcuuucaaugaga

SEQ ID NO: 48460 - RNA, 39 nt, Artificial Sequence
  Synthetic Oligonucleotide; BTLA exon 2; Set B
uaaagaguuguugaguggcuuucaaugagauuagacuga

SEQ ID NO: 48461 - RNA, 31 nt, Artificial Sequence
  Synthetic Oligonucleotide; BTLA exon 2; Set B
gaguuguugaguggcuuucaaugagauuaga

SEQ ID NO: 48462 - RNA, 37 nt, Artificial Sequence
  Synthetic Oligonucleotide; BTLA exon 2; Set B
aaagaguuguugaguggcuuucaaugagauuagacug

SEQ ID NO: 48463 - RNA, 35 nt, Artificial Sequence
  Synthetic Oligonucleotide; BTLA exon 2; Set B
aagaguuguugaguggcuuucaaugagauuagacu

SEQ ID NO: 48464 - RNA, 20 nt, Artificial Sequence
  Synthetic Oligonucleotide; BTLA exon 2; Set C
guugaguggcuuucaaugag

SEQ ID NO: 48465 - RNA, 22 nt, Artificial Sequence
  Synthetic Oligonucleotide; BTLA exon 2; Set C
uguugaguggcuuucaaugaga

SEQ ID NO: 48466 - RNA, 32 nt, Artificial Sequence
  Synthetic Oligonucleotide; BTLA exon 2; Set B
agaguuguugaguggcuuucaaugagauuaga

SEQ ID NO: 48467 - RNA, 38 nt, Artificial Sequence
  Synthetic Oligonucleotide; BTLA exon 2; Set B
uaaagaguuguugaguggcuuucaaugagauuagacug

SEQ ID NO: 48468 - RNA, 36 nt, Artificial Sequence
  Synthetic Oligonucleotide; BTLA exon 2; Set B
aaagaguuguugaguggcuuucaaugagauuagacu

SEQ ID NO: 48469 - RNA, 34 nt, Artificial Sequence
  Synthetic Oligonucleotide; BTLA exon 2; Set B
aagaguuguugaguggcuuucaaugagauuagac

SEQ ID NO: 48470 - RNA, 21 nt, Artificial Sequence
  Synthetic Oligonucleotide; BTLA exon 2; Set C
uguugaguggcuuucaaugag

SEQ ID NO: 48471 - RNA, 23 nt, Artificial Sequence
  Synthetic Oligonucleotide; BTLA exon 2; Set C
uuguugaguggcuuucaaugaga

SEQ ID NO: 48472 - RNA, 19 nt, Artificial Sequence
  Synthetic Oligonucleotide; BTLA exon 2; Set C
guugaguggcuuucaauga

SEQ ID NO: 48473 - RNA, 33 nt, Artificial Sequence
  Synthetic Oligonucleotide; BTLA exon 2; Set B
aagaguuguugaguggcuuucaaugagauuaga

SEQ ID NO: 48474 - RNA, 37 nt, Artificial Sequence
  Synthetic Oligonucleotide; BTLA exon 2; Set B
uaaagaguuguugaguggcuuucaaugagauuagacu

SEQ ID NO: 48475 - RNA, 35 nt, Artificial Sequence
  Synthetic Oligonucleotide; BTLA exon 2; Set B
aaagaguuguugaguggcuuucaaugagauuagac

SEQ ID NO: 48476 - RNA, 22 nt, Artificial Sequence
  Synthetic Oligonucleotide; BTLA exon 2; Set C
uuguugaguggcuuucaaugag

SEQ ID NO: 48477 - RNA, 20 nt, Artificial Sequence
  Synthetic Oligonucleotide; BTLA exon 2; Set C
uguugaguggcuuucaauga

SEQ ID NO: 48478 - RNA, 34 nt, Artificial Sequence
  Synthetic Oligonucleotide; BTLA exon 2; Set B
aaagaguuguugaguggcuuucaaugagauuaga

SEQ ID NO: 48479 - RNA, 36 nt, Artificial Sequence
  Synthetic Oligonucleotide; BTLA exon 2; Set B
uaaagaguuguugaguggcuuucaaugagauuagac

SEQ ID NO: 48480 - RNA, 21 nt, Artificial Sequence
  Synthetic Oligonucleotide; BTLA exon 2; Set C
uuguugaguggcuuucaauga

SEQ ID NO: 48481 - RNA, 35 nt, Artificial Sequence
  Synthetic Oligonucleotide; BTLA exon 2; Set B
uaaagaguuguugaguggcuuucaaugagauuaga

SEQ ID NO: 48482 - RNA, 22 nt, Artificial Sequence
  Synthetic Oligonucleotide; BTLA exon 2; Set C
guuguugaguggcuuucaauga

SEQ ID NO: 48483 - RNA, 35 nt, Artificial Sequence
  Synthetic Oligonucleotide; BTLA exon 2; Set B
auaaagaguuguugaguggcuuucaaugagauuag

SEQ ID NO: 48484 - RNA, 23 nt, Artificial Sequence
  Synthetic Oligonucleotide; BTLA exon 2; Set C
aguuguugaguggcuuucaauga

SEQ ID NO: 48485 - RNA, 34 nt, Artificial Sequence
  Synthetic Oligonucleotide; BTLA exon 2; Set B
auaaagaguuguugaguggcuuucaaugagauua

SEQ ID NO: 48486 - RNA, 36 nt, Artificial Sequence
  Synthetic Oligonucleotide; BTLA exon 2; Set B
cauaaagaguuguugaguggcuuucaaugagauuag

SEQ ID NO: 48487 - RNA, 24 nt, Artificial Sequence
  Synthetic Oligonucleotide; BTLA exon 2; Set B
gaguuguugaguggcuuucaauga

SEQ ID NO: 48488 - RNA, 33 nt, Artificial Sequence
  Synthetic Oligonucleotide; BTLA exon 2; Set B
auaaagaguuguugaguggcuuucaaugagauu

SEQ ID NO: 48489 - RNA, 35 nt, Artificial Sequence
  Synthetic Oligonucleotide; BTLA exon 2; Set B
cauaaagaguuguugaguggcuuucaaugagauua

SEQ ID NO: 48490 - RNA, 25 nt, Artificial Sequence
  Synthetic Oligonucleotide; BTLA exon 2; Set B
agaguuguugaguggcuuucaauga

SEQ ID NO: 48491 - RNA, 34 nt, Artificial Sequence
  Synthetic Oligonucleotide; BTLA exon 2; Set B
cauaaagaguuguugaguggcuuucaaugagauu

SEQ ID NO: 48492 - RNA, 32 nt, Artificial Sequence
  Synthetic Oligonucleotide; BTLA exon 2; Set B
auaaagaguuguugaguggcuuucaaugagau

SEQ ID NO: 48493 - RNA, 26 nt, Artificial Sequence
  Synthetic Oligonucleotide; BTLA exon 2; Set C
aagaguuguugaguggcuuucaauga

SEQ ID NO: 48494 - RNA, 39 nt, Artificial Sequence
  Synthetic Oligonucleotide; BTLA exon 2; Set B
ucacauaaagaguuguugaguggcuuucaaugagauuag

SEQ ID NO: 48495 - RNA, 31 nt, Artificial Sequence
  Synthetic Oligonucleotide; BTLA exon 2; Set B
auaaagaguuguugaguggcuuucaaugaga

SEQ ID NO: 48496 - RNA, 27 nt, Artificial Sequence
  Synthetic Oligonucleotide; BTLA exon 2; Set C
aaagaguuguugaguggcuuucaauga

SEQ ID NO: 48497 - RNA, 38 nt, Artificial Sequence
  Synthetic Oligonucleotide; BTLA exon 2; Set B
ucacauaaagaguuguugaguggcuuucaaugagauua

SEQ ID NO: 48498 - RNA, 30 nt, Artificial Sequence
  Synthetic Oligonucleotide; BTLA exon 2; Set C
auaaagaguuguugaguggcuuucaaugag

SEQ ID NO: 48499 - RNA, 28 nt, Artificial Sequence
  Synthetic Oligonucleotide; BTLA exon 2; Set C
uaaagaguuguugaguggcuuucaauga

SEQ ID NO: 48500 - RNA, 37 nt, Artificial Sequence
  Synthetic Oligonucleotide; BTLA exon 2; Set B
ucacauaaagaguuguugaguggcuuucaaugagauu

SEQ ID NO: 48501 - RNA, 34 nt, Artificial Sequence
  Synthetic Oligonucleotide; BTLA exon 2; Set B
gucacauaaagaguuguugaguggcuuucaauga

SEQ ID NO: 48502 - RNA, 35 nt, Artificial Sequence
  Synthetic Oligonucleotide; BTLA exon 2; Set B
ugucacauaaagaguuguugaguggcuuucaauga

SEQ ID NO: 48503 - RNA, 15 nt, Artificial Sequence
  Synthetic Oligonucleotide; BTLA exon 2; Set C
aagaguuguugagug

SEQ ID NO: 48504 - RNA, 16 nt, Artificial Sequence
  Synthetic Oligonucleotide; BTLA exon 2; Set C
aaagaguuguugagug

SEQ ID NO: 48505 - RNA, 15 nt, Artificial Sequence
  Synthetic Oligonucleotide; BTLA exon 2; Set C
aaagaguuguugagu

SEQ ID NO: 48506 - RNA, 17 nt, Artificial Sequence
  Synthetic Oligonucleotide; BTLA exon 2; Set C
uaaagaguuguugagug

SEQ ID NO: 48507 - RNA, 16 nt, Artificial Sequence
  Synthetic Oligonucleotide; BTLA exon 2; Set C
uaaagaguuguugagu

SEQ ID NO: 48508 - RNA, 15 nt, Artificial Sequence
  Synthetic Oligonucleotide; BTLA exon 2; Set C
uaaagaguuguugag

SEQ ID NO: 48509 - RNA, 23 nt, Artificial Sequence
  Synthetic Oligonucleotide; BTLA exon 2; Set C
gucacauaaagaguuguugagug

SEQ ID NO: 48510 - RNA, 22 nt, Artificial Sequence
  Synthetic Oligonucleotide; BTLA exon 2; Set C
gucacauaaagaguuguugagu

SEQ ID NO: 48511 - RNA, 24 nt, Artificial Sequence
  Synthetic Oligonucleotide; BTLA exon 2; Set C
ugucacauaaagaguuguugagug

SEQ ID NO: 48512 - RNA, 15 nt, Artificial Sequence
  Synthetic Oligonucleotide; BTLA exon 2; Set C
acauaaagaguuguu

SEQ ID NO: 48513 - RNA, 23 nt, Artificial Sequence
  Synthetic Oligonucleotide; BTLA exon 2; Set C
ugucacauaaagaguuguugagu

SEQ ID NO: 48514 - RNA, 21 nt, Artificial Sequence
  Synthetic Oligonucleotide; BTLA exon 2; Set C
gucacauaaagaguuguugag

SEQ ID NO: 48515 - RNA, 16 nt, Artificial Sequence
  Synthetic Oligonucleotide; BTLA exon 2; Set C
cacauaaagaguuguu

SEQ ID NO: 48516 - RNA, 18 nt, Artificial Sequence
  Synthetic Oligonucleotide; BTLA exon 2; Set C
ucacauaaagaguuguug

SEQ ID NO: 48517 - RNA, 20 nt, Artificial Sequence
  Synthetic Oligonucleotide; BTLA exon 2; Set C
gucacauaaagaguuguuga

SEQ ID NO: 48518 - RNA, 22 nt, Artificial Sequence
  Synthetic Oligonucleotide; BTLA exon 2; Set C
ugucacauaaagaguuguugag

SEQ ID NO: 48519 - RNA, 17 nt, Artificial Sequence
  Synthetic Oligonucleotide; BTLA exon 2; Set C
ucacauaaagaguuguu

SEQ ID NO: 48520 - RNA, 15 nt, Artificial Sequence
  Synthetic Oligonucleotide; BTLA exon 2; Set C
cacauaaagaguugu

SEQ ID NO: 48521 - RNA, 21 nt, Artificial Sequence
  Synthetic Oligonucleotide; BTLA exon 2; Set C
ugucacauaaagaguuguuga

SEQ ID NO: 48522 - RNA, 16 nt, Artificial Sequence
  Synthetic Oligonucleotide; BTLA exon 2; Set C
ucacauaaagaguugu

SEQ ID NO: 48523 - RNA, 15 nt, Artificial Sequence
  Synthetic Oligonucleotide; BTLA exon 2; Set C
ucacauaaagaguug

SEQ ID NO: 48524 - RNA, 27 nt, Artificial Sequence
  Synthetic Oligonucleotide; BTLA exon 2; Set B
acucaccugucacauaaagaguuguug

SEQ ID NO: 48525 - RNA, 27 nt, Artificial Sequence
  Synthetic Oligonucleotide; BTLA exon 2; Set B
aacucaccugucacauaaagaguuguu

SEQ ID NO: 48526 - RNA, 32 nt, Artificial Sequence
  Synthetic Oligonucleotide; BTLA exon 2; Set B
uugagaacucaccugucacauaaagaguuguu

SEQ ID NO: 48527 - RNA, 34 nt, Artificial Sequence
  Synthetic Oligonucleotide; BTLA exon 2; Set B
guugagaacucaccugucacauaaagaguuguug

SEQ ID NO: 48528 - RNA, 33 nt, Artificial Sequence
  Synthetic Oligonucleotide; BTLA exon 2; Set B
guugagaacucaccugucacauaaagaguuguu

SEQ ID NO: 48529 - RNA, 35 nt, Artificial Sequence
  Synthetic Oligonucleotide; BTLA exon 2; Set B
uguugagaacucaccugucacauaaagaguuguug

SEQ ID NO: 48530 - RNA, 34 nt, Artificial Sequence
  Synthetic Oligonucleotide; BTLA exon 2; Set B
uguugagaacucaccugucacauaaagaguuguu

SEQ ID NO: 48531 - RNA, 32 nt, Artificial Sequence
  Synthetic Oligonucleotide; BTLA exon 2; Set B
guugagaacucaccugucacauaaagaguugu

SEQ ID NO: 48532 - RNA, 36 nt, Artificial Sequence
  Synthetic Oligonucleotide; BTLA exon 2; Set B
guguugagaacucaccugucacauaaagaguuguug

SEQ ID NO: 48533 - RNA, 35 nt, Artificial Sequence
  Synthetic Oligonucleotide; BTLA exon 2; Set B
guguugagaacucaccugucacauaaagaguuguu

SEQ ID NO: 48534 - RNA, 17 nt, Artificial Sequence
  Synthetic Oligonucleotide; BTLA exon 2; Set C
acucaccugucacauaa

SEQ ID NO: 48535 - RNA, 31 nt, Artificial Sequence
  Synthetic Oligonucleotide; BTLA exon 2; Set B
guugagaacucaccugucacauaaagaguug

SEQ ID NO: 48536 - RNA, 33 nt, Artificial Sequence
  Synthetic Oligonucleotide; BTLA exon 2; Set B
uguugagaacucaccugucacauaaagaguugu

SEQ ID NO: 48537 - RNA, 28 nt, Artificial Sequence
  Synthetic Oligonucleotide; BTLA exon 2; Set B
uugagaacucaccugucacauaaagagu

SEQ ID NO: 48538 - RNA, 36 nt, Artificial Sequence
  Synthetic Oligonucleotide; BTLA exon 2; Set C
gguguugagaacucaccugucacauaaagaguuguu

SEQ ID NO: 48539 - RNA, 30 nt, Artificial Sequence
  Synthetic Oligonucleotide; BTLA exon 2; Set B
guugagaacucaccugucacauaaagaguu

SEQ ID NO: 48540 - RNA, 34 nt, Artificial Sequence
  Synthetic Oligonucleotide; BTLA exon 2; Set B
guguugagaacucaccugucacauaaagaguugu

SEQ ID NO: 48541 - RNA, 32 nt, Artificial Sequence
  Synthetic Oligonucleotide; BTLA exon 2; Set B
uguugagaacucaccugucacauaaagaguug

SEQ ID NO: 48542 - RNA, 29 nt, Artificial Sequence
  Synthetic Oligonucleotide; BTLA exon 2; Set B
guugagaacucaccugucacauaaagagu

SEQ ID NO: 48543 - RNA, 37 nt, Artificial Sequence
  Synthetic Oligonucleotide; BTLA exon 2; Set C
agguguugagaacucaccugucacauaaagaguuguu

SEQ ID NO: 48544 - RNA, 31 nt, Artificial Sequence
  Synthetic Oligonucleotide; BTLA exon 2; Set B
uguugagaacucaccugucacauaaagaguu

SEQ ID NO: 48545 - RNA, 33 nt, Artificial Sequence
  Synthetic Oligonucleotide; BTLA exon 2; Set B
guguugagaacucaccugucacauaaagaguug

SEQ ID NO: 48546 - RNA, 35 nt, Artificial Sequence
  Synthetic Oligonucleotide; BTLA exon 2; Set C
gguguugagaacucaccugucacauaaagaguugu

SEQ ID NO: 48547 - RNA, 39 nt, Artificial Sequence
  Synthetic Oligonucleotide; BTLA exon 2; Set C
uagguguugagaacucaccugucacauaaagaguuguug

SEQ ID NO: 48548 - RNA, 30 nt, Artificial Sequence
  Synthetic Oligonucleotide; BTLA exon 2; Set B
uguugagaacucaccugucacauaaagagu

SEQ ID NO: 48549 - RNA, 28 nt, Artificial Sequence
  Synthetic Oligonucleotide; BTLA exon 2; Set B
guugagaacucaccugucacauaaagag

SEQ ID NO: 48550 - RNA, 32 nt, Artificial Sequence
  Synthetic Oligonucleotide; BTLA exon 2; Set B
guguugagaacucaccugucacauaaagaguu

SEQ ID NO: 48551 - RNA, 34 nt, Artificial Sequence
  Synthetic Oligonucleotide; BTLA exon 2; Set B
gguguugagaacucaccugucacauaaagaguug

SEQ ID NO: 48552 - RNA, 36 nt, Artificial Sequence
  Synthetic Oligonucleotide; BTLA exon 2; Set C
agguguugagaacucaccugucacauaaagaguugu

SEQ ID NO: 48553 - RNA, 40 nt, Artificial Sequence
  Synthetic Oligonucleotide; BTLA exon 2; Set C
cuagguguugagaacucaccugucacauaaagaguuguug

SEQ ID NO: 48554 - RNA, 31 nt, Artificial Sequence
  Synthetic Oligonucleotide; BTLA exon 2; Set B
guguugagaacucaccugucacauaaagagu

SEQ ID NO: 48555 - RNA, 29 nt, Artificial Sequence
  Synthetic Oligonucleotide; BTLA exon 2; Set B
uguugagaacucaccugucacauaaagag

SEQ ID NO: 48556 - RNA, 27 nt, Artificial Sequence
  Synthetic Oligonucleotide; BTLA exon 2; Set B
guugagaacucaccugucacauaaaga

SEQ ID NO: 48557 - RNA, 33 nt, Artificial Sequence
  Synthetic Oligonucleotide; BTLA exon 2; Set B
gguguugagaacucaccugucacauaaagaguu

SEQ ID NO: 48558 - RNA, 37 nt, Artificial Sequence
  Synthetic Oligonucleotide; BTLA exon 2; Set C
uagguguugagaacucaccugucacauaaagaguugu

SEQ ID NO: 48559 - RNA, 35 nt, Artificial Sequence
  Synthetic Oligonucleotide; BTLA exon 2; Set B
agguguugagaacucaccugucacauaaagaguug

SEQ ID NO: 48560 - RNA, 32 nt, Artificial Sequence
  Synthetic Oligonucleotide; BTLA exon 2; Set B
gguguugagaacucaccugucacauaaagagu

SEQ ID NO: 48561 - RNA, 30 nt, Artificial Sequence
  Synthetic Oligonucleotide; BTLA exon 2; Set B
guguugagaacucaccugucacauaaagag

SEQ ID NO: 48562 - RNA, 26 nt, Artificial Sequence
  Synthetic Oligonucleotide; BTLA exon 2; Set C
guugagaacucaccugucacauaaag

SEQ ID NO: 48563 - RNA, 28 nt, Artificial Sequence
  Synthetic Oligonucleotide; BTLA exon 2; Set B
uguugagaacucaccugucacauaaaga

SEQ ID NO: 48564 - RNA, 34 nt, Artificial Sequence
  Synthetic Oligonucleotide; BTLA exon 2; Set B
agguguugagaacucaccugucacauaaagaguu

SEQ ID NO: 48565 - RNA, 36 nt, Artificial Sequence
  Synthetic Oligonucleotide; BTLA exon 2; Set B
uagguguugagaacucaccugucacauaaagaguug

SEQ ID NO: 48566 - RNA, 38 nt, Artificial Sequence
  Synthetic Oligonucleotide; BTLA exon 2; Set C
cuagguguugagaacucaccugucacauaaagaguugu

SEQ ID NO: 48567 - RNA, 33 nt, Artificial Sequence
  Synthetic Oligonucleotide; BTLA exon 2; Set B
agguguugagaacucaccugucacauaaagagu

SEQ ID NO: 48568 - RNA, 31 nt, Artificial Sequence
  Synthetic Oligonucleotide; BTLA exon 2; Set B
gguguugagaacucaccugucacauaaagag

SEQ ID NO: 48569 - RNA, 25 nt, Artificial Sequence
  Synthetic Oligonucleotide; BTLA exon 2; Set C
guugagaacucaccugucacauaaa

SEQ ID NO: 48570 - RNA, 29 nt, Artificial Sequence
  Synthetic Oligonucleotide; BTLA exon 2; Set B
guguugagaacucaccugucacauaaaga

SEQ ID NO: 48571 - RNA, 27 nt, Artificial Sequence
  Synthetic Oligonucleotide; BTLA exon 2; Set B
uguugagaacucaccugucacauaaag

SEQ ID NO: 48572 - RNA, 35 nt, Artificial Sequence
  Synthetic Oligonucleotide; BTLA exon 2; Set B
uagguguugagaacucaccugucacauaaagaguu

SEQ ID NO: 48573 - RNA, 37 nt, Artificial Sequence
  Synthetic Oligonucleotide; BTLA exon 2; Set C
cuagguguugagaacucaccugucacauaaagaguug

SEQ ID NO: 48574 - RNA, 34 nt, Artificial Sequence
  Synthetic Oligonucleotide; BTLA exon 2; Set B
uagguguugagaacucaccugucacauaaagagu

SEQ ID NO: 48575 - RNA, 32 nt, Artificial Sequence
  Synthetic Oligonucleotide; BTLA exon 2; Set B
agguguugagaacucaccugucacauaaagag

SEQ ID NO: 48576 - RNA, 24 nt, Artificial Sequence
  Synthetic Oligonucleotide; BTLA exon 2; Set B
guugagaacucaccugucacauaa

SEQ ID NO: 48577 - RNA, 28 nt, Artificial Sequence
  Synthetic Oligonucleotide; BTLA exon 2; Set B
guguugagaacucaccugucacauaaag

SEQ ID NO: 48578 - RNA, 26 nt, Artificial Sequence
  Synthetic Oligonucleotide; BTLA exon 2; Set B
uguugagaacucaccugucacauaaa

SEQ ID NO: 48579 - RNA, 30 nt, Artificial Sequence
  Synthetic Oligonucleotide; BTLA exon 2; Set B
gguguugagaacucaccugucacauaaaga

SEQ ID NO: 48580 - RNA, 36 nt, Artificial Sequence
  Synthetic Oligonucleotide; BTLA exon 2; Set C
cuagguguugagaacucaccugucacauaaagaguu

SEQ ID NO: 48581 - RNA, 35 nt, Artificial Sequence
  Synthetic Oligonucleotide; BTLA exon 2; Set C
cuagguguugagaacucaccugucacauaaagagu

SEQ ID NO: 48582 - RNA, 33 nt, Artificial Sequence
  Synthetic Oligonucleotide; BTLA exon 2; Set B
uagguguugagaacucaccugucacauaaagag

SEQ ID NO: 48583 - RNA, 27 nt, Artificial Sequence
  Synthetic Oligonucleotide; BTLA exon 2; Set B
guguugagaacucaccugucacauaaa

SEQ ID NO: 48584 - RNA, 25 nt, Artificial Sequence
  Synthetic Oligonucleotide; BTLA exon 2; Set B
uguugagaacucaccugucacauaa

SEQ ID NO: 48585 - RNA, 29 nt, Artificial Sequence
  Synthetic Oligonucleotide; BTLA exon 2; Set B
gguguugagaacucaccugucacauaaag

SEQ ID NO: 48586 - RNA, 31 nt, Artificial Sequence
  Synthetic Oligonucleotide; BTLA exon 2; Set B
agguguugagaacucaccugucacauaaaga

SEQ ID NO: 48587 - RNA, 34 nt, Artificial Sequence
  Synthetic Oligonucleotide; BTLA exon 2; Set B
cuagguguugagaacucaccugucacauaaagag

SEQ ID NO: 48588 - RNA, 32 nt, Artificial Sequence
  Synthetic Oligonucleotide; BTLA exon 2; Set B
uagguguugagaacucaccugucacauaaaga

SEQ ID NO: 48589 - RNA, 26 nt, Artificial Sequence
  Synthetic Oligonucleotide; BTLA exon 2; Set B
guguugagaacucaccugucacauaa

SEQ ID NO: 48590 - RNA, 28 nt, Artificial Sequence
  Synthetic Oligonucleotide; BTLA exon 2; Set B
gguguugagaacucaccugucacauaaa

SEQ ID NO: 48591 - RNA, 30 nt, Artificial Sequence
  Synthetic Oligonucleotide; BTLA exon 2; Set B
agguguugagaacucaccugucacauaaag

SEQ ID NO: 48592 - RNA, 31 nt, Artificial Sequence
  Synthetic Oligonucleotide; BTLA exon 2; Set B
uagguguugagaacucaccugucacauaaag

SEQ ID NO: 48593 - RNA, 33 nt, Artificial Sequence
  Synthetic Oligonucleotide; BTLA exon 2; Set B
cuagguguugagaacucaccugucacauaaaga

SEQ ID NO: 48594 - RNA, 27 nt, Artificial Sequence
  Synthetic Oligonucleotide; BTLA exon 2; Set B
gguguugagaacucaccugucacauaa

SEQ ID NO: 48595 - RNA, 29 nt, Artificial Sequence
  Synthetic Oligonucleotide; BTLA exon 2; Set B
agguguugagaacucaccugucacauaaa

SEQ ID NO: 48596 - RNA, 30 nt, Artificial Sequence
  Synthetic Oligonucleotide; BTLA exon 2; Set B
uagguguugagaacucaccugucacauaaa

SEQ ID NO: 48597 - RNA, 32 nt, Artificial Sequence
  Synthetic Oligonucleotide; BTLA exon 2; Set B
cuagguguugagaacucaccugucacauaaag

SEQ ID NO: 48598 - RNA, 28 nt, Artificial Sequence
  Synthetic Oligonucleotide; BTLA exon 2; Set B
agguguugagaacucaccugucacauaa

SEQ ID NO: 48599 - RNA, 29 nt, Artificial Sequence
  Synthetic Oligonucleotide; BTLA exon 2; Set B
uagguguugagaacucaccugucacauaa

SEQ ID NO: 48600 - RNA, 31 nt, Artificial Sequence
  Synthetic Oligonucleotide; BTLA exon 2; Set B
cuagguguugagaacucaccugucacauaaa

SEQ ID NO: 48601 - RNA, 40 nt, Artificial Sequence
  Synthetic Oligonucleotide; BTLA exon 2; Set C
auggucuagguguugagaacucaccugucacauaaagagu

SEQ ID NO: 48602 - RNA, 30 nt, Artificial Sequence
  Synthetic Oligonucleotide; BTLA exon 2; Set B
cuagguguugagaacucaccugucacauaa

SEQ ID NO: 48603 - RNA, 18 nt, Artificial Sequence
  Synthetic Oligonucleotide; BTLA exon 2; Set C
guugagaacucaccuguc

SEQ ID NO: 48604 - RNA, 39 nt, Artificial Sequence
  Synthetic Oligonucleotide; BTLA exon 2; Set C
auggucuagguguugagaacucaccugucacauaaagag

SEQ ID NO: 48605 - RNA, 17 nt, Artificial Sequence
  Synthetic Oligonucleotide; BTLA exon 2; Set C
guugagaacucaccugu

SEQ ID NO: 48606 - RNA, 19 nt, Artificial Sequence
  Synthetic Oligonucleotide; BTLA exon 2; Set C
uguugagaacucaccuguc

SEQ ID NO: 48607 - RNA, 40 nt, Artificial Sequence
  Synthetic Oligonucleotide; BTLA exon 2; Set C
gauggucuagguguugagaacucaccugucacauaaagag

SEQ ID NO: 48608 - RNA, 38 nt, Artificial Sequence
  Synthetic Oligonucleotide; BTLA exon 2; Set C
auggucuagguguugagaacucaccugucacauaaaga

SEQ ID NO: 48609 - RNA, 18 nt, Artificial Sequence
  Synthetic Oligonucleotide; BTLA exon 2; Set C
uguugagaacucaccugu

SEQ ID NO: 48610 - RNA, 20 nt, Artificial Sequence
  Synthetic Oligonucleotide; BTLA exon 2; Set C
guguugagaacucaccuguc

SEQ ID NO: 48611 - RNA, 30 nt, Artificial Sequence
  Synthetic Oligonucleotide; BTLA exon 2; Set C
ucuagguguugagaacucaccugucacaua

SEQ ID NO: 48612 - RNA, 37 nt, Artificial Sequence
  Synthetic Oligonucleotide; BTLA exon 2; Set C
auggucuagguguugagaacucaccugucacauaaag

SEQ ID NO: 48613 - RNA, 39 nt, Artificial Sequence
  Synthetic Oligonucleotide; BTLA exon 2; Set C
gauggucuagguguugagaacucaccugucacauaaaga

SEQ ID NO: 48614 - RNA, 19 nt, Artificial Sequence
  Synthetic Oligonucleotide; BTLA exon 2; Set C
guguugagaacucaccugu

SEQ ID NO: 48615 - RNA, 21 nt, Artificial Sequence
  Synthetic Oligonucleotide; BTLA exon 2; Set B
gguguugagaacucaccuguc

SEQ ID NO: 48616 - RNA, 31 nt, Artificial Sequence
  Synthetic Oligonucleotide; BTLA exon 2; Set C
gucuagguguugagaacucaccugucacaua

SEQ ID NO: 48617 - RNA, 36 nt, Artificial Sequence
  Synthetic Oligonucleotide; BTLA exon 2; Set C
auggucuagguguugagaacucaccugucacauaaa

SEQ ID NO: 48618 - RNA, 38 nt, Artificial Sequence
  Synthetic Oligonucleotide; BTLA exon 2; Set C
gauggucuagguguugagaacucaccugucacauaaag

SEQ ID NO: 48619 - RNA, 40 nt, Artificial Sequence
  Synthetic Oligonucleotide; BTLA exon 2; Set C
agauggucuagguguugagaacucaccugucacauaaaga

SEQ ID NO: 48620 - RNA, 20 nt, Artificial Sequence
  Synthetic Oligonucleotide; BTLA exon 2; Set C
gguguugagaacucaccugu

SEQ ID NO: 48621 - RNA, 22 nt, Artificial Sequence
  Synthetic Oligonucleotide; BTLA exon 2; Set B
agguguugagaacucaccuguc

SEQ ID NO: 48622 - RNA, 32 nt, Artificial Sequence
  Synthetic Oligonucleotide; BTLA exon 2; Set C
ggucuagguguugagaacucaccugucacaua

SEQ ID NO: 48623 - RNA, 35 nt, Artificial Sequence
  Synthetic Oligonucleotide; BTLA exon 2; Set C
auggucuagguguugagaacucaccugucacauaa

SEQ ID NO: 48624 - RNA, 37 nt, Artificial Sequence
  Synthetic Oligonucleotide; BTLA exon 2; Set C
gauggucuagguguugagaacucaccugucacauaaa

SEQ ID NO: 48625 - RNA, 39 nt, Artificial Sequence
  Synthetic Oligonucleotide; BTLA exon 2; Set C
agauggucuagguguugagaacucaccugucacauaaag

SEQ ID NO: 48626 - RNA, 21 nt, Artificial Sequence
  Synthetic Oligonucleotide; BTLA exon 2; Set C
agguguugagaacucaccugu

SEQ ID NO: 48627 - RNA, 23 nt, Artificial Sequence
  Synthetic Oligonucleotide; BTLA exon 2; Set B
uagguguugagaacucaccuguc

SEQ ID NO: 48628 - RNA, 33 nt, Artificial Sequence
  Synthetic Oligonucleotide; BTLA exon 2; Set C
uggucuagguguugagaacucaccugucacaua

SEQ ID NO: 48629 - RNA, 36 nt, Artificial Sequence
  Synthetic Oligonucleotide; BTLA exon 2; Set C
gauggucuagguguugagaacucaccugucacauaa

SEQ ID NO: 48630 - RNA, 38 nt, Artificial Sequence
  Synthetic Oligonucleotide; BTLA exon 2; Set C
agauggucuagguguugagaacucaccugucacauaaa

SEQ ID NO: 48631 - RNA, 40 nt, Artificial Sequence
  Synthetic Oligonucleotide; BTLA exon 2; Set C
cagauggucuagguguugagaacucaccugucacauaaag

SEQ ID NO: 48632 - RNA, 22 nt, Artificial Sequence
  Synthetic Oligonucleotide; BTLA exon 2; Set B
uagguguugagaacucaccugu

SEQ ID NO: 48633 - RNA, 24 nt, Artificial Sequence
  Synthetic Oligonucleotide; BTLA exon 2; Set B
cuagguguugagaacucaccuguc

SEQ ID NO: 48634 - RNA, 37 nt, Artificial Sequence
  Synthetic Oligonucleotide; BTLA exon 2; Set C
agauggucuagguguugagaacucaccugucacauaa

SEQ ID NO: 48635 - RNA, 39 nt, Artificial Sequence
  Synthetic Oligonucleotide; BTLA exon 2; Set C
cagauggucuagguguugagaacucaccugucacauaaa

SEQ ID NO: 48636 - RNA, 23 nt, Artificial Sequence
  Synthetic Oligonucleotide; BTLA exon 2; Set B
cuagguguugagaacucaccugu

SEQ ID NO: 48637 - RNA, 38 nt, Artificial Sequence
  Synthetic Oligonucleotide; BTLA exon 2; Set C
cagauggucuagguguugagaacucaccugucacauaa

SEQ ID NO: 48638 - RNA, 40 nt, Artificial Sequence
  Synthetic Oligonucleotide; BTLA exon 2; Set C
ucagauggucuagguguugagaacucaccugucacauaaa

SEQ ID NO: 48639 - RNA, 39 nt, Artificial Sequence
  Synthetic Oligonucleotide; BTLA exon 2; Set C
ucagauggucuagguguugagaacucaccugucacauaa

SEQ ID NO: 48640 - RNA, 27 nt, Artificial Sequence
  Synthetic Oligonucleotide; BTLA exon 2; Set B
ggucuagguguugagaacucaccuguc

SEQ ID NO: 48641 - RNA, 40 nt, Artificial Sequence
  Synthetic Oligonucleotide; BTLA exon 2; Set C
aucagauggucuagguguugagaacucaccugucacauaa

SEQ ID NO: 48642 - RNA, 29 nt, Artificial Sequence
  Synthetic Oligonucleotide; BTLA exon 2; Set B
auggucuagguguugagaacucaccuguc

SEQ ID NO: 48643 - RNA, 28 nt, Artificial Sequence
  Synthetic Oligonucleotide; BTLA exon 2; Set B
auggucuagguguugagaacucaccugu

SEQ ID NO: 48644 - RNA, 30 nt, Artificial Sequence
  Synthetic Oligonucleotide; BTLA exon 2; Set C
gauggucuagguguugagaacucaccuguc

SEQ ID NO: 48645 - RNA, 40 nt, Artificial Sequence
  Synthetic Oligonucleotide; BTLA exon 2; Set C
uaucagauggucuagguguugagaacucaccugucacaua

SEQ ID NO: 48646 - RNA, 29 nt, Artificial Sequence
  Synthetic Oligonucleotide; BTLA exon 2; Set C
gauggucuagguguugagaacucaccugu

SEQ ID NO: 48647 - RNA, 31 nt, Artificial Sequence
  Synthetic Oligonucleotide; BTLA exon 2; Set C
agauggucuagguguugagaacucaccuguc

SEQ ID NO: 48648 - RNA, 15 nt, Artificial Sequence
  Synthetic Oligonucleotide; BTLA exon 2; Set C
uagguguugagaacu

SEQ ID NO: 48649 - RNA, 30 nt, Artificial Sequence
  Synthetic Oligonucleotide; BTLA exon 2; Set C
agauggucuagguguugagaacucaccugu

SEQ ID NO: 48650 - RNA, 16 nt, Artificial Sequence
  Synthetic Oligonucleotide; BTLA exon 2; Set C
cuagguguugagaacu

SEQ ID NO: 48651 - RNA, 17 nt, Artificial Sequence
  Synthetic Oligonucleotide; BTLA exon 2; Set C
ucuagguguugagaacu

SEQ ID NO: 48652 - RNA, 34 nt, Artificial Sequence
  Synthetic Oligonucleotide; BTLA exon 2; Set C
aucagauggucuagguguugagaacucaccuguc

SEQ ID NO: 48653 - RNA, 18 nt, Artificial Sequence
  Synthetic Oligonucleotide; BTLA exon 2; Set C
gucuagguguugagaacu

SEQ ID NO: 48654 - RNA, 33 nt, Artificial Sequence
  Synthetic Oligonucleotide; BTLA exon 2; Set C
aucagauggucuagguguugagaacucaccugu

SEQ ID NO: 48655 - RNA, 19 nt, Artificial Sequence
  Synthetic Oligonucleotide; BTLA exon 2; Set C
ggucuagguguugagaacu

SEQ ID NO: 48656 - RNA, 20 nt, Artificial Sequence
  Synthetic Oligonucleotide; BTLA exon 2; Set C
uggucuagguguugagaacu

SEQ ID NO: 48657 - RNA, 21 nt, Artificial Sequence
  Synthetic Oligonucleotide; BTLA exon 2; Set C
auggucuagguguugagaacu

SEQ ID NO: 48658 - RNA, 22 nt, Artificial Sequence
  Synthetic Oligonucleotide; BTLA exon 2; Set C
gauggucuagguguugagaacu

SEQ ID NO: 48659 - RNA, 40 nt, Artificial Sequence
  Synthetic Oligonucleotide; BTLA exon 2; Set B
aaaaauaucagauggucuagguguugagaacucaccuguc

SEQ ID NO: 48660 - RNA, 39 nt, Artificial Sequence
  Synthetic Oligonucleotide; BTLA exon 2; Set B
aaaaauaucagauggucuagguguugagaacucaccugu

SEQ ID NO: 48661 - RNA, 40 nt, Artificial Sequence
  Synthetic Oligonucleotide; BTLA exon 2; Set C
gaaaaauaucagauggucuagguguugagaacucaccugu

SEQ ID NO: 48662 - RNA, 26 nt, Artificial Sequence
  Synthetic Oligonucleotide; BTLA exon 2; Set B
aucagauggucuagguguugagaacu

SEQ ID NO: 48663 - RNA, 27 nt, Artificial Sequence
  Synthetic Oligonucleotide; BTLA exon 2; Set B
uaucagauggucuagguguugagaacu

SEQ ID NO: 48664 - RNA, 28 nt, Artificial Sequence
  Synthetic Oligonucleotide; BTLA exon 2; Set B
auaucagauggucuagguguugagaacu

SEQ ID NO: 48665 - RNA, 29 nt, Artificial Sequence
  Synthetic Oligonucleotide; BTLA exon 2; Set B
aauaucagauggucuagguguugagaacu

SEQ ID NO: 48666 - RNA, 15 nt, Artificial Sequence
  Synthetic Oligonucleotide; BTLA exon 2; Set C
gauggucuagguguu

SEQ ID NO: 48667 - RNA, 30 nt, Artificial Sequence
  Synthetic Oligonucleotide; BTLA exon 2; Set B
aaauaucagauggucuagguguugagaacu

SEQ ID NO: 48668 - RNA, 31 nt, Artificial Sequence
  Synthetic Oligonucleotide; BTLA exon 2; Set B
aaaauaucagauggucuagguguugagaacu

SEQ ID NO: 48669 - RNA, 32 nt, Artificial Sequence
  Synthetic Oligonucleotide; BTLA exon 2; Set B
aaaaauaucagauggucuagguguugagaacu

SEQ ID NO: 48670 - RNA, 33 nt, Artificial Sequence
  Synthetic Oligonucleotide; BTLA exon 2; Set B
gaaaaauaucagauggucuagguguugagaacu

SEQ ID NO: 48671 - RNA, 19 nt, Artificial Sequence
  Synthetic Oligonucleotide; BTLA exon 2; Set C
aucagauggucuagguguu

SEQ ID NO: 48672 - RNA, 34 nt, Artificial Sequence
  Synthetic Oligonucleotide; BTLA exon 2; Set B
agaaaaauaucagauggucuagguguugagaacu

SEQ ID NO: 48673 - RNA, 20 nt, Artificial Sequence
  Synthetic Oligonucleotide; BTLA exon 2; Set C
uaucagauggucuagguguu

SEQ ID NO: 48674 - RNA, 18 nt, Artificial Sequence
  Synthetic Oligonucleotide; BTLA exon 2; Set C
aucagauggucuaggugu

SEQ ID NO: 48675 - RNA, 35 nt, Artificial Sequence
  Synthetic Oligonucleotide; BTLA exon 2; Set B
aagaaaaauaucagauggucuagguguugagaacu

SEQ ID NO: 48676 - RNA, 21 nt, Artificial Sequence
  Synthetic Oligonucleotide; BTLA exon 2; Set C
auaucagauggucuagguguu

SEQ ID NO: 48677 - RNA, 17 nt, Artificial Sequence
  Synthetic Oligonucleotide; BTLA exon 2; Set C
aucagauggucuaggug

SEQ ID NO: 48678 - RNA, 19 nt, Artificial Sequence
  Synthetic Oligonucleotide; BTLA exon 2; Set C
uaucagauggucuaggugu

SEQ ID NO: 48679 - RNA, 22 nt, Artificial Sequence
  Synthetic Oligonucleotide; BTLA exon 2; Set C
aauaucagauggucuagguguu

SEQ ID NO: 48680 - RNA, 18 nt, Artificial Sequence
  Synthetic Oligonucleotide; BTLA exon 2; Set C
uaucagauggucuaggug

SEQ ID NO: 48681 - RNA, 20 nt, Artificial Sequence
  Synthetic Oligonucleotide; BTLA exon 2; Set C
auaucagauggucuaggugu

SEQ ID NO: 48682 - RNA, 23 nt, Artificial Sequence
  Synthetic Oligonucleotide; BTLA exon 2; Set C
aaauaucagauggucuagguguu

SEQ ID NO: 48683 - RNA, 19 nt, Artificial Sequence
  Synthetic Oligonucleotide; BTLA exon 2; Set C
auaucagauggucuaggug

SEQ ID NO: 48684 - RNA, 21 nt, Artificial Sequence
  Synthetic Oligonucleotide; BTLA exon 2; Set C
aauaucagauggucuaggugu

SEQ ID NO: 48685 - RNA, 17 nt, Artificial Sequence
  Synthetic Oligonucleotide; BTLA exon 2; Set C
uaucagauggucuaggu

SEQ ID NO: 48686 - RNA, 24 nt, Artificial Sequence
  Synthetic Oligonucleotide; BTLA exon 2; Set C
aaaauaucagauggucuagguguu

SEQ ID NO: 48687 - RNA, 20 nt, Artificial Sequence
  Synthetic Oligonucleotide; BTLA exon 2; Set C
aauaucagauggucuaggug

SEQ ID NO: 48688 - RNA, 22 nt, Artificial Sequence
  Synthetic Oligonucleotide; BTLA exon 2; Set C
aaauaucagauggucuaggugu

SEQ ID NO: 48689 - RNA, 18 nt, Artificial Sequence
  Synthetic Oligonucleotide; BTLA exon 2; Set C
auaucagauggucuaggu

SEQ ID NO: 48690 - RNA, 16 nt, Artificial Sequence
  Synthetic Oligonucleotide; BTLA exon 2; Set C
uaucagauggucuagg

SEQ ID NO: 48691 - RNA, 36 nt, Artificial Sequence
  Synthetic Oligonucleotide; BTLA exon 2; Set B
auaagaaaaauaucagauggucuagguguugagaac

SEQ ID NO: 48692 - RNA, 15 nt, Artificial Sequence
  Synthetic Oligonucleotide; BTLA exon 2; Set C
uaucagauggucuag

SEQ ID NO: 48693 - RNA, 25 nt, Artificial Sequence
  Synthetic Oligonucleotide; BTLA exon 2; Set C
aaaaauaucagauggucuagguguu

SEQ ID NO: 48694 - RNA, 21 nt, Artificial Sequence
  Synthetic Oligonucleotide; BTLA exon 2; Set C
aaauaucagauggucuaggug

SEQ ID NO: 48695 - RNA, 23 nt, Artificial Sequence
  Synthetic Oligonucleotide; BTLA exon 2; Set C
aaaauaucagauggucuaggugu

SEQ ID NO: 48696 - RNA, 19 nt, Artificial Sequence
  Synthetic Oligonucleotide; BTLA exon 2; Set C
aauaucagauggucuaggu

SEQ ID NO: 48697 - RNA, 17 nt, Artificial Sequence
  Synthetic Oligonucleotide; BTLA exon 2; Set C
auaucagauggucuagg

SEQ ID NO: 48698 - RNA, 37 nt, Artificial Sequence
  Synthetic Oligonucleotide; BTLA exon 2; Set B
uauaagaaaaauaucagauggucuagguguugagaac

SEQ ID NO: 48699 - RNA, 40 nt, Artificial Sequence
  Synthetic Oligonucleotide; BTLA exon 2; Set B
auuauaagaaaaauaucagauggucuagguguugagaacu

SEQ ID NO: 48700 - RNA, 16 nt, Artificial Sequence
  Synthetic Oligonucleotide; BTLA exon 2; Set C
auaucagauggucuag

SEQ ID NO: 48701 - RNA, 26 nt, Artificial Sequence
  Synthetic Oligonucleotide; BTLA exon 2; Set C
gaaaaauaucagauggucuagguguu

SEQ ID NO: 48702 - RNA, 22 nt, Artificial Sequence
  Synthetic Oligonucleotide; BTLA exon 2; Set C
aaaauaucagauggucuaggug

SEQ ID NO: 48703 - RNA, 24 nt, Artificial Sequence
  Synthetic Oligonucleotide; BTLA exon 2; Set C
aaaaauaucagauggucuaggugu

SEQ ID NO: 48704 - RNA, 20 nt, Artificial Sequence
  Synthetic Oligonucleotide; BTLA exon 2; Set C
aaauaucagauggucuaggu

SEQ ID NO: 48705 - RNA, 18 nt, Artificial Sequence
  Synthetic Oligonucleotide; BTLA exon 2; Set C
aauaucagauggucuagg

SEQ ID NO: 48706 - RNA, 38 nt, Artificial Sequence
  Synthetic Oligonucleotide; BTLA exon 2; Set B
uuauaagaaaaauaucagauggucuagguguugagaac

SEQ ID NO: 48707 - RNA, 17 nt, Artificial Sequence
  Synthetic Oligonucleotide; BTLA exon 2; Set C
aauaucagauggucuag

SEQ ID NO: 48708 - RNA, 27 nt, Artificial Sequence
  Synthetic Oligonucleotide; BTLA exon 2; Set C
agaaaaauaucagauggucuagguguu

SEQ ID NO: 48709 - RNA, 15 nt, Artificial Sequence
  Synthetic Oligonucleotide; BTLA exon 2; Set C
auaucagauggucua

SEQ ID NO: 48710 - RNA, 23 nt, Artificial Sequence
  Synthetic Oligonucleotide; BTLA exon 2; Set C
aaaaauaucagauggucuaggug

SEQ ID NO: 48711 - RNA, 25 nt, Artificial Sequence
  Synthetic Oligonucleotide; BTLA exon 2; Set C
gaaaaauaucagauggucuaggugu

SEQ ID NO: 48712 - RNA, 21 nt, Artificial Sequence
  Synthetic Oligonucleotide; BTLA exon 2; Set C
aaaauaucagauggucuaggu

SEQ ID NO: 48713 - RNA, 19 nt, Artificial Sequence
  Synthetic Oligonucleotide; BTLA exon 2; Set C
aaauaucagauggucuagg

SEQ ID NO: 48714 - RNA, 18 nt, Artificial Sequence
  Synthetic Oligonucleotide; BTLA exon 2; Set C
aaauaucagauggucuag

SEQ ID NO: 48715 - RNA, 28 nt, Artificial Sequence
  Synthetic Oligonucleotide; BTLA exon 2; Set C
aagaaaaauaucagauggucuagguguu

SEQ ID NO: 48716 - RNA, 16 nt, Artificial Sequence
  Synthetic Oligonucleotide; BTLA exon 2; Set C
aauaucagauggucua

SEQ ID NO: 48717 - RNA, 24 nt, Artificial Sequence
  Synthetic Oligonucleotide; BTLA exon 2; Set C
gaaaaauaucagauggucuaggug

SEQ ID NO: 48718 - RNA, 26 nt, Artificial Sequence
  Synthetic Oligonucleotide; BTLA exon 2; Set C
agaaaaauaucagauggucuaggugu

SEQ ID NO: 48719 - RNA, 22 nt, Artificial Sequence
  Synthetic Oligonucleotide; BTLA exon 2; Set C
aaaaauaucagauggucuaggu

SEQ ID NO: 48720 - RNA, 20 nt, Artificial Sequence
  Synthetic Oligonucleotide; BTLA exon 2; Set C
aaaauaucagauggucuagg

SEQ ID NO: 48721 - RNA, 30 nt, Artificial Sequence
  Synthetic Oligonucleotide; BTLA exon 2; Set C
uaagaaaaauaucagauggucuagguguug

SEQ ID NO: 48722 - RNA, 19 nt, Artificial Sequence
  Synthetic Oligonucleotide; BTLA exon 2; Set C
aaaauaucagauggucuag

SEQ ID NO: 48723 - RNA, 17 nt, Artificial Sequence
  Synthetic Oligonucleotide; BTLA exon 2; Set C
aaauaucagauggucua

SEQ ID NO: 48724 - RNA, 25 nt, Artificial Sequence
  Synthetic Oligonucleotide; BTLA exon 2; Set C
agaaaaauaucagauggucuaggug

SEQ ID NO: 48725 - RNA, 27 nt, Artificial Sequence
  Synthetic Oligonucleotide; BTLA exon 2; Set C
aagaaaaauaucagauggucuaggugu

SEQ ID NO: 48726 - RNA, 23 nt, Artificial Sequence
  Synthetic Oligonucleotide; BTLA exon 2; Set C
gaaaaauaucagauggucuaggu

SEQ ID NO: 48727 - RNA, 21 nt, Artificial Sequence
  Synthetic Oligonucleotide; BTLA exon 2; Set C
aaaaauaucagauggucuagg

SEQ ID NO: 48728 - RNA, 31 nt, Artificial Sequence
  Synthetic Oligonucleotide; BTLA exon 2; Set C
auaagaaaaauaucagauggucuagguguug

SEQ ID NO: 48729 - RNA, 20 nt, Artificial Sequence
  Synthetic Oligonucleotide; BTLA exon 2; Set C
aaaaauaucagauggucuag

SEQ ID NO: 48730 - RNA, 18 nt, Artificial Sequence
  Synthetic Oligonucleotide; BTLA exon 2; Set C
aaaauaucagauggucua

SEQ ID NO: 48731 - RNA, 26 nt, Artificial Sequence
  Synthetic Oligonucleotide; BTLA exon 2; Set C
aagaaaaauaucagauggucuaggug

SEQ ID NO: 48732 - RNA, 28 nt, Artificial Sequence
  Synthetic Oligonucleotide; BTLA exon 2; Set C
uaagaaaaauaucagauggucuaggugu

SEQ ID NO: 48733 - RNA, 24 nt, Artificial Sequence
  Synthetic Oligonucleotide; BTLA exon 2; Set C
agaaaaauaucagauggucuaggu

SEQ ID NO: 48734 - RNA, 22 nt, Artificial Sequence
  Synthetic Oligonucleotide; BTLA exon 2; Set C
gaaaaauaucagauggucuagg

SEQ ID NO: 48735 - RNA, 32 nt, Artificial Sequence
  Synthetic Oligonucleotide; BTLA exon 2; Set C
uauaagaaaaauaucagauggucuagguguug

SEQ ID NO: 48736 - RNA, 21 nt, Artificial Sequence
  Synthetic Oligonucleotide; BTLA exon 2; Set C
gaaaaauaucagauggucuag

SEQ ID NO: 48737 - RNA, 19 nt, Artificial Sequence
  Synthetic Oligonucleotide; BTLA exon 2; Set C
aaaaauaucagauggucua

SEQ ID NO: 48738 - RNA, 27 nt, Artificial Sequence
  Synthetic Oligonucleotide; BTLA exon 2; Set C
uaagaaaaauaucagauggucuaggug

SEQ ID NO: 48739 - RNA, 25 nt, Artificial Sequence
  Synthetic Oligonucleotide; BTLA exon 2; Set C
aagaaaaauaucagauggucuaggu

SEQ ID NO: 48740 - RNA, 23 nt, Artificial Sequence
  Synthetic Oligonucleotide; BTLA exon 2; Set C
agaaaaauaucagauggucuagg

SEQ ID NO: 48741 - RNA, 33 nt, Artificial Sequence
  Synthetic Oligonucleotide; BTLA exon 2; Set C
uuauaagaaaaauaucagauggucuagguguug

SEQ ID NO: 48742 - RNA, 22 nt, Artificial Sequence
  Synthetic Oligonucleotide; BTLA exon 2; Set C
agaaaaauaucagauggucuag

SEQ ID NO: 48743 - RNA, 20 nt, Artificial Sequence
  Synthetic Oligonucleotide; BTLA exon 2; Set C
gaaaaauaucagauggucua

SEQ ID NO: 48744 - RNA, 26 nt, Artificial Sequence
  Synthetic Oligonucleotide; BTLA exon 2; Set C
uaagaaaaauaucagauggucuaggu

SEQ ID NO: 48745 - RNA, 24 nt, Artificial Sequence
  Synthetic Oligonucleotide; BTLA exon 2; Set C
aagaaaaauaucagauggucuagg

SEQ ID NO: 48746 - RNA, 17 nt, Artificial Sequence
  Synthetic Oligonucleotide; BTLA exon 2; Set C
aaaaauaucagaugguc

SEQ ID NO: 48747 - RNA, 15 nt, Artificial Sequence
  Synthetic Oligonucleotide; BTLA exon 2; Set C
aaaauaucagauggu

SEQ ID NO: 48748 - RNA, 23 nt, Artificial Sequence
  Synthetic Oligonucleotide; BTLA exon 2; Set C
aagaaaaauaucagauggucuag

SEQ ID NO: 48749 - RNA, 33 nt, Artificial Sequence
  Synthetic Oligonucleotide; BTLA exon 2; Set C
auuauaagaaaaauaucagauggucuagguguu

SEQ ID NO: 48750 - RNA, 21 nt, Artificial Sequence
  Synthetic Oligonucleotide; BTLA exon 2; Set C
agaaaaauaucagauggucua

SEQ ID NO: 48751 - RNA, 27 nt, Artificial Sequence
  Synthetic Oligonucleotide; BTLA exon 2; Set C
auaagaaaaauaucagauggucuaggu

SEQ ID NO: 48752 - RNA, 25 nt, Artificial Sequence
  Synthetic Oligonucleotide; BTLA exon 2; Set C
uaagaaaaauaucagauggucuagg

SEQ ID NO: 48753 - RNA, 18 nt, Artificial Sequence
  Synthetic Oligonucleotide; BTLA exon 2; Set C
gaaaaauaucagaugguc

SEQ ID NO: 48754 - RNA, 16 nt, Artificial Sequence
  Synthetic Oligonucleotide; BTLA exon 2; Set C
aaaaauaucagauggu

SEQ ID NO: 48755 - RNA, 34 nt, Artificial Sequence
  Synthetic Oligonucleotide; BTLA exon 2; Set C
cauuauaagaaaaauaucagauggucuagguguu

SEQ ID NO: 48756 - RNA, 22 nt, Artificial Sequence
  Synthetic Oligonucleotide; BTLA exon 2; Set C
aagaaaaauaucagauggucua

SEQ ID NO: 48757 - RNA, 32 nt, Artificial Sequence
  Synthetic Oligonucleotide; BTLA exon 2; Set C
auuauaagaaaaauaucagauggucuaggugu

SEQ ID NO: 48758 - RNA, 26 nt, Artificial Sequence
  Synthetic Oligonucleotide; BTLA exon 2; Set C
auaagaaaaauaucagauggucuagg

SEQ ID NO: 48759 - RNA, 19 nt, Artificial Sequence
  Synthetic Oligonucleotide; BTLA exon 2; Set C
agaaaaauaucagaugguc

SEQ ID NO: 48760 - RNA, 17 nt, Artificial Sequence
  Synthetic Oligonucleotide; BTLA exon 2; Set C
gaaaaauaucagauggu

SEQ ID NO: 48761 - RNA, 31 nt, Artificial Sequence
  Synthetic Oligonucleotide; BTLA exon 2; Set C
auuauaagaaaaauaucagauggucuaggug

SEQ ID NO: 48762 - RNA, 27 nt, Artificial Sequence
  Synthetic Oligonucleotide; BTLA exon 2; Set C
uauaagaaaaauaucagauggucuagg

SEQ ID NO: 48763 - RNA, 16 nt, Artificial Sequence
  Synthetic Oligonucleotide; BTLA exon 2; Set C
gaaaaauaucagaugg

SEQ ID NO: 48764 - RNA, 20 nt, Artificial Sequence
  Synthetic Oligonucleotide; BTLA exon 2; Set C
aagaaaaauaucagaugguc

SEQ ID NO: 48765 - RNA, 18 nt, Artificial Sequence
  Synthetic Oligonucleotide; BTLA exon 2; Set C
agaaaaauaucagauggu

SEQ ID NO: 48766 - RNA, 30 nt, Artificial Sequence
  Synthetic Oligonucleotide; BTLA exon 2; Set C
auuauaagaaaaauaucagauggucuaggu

SEQ ID NO: 48767 - RNA, 28 nt, Artificial Sequence
  Synthetic Oligonucleotide; BTLA exon 2; Set C
uuauaagaaaaauaucagauggucuagg

SEQ ID NO: 48768 - RNA, 19 nt, Artificial Sequence
  Synthetic Oligonucleotide; BTLA exon 2; Set C
aagaaaaauaucagauggu

SEQ ID NO: 48769 - RNA, 15 nt, Artificial Sequence
  Synthetic Oligonucleotide; BTLA exon 2; Set C
gaaaaauaucagaug

SEQ ID NO: 48770 - RNA, 29 nt, Artificial Sequence
  Synthetic Oligonucleotide; BTLA exon 2; Set C
auuauaagaaaaauaucagauggucuagg

SEQ ID NO: 48771 - RNA, 28 nt, Artificial Sequence
  Synthetic Oligonucleotide; BTLA exon 2; Set C
auuauaagaaaaauaucagauggucuag

SEQ ID NO: 48772 - RNA, 38 nt, Artificial Sequence
  Synthetic Oligonucleotide; BTLA exon 2; Set C
gaaacauuauaagaaaaauaucagauggucuagguguu

SEQ ID NO: 48773 - RNA, 16 nt, Artificial Sequence
  Synthetic Oligonucleotide; BTLA exon 2; Set C
agaaaaauaucagaug

SEQ ID NO: 48774 - RNA, 29 nt, Artificial Sequence
  Synthetic Oligonucleotide; BTLA exon 2; Set C
cauuauaagaaaaauaucagauggucuag

SEQ ID NO: 48775 - RNA, 39 nt, Artificial Sequence
  Synthetic Oligonucleotide; BTLA exon 2; Set B
ggaaacauuauaagaaaaauaucagauggucuagguguu

SEQ ID NO: 48776 - RNA, 27 nt, Artificial Sequence
  Synthetic Oligonucleotide; BTLA exon 2; Set C
auuauaagaaaaauaucagauggucua

SEQ ID NO: 48777 - RNA, 17 nt, Artificial Sequence
  Synthetic Oligonucleotide; BTLA exon 2; Set C
aagaaaaauaucagaug

SEQ ID NO: 48778 - RNA, 15 nt, Artificial Sequence
  Synthetic Oligonucleotide; BTLA exon 2; Set C
agaaaaauaucagau

SEQ ID NO: 48779 - RNA, 30 nt, Artificial Sequence
  Synthetic Oligonucleotide; BTLA exon 2; Set C
acauuauaagaaaaauaucagauggucuag

SEQ ID NO: 48780 - RNA, 28 nt, Artificial Sequence
  Synthetic Oligonucleotide; BTLA exon 2; Set C
cauuauaagaaaaauaucagauggucua

SEQ ID NO: 48781 - RNA, 38 nt, Artificial Sequence
  Synthetic Oligonucleotide; BTLA exon 2; Set B
ggaaacauuauaagaaaaauaucagauggucuaggugu

SEQ ID NO: 48782 - RNA, 18 nt, Artificial Sequence
  Synthetic Oligonucleotide; BTLA exon 2; Set C
uaagaaaaauaucagaug

SEQ ID NO: 48783 - RNA, 16 nt, Artificial Sequence
  Synthetic Oligonucleotide; BTLA exon 2; Set C
aagaaaaauaucagau

SEQ ID NO: 48784 - RNA, 27 nt, Artificial Sequence
  Synthetic Oligonucleotide; BTLA exon 2; Set C
cauuauaagaaaaauaucagauggucu

SEQ ID NO: 48785 - RNA, 37 nt, Artificial Sequence
  Synthetic Oligonucleotide; BTLA exon 2; Set C
ggaaacauuauaagaaaaauaucagauggucuaggug

SEQ ID NO: 48786 - RNA, 19 nt, Artificial Sequence
  Synthetic Oligonucleotide; BTLA exon 2; Set C
auaagaaaaauaucagaug

SEQ ID NO: 48787 - RNA, 17 nt, Artificial Sequence
  Synthetic Oligonucleotide; BTLA exon 2; Set C
uaagaaaaauaucagau

SEQ ID NO: 48788 - RNA, 28 nt, Artificial Sequence
  Synthetic Oligonucleotide; BTLA exon 2; Set C
acauuauaagaaaaauaucagauggucu

SEQ ID NO: 48789 - RNA, 26 nt, Artificial Sequence
  Synthetic Oligonucleotide; BTLA exon 2; Set C
cauuauaagaaaaauaucagaugguc

SEQ ID NO: 48790 - RNA, 18 nt, Artificial Sequence
  Synthetic Oligonucleotide; BTLA exon 2; Set C
auaagaaaaauaucagau

SEQ ID NO: 48791 - RNA, 16 nt, Artificial Sequence
  Synthetic Oligonucleotide; BTLA exon 2; Set C
uaagaaaaauaucaga

SEQ ID NO: 48792 - RNA, 29 nt, Artificial Sequence
  Synthetic Oligonucleotide; BTLA exon 2; Set C
aacauuauaagaaaaauaucagauggucu

SEQ ID NO: 48793 - RNA, 27 nt, Artificial Sequence
  Synthetic Oligonucleotide; BTLA exon 2; Set C
acauuauaagaaaaauaucagaugguc

SEQ ID NO: 48794 - RNA, 25 nt, Artificial Sequence
  Synthetic Oligonucleotide; BTLA exon 2; Set C
cauuauaagaaaaauaucagauggu

SEQ ID NO: 48795 - RNA, 33 nt, Artificial Sequence
  Synthetic Oligonucleotide; BTLA exon 2; Set C
gaaacauuauaagaaaaauaucagauggucuag

SEQ ID NO: 48796 - RNA, 17 nt, Artificial Sequence
  Synthetic Oligonucleotide; BTLA exon 2; Set C
auaagaaaaauaucaga

SEQ ID NO: 48797 - RNA, 15 nt, Artificial Sequence
  Synthetic Oligonucleotide; BTLA exon 2; Set C
uaagaaaaauaucag

SEQ ID NO: 48798 - RNA, 30 nt, Artificial Sequence
  Synthetic Oligonucleotide; BTLA exon 2; Set C
aaacauuauaagaaaaauaucagauggucu

SEQ ID NO: 48799 - RNA, 24 nt, Artificial Sequence
  Synthetic Oligonucleotide; BTLA exon 2; Set C
cauuauaagaaaaauaucagaugg

SEQ ID NO: 48800 - RNA, 28 nt, Artificial Sequence
  Synthetic Oligonucleotide; BTLA exon 2; Set C
aacauuauaagaaaaauaucagaugguc

SEQ ID NO: 48801 - RNA, 26 nt, Artificial Sequence
  Synthetic Oligonucleotide; BTLA exon 2; Set C
acauuauaagaaaaauaucagauggu

SEQ ID NO: 48802 - RNA, 34 nt, Artificial Sequence
  Synthetic Oligonucleotide; BTLA exon 2; Set C
ggaaacauuauaagaaaaauaucagauggucuag

SEQ ID NO: 48803 - RNA, 32 nt, Artificial Sequence
  Synthetic Oligonucleotide; BTLA exon 2; Set C
gaaacauuauaagaaaaauaucagauggucua

SEQ ID NO: 48804 - RNA, 22 nt, Artificial Sequence
  Synthetic Oligonucleotide; BTLA exon 2; Set C
auuauaagaaaaauaucagaug

SEQ ID NO: 48805 - RNA, 18 nt, Artificial Sequence
  Synthetic Oligonucleotide; BTLA exon 2; Set C
uauaagaaaaauaucaga

SEQ ID NO: 48806 - RNA, 16 nt, Artificial Sequence
  Synthetic Oligonucleotide; BTLA exon 2; Set C
auaagaaaaauaucag

SEQ ID NO: 48807 - RNA, 31 nt, Artificial Sequence
  Synthetic Oligonucleotide; BTLA exon 2; Set C
gaaacauuauaagaaaaauaucagauggucu

SEQ ID NO: 48808 - RNA, 25 nt, Artificial Sequence
  Synthetic Oligonucleotide; BTLA exon 2; Set C
acauuauaagaaaaauaucagaugg

SEQ ID NO: 48809 - RNA, 29 nt, Artificial Sequence
  Synthetic Oligonucleotide; BTLA exon 2; Set C
aaacauuauaagaaaaauaucagaugguc

SEQ ID NO: 48810 - RNA, 33 nt, Artificial Sequence
  Synthetic Oligonucleotide; BTLA exon 2; Set C
ggaaacauuauaagaaaaauaucagauggucua

SEQ ID NO: 48811 - RNA, 21 nt, Artificial Sequence
  Synthetic Oligonucleotide; BTLA exon 2; Set C
auuauaagaaaaauaucagau

SEQ ID NO: 48812 - RNA, 19 nt, Artificial Sequence
  Synthetic Oligonucleotide; BTLA exon 2; Set C
uuauaagaaaaauaucaga

SEQ ID NO: 48813 - RNA, 17 nt, Artificial Sequence
  Synthetic Oligonucleotide; BTLA exon 2; Set C
uauaagaaaaauaucag

SEQ ID NO: 48814 - RNA, 15 nt, Artificial Sequence
  Synthetic Oligonucleotide; BTLA exon 2; Set C
auaagaaaaauauca

SEQ ID NO: 48815 - RNA, 32 nt, Artificial Sequence
  Synthetic Oligonucleotide; BTLA exon 2; Set C
ggaaacauuauaagaaaaauaucagauggucu

SEQ ID NO: 48816 - RNA, 26 nt, Artificial Sequence
  Synthetic Oligonucleotide; BTLA exon 2; Set C
aacauuauaagaaaaauaucagaugg

SEQ ID NO: 48817 - RNA, 30 nt, Artificial Sequence
  Synthetic Oligonucleotide; BTLA exon 2; Set C
gaaacauuauaagaaaaauaucagaugguc

SEQ ID NO: 48818 - RNA, 20 nt, Artificial Sequence
  Synthetic Oligonucleotide; BTLA exon 2; Set C
auuauaagaaaaauaucaga

SEQ ID NO: 48819 - RNA, 18 nt, Artificial Sequence
  Synthetic Oligonucleotide; BTLA exon 2; Set C
uuauaagaaaaauaucag

SEQ ID NO: 48820 - RNA, 16 nt, Artificial Sequence
  Synthetic Oligonucleotide; BTLA exon 2; Set C
uauaagaaaaauauca

SEQ ID NO: 48821 - RNA, 33 nt, Artificial Sequence
  Synthetic Oligonucleotide; BTLA exon 2; Set C
uggaaacauuauaagaaaaauaucagauggucu

SEQ ID NO: 48822 - RNA, 27 nt, Artificial Sequence
  Synthetic Oligonucleotide; BTLA exon 2; Set C
aaacauuauaagaaaaauaucagaugg

SEQ ID NO: 48823 - RNA, 31 nt, Artificial Sequence
  Synthetic Oligonucleotide; BTLA exon 2; Set C
ggaaacauuauaagaaaaauaucagaugguc

SEQ ID NO: 48824 - RNA, 29 nt, Artificial Sequence
  Synthetic Oligonucleotide; BTLA exon 2; Set C
gaaacauuauaagaaaaauaucagauggu

SEQ ID NO: 48825 - RNA, 17 nt, Artificial Sequence
  Synthetic Oligonucleotide; BTLA exon 2; Set C
uuauaagaaaaauauca

SEQ ID NO: 48826 - RNA, 28 nt, Artificial Sequence
  Synthetic Oligonucleotide; BTLA exon 2; Set C
gaaacauuauaagaaaaauaucagaugg

SEQ ID NO: 48827 - RNA, 32 nt, Artificial Sequence
  Synthetic Oligonucleotide; BTLA exon 2; Set C
uggaaacauuauaagaaaaauaucagaugguc

SEQ ID NO: 48828 - RNA, 30 nt, Artificial Sequence
  Synthetic Oligonucleotide; BTLA exon 2; Set C
ggaaacauuauaagaaaaauaucagauggu

SEQ ID NO: 48829 - RNA, 29 nt, Artificial Sequence
  Synthetic Oligonucleotide; BTLA exon 2; Set C
ggaaacauuauaagaaaaauaucagaugg

SEQ ID NO: 48830 - RNA, 17 nt, Artificial Sequence
  Synthetic Oligonucleotide; BTLA exon 2; Set C
auuauaagaaaaauauc

SEQ ID NO: 48831 - RNA, 30 nt, Artificial Sequence
  Synthetic Oligonucleotide; BTLA exon 2; Set C
uggaaacauuauaagaaaaauaucagaugg

SEQ ID NO: 48832 - RNA, 18 nt, Artificial Sequence
  Synthetic Oligonucleotide; BTLA exon 2; Set C
cauuauaagaaaaauauc

SEQ ID NO: 48833 - RNA, 17 nt, Artificial Sequence
  Synthetic Oligonucleotide; BTLA exon 2; Set C
cauuauaagaaaaauau

SEQ ID NO: 48834 - RNA, 16 nt, Artificial Sequence
  Synthetic Oligonucleotide; BTLA exon 2; Set C
cauuauaagaaaaaua

SEQ ID NO: 48835 - RNA, 18 nt, Artificial Sequence
  Synthetic Oligonucleotide; BTLA exon 2; Set C
acauuauaagaaaaauau

SEQ ID NO: 48836 - RNA, 17 nt, Artificial Sequence
  Synthetic Oligonucleotide; BTLA exon 2; Set C
acauuauaagaaaaaua

SEQ ID NO: 48837 - RNA, 19 nt, Artificial Sequence
  Synthetic Oligonucleotide; BTLA exon 2; Set C
aacauuauaagaaaaauau

SEQ ID NO: 48838 - RNA, 15 nt, Artificial Sequence
  Synthetic Oligonucleotide; BTLA exon 2; Set C
cauuauaagaaaaau

SEQ ID NO: 48839 - RNA, 18 nt, Artificial Sequence
  Synthetic Oligonucleotide; BTLA exon 2; Set C
aacauuauaagaaaaaua

SEQ ID NO: 48840 - RNA, 20 nt, Artificial Sequence
  Synthetic Oligonucleotide; BTLA exon 2; Set C
aaacauuauaagaaaaauau

SEQ ID NO: 48841 - RNA, 16 nt, Artificial Sequence
  Synthetic Oligonucleotide; BTLA exon 2; Set C
acauuauaagaaaaau

SEQ ID NO: 48842 - RNA, 19 nt, Artificial Sequence
  Synthetic Oligonucleotide; BTLA exon 2; Set C
aaacauuauaagaaaaaua

SEQ ID NO: 48843 - RNA, 21 nt, Artificial Sequence
  Synthetic Oligonucleotide; BTLA exon 2; Set C
gaaacauuauaagaaaaauau

SEQ ID NO: 48844 - RNA, 15 nt, Artificial Sequence
  Synthetic Oligonucleotide; BTLA exon 2; Set C
acauuauaagaaaaa

SEQ ID NO: 48845 - RNA, 23 nt, Artificial Sequence
  Synthetic Oligonucleotide; BTLA exon 2; Set C
ggaaacauuauaagaaaaauauc

SEQ ID NO: 48846 - RNA, 20 nt, Artificial Sequence
  Synthetic Oligonucleotide; BTLA exon 2; Set C
gaaacauuauaagaaaaaua

SEQ ID NO: 48847 - RNA, 22 nt, Artificial Sequence
  Synthetic Oligonucleotide; BTLA exon 2; Set C
ggaaacauuauaagaaaaauau

SEQ ID NO: 48848 - RNA, 21 nt, Artificial Sequence
  Synthetic Oligonucleotide; BTLA exon 2; Set C
ggaaacauuauaagaaaaaua

SEQ ID NO: 48849 - RNA, 23 nt, Artificial Sequence
  Synthetic Oligonucleotide; BTLA exon 2; Set C
uggaaacauuauaagaaaaauau

SEQ ID NO: 48850 - RNA, 19 nt, Artificial Sequence
  Synthetic Oligonucleotide; BTLA exon 2; Set C
gaaacauuauaagaaaaau

SEQ ID NO: 48851 - RNA, 22 nt, Artificial Sequence
  Synthetic Oligonucleotide; BTLA exon 2; Set C
uggaaacauuauaagaaaaaua

SEQ ID NO: 48852 - RNA, 20 nt, Artificial Sequence
  Synthetic Oligonucleotide; BTLA exon 2; Set C
ggaaacauuauaagaaaaau

SEQ ID NO: 48853 - RNA, 18 nt, Artificial Sequence
  Synthetic Oligonucleotide; BTLA exon 2; Set C
gaaacauuauaagaaaaa

SEQ ID NO: 48854 - RNA, 19 nt, Artificial Sequence
  Synthetic Oligonucleotide; BTLA exon 2; Set C
ggaaacauuauaagaaaaa

SEQ ID NO: 48855 - RNA, 17 nt, Artificial Sequence
  Synthetic Oligonucleotide; BTLA exon 2; Set C
gaaacauuauaagaaaa

SEQ ID NO: 48856 - RNA, 18 nt, Artificial Sequence
  Synthetic Oligonucleotide; BTLA exon 2; Set C
ggaaacauuauaagaaaa

SEQ ID NO: 48857 - RNA, 16 nt, Artificial Sequence
  Synthetic Oligonucleotide; BTLA exon 2; Set C
gaaacauuauaagaaa

SEQ ID NO: 48858 - RNA, 17 nt, Artificial Sequence
  Synthetic Oligonucleotide; BTLA exon 2; Set C
ggaaacauuauaagaaa

SEQ ID NO: 48859 - RNA, 15 nt, Artificial Sequence
  Synthetic Oligonucleotide; BTLA exon 2; Set C
gaaacauuauaagaa

SEQ ID NO: 48860 - RNA, 16 nt, Artificial Sequence
  Synthetic Oligonucleotide; BTLA exon 2; Set C
ggaaacauuauaagaa

SEQ ID NO: 48861 - RNA, 15 nt, Artificial Sequence
  Synthetic Oligonucleotide; BTLA exon 2; Set C
ggaaacauuauaaga

SEQ ID NO: 48862 - RNA, 22 nt, Artificial Sequence
  Synthetic Oligonucleotide; BTLA exon 2; Set C
aaucaaauauguucuucuggaa

SEQ ID NO: 48863 - RNA, 23 nt, Artificial Sequence
  Synthetic Oligonucleotide; BTLA exon 2; Set C
aaaucaaauauguucuucuggaa

SEQ ID NO: 48864 - RNA, 29 nt, Artificial Sequence
  Synthetic Oligonucleotide; BTLA exon 2; Set C
aaacuaaaaucaaauauguucuucuggaa

SEQ ID NO: 48865 - RNA, 21 nt, Artificial Sequence
  Synthetic Oligonucleotide; BTLA exon 2; Set C
cuaaaaucaaauauguucuuc

SEQ ID NO: 48866 - RNA, 20 nt, Artificial Sequence
  Synthetic Oligonucleotide; BTLA exon 2; Set C
cuaaaaucaaauauguucuu

SEQ ID NO: 48867 - RNA, 19 nt, Artificial Sequence
  Synthetic Oligonucleotide; BTLA exon 2; Set C
cuaaaaucaaauauguucu

SEQ ID NO: 48868 - RNA, 18 nt, Artificial Sequence
  Synthetic Oligonucleotide; BTLA exon 2; Set C
cuaaaaucaaauauguuc

SEQ ID NO: 48869 - RNA, 34 nt, Artificial Sequence
  Synthetic Oligonucleotide; BTLA exon 2; Set C
aaacaaaacuaaaaucaaauauguucuucuggaa

SEQ ID NO: 48870 - RNA, 17 nt, Artificial Sequence
  Synthetic Oligonucleotide; BTLA exon 2; Set C
cuaaaaucaaauauguu

SEQ ID NO: 48871 - RNA, 38 nt, Artificial Sequence
  Synthetic Oligonucleotide; BTLA exon 2; Set C
auaaaaacaaaacuaaaaucaaauauguucuucuggaa

SEQ ID NO: 48872 - RNA, 39 nt, Artificial Sequence
  Synthetic Oligonucleotide; BTLA exon 2; Set C
gauaaaaacaaaacuaaaaucaaauauguucuucuggaa

SEQ ID NO: 48873 - RNA, 40 nt, Artificial Sequence
  Synthetic Oligonucleotide; BTLA exon 2; Set C
agauaaaaacaaaacuaaaaucaaauauguucuucuggaa

SEQ ID NO: 48874 - RNA, 15 nt, Artificial Sequence
  Synthetic Oligonucleotide; BTLA exon 2; Set C
aaacaaaacuaaaau

SEQ ID NO: 48875 - RNA, 19 nt, Artificial Sequence
  Synthetic Oligonucleotide; BTLA exon 2; Set C
auaaaaacaaaacuaaaau

SEQ ID NO: 48876 - RNA, 20 nt, Artificial Sequence
  Synthetic Oligonucleotide; BTLA exon 2; Set C
gauaaaaacaaaacuaaaau

SEQ ID NO: 48877 - RNA, 18 nt, Artificial Sequence
  Synthetic Oligonucleotide; BTLA exon 2; Set C
auaaaaacaaaacuaaaa

SEQ ID NO: 48878 - RNA, 21 nt, Artificial Sequence
  Synthetic Oligonucleotide; BTLA exon 2; Set C
agauaaaaacaaaacuaaaau

SEQ ID NO: 48879 - RNA, 19 nt, Artificial Sequence
  Synthetic Oligonucleotide; BTLA exon 2; Set C
gauaaaaacaaaacuaaaa

SEQ ID NO: 48880 - RNA, 22 nt, Artificial Sequence
  Synthetic Oligonucleotide; BTLA exon 2; Set C
aagauaaaaacaaaacuaaaau

SEQ ID NO: 48881 - RNA, 20 nt, Artificial Sequence
  Synthetic Oligonucleotide; BTLA exon 2; Set C
agauaaaaacaaaacuaaaa

SEQ ID NO: 48882 - RNA, 23 nt, Artificial Sequence
  Synthetic Oligonucleotide; BTLA exon 2; Set C
aaagauaaaaacaaaacuaaaau

SEQ ID NO: 48883 - RNA, 21 nt, Artificial Sequence
  Synthetic Oligonucleotide; BTLA exon 2; Set C
aagauaaaaacaaaacuaaaa

SEQ ID NO: 48884 - RNA, 22 nt, Artificial Sequence
  Synthetic Oligonucleotide; BTLA exon 2; Set C
aaagauaaaaacaaaacuaaaa

SEQ ID NO: 48885 - RNA, 15 nt, Artificial Sequence
  Synthetic Oligonucleotide; BTLA exon 2; Set C
aagauaaaaacaaaa

SEQ ID NO: 48886 - RNA, 16 nt, Artificial Sequence
  Synthetic Oligonucleotide; BTLA exon 2; Set C
aaagauaaaaacaaaa

SEQ ID NO: 48887 - RNA, 37 nt, Artificial Sequence
  Synthetic Oligonucleotide; BTLA exon 2; Set C
acaucacaugauucuuucccuaaaagauaaaaacaaa

SEQ ID NO: 48888 - RNA, 17 nt, Artificial Sequence
  Synthetic Oligonucleotide; BTLA exon 2; Set C
auucuuucccuaaaaga

SEQ ID NO: 48889 - RNA, 38 nt, Artificial Sequence
  Synthetic Oligonucleotide; BTLA exon 2; Set C
uacaucacaugauucuuucccuaaaagauaaaaacaaa

SEQ ID NO: 48890 - RNA, 16 nt, Artificial Sequence
  Synthetic Oligonucleotide; BTLA exon 2; Set C
auucuuucccuaaaag

SEQ ID NO: 48891 - RNA, 40 nt, Artificial Sequence
  Synthetic Oligonucleotide; BTLA exon 2; Set C
guacaucacaugauucuuucccuaaaagauaaaaacaaaa

SEQ ID NO: 48892 - RNA, 15 nt, Artificial Sequence
  Synthetic Oligonucleotide; BTLA exon 2; Set C
auucuuucccuaaaa

SEQ ID NO: 48893 - RNA, 16 nt, Artificial Sequence
  Synthetic Oligonucleotide; BTLA exon 2; Set C
gauucuuucccuaaaa

SEQ ID NO: 48894 - RNA, 32 nt, Artificial Sequence
  Synthetic Oligonucleotide; BTLA exon 2; Set C
acaucacaugauucuuucccuaaaagauaaaa

SEQ ID NO: 48895 - RNA, 31 nt, Artificial Sequence
  Synthetic Oligonucleotide; BTLA exon 2; Set C
acaucacaugauucuuucccuaaaagauaaa

SEQ ID NO: 48896 - RNA, 35 nt, Artificial Sequence
  Synthetic Oligonucleotide; BTLA exon 2; Set C
guacaucacaugauucuuucccuaaaagauaaaaa

SEQ ID NO: 48897 - RNA, 32 nt, Artificial Sequence
  Synthetic Oligonucleotide; BTLA exon 2; Set C
uacaucacaugauucuuucccuaaaagauaaa

SEQ ID NO: 48898 - RNA, 30 nt, Artificial Sequence
  Synthetic Oligonucleotide; BTLA exon 2; Set C
acaucacaugauucuuucccuaaaagauaa

SEQ ID NO: 48899 - RNA, 31 nt, Artificial Sequence
  Synthetic Oligonucleotide; BTLA exon 2; Set C
uacaucacaugauucuuucccuaaaagauaa

SEQ ID NO: 48900 - RNA, 37 nt, Artificial Sequence
  Synthetic Oligonucleotide; BTLA exon 2; Set A
cuguacaucacaugauucuuucccuaaaagauaaaaa

SEQ ID NO: 48901 - RNA, 31 nt, Artificial Sequence
  Synthetic Oligonucleotide; BTLA exon 2; Set A
guacaucacaugauucuuucccuaaaagaua

SEQ ID NO: 48902 - RNA, 30 nt, Artificial Sequence
  Synthetic Oligonucleotide; BTLA exon 2; Set A
guacaucacaugauucuuucccuaaaagau

SEQ ID NO: 48903 - RNA, 29 nt, Artificial Sequence
  Synthetic Oligonucleotide; BTLA exon 2; Set A
guacaucacaugauucuuucccuaaaaga

SEQ ID NO: 48904 - RNA, 30 nt, Artificial Sequence
  Synthetic Oligonucleotide; BTLA exon 2; Set A
uguacaucacaugauucuuucccuaaaaga

SEQ ID NO: 48905 - RNA, 28 nt, Artificial Sequence
  Synthetic Oligonucleotide; BTLA exon 2; Set C
guacaucacaugauucuuucccuaaaag

SEQ ID NO: 48906 - RNA, 29 nt, Artificial Sequence
  Synthetic Oligonucleotide; BTLA exon 2; Set C
uguacaucacaugauucuuucccuaaaag

SEQ ID NO: 48907 - RNA, 31 nt, Artificial Sequence
  Synthetic Oligonucleotide; BTLA exon 2; Set A
cuguacaucacaugauucuuucccuaaaaga

SEQ ID NO: 48908 - RNA, 27 nt, Artificial Sequence
  Synthetic Oligonucleotide; BTLA exon 2; Set C
guacaucacaugauucuuucccuaaaa

SEQ ID NO: 48909 - RNA, 28 nt, Artificial Sequence
  Synthetic Oligonucleotide; BTLA exon 2; Set C
uguacaucacaugauucuuucccuaaaa

SEQ ID NO: 48910 - RNA, 30 nt, Artificial Sequence
  Synthetic Oligonucleotide; BTLA exon 2; Set A
cuguacaucacaugauucuuucccuaaaag

SEQ ID NO: 48911 - RNA, 21 nt, Artificial Sequence
  Synthetic Oligonucleotide; BTLA exon 2; Set C
acaucacaugauucuuucccu

SEQ ID NO: 48912 - RNA, 29 nt, Artificial Sequence
  Synthetic Oligonucleotide; BTLA exon 2; Set A
cuguacaucacaugauucuuucccuaaaa

SEQ ID NO: 48913 - RNA, 22 nt, Artificial Sequence
  Synthetic Oligonucleotide; BTLA exon 2; Set C
uacaucacaugauucuuucccu

SEQ ID NO: 48914 - RNA, 40 nt, Artificial Sequence
  Synthetic Oligonucleotide; BTLA exon 2; Set A
auauaaagcuguacaucacaugauucuuucccuaaaagau

SEQ ID NO: 48915 - RNA, 39 nt, Artificial Sequence
  Synthetic Oligonucleotide; BTLA exon 2; Set A
auauaaagcuguacaucacaugauucuuucccuaaaaga

SEQ ID NO: 48916 - RNA, 38 nt, Artificial Sequence
  Synthetic Oligonucleotide; BTLA exon 2; Set A
auauaaagcuguacaucacaugauucuuucccuaaaag

SEQ ID NO: 48917 - RNA, 40 nt, Artificial Sequence
  Synthetic Oligonucleotide; BTLA exon 2; Set A
uauauaaagcuguacaucacaugauucuuucccuaaaaga

SEQ ID NO: 48918 - RNA, 37 nt, Artificial Sequence
  Synthetic Oligonucleotide; BTLA exon 2; Set A
auauaaagcuguacaucacaugauucuuucccuaaaa

SEQ ID NO: 48919 - RNA, 39 nt, Artificial Sequence
  Synthetic Oligonucleotide; BTLA exon 2; Set A
uauauaaagcuguacaucacaugauucuuucccuaaaag

SEQ ID NO: 48920 - RNA, 40 nt, Artificial Sequence
  Synthetic Oligonucleotide; BTLA exon 2; Set A
uuauauaaagcuguacaucacaugauucuuucccuaaaag

SEQ ID NO: 48921 - RNA, 38 nt, Artificial Sequence
  Synthetic Oligonucleotide; BTLA exon 2; Set A
uauauaaagcuguacaucacaugauucuuucccuaaaa

SEQ ID NO: 48922 - RNA, 39 nt, Artificial Sequence
  Synthetic Oligonucleotide; BTLA exon 2; Set A
uuauauaaagcuguacaucacaugauucuuucccuaaaa

SEQ ID NO: 48923 - RNA, 40 nt, Artificial Sequence
  Synthetic Oligonucleotide; BTLA exon 2; Set A
uuuauauaaagcuguacaucacaugauucuuucccuaaaa

SEQ ID NO: 48924 - RNA, 15 nt, Artificial Sequence
  Synthetic Oligonucleotide; BTLA exon 2; Set C
auauaaagcuguaca

SEQ ID NO: 48925 - RNA, 16 nt, Artificial Sequence
  Synthetic Oligonucleotide; BTLA exon 2; Set C
uauauaaagcuguaca

SEQ ID NO: 48926 - RNA, 15 nt, Artificial Sequence
  Synthetic Oligonucleotide; BTLA exon 2; Set C
uauauaaagcuguac

SEQ ID NO: 48927 - RNA, 19 nt, Artificial Sequence
  Synthetic Oligonucleotide; BTLA exon 2; Set C
cuuuauauaaagcuguaca

SEQ ID NO: 48928 - RNA, 18 nt, Artificial Sequence
  Synthetic Oligonucleotide; BTLA exon 2; Set C
cuuuauauaaagcuguac

SEQ ID NO: 48929 - RNA, 20 nt, Artificial Sequence
  Synthetic Oligonucleotide; BTLA exon 2; Set C
ucuuuauauaaagcuguaca

SEQ ID NO: 48930 - RNA, 19 nt, Artificial Sequence
  Synthetic Oligonucleotide; BTLA exon 2; Set C
ucuuuauauaaagcuguac

SEQ ID NO: 48931 - RNA, 21 nt, Artificial Sequence
  Synthetic Oligonucleotide; BTLA exon 2; Set C
cucuuuauauaaagcuguaca

SEQ ID NO: 48932 - RNA, 20 nt, Artificial Sequence
  Synthetic Oligonucleotide; BTLA exon 2; Set C
cucuuuauauaaagcuguac

SEQ ID NO: 48933 - RNA, 22 nt, Artificial Sequence
  Synthetic Oligonucleotide; BTLA exon 2; Set C
ucucuuuauauaaagcuguaca

SEQ ID NO: 48934 - RNA, 21 nt, Artificial Sequence
  Synthetic Oligonucleotide; BTLA exon 2; Set C
ucucuuuauauaaagcuguac

SEQ ID NO: 48935 - RNA, 15 nt, Artificial Sequence
  Synthetic Oligonucleotide; BTLA exon 2; Set C
auugucucuuuauau

SEQ ID NO: 48936 - RNA, 16 nt, Artificial Sequence
  Synthetic Oligonucleotide; BTLA exon 2; Set C
gauugucucuuuauau

SEQ ID NO: 48937 - RNA, 17 nt, Artificial Sequence
  Synthetic Oligonucleotide; BTLA exon 2; Set C
agauugucucuuuauau

SEQ ID NO: 48938 - RNA, 18 nt, Artificial Sequence
  Synthetic Oligonucleotide; BTLA exon 2; Set C
cagauugucucuuuauau

SEQ ID NO: 48939 - RNA, 20 nt, Artificial Sequence
  Synthetic Oligonucleotide; BTLA exon 2; Set C
uucagauugucucuuuauau

SEQ ID NO: 48940 - RNA, 22 nt, Artificial Sequence
  Synthetic Oligonucleotide; BTLA exon 2; Set C
guguucagauugucucuuuaua

SEQ ID NO: 48941 - RNA, 21 nt, Artificial Sequence
  Synthetic Oligonucleotide; BTLA exon 2; Set C
guguucagauugucucuuuau

SEQ ID NO: 48942 - RNA, 20 nt, Artificial Sequence
  Synthetic Oligonucleotide; BTLA exon 2; Set C
guguucagauugucucuuua

SEQ ID NO: 48943 - RNA, 19 nt, Artificial Sequence
  Synthetic Oligonucleotide; BTLA exon 2; Set C
guguucagauugucucuuu

SEQ ID NO: 48944 - RNA, 18 nt, Artificial Sequence
  Synthetic Oligonucleotide; BTLA exon 2; Set C
guguucagauugucucuu

SEQ ID NO: 48945 - RNA, 30 nt, Artificial Sequence
  Synthetic Oligonucleotide; BTLA exon 2; Set A
agauggaguguucagauugucucuuuauau

SEQ ID NO: 48946 - RNA, 15 nt, Artificial Sequence
  Synthetic Oligonucleotide; BTLA exon 2; Set C
guguucagauugucu

SEQ ID NO: 48947 - RNA, 37 nt, Artificial Sequence
  Synthetic Oligonucleotide; BTLA exon 2; Set C
uccugcuaagauggaguguucagauugucucuuuaua

SEQ ID NO: 48948 - RNA, 38 nt, Artificial Sequence
  Synthetic Oligonucleotide; BTLA exon 2; Set C
cuccugcuaagauggaguguucagauugucucuuuaua

SEQ ID NO: 48949 - RNA, 36 nt, Artificial Sequence
  Synthetic Oligonucleotide; BTLA exon 2; Set C
uccugcuaagauggaguguucagauugucucuuuau

SEQ ID NO: 48950 - RNA, 35 nt, Artificial Sequence
  Synthetic Oligonucleotide; BTLA exon 2; Set C
uccugcuaagauggaguguucagauugucucuuua

SEQ ID NO: 48951 - RNA, 37 nt, Artificial Sequence
  Synthetic Oligonucleotide; BTLA exon 2; Set C
cuccugcuaagauggaguguucagauugucucuuuau

SEQ ID NO: 48952 - RNA, 36 nt, Artificial Sequence
  Synthetic Oligonucleotide; BTLA exon 2; Set C
cuccugcuaagauggaguguucagauugucucuuua

SEQ ID NO: 48953 - RNA, 34 nt, Artificial Sequence
  Synthetic Oligonucleotide; BTLA exon 2; Set A
uccugcuaagauggaguguucagauugucucuuu

SEQ ID NO: 48954 - RNA, 35 nt, Artificial Sequence
  Synthetic Oligonucleotide; BTLA exon 2; Set C
cuccugcuaagauggaguguucagauugucucuuu

SEQ ID NO: 48955 - RNA, 33 nt, Artificial Sequence
  Synthetic Oligonucleotide; BTLA exon 2; Set A
uccugcuaagauggaguguucagauugucucuu

SEQ ID NO: 48956 - RNA, 31 nt, Artificial Sequence
  Synthetic Oligonucleotide; BTLA exon 2; Set A
ccugcuaagauggaguguucagauugucucu

SEQ ID NO: 48957 - RNA, 36 nt, Artificial Sequence
  Synthetic Oligonucleotide; BTLA exon 2; Set C
ucuccugcuaagauggaguguucagauugucucuuu

SEQ ID NO: 48958 - RNA, 34 nt, Artificial Sequence
  Synthetic Oligonucleotide; BTLA exon 2; Set C
cuccugcuaagauggaguguucagauugucucuu

SEQ ID NO: 48959 - RNA, 30 nt, Artificial Sequence
  Synthetic Oligonucleotide; BTLA exon 2; Set A
ccugcuaagauggaguguucagauugucuc

SEQ ID NO: 48960 - RNA, 35 nt, Artificial Sequence
  Synthetic Oligonucleotide; BTLA exon 2; Set C
ucuccugcuaagauggaguguucagauugucucuu

SEQ ID NO: 48961 - RNA, 40 nt, Artificial Sequence
  Synthetic Oligonucleotide; BTLA exon 2; Set C
ggaucuccugcuaagauggaguguucagauugucucuuua

SEQ ID NO: 48962 - RNA, 30 nt, Artificial Sequence
  Synthetic Oligonucleotide; BTLA exon 2; Set A
uccugcuaagauggaguguucagauugucu

SEQ ID NO: 48963 - RNA, 34 nt, Artificial Sequence
  Synthetic Oligonucleotide; BTLA exon 2; Set C
ucuccugcuaagauggaguguucagauugucucu

SEQ ID NO: 48964 - RNA, 39 nt, Artificial Sequence
  Synthetic Oligonucleotide; BTLA exon 2; Set C
ggaucuccugcuaagauggaguguucagauugucucuuu

SEQ ID NO: 48965 - RNA, 29 nt, Artificial Sequence
  Synthetic Oligonucleotide; BTLA exon 2; Set A
uccugcuaagauggaguguucagauuguc

SEQ ID NO: 48966 - RNA, 31 nt, Artificial Sequence
  Synthetic Oligonucleotide; BTLA exon 2; Set A
cuccugcuaagauggaguguucagauugucu

SEQ ID NO: 48967 - RNA, 33 nt, Artificial Sequence
  Synthetic Oligonucleotide; BTLA exon 2; Set C
ucuccugcuaagauggaguguucagauugucuc

SEQ ID NO: 48968 - RNA, 30 nt, Artificial Sequence
  Synthetic Oligonucleotide; BTLA exon 2; Set A
cuccugcuaagauggaguguucagauuguc

SEQ ID NO: 48969 - RNA, 28 nt, Artificial Sequence
  Synthetic Oligonucleotide; BTLA exon 2; Set A
uccugcuaagauggaguguucagauugu

SEQ ID NO: 48970 - RNA, 32 nt, Artificial Sequence
  Synthetic Oligonucleotide; BTLA exon 2; Set A
ucuccugcuaagauggaguguucagauugucu

SEQ ID NO: 48971 - RNA, 38 nt, Artificial Sequence
  Synthetic Oligonucleotide; BTLA exon 2; Set C
ggaucuccugcuaagauggaguguucagauugucucuu

SEQ ID NO: 48972 - RNA, 31 nt, Artificial Sequence
  Synthetic Oligonucleotide; BTLA exon 2; Set A
ucuccugcuaagauggaguguucagauuguc

SEQ ID NO: 48973 - RNA, 29 nt, Artificial Sequence
  Synthetic Oligonucleotide; BTLA exon 2; Set A
cuccugcuaagauggaguguucagauugu

SEQ ID NO: 48974 - RNA, 27 nt, Artificial Sequence
  Synthetic Oligonucleotide; BTLA exon 2; Set A
uccugcuaagauggaguguucagauug

SEQ ID NO: 48975 - RNA, 37 nt, Artificial Sequence
  Synthetic Oligonucleotide; BTLA exon 2; Set C
ggaucuccugcuaagauggaguguucagauugucucu

SEQ ID NO: 48976 - RNA, 30 nt, Artificial Sequence
  Synthetic Oligonucleotide; BTLA exon 2; Set A
ucuccugcuaagauggaguguucagauugu

SEQ ID NO: 48977 - RNA, 28 nt, Artificial Sequence
  Synthetic Oligonucleotide; BTLA exon 2; Set A
cuccugcuaagauggaguguucagauug

SEQ ID NO: 48978 - RNA, 26 nt, Artificial Sequence
  Synthetic Oligonucleotide; BTLA exon 2; Set A
uccugcuaagauggaguguucagauu

SEQ ID NO: 48979 - RNA, 36 nt, Artificial Sequence
  Synthetic Oligonucleotide; BTLA exon 2; Set C
ggaucuccugcuaagauggaguguucagauugucuc

SEQ ID NO: 48980 - RNA, 29 nt, Artificial Sequence
  Synthetic Oligonucleotide; BTLA exon 2; Set A
ucuccugcuaagauggaguguucagauug

SEQ ID NO: 48981 - RNA, 25 nt, Artificial Sequence
  Synthetic Oligonucleotide; BTLA exon 2; Set A
uccugcuaagauggaguguucagau

SEQ ID NO: 48982 - RNA, 27 nt, Artificial Sequence
  Synthetic Oligonucleotide; BTLA exon 2; Set A
cuccugcuaagauggaguguucagauu

SEQ ID NO: 48983 - RNA, 35 nt, Artificial Sequence
  Synthetic Oligonucleotide; BTLA exon 2; Set C
ggaucuccugcuaagauggaguguucagauugucu

SEQ ID NO: 48984 - RNA, 34 nt, Artificial Sequence
  Synthetic Oligonucleotide; BTLA exon 2; Set C
ggaucuccugcuaagauggaguguucagauuguc

SEQ ID NO: 48985 - RNA, 26 nt, Artificial Sequence
  Synthetic Oligonucleotide; BTLA exon 2; Set A
cuccugcuaagauggaguguucagau

SEQ ID NO: 48986 - RNA, 24 nt, Artificial Sequence
  Synthetic Oligonucleotide; BTLA exon 2; Set A
uccugcuaagauggaguguucaga

SEQ ID NO: 48987 - RNA, 28 nt, Artificial Sequence
  Synthetic Oligonucleotide; BTLA exon 2; Set A
ucuccugcuaagauggaguguucagauu

SEQ ID NO: 48988 - RNA, 33 nt, Artificial Sequence
  Synthetic Oligonucleotide; BTLA exon 2; Set C
ggaucuccugcuaagauggaguguucagauugu

SEQ ID NO: 48989 - RNA, 27 nt, Artificial Sequence
  Synthetic Oligonucleotide; BTLA exon 2; Set A
ucuccugcuaagauggaguguucagau

SEQ ID NO: 48990 - RNA, 25 nt, Artificial Sequence
  Synthetic Oligonucleotide; BTLA exon 2; Set A
cuccugcuaagauggaguguucaga

SEQ ID NO: 48991 - RNA, 23 nt, Artificial Sequence
  Synthetic Oligonucleotide; BTLA exon 2; Set A
uccugcuaagauggaguguucag

SEQ ID NO: 48992 - RNA, 21 nt, Artificial Sequence
  Synthetic Oligonucleotide; BTLA exon 2; Set C
ccugcuaagauggaguguuca

SEQ ID NO: 48993 - RNA, 32 nt, Artificial Sequence
  Synthetic Oligonucleotide; BTLA exon 2; Set A
ggaucuccugcuaagauggaguguucagauug

SEQ ID NO: 48994 - RNA, 26 nt, Artificial Sequence
  Synthetic Oligonucleotide; BTLA exon 2; Set A
ucuccugcuaagauggaguguucaga

SEQ ID NO: 48995 - RNA, 24 nt, Artificial Sequence
  Synthetic Oligonucleotide; BTLA exon 2; Set A
cuccugcuaagauggaguguucag

SEQ ID NO: 48996 - RNA, 20 nt, Artificial Sequence
  Synthetic Oligonucleotide; BTLA exon 2; Set C
ccugcuaagauggaguguuc

SEQ ID NO: 48997 - RNA, 18 nt, Artificial Sequence
  Synthetic Oligonucleotide; BTLA exon 2; Set C
cugcuaagauggaguguu

SEQ ID NO: 48998 - RNA, 25 nt, Artificial Sequence
  Synthetic Oligonucleotide; BTLA exon 2; Set A
ucuccugcuaagauggaguguucag

SEQ ID NO: 48999 - RNA, 31 nt, Artificial Sequence
  Synthetic Oligonucleotide; BTLA exon 2; Set A
ggaucuccugcuaagauggaguguucagauu

SEQ ID NO: 49000 - RNA, 17 nt, Artificial Sequence
  Synthetic Oligonucleotide; BTLA exon 2; Set C
cugcuaagauggagugu

SEQ ID NO: 49001 - RNA, 19 nt, Artificial Sequence
  Synthetic Oligonucleotide; BTLA exon 2; Set C
ccugcuaagauggaguguu

SEQ ID NO: 49002 - RNA, 30 nt, Artificial Sequence
  Synthetic Oligonucleotide; BTLA exon 2; Set A
ggaucuccugcuaagauggaguguucagau

SEQ ID NO: 49003 - RNA, 24 nt, Artificial Sequence
  Synthetic Oligonucleotide; BTLA exon 2; Set A
ucuccugcuaagauggaguguuca

SEQ ID NO: 49004 - RNA, 18 nt, Artificial Sequence
  Synthetic Oligonucleotide; BTLA exon 2; Set C
ccugcuaagauggagugu

SEQ ID NO: 49005 - RNA, 39 nt, Artificial Sequence
  Synthetic Oligonucleotide; BTLA exon 2; Set C
caaagggaucuccugcuaagauggaguguucagauuguc

SEQ ID NO: 49006 - RNA, 29 nt, Artificial Sequence
  Synthetic Oligonucleotide; BTLA exon 2; Set A
ggaucuccugcuaagauggaguguucaga

SEQ ID NO: 49007 - RNA, 23 nt, Artificial Sequence
  Synthetic Oligonucleotide; BTLA exon 2; Set A
ucuccugcuaagauggaguguuc

SEQ ID NO: 49008 - RNA, 40 nt, Artificial Sequence
  Synthetic Oligonucleotide; BTLA exon 2; Set C
ucaaagggaucuccugcuaagauggaguguucagauuguc

SEQ ID NO: 49009 - RNA, 38 nt, Artificial Sequence
  Synthetic Oligonucleotide; BTLA exon 2; Set C
caaagggaucuccugcuaagauggaguguucagauugu

SEQ ID NO: 49010 - RNA, 28 nt, Artificial Sequence
  Synthetic Oligonucleotide; BTLA exon 2; Set A
ggaucuccugcuaagauggaguguucag

SEQ ID NO: 49011 - RNA, 22 nt, Artificial Sequence
  Synthetic Oligonucleotide; BTLA exon 2; Set A
ucuccugcuaagauggaguguu

SEQ ID NO: 49012 - RNA, 39 nt, Artificial Sequence
  Synthetic Oligonucleotide; BTLA exon 2; Set C
ucaaagggaucuccugcuaagauggaguguucagauugu

SEQ ID NO: 49013 - RNA, 37 nt, Artificial Sequence
  Synthetic Oligonucleotide; BTLA exon 2; Set C
caaagggaucuccugcuaagauggaguguucagauug

SEQ ID NO: 49014 - RNA, 27 nt, Artificial Sequence
  Synthetic Oligonucleotide; BTLA exon 2; Set A
ggaucuccugcuaagauggaguguuca

SEQ ID NO: 49015 - RNA, 21 nt, Artificial Sequence
  Synthetic Oligonucleotide; BTLA exon 2; Set C
ucuccugcuaagauggagugu

SEQ ID NO: 49016 - RNA, 40 nt, Artificial Sequence
  Synthetic Oligonucleotide; BTLA exon 2; Set C
uucaaagggaucuccugcuaagauggaguguucagauugu

SEQ ID NO: 49017 - RNA, 38 nt, Artificial Sequence
  Synthetic Oligonucleotide; BTLA exon 2; Set C
ucaaagggaucuccugcuaagauggaguguucagauug

SEQ ID NO: 49018 - RNA, 36 nt, Artificial Sequence
  Synthetic Oligonucleotide; BTLA exon 2; Set C
caaagggaucuccugcuaagauggaguguucagauu

SEQ ID NO: 49019 - RNA, 26 nt, Artificial Sequence
  Synthetic Oligonucleotide; BTLA exon 2; Set A
ggaucuccugcuaagauggaguguuc

SEQ ID NO: 49020 - RNA, 39 nt, Artificial Sequence
  Synthetic Oligonucleotide; BTLA exon 2; Set C
uucaaagggaucuccugcuaagauggaguguucagauug

SEQ ID NO: 49021 - RNA, 35 nt, Artificial Sequence
  Synthetic Oligonucleotide; BTLA exon 2; Set C
caaagggaucuccugcuaagauggaguguucagau

SEQ ID NO: 49022 - RNA, 37 nt, Artificial Sequence
  Synthetic Oligonucleotide; BTLA exon 2; Set C
ucaaagggaucuccugcuaagauggaguguucagauu

SEQ ID NO: 49023 - RNA, 36 nt, Artificial Sequence
  Synthetic Oligonucleotide; BTLA exon 2; Set C
ucaaagggaucuccugcuaagauggaguguucagau

SEQ ID NO: 49024 - RNA, 34 nt, Artificial Sequence
  Synthetic Oligonucleotide; BTLA exon 2; Set C
caaagggaucuccugcuaagauggaguguucaga

SEQ ID NO: 49025 - RNA, 38 nt, Artificial Sequence
  Synthetic Oligonucleotide; BTLA exon 2; Set C
uucaaagggaucuccugcuaagauggaguguucagauu

SEQ ID NO: 49026 - RNA, 37 nt, Artificial Sequence
  Synthetic Oligonucleotide; BTLA exon 2; Set C
uucaaagggaucuccugcuaagauggaguguucagau

SEQ ID NO: 49027 - RNA, 35 nt, Artificial Sequence
  Synthetic Oligonucleotide; BTLA exon 2; Set C
ucaaagggaucuccugcuaagauggaguguucaga

SEQ ID NO: 49028 - RNA, 33 nt, Artificial Sequence
  Synthetic Oligonucleotide; BTLA exon 2; Set A
caaagggaucuccugcuaagauggaguguucag

SEQ ID NO: 49029 - RNA, 36 nt, Artificial Sequence
  Synthetic Oligonucleotide; BTLA exon 2; Set C
uucaaagggaucuccugcuaagauggaguguucaga

SEQ ID NO: 49030 - RNA, 34 nt, Artificial Sequence
  Synthetic Oligonucleotide; BTLA exon 2; Set A
ucaaagggaucuccugcuaagauggaguguucag

SEQ ID NO: 49031 - RNA, 35 nt, Artificial Sequence
  Synthetic Oligonucleotide; BTLA exon 2; Set A
uucaaagggaucuccugcuaagauggaguguucag

SEQ ID NO: 49032 - RNA, 17 nt, Artificial Sequence
  Synthetic Oligonucleotide; BTLA exon 2; Set C
ggaucuccugcuaagau

SEQ ID NO: 49033 - RNA, 16 nt, Artificial Sequence
  Synthetic Oligonucleotide; BTLA exon 2; Set C
ggaucuccugcuaaga

SEQ ID NO: 49034 - RNA, 15 nt, Artificial Sequence
  Synthetic Oligonucleotide; BTLA exon 2; Set C
ggaucuccugcuaag

SEQ ID NO: 49035 - RNA, 21 nt, Artificial Sequence
  Synthetic Oligonucleotide; BTLA exon 2; Set C
caaagggaucuccugcuaaga

SEQ ID NO: 49036 - RNA, 23 nt, Artificial Sequence
  Synthetic Oligonucleotide; BTLA exon 2; Set C
ucaaagggaucuccugcuaagau

SEQ ID NO: 49037 - RNA, 22 nt, Artificial Sequence
  Synthetic Oligonucleotide; BTLA exon 2; Set C
ucaaagggaucuccugcuaaga

SEQ ID NO: 49038 - RNA, 24 nt, Artificial Sequence
  Synthetic Oligonucleotide; BTLA exon 2; Set C
uucaaagggaucuccugcuaagau

SEQ ID NO: 49039 - RNA, 23 nt, Artificial Sequence
  Synthetic Oligonucleotide; BTLA exon 2; Set C
uucaaagggaucuccugcuaaga

SEQ ID NO: 49040 - RNA, 17 nt, Artificial Sequence
  Synthetic Oligonucleotide; BTLA exon 2; Set C
caaagggaucuccugcu

SEQ ID NO: 49041 - RNA, 18 nt, Artificial Sequence
  Synthetic Oligonucleotide; BTLA exon 2; Set C
ucaaagggaucuccugcu

SEQ ID NO: 49042 - RNA, 16 nt, Artificial Sequence
  Synthetic Oligonucleotide; BTLA exon 2; Set C
caaagggaucuccugc

SEQ ID NO: 49043 - RNA, 19 nt, Artificial Sequence
  Synthetic Oligonucleotide; BTLA exon 2; Set C
uucaaagggaucuccugcu

SEQ ID NO: 49044 - RNA, 17 nt, Artificial Sequence
  Synthetic Oligonucleotide; BTLA exon 2; Set C
ucaaagggaucuccugc

SEQ ID NO: 49045 - RNA, 18 nt, Artificial Sequence
  Synthetic Oligonucleotide; BTLA exon 2; Set C
uucaaagggaucuccugc

SEQ ID NO: 49046 - RNA, 29 nt, Artificial Sequence
  Synthetic Oligonucleotide; BTLA exon 2; Set A
uucuaguucaaagggaucuccugcuaaga

SEQ ID NO: 49047 - RNA, 16 nt, Artificial Sequence
  Synthetic Oligonucleotide; BTLA exon 2; Set C
guucaaagggaucucc

SEQ ID NO: 49048 - RNA, 15 nt, Artificial Sequence
  Synthetic Oligonucleotide; BTLA exon 2; Set C
guucaaagggaucuc

SEQ ID NO: 49049 - RNA, 17 nt, Artificial Sequence
  Synthetic Oligonucleotide; BTLA exon 2; Set C
aguucaaagggaucucc

SEQ ID NO: 49050 - RNA, 16 nt, Artificial Sequence
  Synthetic Oligonucleotide; BTLA exon 2; Set C
aguucaaagggaucuc

SEQ ID NO: 49051 - RNA, 18 nt, Artificial Sequence
  Synthetic Oligonucleotide; BTLA exon 2; Set C
uaguucaaagggaucucc

SEQ ID NO: 49052 - RNA, 15 nt, Artificial Sequence
  Synthetic Oligonucleotide; BTLA exon 2; Set C
aguucaaagggaucu

SEQ ID NO: 49053 - RNA, 17 nt, Artificial Sequence
  Synthetic Oligonucleotide; BTLA exon 2; Set C
uaguucaaagggaucuc

SEQ ID NO: 49054 - RNA, 19 nt, Artificial Sequence
  Synthetic Oligonucleotide; BTLA exon 2; Set C
cuaguucaaagggaucucc

SEQ ID NO: 49055 - RNA, 16 nt, Artificial Sequence
  Synthetic Oligonucleotide; BTLA exon 2; Set C
uaguucaaagggaucu

SEQ ID NO: 49056 - RNA, 18 nt, Artificial Sequence
  Synthetic Oligonucleotide; BTLA exon 2; Set C
cuaguucaaagggaucuc

SEQ ID NO: 49057 - RNA, 20 nt, Artificial Sequence
  Synthetic Oligonucleotide; BTLA exon 2; Set C
ucuaguucaaagggaucucc

SEQ ID NO: 49058 - RNA, 17 nt, Artificial Sequence
  Synthetic Oligonucleotide; BTLA exon 2; Set C
cuaguucaaagggaucu

SEQ ID NO: 49059 - RNA, 19 nt, Artificial Sequence
  Synthetic Oligonucleotide; BTLA exon 2; Set C
ucuaguucaaagggaucuc

SEQ ID NO: 49060 - RNA, 18 nt, Artificial Sequence
  Synthetic Oligonucleotide; BTLA exon 2; Set C
ucuaguucaaagggaucu

SEQ ID NO: 49061 - RNA, 15 nt, Artificial Sequence
  Synthetic Oligonucleotide; BTLA exon 2; Set C
ucuaguucaaaggga

SEQ ID NO: 49062 - RNA, 35 nt, Artificial Sequence
  Synthetic Oligonucleotide; BTLA exon 2; Set C
auuucacagggcauucuaguucaaagggaucuccu

SEQ ID NO: 49063 - RNA, 36 nt, Artificial Sequence
  Synthetic Oligonucleotide; BTLA exon 2; Set C
uauuucacagggcauucuaguucaaagggaucuccu

SEQ ID NO: 49064 - RNA, 37 nt, Artificial Sequence
  Synthetic Oligonucleotide; BTLA exon 2; Set C
guauuucacagggcauucuaguucaaagggaucuccu

SEQ ID NO: 49065 - RNA, 40 nt, Artificial Sequence
  Synthetic Oligonucleotide; BTLA exon 2; Set C
caguauuucacagggcauucuaguucaaagggaucuccug

SEQ ID NO: 49066 - RNA, 38 nt, Artificial Sequence
  Synthetic Oligonucleotide; BTLA exon 2; Set C
aguauuucacagggcauucuaguucaaagggaucuccu

SEQ ID NO: 49067 - RNA, 32 nt, Artificial Sequence
  Synthetic Oligonucleotide; BTLA exon 2; Set A
auuucacagggcauucuaguucaaagggaucu

SEQ ID NO: 49068 - RNA, 33 nt, Artificial Sequence
  Synthetic Oligonucleotide; BTLA exon 2; Set A
uauuucacagggcauucuaguucaaagggaucu

SEQ ID NO: 49069 - RNA, 34 nt, Artificial Sequence
  Synthetic Oligonucleotide; BTLA exon 2; Set C
guauuucacagggcauucuaguucaaagggaucu

SEQ ID NO: 49070 - RNA, 35 nt, Artificial Sequence
  Synthetic Oligonucleotide; BTLA exon 2; Set C
aguauuucacagggcauucuaguucaaagggaucu

SEQ ID NO: 49071 - RNA, 35 nt, Artificial Sequence
  Synthetic Oligonucleotide; BTLA exon 2; Set C
caguauuucacagggcauucuaguucaaagggauc

SEQ ID NO: 49072 - RNA, 36 nt, Artificial Sequence
  Synthetic Oligonucleotide; BTLA exon 2; Set C
acaguauuucacagggcauucuaguucaaagggauc

SEQ ID NO: 49073 - RNA, 40 nt, Artificial Sequence
  Synthetic Oligonucleotide; BTLA exon 2; Set C
agcacaguauuucacagggcauucuaguucaaagggaucu

SEQ ID NO: 49074 - RNA, 37 nt, Artificial Sequence
  Synthetic Oligonucleotide; BTLA exon 2; Set C
agcacaguauuucacagggcauucuaguucaaaggga

SEQ ID NO: 49075 - RNA, 38 nt, Artificial Sequence
  Synthetic Oligonucleotide; BTLA exon 2; Set C
uagcacaguauuucacagggcauucuaguucaaaggga

SEQ ID NO: 49076 - RNA, 39 nt, Artificial Sequence
  Synthetic Oligonucleotide; BTLA exon 2; Set C
uuagcacaguauuucacagggcauucuaguucaaaggga

SEQ ID NO: 49077 - RNA, 40 nt, Artificial Sequence
  Synthetic Oligonucleotide; BTLA exon 2; Set C
guuagcacaguauuucacagggcauucuaguucaaaggga

SEQ ID NO: 49078 - RNA, 32 nt, Artificial Sequence
  Synthetic Oligonucleotide; BTLA exon 2; Set C
agcacaguauuucacagggcauucuaguucaa

SEQ ID NO: 49079 - RNA, 31 nt, Artificial Sequence
  Synthetic Oligonucleotide; BTLA exon 2; Set C
agcacaguauuucacagggcauucuaguuca

SEQ ID NO: 49080 - RNA, 33 nt, Artificial Sequence
  Synthetic Oligonucleotide; BTLA exon 2; Set C
uagcacaguauuucacagggcauucuaguucaa

SEQ ID NO: 49081 - RNA, 22 nt, Artificial Sequence
  Synthetic Oligonucleotide; BTLA exon 2; Set C
caguauuucacagggcauucua

SEQ ID NO: 49082 - RNA, 30 nt, Artificial Sequence
  Synthetic Oligonucleotide; BTLA exon 2; Set C
agcacaguauuucacagggcauucuaguuc

SEQ ID NO: 49083 - RNA, 32 nt, Artificial Sequence
  Synthetic Oligonucleotide; BTLA exon 2; Set C
uagcacaguauuucacagggcauucuaguuca

SEQ ID NO: 49084 - RNA, 21 nt, Artificial Sequence
  Synthetic Oligonucleotide; BTLA exon 2; Set C
caguauuucacagggcauucu

SEQ ID NO: 49085 - RNA, 23 nt, Artificial Sequence
  Synthetic Oligonucleotide; BTLA exon 2; Set A
acaguauuucacagggcauucua

SEQ ID NO: 49086 - RNA, 31 nt, Artificial Sequence
  Synthetic Oligonucleotide; BTLA exon 2; Set C
uagcacaguauuucacagggcauucuaguuc

SEQ ID NO: 49087 - RNA, 33 nt, Artificial Sequence
  Synthetic Oligonucleotide; BTLA exon 2; Set C
uuagcacaguauuucacagggcauucuaguuca

SEQ ID NO: 49088 - RNA, 22 nt, Artificial Sequence
  Synthetic Oligonucleotide; BTLA exon 2; Set A
acaguauuucacagggcauucu

SEQ ID NO: 49089 - RNA, 32 nt, Artificial Sequence
  Synthetic Oligonucleotide; BTLA exon 2; Set C
uuagcacaguauuucacagggcauucuaguuc

SEQ ID NO: 49090 - RNA, 34 nt, Artificial Sequence
  Synthetic Oligonucleotide; BTLA exon 2; Set C
guuagcacaguauuucacagggcauucuaguuca

SEQ ID NO: 49091 - RNA, 33 nt, Artificial Sequence
  Synthetic Oligonucleotide; BTLA exon 2; Set C
guuagcacaguauuucacagggcauucuaguuc

SEQ ID NO: 49092 - RNA, 33 nt, Artificial Sequence
  Synthetic Oligonucleotide; BTLA exon 2; Set C
uguuagcacaguauuucacagggcauucuaguu

SEQ ID NO: 49093 - RNA, 32 nt, Artificial Sequence
  Synthetic Oligonucleotide; BTLA exon 2; Set C
uguuagcacaguauuucacagggcauucuagu

SEQ ID NO: 49094 - RNA, 31 nt, Artificial Sequence
  Synthetic Oligonucleotide; BTLA exon 2; Set A
uguuagcacaguauuucacagggcauucuag

SEQ ID NO: 49095 - RNA, 30 nt, Artificial Sequence
  Synthetic Oligonucleotide; BTLA exon 2; Set C
uguuagcacaguauuucacagggcauucua

SEQ ID NO: 49096 - RNA, 29 nt, Artificial Sequence
  Synthetic Oligonucleotide; BTLA exon 2; Set C
uguuagcacaguauuucacagggcauucu

SEQ ID NO: 49097 - RNA, 15 nt, Artificial Sequence
  Synthetic Oligonucleotide; BTLA exon 2; Set C
guuagcacaguauuu

SEQ ID NO: 49098 - RNA, 19 nt, Artificial Sequence
  Synthetic Oligonucleotide; BTLA exon 2; Set C
ggccuguuagcacaguauu

SEQ ID NO: 49099 - RNA, 18 nt, Artificial Sequence
  Synthetic Oligonucleotide; BTLA exon 2; Set C
ggccuguuagcacaguau

SEQ ID NO: 49100 - RNA, 17 nt, Artificial Sequence
  Synthetic Oligonucleotide; BTLA exon 2; Set C
ggccuguuagcacagua

SEQ ID NO: 49101 - RNA, 16 nt, Artificial Sequence
  Synthetic Oligonucleotide; BTLA exon 2; Set C
ggccuguuagcacagu

SEQ ID NO: 49102 - RNA, 24 nt, Artificial Sequence
  Synthetic Oligonucleotide; BTLA exon 2; Set A
gucacaugaggccuguuagcacag

SEQ ID NO: 49103 - RNA, 25 nt, Artificial Sequence
  Synthetic Oligonucleotide; BTLA exon 2; Set A
agucacaugaggccuguuagcacag

SEQ ID NO: 49104 - RNA, 23 nt, Artificial Sequence
  Synthetic Oligonucleotide; BTLA exon 2; Set A
gucacaugaggccuguuagcaca

SEQ ID NO: 49105 - RNA, 21 nt, Artificial Sequence
  Synthetic Oligonucleotide; BTLA exon 2; Set A
ucacaugaggccuguuagcac

SEQ ID NO: 49106 - RNA, 34 nt, Artificial Sequence
  Synthetic Oligonucleotide; BTLA exon 2; Set C
caccaagucacaugaggccuguuagcacaguauu

SEQ ID NO: 49107 - RNA, 26 nt, Artificial Sequence
  Synthetic Oligonucleotide; BTLA exon 2; Set A
aagucacaugaggccuguuagcacag

SEQ ID NO: 49108 - RNA, 24 nt, Artificial Sequence
  Synthetic Oligonucleotide; BTLA exon 2; Set A
agucacaugaggccuguuagcaca

SEQ ID NO: 49109 - RNA, 22 nt, Artificial Sequence
  Synthetic Oligonucleotide; BTLA exon 2; Set A
gucacaugaggccuguuagcac

SEQ ID NO: 49110 - RNA, 33 nt, Artificial Sequence
  Synthetic Oligonucleotide; BTLA exon 2; Set C
caccaagucacaugaggccuguuagcacaguau

SEQ ID NO: 49111 - RNA, 21 nt, Artificial Sequence
  Synthetic Oligonucleotide; BTLA exon 2; Set A
gucacaugaggccuguuagca

SEQ ID NO: 49112 - RNA, 25 nt, Artificial Sequence
  Synthetic Oligonucleotide; BTLA exon 2; Set A
aagucacaugaggccuguuagcaca

SEQ ID NO: 49113 - RNA, 23 nt, Artificial Sequence
  Synthetic Oligonucleotide; BTLA exon 2; Set A
agucacaugaggccuguuagcac

SEQ ID NO: 49114 - RNA, 32 nt, Artificial Sequence
  Synthetic Oligonucleotide; BTLA exon 2; Set C
caccaagucacaugaggccuguuagcacagua

SEQ ID NO: 49115 - RNA, 22 nt, Artificial Sequence
  Synthetic Oligonucleotide; BTLA exon 2; Set A
agucacaugaggccuguuagca

SEQ ID NO: 49116 - RNA, 24 nt, Artificial Sequence
  Synthetic Oligonucleotide; BTLA exon 2; Set A
aagucacaugaggccuguuagcac

SEQ ID NO: 49117 - RNA, 31 nt, Artificial Sequence
  Synthetic Oligonucleotide; BTLA exon 2; Set C
caccaagucacaugaggccuguuagcacagu

SEQ ID NO: 49118 - RNA, 23 nt, Artificial Sequence
  Synthetic Oligonucleotide; BTLA exon 2; Set A
aagucacaugaggccuguuagca

SEQ ID NO: 49119 - RNA, 19 nt, Artificial Sequence
  Synthetic Oligonucleotide; BTLA exon 2; Set C
agucacaugaggccuguua

SEQ ID NO: 49120 - RNA, 18 nt, Artificial Sequence
  Synthetic Oligonucleotide; BTLA exon 2; Set C
agucacaugaggccuguu

SEQ ID NO: 49121 - RNA, 26 nt, Artificial Sequence
  Synthetic Oligonucleotide; BTLA exon 2; Set C
caccaagucacaugaggccuguuagc

SEQ ID NO: 49122 - RNA, 32 nt, Artificial Sequence
  Synthetic Oligonucleotide; BTLA exon 2; Set C
uugcaccaagucacaugaggccuguuagcaca

SEQ ID NO: 49123 - RNA, 31 nt, Artificial Sequence
  Synthetic Oligonucleotide; BTLA exon 2; Set C
uugcaccaagucacaugaggccuguuagcac

SEQ ID NO: 49124 - RNA, 37 nt, Artificial Sequence
  Synthetic Oligonucleotide; BTLA exon 2; Set C
gagcuugcaccaagucacaugaggccuguuagcacag

SEQ ID NO: 49125 - RNA, 36 nt, Artificial Sequence
  Synthetic Oligonucleotide; BTLA exon 2; Set C
gagcuugcaccaagucacaugaggccuguuagcaca

SEQ ID NO: 49126 - RNA, 35 nt, Artificial Sequence
  Synthetic Oligonucleotide; BTLA exon 2; Set C
gagcuugcaccaagucacaugaggccuguuagcac

SEQ ID NO: 49127 - RNA, 34 nt, Artificial Sequence
  Synthetic Oligonucleotide; BTLA exon 2; Set C
gagcuugcaccaagucacaugaggccuguuagca

SEQ ID NO: 49128 - RNA, 30 nt, Artificial Sequence
  Synthetic Oligonucleotide; BTLA exon 2; Set C
ugagcuugcaccaagucacaugaggccugu

SEQ ID NO: 49129 - RNA, 31 nt, Artificial Sequence
  Synthetic Oligonucleotide; BTLA exon 2; Set C
uugagcuugcaccaagucacaugaggccugu

SEQ ID NO: 49130 - RNA, 26 nt, Artificial Sequence
  Synthetic Oligonucleotide; BTLA exon 2; Set C
ugagcuugcaccaagucacaugaggc

SEQ ID NO: 49131 - RNA, 17 nt, Artificial Sequence
  Synthetic Oligonucleotide; BTLA exon 2; Set C
cuugcaccaagucacau

SEQ ID NO: 49132 - RNA, 40 nt, Artificial Sequence
  Synthetic Oligonucleotide; BTLA exon 2; Set C
guuguuccauugagcuugcaccaagucacaugaggccugu

SEQ ID NO: 49133 - RNA, 17 nt, Artificial Sequence
  Synthetic Oligonucleotide; BTLA exon 2; Set C
gagcuugcaccaaguca

SEQ ID NO: 49134 - RNA, 16 nt, Artificial Sequence
  Synthetic Oligonucleotide; BTLA exon 2; Set C
gagcuugcaccaaguc

SEQ ID NO: 49135 - RNA, 36 nt, Artificial Sequence
  Synthetic Oligonucleotide; BTLA exon 2; Set C
guuguuccauugagcuugcaccaagucacaugaggc

SEQ ID NO: 49136 - RNA, 17 nt, Artificial Sequence
  Synthetic Oligonucleotide; BTLA exon 2; Set C
uugagcuugcaccaagu

SEQ ID NO: 49137 - RNA, 33 nt, Artificial Sequence
  Synthetic Oligonucleotide; BTLA exon 2; Set C
uguuguuccauugagcuugcaccaagucacaug

SEQ ID NO: 49138 - RNA, 32 nt, Artificial Sequence
  Synthetic Oligonucleotide; BTLA exon 2; Set C
uguuguuccauugagcuugcaccaagucacau

SEQ ID NO: 49139 - RNA, 24 nt, Artificial Sequence
  Synthetic Oligonucleotide; BTLA exon 2; Set A
guuccauugagcuugcaccaaguc

SEQ ID NO: 49140 - RNA, 22 nt, Artificial Sequence
  Synthetic Oligonucleotide; BTLA exon 2; Set A
uuccauugagcuugcaccaagu

SEQ ID NO: 49141 - RNA, 31 nt, Artificial Sequence
  Synthetic Oligonucleotide; BTLA exon 2; Set C
uguuguuccauugagcuugcaccaagucaca

SEQ ID NO: 49142 - RNA, 25 nt, Artificial Sequence
  Synthetic Oligonucleotide; BTLA exon 2; Set A
uguuccauugagcuugcaccaaguc

SEQ ID NO: 49143 - RNA, 21 nt, Artificial Sequence
  Synthetic Oligonucleotide; BTLA exon 2; Set C
uuccauugagcuugcaccaag

SEQ ID NO: 49144 - RNA, 23 nt, Artificial Sequence
  Synthetic Oligonucleotide; BTLA exon 2; Set A
guuccauugagcuugcaccaagu

SEQ ID NO: 49145 - RNA, 30 nt, Artificial Sequence
  Synthetic Oligonucleotide; BTLA exon 2; Set C
uguuguuccauugagcuugcaccaagucac

SEQ ID NO: 49146 - RNA, 22 nt, Artificial Sequence
  Synthetic Oligonucleotide; BTLA exon 2; Set A
guuccauugagcuugcaccaag

SEQ ID NO: 49147 - RNA, 24 nt, Artificial Sequence
  Synthetic Oligonucleotide; BTLA exon 2; Set A
uguuccauugagcuugcaccaagu

SEQ ID NO: 49148 - RNA, 37 nt, Artificial Sequence
  Synthetic Oligonucleotide; BTLA exon 2; Set C
cacauguuguuccauugagcuugcaccaagucacaug

SEQ ID NO: 49149 - RNA, 23 nt, Artificial Sequence
  Synthetic Oligonucleotide; BTLA exon 2; Set A
uguuccauugagcuugcaccaag

SEQ ID NO: 49150 - RNA, 25 nt, Artificial Sequence
  Synthetic Oligonucleotide; BTLA exon 2; Set A
uuguuccauugagcuugcaccaagu

SEQ ID NO: 49151 - RNA, 36 nt, Artificial Sequence
  Synthetic Oligonucleotide; BTLA exon 2; Set C
cacauguuguuccauugagcuugcaccaagucacau

SEQ ID NO: 49152 - RNA, 38 nt, Artificial Sequence
  Synthetic Oligonucleotide; BTLA exon 2; Set C
acacauguuguuccauugagcuugcaccaagucacaug

SEQ ID NO: 49153 - RNA, 24 nt, Artificial Sequence
  Synthetic Oligonucleotide; BTLA exon 2; Set A
uuguuccauugagcuugcaccaag

SEQ ID NO: 49154 - RNA, 37 nt, Artificial Sequence
  Synthetic Oligonucleotide; BTLA exon 2; Set C
acacauguuguuccauugagcuugcaccaagucacau

SEQ ID NO: 49155 - RNA, 35 nt, Artificial Sequence
  Synthetic Oligonucleotide; BTLA exon 2; Set C
cacauguuguuccauugagcuugcaccaagucaca

SEQ ID NO: 49156 - RNA, 39 nt, Artificial Sequence
  Synthetic Oligonucleotide; BTLA exon 2; Set C
uacacauguuguuccauugagcuugcaccaagucacaug

SEQ ID NO: 49157 - RNA, 38 nt, Artificial Sequence
  Synthetic Oligonucleotide; BTLA exon 2; Set C
uacacauguuguuccauugagcuugcaccaagucacau

SEQ ID NO: 49158 - RNA, 34 nt, Artificial Sequence
  Synthetic Oligonucleotide; BTLA exon 2; Set C
cacauguuguuccauugagcuugcaccaagucac

SEQ ID NO: 49159 - RNA, 36 nt, Artificial Sequence
  Synthetic Oligonucleotide; BTLA exon 2; Set C
acacauguuguuccauugagcuugcaccaagucaca

SEQ ID NO: 49160 - RNA, 35 nt, Artificial Sequence
  Synthetic Oligonucleotide; BTLA exon 2; Set C
acacauguuguuccauugagcuugcaccaagucac

SEQ ID NO: 49161 - RNA, 37 nt, Artificial Sequence
  Synthetic Oligonucleotide; BTLA exon 2; Set C
uacacauguuguuccauugagcuugcaccaagucaca

SEQ ID NO: 49162 - RNA, 36 nt, Artificial Sequence
  Synthetic Oligonucleotide; BTLA exon 2; Set C
uacacauguuguuccauugagcuugcaccaagucac

SEQ ID NO: 49163 - RNA, 21 nt, Artificial Sequence
  Synthetic Oligonucleotide; BTLA exon 2; Set A
guuguuccauugagcuugcac

SEQ ID NO: 49164 - RNA, 26 nt, Artificial Sequence
  Synthetic Oligonucleotide; BTLA exon 2; Set A
acacauguuguuccauugagcuugca

SEQ ID NO: 49165 - RNA, 27 nt, Artificial Sequence
  Synthetic Oligonucleotide; BTLA exon 2; Set A
uacacauguuguuccauugagcuugca

SEQ ID NO: 49166 - RNA, 25 nt, Artificial Sequence
  Synthetic Oligonucleotide; BTLA exon 2; Set A
acacauguuguuccauugagcuugc

SEQ ID NO: 49167 - RNA, 29 nt, Artificial Sequence
  Synthetic Oligonucleotide; BTLA exon 2; Set A
uuacacauguuguuccauugagcuugcac

SEQ ID NO: 49168 - RNA, 26 nt, Artificial Sequence
  Synthetic Oligonucleotide; BTLA exon 2; Set A
uacacauguuguuccauugagcuugc

SEQ ID NO: 49169 - RNA, 30 nt, Artificial Sequence
  Synthetic Oligonucleotide; BTLA exon 2; Set A
uuuacacauguuguuccauugagcuugcac

SEQ ID NO: 49170 - RNA, 18 nt, Artificial Sequence
  Synthetic Oligonucleotide; BTLA exon 2; Set C
cacauguuguuccauuga

SEQ ID NO: 49171 - RNA, 19 nt, Artificial Sequence
  Synthetic Oligonucleotide; BTLA exon 2; Set C
acacauguuguuccauuga

SEQ ID NO: 49172 - RNA, 20 nt, Artificial Sequence
  Synthetic Oligonucleotide; BTLA exon 2; Set C
uacacauguuguuccauuga

SEQ ID NO: 49173 - RNA, 18 nt, Artificial Sequence
  Synthetic Oligonucleotide; BTLA exon 2; Set C
acacauguuguuccauug

SEQ ID NO: 49174 - RNA, 19 nt, Artificial Sequence
  Synthetic Oligonucleotide; BTLA exon 2; Set C
uacacauguuguuccauug

SEQ ID NO: 49175 - RNA, 31 nt, Artificial Sequence
  Synthetic Oligonucleotide; BTLA exon 2; Set A
cuucaaguuuuacacauguuguuccauugag

SEQ ID NO: 49176 - RNA, 32 nt, Artificial Sequence
  Synthetic Oligonucleotide; BTLA exon 2; Set A
ucuucaaguuuuacacauguuguuccauugag

SEQ ID NO: 49177 - RNA, 33 nt, Artificial Sequence
  Synthetic Oligonucleotide; BTLA exon 2; Set A
aucuucaaguuuuacacauguuguuccauugag

SEQ ID NO: 49178 - RNA, 34 nt, Artificial Sequence
  Synthetic Oligonucleotide; BTLA exon 2; Set A
uaucuucaaguuuuacacauguuguuccauugag

SEQ ID NO: 49179 - RNA, 35 nt, Artificial Sequence
  Synthetic Oligonucleotide; BTLA exon 2; Set A
cuaucuucaaguuuuacacauguuguuccauugag

SEQ ID NO: 49180 - RNA, 27 nt, Artificial Sequence
  Synthetic Oligonucleotide; BTLA exon 2; Set C
uugucuaucuucaaguuuuacacaugu

SEQ ID NO: 49181 - RNA, 18 nt, Artificial Sequence
  Synthetic Oligonucleotide; BTLA exon 2; Set C
cuaucuucaaguuuuaca

SEQ ID NO: 49182 - RNA, 28 nt, Artificial Sequence
  Synthetic Oligonucleotide; BTLA exon 2; Set C
uuugucuaucuucaaguuuuacacaugu

SEQ ID NO: 49183 - RNA, 35 nt, Artificial Sequence
  Synthetic Oligonucleotide; BTLA exon 2; Set A
cuuguuugucuaucuucaaguuuuacacauguugu

SEQ ID NO: 49184 - RNA, 19 nt, Artificial Sequence
  Synthetic Oligonucleotide; BTLA exon 2; Set C
ucuaucuucaaguuuuaca

SEQ ID NO: 49185 - RNA, 21 nt, Artificial Sequence
  Synthetic Oligonucleotide; BTLA exon 2; Set C
gucuaucuucaaguuuuacac

SEQ ID NO: 49186 - RNA, 34 nt, Artificial Sequence
  Synthetic Oligonucleotide; BTLA exon 2; Set A
cuuguuugucuaucuucaaguuuuacacauguug

SEQ ID NO: 49187 - RNA, 18 nt, Artificial Sequence
  Synthetic Oligonucleotide; BTLA exon 2; Set C
ucuaucuucaaguuuuac

SEQ ID NO: 49188 - RNA, 20 nt, Artificial Sequence
  Synthetic Oligonucleotide; BTLA exon 2; Set C
gucuaucuucaaguuuuaca

SEQ ID NO: 49189 - RNA, 22 nt, Artificial Sequence
  Synthetic Oligonucleotide; BTLA exon 2; Set C
ugucuaucuucaaguuuuacac

SEQ ID NO: 49190 - RNA, 19 nt, Artificial Sequence
  Synthetic Oligonucleotide; BTLA exon 2; Set C
gucuaucuucaaguuuuac

SEQ ID NO: 49191 - RNA, 21 nt, Artificial Sequence
  Synthetic Oligonucleotide; BTLA exon 2; Set C
ugucuaucuucaaguuuuaca

SEQ ID NO: 49192 - RNA, 23 nt, Artificial Sequence
  Synthetic Oligonucleotide; BTLA exon 2; Set C
uugucuaucuucaaguuuuacac

SEQ ID NO: 49193 - RNA, 20 nt, Artificial Sequence
  Synthetic Oligonucleotide; BTLA exon 2; Set C
ugucuaucuucaaguuuuac

SEQ ID NO: 49194 - RNA, 22 nt, Artificial Sequence
  Synthetic Oligonucleotide; BTLA exon 2; Set C
uugucuaucuucaaguuuuaca

SEQ ID NO: 49195 - RNA, 24 nt, Artificial Sequence
  Synthetic Oligonucleotide; BTLA exon 2; Set C
uuugucuaucuucaaguuuuacac

SEQ ID NO: 49196 - RNA, 21 nt, Artificial Sequence
  Synthetic Oligonucleotide; BTLA exon 2; Set C
uugucuaucuucaaguuuuac

SEQ ID NO: 49197 - RNA, 23 nt, Artificial Sequence
  Synthetic Oligonucleotide; BTLA exon 2; Set C
uuugucuaucuucaaguuuuaca

SEQ ID NO: 49198 - RNA, 22 nt, Artificial Sequence
  Synthetic Oligonucleotide; BTLA exon 2; Set C
uuugucuaucuucaaguuuuac

SEQ ID NO: 49199 - RNA, 35 nt, Artificial Sequence
  Synthetic Oligonucleotide; BTLA exon 2; Set A
caacuuguuugucuaucuucaaguuuuacacaugu

SEQ ID NO: 49200 - RNA, 31 nt, Artificial Sequence
  Synthetic Oligonucleotide; BTLA exon 2; Set A
caacuuguuugucuaucuucaaguuuuacac

SEQ ID NO: 49201 - RNA, 30 nt, Artificial Sequence
  Synthetic Oligonucleotide; BTLA exon 2; Set C
caacuuguuugucuaucuucaaguuuuaca

SEQ ID NO: 49202 - RNA, 29 nt, Artificial Sequence
  Synthetic Oligonucleotide; BTLA exon 2; Set C
caacuuguuugucuaucuucaaguuuuac

SEQ ID NO: 49203 - RNA, 22 nt, Artificial Sequence
  Synthetic Oligonucleotide; BTLA exon 2; Set C
cuucucuuccuuccaacuuguu

SEQ ID NO: 49204 - RNA, 21 nt, Artificial Sequence
  Synthetic Oligonucleotide; BTLA exon 2; Set C
cuucucuuccuuccaacuugu

SEQ ID NO: 49205 - RNA, 21 nt, Artificial Sequence
  Synthetic Oligonucleotide; BTLA exon 2; Set C
ucuucucuuccuuccaacuug

SEQ ID NO: 49206 - RNA, 22 nt, Artificial Sequence
  Synthetic Oligonucleotide; BTLA exon 2; Set C
uucuucucuuccuuccaacuug

SEQ ID NO: 49207 - RNA, 20 nt, Artificial Sequence
  Synthetic Oligonucleotide; BTLA exon 2; Set C
ucuucucuuccuuccaacuu

SEQ ID NO: 49208 - RNA, 19 nt, Artificial Sequence
  Synthetic Oligonucleotide; BTLA exon 2; Set C
ucuucucuuccuuccaacu

SEQ ID NO: 49209 - RNA, 21 nt, Artificial Sequence
  Synthetic Oligonucleotide; BTLA exon 2; Set C
uucuucucuuccuuccaacuu

SEQ ID NO: 49210 - RNA, 16 nt, Artificial Sequence
  Synthetic Oligonucleotide; BTLA exon 2; Set C
cuucucuuccuuccaa

SEQ ID NO: 49211 - RNA, 20 nt, Artificial Sequence
  Synthetic Oligonucleotide; BTLA exon 2; Set C
uucuucucuuccuuccaacu

SEQ ID NO: 49212 - RNA, 18 nt, Artificial Sequence
  Synthetic Oligonucleotide; BTLA exon 2; Set C
ucuucucuuccuuccaac

SEQ ID NO: 49213 - RNA, 22 nt, Artificial Sequence
  Synthetic Oligonucleotide; BTLA exon 2; Set C
guucuucucuuccuuccaacuu

SEQ ID NO: 49214 - RNA, 21 nt, Artificial Sequence
  Synthetic Oligonucleotide; BTLA exon 2; Set C
guucuucucuuccuuccaacu

SEQ ID NO: 49215 - RNA, 19 nt, Artificial Sequence
  Synthetic Oligonucleotide; BTLA exon 2; Set C
uucuucucuuccuuccaac

SEQ ID NO: 49216 - RNA, 23 nt, Artificial Sequence
  Synthetic Oligonucleotide; BTLA exon 2; Set C
uguucuucucuuccuuccaacuu

SEQ ID NO: 49217 - RNA, 40 nt, Artificial Sequence
  Synthetic Oligonucleotide; BTLA exon 2; Set A
aaaaugaaauguucuucucuuccuuccaacuuguuugucu

SEQ ID NO: 49218 - RNA, 22 nt, Artificial Sequence
  Synthetic Oligonucleotide; BTLA exon 2; Set C
uguucuucucuuccuuccaacu

SEQ ID NO: 49219 - RNA, 20 nt, Artificial Sequence
  Synthetic Oligonucleotide; BTLA exon 2; Set C
guucuucucuuccuuccaac

SEQ ID NO: 49220 - RNA, 24 nt, Artificial Sequence
  Synthetic Oligonucleotide; BTLA exon 2; Set C
auguucuucucuuccuuccaacuu

SEQ ID NO: 49221 - RNA, 39 nt, Artificial Sequence
  Synthetic Oligonucleotide; BTLA exon 2; Set A
aaaaugaaauguucuucucuuccuuccaacuuguuuguc

SEQ ID NO: 49222 - RNA, 23 nt, Artificial Sequence
  Synthetic Oligonucleotide; BTLA exon 2; Set C
auguucuucucuuccuuccaacu

SEQ ID NO: 49223 - RNA, 21 nt, Artificial Sequence
  Synthetic Oligonucleotide; BTLA exon 2; Set C
uguucuucucuuccuuccaac

SEQ ID NO: 49224 - RNA, 25 nt, Artificial Sequence
  Synthetic Oligonucleotide; BTLA exon 2; Set C
aauguucuucucuuccuuccaacuu

SEQ ID NO: 49225 - RNA, 38 nt, Artificial Sequence
  Synthetic Oligonucleotide; BTLA exon 2; Set A
aaaaugaaauguucuucucuuccuuccaacuuguuugu

SEQ ID NO: 49226 - RNA, 24 nt, Artificial Sequence
  Synthetic Oligonucleotide; BTLA exon 2; Set C
aauguucuucucuuccuuccaacu

SEQ ID NO: 49227 - RNA, 22 nt, Artificial Sequence
  Synthetic Oligonucleotide; BTLA exon 2; Set C
auguucuucucuuccuuccaac

SEQ ID NO: 49228 - RNA, 37 nt, Artificial Sequence
  Synthetic Oligonucleotide; BTLA exon 2; Set A
aaaaugaaauguucuucucuuccuuccaacuuguuug

SEQ ID NO: 49229 - RNA, 25 nt, Artificial Sequence
  Synthetic Oligonucleotide; BTLA exon 2; Set C
aaauguucuucucuuccuuccaacu

SEQ ID NO: 49230 - RNA, 23 nt, Artificial Sequence
  Synthetic Oligonucleotide; BTLA exon 2; Set C
aauguucuucucuuccuuccaac

SEQ ID NO: 49231 - RNA, 36 nt, Artificial Sequence
  Synthetic Oligonucleotide; BTLA exon 2; Set A
aaaaugaaauguucuucucuuccuuccaacuuguuu

SEQ ID NO: 49232 - RNA, 24 nt, Artificial Sequence
  Synthetic Oligonucleotide; BTLA exon 2; Set C
aaauguucuucucuuccuuccaac

SEQ ID NO: 49233 - RNA, 25 nt, Artificial Sequence
  Synthetic Oligonucleotide; BTLA exon 2; Set C
gaaauguucuucucuuccuuccaac

SEQ ID NO: 49234 - RNA, 27 nt, Artificial Sequence
  Synthetic Oligonucleotide; BTLA exon 2; Set C
augaaauguucuucucuuccuuccaac

SEQ ID NO: 49235 - RNA, 31 nt, Artificial Sequence
  Synthetic Oligonucleotide; BTLA exon 2; Set C
aaaugaaauguucuucucuuccuuccaacuu

SEQ ID NO: 49236 - RNA, 30 nt, Artificial Sequence
  Synthetic Oligonucleotide; BTLA exon 2; Set C
aaaugaaauguucuucucuuccuuccaacu

SEQ ID NO: 49237 - RNA, 29 nt, Artificial Sequence
  Synthetic Oligonucleotide; BTLA exon 2; Set C
aaaugaaauguucuucucuuccuuccaac

SEQ ID NO: 49238 - RNA, 38 nt, Artificial Sequence
  Synthetic Oligonucleotide; BTLA exon 2; Set A
aaugaaaaaugaaauguucuucucuuccuuccaacuug

SEQ ID NO: 49239 - RNA, 37 nt, Artificial Sequence
  Synthetic Oligonucleotide; BTLA exon 2; Set C
aaugaaaaaugaaauguucuucucuuccuuccaacuu

SEQ ID NO: 49240 - RNA, 36 nt, Artificial Sequence
  Synthetic Oligonucleotide; BTLA exon 2; Set C
aaugaaaaaugaaauguucuucucuuccuuccaacu

SEQ ID NO: 49241 - RNA, 38 nt, Artificial Sequence
  Synthetic Oligonucleotide; BTLA exon 2; Set A
gaaugaaaaaugaaauguucuucucuuccuuccaacuu

SEQ ID NO: 49242 - RNA, 37 nt, Artificial Sequence
  Synthetic Oligonucleotide; BTLA exon 2; Set A
gaaugaaaaaugaaauguucuucucuuccuuccaacu

SEQ ID NO: 49243 - RNA, 35 nt, Artificial Sequence
  Synthetic Oligonucleotide; BTLA exon 2; Set C
aaugaaaaaugaaauguucuucucuuccuuccaac

SEQ ID NO: 49244 - RNA, 36 nt, Artificial Sequence
  Synthetic Oligonucleotide; BTLA exon 2; Set C
gaaugaaaaaugaaauguucuucucuuccuuccaac

SEQ ID NO: 49245 - RNA, 36 nt, Artificial Sequence
  Synthetic Oligonucleotide; BTLA exon 2; Set C
agaaugaaaaaugaaauguucuucucuuccuuccaa

SEQ ID NO: 49246 - RNA, 37 nt, Artificial Sequence
  Synthetic Oligonucleotide; BTLA exon 2; Set C
uagaaugaaaaaugaaauguucuucucuuccuuccaa

SEQ ID NO: 49247 - RNA, 38 nt, Artificial Sequence
  Synthetic Oligonucleotide; BTLA exon 2; Set A
guagaaugaaaaaugaaauguucuucucuuccuuccaa

SEQ ID NO: 49248 - RNA, 39 nt, Artificial Sequence
  Synthetic Oligonucleotide; BTLA exon 2; Set A
uguagaaugaaaaaugaaauguucuucucuuccuuccaa

SEQ ID NO: 49249 - RNA, 16 nt, Artificial Sequence
  Synthetic Oligonucleotide; BTLA exon 2; Set C
aaaaugaaauguucuu

SEQ ID NO: 49250 - RNA, 15 nt, Artificial Sequence
  Synthetic Oligonucleotide; BTLA exon 2; Set C
aaaaugaaauguucu

SEQ ID NO: 49251 - RNA, 16 nt, Artificial Sequence
  Synthetic Oligonucleotide; BTLA exon 2; Set C
aaaaaugaaauguucu

SEQ ID NO: 49252 - RNA, 15 nt, Artificial Sequence
  Synthetic Oligonucleotide; BTLA exon 2; Set C
aaaaaugaaauguuc

SEQ ID NO: 49253 - RNA, 22 nt, Artificial Sequence
  Synthetic Oligonucleotide; BTLA exon 2; Set C
agaaugaaaaaugaaauguucu

SEQ ID NO: 49254 - RNA, 23 nt, Artificial Sequence
  Synthetic Oligonucleotide; BTLA exon 2; Set C
uagaaugaaaaaugaaauguucu

SEQ ID NO: 49255 - RNA, 21 nt, Artificial Sequence
  Synthetic Oligonucleotide; BTLA exon 2; Set C
agaaugaaaaaugaaauguuc

SEQ ID NO: 49256 - RNA, 25 nt, Artificial Sequence
  Synthetic Oligonucleotide; BTLA exon 2; Set C
guagaaugaaaaaugaaauguucuu

SEQ ID NO: 49257 - RNA, 20 nt, Artificial Sequence
  Synthetic Oligonucleotide; BTLA exon 2; Set C
agaaugaaaaaugaaauguu

SEQ ID NO: 49258 - RNA, 22 nt, Artificial Sequence
  Synthetic Oligonucleotide; BTLA exon 2; Set C
uagaaugaaaaaugaaauguuc

SEQ ID NO: 49259 - RNA, 26 nt, Artificial Sequence
  Synthetic Oligonucleotide; BTLA exon 2; Set C
uguagaaugaaaaaugaaauguucuu

SEQ ID NO: 49260 - RNA, 19 nt, Artificial Sequence
  Synthetic Oligonucleotide; BTLA exon 2; Set C
agaaugaaaaaugaaaugu

SEQ ID NO: 49261 - RNA, 21 nt, Artificial Sequence
  Synthetic Oligonucleotide; BTLA exon 2; Set C
uagaaugaaaaaugaaauguu

SEQ ID NO: 49262 - RNA, 27 nt, Artificial Sequence
  Synthetic Oligonucleotide; BTLA exon 2; Set C
auguagaaugaaaaaugaaauguucuu

SEQ ID NO: 49263 - RNA, 20 nt, Artificial Sequence
  Synthetic Oligonucleotide; BTLA exon 2; Set C
uagaaugaaaaaugaaaugu

SEQ ID NO: 49264 - RNA, 18 nt, Artificial Sequence
  Synthetic Oligonucleotide; BTLA exon 2; Set C
agaaugaaaaaugaaaug

SEQ ID NO: 49265 - RNA, 28 nt, Artificial Sequence
  Synthetic Oligonucleotide; BTLA exon 2; Set C
aauguagaaugaaaaaugaaauguucuu

SEQ ID NO: 49266 - RNA, 19 nt, Artificial Sequence
  Synthetic Oligonucleotide; BTLA exon 2; Set C
uagaaugaaaaaugaaaug

SEQ ID NO: 49267 - RNA, 17 nt, Artificial Sequence
  Synthetic Oligonucleotide; BTLA exon 2; Set C
agaaugaaaaaugaaau

SEQ ID NO: 49268 - RNA, 29 nt, Artificial Sequence
  Synthetic Oligonucleotide; BTLA exon 2; Set C
aaauguagaaugaaaaaugaaauguucuu

SEQ ID NO: 49269 - RNA, 20 nt, Artificial Sequence
  Synthetic Oligonucleotide; BTLA exon 2; Set C
guagaaugaaaaaugaaaug

SEQ ID NO: 49270 - RNA, 18 nt, Artificial Sequence
  Synthetic Oligonucleotide; BTLA exon 2; Set C
uagaaugaaaaaugaaau

SEQ ID NO: 49271 - RNA, 16 nt, Artificial Sequence
  Synthetic Oligonucleotide; BTLA exon 2; Set C
agaaugaaaaaugaaa

SEQ ID NO: 49272 - RNA, 21 nt, Artificial Sequence
  Synthetic Oligonucleotide; BTLA exon 2; Set C
uguagaaugaaaaaugaaaug

SEQ ID NO: 49273 - RNA, 19 nt, Artificial Sequence
  Synthetic Oligonucleotide; BTLA exon 2; Set C
guagaaugaaaaaugaaau

SEQ ID NO: 49274 - RNA, 17 nt, Artificial Sequence
  Synthetic Oligonucleotide; BTLA exon 2; Set C
uagaaugaaaaaugaaa

SEQ ID NO: 49275 - RNA, 15 nt, Artificial Sequence
  Synthetic Oligonucleotide; BTLA exon 2; Set C
agaaugaaaaaugaa

SEQ ID NO: 49276 - RNA, 20 nt, Artificial Sequence
  Synthetic Oligonucleotide; BTLA exon 2; Set C
uguagaaugaaaaaugaaau

SEQ ID NO: 49277 - RNA, 18 nt, Artificial Sequence
  Synthetic Oligonucleotide; BTLA exon 2; Set C
guagaaugaaaaaugaaa

SEQ ID NO: 49278 - RNA, 16 nt, Artificial Sequence
  Synthetic Oligonucleotide; BTLA exon 2; Set C
uagaaugaaaaaugaa

SEQ ID NO: 49279 - RNA, 19 nt, Artificial Sequence
  Synthetic Oligonucleotide; BTLA exon 2; Set C
uguagaaugaaaaaugaaa

SEQ ID NO: 49280 - RNA, 17 nt, Artificial Sequence
  Synthetic Oligonucleotide; BTLA exon 2; Set C
guagaaugaaaaaugaa

SEQ ID NO: 49281 - RNA, 15 nt, Artificial Sequence
  Synthetic Oligonucleotide; BTLA exon 2; Set C
uagaaugaaaaauga

SEQ ID NO: 49282 - RNA, 18 nt, Artificial Sequence
  Synthetic Oligonucleotide; BTLA exon 2; Set C
uguagaaugaaaaaugaa

SEQ ID NO: 49283 - RNA, 16 nt, Artificial Sequence
  Synthetic Oligonucleotide; BTLA exon 2; Set C
guagaaugaaaaauga

SEQ ID NO: 49284 - RNA, 17 nt, Artificial Sequence
  Synthetic Oligonucleotide; BTLA exon 2; Set C
uguagaaugaaaaauga

SEQ ID NO: 49285 - RNA, 15 nt, Artificial Sequence
  Synthetic Oligonucleotide; BTLA exon 2; Set C
guagaaugaaaaaug

SEQ ID NO: 49286 - RNA, 16 nt, Artificial Sequence
  Synthetic Oligonucleotide; BTLA exon 2; Set C
uguagaaugaaaaaug

SEQ ID NO: 49287 - RNA, 15 nt, Artificial Sequence
  Synthetic Oligonucleotide; BTLA exon 2; Set C
uguagaaugaaaaau

SEQ ID NO: 49288 - RNA, 15 nt, Artificial Sequence
  Synthetic Oligonucleotide; BTLA exon 2; Set C
auguagaaugaaaaa

SEQ ID NO: 49289 - RNA, 16 nt, Artificial Sequence
  Synthetic Oligonucleotide; BTLA exon 2; Set C
aauguagaaugaaaaa

SEQ ID NO: 49290 - RNA, 39 nt, Artificial Sequence
  Synthetic Oligonucleotide; BTLA exon 2; Set A
gcacugguucaaaauguagaaugaaaaaugaaauguucu

SEQ ID NO: 49291 - RNA, 17 nt, Artificial Sequence
  Synthetic Oligonucleotide; BTLA exon 2; Set C
aaauguagaaugaaaaa

SEQ ID NO: 49292 - RNA, 38 nt, Artificial Sequence
  Synthetic Oligonucleotide; BTLA exon 2; Set C
gcacugguucaaaauguagaaugaaaaaugaaauguuc

SEQ ID NO: 49293 - RNA, 40 nt, Artificial Sequence
  Synthetic Oligonucleotide; BTLA exon 2; Set A
agcacugguucaaaauguagaaugaaaaaugaaauguucu

SEQ ID NO: 49294 - RNA, 37 nt, Artificial Sequence
  Synthetic Oligonucleotide; BTLA exon 2; Set C
gcacugguucaaaauguagaaugaaaaaugaaauguu

SEQ ID NO: 49295 - RNA, 39 nt, Artificial Sequence
  Synthetic Oligonucleotide; BTLA exon 2; Set C
agcacugguucaaaauguagaaugaaaaaugaaauguuc

SEQ ID NO: 49296 - RNA, 36 nt, Artificial Sequence
  Synthetic Oligonucleotide; BTLA exon 2; Set C
gcacugguucaaaauguagaaugaaaaaugaaaugu

SEQ ID NO: 49297 - RNA, 38 nt, Artificial Sequence
  Synthetic Oligonucleotide; BTLA exon 2; Set C
agcacugguucaaaauguagaaugaaaaaugaaauguu

SEQ ID NO: 49298 - RNA, 37 nt, Artificial Sequence
  Synthetic Oligonucleotide; BTLA exon 2; Set C
agcacugguucaaaauguagaaugaaaaaugaaaugu

SEQ ID NO: 49299 - RNA, 39 nt, Artificial Sequence
  Synthetic Oligonucleotide; BTLA exon 2; Set C
aagcacugguucaaaauguagaaugaaaaaugaaauguu

SEQ ID NO: 49300 - RNA, 35 nt, Artificial Sequence
  Synthetic Oligonucleotide; BTLA exon 2; Set C
gcacugguucaaaauguagaaugaaaaaugaaaug

SEQ ID NO: 49301 - RNA, 38 nt, Artificial Sequence
  Synthetic Oligonucleotide; BTLA exon 2; Set C
aagcacugguucaaaauguagaaugaaaaaugaaaugu

SEQ ID NO: 49302 - RNA, 40 nt, Artificial Sequence
  Synthetic Oligonucleotide; BTLA exon 2; Set C
gaagcacugguucaaaauguagaaugaaaaaugaaauguu

SEQ ID NO: 49303 - RNA, 34 nt, Artificial Sequence
  Synthetic Oligonucleotide; BTLA exon 2; Set C
gcacugguucaaaauguagaaugaaaaaugaaau

SEQ ID NO: 49304 - RNA, 36 nt, Artificial Sequence
  Synthetic Oligonucleotide; BTLA exon 2; Set C
agcacugguucaaaauguagaaugaaaaaugaaaug

SEQ ID NO: 49305 - RNA, 39 nt, Artificial Sequence
  Synthetic Oligonucleotide; BTLA exon 2; Set C
gaagcacugguucaaaauguagaaugaaaaaugaaaugu

SEQ ID NO: 49306 - RNA, 33 nt, Artificial Sequence
  Synthetic Oligonucleotide; BTLA exon 2; Set C
gcacugguucaaaauguagaaugaaaaaugaaa

SEQ ID NO: 49307 - RNA, 35 nt, Artificial Sequence
  Synthetic Oligonucleotide; BTLA exon 2; Set C
agcacugguucaaaauguagaaugaaaaaugaaau

SEQ ID NO: 49308 - RNA, 40 nt, Artificial Sequence
  Synthetic Oligonucleotide; BTLA exon 2; Set A
ggaagcacugguucaaaauguagaaugaaaaaugaaaugu

SEQ ID NO: 49309 - RNA, 38 nt, Artificial Sequence
  Synthetic Oligonucleotide; BTLA exon 2; Set C
gaagcacugguucaaaauguagaaugaaaaaugaaaug

SEQ ID NO: 49310 - RNA, 39 nt, Artificial Sequence
  Synthetic Oligonucleotide; BTLA exon 2; Set C
ggaagcacugguucaaaauguagaaugaaaaaugaaaug

SEQ ID NO: 49311 - RNA, 37 nt, Artificial Sequence
  Synthetic Oligonucleotide; BTLA exon 2; Set C
gaagcacugguucaaaauguagaaugaaaaaugaaau

SEQ ID NO: 49312 - RNA, 38 nt, Artificial Sequence
  Synthetic Oligonucleotide; BTLA exon 2; Set C
ggaagcacugguucaaaauguagaaugaaaaaugaaau

SEQ ID NO: 49313 - RNA, 36 nt, Artificial Sequence
  Synthetic Oligonucleotide; BTLA exon 2; Set C
gaagcacugguucaaaauguagaaugaaaaaugaaa

SEQ ID NO: 49314 - RNA, 37 nt, Artificial Sequence
  Synthetic Oligonucleotide; BTLA exon 2; Set C
ggaagcacugguucaaaauguagaaugaaaaaugaaa

SEQ ID NO: 49315 - RNA, 35 nt, Artificial Sequence
  Synthetic Oligonucleotide; BTLA exon 2; Set C
gaagcacugguucaaaauguagaaugaaaaaugaa

SEQ ID NO: 49316 - RNA, 36 nt, Artificial Sequence
  Synthetic Oligonucleotide; BTLA exon 2; Set C
ggaagcacugguucaaaauguagaaugaaaaaugaa

SEQ ID NO: 49317 - RNA, 34 nt, Artificial Sequence
  Synthetic Oligonucleotide; BTLA exon 2; Set C
gaagcacugguucaaaauguagaaugaaaaauga

SEQ ID NO: 49318 - RNA, 35 nt, Artificial Sequence
  Synthetic Oligonucleotide; BTLA exon 2; Set A
ggaagcacugguucaaaauguagaaugaaaaauga

SEQ ID NO: 49319 - RNA, 33 nt, Artificial Sequence
  Synthetic Oligonucleotide; BTLA exon 2; Set C
gaagcacugguucaaaauguagaaugaaaaaug

SEQ ID NO: 49320 - RNA, 34 nt, Artificial Sequence
  Synthetic Oligonucleotide; BTLA exon 2; Set C
ggaagcacugguucaaaauguagaaugaaaaaug

SEQ ID NO: 49321 - RNA, 32 nt, Artificial Sequence
  Synthetic Oligonucleotide; BTLA exon 2; Set C
gaagcacugguucaaaauguagaaugaaaaau

SEQ ID NO: 49322 - RNA, 33 nt, Artificial Sequence
  Synthetic Oligonucleotide; BTLA exon 2; Set C
ggaagcacugguucaaaauguagaaugaaaaau

SEQ ID NO: 49323 - RNA, 15 nt, Artificial Sequence
  Synthetic Oligonucleotide; BTLA exon 2; Set C
gguucaaaauguaga

SEQ ID NO: 49324 - RNA, 16 nt, Artificial Sequence
  Synthetic Oligonucleotide; BTLA exon 2; Set C
ugguucaaaauguaga

SEQ ID NO: 49325 - RNA, 33 nt, Artificial Sequence
  Synthetic Oligonucleotide; BTLA exon 2; Set C
aggaagcacugguucaaaauguagaaugaaaaa

SEQ ID NO: 49326 - RNA, 15 nt, Artificial Sequence
  Synthetic Oligonucleotide; BTLA exon 2; Set C
ugguucaaaauguag

SEQ ID NO: 49327 - RNA, 17 nt, Artificial Sequence
  Synthetic Oligonucleotide; BTLA exon 2; Set C
cugguucaaaauguaga

SEQ ID NO: 49328 - RNA, 16 nt, Artificial Sequence
  Synthetic Oligonucleotide; BTLA exon 2; Set C
cugguucaaaauguag

SEQ ID NO: 49329 - RNA, 18 nt, Artificial Sequence
  Synthetic Oligonucleotide; BTLA exon 2; Set C
acugguucaaaauguaga

SEQ ID NO: 49330 - RNA, 39 nt, Artificial Sequence
  Synthetic Oligonucleotide; BTLA exon 2; Set A
cauuaggaagcacugguucaaaauguagaaugaaaaaug

SEQ ID NO: 49331 - RNA, 15 nt, Artificial Sequence
  Synthetic Oligonucleotide; BTLA exon 2; Set C
cugguucaaaaugua

SEQ ID NO: 49332 - RNA, 17 nt, Artificial Sequence
  Synthetic Oligonucleotide; BTLA exon 2; Set C
acugguucaaaauguag

SEQ ID NO: 49333 - RNA, 19 nt, Artificial Sequence
  Synthetic Oligonucleotide; BTLA exon 2; Set C
cacugguucaaaauguaga

SEQ ID NO: 49334 - RNA, 38 nt, Artificial Sequence
  Synthetic Oligonucleotide; BTLA exon 2; Set A
cauuaggaagcacugguucaaaauguagaaugaaaaau

SEQ ID NO: 49335 - RNA, 40 nt, Artificial Sequence
  Synthetic Oligonucleotide; BTLA exon 2; Set A
ucauuaggaagcacugguucaaaauguagaaugaaaaaug

SEQ ID NO: 49336 - RNA, 16 nt, Artificial Sequence
  Synthetic Oligonucleotide; BTLA exon 2; Set C
acugguucaaaaugua

SEQ ID NO: 49337 - RNA, 18 nt, Artificial Sequence
  Synthetic Oligonucleotide; BTLA exon 2; Set C
cacugguucaaaauguag

SEQ ID NO: 49338 - RNA, 39 nt, Artificial Sequence
  Synthetic Oligonucleotide; BTLA exon 2; Set A
ucauuaggaagcacugguucaaaauguagaaugaaaaau

SEQ ID NO: 49339 - RNA, 25 nt, Artificial Sequence
  Synthetic Oligonucleotide; BTLA exon 2; Set C
gaagcacugguucaaaauguagaau

SEQ ID NO: 49340 - RNA, 37 nt, Artificial Sequence
  Synthetic Oligonucleotide; BTLA exon 2; Set A
cauuaggaagcacugguucaaaauguagaaugaaaaa

SEQ ID NO: 49341 - RNA, 15 nt, Artificial Sequence
  Synthetic Oligonucleotide; BTLA exon 2; Set C
acugguucaaaaugu

SEQ ID NO: 49342 - RNA, 17 nt, Artificial Sequence
  Synthetic Oligonucleotide; BTLA exon 2; Set C
cacugguucaaaaugua

SEQ ID NO: 49343 - RNA, 40 nt, Artificial Sequence
  Synthetic Oligonucleotide; BTLA exon 2; Set A
gucauuaggaagcacugguucaaaauguagaaugaaaaau

SEQ ID NO: 49344 - RNA, 24 nt, Artificial Sequence
  Synthetic Oligonucleotide; BTLA exon 2; Set C
gaagcacugguucaaaauguagaa

SEQ ID NO: 49345 - RNA, 26 nt, Artificial Sequence
  Synthetic Oligonucleotide; BTLA exon 2; Set C
ggaagcacugguucaaaauguagaau

SEQ ID NO: 49346 - RNA, 38 nt, Artificial Sequence
  Synthetic Oligonucleotide; BTLA exon 2; Set A
ucauuaggaagcacugguucaaaauguagaaugaaaaa

SEQ ID NO: 49347 - RNA, 16 nt, Artificial Sequence
  Synthetic Oligonucleotide; BTLA exon 2; Set C
cacugguucaaaaugu

SEQ ID NO: 49348 - RNA, 25 nt, Artificial Sequence
  Synthetic Oligonucleotide; BTLA exon 2; Set C
ggaagcacugguucaaaauguagaa

SEQ ID NO: 49349 - RNA, 40 nt, Artificial Sequence
  Synthetic Oligonucleotide; BTLA exon 2; Set A
ugucauuaggaagcacugguucaaaauguagaaugaaaaa

SEQ ID NO: 49350 - RNA, 27 nt, Artificial Sequence
  Synthetic Oligonucleotide; BTLA exon 2; Set C
uuaggaagcacugguucaaaauguaga

SEQ ID NO: 49351 - RNA, 32 nt, Artificial Sequence
  Synthetic Oligonucleotide; BTLA exon 2; Set A
ucauuaggaagcacugguucaaaauguagaau

SEQ ID NO: 49352 - RNA, 24 nt, Artificial Sequence
  Synthetic Oligonucleotide; BTLA exon 2; Set C
uaggaagcacugguucaaaaugua

SEQ ID NO: 49353 - RNA, 26 nt, Artificial Sequence
  Synthetic Oligonucleotide; BTLA exon 2; Set C
uuaggaagcacugguucaaaauguag

SEQ ID NO: 49354 - RNA, 28 nt, Artificial Sequence
  Synthetic Oligonucleotide; BTLA exon 2; Set C
auuaggaagcacugguucaaaauguaga

SEQ ID NO: 49355 - RNA, 31 nt, Artificial Sequence
  Synthetic Oligonucleotide; BTLA exon 2; Set A
ucauuaggaagcacugguucaaaauguagaa

SEQ ID NO: 49356 - RNA, 33 nt, Artificial Sequence
  Synthetic Oligonucleotide; BTLA exon 2; Set A
gucauuaggaagcacugguucaaaauguagaau

SEQ ID NO: 49357 - RNA, 21 nt, Artificial Sequence
  Synthetic Oligonucleotide; BTLA exon 2; Set C
aggaagcacugguucaaaaug

SEQ ID NO: 49358 - RNA, 23 nt, Artificial Sequence
  Synthetic Oligonucleotide; BTLA exon 2; Set C
uaggaagcacugguucaaaaugu

SEQ ID NO: 49359 - RNA, 25 nt, Artificial Sequence
  Synthetic Oligonucleotide; BTLA exon 2; Set C
uuaggaagcacugguucaaaaugua

SEQ ID NO: 49360 - RNA, 27 nt, Artificial Sequence
  Synthetic Oligonucleotide; BTLA exon 2; Set C
auuaggaagcacugguucaaaauguag

SEQ ID NO: 49361 - RNA, 32 nt, Artificial Sequence
  Synthetic Oligonucleotide; BTLA exon 2; Set A
gucauuaggaagcacugguucaaaauguagaa

SEQ ID NO: 49362 - RNA, 34 nt, Artificial Sequence
  Synthetic Oligonucleotide; BTLA exon 2; Set A
ugucauuaggaagcacugguucaaaauguagaau

SEQ ID NO: 49363 - RNA, 20 nt, Artificial Sequence
  Synthetic Oligonucleotide; BTLA exon 2; Set C
aggaagcacugguucaaaau

SEQ ID NO: 49364 - RNA, 22 nt, Artificial Sequence
  Synthetic Oligonucleotide; BTLA exon 2; Set C
uaggaagcacugguucaaaaug

SEQ ID NO: 49365 - RNA, 24 nt, Artificial Sequence
  Synthetic Oligonucleotide; BTLA exon 2; Set C
uuaggaagcacugguucaaaaugu

SEQ ID NO: 49366 - RNA, 26 nt, Artificial Sequence
  Synthetic Oligonucleotide; BTLA exon 2; Set C
auuaggaagcacugguucaaaaugua

SEQ ID NO: 49367 - RNA, 33 nt, Artificial Sequence
  Synthetic Oligonucleotide; BTLA exon 2; Set A
ugucauuaggaagcacugguucaaaauguagaa

SEQ ID NO: 49368 - RNA, 35 nt, Artificial Sequence
  Synthetic Oligonucleotide; BTLA exon 2; Set A
uugucauuaggaagcacugguucaaaauguagaau

SEQ ID NO: 49369 - RNA, 21 nt, Artificial Sequence
  Synthetic Oligonucleotide; BTLA exon 2; Set C
uaggaagcacugguucaaaau

SEQ ID NO: 49370 - RNA, 19 nt, Artificial Sequence
  Synthetic Oligonucleotide; BTLA exon 2; Set C
aggaagcacugguucaaaa

SEQ ID NO: 49371 - RNA, 25 nt, Artificial Sequence
  Synthetic Oligonucleotide; BTLA exon 2; Set C
auuaggaagcacugguucaaaaugu

SEQ ID NO: 49372 - RNA, 34 nt, Artificial Sequence
  Synthetic Oligonucleotide; BTLA exon 2; Set A
uugucauuaggaagcacugguucaaaauguagaa

SEQ ID NO: 49373 - RNA, 20 nt, Artificial Sequence
  Synthetic Oligonucleotide; BTLA exon 2; Set C
uaggaagcacugguucaaaa

SEQ ID NO: 49374 - RNA, 25 nt, Artificial Sequence
  Synthetic Oligonucleotide; BTLA exon 2; Set C
cauuaggaagcacugguucaaaaug

SEQ ID NO: 49375 - RNA, 24 nt, Artificial Sequence
  Synthetic Oligonucleotide; BTLA exon 2; Set C
cauuaggaagcacugguucaaaau

SEQ ID NO: 49376 - RNA, 26 nt, Artificial Sequence
  Synthetic Oligonucleotide; BTLA exon 2; Set C
ucauuaggaagcacugguucaaaaug

SEQ ID NO: 49377 - RNA, 34 nt, Artificial Sequence
  Synthetic Oligonucleotide; BTLA exon 2; Set A
auugucauuaggaagcacugguucaaaauguaga

SEQ ID NO: 49378 - RNA, 25 nt, Artificial Sequence
  Synthetic Oligonucleotide; BTLA exon 2; Set C
ucauuaggaagcacugguucaaaau

SEQ ID NO: 49379 - RNA, 23 nt, Artificial Sequence
  Synthetic Oligonucleotide; BTLA exon 2; Set C
cauuaggaagcacugguucaaaa

SEQ ID NO: 49380 - RNA, 33 nt, Artificial Sequence
  Synthetic Oligonucleotide; BTLA exon 2; Set A
auugucauuaggaagcacugguucaaaauguag

SEQ ID NO: 49381 - RNA, 35 nt, Artificial Sequence
  Synthetic Oligonucleotide; BTLA exon 2; Set A
cauugucauuaggaagcacugguucaaaauguaga

SEQ ID NO: 49382 - RNA, 32 nt, Artificial Sequence
  Synthetic Oligonucleotide; BTLA exon 2; Set A
auugucauuaggaagcacugguucaaaaugua

SEQ ID NO: 49383 - RNA, 34 nt, Artificial Sequence
  Synthetic Oligonucleotide; BTLA exon 2; Set A
cauugucauuaggaagcacugguucaaaauguag

SEQ ID NO: 49384 - RNA, 31 nt, Artificial Sequence
  Synthetic Oligonucleotide; BTLA exon 2; Set A
auugucauuaggaagcacugguucaaaaugu

SEQ ID NO: 49385 - RNA, 33 nt, Artificial Sequence
  Synthetic Oligonucleotide; BTLA exon 2; Set A
cauugucauuaggaagcacugguucaaaaugua

SEQ ID NO: 49386 - RNA, 32 nt, Artificial Sequence
  Synthetic Oligonucleotide; BTLA exon 2; Set A
cauugucauuaggaagcacugguucaaaaugu

SEQ ID NO: 49387 - RNA, 34 nt, Artificial Sequence
  Synthetic Oligonucleotide; BTLA exon 2; Set A
ccauugucauuaggaagcacugguucaaaaugua

SEQ ID NO: 49388 - RNA, 31 nt, Artificial Sequence
  Synthetic Oligonucleotide; BTLA exon 2; Set A
cauugucauuaggaagcacugguucaaaaug

SEQ ID NO: 49389 - RNA, 33 nt, Artificial Sequence
  Synthetic Oligonucleotide; BTLA exon 2; Set A
ccauugucauuaggaagcacugguucaaaaugu

SEQ ID NO: 49390 - RNA, 32 nt, Artificial Sequence
  Synthetic Oligonucleotide; BTLA exon 2; Set A
ccauugucauuaggaagcacugguucaaaaug

SEQ ID NO: 49391 - RNA, 31 nt, Artificial Sequence
  Synthetic Oligonucleotide; BTLA exon 2; Set A
ccauugucauuaggaagcacugguucaaaau

SEQ ID NO: 49392 - RNA, 29 nt, Artificial Sequence
  Synthetic Oligonucleotide; BTLA exon 2; Set A
cauugucauuaggaagcacugguucaaaa

SEQ ID NO: 49393 - RNA, 20 nt, Artificial Sequence
  Synthetic Oligonucleotide; BTLA exon 2; Set C
gucauuaggaagcacugguu

SEQ ID NO: 49394 - RNA, 30 nt, Artificial Sequence
  Synthetic Oligonucleotide; BTLA exon 2; Set A
ccauugucauuaggaagcacugguucaaaa

SEQ ID NO: 49395 - RNA, 19 nt, Artificial Sequence
  Synthetic Oligonucleotide; BTLA exon 2; Set C
gucauuaggaagcacuggu

SEQ ID NO: 49396 - RNA, 21 nt, Artificial Sequence
  Synthetic Oligonucleotide; BTLA exon 2; Set C
ugucauuaggaagcacugguu

SEQ ID NO: 49397 - RNA, 18 nt, Artificial Sequence
  Synthetic Oligonucleotide; BTLA exon 2; Set C
gucauuaggaagcacugg

SEQ ID NO: 49398 - RNA, 22 nt, Artificial Sequence
  Synthetic Oligonucleotide; BTLA exon 2; Set C
uugucauuaggaagcacugguu

SEQ ID NO: 49399 - RNA, 40 nt, Artificial Sequence
  Synthetic Oligonucleotide; BTLA exon 2; Set C
uaugacccauugucauuaggaagcacugguucaaaaugua

SEQ ID NO: 49400 - RNA, 17 nt, Artificial Sequence
  Synthetic Oligonucleotide; BTLA exon 2; Set C
gucauuaggaagcacug

SEQ ID NO: 49401 - RNA, 21 nt, Artificial Sequence
  Synthetic Oligonucleotide; BTLA exon 2; Set C
uugucauuaggaagcacuggu

SEQ ID NO: 49402 - RNA, 39 nt, Artificial Sequence
  Synthetic Oligonucleotide; BTLA exon 2; Set C
uaugacccauugucauuaggaagcacugguucaaaaugu

SEQ ID NO: 49403 - RNA, 16 nt, Artificial Sequence
  Synthetic Oligonucleotide; BTLA exon 2; Set C
gucauuaggaagcacu

SEQ ID NO: 49404 - RNA, 20 nt, Artificial Sequence
  Synthetic Oligonucleotide; BTLA exon 2; Set C
uugucauuaggaagcacugg

SEQ ID NO: 49405 - RNA, 40 nt, Artificial Sequence
  Synthetic Oligonucleotide; BTLA exon 2; Set C
guaugacccauugucauuaggaagcacugguucaaaaugu

SEQ ID NO: 49406 - RNA, 19 nt, Artificial Sequence
  Synthetic Oligonucleotide; BTLA exon 2; Set C
uugucauuaggaagcacug

SEQ ID NO: 49407 - RNA, 15 nt, Artificial Sequence
  Synthetic Oligonucleotide; BTLA exon 2; Set C
gucauuaggaagcac

SEQ ID NO: 49408 - RNA, 18 nt, Artificial Sequence
  Synthetic Oligonucleotide; BTLA exon 2; Set C
uugucauuaggaagcacu

SEQ ID NO: 49409 - RNA, 16 nt, Artificial Sequence
  Synthetic Oligonucleotide; BTLA exon 2; Set C
ugucauuaggaagcac

SEQ ID NO: 49410 - RNA, 17 nt, Artificial Sequence
  Synthetic Oligonucleotide; BTLA exon 2; Set C
uugucauuaggaagcac

SEQ ID NO: 49411 - RNA, 29 nt, Artificial Sequence
  Synthetic Oligonucleotide; BTLA exon 2; Set C
augacccauugucauuaggaagcacuggu

SEQ ID NO: 49412 - RNA, 28 nt, Artificial Sequence
  Synthetic Oligonucleotide; BTLA exon 2; Set A
augacccauugucauuaggaagcacugg

SEQ ID NO: 49413 - RNA, 27 nt, Artificial Sequence
  Synthetic Oligonucleotide; BTLA exon 2; Set A
augacccauugucauuaggaagcacug

SEQ ID NO: 49414 - RNA, 15 nt, Artificial Sequence
  Synthetic Oligonucleotide; BTLA exon 2; Set C
cauugucauuaggaa

SEQ ID NO: 49415 - RNA, 26 nt, Artificial Sequence
  Synthetic Oligonucleotide; BTLA exon 2; Set A
augacccauugucauuaggaagcacu

SEQ ID NO: 49416 - RNA, 34 nt, Artificial Sequence
  Synthetic Oligonucleotide; BTLA exon 2; Set C
cgguaugacccauugucauuaggaagcacugguu

SEQ ID NO: 49417 - RNA, 33 nt, Artificial Sequence
  Synthetic Oligonucleotide; BTLA exon 2; Set C
cgguaugacccauugucauuaggaagcacuggu

SEQ ID NO: 49418 - RNA, 35 nt, Artificial Sequence
  Synthetic Oligonucleotide; BTLA exon 2; Set C
gcgguaugacccauugucauuaggaagcacugguu

SEQ ID NO: 49419 - RNA, 15 nt, Artificial Sequence
  Synthetic Oligonucleotide; BTLA exon 2; Set C
ccauugucauuagga

SEQ ID NO: 49420 - RNA, 34 nt, Artificial Sequence
  Synthetic Oligonucleotide; BTLA exon 2; Set C
gcgguaugacccauugucauuaggaagcacuggu

SEQ ID NO: 49421 - RNA, 36 nt, Artificial Sequence
  Synthetic Oligonucleotide; BTLA exon 2; Set C
agcgguaugacccauugucauuaggaagcacugguu

SEQ ID NO: 49422 - RNA, 33 nt, Artificial Sequence
  Synthetic Oligonucleotide; BTLA exon 2; Set C
gcgguaugacccauugucauuaggaagcacugg

SEQ ID NO: 49423 - RNA, 35 nt, Artificial Sequence
  Synthetic Oligonucleotide; BTLA exon 2; Set C
agcgguaugacccauugucauuaggaagcacuggu

SEQ ID NO: 49424 - RNA, 37 nt, Artificial Sequence
  Synthetic Oligonucleotide; BTLA exon 2; Set C
cagcgguaugacccauugucauuaggaagcacugguu

SEQ ID NO: 49425 - RNA, 25 nt, Artificial Sequence
  Synthetic Oligonucleotide; BTLA exon 2; Set A
uaugacccauugucauuaggaagca

SEQ ID NO: 49426 - RNA, 32 nt, Artificial Sequence
  Synthetic Oligonucleotide; BTLA exon 2; Set C
gcgguaugacccauugucauuaggaagcacug

SEQ ID NO: 49427 - RNA, 34 nt, Artificial Sequence
  Synthetic Oligonucleotide; BTLA exon 2; Set C
agcgguaugacccauugucauuaggaagcacugg

SEQ ID NO: 49428 - RNA, 36 nt, Artificial Sequence
  Synthetic Oligonucleotide; BTLA exon 2; Set C
cagcgguaugacccauugucauuaggaagcacuggu

SEQ ID NO: 49429 - RNA, 26 nt, Artificial Sequence
  Synthetic Oligonucleotide; BTLA exon 2; Set A
guaugacccauugucauuaggaagca

SEQ ID NO: 49430 - RNA, 24 nt, Artificial Sequence
  Synthetic Oligonucleotide; BTLA exon 2; Set B
uaugacccauugucauuaggaagc

SEQ ID NO: 49431 - RNA, 31 nt, Artificial Sequence
  Synthetic Oligonucleotide; BTLA exon 2; Set C
gcgguaugacccauugucauuaggaagcacu

SEQ ID NO: 49432 - RNA, 33 nt, Artificial Sequence
  Synthetic Oligonucleotide; BTLA exon 2; Set C
agcgguaugacccauugucauuaggaagcacug

SEQ ID NO: 49433 - RNA, 35 nt, Artificial Sequence
  Synthetic Oligonucleotide; BTLA exon 2; Set C
cagcgguaugacccauugucauuaggaagcacugg

SEQ ID NO: 49434 - RNA, 29 nt, Artificial Sequence
  Synthetic Oligonucleotide; BTLA exon 2; Set C
cgguaugacccauugucauuaggaagcac

SEQ ID NO: 49435 - RNA, 27 nt, Artificial Sequence
  Synthetic Oligonucleotide; BTLA exon 2; Set A
gguaugacccauugucauuaggaagca

SEQ ID NO: 49436 - RNA, 25 nt, Artificial Sequence
  Synthetic Oligonucleotide; BTLA exon 2; Set B
guaugacccauugucauuaggaagc

SEQ ID NO: 49437 - RNA, 32 nt, Artificial Sequence
  Synthetic Oligonucleotide; BTLA exon 2; Set C
agcgguaugacccauugucauuaggaagcacu

SEQ ID NO: 49438 - RNA, 34 nt, Artificial Sequence
  Synthetic Oligonucleotide; BTLA exon 2; Set C
cagcgguaugacccauugucauuaggaagcacug

SEQ ID NO: 49439 - RNA, 30 nt, Artificial Sequence
  Synthetic Oligonucleotide; BTLA exon 2; Set C
gcgguaugacccauugucauuaggaagcac

SEQ ID NO: 49440 - RNA, 22 nt, Artificial Sequence
  Synthetic Oligonucleotide; BTLA exon 2; Set C
uaugacccauugucauuaggaa

SEQ ID NO: 49441 - RNA, 26 nt, Artificial Sequence
  Synthetic Oligonucleotide; BTLA exon 2; Set B
gguaugacccauugucauuaggaagc

SEQ ID NO: 49442 - RNA, 24 nt, Artificial Sequence
  Synthetic Oligonucleotide; BTLA exon 2; Set C
guaugacccauugucauuaggaag

SEQ ID NO: 49443 - RNA, 33 nt, Artificial Sequence
  Synthetic Oligonucleotide; BTLA exon 2; Set C
cagcgguaugacccauugucauuaggaagcacu

SEQ ID NO: 49444 - RNA, 31 nt, Artificial Sequence
  Synthetic Oligonucleotide; BTLA exon 2; Set C
agcgguaugacccauugucauuaggaagcac

SEQ ID NO: 49445 - RNA, 21 nt, Artificial Sequence
  Synthetic Oligonucleotide; BTLA exon 2; Set C
uaugacccauugucauuagga

SEQ ID NO: 49446 - RNA, 23 nt, Artificial Sequence
  Synthetic Oligonucleotide; BTLA exon 2; Set C
guaugacccauugucauuaggaa

SEQ ID NO: 49447 - RNA, 25 nt, Artificial Sequence
  Synthetic Oligonucleotide; BTLA exon 2; Set B
gguaugacccauugucauuaggaag

SEQ ID NO: 49448 - RNA, 32 nt, Artificial Sequence
  Synthetic Oligonucleotide; BTLA exon 2; Set C
cagcgguaugacccauugucauuaggaagcac

SEQ ID NO: 49449 - RNA, 22 nt, Artificial Sequence
  Synthetic Oligonucleotide; BTLA exon 2; Set C
guaugacccauugucauuagga

SEQ ID NO: 49450 - RNA, 24 nt, Artificial Sequence
  Synthetic Oligonucleotide; BTLA exon 2; Set B
gguaugacccauugucauuaggaa

SEQ ID NO: 49451 - RNA, 23 nt, Artificial Sequence
  Synthetic Oligonucleotide; BTLA exon 2; Set B
gguaugacccauugucauuagga

SEQ ID NO: 49452 - RNA, 23 nt, Artificial Sequence
  Synthetic Oligonucleotide; BTLA exon 2; Set B
cgguaugacccauugucauuagg

SEQ ID NO: 49453 - RNA, 22 nt, Artificial Sequence
  Synthetic Oligonucleotide; BTLA exon 2; Set C
cgguaugacccauugucauuag

SEQ ID NO: 49454 - RNA, 34 nt, Artificial Sequence
  Synthetic Oligonucleotide; BTLA exon 2; Set C
gaacagcgguaugacccauugucauuaggaagca

SEQ ID NO: 49455 - RNA, 21 nt, Artificial Sequence
  Synthetic Oligonucleotide; BTLA exon 2; Set C
cgguaugacccauugucauua

SEQ ID NO: 49456 - RNA, 15 nt, Artificial Sequence
  Synthetic Oligonucleotide; BTLA exon 2; Set C
uaugacccauuguca

SEQ ID NO: 49457 - RNA, 35 nt, Artificial Sequence
  Synthetic Oligonucleotide; BTLA exon 2; Set C
agaacagcgguaugacccauugucauuaggaagca

SEQ ID NO: 49458 - RNA, 33 nt, Artificial Sequence
  Synthetic Oligonucleotide; BTLA exon 2; Set C
gaacagcgguaugacccauugucauuaggaagc

SEQ ID NO: 49459 - RNA, 22 nt, Artificial Sequence
  Synthetic Oligonucleotide; BTLA exon 2; Set B
gcgguaugacccauugucauua

SEQ ID NO: 49460 - RNA, 20 nt, Artificial Sequence
  Synthetic Oligonucleotide; BTLA exon 2; Set C
cgguaugacccauugucauu

SEQ ID NO: 49461 - RNA, 16 nt, Artificial Sequence
  Synthetic Oligonucleotide; BTLA exon 2; Set C
guaugacccauuguca

SEQ ID NO: 49462 - RNA, 36 nt, Artificial Sequence
  Synthetic Oligonucleotide; BTLA exon 2; Set C
cagaacagcgguaugacccauugucauuaggaagca

SEQ ID NO: 49463 - RNA, 34 nt, Artificial Sequence
  Synthetic Oligonucleotide; BTLA exon 2; Set C
agaacagcgguaugacccauugucauuaggaagc

SEQ ID NO: 49464 - RNA, 32 nt, Artificial Sequence
  Synthetic Oligonucleotide; BTLA exon 2; Set C
gaacagcgguaugacccauugucauuaggaag

SEQ ID NO: 49465 - RNA, 23 nt, Artificial Sequence
  Synthetic Oligonucleotide; BTLA exon 2; Set B
agcgguaugacccauugucauua

SEQ ID NO: 49466 - RNA, 21 nt, Artificial Sequence
  Synthetic Oligonucleotide; BTLA exon 2; Set B
gcgguaugacccauugucauu

SEQ ID NO: 49467 - RNA, 27 nt, Artificial Sequence
  Synthetic Oligonucleotide; BTLA exon 2; Set B
acagcgguaugacccauugucauuagg

SEQ ID NO: 49468 - RNA, 17 nt, Artificial Sequence
  Synthetic Oligonucleotide; BTLA exon 2; Set C
gguaugacccauuguca

SEQ ID NO: 49469 - RNA, 31 nt, Artificial Sequence
  Synthetic Oligonucleotide; BTLA exon 2; Set C
gaacagcgguaugacccauugucauuaggaa

SEQ ID NO: 49470 - RNA, 15 nt, Artificial Sequence
  Synthetic Oligonucleotide; BTLA exon 2; Set C
guaugacccauuguc

SEQ ID NO: 49471 - RNA, 37 nt, Artificial Sequence
  Synthetic Oligonucleotide; BTLA exon 2; Set C
gcagaacagcgguaugacccauugucauuaggaagca

SEQ ID NO: 49472 - RNA, 35 nt, Artificial Sequence
  Synthetic Oligonucleotide; BTLA exon 2; Set C
cagaacagcgguaugacccauugucauuaggaagc

SEQ ID NO: 49473 - RNA, 33 nt, Artificial Sequence
  Synthetic Oligonucleotide; BTLA exon 2; Set C
agaacagcgguaugacccauugucauuaggaag

SEQ ID NO: 49474 - RNA, 24 nt, Artificial Sequence
  Synthetic Oligonucleotide; BTLA exon 2; Set B
cagcgguaugacccauugucauua

SEQ ID NO: 49475 - RNA, 22 nt, Artificial Sequence
  Synthetic Oligonucleotide; BTLA exon 2; Set B
agcgguaugacccauugucauu

SEQ ID NO: 49476 - RNA, 26 nt, Artificial Sequence
  Synthetic Oligonucleotide; BTLA exon 2; Set B
acagcgguaugacccauugucauuag

SEQ ID NO: 49477 - RNA, 28 nt, Artificial Sequence
  Synthetic Oligonucleotide; BTLA exon 2; Set B
aacagcgguaugacccauugucauuagg

SEQ ID NO: 49478 - RNA, 30 nt, Artificial Sequence
  Synthetic Oligonucleotide; BTLA exon 2; Set C
gaacagcgguaugacccauugucauuagga

SEQ ID NO: 49479 - RNA, 32 nt, Artificial Sequence
  Synthetic Oligonucleotide; BTLA exon 2; Set C
agaacagcgguaugacccauugucauuaggaa

SEQ ID NO: 49480 - RNA, 16 nt, Artificial Sequence
  Synthetic Oligonucleotide; BTLA exon 2; Set C
gguaugacccauuguc

SEQ ID NO: 49481 - RNA, 38 nt, Artificial Sequence
  Synthetic Oligonucleotide; BTLA exon 2; Set C
ugcagaacagcgguaugacccauugucauuaggaagca

SEQ ID NO: 49482 - RNA, 36 nt, Artificial Sequence
  Synthetic Oligonucleotide; BTLA exon 2; Set C
gcagaacagcgguaugacccauugucauuaggaagc

SEQ ID NO: 49483 - RNA, 34 nt, Artificial Sequence
  Synthetic Oligonucleotide; BTLA exon 2; Set C
cagaacagcgguaugacccauugucauuaggaag

SEQ ID NO: 49484 - RNA, 23 nt, Artificial Sequence
  Synthetic Oligonucleotide; BTLA exon 2; Set B
cagcgguaugacccauugucauu

SEQ ID NO: 49485 - RNA, 27 nt, Artificial Sequence
  Synthetic Oligonucleotide; BTLA exon 2; Set B
aacagcgguaugacccauugucauuag

SEQ ID NO: 49486 - RNA, 15 nt, Artificial Sequence
  Synthetic Oligonucleotide; BTLA exon 2; Set C
gguaugacccauugu

SEQ ID NO: 49487 - RNA, 31 nt, Artificial Sequence
  Synthetic Oligonucleotide; BTLA exon 2; Set C
agaacagcgguaugacccauugucauuagga

SEQ ID NO: 49488 - RNA, 33 nt, Artificial Sequence
  Synthetic Oligonucleotide; BTLA exon 2; Set C
cagaacagcgguaugacccauugucauuaggaa

SEQ ID NO: 49489 - RNA, 39 nt, Artificial Sequence
  Synthetic Oligonucleotide; BTLA exon 2; Set C
uugcagaacagcgguaugacccauugucauuaggaagca

SEQ ID NO: 49490 - RNA, 37 nt, Artificial Sequence
  Synthetic Oligonucleotide; BTLA exon 2; Set C
ugcagaacagcgguaugacccauugucauuaggaagc

SEQ ID NO: 49491 - RNA, 35 nt, Artificial Sequence
  Synthetic Oligonucleotide; BTLA exon 2; Set C
gcagaacagcgguaugacccauugucauuaggaag

SEQ ID NO: 49492 - RNA, 32 nt, Artificial Sequence
  Synthetic Oligonucleotide; BTLA exon 2; Set C
cagaacagcgguaugacccauugucauuagga

SEQ ID NO: 49493 - RNA, 34 nt, Artificial Sequence
  Synthetic Oligonucleotide; BTLA exon 2; Set C
gcagaacagcgguaugacccauugucauuaggaa

SEQ ID NO: 49494 - RNA, 40 nt, Artificial Sequence
  Synthetic Oligonucleotide; BTLA exon 2; Set C
uuugcagaacagcgguaugacccauugucauuaggaagca

SEQ ID NO: 49495 - RNA, 38 nt, Artificial Sequence
  Synthetic Oligonucleotide; BTLA exon 2; Set C
uugcagaacagcgguaugacccauugucauuaggaagc

SEQ ID NO: 49496 - RNA, 36 nt, Artificial Sequence
  Synthetic Oligonucleotide; BTLA exon 2; Set C
ugcagaacagcgguaugacccauugucauuaggaag

SEQ ID NO: 49497 - RNA, 23 nt, Artificial Sequence
  Synthetic Oligonucleotide; BTLA exon 2; Set B
acagcgguaugacccauugucau

SEQ ID NO: 49498 - RNA, 33 nt, Artificial Sequence
  Synthetic Oligonucleotide; BTLA exon 2; Set C
gcagaacagcgguaugacccauugucauuagga

SEQ ID NO: 49499 - RNA, 35 nt, Artificial Sequence
  Synthetic Oligonucleotide; BTLA exon 2; Set C
ugcagaacagcgguaugacccauugucauuaggaa

SEQ ID NO: 49500 - RNA, 39 nt, Artificial Sequence
  Synthetic Oligonucleotide; BTLA exon 2; Set C
uuugcagaacagcgguaugacccauugucauuaggaagc

SEQ ID NO: 49501 - RNA, 37 nt, Artificial Sequence
  Synthetic Oligonucleotide; BTLA exon 2; Set C
uugcagaacagcgguaugacccauugucauuaggaag

SEQ ID NO: 49502 - RNA, 24 nt, Artificial Sequence
  Synthetic Oligonucleotide; BTLA exon 2; Set B
aacagcgguaugacccauugucau

SEQ ID NO: 49503 - RNA, 34 nt, Artificial Sequence
  Synthetic Oligonucleotide; BTLA exon 2; Set C
ugcagaacagcgguaugacccauugucauuagga

SEQ ID NO: 49504 - RNA, 36 nt, Artificial Sequence
  Synthetic Oligonucleotide; BTLA exon 2; Set C
uugcagaacagcgguaugacccauugucauuaggaa

SEQ ID NO: 49505 - RNA, 40 nt, Artificial Sequence
  Synthetic Oligonucleotide; BTLA exon 2; Set C
auuugcagaacagcgguaugacccauugucauuaggaagc

SEQ ID NO: 49506 - RNA, 38 nt, Artificial Sequence
  Synthetic Oligonucleotide; BTLA exon 2; Set C
uuugcagaacagcgguaugacccauugucauuaggaag

SEQ ID NO: 49507 - RNA, 23 nt, Artificial Sequence
  Synthetic Oligonucleotide; BTLA exon 2; Set B
aacagcgguaugacccauuguca

SEQ ID NO: 49508 - RNA, 35 nt, Artificial Sequence
  Synthetic Oligonucleotide; BTLA exon 2; Set C
uugcagaacagcgguaugacccauugucauuagga

SEQ ID NO: 49509 - RNA, 37 nt, Artificial Sequence
  Synthetic Oligonucleotide; BTLA exon 2; Set C
uuugcagaacagcgguaugacccauugucauuaggaa

SEQ ID NO: 49510 - RNA, 39 nt, Artificial Sequence
  Synthetic Oligonucleotide; BTLA exon 2; Set C
auuugcagaacagcgguaugacccauugucauuaggaag

SEQ ID NO: 49511 - RNA, 36 nt, Artificial Sequence
  Synthetic Oligonucleotide; BTLA exon 2; Set C
uuugcagaacagcgguaugacccauugucauuagga

SEQ ID NO: 49512 - RNA, 38 nt, Artificial Sequence
  Synthetic Oligonucleotide; BTLA exon 2; Set C
auuugcagaacagcgguaugacccauugucauuaggaa

SEQ ID NO: 49513 - RNA, 40 nt, Artificial Sequence
  Synthetic Oligonucleotide; BTLA exon 2; Set C
aauuugcagaacagcgguaugacccauugucauuaggaag

SEQ ID NO: 49514 - RNA, 37 nt, Artificial Sequence
  Synthetic Oligonucleotide; BTLA exon 2; Set C
auuugcagaacagcgguaugacccauugucauuagga

SEQ ID NO: 49515 - RNA, 39 nt, Artificial Sequence
  Synthetic Oligonucleotide; BTLA exon 2; Set C
aauuugcagaacagcgguaugacccauugucauuaggaa

SEQ ID NO: 49516 - RNA, 23 nt, Artificial Sequence
  Synthetic Oligonucleotide; BTLA exon 2; Set B
gaacagcgguaugacccauuguc

SEQ ID NO: 49517 - RNA, 18 nt, Artificial Sequence
  Synthetic Oligonucleotide; BTLA exon 2; Set C
acagcgguaugacccauu

SEQ ID NO: 49518 - RNA, 22 nt, Artificial Sequence
  Synthetic Oligonucleotide; BTLA exon 2; Set B
gaacagcgguaugacccauugu

SEQ ID NO: 49519 - RNA, 38 nt, Artificial Sequence
  Synthetic Oligonucleotide; BTLA exon 2; Set C
aauuugcagaacagcgguaugacccauugucauuagga

SEQ ID NO: 49520 - RNA, 40 nt, Artificial Sequence
  Synthetic Oligonucleotide; BTLA exon 2; Set C
aaauuugcagaacagcgguaugacccauugucauuaggaa

SEQ ID NO: 49521 - RNA, 24 nt, Artificial Sequence
  Synthetic Oligonucleotide; BTLA exon 2; Set B
agaacagcgguaugacccauuguc

SEQ ID NO: 49522 - RNA, 17 nt, Artificial Sequence
  Synthetic Oligonucleotide; BTLA exon 2; Set C
acagcgguaugacccau

SEQ ID NO: 49523 - RNA, 23 nt, Artificial Sequence
  Synthetic Oligonucleotide; BTLA exon 2; Set B
agaacagcgguaugacccauugu

SEQ ID NO: 49524 - RNA, 39 nt, Artificial Sequence
  Synthetic Oligonucleotide; BTLA exon 2; Set C
aaauuugcagaacagcgguaugacccauugucauuagga

SEQ ID NO: 49525 - RNA, 21 nt, Artificial Sequence
  Synthetic Oligonucleotide; BTLA exon 2; Set B
gaacagcgguaugacccauug

SEQ ID NO: 49526 - RNA, 25 nt, Artificial Sequence
  Synthetic Oligonucleotide; BTLA exon 2; Set B
cagaacagcgguaugacccauuguc

SEQ ID NO: 49527 - RNA, 18 nt, Artificial Sequence
  Synthetic Oligonucleotide; BTLA exon 2; Set C
aacagcgguaugacccau

SEQ ID NO: 49528 - RNA, 16 nt, Artificial Sequence
  Synthetic Oligonucleotide; BTLA exon 2; Set C
acagcgguaugaccca

SEQ ID NO: 49529 - RNA, 24 nt, Artificial Sequence
  Synthetic Oligonucleotide; BTLA exon 2; Set B
cagaacagcgguaugacccauugu

SEQ ID NO: 49530 - RNA, 40 nt, Artificial Sequence
  Synthetic Oligonucleotide; BTLA exon 2; Set C
aaaauuugcagaacagcgguaugacccauugucauuagga

SEQ ID NO: 49531 - RNA, 22 nt, Artificial Sequence
  Synthetic Oligonucleotide; BTLA exon 2; Set B
agaacagcgguaugacccauug

SEQ ID NO: 49532 - RNA, 26 nt, Artificial Sequence
  Synthetic Oligonucleotide; BTLA exon 2; Set C
gcagaacagcgguaugacccauuguc

SEQ ID NO: 49533 - RNA, 17 nt, Artificial Sequence
  Synthetic Oligonucleotide; BTLA exon 2; Set C
aacagcgguaugaccca

SEQ ID NO: 49534 - RNA, 25 nt, Artificial Sequence
  Synthetic Oligonucleotide; BTLA exon 2; Set C
gcagaacagcgguaugacccauugu

SEQ ID NO: 49535 - RNA, 23 nt, Artificial Sequence
  Synthetic Oligonucleotide; BTLA exon 2; Set B
cagaacagcgguaugacccauug

SEQ ID NO: 49536 - RNA, 27 nt, Artificial Sequence
  Synthetic Oligonucleotide; BTLA exon 2; Set C
ugcagaacagcgguaugacccauuguc

SEQ ID NO: 49537 - RNA, 40 nt, Artificial Sequence
  Synthetic Oligonucleotide; BTLA exon 2; Set C
gaaaauuugcagaacagcgguaugacccauugucauuagg

SEQ ID NO: 49538 - RNA, 26 nt, Artificial Sequence
  Synthetic Oligonucleotide; BTLA exon 2; Set C
ugcagaacagcgguaugacccauugu

SEQ ID NO: 49539 - RNA, 24 nt, Artificial Sequence
  Synthetic Oligonucleotide; BTLA exon 2; Set B
gcagaacagcgguaugacccauug

SEQ ID NO: 49540 - RNA, 28 nt, Artificial Sequence
  Synthetic Oligonucleotide; BTLA exon 2; Set C
uugcagaacagcgguaugacccauuguc

SEQ ID NO: 49541 - RNA, 27 nt, Artificial Sequence
  Synthetic Oligonucleotide; BTLA exon 2; Set C
uugcagaacagcgguaugacccauugu

SEQ ID NO: 49542 - RNA, 25 nt, Artificial Sequence
  Synthetic Oligonucleotide; BTLA exon 2; Set B
ugcagaacagcgguaugacccauug

SEQ ID NO: 49543 - RNA, 29 nt, Artificial Sequence
  Synthetic Oligonucleotide; BTLA exon 2; Set C
uuugcagaacagcgguaugacccauuguc

SEQ ID NO: 49544 - RNA, 40 nt, Artificial Sequence
  Synthetic Oligonucleotide; BTLA exon 2; Set C
ugaaaauuugcagaacagcgguaugacccauugucauuag

SEQ ID NO: 49545 - RNA, 28 nt, Artificial Sequence
  Synthetic Oligonucleotide; BTLA exon 2; Set C
uuugcagaacagcgguaugacccauugu

SEQ ID NO: 49546 - RNA, 26 nt, Artificial Sequence
  Synthetic Oligonucleotide; BTLA exon 2; Set B
uugcagaacagcgguaugacccauug

SEQ ID NO: 49547 - RNA, 30 nt, Artificial Sequence
  Synthetic Oligonucleotide; BTLA exon 2; Set C
auuugcagaacagcgguaugacccauuguc

SEQ ID NO: 49548 - RNA, 29 nt, Artificial Sequence
  Synthetic Oligonucleotide; BTLA exon 2; Set C
auuugcagaacagcgguaugacccauugu

SEQ ID NO: 49549 - RNA, 27 nt, Artificial Sequence
  Synthetic Oligonucleotide; BTLA exon 2; Set B
uuugcagaacagcgguaugacccauug

SEQ ID NO: 49550 - RNA, 31 nt, Artificial Sequence
  Synthetic Oligonucleotide; BTLA exon 2; Set C
aauuugcagaacagcgguaugacccauuguc

SEQ ID NO: 49551 - RNA, 36 nt, Artificial Sequence
  Synthetic Oligonucleotide; BTLA exon 2; Set C
gaaaauuugcagaacagcgguaugacccauugucau

SEQ ID NO: 49552 - RNA, 30 nt, Artificial Sequence
  Synthetic Oligonucleotide; BTLA exon 2; Set C
aauuugcagaacagcgguaugacccauugu

SEQ ID NO: 49553 - RNA, 28 nt, Artificial Sequence
  Synthetic Oligonucleotide; BTLA exon 2; Set B
auuugcagaacagcgguaugacccauug

SEQ ID NO: 49554 - RNA, 32 nt, Artificial Sequence
  Synthetic Oligonucleotide; BTLA exon 2; Set B
aaauuugcagaacagcgguaugacccauuguc

SEQ ID NO: 49555 - RNA, 37 nt, Artificial Sequence
  Synthetic Oligonucleotide; BTLA exon 2; Set C
ugaaaauuugcagaacagcgguaugacccauugucau

SEQ ID NO: 49556 - RNA, 35 nt, Artificial Sequence
  Synthetic Oligonucleotide; BTLA exon 2; Set C
gaaaauuugcagaacagcgguaugacccauuguca

SEQ ID NO: 49557 - RNA, 31 nt, Artificial Sequence
  Synthetic Oligonucleotide; BTLA exon 2; Set B
aaauuugcagaacagcgguaugacccauugu

SEQ ID NO: 49558 - RNA, 29 nt, Artificial Sequence
  Synthetic Oligonucleotide; BTLA exon 2; Set B
aauuugcagaacagcgguaugacccauug

SEQ ID NO: 49559 - RNA, 33 nt, Artificial Sequence
  Synthetic Oligonucleotide; BTLA exon 2; Set B
aaaauuugcagaacagcgguaugacccauuguc

SEQ ID NO: 49560 - RNA, 40 nt, Artificial Sequence
  Synthetic Oligonucleotide; BTLA exon 2; Set C
acugaaaauuugcagaacagcgguaugacccauugucauu

SEQ ID NO: 49561 - RNA, 30 nt, Artificial Sequence
  Synthetic Oligonucleotide; BTLA exon 2; Set B
aaauuugcagaacagcgguaugacccauug

SEQ ID NO: 49562 - RNA, 31 nt, Artificial Sequence
  Synthetic Oligonucleotide; BTLA exon 2; Set B
aaaauuugcagaacagcgguaugacccauug

SEQ ID NO: 49563 - RNA, 15 nt, Artificial Sequence
  Synthetic Oligonucleotide; BTLA exon 2; Set C
cagaacagcgguaug

SEQ ID NO: 49564 - RNA, 16 nt, Artificial Sequence
  Synthetic Oligonucleotide; BTLA exon 2; Set C
gcagaacagcgguaug

SEQ ID NO: 49565 - RNA, 17 nt, Artificial Sequence
  Synthetic Oligonucleotide; BTLA exon 2; Set C
ugcagaacagcgguaug

SEQ ID NO: 49566 - RNA, 18 nt, Artificial Sequence
  Synthetic Oligonucleotide; BTLA exon 2; Set C
uugcagaacagcgguaug

SEQ ID NO: 49567 - RNA, 33 nt, Artificial Sequence
  Synthetic Oligonucleotide; BTLA exon 2; Set B
cugaaaauuugcagaacagcgguaugacccauu

SEQ ID NO: 49568 - RNA, 31 nt, Artificial Sequence
  Synthetic Oligonucleotide; BTLA exon 2; Set B
ugaaaauuugcagaacagcgguaugacccau

SEQ ID NO: 49569 - RNA, 29 nt, Artificial Sequence
  Synthetic Oligonucleotide; BTLA exon 2; Set B
gaaaauuugcagaacagcgguaugaccca

SEQ ID NO: 49570 - RNA, 19 nt, Artificial Sequence
  Synthetic Oligonucleotide; BTLA exon 2; Set C
uuugcagaacagcgguaug

SEQ ID NO: 49571 - RNA, 34 nt, Artificial Sequence
  Synthetic Oligonucleotide; BTLA exon 2; Set C
acugaaaauuugcagaacagcgguaugacccauu

SEQ ID NO: 49572 - RNA, 32 nt, Artificial Sequence
  Synthetic Oligonucleotide; BTLA exon 2; Set B
cugaaaauuugcagaacagcgguaugacccau

SEQ ID NO: 49573 - RNA, 30 nt, Artificial Sequence
  Synthetic Oligonucleotide; BTLA exon 2; Set B
ugaaaauuugcagaacagcgguaugaccca

SEQ ID NO: 49574 - RNA, 40 nt, Artificial Sequence
  Synthetic Oligonucleotide; BTLA exon 2; Set C
uagacugaaaauuugcagaacagcgguaugacccauuguc

SEQ ID NO: 49575 - RNA, 20 nt, Artificial Sequence
  Synthetic Oligonucleotide; BTLA exon 2; Set C
auuugcagaacagcgguaug

SEQ ID NO: 49576 - RNA, 35 nt, Artificial Sequence
  Synthetic Oligonucleotide; BTLA exon 2; Set C
gacugaaaauuugcagaacagcgguaugacccauu

SEQ ID NO: 49577 - RNA, 33 nt, Artificial Sequence
  Synthetic Oligonucleotide; BTLA exon 2; Set C
acugaaaauuugcagaacagcgguaugacccau

SEQ ID NO: 49578 - RNA, 31 nt, Artificial Sequence
  Synthetic Oligonucleotide; BTLA exon 2; Set B
cugaaaauuugcagaacagcgguaugaccca

SEQ ID NO: 49579 - RNA, 39 nt, Artificial Sequence
  Synthetic Oligonucleotide; BTLA exon 2; Set C
uagacugaaaauuugcagaacagcgguaugacccauugu

SEQ ID NO: 49580 - RNA, 21 nt, Artificial Sequence
  Synthetic Oligonucleotide; BTLA exon 2; Set C
aauuugcagaacagcgguaug

SEQ ID NO: 49581 - RNA, 36 nt, Artificial Sequence
  Synthetic Oligonucleotide; BTLA exon 2; Set C
agacugaaaauuugcagaacagcgguaugacccauu

SEQ ID NO: 49582 - RNA, 34 nt, Artificial Sequence
  Synthetic Oligonucleotide; BTLA exon 2; Set C
gacugaaaauuugcagaacagcgguaugacccau

SEQ ID NO: 49583 - RNA, 32 nt, Artificial Sequence
  Synthetic Oligonucleotide; BTLA exon 2; Set C
acugaaaauuugcagaacagcgguaugaccca

SEQ ID NO: 49584 - RNA, 40 nt, Artificial Sequence
  Synthetic Oligonucleotide; BTLA exon 2; Set C
uuagacugaaaauuugcagaacagcgguaugacccauugu

SEQ ID NO: 49585 - RNA, 38 nt, Artificial Sequence
  Synthetic Oligonucleotide; BTLA exon 2; Set C
uagacugaaaauuugcagaacagcgguaugacccauug

SEQ ID NO: 49586 - RNA, 22 nt, Artificial Sequence
  Synthetic Oligonucleotide; BTLA exon 2; Set C
aaauuugcagaacagcgguaug

SEQ ID NO: 49587 - RNA, 35 nt, Artificial Sequence
  Synthetic Oligonucleotide; BTLA exon 2; Set C
agacugaaaauuugcagaacagcgguaugacccau

SEQ ID NO: 49588 - RNA, 33 nt, Artificial Sequence
  Synthetic Oligonucleotide; BTLA exon 2; Set C
gacugaaaauuugcagaacagcgguaugaccca

SEQ ID NO: 49589 - RNA, 39 nt, Artificial Sequence
  Synthetic Oligonucleotide; BTLA exon 2; Set C
uuagacugaaaauuugcagaacagcgguaugacccauug

SEQ ID NO: 49590 - RNA, 23 nt, Artificial Sequence
  Synthetic Oligonucleotide; BTLA exon 2; Set C
aaaauuugcagaacagcgguaug

SEQ ID NO: 49591 - RNA, 34 nt, Artificial Sequence
  Synthetic Oligonucleotide; BTLA exon 2; Set C
agacugaaaauuugcagaacagcgguaugaccca

SEQ ID NO: 49592 - RNA, 40 nt, Artificial Sequence
  Synthetic Oligonucleotide; BTLA exon 2; Set C
auuagacugaaaauuugcagaacagcgguaugacccauug

SEQ ID NO: 49593 - RNA, 20 nt, Artificial Sequence
  Synthetic Oligonucleotide; BTLA exon 2; Set C
gaaaauuugcagaacagcgg

SEQ ID NO: 49594 - RNA, 21 nt, Artificial Sequence
  Synthetic Oligonucleotide; BTLA exon 2; Set C
ugaaaauuugcagaacagcgg

SEQ ID NO: 49595 - RNA, 19 nt, Artificial Sequence
  Synthetic Oligonucleotide; BTLA exon 2; Set C
gaaaauuugcagaacagcg

SEQ ID NO: 49596 - RNA, 22 nt, Artificial Sequence
  Synthetic Oligonucleotide; BTLA exon 2; Set C
cugaaaauuugcagaacagcgg

SEQ ID NO: 49597 - RNA, 20 nt, Artificial Sequence
  Synthetic Oligonucleotide; BTLA exon 2; Set C
ugaaaauuugcagaacagcg

SEQ ID NO: 49598 - RNA, 18 nt, Artificial Sequence
  Synthetic Oligonucleotide; BTLA exon 2; Set C
gaaaauuugcagaacagc

SEQ ID NO: 49599 - RNA, 30 nt, Artificial Sequence
  Synthetic Oligonucleotide; BTLA exon 2; Set B
uagacugaaaauuugcagaacagcgguaug

SEQ ID NO: 49600 - RNA, 17 nt, Artificial Sequence
  Synthetic Oligonucleotide; BTLA exon 2; Set C
gaaaauuugcagaacag

SEQ ID NO: 49601 - RNA, 31 nt, Artificial Sequence
  Synthetic Oligonucleotide; BTLA exon 2; Set B
uuagacugaaaauuugcagaacagcgguaug

SEQ ID NO: 49602 - RNA, 32 nt, Artificial Sequence
  Synthetic Oligonucleotide; BTLA exon 2; Set B
auuagacugaaaauuugcagaacagcgguaug

SEQ ID NO: 49603 - RNA, 25 nt, Artificial Sequence
  Synthetic Oligonucleotide; BTLA exon 2; Set C
agacugaaaauuugcagaacagcgg

SEQ ID NO: 49604 - RNA, 33 nt, Artificial Sequence
  Synthetic Oligonucleotide; BTLA exon 2; Set B
gauuagacugaaaauuugcagaacagcgguaug

SEQ ID NO: 49605 - RNA, 18 nt, Artificial Sequence
  Synthetic Oligonucleotide; BTLA exon 2; Set C
cugaaaauuugcagaaca

SEQ ID NO: 49606 - RNA, 34 nt, Artificial Sequence
  Synthetic Oligonucleotide; BTLA exon 2; Set B
agauuagacugaaaauuugcagaacagcgguaug

SEQ ID NO: 49607 - RNA, 17 nt, Artificial Sequence
  Synthetic Oligonucleotide; BTLA exon 2; Set C
cugaaaauuugcagaac

SEQ ID NO: 49608 - RNA, 19 nt, Artificial Sequence
  Synthetic Oligonucleotide; BTLA exon 2; Set C
acugaaaauuugcagaaca

SEQ ID NO: 49609 - RNA, 35 nt, Artificial Sequence
  Synthetic Oligonucleotide; BTLA exon 2; Set B
gagauuagacugaaaauuugcagaacagcgguaug

SEQ ID NO: 49610 - RNA, 18 nt, Artificial Sequence
  Synthetic Oligonucleotide; BTLA exon 2; Set C
acugaaaauuugcagaac

SEQ ID NO: 49611 - RNA, 20 nt, Artificial Sequence
  Synthetic Oligonucleotide; BTLA exon 2; Set C
gacugaaaauuugcagaaca

SEQ ID NO: 49612 - RNA, 19 nt, Artificial Sequence
  Synthetic Oligonucleotide; BTLA exon 2; Set C
gacugaaaauuugcagaac

SEQ ID NO: 49613 - RNA, 21 nt, Artificial Sequence
  Synthetic Oligonucleotide; BTLA exon 2; Set C
agacugaaaauuugcagaaca

SEQ ID NO: 49614 - RNA, 20 nt, Artificial Sequence
  Synthetic Oligonucleotide; BTLA exon 2; Set C
agacugaaaauuugcagaac

SEQ ID NO: 49615 - RNA, 27 nt, Artificial Sequence
  Synthetic Oligonucleotide; BTLA exon 2; Set C
gauuagacugaaaauuugcagaacagc

SEQ ID NO: 49616 - RNA, 32 nt, Artificial Sequence
  Synthetic Oligonucleotide; BTLA exon 2; Set B
ugagauuagacugaaaauuugcagaacagcgg

SEQ ID NO: 49617 - RNA, 28 nt, Artificial Sequence
  Synthetic Oligonucleotide; BTLA exon 2; Set C
agauuagacugaaaauuugcagaacagc

SEQ ID NO: 49618 - RNA, 26 nt, Artificial Sequence
  Synthetic Oligonucleotide; BTLA exon 2; Set C
gauuagacugaaaauuugcagaacag

SEQ ID NO: 49619 - RNA, 31 nt, Artificial Sequence
  Synthetic Oligonucleotide; BTLA exon 2; Set B
ugagauuagacugaaaauuugcagaacagcg

SEQ ID NO: 49620 - RNA, 29 nt, Artificial Sequence
  Synthetic Oligonucleotide; BTLA exon 2; Set C
gagauuagacugaaaauuugcagaacagc

SEQ ID NO: 49621 - RNA, 27 nt, Artificial Sequence
  Synthetic Oligonucleotide; BTLA exon 2; Set C
agauuagacugaaaauuugcagaacag

SEQ ID NO: 49622 - RNA, 40 nt, Artificial Sequence
  Synthetic Oligonucleotide; BTLA exon 2; Set B
uucaaugagauuagacugaaaauuugcagaacagcgguau

SEQ ID NO: 49623 - RNA, 30 nt, Artificial Sequence
  Synthetic Oligonucleotide; BTLA exon 2; Set B
ugagauuagacugaaaauuugcagaacagc

SEQ ID NO: 49624 - RNA, 28 nt, Artificial Sequence
  Synthetic Oligonucleotide; BTLA exon 2; Set C
gagauuagacugaaaauuugcagaacag

SEQ ID NO: 49625 - RNA, 39 nt, Artificial Sequence
  Synthetic Oligonucleotide; BTLA exon 2; Set B
uucaaugagauuagacugaaaauuugcagaacagcggua

SEQ ID NO: 49626 - RNA, 29 nt, Artificial Sequence
  Synthetic Oligonucleotide; BTLA exon 2; Set C
ugagauuagacugaaaauuugcagaacag

SEQ ID NO: 49627 - RNA, 40 nt, Artificial Sequence
  Synthetic Oligonucleotide; BTLA exon 2; Set B
uuucaaugagauuagacugaaaauuugcagaacagcggua

SEQ ID NO: 49628 - RNA, 39 nt, Artificial Sequence
  Synthetic Oligonucleotide; BTLA exon 2; Set B
uuucaaugagauuagacugaaaauuugcagaacagcggu

SEQ ID NO: 49629 - RNA, 40 nt, Artificial Sequence
  Synthetic Oligonucleotide; BTLA exon 2; Set B
cuuucaaugagauuagacugaaaauuugcagaacagcggu

SEQ ID NO: 49630 - RNA, 31 nt, Artificial Sequence
  Synthetic Oligonucleotide; BTLA exon 2; Set C
uucaaugagauuagacugaaaauuugcagaa

SEQ ID NO: 49631 - RNA, 32 nt, Artificial Sequence
  Synthetic Oligonucleotide; BTLA exon 2; Set C
uuucaaugagauuagacugaaaauuugcagaa

SEQ ID NO: 49632 - RNA, 33 nt, Artificial Sequence
  Synthetic Oligonucleotide; BTLA exon 2; Set C
cuuucaaugagauuagacugaaaauuugcagaa

SEQ ID NO: 49633 - RNA, 31 nt, Artificial Sequence
  Synthetic Oligonucleotide; BTLA exon 2; Set C
uuucaaugagauuagacugaaaauuugcaga

SEQ ID NO: 49634 - RNA, 32 nt, Artificial Sequence
  Synthetic Oligonucleotide; BTLA exon 2; Set C
cuuucaaugagauuagacugaaaauuugcaga

SEQ ID NO: 49635 - RNA, 30 nt, Artificial Sequence
  Synthetic Oligonucleotide; BTLA exon 2; Set C
uuucaaugagauuagacugaaaauuugcag

SEQ ID NO: 49636 - RNA, 31 nt, Artificial Sequence
  Synthetic Oligonucleotide; BTLA exon 2; Set C
cuuucaaugagauuagacugaaaauuugcag

SEQ ID NO: 49637 - RNA, 29 nt, Artificial Sequence
  Synthetic Oligonucleotide; BTLA exon 2; Set C
uuucaaugagauuagacugaaaauuugca

SEQ ID NO: 49638 - RNA, 36 nt, Artificial Sequence
  Synthetic Oligonucleotide; BTLA exon 2; Set B
uggcuuucaaugagauuagacugaaaauuugcagaa

SEQ ID NO: 49639 - RNA, 30 nt, Artificial Sequence
  Synthetic Oligonucleotide; BTLA exon 2; Set C
cuuucaaugagauuagacugaaaauuugca

SEQ ID NO: 49640 - RNA, 28 nt, Artificial Sequence
  Synthetic Oligonucleotide; BTLA exon 2; Set C
uuucaaugagauuagacugaaaauuugc

SEQ ID NO: 49641 - RNA, 40 nt, Artificial Sequence
  Synthetic Oligonucleotide; BTLA exon 2; Set B
aguggcuuucaaugagauuagacugaaaauuugcagaaca

SEQ ID NO: 49642 - RNA, 37 nt, Artificial Sequence
  Synthetic Oligonucleotide; BTLA exon 2; Set B
guggcuuucaaugagauuagacugaaaauuugcagaa

SEQ ID NO: 49643 - RNA, 35 nt, Artificial Sequence
  Synthetic Oligonucleotide; BTLA exon 2; Set B
uggcuuucaaugagauuagacugaaaauuugcaga

SEQ ID NO: 49644 - RNA, 27 nt, Artificial Sequence
  Synthetic Oligonucleotide; BTLA exon 2; Set C
uuucaaugagauuagacugaaaauuug

SEQ ID NO: 49645 - RNA, 29 nt, Artificial Sequence
  Synthetic Oligonucleotide; BTLA exon 2; Set C
cuuucaaugagauuagacugaaaauuugc

SEQ ID NO: 49646 - RNA, 39 nt, Artificial Sequence
  Synthetic Oligonucleotide; BTLA exon 2; Set B
aguggcuuucaaugagauuagacugaaaauuugcagaac

SEQ ID NO: 49647 - RNA, 15 nt, Artificial Sequence
  Synthetic Oligonucleotide; BTLA exon 2; Set C
ugagauuagacugaa

SEQ ID NO: 49648 - RNA, 26 nt, Artificial Sequence
  Synthetic Oligonucleotide; BTLA exon 2; Set C
uuucaaugagauuagacugaaaauuu

SEQ ID NO: 49649 - RNA, 36 nt, Artificial Sequence
  Synthetic Oligonucleotide; BTLA exon 2; Set B
guggcuuucaaugagauuagacugaaaauuugcaga

SEQ ID NO: 49650 - RNA, 28 nt, Artificial Sequence
  Synthetic Oligonucleotide; BTLA exon 2; Set C
cuuucaaugagauuagacugaaaauuug

SEQ ID NO: 49651 - RNA, 34 nt, Artificial Sequence
  Synthetic Oligonucleotide; BTLA exon 2; Set B
uggcuuucaaugagauuagacugaaaauuugcag

SEQ ID NO: 49652 - RNA, 40 nt, Artificial Sequence
  Synthetic Oligonucleotide; BTLA exon 2; Set B
gaguggcuuucaaugagauuagacugaaaauuugcagaac

SEQ ID NO: 49653 - RNA, 27 nt, Artificial Sequence
  Synthetic Oligonucleotide; BTLA exon 2; Set C
cuuucaaugagauuagacugaaaauuu

SEQ ID NO: 49654 - RNA, 25 nt, Artificial Sequence
  Synthetic Oligonucleotide; BTLA exon 2; Set C
uuucaaugagauuagacugaaaauu

SEQ ID NO: 49655 - RNA, 35 nt, Artificial Sequence
  Synthetic Oligonucleotide; BTLA exon 2; Set B
guggcuuucaaugagauuagacugaaaauuugcag

SEQ ID NO: 49656 - RNA, 33 nt, Artificial Sequence
  Synthetic Oligonucleotide; BTLA exon 2; Set B
uggcuuucaaugagauuagacugaaaauuugca

SEQ ID NO: 49657 - RNA, 26 nt, Artificial Sequence
  Synthetic Oligonucleotide; BTLA exon 2; Set C
cuuucaaugagauuagacugaaaauu

SEQ ID NO: 49658 - RNA, 24 nt, Artificial Sequence
  Synthetic Oligonucleotide; BTLA exon 2; Set C
uuucaaugagauuagacugaaaau

SEQ ID NO: 49659 - RNA, 36 nt, Artificial Sequence
  Synthetic Oligonucleotide; BTLA exon 2; Set B
aguggcuuucaaugagauuagacugaaaauuugcag

SEQ ID NO: 49660 - RNA, 34 nt, Artificial Sequence
  Synthetic Oligonucleotide; BTLA exon 2; Set B
guggcuuucaaugagauuagacugaaaauuugca

SEQ ID NO: 49661 - RNA, 32 nt, Artificial Sequence
  Synthetic Oligonucleotide; BTLA exon 2; Set B
uggcuuucaaugagauuagacugaaaauuugc

SEQ ID NO: 49662 - RNA, 25 nt, Artificial Sequence
  Synthetic Oligonucleotide; BTLA exon 2; Set C
cuuucaaugagauuagacugaaaau

SEQ ID NO: 49663 - RNA, 23 nt, Artificial Sequence
  Synthetic Oligonucleotide; BTLA exon 2; Set C
uuucaaugagauuagacugaaaa

SEQ ID NO: 49664 - RNA, 31 nt, Artificial Sequence
  Synthetic Oligonucleotide; BTLA exon 2; Set C
uggcuuucaaugagauuagacugaaaauuug

SEQ ID NO: 49665 - RNA, 35 nt, Artificial Sequence
  Synthetic Oligonucleotide; BTLA exon 2; Set B
aguggcuuucaaugagauuagacugaaaauuugca

SEQ ID NO: 49666 - RNA, 37 nt, Artificial Sequence
  Synthetic Oligonucleotide; BTLA exon 2; Set B
gaguggcuuucaaugagauuagacugaaaauuugcag

SEQ ID NO: 49667 - RNA, 33 nt, Artificial Sequence
  Synthetic Oligonucleotide; BTLA exon 2; Set B
guggcuuucaaugagauuagacugaaaauuugc

SEQ ID NO: 49668 - RNA, 30 nt, Artificial Sequence
  Synthetic Oligonucleotide; BTLA exon 2; Set C
uggcuuucaaugagauuagacugaaaauuu

SEQ ID NO: 49669 - RNA, 24 nt, Artificial Sequence
  Synthetic Oligonucleotide; BTLA exon 2; Set C
cuuucaaugagauuagacugaaaa

SEQ ID NO: 49670 - RNA, 22 nt, Artificial Sequence
  Synthetic Oligonucleotide; BTLA exon 2; Set C
uuucaaugagauuagacugaaa

SEQ ID NO: 49671 - RNA, 32 nt, Artificial Sequence
  Synthetic Oligonucleotide; BTLA exon 2; Set C
guggcuuucaaugagauuagacugaaaauuug

SEQ ID NO: 49672 - RNA, 34 nt, Artificial Sequence
  Synthetic Oligonucleotide; BTLA exon 2; Set B
aguggcuuucaaugagauuagacugaaaauuugc

SEQ ID NO: 49673 - RNA, 36 nt, Artificial Sequence
  Synthetic Oligonucleotide; BTLA exon 2; Set B
gaguggcuuucaaugagauuagacugaaaauuugca

SEQ ID NO: 49674 - RNA, 31 nt, Artificial Sequence
  Synthetic Oligonucleotide; BTLA exon 2; Set C
guggcuuucaaugagauuagacugaaaauuu

SEQ ID NO: 49675 - RNA, 29 nt, Artificial Sequence
  Synthetic Oligonucleotide; BTLA exon 2; Set C
uggcuuucaaugagauuagacugaaaauu

SEQ ID NO: 49676 - RNA, 23 nt, Artificial Sequence
  Synthetic Oligonucleotide; BTLA exon 2; Set C
cuuucaaugagauuagacugaaa

SEQ ID NO: 49677 - RNA, 33 nt, Artificial Sequence
  Synthetic Oligonucleotide; BTLA exon 2; Set C
aguggcuuucaaugagauuagacugaaaauuug

SEQ ID NO: 49678 - RNA, 35 nt, Artificial Sequence
  Synthetic Oligonucleotide; BTLA exon 2; Set B
gaguggcuuucaaugagauuagacugaaaauuugc

SEQ ID NO: 49679 - RNA, 30 nt, Artificial Sequence
  Synthetic Oligonucleotide; BTLA exon 2; Set C
guggcuuucaaugagauuagacugaaaauu

SEQ ID NO: 49680 - RNA, 28 nt, Artificial Sequence
  Synthetic Oligonucleotide; BTLA exon 2; Set C
uggcuuucaaugagauuagacugaaaau

SEQ ID NO: 49681 - RNA, 34 nt, Artificial Sequence
  Synthetic Oligonucleotide; BTLA exon 2; Set B
gaguggcuuucaaugagauuagacugaaaauuug

SEQ ID NO: 49682 - RNA, 33 nt, Artificial Sequence
  Synthetic Oligonucleotide; BTLA exon 2; Set B
gaguggcuuucaaugagauuagacugaaaauuu

SEQ ID NO: 49683 - RNA, 31 nt, Artificial Sequence
  Synthetic Oligonucleotide; BTLA exon 2; Set C
aguggcuuucaaugagauuagacugaaaauu

SEQ ID NO: 49684 - RNA, 29 nt, Artificial Sequence
  Synthetic Oligonucleotide; BTLA exon 2; Set C
guggcuuucaaugagauuagacugaaaau

SEQ ID NO: 49685 - RNA, 32 nt, Artificial Sequence
  Synthetic Oligonucleotide; BTLA exon 2; Set B
gaguggcuuucaaugagauuagacugaaaauu

SEQ ID NO: 49686 - RNA, 30 nt, Artificial Sequence
  Synthetic Oligonucleotide; BTLA exon 2; Set C
aguggcuuucaaugagauuagacugaaaau

SEQ ID NO: 49687 - RNA, 28 nt, Artificial Sequence
  Synthetic Oligonucleotide; BTLA exon 2; Set C
guggcuuucaaugagauuagacugaaaa

SEQ ID NO: 49688 - RNA, 29 nt, Artificial Sequence
  Synthetic Oligonucleotide; BTLA exon 2; Set C
aguggcuuucaaugagauuagacugaaaa

SEQ ID NO: 49689 - RNA, 31 nt, Artificial Sequence
  Synthetic Oligonucleotide; BTLA exon 2; Set B
gaguggcuuucaaugagauuagacugaaaau

SEQ ID NO: 49690 - RNA, 27 nt, Artificial Sequence
  Synthetic Oligonucleotide; BTLA exon 2; Set C
guggcuuucaaugagauuagacugaaa

SEQ ID NO: 49691 - RNA, 28 nt, Artificial Sequence
  Synthetic Oligonucleotide; BTLA exon 2; Set C
aguggcuuucaaugagauuagacugaaa

SEQ ID NO: 49692 - RNA, 30 nt, Artificial Sequence
  Synthetic Oligonucleotide; BTLA exon 2; Set B
gaguggcuuucaaugagauuagacugaaaa

SEQ ID NO: 49693 - RNA, 31 nt, Artificial Sequence
  Synthetic Oligonucleotide; BTLA exon 2; Set B
ugaguggcuuucaaugagauuagacugaaaa

SEQ ID NO: 49694 - RNA, 29 nt, Artificial Sequence
  Synthetic Oligonucleotide; BTLA exon 2; Set B
gaguggcuuucaaugagauuagacugaaa

SEQ ID NO: 49695 - RNA, 15 nt, Artificial Sequence
  Synthetic Oligonucleotide; BTLA exon 2; Set C
uuucaaugagauuag

SEQ ID NO: 49696 - RNA, 30 nt, Artificial Sequence
  Synthetic Oligonucleotide; BTLA exon 2; Set B
ugaguggcuuucaaugagauuagacugaaa

SEQ ID NO: 49697 - RNA, 16 nt, Artificial Sequence
  Synthetic Oligonucleotide; BTLA exon 2; Set C
cuuucaaugagauuag

SEQ ID NO: 49698 - RNA, 15 nt, Artificial Sequence
  Synthetic Oligonucleotide; BTLA exon 2; Set C
cuuucaaugagauua

SEQ ID NO: 49699 - RNA, 30 nt, Artificial Sequence
  Synthetic Oligonucleotide; BTLA exon 2; Set B
uugaguggcuuucaaugagauuagacugaa

SEQ ID NO: 49700 - RNA, 29 nt, Artificial Sequence
  Synthetic Oligonucleotide; BTLA exon 2; Set B
uugaguggcuuucaaugagauuagacuga

SEQ ID NO: 49701 - RNA, 20 nt, Artificial Sequence
  Synthetic Oligonucleotide; BTLA exon 2; Set C
guggcuuucaaugagauuag

SEQ ID NO: 49702 - RNA, 28 nt, Artificial Sequence
  Synthetic Oligonucleotide; BTLA exon 2; Set B
uugaguggcuuucaaugagauuagacug

SEQ ID NO: 49703 - RNA, 19 nt, Artificial Sequence
  Synthetic Oligonucleotide; BTLA exon 2; Set C
guggcuuucaaugagauua

SEQ ID NO: 49704 - RNA, 21 nt, Artificial Sequence
  Synthetic Oligonucleotide; BTLA exon 2; Set C
aguggcuuucaaugagauuag

SEQ ID NO: 49705 - RNA, 29 nt, Artificial Sequence
  Synthetic Oligonucleotide; BTLA exon 2; Set B
guugaguggcuuucaaugagauuagacug

SEQ ID NO: 49706 - RNA, 18 nt, Artificial Sequence
  Synthetic Oligonucleotide; BTLA exon 2; Set C
guggcuuucaaugagauu

SEQ ID NO: 49707 - RNA, 20 nt, Artificial Sequence
  Synthetic Oligonucleotide; BTLA exon 2; Set C
aguggcuuucaaugagauua

SEQ ID NO: 49708 - RNA, 22 nt, Artificial Sequence
  Synthetic Oligonucleotide; BTLA exon 2; Set C
gaguggcuuucaaugagauuag

SEQ ID NO: 49709 - RNA, 30 nt, Artificial Sequence
  Synthetic Oligonucleotide; BTLA exon 2; Set B
uguugaguggcuuucaaugagauuagacug

SEQ ID NO: 49710 - RNA, 28 nt, Artificial Sequence
  Synthetic Oligonucleotide; BTLA exon 2; Set B
guugaguggcuuucaaugagauuagacu

SEQ ID NO: 49711 - RNA, 19 nt, Artificial Sequence
  Synthetic Oligonucleotide; BTLA exon 2; Set C
aguggcuuucaaugagauu

SEQ ID NO: 49712 - RNA, 21 nt, Artificial Sequence
  Synthetic Oligonucleotide; BTLA exon 2; Set C
gaguggcuuucaaugagauua

SEQ ID NO: 49713 - RNA, 23 nt, Artificial Sequence
  Synthetic Oligonucleotide; BTLA exon 2; Set C
ugaguggcuuucaaugagauuag

SEQ ID NO: 49714 - RNA, 25 nt, Artificial Sequence
  Synthetic Oligonucleotide; BTLA exon 2; Set C
uugaguggcuuucaaugagauuaga

SEQ ID NO: 49715 - RNA, 31 nt, Artificial Sequence
  Synthetic Oligonucleotide; BTLA exon 2; Set B
uuguugaguggcuuucaaugagauuagacug

SEQ ID NO: 49716 - RNA, 29 nt, Artificial Sequence
  Synthetic Oligonucleotide; BTLA exon 2; Set B
uguugaguggcuuucaaugagauuagacu

SEQ ID NO: 49717 - RNA, 27 nt, Artificial Sequence
  Synthetic Oligonucleotide; BTLA exon 2; Set B
guugaguggcuuucaaugagauuagac

SEQ ID NO: 49718 - RNA, 20 nt, Artificial Sequence
  Synthetic Oligonucleotide; BTLA exon 2; Set C
gaguggcuuucaaugagauu

SEQ ID NO: 49719 - RNA, 22 nt, Artificial Sequence
  Synthetic Oligonucleotide; BTLA exon 2; Set C
ugaguggcuuucaaugagauua

SEQ ID NO: 49720 - RNA, 18 nt, Artificial Sequence
  Synthetic Oligonucleotide; BTLA exon 2; Set C
aguggcuuucaaugagau

SEQ ID NO: 49721 - RNA, 32 nt, Artificial Sequence
  Synthetic Oligonucleotide; BTLA exon 2; Set B
guuguugaguggcuuucaaugagauuagacug

SEQ ID NO: 49722 - RNA, 30 nt, Artificial Sequence
  Synthetic Oligonucleotide; BTLA exon 2; Set B
uuguugaguggcuuucaaugagauuagacu

SEQ ID NO: 49723 - RNA, 28 nt, Artificial Sequence
  Synthetic Oligonucleotide; BTLA exon 2; Set B
uguugaguggcuuucaaugagauuagac

SEQ ID NO: 49724 - RNA, 21 nt, Artificial Sequence
  Synthetic Oligonucleotide; BTLA exon 2; Set C
ugaguggcuuucaaugagauu

SEQ ID NO: 49725 - RNA, 19 nt, Artificial Sequence
  Synthetic Oligonucleotide; BTLA exon 2; Set C
gaguggcuuucaaugagau

SEQ ID NO: 49726 - RNA, 31 nt, Artificial Sequence
  Synthetic Oligonucleotide; BTLA exon 2; Set B
guuguugaguggcuuucaaugagauuagacu

SEQ ID NO: 49727 - RNA, 29 nt, Artificial Sequence
  Synthetic Oligonucleotide; BTLA exon 2; Set B
uuguugaguggcuuucaaugagauuagac

SEQ ID NO: 49728 - RNA, 20 nt, Artificial Sequence
  Synthetic Oligonucleotide; BTLA exon 2; Set C
ugaguggcuuucaaugagau

SEQ ID NO: 49729 - RNA, 32 nt, Artificial Sequence
  Synthetic Oligonucleotide; BTLA exon 2; Set B
aguuguugaguggcuuucaaugagauuagacu

SEQ ID NO: 49730 - RNA, 30 nt, Artificial Sequence
  Synthetic Oligonucleotide; BTLA exon 2; Set B
guuguugaguggcuuucaaugagauuagac

SEQ ID NO: 49731 - RNA, 19 nt, Artificial Sequence
  Synthetic Oligonucleotide; BTLA exon 2; Set C
ugaguggcuuucaaugaga

SEQ ID NO: 49732 - RNA, 33 nt, Artificial Sequence
  Synthetic Oligonucleotide; BTLA exon 2; Set B
gaguuguugaguggcuuucaaugagauuagacu

SEQ ID NO: 49733 - RNA, 31 nt, Artificial Sequence
  Synthetic Oligonucleotide; BTLA exon 2; Set B
aguuguugaguggcuuucaaugagauuagac

SEQ ID NO: 49734 - RNA, 18 nt, Artificial Sequence
  Synthetic Oligonucleotide; BTLA exon 2; Set C
ugaguggcuuucaaugag

SEQ ID NO: 49735 - RNA, 34 nt, Artificial Sequence
  Synthetic Oligonucleotide; BTLA exon 2; Set B
agaguuguugaguggcuuucaaugagauuagacu

SEQ ID NO: 49736 - RNA, 32 nt, Artificial Sequence
  Synthetic Oligonucleotide; BTLA exon 2; Set B
gaguuguugaguggcuuucaaugagauuagac

SEQ ID NO: 49737 - RNA, 19 nt, Artificial Sequence
  Synthetic Oligonucleotide; BTLA exon 2; Set C
uugaguggcuuucaaugag

SEQ ID NO: 49738 - RNA, 33 nt, Artificial Sequence
  Synthetic Oligonucleotide; BTLA exon 2; Set B
agaguuguugaguggcuuucaaugagauuagac

SEQ ID NO: 49739 - RNA, 18 nt, Artificial Sequence
  Synthetic Oligonucleotide; BTLA exon 2; Set C
uugaguggcuuucaauga

SEQ ID NO: 49740 - RNA, 40 nt, Artificial Sequence
  Synthetic Oligonucleotide; BTLA exon 2; Set B
auaaagaguuguugaguggcuuucaaugagauuagacuga

SEQ ID NO: 49741 - RNA, 39 nt, Artificial Sequence
  Synthetic Oligonucleotide; BTLA exon 2; Set B
auaaagaguuguugaguggcuuucaaugagauuagacug

SEQ ID NO: 49742 - RNA, 38 nt, Artificial Sequence
  Synthetic Oligonucleotide; BTLA exon 2; Set B
auaaagaguuguugaguggcuuucaaugagauuagacu

SEQ ID NO: 49743 - RNA, 37 nt, Artificial Sequence
  Synthetic Oligonucleotide; BTLA exon 2; Set B
auaaagaguuguugaguggcuuucaaugagauuagac

SEQ ID NO: 49744 - RNA, 36 nt, Artificial Sequence
  Synthetic Oligonucleotide; BTLA exon 2; Set B
auaaagaguuguugaguggcuuucaaugagauuaga

SEQ ID NO: 49745 - RNA, 37 nt, Artificial Sequence
  Synthetic Oligonucleotide; BTLA exon 2; Set B
acauaaagaguuguugaguggcuuucaaugagauuag

SEQ ID NO: 49746 - RNA, 36 nt, Artificial Sequence
  Synthetic Oligonucleotide; BTLA exon 2; Set B
acauaaagaguuguugaguggcuuucaaugagauua

SEQ ID NO: 49747 - RNA, 38 nt, Artificial Sequence
  Synthetic Oligonucleotide; BTLA exon 2; Set B
cacauaaagaguuguugaguggcuuucaaugagauuag

SEQ ID NO: 49748 - RNA, 35 nt, Artificial Sequence
  Synthetic Oligonucleotide; BTLA exon 2; Set B
acauaaagaguuguugaguggcuuucaaugagauu

SEQ ID NO: 49749 - RNA, 37 nt, Artificial Sequence
  Synthetic Oligonucleotide; BTLA exon 2; Set B
cacauaaagaguuguugaguggcuuucaaugagauua

SEQ ID NO: 49750 - RNA, 33 nt, Artificial Sequence
  Synthetic Oligonucleotide; BTLA exon 2; Set B
cauaaagaguuguugaguggcuuucaaugagau

SEQ ID NO: 49751 - RNA, 15 nt, Artificial Sequence
  Synthetic Oligonucleotide; BTLA exon 2; Set C
uuguugaguggcuuu

SEQ ID NO: 49752 - RNA, 36 nt, Artificial Sequence
  Synthetic Oligonucleotide; BTLA exon 2; Set B
cacauaaagaguuguugaguggcuuucaaugagauu

SEQ ID NO: 49753 - RNA, 34 nt, Artificial Sequence
  Synthetic Oligonucleotide; BTLA exon 2; Set B
acauaaagaguuguugaguggcuuucaaugagau

SEQ ID NO: 49754 - RNA, 32 nt, Artificial Sequence
  Synthetic Oligonucleotide; BTLA exon 2; Set B
cauaaagaguuguugaguggcuuucaaugaga

SEQ ID NO: 49755 - RNA, 16 nt, Artificial Sequence
  Synthetic Oligonucleotide; BTLA exon 2; Set C
guuguugaguggcuuu

SEQ ID NO: 49756 - RNA, 31 nt, Artificial Sequence
  Synthetic Oligonucleotide; BTLA exon 2; Set B
cauaaagaguuguugaguggcuuucaaugag

SEQ ID NO: 49757 - RNA, 35 nt, Artificial Sequence
  Synthetic Oligonucleotide; BTLA exon 2; Set B
cacauaaagaguuguugaguggcuuucaaugagau

SEQ ID NO: 49758 - RNA, 33 nt, Artificial Sequence
  Synthetic Oligonucleotide; BTLA exon 2; Set B
acauaaagaguuguugaguggcuuucaaugaga

SEQ ID NO: 49759 - RNA, 29 nt, Artificial Sequence
  Synthetic Oligonucleotide; BTLA exon 2; Set C
auaaagaguuguugaguggcuuucaauga

SEQ ID NO: 49760 - RNA, 15 nt, Artificial Sequence
  Synthetic Oligonucleotide; BTLA exon 2; Set C
guuguugaguggcuu

SEQ ID NO: 49761 - RNA, 17 nt, Artificial Sequence
  Synthetic Oligonucleotide; BTLA exon 2; Set C
aguuguugaguggcuuu

SEQ ID NO: 49762 - RNA, 32 nt, Artificial Sequence
  Synthetic Oligonucleotide; BTLA exon 2; Set B
acauaaagaguuguugaguggcuuucaaugag

SEQ ID NO: 49763 - RNA, 36 nt, Artificial Sequence
  Synthetic Oligonucleotide; BTLA exon 2; Set B
ucacauaaagaguuguugaguggcuuucaaugagau

SEQ ID NO: 49764 - RNA, 34 nt, Artificial Sequence
  Synthetic Oligonucleotide; BTLA exon 2; Set B
cacauaaagaguuguugaguggcuuucaaugaga

SEQ ID NO: 49765 - RNA, 16 nt, Artificial Sequence
  Synthetic Oligonucleotide; BTLA exon 2; Set C
aguuguugaguggcuu

SEQ ID NO: 49766 - RNA, 18 nt, Artificial Sequence
  Synthetic Oligonucleotide; BTLA exon 2; Set C
gaguuguugaguggcuuu

SEQ ID NO: 49767 - RNA, 33 nt, Artificial Sequence
  Synthetic Oligonucleotide; BTLA exon 2; Set B
cacauaaagaguuguugaguggcuuucaaugag

SEQ ID NO: 49768 - RNA, 35 nt, Artificial Sequence
  Synthetic Oligonucleotide; BTLA exon 2; Set B
ucacauaaagaguuguugaguggcuuucaaugaga

SEQ ID NO: 49769 - RNA, 17 nt, Artificial Sequence
  Synthetic Oligonucleotide; BTLA exon 2; Set C
gaguuguugaguggcuu

SEQ ID NO: 49770 - RNA, 19 nt, Artificial Sequence
  Synthetic Oligonucleotide; BTLA exon 2; Set C
agaguuguugaguggcuuu

SEQ ID NO: 49771 - RNA, 40 nt, Artificial Sequence
  Synthetic Oligonucleotide; BTLA exon 2; Set B
cugucacauaaagaguuguugaguggcuuucaaugagauu

SEQ ID NO: 49772 - RNA, 34 nt, Artificial Sequence
  Synthetic Oligonucleotide; BTLA exon 2; Set B
ucacauaaagaguuguugaguggcuuucaaugag

SEQ ID NO: 49773 - RNA, 18 nt, Artificial Sequence
  Synthetic Oligonucleotide; BTLA exon 2; Set C
agaguuguugaguggcuu

SEQ ID NO: 49774 - RNA, 20 nt, Artificial Sequence
  Synthetic Oligonucleotide; BTLA exon 2; Set C
aagaguuguugaguggcuuu

SEQ ID NO: 49775 - RNA, 33 nt, Artificial Sequence
  Synthetic Oligonucleotide; BTLA exon 2; Set B
ucacauaaagaguuguugaguggcuuucaauga

SEQ ID NO: 49776 - RNA, 19 nt, Artificial Sequence
  Synthetic Oligonucleotide; BTLA exon 2; Set C
aagaguuguugaguggcuu

SEQ ID NO: 49777 - RNA, 21 nt, Artificial Sequence
  Synthetic Oligonucleotide; BTLA exon 2; Set C
aaagaguuguugaguggcuuu

SEQ ID NO: 49778 - RNA, 20 nt, Artificial Sequence
  Synthetic Oligonucleotide; BTLA exon 2; Set C
aaagaguuguugaguggcuu

SEQ ID NO: 49779 - RNA, 22 nt, Artificial Sequence
  Synthetic Oligonucleotide; BTLA exon 2; Set C
uaaagaguuguugaguggcuuu

SEQ ID NO: 49780 - RNA, 21 nt, Artificial Sequence
  Synthetic Oligonucleotide; BTLA exon 2; Set C
uaaagaguuguugaguggcuu

SEQ ID NO: 49781 - RNA, 15 nt, Artificial Sequence
  Synthetic Oligonucleotide; BTLA exon 2; Set C
agaguuguugagugg

SEQ ID NO: 49782 - RNA, 16 nt, Artificial Sequence
  Synthetic Oligonucleotide; BTLA exon 2; Set C
aagaguuguugagugg

SEQ ID NO: 49783 - RNA, 17 nt, Artificial Sequence
  Synthetic Oligonucleotide; BTLA exon 2; Set C
aaagaguuguugagugg

SEQ ID NO: 49784 - RNA, 18 nt, Artificial Sequence
  Synthetic Oligonucleotide; BTLA exon 2; Set C
uaaagaguuguugagugg

SEQ ID NO: 49785 - RNA, 18 nt, Artificial Sequence
  Synthetic Oligonucleotide; BTLA exon 2; Set C
auaaagaguuguugagug

SEQ ID NO: 49786 - RNA, 28 nt, Artificial Sequence
  Synthetic Oligonucleotide; BTLA exon 2; Set B
gucacauaaagaguuguugaguggcuuu

SEQ ID NO: 49787 - RNA, 17 nt, Artificial Sequence
  Synthetic Oligonucleotide; BTLA exon 2; Set C
auaaagaguuguugagu

SEQ ID NO: 49788 - RNA, 27 nt, Artificial Sequence
  Synthetic Oligonucleotide; BTLA exon 2; Set B
gucacauaaagaguuguugaguggcuu

SEQ ID NO: 49789 - RNA, 29 nt, Artificial Sequence
  Synthetic Oligonucleotide; BTLA exon 2; Set B
ugucacauaaagaguuguugaguggcuuu

SEQ ID NO: 49790 - RNA, 16 nt, Artificial Sequence
  Synthetic Oligonucleotide; BTLA exon 2; Set C
auaaagaguuguugag

SEQ ID NO: 49791 - RNA, 28 nt, Artificial Sequence
  Synthetic Oligonucleotide; BTLA exon 2; Set B
ugucacauaaagaguuguugaguggcuu

SEQ ID NO: 49792 - RNA, 15 nt, Artificial Sequence
  Synthetic Oligonucleotide; BTLA exon 2; Set C
auaaagaguuguuga

SEQ ID NO: 49793 - RNA, 24 nt, Artificial Sequence
  Synthetic Oligonucleotide; BTLA exon 2; Set C
gucacauaaagaguuguugagugg

SEQ ID NO: 49794 - RNA, 15 nt, Artificial Sequence
  Synthetic Oligonucleotide; BTLA exon 2; Set C
cauaaagaguuguug

SEQ ID NO: 49795 - RNA, 25 nt, Artificial Sequence
  Synthetic Oligonucleotide; BTLA exon 2; Set C
ugucacauaaagaguuguugagugg

SEQ ID NO: 49796 - RNA, 16 nt, Artificial Sequence
  Synthetic Oligonucleotide; BTLA exon 2; Set C
acauaaagaguuguug

SEQ ID NO: 49797 - RNA, 17 nt, Artificial Sequence
  Synthetic Oligonucleotide; BTLA exon 2; Set C
cacauaaagaguuguug

SEQ ID NO: 49798 - RNA, 19 nt, Artificial Sequence
  Synthetic Oligonucleotide; BTLA exon 2; Set C
ucacauaaagaguuguuga

SEQ ID NO: 49799 - RNA, 20 nt, Artificial Sequence
  Synthetic Oligonucleotide; BTLA exon 2; Set C
cugucacauaaagaguuguu

SEQ ID NO: 49800 - RNA, 19 nt, Artificial Sequence
  Synthetic Oligonucleotide; BTLA exon 2; Set C
cugucacauaaagaguugu

SEQ ID NO: 49801 - RNA, 31 nt, Artificial Sequence
  Synthetic Oligonucleotide; BTLA exon 2; Set B
acucaccugucacauaaagaguuguugagug

SEQ ID NO: 49802 - RNA, 18 nt, Artificial Sequence
  Synthetic Oligonucleotide; BTLA exon 2; Set C
cugucacauaaagaguug

SEQ ID NO: 49803 - RNA, 30 nt, Artificial Sequence
  Synthetic Oligonucleotide; BTLA exon 2; Set B
acucaccugucacauaaagaguuguugagu

SEQ ID NO: 49804 - RNA, 17 nt, Artificial Sequence
  Synthetic Oligonucleotide; BTLA exon 2; Set C
cugucacauaaagaguu

SEQ ID NO: 49805 - RNA, 29 nt, Artificial Sequence
  Synthetic Oligonucleotide; BTLA exon 2; Set B
acucaccugucacauaaagaguuguugag

SEQ ID NO: 49806 - RNA, 16 nt, Artificial Sequence
  Synthetic Oligonucleotide; BTLA exon 2; Set C
cugucacauaaagagu

SEQ ID NO: 49807 - RNA, 28 nt, Artificial Sequence
  Synthetic Oligonucleotide; BTLA exon 2; Set B
acucaccugucacauaaagaguuguuga

SEQ ID NO: 49808 - RNA, 15 nt, Artificial Sequence
  Synthetic Oligonucleotide; BTLA exon 2; Set C
cugucacauaaagag

SEQ ID NO: 49809 - RNA, 28 nt, Artificial Sequence
  Synthetic Oligonucleotide; BTLA exon 2; Set B
aacucaccugucacauaaagaguuguug

SEQ ID NO: 49810 - RNA, 28 nt, Artificial Sequence
  Synthetic Oligonucleotide; BTLA exon 2; Set B
gaacucaccugucacauaaagaguuguu

SEQ ID NO: 49811 - RNA, 26 nt, Artificial Sequence
  Synthetic Oligonucleotide; BTLA exon 2; Set C
aacucaccugucacauaaagaguugu

SEQ ID NO: 49812 - RNA, 25 nt, Artificial Sequence
  Synthetic Oligonucleotide; BTLA exon 2; Set C
aacucaccugucacauaaagaguug

SEQ ID NO: 49813 - RNA, 27 nt, Artificial Sequence
  Synthetic Oligonucleotide; BTLA exon 2; Set B
gaacucaccugucacauaaagaguugu

SEQ ID NO: 49814 - RNA, 37 nt, Artificial Sequence
  Synthetic Oligonucleotide; BTLA exon 2; Set C
guugagaacucaccugucacauaaagaguuguugagu

SEQ ID NO: 49815 - RNA, 30 nt, Artificial Sequence
  Synthetic Oligonucleotide; BTLA exon 2; Set B
gagaacucaccugucacauaaagaguuguu

SEQ ID NO: 49816 - RNA, 24 nt, Artificial Sequence
  Synthetic Oligonucleotide; BTLA exon 2; Set C
aacucaccugucacauaaagaguu

SEQ ID NO: 49817 - RNA, 26 nt, Artificial Sequence
  Synthetic Oligonucleotide; BTLA exon 2; Set C
gaacucaccugucacauaaagaguug

SEQ ID NO: 49818 - RNA, 38 nt, Artificial Sequence
  Synthetic Oligonucleotide; BTLA exon 2; Set C
uguugagaacucaccugucacauaaagaguuguugagu

SEQ ID NO: 49819 - RNA, 36 nt, Artificial Sequence
  Synthetic Oligonucleotide; BTLA exon 2; Set B
guugagaacucaccugucacauaaagaguuguugag

SEQ ID NO: 49820 - RNA, 23 nt, Artificial Sequence
  Synthetic Oligonucleotide; BTLA exon 2; Set C
aacucaccugucacauaaagagu

SEQ ID NO: 49821 - RNA, 31 nt, Artificial Sequence
  Synthetic Oligonucleotide; BTLA exon 2; Set B
ugagaacucaccugucacauaaagaguuguu

SEQ ID NO: 49822 - RNA, 25 nt, Artificial Sequence
  Synthetic Oligonucleotide; BTLA exon 2; Set C
gaacucaccugucacauaaagaguu

SEQ ID NO: 49823 - RNA, 29 nt, Artificial Sequence
  Synthetic Oligonucleotide; BTLA exon 2; Set B
gagaacucaccugucacauaaagaguugu

SEQ ID NO: 49824 - RNA, 33 nt, Artificial Sequence
  Synthetic Oligonucleotide; BTLA exon 2; Set B
uugagaacucaccugucacauaaagaguuguug

SEQ ID NO: 49825 - RNA, 35 nt, Artificial Sequence
  Synthetic Oligonucleotide; BTLA exon 2; Set B
guugagaacucaccugucacauaaagaguuguuga

SEQ ID NO: 49826 - RNA, 39 nt, Artificial Sequence
  Synthetic Oligonucleotide; BTLA exon 2; Set C
guguugagaacucaccugucacauaaagaguuguugagu

SEQ ID NO: 49827 - RNA, 37 nt, Artificial Sequence
  Synthetic Oligonucleotide; BTLA exon 2; Set B
uguugagaacucaccugucacauaaagaguuguugag

SEQ ID NO: 49828 - RNA, 24 nt, Artificial Sequence
  Synthetic Oligonucleotide; BTLA exon 2; Set C
gaacucaccugucacauaaagagu

SEQ ID NO: 49829 - RNA, 22 nt, Artificial Sequence
  Synthetic Oligonucleotide; BTLA exon 2; Set C
aacucaccugucacauaaagag

SEQ ID NO: 49830 - RNA, 30 nt, Artificial Sequence
  Synthetic Oligonucleotide; BTLA exon 2; Set B
ugagaacucaccugucacauaaagaguugu

SEQ ID NO: 49831 - RNA, 28 nt, Artificial Sequence
  Synthetic Oligonucleotide; BTLA exon 2; Set B
gagaacucaccugucacauaaagaguug

SEQ ID NO: 49832 - RNA, 36 nt, Artificial Sequence
  Synthetic Oligonucleotide; BTLA exon 2; Set B
uguugagaacucaccugucacauaaagaguuguuga

SEQ ID NO: 49833 - RNA, 38 nt, Artificial Sequence
  Synthetic Oligonucleotide; BTLA exon 2; Set C
guguugagaacucaccugucacauaaagaguuguugag

SEQ ID NO: 49834 - RNA, 23 nt, Artificial Sequence
  Synthetic Oligonucleotide; BTLA exon 2; Set C
gaacucaccugucacauaaagag

SEQ ID NO: 49835 - RNA, 21 nt, Artificial Sequence
  Synthetic Oligonucleotide; BTLA exon 2; Set C
aacucaccugucacauaaaga

SEQ ID NO: 49836 - RNA, 27 nt, Artificial Sequence
  Synthetic Oligonucleotide; BTLA exon 2; Set B
gagaacucaccugucacauaaagaguu

SEQ ID NO: 49837 - RNA, 31 nt, Artificial Sequence
  Synthetic Oligonucleotide; BTLA exon 2; Set B
uugagaacucaccugucacauaaagaguugu

SEQ ID NO: 49838 - RNA, 29 nt, Artificial Sequence
  Synthetic Oligonucleotide; BTLA exon 2; Set B
ugagaacucaccugucacauaaagaguug

SEQ ID NO: 49839 - RNA, 37 nt, Artificial Sequence
  Synthetic Oligonucleotide; BTLA exon 2; Set C
guguugagaacucaccugucacauaaagaguuguuga

SEQ ID NO: 49840 - RNA, 26 nt, Artificial Sequence
  Synthetic Oligonucleotide; BTLA exon 2; Set B
gagaacucaccugucacauaaagagu

SEQ ID NO: 49841 - RNA, 20 nt, Artificial Sequence
  Synthetic Oligonucleotide; BTLA exon 2; Set C
aacucaccugucacauaaag

SEQ ID NO: 49842 - RNA, 22 nt, Artificial Sequence
  Synthetic Oligonucleotide; BTLA exon 2; Set C
gaacucaccugucacauaaaga

SEQ ID NO: 49843 - RNA, 28 nt, Artificial Sequence
  Synthetic Oligonucleotide; BTLA exon 2; Set B
ugagaacucaccugucacauaaagaguu

SEQ ID NO: 49844 - RNA, 30 nt, Artificial Sequence
  Synthetic Oligonucleotide; BTLA exon 2; Set B
uugagaacucaccugucacauaaagaguug

SEQ ID NO: 49845 - RNA, 38 nt, Artificial Sequence
  Synthetic Oligonucleotide; BTLA exon 2; Set C
gguguugagaacucaccugucacauaaagaguuguuga

SEQ ID NO: 49846 - RNA, 27 nt, Artificial Sequence
  Synthetic Oligonucleotide; BTLA exon 2; Set B
ugagaacucaccugucacauaaagagu

SEQ ID NO: 49847 - RNA, 25 nt, Artificial Sequence
  Synthetic Oligonucleotide; BTLA exon 2; Set C
gagaacucaccugucacauaaagag

SEQ ID NO: 49848 - RNA, 19 nt, Artificial Sequence
  Synthetic Oligonucleotide; BTLA exon 2; Set C
aacucaccugucacauaaa

SEQ ID NO: 49849 - RNA, 21 nt, Artificial Sequence
  Synthetic Oligonucleotide; BTLA exon 2; Set C
gaacucaccugucacauaaag

SEQ ID NO: 49850 - RNA, 29 nt, Artificial Sequence
  Synthetic Oligonucleotide; BTLA exon 2; Set B
uugagaacucaccugucacauaaagaguu

SEQ ID NO: 49851 - RNA, 37 nt, Artificial Sequence
  Synthetic Oligonucleotide; BTLA exon 2; Set C
gguguugagaacucaccugucacauaaagaguuguug

SEQ ID NO: 49852 - RNA, 26 nt, Artificial Sequence
  Synthetic Oligonucleotide; BTLA exon 2; Set C
ugagaacucaccugucacauaaagag

SEQ ID NO: 49853 - RNA, 18 nt, Artificial Sequence
  Synthetic Oligonucleotide; BTLA exon 2; Set C
aacucaccugucacauaa

SEQ ID NO: 49854 - RNA, 24 nt, Artificial Sequence
  Synthetic Oligonucleotide; BTLA exon 2; Set C
gagaacucaccugucacauaaaga

SEQ ID NO: 49855 - RNA, 38 nt, Artificial Sequence
  Synthetic Oligonucleotide; BTLA exon 2; Set C
agguguugagaacucaccugucacauaaagaguuguug

SEQ ID NO: 49856 - RNA, 16 nt, Artificial Sequence
  Synthetic Oligonucleotide; BTLA exon 2; Set C
acucaccugucacaua

SEQ ID NO: 49857 - RNA, 40 nt, Artificial Sequence
  Synthetic Oligonucleotide; BTLA exon 2; Set C
uagguguugagaacucaccugucacauaaagaguuguuga

SEQ ID NO: 49858 - RNA, 27 nt, Artificial Sequence
  Synthetic Oligonucleotide; BTLA exon 2; Set C
uugagaacucaccugucacauaaagag

SEQ ID NO: 49859 - RNA, 25 nt, Artificial Sequence
  Synthetic Oligonucleotide; BTLA exon 2; Set C
ugagaacucaccugucacauaaaga

SEQ ID NO: 49860 - RNA, 23 nt, Artificial Sequence
  Synthetic Oligonucleotide; BTLA exon 2; Set C
gagaacucaccugucacauaaag

SEQ ID NO: 49861 - RNA, 15 nt, Artificial Sequence
  Synthetic Oligonucleotide; BTLA exon 2; Set C
acucaccugucacau

SEQ ID NO: 49862 - RNA, 26 nt, Artificial Sequence
  Synthetic Oligonucleotide; BTLA exon 2; Set C
uugagaacucaccugucacauaaaga

SEQ ID NO: 49863 - RNA, 24 nt, Artificial Sequence
  Synthetic Oligonucleotide; BTLA exon 2; Set C
ugagaacucaccugucacauaaag

SEQ ID NO: 49864 - RNA, 22 nt, Artificial Sequence
  Synthetic Oligonucleotide; BTLA exon 2; Set C
gagaacucaccugucacauaaa

SEQ ID NO: 49865 - RNA, 25 nt, Artificial Sequence
  Synthetic Oligonucleotide; BTLA exon 2; Set C
uugagaacucaccugucacauaaag

SEQ ID NO: 49866 - RNA, 23 nt, Artificial Sequence
  Synthetic Oligonucleotide; BTLA exon 2; Set C
ugagaacucaccugucacauaaa

SEQ ID NO: 49867 - RNA, 21 nt, Artificial Sequence
  Synthetic Oligonucleotide; BTLA exon 2; Set C
gagaacucaccugucacauaa

SEQ ID NO: 49868 - RNA, 24 nt, Artificial Sequence
  Synthetic Oligonucleotide; BTLA exon 2; Set C
uugagaacucaccugucacauaaa

SEQ ID NO: 49869 - RNA, 22 nt, Artificial Sequence
  Synthetic Oligonucleotide; BTLA exon 2; Set C
ugagaacucaccugucacauaa

SEQ ID NO: 49870 - RNA, 23 nt, Artificial Sequence
  Synthetic Oligonucleotide; BTLA exon 2; Set C
uugagaacucaccugucacauaa

SEQ ID NO: 49871 - RNA, 23 nt, Artificial Sequence
  Synthetic Oligonucleotide; BTLA exon 2; Set B
guugagaacucaccugucacaua

SEQ ID NO: 49872 - RNA, 24 nt, Artificial Sequence
  Synthetic Oligonucleotide; BTLA exon 2; Set B
uguugagaacucaccugucacaua

SEQ ID NO: 49873 - RNA, 25 nt, Artificial Sequence
  Synthetic Oligonucleotide; BTLA exon 2; Set B
guguugagaacucaccugucacaua

SEQ ID NO: 49874 - RNA, 26 nt, Artificial Sequence
  Synthetic Oligonucleotide; BTLA exon 2; Set B
gguguugagaacucaccugucacaua

SEQ ID NO: 49875 - RNA, 17 nt, Artificial Sequence
  Synthetic Oligonucleotide; BTLA exon 2; Set C
uugagaacucaccuguc

SEQ ID NO: 49876 - RNA, 27 nt, Artificial Sequence
  Synthetic Oligonucleotide; BTLA exon 2; Set B
agguguugagaacucaccugucacaua

SEQ ID NO: 49877 - RNA, 16 nt, Artificial Sequence
  Synthetic Oligonucleotide; BTLA exon 2; Set C
uugagaacucaccugu

SEQ ID NO: 49878 - RNA, 28 nt, Artificial Sequence
  Synthetic Oligonucleotide; BTLA exon 2; Set B
uagguguugagaacucaccugucacaua

SEQ ID NO: 49879 - RNA, 29 nt, Artificial Sequence
  Synthetic Oligonucleotide; BTLA exon 2; Set B
cuagguguugagaacucaccugucacaua

SEQ ID NO: 49880 - RNA, 29 nt, Artificial Sequence
  Synthetic Oligonucleotide; BTLA exon 2; Set B
ucuagguguugagaacucaccugucacau

SEQ ID NO: 49881 - RNA, 24 nt, Artificial Sequence
  Synthetic Oligonucleotide; BTLA exon 2; Set B
uagguguugagaacucaccuguca

SEQ ID NO: 49882 - RNA, 30 nt, Artificial Sequence
  Synthetic Oligonucleotide; BTLA exon 2; Set C
gucuagguguugagaacucaccugucacau

SEQ ID NO: 49883 - RNA, 28 nt, Artificial Sequence
  Synthetic Oligonucleotide; BTLA exon 2; Set B
ucuagguguugagaacucaccugucaca

SEQ ID NO: 49884 - RNA, 25 nt, Artificial Sequence
  Synthetic Oligonucleotide; BTLA exon 2; Set B
cuagguguugagaacucaccuguca

SEQ ID NO: 49885 - RNA, 31 nt, Artificial Sequence
  Synthetic Oligonucleotide; BTLA exon 2; Set C
ggucuagguguugagaacucaccugucacau

SEQ ID NO: 49886 - RNA, 27 nt, Artificial Sequence
  Synthetic Oligonucleotide; BTLA exon 2; Set B
ucuagguguugagaacucaccugucac

SEQ ID NO: 49887 - RNA, 29 nt, Artificial Sequence
  Synthetic Oligonucleotide; BTLA exon 2; Set C
gucuagguguugagaacucaccugucaca

SEQ ID NO: 49888 - RNA, 34 nt, Artificial Sequence
  Synthetic Oligonucleotide; BTLA exon 2; Set C
auggucuagguguugagaacucaccugucacaua

SEQ ID NO: 49889 - RNA, 26 nt, Artificial Sequence
  Synthetic Oligonucleotide; BTLA exon 2; Set B
ucuagguguugagaacucaccuguca

SEQ ID NO: 49890 - RNA, 32 nt, Artificial Sequence
  Synthetic Oligonucleotide; BTLA exon 2; Set C
uggucuagguguugagaacucaccugucacau

SEQ ID NO: 49891 - RNA, 28 nt, Artificial Sequence
  Synthetic Oligonucleotide; BTLA exon 2; Set B
gucuagguguugagaacucaccugucac

SEQ ID NO: 49892 - RNA, 30 nt, Artificial Sequence
  Synthetic Oligonucleotide; BTLA exon 2; Set C
ggucuagguguugagaacucaccugucaca

SEQ ID NO: 49893 - RNA, 35 nt, Artificial Sequence
  Synthetic Oligonucleotide; BTLA exon 2; Set C
gauggucuagguguugagaacucaccugucacaua

SEQ ID NO: 49894 - RNA, 27 nt, Artificial Sequence
  Synthetic Oligonucleotide; BTLA exon 2; Set B
gucuagguguugagaacucaccuguca

SEQ ID NO: 49895 - RNA, 31 nt, Artificial Sequence
  Synthetic Oligonucleotide; BTLA exon 2; Set C
uggucuagguguugagaacucaccugucaca

SEQ ID NO: 49896 - RNA, 29 nt, Artificial Sequence
  Synthetic Oligonucleotide; BTLA exon 2; Set C
ggucuagguguugagaacucaccugucac

SEQ ID NO: 49897 - RNA, 36 nt, Artificial Sequence
  Synthetic Oligonucleotide; BTLA exon 2; Set C
agauggucuagguguugagaacucaccugucacaua

SEQ ID NO: 49898 - RNA, 28 nt, Artificial Sequence
  Synthetic Oligonucleotide; BTLA exon 2; Set C
ggucuagguguugagaacucaccuguca

SEQ ID NO: 49899 - RNA, 30 nt, Artificial Sequence
  Synthetic Oligonucleotide; BTLA exon 2; Set C
uggucuagguguugagaacucaccugucac

SEQ ID NO: 49900 - RNA, 37 nt, Artificial Sequence
  Synthetic Oligonucleotide; BTLA exon 2; Set C
cagauggucuagguguugagaacucaccugucacaua

SEQ ID NO: 49901 - RNA, 29 nt, Artificial Sequence
  Synthetic Oligonucleotide; BTLA exon 2; Set C
uggucuagguguugagaacucaccuguca

SEQ ID NO: 49902 - RNA, 38 nt, Artificial Sequence
  Synthetic Oligonucleotide; BTLA exon 2; Set C
ucagauggucuagguguugagaacucaccugucacaua

SEQ ID NO: 49903 - RNA, 30 nt, Artificial Sequence
  Synthetic Oligonucleotide; BTLA exon 2; Set C
auggucuagguguugagaacucaccuguca

SEQ ID NO: 49904 - RNA, 39 nt, Artificial Sequence
  Synthetic Oligonucleotide; BTLA exon 2; Set C
aucagauggucuagguguugagaacucaccugucacaua

SEQ ID NO: 49905 - RNA, 38 nt, Artificial Sequence
  Synthetic Oligonucleotide; BTLA exon 2; Set C
aucagauggucuagguguugagaacucaccugucacau

SEQ ID NO: 49906 - RNA, 39 nt, Artificial Sequence
  Synthetic Oligonucleotide; BTLA exon 2; Set C
uaucagauggucuagguguugagaacucaccugucacau

SEQ ID NO: 49907 - RNA, 32 nt, Artificial Sequence
  Synthetic Oligonucleotide; BTLA exon 2; Set C
cagauggucuagguguugagaacucaccuguc

SEQ ID NO: 49908 - RNA, 40 nt, Artificial Sequence
  Synthetic Oligonucleotide; BTLA exon 2; Set C
auaucagauggucuagguguugagaacucaccugucacau

SEQ ID NO: 49909 - RNA, 38 nt, Artificial Sequence
  Synthetic Oligonucleotide; BTLA exon 2; Set C
uaucagauggucuagguguugagaacucaccugucaca

SEQ ID NO: 49910 - RNA, 31 nt, Artificial Sequence
  Synthetic Oligonucleotide; BTLA exon 2; Set C
cagauggucuagguguugagaacucaccugu

SEQ ID NO: 49911 - RNA, 33 nt, Artificial Sequence
  Synthetic Oligonucleotide; BTLA exon 2; Set C
ucagauggucuagguguugagaacucaccuguc

SEQ ID NO: 49912 - RNA, 35 nt, Artificial Sequence
  Synthetic Oligonucleotide; BTLA exon 2; Set C
aucagauggucuagguguugagaacucaccuguca

SEQ ID NO: 49913 - RNA, 15 nt, Artificial Sequence
  Synthetic Oligonucleotide; BTLA exon 2; Set C
cuagguguugagaac

SEQ ID NO: 49914 - RNA, 39 nt, Artificial Sequence
  Synthetic Oligonucleotide; BTLA exon 2; Set C
auaucagauggucuagguguugagaacucaccugucaca

SEQ ID NO: 49915 - RNA, 37 nt, Artificial Sequence
  Synthetic Oligonucleotide; BTLA exon 2; Set C
uaucagauggucuagguguugagaacucaccugucac

SEQ ID NO: 49916 - RNA, 32 nt, Artificial Sequence
  Synthetic Oligonucleotide; BTLA exon 2; Set C
ucagauggucuagguguugagaacucaccugu

SEQ ID NO: 49917 - RNA, 36 nt, Artificial Sequence
  Synthetic Oligonucleotide; BTLA exon 2; Set C
uaucagauggucuagguguugagaacucaccuguca

SEQ ID NO: 49918 - RNA, 16 nt, Artificial Sequence
  Synthetic Oligonucleotide; BTLA exon 2; Set C
ucuagguguugagaac

SEQ ID NO: 49919 - RNA, 38 nt, Artificial Sequence
  Synthetic Oligonucleotide; BTLA exon 2; Set C
auaucagauggucuagguguugagaacucaccugucac

SEQ ID NO: 49920 - RNA, 40 nt, Artificial Sequence
  Synthetic Oligonucleotide; BTLA exon 2; Set C
aauaucagauggucuagguguugagaacucaccugucaca

SEQ ID NO: 49921 - RNA, 37 nt, Artificial Sequence
  Synthetic Oligonucleotide; BTLA exon 2; Set C
auaucagauggucuagguguugagaacucaccuguca

SEQ ID NO: 49922 - RNA, 17 nt, Artificial Sequence
  Synthetic Oligonucleotide; BTLA exon 2; Set C
gucuagguguugagaac

SEQ ID NO: 49923 - RNA, 39 nt, Artificial Sequence
  Synthetic Oligonucleotide; BTLA exon 2; Set C
aauaucagauggucuagguguugagaacucaccugucac

SEQ ID NO: 49924 - RNA, 38 nt, Artificial Sequence
  Synthetic Oligonucleotide; BTLA exon 2; Set C
aauaucagauggucuagguguugagaacucaccuguca

SEQ ID NO: 49925 - RNA, 18 nt, Artificial Sequence
  Synthetic Oligonucleotide; BTLA exon 2; Set C
ggucuagguguugagaac

SEQ ID NO: 49926 - RNA, 40 nt, Artificial Sequence
  Synthetic Oligonucleotide; BTLA exon 2; Set C
aaauaucagauggucuagguguugagaacucaccugucac

SEQ ID NO: 49927 - RNA, 39 nt, Artificial Sequence
  Synthetic Oligonucleotide; BTLA exon 2; Set C
aaauaucagauggucuagguguugagaacucaccuguca

SEQ ID NO: 49928 - RNA, 19 nt, Artificial Sequence
  Synthetic Oligonucleotide; BTLA exon 2; Set C
uggucuagguguugagaac

SEQ ID NO: 49929 - RNA, 40 nt, Artificial Sequence
  Synthetic Oligonucleotide; BTLA exon 2; Set C
aaaauaucagauggucuagguguugagaacucaccuguca

SEQ ID NO: 49930 - RNA, 23 nt, Artificial Sequence
  Synthetic Oligonucleotide; BTLA exon 2; Set C
agauggucuagguguugagaacu

SEQ ID NO: 49931 - RNA, 24 nt, Artificial Sequence
  Synthetic Oligonucleotide; BTLA exon 2; Set B
cagauggucuagguguugagaacu

SEQ ID NO: 49932 - RNA, 16 nt, Artificial Sequence
  Synthetic Oligonucleotide; BTLA exon 2; Set C
uggucuagguguugag

SEQ ID NO: 49933 - RNA, 25 nt, Artificial Sequence
  Synthetic Oligonucleotide; BTLA exon 2; Set B
ucagauggucuagguguugagaacu

SEQ ID NO: 49934 - RNA, 15 nt, Artificial Sequence
  Synthetic Oligonucleotide; BTLA exon 2; Set C
uggucuagguguuga

SEQ ID NO: 49935 - RNA, 15 nt, Artificial Sequence
  Synthetic Oligonucleotide; BTLA exon 2; Set C
auggucuagguguug

SEQ ID NO: 49936 - RNA, 25 nt, Artificial Sequence
  Synthetic Oligonucleotide; BTLA exon 2; Set B
aucagauggucuagguguugagaac

SEQ ID NO: 49937 - RNA, 16 nt, Artificial Sequence
  Synthetic Oligonucleotide; BTLA exon 2; Set C
gauggucuagguguug

SEQ ID NO: 49938 - RNA, 26 nt, Artificial Sequence
  Synthetic Oligonucleotide; BTLA exon 2; Set B
uaucagauggucuagguguugagaac

SEQ ID NO: 49939 - RNA, 27 nt, Artificial Sequence
  Synthetic Oligonucleotide; BTLA exon 2; Set B
auaucagauggucuagguguugagaac

SEQ ID NO: 49940 - RNA, 16 nt, Artificial Sequence
  Synthetic Oligonucleotide; BTLA exon 2; Set C
agauggucuagguguu

SEQ ID NO: 49941 - RNA, 28 nt, Artificial Sequence
  Synthetic Oligonucleotide; BTLA exon 2; Set B
aauaucagauggucuagguguugagaac

SEQ ID NO: 49942 - RNA, 17 nt, Artificial Sequence
  Synthetic Oligonucleotide; BTLA exon 2; Set C
cagauggucuagguguu

SEQ ID NO: 49943 - RNA, 15 nt, Artificial Sequence
  Synthetic Oligonucleotide; BTLA exon 2; Set C
agauggucuaggugu

SEQ ID NO: 49944 - RNA, 29 nt, Artificial Sequence
  Synthetic Oligonucleotide; BTLA exon 2; Set C
aaauaucagauggucuagguguugagaac

SEQ ID NO: 49945 - RNA, 23 nt, Artificial Sequence
  Synthetic Oligonucleotide; BTLA exon 2; Set C
uaucagauggucuagguguugag

SEQ ID NO: 49946 - RNA, 18 nt, Artificial Sequence
  Synthetic Oligonucleotide; BTLA exon 2; Set C
ucagauggucuagguguu

SEQ ID NO: 49947 - RNA, 16 nt, Artificial Sequence
  Synthetic Oligonucleotide; BTLA exon 2; Set C
cagauggucuaggugu

SEQ ID NO: 49948 - RNA, 20 nt, Artificial Sequence
  Synthetic Oligonucleotide; BTLA exon 2; Set C
aucagauggucuagguguug

SEQ ID NO: 49949 - RNA, 30 nt, Artificial Sequence
  Synthetic Oligonucleotide; BTLA exon 2; Set C
aaaauaucagauggucuagguguugagaac

SEQ ID NO: 49950 - RNA, 22 nt, Artificial Sequence
  Synthetic Oligonucleotide; BTLA exon 2; Set C
uaucagauggucuagguguuga

SEQ ID NO: 49951 - RNA, 24 nt, Artificial Sequence
  Synthetic Oligonucleotide; BTLA exon 2; Set C
auaucagauggucuagguguugag

SEQ ID NO: 49952 - RNA, 15 nt, Artificial Sequence
  Synthetic Oligonucleotide; BTLA exon 2; Set C
cagauggucuaggug

SEQ ID NO: 49953 - RNA, 17 nt, Artificial Sequence
  Synthetic Oligonucleotide; BTLA exon 2; Set C
ucagauggucuaggugu

SEQ ID NO: 49954 - RNA, 21 nt, Artificial Sequence
  Synthetic Oligonucleotide; BTLA exon 2; Set C
uaucagauggucuagguguug

SEQ ID NO: 49955 - RNA, 31 nt, Artificial Sequence
  Synthetic Oligonucleotide; BTLA exon 2; Set C
aaaaauaucagauggucuagguguugagaac

SEQ ID NO: 49956 - RNA, 23 nt, Artificial Sequence
  Synthetic Oligonucleotide; BTLA exon 2; Set C
auaucagauggucuagguguuga

SEQ ID NO: 49957 - RNA, 16 nt, Artificial Sequence
  Synthetic Oligonucleotide; BTLA exon 2; Set C
ucagauggucuaggug

SEQ ID NO: 49958 - RNA, 22 nt, Artificial Sequence
  Synthetic Oligonucleotide; BTLA exon 2; Set C
auaucagauggucuagguguug

SEQ ID NO: 49959 - RNA, 32 nt, Artificial Sequence
  Synthetic Oligonucleotide; BTLA exon 2; Set B
gaaaaauaucagauggucuagguguugagaac

SEQ ID NO: 49960 - RNA, 24 nt, Artificial Sequence
  Synthetic Oligonucleotide; BTLA exon 2; Set C
aauaucagauggucuagguguuga

SEQ ID NO: 49961 - RNA, 15 nt, Artificial Sequence
  Synthetic Oligonucleotide; BTLA exon 2; Set C
ucagauggucuaggu

SEQ ID NO: 49962 - RNA, 23 nt, Artificial Sequence
  Synthetic Oligonucleotide; BTLA exon 2; Set C
aauaucagauggucuagguguug

SEQ ID NO: 49963 - RNA, 33 nt, Artificial Sequence
  Synthetic Oligonucleotide; BTLA exon 2; Set B
agaaaaauaucagauggucuagguguugagaac

SEQ ID NO: 49964 - RNA, 25 nt, Artificial Sequence
  Synthetic Oligonucleotide; BTLA exon 2; Set C
aaauaucagauggucuagguguuga

SEQ ID NO: 49965 - RNA, 16 nt, Artificial Sequence
  Synthetic Oligonucleotide; BTLA exon 2; Set C
aucagauggucuaggu

SEQ ID NO: 49966 - RNA, 24 nt, Artificial Sequence
  Synthetic Oligonucleotide; BTLA exon 2; Set C
aaauaucagauggucuagguguug

SEQ ID NO: 49967 - RNA, 34 nt, Artificial Sequence
  Synthetic Oligonucleotide; BTLA exon 2; Set B
aagaaaaauaucagauggucuagguguugagaac

SEQ ID NO: 49968 - RNA, 26 nt, Artificial Sequence
  Synthetic Oligonucleotide; BTLA exon 2; Set C
aaaauaucagauggucuagguguuga

SEQ ID NO: 49969 - RNA, 15 nt, Artificial Sequence
  Synthetic Oligonucleotide; BTLA exon 2; Set C
aucagauggucuagg

SEQ ID NO: 49970 - RNA, 25 nt, Artificial Sequence
  Synthetic Oligonucleotide; BTLA exon 2; Set C
aaaauaucagauggucuagguguug

SEQ ID NO: 49971 - RNA, 35 nt, Artificial Sequence
  Synthetic Oligonucleotide; BTLA exon 2; Set B
uaagaaaaauaucagauggucuagguguugagaac

SEQ ID NO: 49972 - RNA, 26 nt, Artificial Sequence
  Synthetic Oligonucleotide; BTLA exon 2; Set C
aaaaauaucagauggucuagguguug

SEQ ID NO: 49973 - RNA, 34 nt, Artificial Sequence
  Synthetic Oligonucleotide; BTLA exon 2; Set C
uaagaaaaauaucagauggucuagguguugagaa

SEQ ID NO: 49974 - RNA, 27 nt, Artificial Sequence
  Synthetic Oligonucleotide; BTLA exon 2; Set C
gaaaaauaucagauggucuagguguug

SEQ ID NO: 49975 - RNA, 35 nt, Artificial Sequence
  Synthetic Oligonucleotide; BTLA exon 2; Set C
auaagaaaaauaucagauggucuagguguugagaa

SEQ ID NO: 49976 - RNA, 28 nt, Artificial Sequence
  Synthetic Oligonucleotide; BTLA exon 2; Set C
agaaaaauaucagauggucuagguguug

SEQ ID NO: 49977 - RNA, 32 nt, Artificial Sequence
  Synthetic Oligonucleotide; BTLA exon 2; Set C
uaagaaaaauaucagauggucuagguguugag

SEQ ID NO: 49978 - RNA, 36 nt, Artificial Sequence
  Synthetic Oligonucleotide; BTLA exon 2; Set C
uauaagaaaaauaucagauggucuagguguugagaa

SEQ ID NO: 49979 - RNA, 29 nt, Artificial Sequence
  Synthetic Oligonucleotide; BTLA exon 2; Set C
aagaaaaauaucagauggucuagguguug

SEQ ID NO: 49980 - RNA, 39 nt, Artificial Sequence
  Synthetic Oligonucleotide; BTLA exon 2; Set B
auuauaagaaaaauaucagauggucuagguguugagaac

SEQ ID NO: 49981 - RNA, 31 nt, Artificial Sequence
  Synthetic Oligonucleotide; BTLA exon 2; Set C
uaagaaaaauaucagauggucuagguguuga

SEQ ID NO: 49982 - RNA, 33 nt, Artificial Sequence
  Synthetic Oligonucleotide; BTLA exon 2; Set C
auaagaaaaauaucagauggucuagguguugag

SEQ ID NO: 49983 - RNA, 37 nt, Artificial Sequence
  Synthetic Oligonucleotide; BTLA exon 2; Set B
uuauaagaaaaauaucagauggucuagguguugagaa

SEQ ID NO: 49984 - RNA, 32 nt, Artificial Sequence
  Synthetic Oligonucleotide; BTLA exon 2; Set C
auaagaaaaauaucagauggucuagguguuga

SEQ ID NO: 49985 - RNA, 34 nt, Artificial Sequence
  Synthetic Oligonucleotide; BTLA exon 2; Set C
uauaagaaaaauaucagauggucuagguguugag

SEQ ID NO: 49986 - RNA, 33 nt, Artificial Sequence
  Synthetic Oligonucleotide; BTLA exon 2; Set C
uauaagaaaaauaucagauggucuagguguuga

SEQ ID NO: 49987 - RNA, 35 nt, Artificial Sequence
  Synthetic Oligonucleotide; BTLA exon 2; Set C
uuauaagaaaaauaucagauggucuagguguugag

SEQ ID NO: 49988 - RNA, 34 nt, Artificial Sequence
  Synthetic Oligonucleotide; BTLA exon 2; Set C
uuauaagaaaaauaucagauggucuagguguuga

SEQ ID NO: 49989 - RNA, 36 nt, Artificial Sequence
  Synthetic Oligonucleotide; BTLA exon 2; Set C
auuauaagaaaaauaucagauggucuagguguugag

SEQ ID NO: 49990 - RNA, 35 nt, Artificial Sequence
  Synthetic Oligonucleotide; BTLA exon 2; Set C
auuauaagaaaaauaucagauggucuagguguuga

SEQ ID NO: 49991 - RNA, 34 nt, Artificial Sequence
  Synthetic Oligonucleotide; BTLA exon 2; Set C
auuauaagaaaaauaucagauggucuagguguug

SEQ ID NO: 49992 - RNA, 35 nt, Artificial Sequence
  Synthetic Oligonucleotide; BTLA exon 2; Set C
cauuauaagaaaaauaucagauggucuagguguug

SEQ ID NO: 49993 - RNA, 36 nt, Artificial Sequence
  Synthetic Oligonucleotide; BTLA exon 2; Set C
acauuauaagaaaaauaucagauggucuagguguug

SEQ ID NO: 49994 - RNA, 35 nt, Artificial Sequence
  Synthetic Oligonucleotide; BTLA exon 2; Set C
acauuauaagaaaaauaucagauggucuagguguu

SEQ ID NO: 49995 - RNA, 33 nt, Artificial Sequence
  Synthetic Oligonucleotide; BTLA exon 2; Set C
cauuauaagaaaaauaucagauggucuaggugu

SEQ ID NO: 49996 - RNA, 36 nt, Artificial Sequence
  Synthetic Oligonucleotide; BTLA exon 2; Set C
aacauuauaagaaaaauaucagauggucuagguguu

SEQ ID NO: 49997 - RNA, 32 nt, Artificial Sequence
  Synthetic Oligonucleotide; BTLA exon 2; Set C
cauuauaagaaaaauaucagauggucuaggug

SEQ ID NO: 49998 - RNA, 34 nt, Artificial Sequence
  Synthetic Oligonucleotide; BTLA exon 2; Set C
acauuauaagaaaaauaucagauggucuaggugu

SEQ ID NO: 49999 - RNA, 37 nt, Artificial Sequence
  Synthetic Oligonucleotide; BTLA exon 2; Set C
aaacauuauaagaaaaauaucagauggucuagguguu

SEQ ID NO: 50000 - RNA, 33 nt, Artificial Sequence
  Synthetic Oligonucleotide; BTLA exon 2; Set C
acauuauaagaaaaauaucagauggucuaggug

SEQ ID NO: 50001 - RNA, 35 nt, Artificial Sequence
  Synthetic Oligonucleotide; BTLA exon 2; Set C
aacauuauaagaaaaauaucagauggucuaggugu

SEQ ID NO: 50002 - RNA, 31 nt, Artificial Sequence
  Synthetic Oligonucleotide; BTLA exon 2; Set C
cauuauaagaaaaauaucagauggucuaggu

SEQ ID NO: 50003 - RNA, 39 nt, Artificial Sequence
  Synthetic Oligonucleotide; BTLA exon 2; Set B
gaaacauuauaagaaaaauaucagauggucuagguguug

SEQ ID NO: 50004 - RNA, 34 nt, Artificial Sequence
  Synthetic Oligonucleotide; BTLA exon 2; Set C
aacauuauaagaaaaauaucagauggucuaggug

SEQ ID NO: 50005 - RNA, 36 nt, Artificial Sequence
  Synthetic Oligonucleotide; BTLA exon 2; Set C
aaacauuauaagaaaaauaucagauggucuaggugu

SEQ ID NO: 50006 - RNA, 32 nt, Artificial Sequence
  Synthetic Oligonucleotide; BTLA exon 2; Set C
acauuauaagaaaaauaucagauggucuaggu

SEQ ID NO: 50007 - RNA, 30 nt, Artificial Sequence
  Synthetic Oligonucleotide; BTLA exon 2; Set C
cauuauaagaaaaauaucagauggucuagg

SEQ ID NO: 50008 - RNA, 40 nt, Artificial Sequence
  Synthetic Oligonucleotide; BTLA exon 2; Set B
ggaaacauuauaagaaaaauaucagauggucuagguguug

SEQ ID NO: 50009 - RNA, 35 nt, Artificial Sequence
  Synthetic Oligonucleotide; BTLA exon 2; Set C
aaacauuauaagaaaaauaucagauggucuaggug

SEQ ID NO: 50010 - RNA, 37 nt, Artificial Sequence
  Synthetic Oligonucleotide; BTLA exon 2; Set C
gaaacauuauaagaaaaauaucagauggucuaggugu

SEQ ID NO: 50011 - RNA, 33 nt, Artificial Sequence
  Synthetic Oligonucleotide; BTLA exon 2; Set C
aacauuauaagaaaaauaucagauggucuaggu

SEQ ID NO: 50012 - RNA, 31 nt, Artificial Sequence
  Synthetic Oligonucleotide; BTLA exon 2; Set C
acauuauaagaaaaauaucagauggucuagg

SEQ ID NO: 50013 - RNA, 40 nt, Artificial Sequence
  Synthetic Oligonucleotide; BTLA exon 2; Set B
uggaaacauuauaagaaaaauaucagauggucuagguguu

SEQ ID NO: 50014 - RNA, 36 nt, Artificial Sequence
  Synthetic Oligonucleotide; BTLA exon 2; Set C
gaaacauuauaagaaaaauaucagauggucuaggug

SEQ ID NO: 50015 - RNA, 34 nt, Artificial Sequence
  Synthetic Oligonucleotide; BTLA exon 2; Set C
aaacauuauaagaaaaauaucagauggucuaggu

SEQ ID NO: 50016 - RNA, 32 nt, Artificial Sequence
  Synthetic Oligonucleotide; BTLA exon 2; Set C
aacauuauaagaaaaauaucagauggucuagg

SEQ ID NO: 50017 - RNA, 31 nt, Artificial Sequence
  Synthetic Oligonucleotide; BTLA exon 2; Set C
aacauuauaagaaaaauaucagauggucuag

SEQ ID NO: 50018 - RNA, 29 nt, Artificial Sequence
  Synthetic Oligonucleotide; BTLA exon 2; Set C
acauuauaagaaaaauaucagauggucua

SEQ ID NO: 50019 - RNA, 39 nt, Artificial Sequence
  Synthetic Oligonucleotide; BTLA exon 2; Set B
uggaaacauuauaagaaaaauaucagauggucuaggugu

SEQ ID NO: 50020 - RNA, 35 nt, Artificial Sequence
  Synthetic Oligonucleotide; BTLA exon 2; Set C
gaaacauuauaagaaaaauaucagauggucuaggu

SEQ ID NO: 50021 - RNA, 33 nt, Artificial Sequence
  Synthetic Oligonucleotide; BTLA exon 2; Set C
aaacauuauaagaaaaauaucagauggucuagg

SEQ ID NO: 50022 - RNA, 15 nt, Artificial Sequence
  Synthetic Oligonucleotide; BTLA exon 2; Set C
aagaaaaauaucaga

SEQ ID NO: 50023 - RNA, 32 nt, Artificial Sequence
  Synthetic Oligonucleotide; BTLA exon 2; Set C
aaacauuauaagaaaaauaucagauggucuag

SEQ ID NO: 50024 - RNA, 30 nt, Artificial Sequence
  Synthetic Oligonucleotide; BTLA exon 2; Set C
aacauuauaagaaaaauaucagauggucua

SEQ ID NO: 50025 - RNA, 38 nt, Artificial Sequence
  Synthetic Oligonucleotide; BTLA exon 2; Set B
uggaaacauuauaagaaaaauaucagauggucuaggug

SEQ ID NO: 50026 - RNA, 36 nt, Artificial Sequence
  Synthetic Oligonucleotide; BTLA exon 2; Set C
ggaaacauuauaagaaaaauaucagauggucuaggu

SEQ ID NO: 50027 - RNA, 34 nt, Artificial Sequence
  Synthetic Oligonucleotide; BTLA exon 2; Set C
gaaacauuauaagaaaaauaucagauggucuagg

SEQ ID NO: 50028 - RNA, 31 nt, Artificial Sequence
  Synthetic Oligonucleotide; BTLA exon 2; Set C
aaacauuauaagaaaaauaucagauggucua

SEQ ID NO: 50029 - RNA, 37 nt, Artificial Sequence
  Synthetic Oligonucleotide; BTLA exon 2; Set B
uggaaacauuauaagaaaaauaucagauggucuaggu

SEQ ID NO: 50030 - RNA, 35 nt, Artificial Sequence
  Synthetic Oligonucleotide; BTLA exon 2; Set C
ggaaacauuauaagaaaaauaucagauggucuagg

SEQ ID NO: 50031 - RNA, 36 nt, Artificial Sequence
  Synthetic Oligonucleotide; BTLA exon 2; Set C
uggaaacauuauaagaaaaauaucagauggucuagg

SEQ ID NO: 50032 - RNA, 27 nt, Artificial Sequence
  Synthetic Oligonucleotide; BTLA exon 2; Set C
aacauuauaagaaaaauaucagauggu

SEQ ID NO: 50033 - RNA, 35 nt, Artificial Sequence
  Synthetic Oligonucleotide; BTLA exon 2; Set C
uggaaacauuauaagaaaaauaucagauggucuag

SEQ ID NO: 50034 - RNA, 23 nt, Artificial Sequence
  Synthetic Oligonucleotide; BTLA exon 2; Set C
cauuauaagaaaaauaucagaug

SEQ ID NO: 50035 - RNA, 28 nt, Artificial Sequence
  Synthetic Oligonucleotide; BTLA exon 2; Set C
aaacauuauaagaaaaauaucagauggu

SEQ ID NO: 50036 - RNA, 34 nt, Artificial Sequence
  Synthetic Oligonucleotide; BTLA exon 2; Set C
uggaaacauuauaagaaaaauaucagauggucua

SEQ ID NO: 50037 - RNA, 24 nt, Artificial Sequence
  Synthetic Oligonucleotide; BTLA exon 2; Set C
acauuauaagaaaaauaucagaug

SEQ ID NO: 50038 - RNA, 22 nt, Artificial Sequence
  Synthetic Oligonucleotide; BTLA exon 2; Set C
cauuauaagaaaaauaucagau

SEQ ID NO: 50039 - RNA, 25 nt, Artificial Sequence
  Synthetic Oligonucleotide; BTLA exon 2; Set C
aacauuauaagaaaaauaucagaug

SEQ ID NO: 50040 - RNA, 23 nt, Artificial Sequence
  Synthetic Oligonucleotide; BTLA exon 2; Set C
acauuauaagaaaaauaucagau

SEQ ID NO: 50041 - RNA, 21 nt, Artificial Sequence
  Synthetic Oligonucleotide; BTLA exon 2; Set C
cauuauaagaaaaauaucaga

SEQ ID NO: 50042 - RNA, 19 nt, Artificial Sequence
  Synthetic Oligonucleotide; BTLA exon 2; Set C
auuauaagaaaaauaucag

SEQ ID NO: 50043 - RNA, 26 nt, Artificial Sequence
  Synthetic Oligonucleotide; BTLA exon 2; Set C
aaacauuauaagaaaaauaucagaug

SEQ ID NO: 50044 - RNA, 24 nt, Artificial Sequence
  Synthetic Oligonucleotide; BTLA exon 2; Set C
aacauuauaagaaaaauaucagau

SEQ ID NO: 50045 - RNA, 22 nt, Artificial Sequence
  Synthetic Oligonucleotide; BTLA exon 2; Set C
acauuauaagaaaaauaucaga

SEQ ID NO: 50046 - RNA, 20 nt, Artificial Sequence
  Synthetic Oligonucleotide; BTLA exon 2; Set C
cauuauaagaaaaauaucag

SEQ ID NO: 50047 - RNA, 18 nt, Artificial Sequence
  Synthetic Oligonucleotide; BTLA exon 2; Set C
auuauaagaaaaauauca

SEQ ID NO: 50048 - RNA, 31 nt, Artificial Sequence
  Synthetic Oligonucleotide; BTLA exon 2; Set C
uggaaacauuauaagaaaaauaucagauggu

SEQ ID NO: 50049 - RNA, 27 nt, Artificial Sequence
  Synthetic Oligonucleotide; BTLA exon 2; Set C
gaaacauuauaagaaaaauaucagaug

SEQ ID NO: 50050 - RNA, 25 nt, Artificial Sequence
  Synthetic Oligonucleotide; BTLA exon 2; Set C
aaacauuauaagaaaaauaucagau

SEQ ID NO: 50051 - RNA, 23 nt, Artificial Sequence
  Synthetic Oligonucleotide; BTLA exon 2; Set C
aacauuauaagaaaaauaucaga

SEQ ID NO: 50052 - RNA, 21 nt, Artificial Sequence
  Synthetic Oligonucleotide; BTLA exon 2; Set C
acauuauaagaaaaauaucag

SEQ ID NO: 50053 - RNA, 19 nt, Artificial Sequence
  Synthetic Oligonucleotide; BTLA exon 2; Set C
cauuauaagaaaaauauca

SEQ ID NO: 50054 - RNA, 28 nt, Artificial Sequence
  Synthetic Oligonucleotide; BTLA exon 2; Set C
ggaaacauuauaagaaaaauaucagaug

SEQ ID NO: 50055 - RNA, 26 nt, Artificial Sequence
  Synthetic Oligonucleotide; BTLA exon 2; Set C
gaaacauuauaagaaaaauaucagau

SEQ ID NO: 50056 - RNA, 24 nt, Artificial Sequence
  Synthetic Oligonucleotide; BTLA exon 2; Set C
aaacauuauaagaaaaauaucaga

SEQ ID NO: 50057 - RNA, 20 nt, Artificial Sequence
  Synthetic Oligonucleotide; BTLA exon 2; Set C
acauuauaagaaaaauauca

SEQ ID NO: 50058 - RNA, 19 nt, Artificial Sequence
  Synthetic Oligonucleotide; BTLA exon 2; Set C
acauuauaagaaaaauauc

SEQ ID NO: 50059 - RNA, 29 nt, Artificial Sequence
  Synthetic Oligonucleotide; BTLA exon 2; Set C
uggaaacauuauaagaaaaauaucagaug

SEQ ID NO: 50060 - RNA, 27 nt, Artificial Sequence
  Synthetic Oligonucleotide; BTLA exon 2; Set C
ggaaacauuauaagaaaaauaucagau

SEQ ID NO: 50061 - RNA, 25 nt, Artificial Sequence
  Synthetic Oligonucleotide; BTLA exon 2; Set C
gaaacauuauaagaaaaauaucaga

SEQ ID NO: 50062 - RNA, 20 nt, Artificial Sequence
  Synthetic Oligonucleotide; BTLA exon 2; Set C
aacauuauaagaaaaauauc

SEQ ID NO: 50063 - RNA, 28 nt, Artificial Sequence
  Synthetic Oligonucleotide; BTLA exon 2; Set C
uggaaacauuauaagaaaaauaucagau

SEQ ID NO: 50064 - RNA, 26 nt, Artificial Sequence
  Synthetic Oligonucleotide; BTLA exon 2; Set C
ggaaacauuauaagaaaaauaucaga

SEQ ID NO: 50065 - RNA, 24 nt, Artificial Sequence
  Synthetic Oligonucleotide; BTLA exon 2; Set C
gaaacauuauaagaaaaauaucag

SEQ ID NO: 50066 - RNA, 21 nt, Artificial Sequence
  Synthetic Oligonucleotide; BTLA exon 2; Set C
aaacauuauaagaaaaauauc

SEQ ID NO: 50067 - RNA, 27 nt, Artificial Sequence
  Synthetic Oligonucleotide; BTLA exon 2; Set C
uggaaacauuauaagaaaaauaucaga

SEQ ID NO: 50068 - RNA, 25 nt, Artificial Sequence
  Synthetic Oligonucleotide; BTLA exon 2; Set C
ggaaacauuauaagaaaaauaucag

SEQ ID NO: 50069 - RNA, 23 nt, Artificial Sequence
  Synthetic Oligonucleotide; BTLA exon 2; Set C
gaaacauuauaagaaaaauauca

SEQ ID NO: 50070 - RNA, 22 nt, Artificial Sequence
  Synthetic Oligonucleotide; BTLA exon 2; Set C
gaaacauuauaagaaaaauauc

SEQ ID NO: 50071 - RNA, 24 nt, Artificial Sequence
  Synthetic Oligonucleotide; BTLA exon 2; Set C
ggaaacauuauaagaaaaauauca

SEQ ID NO: 50072 - RNA, 17 nt, Artificial Sequence
  Synthetic Oligonucleotide; BTLA exon 2; Set C
aacauuauaagaaaaau

SEQ ID NO: 50073 - RNA, 18 nt, Artificial Sequence
  Synthetic Oligonucleotide; BTLA exon 2; Set C
aaacauuauaagaaaaau

SEQ ID NO: 50074 - RNA, 16 nt, Artificial Sequence
  Synthetic Oligonucleotide; BTLA exon 2; Set C
aacauuauaagaaaaa

SEQ ID NO: 50075 - RNA, 24 nt, Artificial Sequence
  Synthetic Oligonucleotide; BTLA exon 2; Set C
uggaaacauuauaagaaaaauauc

SEQ ID NO: 50076 - RNA, 17 nt, Artificial Sequence
  Synthetic Oligonucleotide; BTLA exon 2; Set C
aaacauuauaagaaaaa

SEQ ID NO: 50077 - RNA, 15 nt, Artificial Sequence
  Synthetic Oligonucleotide; BTLA exon 2; Set C
aacauuauaagaaaa

SEQ ID NO: 50078 - RNA, 16 nt, Artificial Sequence
  Synthetic Oligonucleotide; BTLA exon 2; Set C
aaacauuauaagaaaa

SEQ ID NO: 50079 - RNA, 21 nt, Artificial Sequence
  Synthetic Oligonucleotide; BTLA exon 2; Set C
uggaaacauuauaagaaaaau

SEQ ID NO: 50080 - RNA, 15 nt, Artificial Sequence
  Synthetic Oligonucleotide; BTLA exon 2; Set C
aaacauuauaagaaa

SEQ ID NO: 50081 - RNA, 20 nt, Artificial Sequence
  Synthetic Oligonucleotide; BTLA exon 2; Set C
uggaaacauuauaagaaaaa

SEQ ID NO: 50082 - RNA, 19 nt, Artificial Sequence
  Synthetic Oligonucleotide; BTLA exon 2; Set C
uggaaacauuauaagaaaa

SEQ ID NO: 50083 - RNA, 18 nt, Artificial Sequence
  Synthetic Oligonucleotide; BTLA exon 2; Set C
uggaaacauuauaagaaa

SEQ ID NO: 50084 - RNA, 17 nt, Artificial Sequence
  Synthetic Oligonucleotide; BTLA exon 2; Set C
uggaaacauuauaagaa

SEQ ID NO: 50085 - RNA, 16 nt, Artificial Sequence
  Synthetic Oligonucleotide; BTLA exon 2; Set C
uggaaacauuauaaga

SEQ ID NO: 50086 - RNA, 15 nt, Artificial Sequence
  Synthetic Oligonucleotide; BTLA exon 2; Set C
uggaaacauuauaag

SEQ ID NO: 50087 - RNA, 29 nt, Artificial Sequence
  Synthetic Oligonucleotide; BTLA exon 2; Set C
cuaaaaucaaauauguucuucuggaagua

SEQ ID NO: 50088 - RNA, 28 nt, Artificial Sequence
  Synthetic Oligonucleotide; BTLA exon 2; Set C
cuaaaaucaaauauguucuucuggaagu

SEQ ID NO: 50089 - RNA, 29 nt, Artificial Sequence
  Synthetic Oligonucleotide; BTLA exon 2; Set C
acuaaaaucaaauauguucuucuggaagu

SEQ ID NO: 50090 - RNA, 27 nt, Artificial Sequence
  Synthetic Oligonucleotide; BTLA exon 2; Set C
cuaaaaucaaauauguucuucuggaag

SEQ ID NO: 50091 - RNA, 30 nt, Artificial Sequence
  Synthetic Oligonucleotide; BTLA exon 2; Set C
aacuaaaaucaaauauguucuucuggaagu

SEQ ID NO: 50092 - RNA, 22 nt, Artificial Sequence
  Synthetic Oligonucleotide; BTLA exon 2; Set C
cuaaaaucaaauauguucuucu

SEQ ID NO: 50093 - RNA, 22 nt, Artificial Sequence
  Synthetic Oligonucleotide; BTLA exon 2; Set C
acuaaaaucaaauauguucuuc

SEQ ID NO: 50094 - RNA, 21 nt, Artificial Sequence
  Synthetic Oligonucleotide; BTLA exon 2; Set C
acuaaaaucaaauauguucuu

SEQ ID NO: 50095 - RNA, 23 nt, Artificial Sequence
  Synthetic Oligonucleotide; BTLA exon 2; Set C
aacuaaaaucaaauauguucuuc

SEQ ID NO: 50096 - RNA, 20 nt, Artificial Sequence
  Synthetic Oligonucleotide; BTLA exon 2; Set C
acuaaaaucaaauauguucu

SEQ ID NO: 50097 - RNA, 22 nt, Artificial Sequence
  Synthetic Oligonucleotide; BTLA exon 2; Set C
aacuaaaaucaaauauguucuu

SEQ ID NO: 50098 - RNA, 21 nt, Artificial Sequence
  Synthetic Oligonucleotide; BTLA exon 2; Set C
aacuaaaaucaaauauguucu

SEQ ID NO: 50099 - RNA, 19 nt, Artificial Sequence
  Synthetic Oligonucleotide; BTLA exon 2; Set C
acuaaaaucaaauauguuc

SEQ ID NO: 50100 - RNA, 18 nt, Artificial Sequence
  Synthetic Oligonucleotide; BTLA exon 2; Set C
acuaaaaucaaauauguu

SEQ ID NO: 50101 - RNA, 20 nt, Artificial Sequence
  Synthetic Oligonucleotide; BTLA exon 2; Set C
aacuaaaaucaaauauguuc

SEQ ID NO: 50102 - RNA, 16 nt, Artificial Sequence
  Synthetic Oligonucleotide; BTLA exon 2; Set C
cuaaaaucaaauaugu

SEQ ID NO: 50103 - RNA, 19 nt, Artificial Sequence
  Synthetic Oligonucleotide; BTLA exon 2; Set C
aacuaaaaucaaauauguu

SEQ ID NO: 50104 - RNA, 15 nt, Artificial Sequence
  Synthetic Oligonucleotide; BTLA exon 2; Set C
cuaaaaucaaauaug

SEQ ID NO: 50105 - RNA, 18 nt, Artificial Sequence
  Synthetic Oligonucleotide; BTLA exon 2; Set C
aacuaaaaucaaauaugu

SEQ ID NO: 50106 - RNA, 23 nt, Artificial Sequence
  Synthetic Oligonucleotide; BTLA exon 2; Set C
ccuaaaagauaaaaacaaaacua

SEQ ID NO: 50107 - RNA, 31 nt, Artificial Sequence
  Synthetic Oligonucleotide; BTLA exon 2; Set C
auucuuucccuaaaagauaaaaacaaaacua

SEQ ID NO: 50108 - RNA, 32 nt, Artificial Sequence
  Synthetic Oligonucleotide; BTLA exon 2; Set C
gauucuuucccuaaaagauaaaaacaaaacua

SEQ ID NO: 50109 - RNA, 38 nt, Artificial Sequence
  Synthetic Oligonucleotide; BTLA exon 2; Set C
acaucacaugauucuuucccuaaaagauaaaaacaaaa

SEQ ID NO: 50110 - RNA, 39 nt, Artificial Sequence
  Synthetic Oligonucleotide; BTLA exon 2; Set C
uacaucacaugauucuuucccuaaaagauaaaaacaaaa

SEQ ID NO: 50111 - RNA, 33 nt, Artificial Sequence
  Synthetic Oligonucleotide; BTLA exon 2; Set C
acaucacaugauucuuucccuaaaagauaaaaa

SEQ ID NO: 50112 - RNA, 34 nt, Artificial Sequence
  Synthetic Oligonucleotide; BTLA exon 2; Set C
uacaucacaugauucuuucccuaaaagauaaaaa

SEQ ID NO: 50113 - RNA, 29 nt, Artificial Sequence
  Synthetic Oligonucleotide; BTLA exon 2; Set C
acaucacaugauucuuucccuaaaagaua

SEQ ID NO: 50114 - RNA, 28 nt, Artificial Sequence
  Synthetic Oligonucleotide; BTLA exon 2; Set C
acaucacaugauucuuucccuaaaagau

SEQ ID NO: 50115 - RNA, 30 nt, Artificial Sequence
  Synthetic Oligonucleotide; BTLA exon 2; Set C
uacaucacaugauucuuucccuaaaagaua

SEQ ID NO: 50116 - RNA, 29 nt, Artificial Sequence
  Synthetic Oligonucleotide; BTLA exon 2; Set C
uacaucacaugauucuuucccuaaaagau

SEQ ID NO: 50117 - RNA, 27 nt, Artificial Sequence
  Synthetic Oligonucleotide; BTLA exon 2; Set C
acaucacaugauucuuucccuaaaaga

SEQ ID NO: 50118 - RNA, 28 nt, Artificial Sequence
  Synthetic Oligonucleotide; BTLA exon 2; Set C
uacaucacaugauucuuucccuaaaaga

SEQ ID NO: 50119 - RNA, 26 nt, Artificial Sequence
  Synthetic Oligonucleotide; BTLA exon 2; Set C
acaucacaugauucuuucccuaaaag

SEQ ID NO: 50120 - RNA, 27 nt, Artificial Sequence
  Synthetic Oligonucleotide; BTLA exon 2; Set C
uacaucacaugauucuuucccuaaaag

SEQ ID NO: 50121 - RNA, 25 nt, Artificial Sequence
  Synthetic Oligonucleotide; BTLA exon 2; Set C
acaucacaugauucuuucccuaaaa

SEQ ID NO: 50122 - RNA, 26 nt, Artificial Sequence
  Synthetic Oligonucleotide; BTLA exon 2; Set C
uacaucacaugauucuuucccuaaaa

SEQ ID NO: 50123 - RNA, 32 nt, Artificial Sequence
  Synthetic Oligonucleotide; BTLA exon 2; Set A
guguucagauugucucuuuauauaaagcugua

SEQ ID NO: 50124 - RNA, 31 nt, Artificial Sequence
  Synthetic Oligonucleotide; BTLA exon 2; Set A
guguucagauugucucuuuauauaaagcugu

SEQ ID NO: 50125 - RNA, 30 nt, Artificial Sequence
  Synthetic Oligonucleotide; BTLA exon 2; Set C
guguucagauugucucuuuauauaaagcug

SEQ ID NO: 50126 - RNA, 34 nt, Artificial Sequence
  Synthetic Oligonucleotide; BTLA exon 2; Set A
ggaguguucagauugucucuuuauauaaagcugu

SEQ ID NO: 50127 - RNA, 36 nt, Artificial Sequence
  Synthetic Oligonucleotide; BTLA exon 2; Set A
uggaguguucagauugucucuuuauauaaagcugua

SEQ ID NO: 50128 - RNA, 35 nt, Artificial Sequence
  Synthetic Oligonucleotide; BTLA exon 2; Set A
uggaguguucagauugucucuuuauauaaagcugu

SEQ ID NO: 50129 - RNA, 37 nt, Artificial Sequence
  Synthetic Oligonucleotide; BTLA exon 2; Set A
auggaguguucagauugucucuuuauauaaagcugua

SEQ ID NO: 50130 - RNA, 19 nt, Artificial Sequence
  Synthetic Oligonucleotide; BTLA exon 2; Set C
ucagauugucucuuuauau

SEQ ID NO: 50131 - RNA, 36 nt, Artificial Sequence
  Synthetic Oligonucleotide; BTLA exon 2; Set A
auggaguguucagauugucucuuuauauaaagcugu

SEQ ID NO: 50132 - RNA, 35 nt, Artificial Sequence
  Synthetic Oligonucleotide; BTLA exon 2; Set A
auggaguguucagauugucucuuuauauaaagcug

SEQ ID NO: 50133 - RNA, 21 nt, Artificial Sequence
  Synthetic Oligonucleotide; BTLA exon 2; Set C
guucagauugucucuuuauau

SEQ ID NO: 50134 - RNA, 22 nt, Artificial Sequence
  Synthetic Oligonucleotide; BTLA exon 2; Set C
uguucagauugucucuuuauau

SEQ ID NO: 50135 - RNA, 23 nt, Artificial Sequence
  Synthetic Oligonucleotide; BTLA exon 2; Set C
aguguucagauugucucuuuaua

SEQ ID NO: 50136 - RNA, 24 nt, Artificial Sequence
  Synthetic Oligonucleotide; BTLA exon 2; Set C
gaguguucagauugucucuuuaua

SEQ ID NO: 50137 - RNA, 22 nt, Artificial Sequence
  Synthetic Oligonucleotide; BTLA exon 2; Set C
aguguucagauugucucuuuau

SEQ ID NO: 50138 - RNA, 21 nt, Artificial Sequence
  Synthetic Oligonucleotide; BTLA exon 2; Set C
aguguucagauugucucuuua

SEQ ID NO: 50139 - RNA, 25 nt, Artificial Sequence
  Synthetic Oligonucleotide; BTLA exon 2; Set C
ggaguguucagauugucucuuuaua

SEQ ID NO: 50140 - RNA, 23 nt, Artificial Sequence
  Synthetic Oligonucleotide; BTLA exon 2; Set C
gaguguucagauugucucuuuau

SEQ ID NO: 50141 - RNA, 22 nt, Artificial Sequence
  Synthetic Oligonucleotide; BTLA exon 2; Set C
gaguguucagauugucucuuua

SEQ ID NO: 50142 - RNA, 26 nt, Artificial Sequence
  Synthetic Oligonucleotide; BTLA exon 2; Set C
uggaguguucagauugucucuuuaua

SEQ ID NO: 50143 - RNA, 24 nt, Artificial Sequence
  Synthetic Oligonucleotide; BTLA exon 2; Set C
ggaguguucagauugucucuuuau

SEQ ID NO: 50144 - RNA, 20 nt, Artificial Sequence
  Synthetic Oligonucleotide; BTLA exon 2; Set C
aguguucagauugucucuuu

SEQ ID NO: 50145 - RNA, 23 nt, Artificial Sequence
  Synthetic Oligonucleotide; BTLA exon 2; Set C
ggaguguucagauugucucuuua

SEQ ID NO: 50146 - RNA, 27 nt, Artificial Sequence
  Synthetic Oligonucleotide; BTLA exon 2; Set C
auggaguguucagauugucucuuuaua

SEQ ID NO: 50147 - RNA, 25 nt, Artificial Sequence
  Synthetic Oligonucleotide; BTLA exon 2; Set C
uggaguguucagauugucucuuuau

SEQ ID NO: 50148 - RNA, 21 nt, Artificial Sequence
  Synthetic Oligonucleotide; BTLA exon 2; Set C
gaguguucagauugucucuuu

SEQ ID NO: 50149 - RNA, 17 nt, Artificial Sequence
  Synthetic Oligonucleotide; BTLA exon 2; Set C
guguucagauugucucu

SEQ ID NO: 50150 - RNA, 29 nt, Artificial Sequence
  Synthetic Oligonucleotide; BTLA exon 2; Set A
gauggaguguucagauugucucuuuauau

SEQ ID NO: 50151 - RNA, 24 nt, Artificial Sequence
  Synthetic Oligonucleotide; BTLA exon 2; Set C
uggaguguucagauugucucuuua

SEQ ID NO: 50152 - RNA, 26 nt, Artificial Sequence
  Synthetic Oligonucleotide; BTLA exon 2; Set C
auggaguguucagauugucucuuuau

SEQ ID NO: 50153 - RNA, 22 nt, Artificial Sequence
  Synthetic Oligonucleotide; BTLA exon 2; Set C
ggaguguucagauugucucuuu

SEQ ID NO: 50154 - RNA, 16 nt, Artificial Sequence
  Synthetic Oligonucleotide; BTLA exon 2; Set C
guguucagauugucuc

SEQ ID NO: 50155 - RNA, 25 nt, Artificial Sequence
  Synthetic Oligonucleotide; BTLA exon 2; Set C
auggaguguucagauugucucuuua

SEQ ID NO: 50156 - RNA, 23 nt, Artificial Sequence
  Synthetic Oligonucleotide; BTLA exon 2; Set C
uggaguguucagauugucucuuu

SEQ ID NO: 50157 - RNA, 21 nt, Artificial Sequence
  Synthetic Oligonucleotide; BTLA exon 2; Set C
ggaguguucagauugucucuu

SEQ ID NO: 50158 - RNA, 31 nt, Artificial Sequence
  Synthetic Oligonucleotide; BTLA exon 2; Set A
aagauggaguguucagauugucucuuuauau

SEQ ID NO: 50159 - RNA, 24 nt, Artificial Sequence
  Synthetic Oligonucleotide; BTLA exon 2; Set C
auggaguguucagauugucucuuu

SEQ ID NO: 50160 - RNA, 16 nt, Artificial Sequence
  Synthetic Oligonucleotide; BTLA exon 2; Set C
aguguucagauugucu

SEQ ID NO: 50161 - RNA, 22 nt, Artificial Sequence
  Synthetic Oligonucleotide; BTLA exon 2; Set C
uggaguguucagauugucucuu

SEQ ID NO: 50162 - RNA, 32 nt, Artificial Sequence
  Synthetic Oligonucleotide; BTLA exon 2; Set A
uaagauggaguguucagauugucucuuuauau

SEQ ID NO: 50163 - RNA, 15 nt, Artificial Sequence
  Synthetic Oligonucleotide; BTLA exon 2; Set C
aguguucagauuguc

SEQ ID NO: 50164 - RNA, 23 nt, Artificial Sequence
  Synthetic Oligonucleotide; BTLA exon 2; Set C
auggaguguucagauugucucuu

SEQ ID NO: 50165 - RNA, 33 nt, Artificial Sequence
  Synthetic Oligonucleotide; BTLA exon 2; Set A
cuaagauggaguguucagauugucucuuuauau

SEQ ID NO: 50166 - RNA, 16 nt, Artificial Sequence
  Synthetic Oligonucleotide; BTLA exon 2; Set C
gaguguucagauuguc

SEQ ID NO: 50167 - RNA, 18 nt, Artificial Sequence
  Synthetic Oligonucleotide; BTLA exon 2; Set C
ggaguguucagauugucu

SEQ ID NO: 50168 - RNA, 34 nt, Artificial Sequence
  Synthetic Oligonucleotide; BTLA exon 2; Set A
gcuaagauggaguguucagauugucucuuuauau

SEQ ID NO: 50169 - RNA, 17 nt, Artificial Sequence
  Synthetic Oligonucleotide; BTLA exon 2; Set C
ggaguguucagauuguc

SEQ ID NO: 50170 - RNA, 15 nt, Artificial Sequence
  Synthetic Oligonucleotide; BTLA exon 2; Set C
gaguguucagauugu

SEQ ID NO: 50171 - RNA, 19 nt, Artificial Sequence
  Synthetic Oligonucleotide; BTLA exon 2; Set C
uggaguguucagauugucu

SEQ ID NO: 50172 - RNA, 35 nt, Artificial Sequence
  Synthetic Oligonucleotide; BTLA exon 2; Set A
ugcuaagauggaguguucagauugucucuuuauau

SEQ ID NO: 50173 - RNA, 18 nt, Artificial Sequence
  Synthetic Oligonucleotide; BTLA exon 2; Set C
uggaguguucagauuguc

SEQ ID NO: 50174 - RNA, 16 nt, Artificial Sequence
  Synthetic Oligonucleotide; BTLA exon 2; Set C
ggaguguucagauugu

SEQ ID NO: 50175 - RNA, 20 nt, Artificial Sequence
  Synthetic Oligonucleotide; BTLA exon 2; Set C
auggaguguucagauugucu

SEQ ID NO: 50176 - RNA, 19 nt, Artificial Sequence
  Synthetic Oligonucleotide; BTLA exon 2; Set C
auggaguguucagauuguc

SEQ ID NO: 50177 - RNA, 17 nt, Artificial Sequence
  Synthetic Oligonucleotide; BTLA exon 2; Set C
uggaguguucagauugu

SEQ ID NO: 50178 - RNA, 15 nt, Artificial Sequence
  Synthetic Oligonucleotide; BTLA exon 2; Set C
ggaguguucagauug

SEQ ID NO: 50179 - RNA, 18 nt, Artificial Sequence
  Synthetic Oligonucleotide; BTLA exon 2; Set C
auggaguguucagauugu

SEQ ID NO: 50180 - RNA, 16 nt, Artificial Sequence
  Synthetic Oligonucleotide; BTLA exon 2; Set C
uggaguguucagauug

SEQ ID NO: 50181 - RNA, 17 nt, Artificial Sequence
  Synthetic Oligonucleotide; BTLA exon 2; Set C
auggaguguucagauug

SEQ ID NO: 50182 - RNA, 15 nt, Artificial Sequence
  Synthetic Oligonucleotide; BTLA exon 2; Set C
uggaguguucagauu

SEQ ID NO: 50183 - RNA, 16 nt, Artificial Sequence
  Synthetic Oligonucleotide; BTLA exon 2; Set C
auggaguguucagauu

SEQ ID NO: 50184 - RNA, 15 nt, Artificial Sequence
  Synthetic Oligonucleotide; BTLA exon 2; Set C
auggaguguucagau

SEQ ID NO: 50185 - RNA, 32 nt, Artificial Sequence
  Synthetic Oligonucleotide; BTLA exon 2; Set A
uccugcuaagauggaguguucagauugucucu

SEQ ID NO: 50186 - RNA, 33 nt, Artificial Sequence
  Synthetic Oligonucleotide; BTLA exon 2; Set C
cuccugcuaagauggaguguucagauugucucu

SEQ ID NO: 50187 - RNA, 31 nt, Artificial Sequence
  Synthetic Oligonucleotide; BTLA exon 2; Set A
uccugcuaagauggaguguucagauugucuc

SEQ ID NO: 50188 - RNA, 32 nt, Artificial Sequence
  Synthetic Oligonucleotide; BTLA exon 2; Set A
cuccugcuaagauggaguguucagauugucuc

SEQ ID NO: 50189 - RNA, 40 nt, Artificial Sequence
  Synthetic Oligonucleotide; BTLA exon 2; Set C
gggaucuccugcuaagauggaguguucagauugucucuuu

SEQ ID NO: 50190 - RNA, 39 nt, Artificial Sequence
  Synthetic Oligonucleotide; BTLA exon 2; Set C
gggaucuccugcuaagauggaguguucagauugucucuu

SEQ ID NO: 50191 - RNA, 38 nt, Artificial Sequence
  Synthetic Oligonucleotide; BTLA exon 2; Set C
gggaucuccugcuaagauggaguguucagauugucucu

SEQ ID NO: 50192 - RNA, 37 nt, Artificial Sequence
  Synthetic Oligonucleotide; BTLA exon 2; Set C
gggaucuccugcuaagauggaguguucagauugucuc

SEQ ID NO: 50193 - RNA, 36 nt, Artificial Sequence
  Synthetic Oligonucleotide; BTLA exon 2; Set C
gggaucuccugcuaagauggaguguucagauugucu

SEQ ID NO: 50194 - RNA, 35 nt, Artificial Sequence
  Synthetic Oligonucleotide; BTLA exon 2; Set C
gggaucuccugcuaagauggaguguucagauuguc

SEQ ID NO: 50195 - RNA, 34 nt, Artificial Sequence
  Synthetic Oligonucleotide; BTLA exon 2; Set C
gggaucuccugcuaagauggaguguucagauugu

SEQ ID NO: 50196 - RNA, 22 nt, Artificial Sequence
  Synthetic Oligonucleotide; BTLA exon 2; Set A
uccugcuaagauggaguguuca

SEQ ID NO: 50197 - RNA, 33 nt, Artificial Sequence
  Synthetic Oligonucleotide; BTLA exon 2; Set C
gggaucuccugcuaagauggaguguucagauug

SEQ ID NO: 50198 - RNA, 21 nt, Artificial Sequence
  Synthetic Oligonucleotide; BTLA exon 2; Set C
uccugcuaagauggaguguuc

SEQ ID NO: 50199 - RNA, 23 nt, Artificial Sequence
  Synthetic Oligonucleotide; BTLA exon 2; Set A
cuccugcuaagauggaguguuca

SEQ ID NO: 50200 - RNA, 15 nt, Artificial Sequence
  Synthetic Oligonucleotide; BTLA exon 2; Set C
ugcuaagauggagug

SEQ ID NO: 50201 - RNA, 38 nt, Artificial Sequence
  Synthetic Oligonucleotide; BTLA exon 2; Set C
aaagggaucuccugcuaagauggaguguucagauuguc

SEQ ID NO: 50202 - RNA, 32 nt, Artificial Sequence
  Synthetic Oligonucleotide; BTLA exon 2; Set C
gggaucuccugcuaagauggaguguucagauu

SEQ ID NO: 50203 - RNA, 22 nt, Artificial Sequence
  Synthetic Oligonucleotide; BTLA exon 2; Set C
cuccugcuaagauggaguguuc

SEQ ID NO: 50204 - RNA, 40 nt, Artificial Sequence
  Synthetic Oligonucleotide; BTLA exon 2; Set C
caaagggaucuccugcuaagauggaguguucagauugucu

SEQ ID NO: 50205 - RNA, 20 nt, Artificial Sequence
  Synthetic Oligonucleotide; BTLA exon 2; Set C
uccugcuaagauggaguguu

SEQ ID NO: 50206 - RNA, 37 nt, Artificial Sequence
  Synthetic Oligonucleotide; BTLA exon 2; Set C
aaagggaucuccugcuaagauggaguguucagauugu

SEQ ID NO: 50207 - RNA, 31 nt, Artificial Sequence
  Synthetic Oligonucleotide; BTLA exon 2; Set C
gggaucuccugcuaagauggaguguucagau

SEQ ID NO: 50208 - RNA, 21 nt, Artificial Sequence
  Synthetic Oligonucleotide; BTLA exon 2; Set C
cuccugcuaagauggaguguu

SEQ ID NO: 50209 - RNA, 19 nt, Artificial Sequence
  Synthetic Oligonucleotide; BTLA exon 2; Set C
uccugcuaagauggagugu

SEQ ID NO: 50210 - RNA, 36 nt, Artificial Sequence
  Synthetic Oligonucleotide; BTLA exon 2; Set A
aaagggaucuccugcuaagauggaguguucagauug

SEQ ID NO: 50211 - RNA, 30 nt, Artificial Sequence
  Synthetic Oligonucleotide; BTLA exon 2; Set C
gggaucuccugcuaagauggaguguucaga

SEQ ID NO: 50212 - RNA, 20 nt, Artificial Sequence
  Synthetic Oligonucleotide; BTLA exon 2; Set C
cuccugcuaagauggagugu

SEQ ID NO: 50213 - RNA, 29 nt, Artificial Sequence
  Synthetic Oligonucleotide; BTLA exon 2; Set A
gggaucuccugcuaagauggaguguucag

SEQ ID NO: 50214 - RNA, 35 nt, Artificial Sequence
  Synthetic Oligonucleotide; BTLA exon 2; Set A
aaagggaucuccugcuaagauggaguguucagauu

SEQ ID NO: 50215 - RNA, 34 nt, Artificial Sequence
  Synthetic Oligonucleotide; BTLA exon 2; Set A
aaagggaucuccugcuaagauggaguguucagau

SEQ ID NO: 50216 - RNA, 33 nt, Artificial Sequence
  Synthetic Oligonucleotide; BTLA exon 2; Set A
aaagggaucuccugcuaagauggaguguucaga

SEQ ID NO: 50217 - RNA, 27 nt, Artificial Sequence
  Synthetic Oligonucleotide; BTLA exon 2; Set A
gggaucuccugcuaagauggaguguuc

SEQ ID NO: 50218 - RNA, 25 nt, Artificial Sequence
  Synthetic Oligonucleotide; BTLA exon 2; Set A
ggaucuccugcuaagauggaguguu

SEQ ID NO: 50219 - RNA, 21 nt, Artificial Sequence
  Synthetic Oligonucleotide; BTLA exon 2; Set C
aucuccugcuaagauggagug

SEQ ID NO: 50220 - RNA, 32 nt, Artificial Sequence
  Synthetic Oligonucleotide; BTLA exon 2; Set A
aaagggaucuccugcuaagauggaguguucag

SEQ ID NO: 50221 - RNA, 24 nt, Artificial Sequence
  Synthetic Oligonucleotide; BTLA exon 2; Set A
ggaucuccugcuaagauggagugu

SEQ ID NO: 50222 - RNA, 22 nt, Artificial Sequence
  Synthetic Oligonucleotide; BTLA exon 2; Set C
gaucuccugcuaagauggagug

SEQ ID NO: 50223 - RNA, 32 nt, Artificial Sequence
  Synthetic Oligonucleotide; BTLA exon 2; Set A
caaagggaucuccugcuaagauggaguguuca

SEQ ID NO: 50224 - RNA, 31 nt, Artificial Sequence
  Synthetic Oligonucleotide; BTLA exon 2; Set A
caaagggaucuccugcuaagauggaguguuc

SEQ ID NO: 50225 - RNA, 33 nt, Artificial Sequence
  Synthetic Oligonucleotide; BTLA exon 2; Set C
ucaaagggaucuccugcuaagauggaguguuca

SEQ ID NO: 50226 - RNA, 17 nt, Artificial Sequence
  Synthetic Oligonucleotide; BTLA exon 2; Set C
aucuccugcuaagaugg

SEQ ID NO: 50227 - RNA, 19 nt, Artificial Sequence
  Synthetic Oligonucleotide; BTLA exon 2; Set C
gaucuccugcuaagaugga

SEQ ID NO: 50228 - RNA, 32 nt, Artificial Sequence
  Synthetic Oligonucleotide; BTLA exon 2; Set A
ucaaagggaucuccugcuaagauggaguguuc

SEQ ID NO: 50229 - RNA, 34 nt, Artificial Sequence
  Synthetic Oligonucleotide; BTLA exon 2; Set C
uucaaagggaucuccugcuaagauggaguguuca

SEQ ID NO: 50230 - RNA, 30 nt, Artificial Sequence
  Synthetic Oligonucleotide; BTLA exon 2; Set A
caaagggaucuccugcuaagauggaguguu

SEQ ID NO: 50231 - RNA, 16 nt, Artificial Sequence
  Synthetic Oligonucleotide; BTLA exon 2; Set C
aucuccugcuaagaug

SEQ ID NO: 50232 - RNA, 18 nt, Artificial Sequence
  Synthetic Oligonucleotide; BTLA exon 2; Set C
gaucuccugcuaagaugg

SEQ ID NO: 50233 - RNA, 33 nt, Artificial Sequence
  Synthetic Oligonucleotide; BTLA exon 2; Set A
uucaaagggaucuccugcuaagauggaguguuc

SEQ ID NO: 50234 - RNA, 31 nt, Artificial Sequence
  Synthetic Oligonucleotide; BTLA exon 2; Set A
ucaaagggaucuccugcuaagauggaguguu

SEQ ID NO: 50235 - RNA, 29 nt, Artificial Sequence
  Synthetic Oligonucleotide; BTLA exon 2; Set A
caaagggaucuccugcuaagauggagugu

SEQ ID NO: 50236 - RNA, 17 nt, Artificial Sequence
  Synthetic Oligonucleotide; BTLA exon 2; Set C
gaucuccugcuaagaug

SEQ ID NO: 50237 - RNA, 32 nt, Artificial Sequence
  Synthetic Oligonucleotide; BTLA exon 2; Set A
uucaaagggaucuccugcuaagauggaguguu

SEQ ID NO: 50238 - RNA, 30 nt, Artificial Sequence
  Synthetic Oligonucleotide; BTLA exon 2; Set A
ucaaagggaucuccugcuaagauggagugu

SEQ ID NO: 50239 - RNA, 31 nt, Artificial Sequence
  Synthetic Oligonucleotide; BTLA exon 2; Set A
uucaaagggaucuccugcuaagauggagugu

SEQ ID NO: 50240 - RNA, 18 nt, Artificial Sequence
  Synthetic Oligonucleotide; BTLA exon 2; Set C
gggaucuccugcuaagau

SEQ ID NO: 50241 - RNA, 17 nt, Artificial Sequence
  Synthetic Oligonucleotide; BTLA exon 2; Set C
gggaucuccugcuaaga

SEQ ID NO: 50242 - RNA, 31 nt, Artificial Sequence
  Synthetic Oligonucleotide; BTLA exon 2; Set A
guucaaagggaucuccugcuaagauggagug

SEQ ID NO: 50243 - RNA, 40 nt, Artificial Sequence
  Synthetic Oligonucleotide; BTLA exon 2; Set C
uucuaguucaaagggaucuccugcuaagauggaguguuca

SEQ ID NO: 50244 - RNA, 32 nt, Artificial Sequence
  Synthetic Oligonucleotide; BTLA exon 2; Set A
aguucaaagggaucuccugcuaagauggagug

SEQ ID NO: 50245 - RNA, 39 nt, Artificial Sequence
  Synthetic Oligonucleotide; BTLA exon 2; Set C
uucuaguucaaagggaucuccugcuaagauggaguguuc

SEQ ID NO: 50246 - RNA, 33 nt, Artificial Sequence
  Synthetic Oligonucleotide; BTLA exon 2; Set A
uaguucaaagggaucuccugcuaagauggagug

SEQ ID NO: 50247 - RNA, 20 nt, Artificial Sequence
  Synthetic Oligonucleotide; BTLA exon 2; Set C
aaagggaucuccugcuaaga

SEQ ID NO: 50248 - RNA, 22 nt, Artificial Sequence
  Synthetic Oligonucleotide; BTLA exon 2; Set C
caaagggaucuccugcuaagau

SEQ ID NO: 50249 - RNA, 38 nt, Artificial Sequence
  Synthetic Oligonucleotide; BTLA exon 2; Set C
uucuaguucaaagggaucuccugcuaagauggaguguu

SEQ ID NO: 50250 - RNA, 34 nt, Artificial Sequence
  Synthetic Oligonucleotide; BTLA exon 2; Set A
cuaguucaaagggaucuccugcuaagauggagug

SEQ ID NO: 50251 - RNA, 28 nt, Artificial Sequence
  Synthetic Oligonucleotide; BTLA exon 2; Set A
guucaaagggaucuccugcuaagaugga

SEQ ID NO: 50252 - RNA, 37 nt, Artificial Sequence
  Synthetic Oligonucleotide; BTLA exon 2; Set C
uucuaguucaaagggaucuccugcuaagauggagugu

SEQ ID NO: 50253 - RNA, 35 nt, Artificial Sequence
  Synthetic Oligonucleotide; BTLA exon 2; Set A
ucuaguucaaagggaucuccugcuaagauggagug

SEQ ID NO: 50254 - RNA, 27 nt, Artificial Sequence
  Synthetic Oligonucleotide; BTLA exon 2; Set A
guucaaagggaucuccugcuaagaugg

SEQ ID NO: 50255 - RNA, 29 nt, Artificial Sequence
  Synthetic Oligonucleotide; BTLA exon 2; Set A
aguucaaagggaucuccugcuaagaugga

SEQ ID NO: 50256 - RNA, 20 nt, Artificial Sequence
  Synthetic Oligonucleotide; BTLA exon 2; Set C
caaagggaucuccugcuaag

SEQ ID NO: 50257 - RNA, 26 nt, Artificial Sequence
  Synthetic Oligonucleotide; BTLA exon 2; Set A
guucaaagggaucuccugcuaagaug

SEQ ID NO: 50258 - RNA, 28 nt, Artificial Sequence
  Synthetic Oligonucleotide; BTLA exon 2; Set A
aguucaaagggaucuccugcuaagaugg

SEQ ID NO: 50259 - RNA, 30 nt, Artificial Sequence
  Synthetic Oligonucleotide; BTLA exon 2; Set A
uaguucaaagggaucuccugcuaagaugga

SEQ ID NO: 50260 - RNA, 21 nt, Artificial Sequence
  Synthetic Oligonucleotide; BTLA exon 2; Set C
ucaaagggaucuccugcuaag

SEQ ID NO: 50261 - RNA, 19 nt, Artificial Sequence
  Synthetic Oligonucleotide; BTLA exon 2; Set C
caaagggaucuccugcuaa

SEQ ID NO: 50262 - RNA, 27 nt, Artificial Sequence
  Synthetic Oligonucleotide; BTLA exon 2; Set A
aguucaaagggaucuccugcuaagaug

SEQ ID NO: 50263 - RNA, 29 nt, Artificial Sequence
  Synthetic Oligonucleotide; BTLA exon 2; Set A
uaguucaaagggaucuccugcuaagaugg

SEQ ID NO: 50264 - RNA, 31 nt, Artificial Sequence
  Synthetic Oligonucleotide; BTLA exon 2; Set A
cuaguucaaagggaucuccugcuaagaugga

SEQ ID NO: 50265 - RNA, 16 nt, Artificial Sequence
  Synthetic Oligonucleotide; BTLA exon 2; Set C
aaagggaucuccugcu

SEQ ID NO: 50266 - RNA, 22 nt, Artificial Sequence
  Synthetic Oligonucleotide; BTLA exon 2; Set C
uucaaagggaucuccugcuaag

SEQ ID NO: 50267 - RNA, 20 nt, Artificial Sequence
  Synthetic Oligonucleotide; BTLA exon 2; Set C
ucaaagggaucuccugcuaa

SEQ ID NO: 50268 - RNA, 18 nt, Artificial Sequence
  Synthetic Oligonucleotide; BTLA exon 2; Set C
caaagggaucuccugcua

SEQ ID NO: 50269 - RNA, 28 nt, Artificial Sequence
  Synthetic Oligonucleotide; BTLA exon 2; Set A
uaguucaaagggaucuccugcuaagaug

SEQ ID NO: 50270 - RNA, 30 nt, Artificial Sequence
  Synthetic Oligonucleotide; BTLA exon 2; Set A
cuaguucaaagggaucuccugcuaagaugg

SEQ ID NO: 50271 - RNA, 32 nt, Artificial Sequence
  Synthetic Oligonucleotide; BTLA exon 2; Set A
ucuaguucaaagggaucuccugcuaagaugga

SEQ ID NO: 50272 - RNA, 15 nt, Artificial Sequence
  Synthetic Oligonucleotide; BTLA exon 2; Set C
aaagggaucuccugc

SEQ ID NO: 50273 - RNA, 21 nt, Artificial Sequence
  Synthetic Oligonucleotide; BTLA exon 2; Set C
uucaaagggaucuccugcuaa

SEQ ID NO: 50274 - RNA, 19 nt, Artificial Sequence
  Synthetic Oligonucleotide; BTLA exon 2; Set C
ucaaagggaucuccugcua

SEQ ID NO: 50275 - RNA, 29 nt, Artificial Sequence
  Synthetic Oligonucleotide; BTLA exon 2; Set A
cuaguucaaagggaucuccugcuaagaug

SEQ ID NO: 50276 - RNA, 31 nt, Artificial Sequence
  Synthetic Oligonucleotide; BTLA exon 2; Set A
ucuaguucaaagggaucuccugcuaagaugg

SEQ ID NO: 50277 - RNA, 20 nt, Artificial Sequence
  Synthetic Oligonucleotide; BTLA exon 2; Set C
uucaaagggaucuccugcua

SEQ ID NO: 50278 - RNA, 30 nt, Artificial Sequence
  Synthetic Oligonucleotide; BTLA exon 2; Set A
ucuaguucaaagggaucuccugcuaagaug

SEQ ID NO: 50279 - RNA, 30 nt, Artificial Sequence
  Synthetic Oligonucleotide; BTLA exon 2; Set A
uucuaguucaaagggaucuccugcuaagau

SEQ ID NO: 50280 - RNA, 17 nt, Artificial Sequence
  Synthetic Oligonucleotide; BTLA exon 2; Set C
uucaaagggaucuccug

SEQ ID NO: 50281 - RNA, 28 nt, Artificial Sequence
  Synthetic Oligonucleotide; BTLA exon 2; Set A
uucuaguucaaagggaucuccugcuaag

SEQ ID NO: 50282 - RNA, 27 nt, Artificial Sequence
  Synthetic Oligonucleotide; BTLA exon 2; Set A
uucuaguucaaagggaucuccugcuaa

SEQ ID NO: 50283 - RNA, 34 nt, Artificial Sequence
  Synthetic Oligonucleotide; BTLA exon 2; Set C
ggcauucuaguucaaagggaucuccugcuaagau

SEQ ID NO: 50284 - RNA, 26 nt, Artificial Sequence
  Synthetic Oligonucleotide; BTLA exon 2; Set A
uucuaguucaaagggaucuccugcua

SEQ ID NO: 50285 - RNA, 33 nt, Artificial Sequence
  Synthetic Oligonucleotide; BTLA exon 2; Set C
ggcauucuaguucaaagggaucuccugcuaaga

SEQ ID NO: 50286 - RNA, 25 nt, Artificial Sequence
  Synthetic Oligonucleotide; BTLA exon 2; Set A
uucuaguucaaagggaucuccugcu

SEQ ID NO: 50287 - RNA, 35 nt, Artificial Sequence
  Synthetic Oligonucleotide; BTLA exon 2; Set C
gggcauucuaguucaaagggaucuccugcuaagau

SEQ ID NO: 50288 - RNA, 34 nt, Artificial Sequence
  Synthetic Oligonucleotide; BTLA exon 2; Set C
gggcauucuaguucaaagggaucuccugcuaaga

SEQ ID NO: 50289 - RNA, 24 nt, Artificial Sequence
  Synthetic Oligonucleotide; BTLA exon 2; Set A
uucuaguucaaagggaucuccugc

SEQ ID NO: 50290 - RNA, 32 nt, Artificial Sequence
  Synthetic Oligonucleotide; BTLA exon 2; Set A
ggcauucuaguucaaagggaucuccugcuaag

SEQ ID NO: 50291 - RNA, 33 nt, Artificial Sequence
  Synthetic Oligonucleotide; BTLA exon 2; Set C
gggcauucuaguucaaagggaucuccugcuaag

SEQ ID NO: 50292 - RNA, 32 nt, Artificial Sequence
  Synthetic Oligonucleotide; BTLA exon 2; Set C
gggcauucuaguucaaagggaucuccugcuaa

SEQ ID NO: 50293 - RNA, 29 nt, Artificial Sequence
  Synthetic Oligonucleotide; BTLA exon 2; Set C
ggcauucuaguucaaagggaucuccugcu

SEQ ID NO: 50294 - RNA, 31 nt, Artificial Sequence
  Synthetic Oligonucleotide; BTLA exon 2; Set C
gggcauucuaguucaaagggaucuccugcua

SEQ ID NO: 50295 - RNA, 30 nt, Artificial Sequence
  Synthetic Oligonucleotide; BTLA exon 2; Set C
gggcauucuaguucaaagggaucuccugcu

SEQ ID NO: 50296 - RNA, 28 nt, Artificial Sequence
  Synthetic Oligonucleotide; BTLA exon 2; Set A
ggcauucuaguucaaagggaucuccugc

SEQ ID NO: 50297 - RNA, 29 nt, Artificial Sequence
  Synthetic Oligonucleotide; BTLA exon 2; Set C
gggcauucuaguucaaagggaucuccugc

SEQ ID NO: 50298 - RNA, 18 nt, Artificial Sequence
  Synthetic Oligonucleotide; BTLA exon 2; Set C
uucuaguucaaagggauc

SEQ ID NO: 50299 - RNA, 17 nt, Artificial Sequence
  Synthetic Oligonucleotide; BTLA exon 2; Set C
uucuaguucaaagggau

SEQ ID NO: 50300 - RNA, 22 nt, Artificial Sequence
  Synthetic Oligonucleotide; BTLA exon 2; Set C
ggcauucuaguucaaagggauc

SEQ ID NO: 50301 - RNA, 21 nt, Artificial Sequence
  Synthetic Oligonucleotide; BTLA exon 2; Set C
ggcauucuaguucaaagggau

SEQ ID NO: 50302 - RNA, 23 nt, Artificial Sequence
  Synthetic Oligonucleotide; BTLA exon 2; Set A
gggcauucuaguucaaagggauc

SEQ ID NO: 50303 - RNA, 22 nt, Artificial Sequence
  Synthetic Oligonucleotide; BTLA exon 2; Set C
gggcauucuaguucaaagggau

SEQ ID NO: 50304 - RNA, 34 nt, Artificial Sequence
  Synthetic Oligonucleotide; BTLA exon 2; Set C
auuucacagggcauucuaguucaaagggaucucc

SEQ ID NO: 50305 - RNA, 33 nt, Artificial Sequence
  Synthetic Oligonucleotide; BTLA exon 2; Set A
auuucacagggcauucuaguucaaagggaucuc

SEQ ID NO: 50306 - RNA, 35 nt, Artificial Sequence
  Synthetic Oligonucleotide; BTLA exon 2; Set C
uauuucacagggcauucuaguucaaagggaucucc

SEQ ID NO: 50307 - RNA, 34 nt, Artificial Sequence
  Synthetic Oligonucleotide; BTLA exon 2; Set A
uauuucacagggcauucuaguucaaagggaucuc

SEQ ID NO: 50308 - RNA, 36 nt, Artificial Sequence
  Synthetic Oligonucleotide; BTLA exon 2; Set C
guauuucacagggcauucuaguucaaagggaucucc

SEQ ID NO: 50309 - RNA, 39 nt, Artificial Sequence
  Synthetic Oligonucleotide; BTLA exon 2; Set C
caguauuucacagggcauucuaguucaaagggaucuccu

SEQ ID NO: 50310 - RNA, 35 nt, Artificial Sequence
  Synthetic Oligonucleotide; BTLA exon 2; Set C
guauuucacagggcauucuaguucaaagggaucuc

SEQ ID NO: 50311 - RNA, 37 nt, Artificial Sequence
  Synthetic Oligonucleotide; BTLA exon 2; Set C
aguauuucacagggcauucuaguucaaagggaucucc

SEQ ID NO: 50312 - RNA, 40 nt, Artificial Sequence
  Synthetic Oligonucleotide; BTLA exon 2; Set C
acaguauuucacagggcauucuaguucaaagggaucuccu

SEQ ID NO: 50313 - RNA, 36 nt, Artificial Sequence
  Synthetic Oligonucleotide; BTLA exon 2; Set C
aguauuucacagggcauucuaguucaaagggaucuc

SEQ ID NO: 50314 - RNA, 29 nt, Artificial Sequence
  Synthetic Oligonucleotide; BTLA exon 2; Set A
auuucacagggcauucuaguucaaaggga

SEQ ID NO: 50315 - RNA, 36 nt, Artificial Sequence
  Synthetic Oligonucleotide; BTLA exon 2; Set C
caguauuucacagggcauucuaguucaaagggaucu

SEQ ID NO: 50316 - RNA, 30 nt, Artificial Sequence
  Synthetic Oligonucleotide; BTLA exon 2; Set A
uauuucacagggcauucuaguucaaaggga

SEQ ID NO: 50317 - RNA, 37 nt, Artificial Sequence
  Synthetic Oligonucleotide; BTLA exon 2; Set C
acaguauuucacagggcauucuaguucaaagggaucu

SEQ ID NO: 50318 - RNA, 31 nt, Artificial Sequence
  Synthetic Oligonucleotide; BTLA exon 2; Set A
guauuucacagggcauucuaguucaaaggga

SEQ ID NO: 50319 - RNA, 38 nt, Artificial Sequence
  Synthetic Oligonucleotide; BTLA exon 2; Set C
cacaguauuucacagggcauucuaguucaaagggaucu

SEQ ID NO: 50320 - RNA, 32 nt, Artificial Sequence
  Synthetic Oligonucleotide; BTLA exon 2; Set A
aguauuucacagggcauucuaguucaaaggga

SEQ ID NO: 50321 - RNA, 40 nt, Artificial Sequence
  Synthetic Oligonucleotide; BTLA exon 2; Set C
gcacaguauuucacagggcauucuaguucaaagggaucuc

SEQ ID NO: 50322 - RNA, 39 nt, Artificial Sequence
  Synthetic Oligonucleotide; BTLA exon 2; Set C
gcacaguauuucacagggcauucuaguucaaagggaucu

SEQ ID NO: 50323 - RNA, 24 nt, Artificial Sequence
  Synthetic Oligonucleotide; BTLA exon 2; Set C
auuucacagggcauucuaguucaa

SEQ ID NO: 50324 - RNA, 35 nt, Artificial Sequence
  Synthetic Oligonucleotide; BTLA exon 2; Set C
cacaguauuucacagggcauucuaguucaaaggga

SEQ ID NO: 50325 - RNA, 23 nt, Artificial Sequence
  Synthetic Oligonucleotide; BTLA exon 2; Set A
auuucacagggcauucuaguuca

SEQ ID NO: 50326 - RNA, 25 nt, Artificial Sequence
  Synthetic Oligonucleotide; BTLA exon 2; Set A
uauuucacagggcauucuaguucaa

SEQ ID NO: 50327 - RNA, 36 nt, Artificial Sequence
  Synthetic Oligonucleotide; BTLA exon 2; Set C
gcacaguauuucacagggcauucuaguucaaaggga

SEQ ID NO: 50328 - RNA, 22 nt, Artificial Sequence
  Synthetic Oligonucleotide; BTLA exon 2; Set C
auuucacagggcauucuaguuc

SEQ ID NO: 50329 - RNA, 24 nt, Artificial Sequence
  Synthetic Oligonucleotide; BTLA exon 2; Set A
uauuucacagggcauucuaguuca

SEQ ID NO: 50330 - RNA, 26 nt, Artificial Sequence
  Synthetic Oligonucleotide; BTLA exon 2; Set A
guauuucacagggcauucuaguucaa

SEQ ID NO: 50331 - RNA, 23 nt, Artificial Sequence
  Synthetic Oligonucleotide; BTLA exon 2; Set C
uauuucacagggcauucuaguuc

SEQ ID NO: 50332 - RNA, 25 nt, Artificial Sequence
  Synthetic Oligonucleotide; BTLA exon 2; Set A
guauuucacagggcauucuaguuca

SEQ ID NO: 50333 - RNA, 27 nt, Artificial Sequence
  Synthetic Oligonucleotide; BTLA exon 2; Set A
aguauuucacagggcauucuaguucaa

SEQ ID NO: 50334 - RNA, 24 nt, Artificial Sequence
  Synthetic Oligonucleotide; BTLA exon 2; Set A
guauuucacagggcauucuaguuc

SEQ ID NO: 50335 - RNA, 26 nt, Artificial Sequence
  Synthetic Oligonucleotide; BTLA exon 2; Set A
aguauuucacagggcauucuaguuca

SEQ ID NO: 50336 - RNA, 36 nt, Artificial Sequence
  Synthetic Oligonucleotide; BTLA exon 2; Set C
agcacaguauuucacagggcauucuaguucaaaggg

SEQ ID NO: 50337 - RNA, 25 nt, Artificial Sequence
  Synthetic Oligonucleotide; BTLA exon 2; Set A
aguauuucacagggcauucuaguuc

SEQ ID NO: 50338 - RNA, 37 nt, Artificial Sequence
  Synthetic Oligonucleotide; BTLA exon 2; Set C
uagcacaguauuucacagggcauucuaguucaaaggg

SEQ ID NO: 50339 - RNA, 38 nt, Artificial Sequence
  Synthetic Oligonucleotide; BTLA exon 2; Set C
uuagcacaguauuucacagggcauucuaguucaaaggg

SEQ ID NO: 50340 - RNA, 31 nt, Artificial Sequence
  Synthetic Oligonucleotide; BTLA exon 2; Set C
gcacaguauuucacagggcauucuaguucaa

SEQ ID NO: 50341 - RNA, 39 nt, Artificial Sequence
  Synthetic Oligonucleotide; BTLA exon 2; Set C
guuagcacaguauuucacagggcauucuaguucaaaggg

SEQ ID NO: 50342 - RNA, 30 nt, Artificial Sequence
  Synthetic Oligonucleotide; BTLA exon 2; Set C
gcacaguauuucacagggcauucuaguuca

SEQ ID NO: 50343 - RNA, 29 nt, Artificial Sequence
  Synthetic Oligonucleotide; BTLA exon 2; Set C
gcacaguauuucacagggcauucuaguuc

SEQ ID NO: 50344 - RNA, 34 nt, Artificial Sequence
  Synthetic Oligonucleotide; BTLA exon 2; Set C
uuagcacaguauuucacagggcauucuaguucaa

SEQ ID NO: 50345 - RNA, 35 nt, Artificial Sequence
  Synthetic Oligonucleotide; BTLA exon 2; Set C
guuagcacaguauuucacagggcauucuaguucaa

SEQ ID NO: 50346 - RNA, 24 nt, Artificial Sequence
  Synthetic Oligonucleotide; BTLA exon 2; Set A
agcacaguauuucacagggcauuc

SEQ ID NO: 50347 - RNA, 25 nt, Artificial Sequence
  Synthetic Oligonucleotide; BTLA exon 2; Set A
uagcacaguauuucacagggcauuc

SEQ ID NO: 50348 - RNA, 26 nt, Artificial Sequence
  Synthetic Oligonucleotide; BTLA exon 2; Set A
uuagcacaguauuucacagggcauuc

SEQ ID NO: 50349 - RNA, 37 nt, Artificial Sequence
  Synthetic Oligonucleotide; BTLA exon 2; Set C
ggccuguuagcacaguauuucacagggcauucuaguu

SEQ ID NO: 50350 - RNA, 27 nt, Artificial Sequence
  Synthetic Oligonucleotide; BTLA exon 2; Set A
guuagcacaguauuucacagggcauuc

SEQ ID NO: 50351 - RNA, 36 nt, Artificial Sequence
  Synthetic Oligonucleotide; BTLA exon 2; Set C
ggccuguuagcacaguauuucacagggcauucuagu

SEQ ID NO: 50352 - RNA, 20 nt, Artificial Sequence
  Synthetic Oligonucleotide; BTLA exon 2; Set A
agcacaguauuucacagggc

SEQ ID NO: 50353 - RNA, 35 nt, Artificial Sequence
  Synthetic Oligonucleotide; BTLA exon 2; Set C
ggccuguuagcacaguauuucacagggcauucuag

SEQ ID NO: 50354 - RNA, 19 nt, Artificial Sequence
  Synthetic Oligonucleotide; BTLA exon 2; Set C
agcacaguauuucacaggg

SEQ ID NO: 50355 - RNA, 21 nt, Artificial Sequence
  Synthetic Oligonucleotide; BTLA exon 2; Set A
uagcacaguauuucacagggc

SEQ ID NO: 50356 - RNA, 34 nt, Artificial Sequence
  Synthetic Oligonucleotide; BTLA exon 2; Set C
ggccuguuagcacaguauuucacagggcauucua

SEQ ID NO: 50357 - RNA, 20 nt, Artificial Sequence
  Synthetic Oligonucleotide; BTLA exon 2; Set C
uagcacaguauuucacaggg

SEQ ID NO: 50358 - RNA, 22 nt, Artificial Sequence
  Synthetic Oligonucleotide; BTLA exon 2; Set A
uuagcacaguauuucacagggc

SEQ ID NO: 50359 - RNA, 33 nt, Artificial Sequence
  Synthetic Oligonucleotide; BTLA exon 2; Set C
ggccuguuagcacaguauuucacagggcauucu

SEQ ID NO: 50360 - RNA, 21 nt, Artificial Sequence
  Synthetic Oligonucleotide; BTLA exon 2; Set C
uuagcacaguauuucacaggg

SEQ ID NO: 50361 - RNA, 23 nt, Artificial Sequence
  Synthetic Oligonucleotide; BTLA exon 2; Set A
guuagcacaguauuucacagggc

SEQ ID NO: 50362 - RNA, 22 nt, Artificial Sequence
  Synthetic Oligonucleotide; BTLA exon 2; Set A
guuagcacaguauuucacaggg

SEQ ID NO: 50363 - RNA, 37 nt, Artificial Sequence
  Synthetic Oligonucleotide; BTLA exon 2; Set C
caugaggccuguuagcacaguauuucacagggcauuc

SEQ ID NO: 50364 - RNA, 15 nt, Artificial Sequence
  Synthetic Oligonucleotide; BTLA exon 2; Set C
uuagcacaguauuuc

SEQ ID NO: 50365 - RNA, 38 nt, Artificial Sequence
  Synthetic Oligonucleotide; BTLA exon 2; Set C
acaugaggccuguuagcacaguauuucacagggcauuc

SEQ ID NO: 50366 - RNA, 16 nt, Artificial Sequence
  Synthetic Oligonucleotide; BTLA exon 2; Set C
guuagcacaguauuuc

SEQ ID NO: 50367 - RNA, 39 nt, Artificial Sequence
  Synthetic Oligonucleotide; BTLA exon 2; Set C
cacaugaggccuguuagcacaguauuucacagggcauuc

SEQ ID NO: 50368 - RNA, 31 nt, Artificial Sequence
  Synthetic Oligonucleotide; BTLA exon 2; Set C
augaggccuguuagcacaguauuucacaggg

SEQ ID NO: 50369 - RNA, 33 nt, Artificial Sequence
  Synthetic Oligonucleotide; BTLA exon 2; Set C
caugaggccuguuagcacaguauuucacagggc

SEQ ID NO: 50370 - RNA, 32 nt, Artificial Sequence
  Synthetic Oligonucleotide; BTLA exon 2; Set C
caugaggccuguuagcacaguauuucacaggg

SEQ ID NO: 50371 - RNA, 34 nt, Artificial Sequence
  Synthetic Oligonucleotide; BTLA exon 2; Set C
acaugaggccuguuagcacaguauuucacagggc

SEQ ID NO: 50372 - RNA, 33 nt, Artificial Sequence
  Synthetic Oligonucleotide; BTLA exon 2; Set C
acaugaggccuguuagcacaguauuucacaggg

SEQ ID NO: 50373 - RNA, 35 nt, Artificial Sequence
  Synthetic Oligonucleotide; BTLA exon 2; Set C
cacaugaggccuguuagcacaguauuucacagggc

SEQ ID NO: 50374 - RNA, 34 nt, Artificial Sequence
  Synthetic Oligonucleotide; BTLA exon 2; Set C
cacaugaggccuguuagcacaguauuucacaggg

SEQ ID NO: 50375 - RNA, 24 nt, Artificial Sequence
  Synthetic Oligonucleotide; BTLA exon 2; Set A
augaggccuguuagcacaguauuu

SEQ ID NO: 50376 - RNA, 15 nt, Artificial Sequence
  Synthetic Oligonucleotide; BTLA exon 2; Set C
ggccuguuagcacag

SEQ ID NO: 50377 - RNA, 25 nt, Artificial Sequence
  Synthetic Oligonucleotide; BTLA exon 2; Set A
caugaggccuguuagcacaguauuu

SEQ ID NO: 50378 - RNA, 26 nt, Artificial Sequence
  Synthetic Oligonucleotide; BTLA exon 2; Set A
acaugaggccuguuagcacaguauuu

SEQ ID NO: 50379 - RNA, 27 nt, Artificial Sequence
  Synthetic Oligonucleotide; BTLA exon 2; Set A
cacaugaggccuguuagcacaguauuu

SEQ ID NO: 50380 - RNA, 31 nt, Artificial Sequence
  Synthetic Oligonucleotide; BTLA exon 2; Set C
caagucacaugaggccuguuagcacaguauu

SEQ ID NO: 50381 - RNA, 30 nt, Artificial Sequence
  Synthetic Oligonucleotide; BTLA exon 2; Set C
caagucacaugaggccuguuagcacaguau

SEQ ID NO: 50382 - RNA, 29 nt, Artificial Sequence
  Synthetic Oligonucleotide; BTLA exon 2; Set C
caagucacaugaggccuguuagcacagua

SEQ ID NO: 50383 - RNA, 36 nt, Artificial Sequence
  Synthetic Oligonucleotide; BTLA exon 2; Set C
gcaccaagucacaugaggccuguuagcacaguauuu

SEQ ID NO: 50384 - RNA, 37 nt, Artificial Sequence
  Synthetic Oligonucleotide; BTLA exon 2; Set C
ugcaccaagucacaugaggccuguuagcacaguauuu

SEQ ID NO: 50385 - RNA, 38 nt, Artificial Sequence
  Synthetic Oligonucleotide; BTLA exon 2; Set C
cuugcaccaagucacaugaggccuguuagcacaguauu

SEQ ID NO: 50386 - RNA, 30 nt, Artificial Sequence
  Synthetic Oligonucleotide; BTLA exon 2; Set C
caccaagucacaugaggccuguuagcacag

SEQ ID NO: 50387 - RNA, 37 nt, Artificial Sequence
  Synthetic Oligonucleotide; BTLA exon 2; Set C
cuugcaccaagucacaugaggccuguuagcacaguau

SEQ ID NO: 50388 - RNA, 39 nt, Artificial Sequence
  Synthetic Oligonucleotide; BTLA exon 2; Set C
gcuugcaccaagucacaugaggccuguuagcacaguauu

SEQ ID NO: 50389 - RNA, 29 nt, Artificial Sequence
  Synthetic Oligonucleotide; BTLA exon 2; Set C
caccaagucacaugaggccuguuagcaca

SEQ ID NO: 50390 - RNA, 15 nt, Artificial Sequence
  Synthetic Oligonucleotide; BTLA exon 2; Set C
ucacaugaggccugu

SEQ ID NO: 50391 - RNA, 38 nt, Artificial Sequence
  Synthetic Oligonucleotide; BTLA exon 2; Set C
gcuugcaccaagucacaugaggccuguuagcacaguau

SEQ ID NO: 50392 - RNA, 40 nt, Artificial Sequence
  Synthetic Oligonucleotide; BTLA exon 2; Set C
agcuugcaccaagucacaugaggccuguuagcacaguauu

SEQ ID NO: 50393 - RNA, 36 nt, Artificial Sequence
  Synthetic Oligonucleotide; BTLA exon 2; Set C
cuugcaccaagucacaugaggccuguuagcacagua

SEQ ID NO: 50394 - RNA, 16 nt, Artificial Sequence
  Synthetic Oligonucleotide; BTLA exon 2; Set C
gucacaugaggccugu

SEQ ID NO: 50395 - RNA, 39 nt, Artificial Sequence
  Synthetic Oligonucleotide; BTLA exon 2; Set C
agcuugcaccaagucacaugaggccuguuagcacaguau

SEQ ID NO: 50396 - RNA, 37 nt, Artificial Sequence
  Synthetic Oligonucleotide; BTLA exon 2; Set C
gcuugcaccaagucacaugaggccuguuagcacagua

SEQ ID NO: 50397 - RNA, 35 nt, Artificial Sequence
  Synthetic Oligonucleotide; BTLA exon 2; Set C
cuugcaccaagucacaugaggccuguuagcacagu

SEQ ID NO: 50398 - RNA, 27 nt, Artificial Sequence
  Synthetic Oligonucleotide; BTLA exon 2; Set C
caccaagucacaugaggccuguuagca

SEQ ID NO: 50399 - RNA, 38 nt, Artificial Sequence
  Synthetic Oligonucleotide; BTLA exon 2; Set C
agcuugcaccaagucacaugaggccuguuagcacagua

SEQ ID NO: 50400 - RNA, 36 nt, Artificial Sequence
  Synthetic Oligonucleotide; BTLA exon 2; Set C
gcuugcaccaagucacaugaggccuguuagcacagu

SEQ ID NO: 50401 - RNA, 18 nt, Artificial Sequence
  Synthetic Oligonucleotide; BTLA exon 2; Set C
aagucacaugaggccugu

SEQ ID NO: 50402 - RNA, 25 nt, Artificial Sequence
  Synthetic Oligonucleotide; BTLA exon 2; Set A
caccaagucacaugaggccuguuag

SEQ ID NO: 50403 - RNA, 37 nt, Artificial Sequence
  Synthetic Oligonucleotide; BTLA exon 2; Set C
agcuugcaccaagucacaugaggccuguuagcacagu

SEQ ID NO: 50404 - RNA, 24 nt, Artificial Sequence
  Synthetic Oligonucleotide; BTLA exon 2; Set A
caccaagucacaugaggccuguua

SEQ ID NO: 50405 - RNA, 23 nt, Artificial Sequence
  Synthetic Oligonucleotide; BTLA exon 2; Set A
caccaagucacaugaggccuguu

SEQ ID NO: 50406 - RNA, 30 nt, Artificial Sequence
  Synthetic Oligonucleotide; BTLA exon 2; Set C
cuugcaccaagucacaugaggccuguuagc

SEQ ID NO: 50407 - RNA, 29 nt, Artificial Sequence
  Synthetic Oligonucleotide; BTLA exon 2; Set C
cuugcaccaagucacaugaggccuguuag

SEQ ID NO: 50408 - RNA, 31 nt, Artificial Sequence
  Synthetic Oligonucleotide; BTLA exon 2; Set C
gcuugcaccaagucacaugaggccuguuagc

SEQ ID NO: 50409 - RNA, 23 nt, Artificial Sequence
  Synthetic Oligonucleotide; BTLA exon 2; Set C
gcaccaagucacaugaggccugu

SEQ ID NO: 50410 - RNA, 30 nt, Artificial Sequence
  Synthetic Oligonucleotide; BTLA exon 2; Set C
gcuugcaccaagucacaugaggccuguuag

SEQ ID NO: 50411 - RNA, 32 nt, Artificial Sequence
  Synthetic Oligonucleotide; BTLA exon 2; Set C
agcuugcaccaagucacaugaggccuguuagc

SEQ ID NO: 50412 - RNA, 28 nt, Artificial Sequence
  Synthetic Oligonucleotide; BTLA exon 2; Set C
cuugcaccaagucacaugaggccuguua

SEQ ID NO: 50413 - RNA, 24 nt, Artificial Sequence
  Synthetic Oligonucleotide; BTLA exon 2; Set C
ugcaccaagucacaugaggccugu

SEQ ID NO: 50414 - RNA, 31 nt, Artificial Sequence
  Synthetic Oligonucleotide; BTLA exon 2; Set C
agcuugcaccaagucacaugaggccuguuag

SEQ ID NO: 50415 - RNA, 29 nt, Artificial Sequence
  Synthetic Oligonucleotide; BTLA exon 2; Set C
gcuugcaccaagucacaugaggccuguua

SEQ ID NO: 50416 - RNA, 27 nt, Artificial Sequence
  Synthetic Oligonucleotide; BTLA exon 2; Set C
cuugcaccaagucacaugaggccuguu

SEQ ID NO: 50417 - RNA, 25 nt, Artificial Sequence
  Synthetic Oligonucleotide; BTLA exon 2; Set C
uugcaccaagucacaugaggccugu

SEQ ID NO: 50418 - RNA, 30 nt, Artificial Sequence
  Synthetic Oligonucleotide; BTLA exon 2; Set C
agcuugcaccaagucacaugaggccuguua

SEQ ID NO: 50419 - RNA, 28 nt, Artificial Sequence
  Synthetic Oligonucleotide; BTLA exon 2; Set C
gcuugcaccaagucacaugaggccuguu

SEQ ID NO: 50420 - RNA, 29 nt, Artificial Sequence
  Synthetic Oligonucleotide; BTLA exon 2; Set C
agcuugcaccaagucacaugaggccuguu

SEQ ID NO: 50421 - RNA, 19 nt, Artificial Sequence
  Synthetic Oligonucleotide; BTLA exon 2; Set A
gcaccaagucacaugaggc

SEQ ID NO: 50422 - RNA, 36 nt, Artificial Sequence
  Synthetic Oligonucleotide; BTLA exon 2; Set C
auugagcuugcaccaagucacaugaggccuguuagc

SEQ ID NO: 50423 - RNA, 20 nt, Artificial Sequence
  Synthetic Oligonucleotide; BTLA exon 2; Set A
ugcaccaagucacaugaggc

SEQ ID NO: 50424 - RNA, 35 nt, Artificial Sequence
  Synthetic Oligonucleotide; BTLA exon 2; Set C
auugagcuugcaccaagucacaugaggccuguuag

SEQ ID NO: 50425 - RNA, 21 nt, Artificial Sequence
  Synthetic Oligonucleotide; BTLA exon 2; Set A
uugcaccaagucacaugaggc

SEQ ID NO: 50426 - RNA, 34 nt, Artificial Sequence
  Synthetic Oligonucleotide; BTLA exon 2; Set C
auugagcuugcaccaagucacaugaggccuguua

SEQ ID NO: 50427 - RNA, 33 nt, Artificial Sequence
  Synthetic Oligonucleotide; BTLA exon 2; Set C
auugagcuugcaccaagucacaugaggccuguu

SEQ ID NO: 50428 - RNA, 18 nt, Artificial Sequence
  Synthetic Oligonucleotide; BTLA exon 2; Set C
cuugcaccaagucacaug

SEQ ID NO: 50429 - RNA, 19 nt, Artificial Sequence
  Synthetic Oligonucleotide; BTLA exon 2; Set C
gcuugcaccaagucacaug

SEQ ID NO: 50430 - RNA, 27 nt, Artificial Sequence
  Synthetic Oligonucleotide; BTLA exon 2; Set C
uugagcuugcaccaagucacaugaggc

SEQ ID NO: 50431 - RNA, 18 nt, Artificial Sequence
  Synthetic Oligonucleotide; BTLA exon 2; Set C
gcuugcaccaagucacau

SEQ ID NO: 50432 - RNA, 16 nt, Artificial Sequence
  Synthetic Oligonucleotide; BTLA exon 2; Set C
cuugcaccaagucaca

SEQ ID NO: 50433 - RNA, 20 nt, Artificial Sequence
  Synthetic Oligonucleotide; BTLA exon 2; Set C
agcuugcaccaagucacaug

SEQ ID NO: 50434 - RNA, 36 nt, Artificial Sequence
  Synthetic Oligonucleotide; BTLA exon 2; Set C
uuccauugagcuugcaccaagucacaugaggccugu

SEQ ID NO: 50435 - RNA, 19 nt, Artificial Sequence
  Synthetic Oligonucleotide; BTLA exon 2; Set C
agcuugcaccaagucacau

SEQ ID NO: 50436 - RNA, 15 nt, Artificial Sequence
  Synthetic Oligonucleotide; BTLA exon 2; Set C
cuugcaccaagucac

SEQ ID NO: 50437 - RNA, 17 nt, Artificial Sequence
  Synthetic Oligonucleotide; BTLA exon 2; Set C
gcuugcaccaagucaca

SEQ ID NO: 50438 - RNA, 37 nt, Artificial Sequence
  Synthetic Oligonucleotide; BTLA exon 2; Set C
guuccauugagcuugcaccaagucacaugaggccugu

SEQ ID NO: 50439 - RNA, 16 nt, Artificial Sequence
  Synthetic Oligonucleotide; BTLA exon 2; Set C
gcuugcaccaagucac

SEQ ID NO: 50440 - RNA, 18 nt, Artificial Sequence
  Synthetic Oligonucleotide; BTLA exon 2; Set C
agcuugcaccaagucaca

SEQ ID NO: 50441 - RNA, 38 nt, Artificial Sequence
  Synthetic Oligonucleotide; BTLA exon 2; Set C
uguuccauugagcuugcaccaagucacaugaggccugu

SEQ ID NO: 50442 - RNA, 17 nt, Artificial Sequence
  Synthetic Oligonucleotide; BTLA exon 2; Set C
agcuugcaccaagucac

SEQ ID NO: 50443 - RNA, 39 nt, Artificial Sequence
  Synthetic Oligonucleotide; BTLA exon 2; Set C
uuguuccauugagcuugcaccaagucacaugaggccugu

SEQ ID NO: 50444 - RNA, 24 nt, Artificial Sequence
  Synthetic Oligonucleotide; BTLA exon 2; Set A
auugagcuugcaccaagucacaug

SEQ ID NO: 50445 - RNA, 32 nt, Artificial Sequence
  Synthetic Oligonucleotide; BTLA exon 2; Set C
uuccauugagcuugcaccaagucacaugaggc

SEQ ID NO: 50446 - RNA, 23 nt, Artificial Sequence
  Synthetic Oligonucleotide; BTLA exon 2; Set A
auugagcuugcaccaagucacau

SEQ ID NO: 50447 - RNA, 33 nt, Artificial Sequence
  Synthetic Oligonucleotide; BTLA exon 2; Set C
guuccauugagcuugcaccaagucacaugaggc

SEQ ID NO: 50448 - RNA, 22 nt, Artificial Sequence
  Synthetic Oligonucleotide; BTLA exon 2; Set A
auugagcuugcaccaagucaca

SEQ ID NO: 50449 - RNA, 34 nt, Artificial Sequence
  Synthetic Oligonucleotide; BTLA exon 2; Set C
uguuccauugagcuugcaccaagucacaugaggc

SEQ ID NO: 50450 - RNA, 21 nt, Artificial Sequence
  Synthetic Oligonucleotide; BTLA exon 2; Set A
auugagcuugcaccaagucac

SEQ ID NO: 50451 - RNA, 15 nt, Artificial Sequence
  Synthetic Oligonucleotide; BTLA exon 2; Set C
gagcuugcaccaagu

SEQ ID NO: 50452 - RNA, 35 nt, Artificial Sequence
  Synthetic Oligonucleotide; BTLA exon 2; Set C
uuguuccauugagcuugcaccaagucacaugaggc

SEQ ID NO: 50453 - RNA, 34 nt, Artificial Sequence
  Synthetic Oligonucleotide; BTLA exon 2; Set C
auguuguuccauugagcuugcaccaagucacaug

SEQ ID NO: 50454 - RNA, 33 nt, Artificial Sequence
  Synthetic Oligonucleotide; BTLA exon 2; Set C
auguuguuccauugagcuugcaccaagucacau

SEQ ID NO: 50455 - RNA, 35 nt, Artificial Sequence
  Synthetic Oligonucleotide; BTLA exon 2; Set C
cauguuguuccauugagcuugcaccaagucacaug

SEQ ID NO: 50456 - RNA, 34 nt, Artificial Sequence
  Synthetic Oligonucleotide; BTLA exon 2; Set C
cauguuguuccauugagcuugcaccaagucacau

SEQ ID NO: 50457 - RNA, 32 nt, Artificial Sequence
  Synthetic Oligonucleotide; BTLA exon 2; Set C
auguuguuccauugagcuugcaccaagucaca

SEQ ID NO: 50458 - RNA, 36 nt, Artificial Sequence
  Synthetic Oligonucleotide; BTLA exon 2; Set C
acauguuguuccauugagcuugcaccaagucacaug

SEQ ID NO: 50459 - RNA, 35 nt, Artificial Sequence
  Synthetic Oligonucleotide; BTLA exon 2; Set C
acauguuguuccauugagcuugcaccaagucacau

SEQ ID NO: 50460 - RNA, 31 nt, Artificial Sequence
  Synthetic Oligonucleotide; BTLA exon 2; Set C
auguuguuccauugagcuugcaccaagucac

SEQ ID NO: 50461 - RNA, 33 nt, Artificial Sequence
  Synthetic Oligonucleotide; BTLA exon 2; Set C
cauguuguuccauugagcuugcaccaagucaca

SEQ ID NO: 50462 - RNA, 29 nt, Artificial Sequence
  Synthetic Oligonucleotide; BTLA exon 2; Set C
uguuguuccauugagcuugcaccaaguca

SEQ ID NO: 50463 - RNA, 32 nt, Artificial Sequence
  Synthetic Oligonucleotide; BTLA exon 2; Set C
cauguuguuccauugagcuugcaccaagucac

SEQ ID NO: 50464 - RNA, 34 nt, Artificial Sequence
  Synthetic Oligonucleotide; BTLA exon 2; Set C
acauguuguuccauugagcuugcaccaagucaca

SEQ ID NO: 50465 - RNA, 33 nt, Artificial Sequence
  Synthetic Oligonucleotide; BTLA exon 2; Set C
acauguuguuccauugagcuugcaccaagucac

SEQ ID NO: 50466 - RNA, 17 nt, Artificial Sequence
  Synthetic Oligonucleotide; BTLA exon 2; Set C
uuccauugagcuugcac

SEQ ID NO: 50467 - RNA, 18 nt, Artificial Sequence
  Synthetic Oligonucleotide; BTLA exon 2; Set C
guuccauugagcuugcac

SEQ ID NO: 50468 - RNA, 24 nt, Artificial Sequence
  Synthetic Oligonucleotide; BTLA exon 2; Set A
guuguuccauugagcuugcaccaa

SEQ ID NO: 50469 - RNA, 33 nt, Artificial Sequence
  Synthetic Oligonucleotide; BTLA exon 2; Set C
cacauguuguuccauugagcuugcaccaaguca

SEQ ID NO: 50470 - RNA, 19 nt, Artificial Sequence
  Synthetic Oligonucleotide; BTLA exon 2; Set C
uguuccauugagcuugcac

SEQ ID NO: 50471 - RNA, 34 nt, Artificial Sequence
  Synthetic Oligonucleotide; BTLA exon 2; Set C
acacauguuguuccauugagcuugcaccaaguca

SEQ ID NO: 50472 - RNA, 32 nt, Artificial Sequence
  Synthetic Oligonucleotide; BTLA exon 2; Set C
cacauguuguuccauugagcuugcaccaaguc

SEQ ID NO: 50473 - RNA, 20 nt, Artificial Sequence
  Synthetic Oligonucleotide; BTLA exon 2; Set C
uuguuccauugagcuugcac

SEQ ID NO: 50474 - RNA, 35 nt, Artificial Sequence
  Synthetic Oligonucleotide; BTLA exon 2; Set C
uacacauguuguuccauugagcuugcaccaaguca

SEQ ID NO: 50475 - RNA, 33 nt, Artificial Sequence
  Synthetic Oligonucleotide; BTLA exon 2; Set C
acacauguuguuccauugagcuugcaccaaguc

SEQ ID NO: 50476 - RNA, 34 nt, Artificial Sequence
  Synthetic Oligonucleotide; BTLA exon 2; Set C
uacacauguuguuccauugagcuugcaccaaguc

SEQ ID NO: 50477 - RNA, 21 nt, Artificial Sequence
  Synthetic Oligonucleotide; BTLA exon 2; Set A
uguuguuccauugagcuugca

SEQ ID NO: 50478 - RNA, 31 nt, Artificial Sequence
  Synthetic Oligonucleotide; BTLA exon 2; Set C
acacauguuguuccauugagcuugcaccaag

SEQ ID NO: 50479 - RNA, 15 nt, Artificial Sequence
  Synthetic Oligonucleotide; BTLA exon 2; Set C
uguuccauugagcuu

SEQ ID NO: 50480 - RNA, 22 nt, Artificial Sequence
  Synthetic Oligonucleotide; BTLA exon 2; Set A
auguuguuccauugagcuugca

SEQ ID NO: 50481 - RNA, 20 nt, Artificial Sequence
  Synthetic Oligonucleotide; BTLA exon 2; Set C
uguuguuccauugagcuugc

SEQ ID NO: 50482 - RNA, 32 nt, Artificial Sequence
  Synthetic Oligonucleotide; BTLA exon 2; Set C
uacacauguuguuccauugagcuugcaccaag

SEQ ID NO: 50483 - RNA, 16 nt, Artificial Sequence
  Synthetic Oligonucleotide; BTLA exon 2; Set C
uuguuccauugagcuu

SEQ ID NO: 50484 - RNA, 23 nt, Artificial Sequence
  Synthetic Oligonucleotide; BTLA exon 2; Set A
cauguuguuccauugagcuugca

SEQ ID NO: 50485 - RNA, 21 nt, Artificial Sequence
  Synthetic Oligonucleotide; BTLA exon 2; Set C
auguuguuccauugagcuugc

SEQ ID NO: 50486 - RNA, 19 nt, Artificial Sequence
  Synthetic Oligonucleotide; BTLA exon 2; Set C
uguuguuccauugagcuug

SEQ ID NO: 50487 - RNA, 17 nt, Artificial Sequence
  Synthetic Oligonucleotide; BTLA exon 2; Set C
guuguuccauugagcuu

SEQ ID NO: 50488 - RNA, 24 nt, Artificial Sequence
  Synthetic Oligonucleotide; BTLA exon 2; Set A
acauguuguuccauugagcuugca

SEQ ID NO: 50489 - RNA, 22 nt, Artificial Sequence
  Synthetic Oligonucleotide; BTLA exon 2; Set A
cauguuguuccauugagcuugc

SEQ ID NO: 50490 - RNA, 16 nt, Artificial Sequence
  Synthetic Oligonucleotide; BTLA exon 2; Set C
guuguuccauugagcu

SEQ ID NO: 50491 - RNA, 32 nt, Artificial Sequence
  Synthetic Oligonucleotide; BTLA exon 2; Set C
uuacacauguuguuccauugagcuugcaccaa

SEQ ID NO: 50492 - RNA, 25 nt, Artificial Sequence
  Synthetic Oligonucleotide; BTLA exon 2; Set A
cacauguuguuccauugagcuugca

SEQ ID NO: 50493 - RNA, 23 nt, Artificial Sequence
  Synthetic Oligonucleotide; BTLA exon 2; Set A
acauguuguuccauugagcuugc

SEQ ID NO: 50494 - RNA, 15 nt, Artificial Sequence
  Synthetic Oligonucleotide; BTLA exon 2; Set C
guuguuccauugagc

SEQ ID NO: 50495 - RNA, 33 nt, Artificial Sequence
  Synthetic Oligonucleotide; BTLA exon 2; Set C
uuuacacauguuguuccauugagcuugcaccaa

SEQ ID NO: 50496 - RNA, 24 nt, Artificial Sequence
  Synthetic Oligonucleotide; BTLA exon 2; Set A
cacauguuguuccauugagcuugc

SEQ ID NO: 50497 - RNA, 23 nt, Artificial Sequence
  Synthetic Oligonucleotide; BTLA exon 2; Set C
cacauguuguuccauugagcuug

SEQ ID NO: 50498 - RNA, 24 nt, Artificial Sequence
  Synthetic Oligonucleotide; BTLA exon 2; Set A
acacauguuguuccauugagcuug

SEQ ID NO: 50499 - RNA, 15 nt, Artificial Sequence
  Synthetic Oligonucleotide; BTLA exon 2; Set C
auguuguuccauuga

SEQ ID NO: 50500 - RNA, 25 nt, Artificial Sequence
  Synthetic Oligonucleotide; BTLA exon 2; Set A
uacacauguuguuccauugagcuug

SEQ ID NO: 50501 - RNA, 16 nt, Artificial Sequence
  Synthetic Oligonucleotide; BTLA exon 2; Set C
cauguuguuccauuga

SEQ ID NO: 50502 - RNA, 17 nt, Artificial Sequence
  Synthetic Oligonucleotide; BTLA exon 2; Set C
acauguuguuccauuga

SEQ ID NO: 50503 - RNA, 25 nt, Artificial Sequence
  Synthetic Oligonucleotide; BTLA exon 2; Set A
uuacacauguuguuccauugagcuu

SEQ ID NO: 50504 - RNA, 16 nt, Artificial Sequence
  Synthetic Oligonucleotide; BTLA exon 2; Set C
acauguuguuccauug

SEQ ID NO: 50505 - RNA, 26 nt, Artificial Sequence
  Synthetic Oligonucleotide; BTLA exon 2; Set A
uuuacacauguuguuccauugagcuu

SEQ ID NO: 50506 - RNA, 24 nt, Artificial Sequence
  Synthetic Oligonucleotide; BTLA exon 2; Set A
uuacacauguuguuccauugagcu

SEQ ID NO: 50507 - RNA, 17 nt, Artificial Sequence
  Synthetic Oligonucleotide; BTLA exon 2; Set C
cacauguuguuccauug

SEQ ID NO: 50508 - RNA, 21 nt, Artificial Sequence
  Synthetic Oligonucleotide; BTLA exon 2; Set C
uacacauguuguuccauugag

SEQ ID NO: 50509 - RNA, 23 nt, Artificial Sequence
  Synthetic Oligonucleotide; BTLA exon 2; Set C
uuacacauguuguuccauugagc

SEQ ID NO: 50510 - RNA, 25 nt, Artificial Sequence
  Synthetic Oligonucleotide; BTLA exon 2; Set A
uuuacacauguuguuccauugagcu

SEQ ID NO: 50511 - RNA, 24 nt, Artificial Sequence
  Synthetic Oligonucleotide; BTLA exon 2; Set C
uuuacacauguuguuccauugagc

SEQ ID NO: 50512 - RNA, 38 nt, Artificial Sequence
  Synthetic Oligonucleotide; BTLA exon 2; Set C
cuucaaguuuuacacauguuguuccauugagcuugcac

SEQ ID NO: 50513 - RNA, 39 nt, Artificial Sequence
  Synthetic Oligonucleotide; BTLA exon 2; Set C
ucuucaaguuuuacacauguuguuccauugagcuugcac

SEQ ID NO: 50514 - RNA, 19 nt, Artificial Sequence
  Synthetic Oligonucleotide; BTLA exon 2; Set C
uuacacauguuguuccauu

SEQ ID NO: 50515 - RNA, 40 nt, Artificial Sequence
  Synthetic Oligonucleotide; BTLA exon 2; Set C
aucuucaaguuuuacacauguuguuccauugagcuugcac

SEQ ID NO: 50516 - RNA, 20 nt, Artificial Sequence
  Synthetic Oligonucleotide; BTLA exon 2; Set C
uuuacacauguuguuccauu

SEQ ID NO: 50517 - RNA, 34 nt, Artificial Sequence
  Synthetic Oligonucleotide; BTLA exon 2; Set A
cuucaaguuuuacacauguuguuccauugagcuu

SEQ ID NO: 50518 - RNA, 35 nt, Artificial Sequence
  Synthetic Oligonucleotide; BTLA exon 2; Set A
ucuucaaguuuuacacauguuguuccauugagcuu

SEQ ID NO: 50519 - RNA, 33 nt, Artificial Sequence
  Synthetic Oligonucleotide; BTLA exon 2; Set A
cuucaaguuuuacacauguuguuccauugagcu

SEQ ID NO: 50520 - RNA, 36 nt, Artificial Sequence
  Synthetic Oligonucleotide; BTLA exon 2; Set A
aucuucaaguuuuacacauguuguuccauugagcuu

SEQ ID NO: 50521 - RNA, 32 nt, Artificial Sequence
  Synthetic Oligonucleotide; BTLA exon 2; Set A
cuucaaguuuuacacauguuguuccauugagc

SEQ ID NO: 50522 - RNA, 34 nt, Artificial Sequence
  Synthetic Oligonucleotide; BTLA exon 2; Set A
ucuucaaguuuuacacauguuguuccauugagcu

SEQ ID NO: 50523 - RNA, 37 nt, Artificial Sequence
  Synthetic Oligonucleotide; BTLA exon 2; Set A
uaucuucaaguuuuacacauguuguuccauugagcuu

SEQ ID NO: 50524 - RNA, 33 nt, Artificial Sequence
  Synthetic Oligonucleotide; BTLA exon 2; Set A
ucuucaaguuuuacacauguuguuccauugagc

SEQ ID NO: 50525 - RNA, 35 nt, Artificial Sequence
  Synthetic Oligonucleotide; BTLA exon 2; Set A
aucuucaaguuuuacacauguuguuccauugagcu

SEQ ID NO: 50526 - RNA, 38 nt, Artificial Sequence
  Synthetic Oligonucleotide; BTLA exon 2; Set A
cuaucuucaaguuuuacacauguuguuccauugagcuu

SEQ ID NO: 50527 - RNA, 34 nt, Artificial Sequence
  Synthetic Oligonucleotide; BTLA exon 2; Set A
aucuucaaguuuuacacauguuguuccauugagc

SEQ ID NO: 50528 - RNA, 36 nt, Artificial Sequence
  Synthetic Oligonucleotide; BTLA exon 2; Set A
uaucuucaaguuuuacacauguuguuccauugagcu

SEQ ID NO: 50529 - RNA, 39 nt, Artificial Sequence
  Synthetic Oligonucleotide; BTLA exon 2; Set C
ucuaucuucaaguuuuacacauguuguuccauugagcuu

SEQ ID NO: 50530 - RNA, 35 nt, Artificial Sequence
  Synthetic Oligonucleotide; BTLA exon 2; Set A
uaucuucaaguuuuacacauguuguuccauugagc

SEQ ID NO: 50531 - RNA, 37 nt, Artificial Sequence
  Synthetic Oligonucleotide; BTLA exon 2; Set A
cuaucuucaaguuuuacacauguuguuccauugagcu

SEQ ID NO: 50532 - RNA, 40 nt, Artificial Sequence
  Synthetic Oligonucleotide; BTLA exon 2; Set C
gucuaucuucaaguuuuacacauguuguuccauugagcuu

SEQ ID NO: 50533 - RNA, 36 nt, Artificial Sequence
  Synthetic Oligonucleotide; BTLA exon 2; Set A
cuaucuucaaguuuuacacauguuguuccauugagc

SEQ ID NO: 50534 - RNA, 38 nt, Artificial Sequence
  Synthetic Oligonucleotide; BTLA exon 2; Set C
ucuaucuucaaguuuuacacauguuguuccauugagcu

SEQ ID NO: 50535 - RNA, 37 nt, Artificial Sequence
  Synthetic Oligonucleotide; BTLA exon 2; Set A
ucuaucuucaaguuuuacacauguuguuccauugagc

SEQ ID NO: 50536 - RNA, 39 nt, Artificial Sequence
  Synthetic Oligonucleotide; BTLA exon 2; Set C
gucuaucuucaaguuuuacacauguuguuccauugagcu

SEQ ID NO: 50537 - RNA, 38 nt, Artificial Sequence
  Synthetic Oligonucleotide; BTLA exon 2; Set C
gucuaucuucaaguuuuacacauguuguuccauugagc

SEQ ID NO: 50538 - RNA, 40 nt, Artificial Sequence
  Synthetic Oligonucleotide; BTLA exon 2; Set C
ugucuaucuucaaguuuuacacauguuguuccauugagcu

SEQ ID NO: 50539 - RNA, 39 nt, Artificial Sequence
  Synthetic Oligonucleotide; BTLA exon 2; Set C
ugucuaucuucaaguuuuacacauguuguuccauugagc

SEQ ID NO: 50540 - RNA, 40 nt, Artificial Sequence
  Synthetic Oligonucleotide; BTLA exon 2; Set C
uugucuaucuucaaguuuuacacauguuguuccauugagc

SEQ ID NO: 50541 - RNA, 34 nt, Artificial Sequence
  Synthetic Oligonucleotide; BTLA exon 2; Set A
gucuaucuucaaguuuuacacauguuguuccauu

SEQ ID NO: 50542 - RNA, 35 nt, Artificial Sequence
  Synthetic Oligonucleotide; BTLA exon 2; Set A
ugucuaucuucaaguuuuacacauguuguuccauu

SEQ ID NO: 50543 - RNA, 36 nt, Artificial Sequence
  Synthetic Oligonucleotide; BTLA exon 2; Set A
uugucuaucuucaaguuuuacacauguuguuccauu

SEQ ID NO: 50544 - RNA, 19 nt, Artificial Sequence
  Synthetic Oligonucleotide; BTLA exon 2; Set C
cuucaaguuuuacacaugu

SEQ ID NO: 50545 - RNA, 37 nt, Artificial Sequence
  Synthetic Oligonucleotide; BTLA exon 2; Set A
uuugucuaucuucaaguuuuacacauguuguuccauu

SEQ ID NO: 50546 - RNA, 20 nt, Artificial Sequence
  Synthetic Oligonucleotide; BTLA exon 2; Set C
ucuucaaguuuuacacaugu

SEQ ID NO: 50547 - RNA, 21 nt, Artificial Sequence
  Synthetic Oligonucleotide; BTLA exon 2; Set C
aucuucaaguuuuacacaugu

SEQ ID NO: 50548 - RNA, 22 nt, Artificial Sequence
  Synthetic Oligonucleotide; BTLA exon 2; Set C
uaucuucaaguuuuacacaugu

SEQ ID NO: 50549 - RNA, 15 nt, Artificial Sequence
  Synthetic Oligonucleotide; BTLA exon 2; Set C
cuucaaguuuuacac

SEQ ID NO: 50550 - RNA, 23 nt, Artificial Sequence
  Synthetic Oligonucleotide; BTLA exon 2; Set C
cuaucuucaaguuuuacacaugu

SEQ ID NO: 50551 - RNA, 16 nt, Artificial Sequence
  Synthetic Oligonucleotide; BTLA exon 2; Set C
ucuucaaguuuuacac

SEQ ID NO: 50552 - RNA, 24 nt, Artificial Sequence
  Synthetic Oligonucleotide; BTLA exon 2; Set C
ucuaucuucaaguuuuacacaugu

SEQ ID NO: 50553 - RNA, 22 nt, Artificial Sequence
  Synthetic Oligonucleotide; BTLA exon 2; Set C
cuaucuucaaguuuuacacaug

SEQ ID NO: 50554 - RNA, 15 nt, Artificial Sequence
  Synthetic Oligonucleotide; BTLA exon 2; Set C
ucuucaaguuuuaca

SEQ ID NO: 50555 - RNA, 17 nt, Artificial Sequence
  Synthetic Oligonucleotide; BTLA exon 2; Set C
aucuucaaguuuuacac

SEQ ID NO: 50556 - RNA, 25 nt, Artificial Sequence
  Synthetic Oligonucleotide; BTLA exon 2; Set C
gucuaucuucaaguuuuacacaugu

SEQ ID NO: 50557 - RNA, 23 nt, Artificial Sequence
  Synthetic Oligonucleotide; BTLA exon 2; Set C
ucuaucuucaaguuuuacacaug

SEQ ID NO: 50558 - RNA, 16 nt, Artificial Sequence
  Synthetic Oligonucleotide; BTLA exon 2; Set C
aucuucaaguuuuaca

SEQ ID NO: 50559 - RNA, 18 nt, Artificial Sequence
  Synthetic Oligonucleotide; BTLA exon 2; Set C
uaucuucaaguuuuacac

SEQ ID NO: 50560 - RNA, 26 nt, Artificial Sequence
  Synthetic Oligonucleotide; BTLA exon 2; Set C
ugucuaucuucaaguuuuacacaugu

SEQ ID NO: 50561 - RNA, 24 nt, Artificial Sequence
  Synthetic Oligonucleotide; BTLA exon 2; Set C
gucuaucuucaaguuuuacacaug

SEQ ID NO: 50562 - RNA, 15 nt, Artificial Sequence
  Synthetic Oligonucleotide; BTLA exon 2; Set C
aucuucaaguuuuac

SEQ ID NO: 50563 - RNA, 17 nt, Artificial Sequence
  Synthetic Oligonucleotide; BTLA exon 2; Set C
uaucuucaaguuuuaca

SEQ ID NO: 50564 - RNA, 19 nt, Artificial Sequence
  Synthetic Oligonucleotide; BTLA exon 2; Set C
cuaucuucaaguuuuacac

SEQ ID NO: 50565 - RNA, 25 nt, Artificial Sequence
  Synthetic Oligonucleotide; BTLA exon 2; Set C
ugucuaucuucaaguuuuacacaug

SEQ ID NO: 50566 - RNA, 23 nt, Artificial Sequence
  Synthetic Oligonucleotide; BTLA exon 2; Set C
gucuaucuucaaguuuuacacau

SEQ ID NO: 50567 - RNA, 21 nt, Artificial Sequence
  Synthetic Oligonucleotide; BTLA exon 2; Set C
ucuaucuucaaguuuuacaca

SEQ ID NO: 50568 - RNA, 16 nt, Artificial Sequence
  Synthetic Oligonucleotide; BTLA exon 2; Set C
uaucuucaaguuuuac

SEQ ID NO: 50569 - RNA, 20 nt, Artificial Sequence
  Synthetic Oligonucleotide; BTLA exon 2; Set C
ucuaucuucaaguuuuacac

SEQ ID NO: 50570 - RNA, 26 nt, Artificial Sequence
  Synthetic Oligonucleotide; BTLA exon 2; Set C
uugucuaucuucaaguuuuacacaug

SEQ ID NO: 50571 - RNA, 24 nt, Artificial Sequence
  Synthetic Oligonucleotide; BTLA exon 2; Set C
ugucuaucuucaaguuuuacacau

SEQ ID NO: 50572 - RNA, 22 nt, Artificial Sequence
  Synthetic Oligonucleotide; BTLA exon 2; Set C
gucuaucuucaaguuuuacaca

SEQ ID NO: 50573 - RNA, 17 nt, Artificial Sequence
  Synthetic Oligonucleotide; BTLA exon 2; Set C
cuaucuucaaguuuuac

SEQ ID NO: 50574 - RNA, 29 nt, Artificial Sequence
  Synthetic Oligonucleotide; BTLA exon 2; Set A
guuugucuaucuucaaguuuuacacaugu

SEQ ID NO: 50575 - RNA, 27 nt, Artificial Sequence
  Synthetic Oligonucleotide; BTLA exon 2; Set C
uuugucuaucuucaaguuuuacacaug

SEQ ID NO: 50576 - RNA, 25 nt, Artificial Sequence
  Synthetic Oligonucleotide; BTLA exon 2; Set C
uugucuaucuucaaguuuuacacau

SEQ ID NO: 50577 - RNA, 23 nt, Artificial Sequence
  Synthetic Oligonucleotide; BTLA exon 2; Set C
ugucuaucuucaaguuuuacaca

SEQ ID NO: 50578 - RNA, 30 nt, Artificial Sequence
  Synthetic Oligonucleotide; BTLA exon 2; Set A
uguuugucuaucuucaaguuuuacacaugu

SEQ ID NO: 50579 - RNA, 26 nt, Artificial Sequence
  Synthetic Oligonucleotide; BTLA exon 2; Set C
uuugucuaucuucaaguuuuacacau

SEQ ID NO: 50580 - RNA, 24 nt, Artificial Sequence
  Synthetic Oligonucleotide; BTLA exon 2; Set C
uugucuaucuucaaguuuuacaca

SEQ ID NO: 50581 - RNA, 31 nt, Artificial Sequence
  Synthetic Oligonucleotide; BTLA exon 2; Set A
uuguuugucuaucuucaaguuuuacacaugu

SEQ ID NO: 50582 - RNA, 25 nt, Artificial Sequence
  Synthetic Oligonucleotide; BTLA exon 2; Set C
uuugucuaucuucaaguuuuacaca

SEQ ID NO: 50583 - RNA, 25 nt, Artificial Sequence
  Synthetic Oligonucleotide; BTLA exon 2; Set C
guuugucuaucuucaaguuuuacac

SEQ ID NO: 50584 - RNA, 24 nt, Artificial Sequence
  Synthetic Oligonucleotide; BTLA exon 2; Set C
guuugucuaucuucaaguuuuaca

SEQ ID NO: 50585 - RNA, 26 nt, Artificial Sequence
  Synthetic Oligonucleotide; BTLA exon 2; Set C
uguuugucuaucuucaaguuuuacac

SEQ ID NO: 50586 - RNA, 37 nt, Artificial Sequence
  Synthetic Oligonucleotide; BTLA exon 2; Set A
ccaacuuguuugucuaucuucaaguuuuacacauguu

SEQ ID NO: 50587 - RNA, 23 nt, Artificial Sequence
  Synthetic Oligonucleotide; BTLA exon 2; Set C
guuugucuaucuucaaguuuuac

SEQ ID NO: 50588 - RNA, 25 nt, Artificial Sequence
  Synthetic Oligonucleotide; BTLA exon 2; Set C
uguuugucuaucuucaaguuuuaca

SEQ ID NO: 50589 - RNA, 27 nt, Artificial Sequence
  Synthetic Oligonucleotide; BTLA exon 2; Set C
uuguuugucuaucuucaaguuuuacac

SEQ ID NO: 50590 - RNA, 24 nt, Artificial Sequence
  Synthetic Oligonucleotide; BTLA exon 2; Set C
uguuugucuaucuucaaguuuuac

SEQ ID NO: 50591 - RNA, 26 nt, Artificial Sequence
  Synthetic Oligonucleotide; BTLA exon 2; Set C
uuguuugucuaucuucaaguuuuaca

SEQ ID NO: 50592 - RNA, 28 nt, Artificial Sequence
  Synthetic Oligonucleotide; BTLA exon 2; Set C
cuuguuugucuaucuucaaguuuuacac

SEQ ID NO: 50593 - RNA, 34 nt, Artificial Sequence
  Synthetic Oligonucleotide; BTLA exon 2; Set A
caacuuguuugucuaucuucaaguuuuacacaug

SEQ ID NO: 50594 - RNA, 25 nt, Artificial Sequence
  Synthetic Oligonucleotide; BTLA exon 2; Set C
uuguuugucuaucuucaaguuuuac

SEQ ID NO: 50595 - RNA, 27 nt, Artificial Sequence
  Synthetic Oligonucleotide; BTLA exon 2; Set C
cuuguuugucuaucuucaaguuuuaca

SEQ ID NO: 50596 - RNA, 29 nt, Artificial Sequence
  Synthetic Oligonucleotide; BTLA exon 2; Set C
acuuguuugucuaucuucaaguuuuacac

SEQ ID NO: 50597 - RNA, 33 nt, Artificial Sequence
  Synthetic Oligonucleotide; BTLA exon 2; Set A
caacuuguuugucuaucuucaaguuuuacacau

SEQ ID NO: 50598 - RNA, 26 nt, Artificial Sequence
  Synthetic Oligonucleotide; BTLA exon 2; Set C
cuuguuugucuaucuucaaguuuuac

SEQ ID NO: 50599 - RNA, 28 nt, Artificial Sequence
  Synthetic Oligonucleotide; BTLA exon 2; Set C
acuuguuugucuaucuucaaguuuuaca

SEQ ID NO: 50600 - RNA, 30 nt, Artificial Sequence
  Synthetic Oligonucleotide; BTLA exon 2; Set C
aacuuguuugucuaucuucaaguuuuacac

SEQ ID NO: 50601 - RNA, 32 nt, Artificial Sequence
  Synthetic Oligonucleotide; BTLA exon 2; Set A
caacuuguuugucuaucuucaaguuuuacaca

SEQ ID NO: 50602 - RNA, 27 nt, Artificial Sequence
  Synthetic Oligonucleotide; BTLA exon 2; Set C
acuuguuugucuaucuucaaguuuuac

SEQ ID NO: 50603 - RNA, 29 nt, Artificial Sequence
  Synthetic Oligonucleotide; BTLA exon 2; Set C
aacuuguuugucuaucuucaaguuuuaca

SEQ ID NO: 50604 - RNA, 28 nt, Artificial Sequence
  Synthetic Oligonucleotide; BTLA exon 2; Set C
aacuuguuugucuaucuucaaguuuuac

SEQ ID NO: 50605 - RNA, 29 nt, Artificial Sequence
  Synthetic Oligonucleotide; BTLA exon 2; Set C
ccaacuuguuugucuaucuucaaguuuua

SEQ ID NO: 50606 - RNA, 28 nt, Artificial Sequence
  Synthetic Oligonucleotide; BTLA exon 2; Set C
ccaacuuguuugucuaucuucaaguuuu

SEQ ID NO: 50607 - RNA, 33 nt, Artificial Sequence
  Synthetic Oligonucleotide; BTLA exon 2; Set A
ccuuccaacuuguuugucuaucuucaaguuuua

SEQ ID NO: 50608 - RNA, 32 nt, Artificial Sequence
  Synthetic Oligonucleotide; BTLA exon 2; Set A
ccuuccaacuuguuugucuaucuucaaguuuu

SEQ ID NO: 50609 - RNA, 20 nt, Artificial Sequence
  Synthetic Oligonucleotide; BTLA exon 2; Set C
ccaacuuguuugucuaucuu

SEQ ID NO: 50610 - RNA, 19 nt, Artificial Sequence
  Synthetic Oligonucleotide; BTLA exon 2; Set C
ccaacuuguuugucuaucu

SEQ ID NO: 50611 - RNA, 21 nt, Artificial Sequence
  Synthetic Oligonucleotide; BTLA exon 2; Set C
uccaacuuguuugucuaucuu

SEQ ID NO: 50612 - RNA, 20 nt, Artificial Sequence
  Synthetic Oligonucleotide; BTLA exon 2; Set C
uccaacuuguuugucuaucu

SEQ ID NO: 50613 - RNA, 18 nt, Artificial Sequence
  Synthetic Oligonucleotide; BTLA exon 2; Set C
ccaacuuguuugucuauc

SEQ ID NO: 50614 - RNA, 17 nt, Artificial Sequence
  Synthetic Oligonucleotide; BTLA exon 2; Set C
ccaacuuguuugucuau

SEQ ID NO: 50615 - RNA, 16 nt, Artificial Sequence
  Synthetic Oligonucleotide; BTLA exon 2; Set C
ccaacuuguuugucua

SEQ ID NO: 50616 - RNA, 18 nt, Artificial Sequence
  Synthetic Oligonucleotide; BTLA exon 2; Set C
uccaacuuguuugucuau

SEQ ID NO: 50617 - RNA, 24 nt, Artificial Sequence
  Synthetic Oligonucleotide; BTLA exon 2; Set C
ccuuccaacuuguuugucuaucuu

SEQ ID NO: 50618 - RNA, 15 nt, Artificial Sequence
  Synthetic Oligonucleotide; BTLA exon 2; Set C
ccaacuuguuugucu

SEQ ID NO: 50619 - RNA, 17 nt, Artificial Sequence
  Synthetic Oligonucleotide; BTLA exon 2; Set C
uccaacuuguuugucua

SEQ ID NO: 50620 - RNA, 23 nt, Artificial Sequence
  Synthetic Oligonucleotide; BTLA exon 2; Set C
ccuuccaacuuguuugucuaucu

SEQ ID NO: 50621 - RNA, 16 nt, Artificial Sequence
  Synthetic Oligonucleotide; BTLA exon 2; Set C
uccaacuuguuugucu

SEQ ID NO: 50622 - RNA, 22 nt, Artificial Sequence
  Synthetic Oligonucleotide; BTLA exon 2; Set C
ccuuccaacuuguuugucuauc

SEQ ID NO: 50623 - RNA, 21 nt, Artificial Sequence
  Synthetic Oligonucleotide; BTLA exon 2; Set C
ccuuccaacuuguuugucuau

SEQ ID NO: 50624 - RNA, 20 nt, Artificial Sequence
  Synthetic Oligonucleotide; BTLA exon 2; Set C
ccuuccaacuuguuugucua

SEQ ID NO: 50625 - RNA, 19 nt, Artificial Sequence
  Synthetic Oligonucleotide; BTLA exon 2; Set C
ccuuccaacuuguuugucu

SEQ ID NO: 50626 - RNA, 18 nt, Artificial Sequence
  Synthetic Oligonucleotide; BTLA exon 2; Set C
ccuuccaacuuguuuguc

SEQ ID NO: 50627 - RNA, 17 nt, Artificial Sequence
  Synthetic Oligonucleotide; BTLA exon 2; Set C
ccuuccaacuuguuugu

SEQ ID NO: 50628 - RNA, 16 nt, Artificial Sequence
  Synthetic Oligonucleotide; BTLA exon 2; Set C
ccuuccaacuuguuug

SEQ ID NO: 50629 - RNA, 15 nt, Artificial Sequence
  Synthetic Oligonucleotide; BTLA exon 2; Set C
ccuuccaacuuguuu

SEQ ID NO: 50630 - RNA, 20 nt, Artificial Sequence
  Synthetic Oligonucleotide; BTLA exon 2; Set C
cuucucuuccuuccaacuug

SEQ ID NO: 50631 - RNA, 19 nt, Artificial Sequence
  Synthetic Oligonucleotide; BTLA exon 2; Set C
cuucucuuccuuccaacuu

SEQ ID NO: 50632 - RNA, 18 nt, Artificial Sequence
  Synthetic Oligonucleotide; BTLA exon 2; Set C
cuucucuuccuuccaacu

SEQ ID NO: 50633 - RNA, 17 nt, Artificial Sequence
  Synthetic Oligonucleotide; BTLA exon 2; Set C
cuucucuuccuuccaac

SEQ ID NO: 50634 - RNA, 40 nt, Artificial Sequence
  Synthetic Oligonucleotide; BTLA exon 2; Set A
aaaaaugaaauguucuucucuuccuuccaacuuguuuguc

SEQ ID NO: 50635 - RNA, 39 nt, Artificial Sequence
  Synthetic Oligonucleotide; BTLA exon 2; Set A
aaaaaugaaauguucuucucuuccuuccaacuuguuugu

SEQ ID NO: 50636 - RNA, 38 nt, Artificial Sequence
  Synthetic Oligonucleotide; BTLA exon 2; Set A
aaaaaugaaauguucuucucuuccuuccaacuuguuug

SEQ ID NO: 50637 - RNA, 37 nt, Artificial Sequence
  Synthetic Oligonucleotide; BTLA exon 2; Set A
aaaaaugaaauguucuucucuuccuuccaacuuguuu

SEQ ID NO: 50638 - RNA, 35 nt, Artificial Sequence
  Synthetic Oligonucleotide; BTLA exon 2; Set A
aaaaugaaauguucuucucuuccuuccaacuuguu

SEQ ID NO: 50639 - RNA, 36 nt, Artificial Sequence
  Synthetic Oligonucleotide; BTLA exon 2; Set A
aaaaaugaaauguucuucucuuccuuccaacuuguu

SEQ ID NO: 50640 - RNA, 34 nt, Artificial Sequence
  Synthetic Oligonucleotide; BTLA exon 2; Set A
aaaaugaaauguucuucucuuccuuccaacuugu

SEQ ID NO: 50641 - RNA, 35 nt, Artificial Sequence
  Synthetic Oligonucleotide; BTLA exon 2; Set A
aaaaaugaaauguucuucucuuccuuccaacuugu

SEQ ID NO: 50642 - RNA, 33 nt, Artificial Sequence
  Synthetic Oligonucleotide; BTLA exon 2; Set C
aaaaugaaauguucuucucuuccuuccaacuug

SEQ ID NO: 50643 - RNA, 29 nt, Artificial Sequence
  Synthetic Oligonucleotide; BTLA exon 2; Set C
aaaaugaaauguucuucucuuccuuccaa

SEQ ID NO: 50644 - RNA, 30 nt, Artificial Sequence
  Synthetic Oligonucleotide; BTLA exon 2; Set C
aaaaaugaaauguucuucucuuccuuccaa

SEQ ID NO: 50645 - RNA, 40 nt, Artificial Sequence
  Synthetic Oligonucleotide; BTLA exon 2; Set A
agaaugaaaaaugaaauguucuucucuuccuuccaacuug

SEQ ID NO: 50646 - RNA, 39 nt, Artificial Sequence
  Synthetic Oligonucleotide; BTLA exon 2; Set A
agaaugaaaaaugaaauguucuucucuuccuuccaacuu

SEQ ID NO: 50647 - RNA, 38 nt, Artificial Sequence
  Synthetic Oligonucleotide; BTLA exon 2; Set A
agaaugaaaaaugaaauguucuucucuuccuuccaacu

SEQ ID NO: 50648 - RNA, 40 nt, Artificial Sequence
  Synthetic Oligonucleotide; BTLA exon 2; Set A
uagaaugaaaaaugaaauguucuucucuuccuuccaacuu

SEQ ID NO: 50649 - RNA, 39 nt, Artificial Sequence
  Synthetic Oligonucleotide; BTLA exon 2; Set A
uagaaugaaaaaugaaauguucuucucuuccuuccaacu

SEQ ID NO: 50650 - RNA, 37 nt, Artificial Sequence
  Synthetic Oligonucleotide; BTLA exon 2; Set C
agaaugaaaaaugaaauguucuucucuuccuuccaac

SEQ ID NO: 50651 - RNA, 40 nt, Artificial Sequence
  Synthetic Oligonucleotide; BTLA exon 2; Set A
guagaaugaaaaaugaaauguucuucucuuccuuccaacu

SEQ ID NO: 50652 - RNA, 38 nt, Artificial Sequence
  Synthetic Oligonucleotide; BTLA exon 2; Set A
uagaaugaaaaaugaaauguucuucucuuccuuccaac

SEQ ID NO: 50653 - RNA, 39 nt, Artificial Sequence
  Synthetic Oligonucleotide; BTLA exon 2; Set A
guagaaugaaaaaugaaauguucuucucuuccuuccaac

SEQ ID NO: 50654 - RNA, 40 nt, Artificial Sequence
  Synthetic Oligonucleotide; BTLA exon 2; Set A
uguagaaugaaaaaugaaauguucuucucuuccuuccaac

SEQ ID NO: 50655 - RNA, 15 nt, Artificial Sequence
  Synthetic Oligonucleotide; BTLA exon 2; Set C
aaugaaauguucuuc

SEQ ID NO: 50656 - RNA, 16 nt, Artificial Sequence
  Synthetic Oligonucleotide; BTLA exon 2; Set C
aaaugaaauguucuuc

SEQ ID NO: 50657 - RNA, 17 nt, Artificial Sequence
  Synthetic Oligonucleotide; BTLA exon 2; Set C
aaaaaugaaauguucuu

SEQ ID NO: 50658 - RNA, 23 nt, Artificial Sequence
  Synthetic Oligonucleotide; BTLA exon 2; Set C
agaaugaaaaaugaaauguucuu

SEQ ID NO: 50659 - RNA, 24 nt, Artificial Sequence
  Synthetic Oligonucleotide; BTLA exon 2; Set C
uagaaugaaaaaugaaauguucuu

SEQ ID NO: 50660 - RNA, 37 nt, Artificial Sequence
  Synthetic Oligonucleotide; BTLA exon 2; Set C
ugguucaaaauguagaaugaaaaaugaaauguucuuc

SEQ ID NO: 50661 - RNA, 38 nt, Artificial Sequence
  Synthetic Oligonucleotide; BTLA exon 2; Set C
cugguucaaaauguagaaugaaaaaugaaauguucuuc

SEQ ID NO: 50662 - RNA, 39 nt, Artificial Sequence
  Synthetic Oligonucleotide; BTLA exon 2; Set C
acugguucaaaauguagaaugaaaaaugaaauguucuuc

SEQ ID NO: 50663 - RNA, 40 nt, Artificial Sequence
  Synthetic Oligonucleotide; BTLA exon 2; Set C
cacugguucaaaauguagaaugaaaaaugaaauguucuuc

SEQ ID NO: 50664 - RNA, 40 nt, Artificial Sequence
  Synthetic Oligonucleotide; BTLA exon 2; Set A
gcacugguucaaaauguagaaugaaaaaugaaauguucuu

SEQ ID NO: 50665 - RNA, 40 nt, Artificial Sequence
  Synthetic Oligonucleotide; BTLA exon 2; Set C
aagcacugguucaaaauguagaaugaaaaaugaaauguuc

SEQ ID NO: 50666 - RNA, 37 nt, Artificial Sequence
  Synthetic Oligonucleotide; BTLA exon 2; Set C
aagcacugguucaaaauguagaaugaaaaaugaaaug

SEQ ID NO: 50667 - RNA, 21 nt, Artificial Sequence
  Synthetic Oligonucleotide; BTLA exon 2; Set C
guucaaaauguagaaugaaaa

SEQ ID NO: 50668 - RNA, 34 nt, Artificial Sequence
  Synthetic Oligonucleotide; BTLA exon 2; Set C
agcacugguucaaaauguagaaugaaaaaugaaa

SEQ ID NO: 50669 - RNA, 36 nt, Artificial Sequence
  Synthetic Oligonucleotide; BTLA exon 2; Set C
aagcacugguucaaaauguagaaugaaaaaugaaau

SEQ ID NO: 50670 - RNA, 32 nt, Artificial Sequence
  Synthetic Oligonucleotide; BTLA exon 2; Set C
gcacugguucaaaauguagaaugaaaaaugaa

SEQ ID NO: 50671 - RNA, 22 nt, Artificial Sequence
  Synthetic Oligonucleotide; BTLA exon 2; Set C
gguucaaaauguagaaugaaaa

SEQ ID NO: 50672 - RNA, 35 nt, Artificial Sequence
  Synthetic Oligonucleotide; BTLA exon 2; Set C
aagcacugguucaaaauguagaaugaaaaaugaaa

SEQ ID NO: 50673 - RNA, 33 nt, Artificial Sequence
  Synthetic Oligonucleotide; BTLA exon 2; Set C
agcacugguucaaaauguagaaugaaaaaugaa

SEQ ID NO: 50674 - RNA, 31 nt, Artificial Sequence
  Synthetic Oligonucleotide; BTLA exon 2; Set C
gcacugguucaaaauguagaaugaaaaauga

SEQ ID NO: 50675 - RNA, 23 nt, Artificial Sequence
  Synthetic Oligonucleotide; BTLA exon 2; Set C
ugguucaaaauguagaaugaaaa

SEQ ID NO: 50676 - RNA, 21 nt, Artificial Sequence
  Synthetic Oligonucleotide; BTLA exon 2; Set C
gguucaaaauguagaaugaaa

SEQ ID NO: 50677 - RNA, 34 nt, Artificial Sequence
  Synthetic Oligonucleotide; BTLA exon 2; Set C
aagcacugguucaaaauguagaaugaaaaaugaa

SEQ ID NO: 50678 - RNA, 32 nt, Artificial Sequence
  Synthetic Oligonucleotide; BTLA exon 2; Set C
agcacugguucaaaauguagaaugaaaaauga

SEQ ID NO: 50679 - RNA, 30 nt, Artificial Sequence
  Synthetic Oligonucleotide; BTLA exon 2; Set C
gcacugguucaaaauguagaaugaaaaaug

SEQ ID NO: 50680 - RNA, 24 nt, Artificial Sequence
  Synthetic Oligonucleotide; BTLA exon 2; Set C
cugguucaaaauguagaaugaaaa

SEQ ID NO: 50681 - RNA, 22 nt, Artificial Sequence
  Synthetic Oligonucleotide; BTLA exon 2; Set C
ugguucaaaauguagaaugaaa

SEQ ID NO: 50682 - RNA, 33 nt, Artificial Sequence
  Synthetic Oligonucleotide; BTLA exon 2; Set C
aagcacugguucaaaauguagaaugaaaaauga

SEQ ID NO: 50683 - RNA, 29 nt, Artificial Sequence
  Synthetic Oligonucleotide; BTLA exon 2; Set C
gcacugguucaaaauguagaaugaaaaau

SEQ ID NO: 50684 - RNA, 31 nt, Artificial Sequence
  Synthetic Oligonucleotide; BTLA exon 2; Set C
agcacugguucaaaauguagaaugaaaaaug

SEQ ID NO: 50685 - RNA, 25 nt, Artificial Sequence
  Synthetic Oligonucleotide; BTLA exon 2; Set C
acugguucaaaauguagaaugaaaa

SEQ ID NO: 50686 - RNA, 23 nt, Artificial Sequence
  Synthetic Oligonucleotide; BTLA exon 2; Set C
cugguucaaaauguagaaugaaa

SEQ ID NO: 50687 - RNA, 30 nt, Artificial Sequence
  Synthetic Oligonucleotide; BTLA exon 2; Set C
agcacugguucaaaauguagaaugaaaaau

SEQ ID NO: 50688 - RNA, 32 nt, Artificial Sequence
  Synthetic Oligonucleotide; BTLA exon 2; Set C
aagcacugguucaaaauguagaaugaaaaaug

SEQ ID NO: 50689 - RNA, 28 nt, Artificial Sequence
  Synthetic Oligonucleotide; BTLA exon 2; Set C
gcacugguucaaaauguagaaugaaaaa

SEQ ID NO: 50690 - RNA, 26 nt, Artificial Sequence
  Synthetic Oligonucleotide; BTLA exon 2; Set C
cacugguucaaaauguagaaugaaaa

SEQ ID NO: 50691 - RNA, 24 nt, Artificial Sequence
  Synthetic Oligonucleotide; BTLA exon 2; Set C
acugguucaaaauguagaaugaaa

SEQ ID NO: 50692 - RNA, 31 nt, Artificial Sequence
  Synthetic Oligonucleotide; BTLA exon 2; Set C
aagcacugguucaaaauguagaaugaaaaau

SEQ ID NO: 50693 - RNA, 29 nt, Artificial Sequence
  Synthetic Oligonucleotide; BTLA exon 2; Set C
agcacugguucaaaauguagaaugaaaaa

SEQ ID NO: 50694 - RNA, 25 nt, Artificial Sequence
  Synthetic Oligonucleotide; BTLA exon 2; Set C
cacugguucaaaauguagaaugaaa

SEQ ID NO: 50695 - RNA, 30 nt, Artificial Sequence
  Synthetic Oligonucleotide; BTLA exon 2; Set C
aagcacugguucaaaauguagaaugaaaaa

SEQ ID NO: 50696 - RNA, 31 nt, Artificial Sequence
  Synthetic Oligonucleotide; BTLA exon 2; Set C
gaagcacugguucaaaauguagaaugaaaaa

SEQ ID NO: 50697 - RNA, 32 nt, Artificial Sequence
  Synthetic Oligonucleotide; BTLA exon 2; Set C
ggaagcacugguucaaaauguagaaugaaaaa

SEQ ID NO: 50698 - RNA, 22 nt, Artificial Sequence
  Synthetic Oligonucleotide; BTLA exon 2; Set C
gcacugguucaaaauguagaau

SEQ ID NO: 50699 - RNA, 21 nt, Artificial Sequence
  Synthetic Oligonucleotide; BTLA exon 2; Set C
gcacugguucaaaauguagaa

SEQ ID NO: 50700 - RNA, 23 nt, Artificial Sequence
  Synthetic Oligonucleotide; BTLA exon 2; Set C
agcacugguucaaaauguagaau

SEQ ID NO: 50701 - RNA, 33 nt, Artificial Sequence
  Synthetic Oligonucleotide; BTLA exon 2; Set C
uaggaagcacugguucaaaauguagaaugaaaa

SEQ ID NO: 50702 - RNA, 22 nt, Artificial Sequence
  Synthetic Oligonucleotide; BTLA exon 2; Set C
agcacugguucaaaauguagaa

SEQ ID NO: 50703 - RNA, 24 nt, Artificial Sequence
  Synthetic Oligonucleotide; BTLA exon 2; Set C
aagcacugguucaaaauguagaau

SEQ ID NO: 50704 - RNA, 34 nt, Artificial Sequence
  Synthetic Oligonucleotide; BTLA exon 2; Set C
uuaggaagcacugguucaaaauguagaaugaaaa

SEQ ID NO: 50705 - RNA, 23 nt, Artificial Sequence
  Synthetic Oligonucleotide; BTLA exon 2; Set C
aagcacugguucaaaauguagaa

SEQ ID NO: 50706 - RNA, 35 nt, Artificial Sequence
  Synthetic Oligonucleotide; BTLA exon 2; Set C
auuaggaagcacugguucaaaauguagaaugaaaa

SEQ ID NO: 50707 - RNA, 33 nt, Artificial Sequence
  Synthetic Oligonucleotide; BTLA exon 2; Set C
uuaggaagcacugguucaaaauguagaaugaaa

SEQ ID NO: 50708 - RNA, 34 nt, Artificial Sequence
  Synthetic Oligonucleotide; BTLA exon 2; Set C
auuaggaagcacugguucaaaauguagaaugaaa

SEQ ID NO: 50709 - RNA, 39 nt, Artificial Sequence
  Synthetic Oligonucleotide; BTLA exon 2; Set A
gucauuaggaagcacugguucaaaauguagaaugaaaaa

SEQ ID NO: 50710 - RNA, 15 nt, Artificial Sequence
  Synthetic Oligonucleotide; BTLA exon 2; Set C
gcacugguucaaaau

SEQ ID NO: 50711 - RNA, 25 nt, Artificial Sequence
  Synthetic Oligonucleotide; BTLA exon 2; Set C
aggaagcacugguucaaaauguaga

SEQ ID NO: 50712 - RNA, 24 nt, Artificial Sequence
  Synthetic Oligonucleotide; BTLA exon 2; Set C
aggaagcacugguucaaaauguag

SEQ ID NO: 50713 - RNA, 26 nt, Artificial Sequence
  Synthetic Oligonucleotide; BTLA exon 2; Set C
uaggaagcacugguucaaaauguaga

SEQ ID NO: 50714 - RNA, 19 nt, Artificial Sequence
  Synthetic Oligonucleotide; BTLA exon 2; Set C
gaagcacugguucaaaaug

SEQ ID NO: 50715 - RNA, 23 nt, Artificial Sequence
  Synthetic Oligonucleotide; BTLA exon 2; Set C
aggaagcacugguucaaaaugua

SEQ ID NO: 50716 - RNA, 25 nt, Artificial Sequence
  Synthetic Oligonucleotide; BTLA exon 2; Set C
uaggaagcacugguucaaaauguag

SEQ ID NO: 50717 - RNA, 18 nt, Artificial Sequence
  Synthetic Oligonucleotide; BTLA exon 2; Set C
gaagcacugguucaaaau

SEQ ID NO: 50718 - RNA, 20 nt, Artificial Sequence
  Synthetic Oligonucleotide; BTLA exon 2; Set C
ggaagcacugguucaaaaug

SEQ ID NO: 50719 - RNA, 22 nt, Artificial Sequence
  Synthetic Oligonucleotide; BTLA exon 2; Set C
aggaagcacugguucaaaaugu

SEQ ID NO: 50720 - RNA, 40 nt, Artificial Sequence
  Synthetic Oligonucleotide; BTLA exon 2; Set A
auugucauuaggaagcacugguucaaaauguagaaugaaa

SEQ ID NO: 50721 - RNA, 19 nt, Artificial Sequence
  Synthetic Oligonucleotide; BTLA exon 2; Set C
ggaagcacugguucaaaau

SEQ ID NO: 50722 - RNA, 17 nt, Artificial Sequence
  Synthetic Oligonucleotide; BTLA exon 2; Set C
gaagcacugguucaaaa

SEQ ID NO: 50723 - RNA, 29 nt, Artificial Sequence
  Synthetic Oligonucleotide; BTLA exon 2; Set A
cauuaggaagcacugguucaaaauguaga

SEQ ID NO: 50724 - RNA, 18 nt, Artificial Sequence
  Synthetic Oligonucleotide; BTLA exon 2; Set C
ggaagcacugguucaaaa

SEQ ID NO: 50725 - RNA, 28 nt, Artificial Sequence
  Synthetic Oligonucleotide; BTLA exon 2; Set C
cauuaggaagcacugguucaaaauguag

SEQ ID NO: 50726 - RNA, 30 nt, Artificial Sequence
  Synthetic Oligonucleotide; BTLA exon 2; Set A
ucauuaggaagcacugguucaaaauguaga

SEQ ID NO: 50727 - RNA, 27 nt, Artificial Sequence
  Synthetic Oligonucleotide; BTLA exon 2; Set C
cauuaggaagcacugguucaaaaugua

SEQ ID NO: 50728 - RNA, 29 nt, Artificial Sequence
  Synthetic Oligonucleotide; BTLA exon 2; Set C
ucauuaggaagcacugguucaaaauguag

SEQ ID NO: 50729 - RNA, 26 nt, Artificial Sequence
  Synthetic Oligonucleotide; BTLA exon 2; Set C
cauuaggaagcacugguucaaaaugu

SEQ ID NO: 50730 - RNA, 28 nt, Artificial Sequence
  Synthetic Oligonucleotide; BTLA exon 2; Set A
ucauuaggaagcacugguucaaaaugua

SEQ ID NO: 50731 - RNA, 27 nt, Artificial Sequence
  Synthetic Oligonucleotide; BTLA exon 2; Set C
ucauuaggaagcacugguucaaaaugu

SEQ ID NO: 50732 - RNA, 30 nt, Artificial Sequence
  Synthetic Oligonucleotide; BTLA exon 2; Set A
ugucauuaggaagcacugguucaaaaugua

SEQ ID NO: 50733 - RNA, 27 nt, Artificial Sequence
  Synthetic Oligonucleotide; BTLA exon 2; Set C
gucauuaggaagcacugguucaaaaug

SEQ ID NO: 50734 - RNA, 29 nt, Artificial Sequence
  Synthetic Oligonucleotide; BTLA exon 2; Set A
ugucauuaggaagcacugguucaaaaugu

SEQ ID NO: 50735 - RNA, 26 nt, Artificial Sequence
  Synthetic Oligonucleotide; BTLA exon 2; Set C
gucauuaggaagcacugguucaaaau

SEQ ID NO: 50736 - RNA, 28 nt, Artificial Sequence
  Synthetic Oligonucleotide; BTLA exon 2; Set C
ugucauuaggaagcacugguucaaaaug

SEQ ID NO: 50737 - RNA, 24 nt, Artificial Sequence
  Synthetic Oligonucleotide; BTLA exon 2; Set C
ucauuaggaagcacugguucaaaa

SEQ ID NO: 50738 - RNA, 36 nt, Artificial Sequence
  Synthetic Oligonucleotide; BTLA exon 2; Set A
ccauugucauuaggaagcacugguucaaaauguaga

SEQ ID NO: 50739 - RNA, 27 nt, Artificial Sequence
  Synthetic Oligonucleotide; BTLA exon 2; Set C
ugucauuaggaagcacugguucaaaau

SEQ ID NO: 50740 - RNA, 29 nt, Artificial Sequence
  Synthetic Oligonucleotide; BTLA exon 2; Set A
uugucauuaggaagcacugguucaaaaug

SEQ ID NO: 50741 - RNA, 25 nt, Artificial Sequence
  Synthetic Oligonucleotide; BTLA exon 2; Set C
gucauuaggaagcacugguucaaaa

SEQ ID NO: 50742 - RNA, 35 nt, Artificial Sequence
  Synthetic Oligonucleotide; BTLA exon 2; Set A
ccauugucauuaggaagcacugguucaaaauguag

SEQ ID NO: 50743 - RNA, 28 nt, Artificial Sequence
  Synthetic Oligonucleotide; BTLA exon 2; Set C
uugucauuaggaagcacugguucaaaau

SEQ ID NO: 50744 - RNA, 26 nt, Artificial Sequence
  Synthetic Oligonucleotide; BTLA exon 2; Set C
ugucauuaggaagcacugguucaaaa

SEQ ID NO: 50745 - RNA, 27 nt, Artificial Sequence
  Synthetic Oligonucleotide; BTLA exon 2; Set C
uugucauuaggaagcacugguucaaaa

SEQ ID NO: 50746 - RNA, 40 nt, Artificial Sequence
  Synthetic Oligonucleotide; BTLA exon 2; Set C
cgguaugacccauugucauuaggaagcacugguucaaaau

SEQ ID NO: 50747 - RNA, 39 nt, Artificial Sequence
  Synthetic Oligonucleotide; BTLA exon 2; Set C
cgguaugacccauugucauuaggaagcacugguucaaaa

SEQ ID NO: 50748 - RNA, 17 nt, Artificial Sequence
  Synthetic Oligonucleotide; BTLA exon 2; Set C
auugucauuaggaagca

SEQ ID NO: 50749 - RNA, 28 nt, Artificial Sequence
  Synthetic Oligonucleotide; BTLA exon 2; Set C
ugacccauugucauuaggaagcacuggu

SEQ ID NO: 50750 - RNA, 30 nt, Artificial Sequence
  Synthetic Oligonucleotide; BTLA exon 2; Set C
augacccauugucauuaggaagcacugguu

SEQ ID NO: 50751 - RNA, 40 nt, Artificial Sequence
  Synthetic Oligonucleotide; BTLA exon 2; Set C
gcgguaugacccauugucauuaggaagcacugguucaaaa

SEQ ID NO: 50752 - RNA, 18 nt, Artificial Sequence
  Synthetic Oligonucleotide; BTLA exon 2; Set C
cauugucauuaggaagca

SEQ ID NO: 50753 - RNA, 16 nt, Artificial Sequence
  Synthetic Oligonucleotide; BTLA exon 2; Set C
auugucauuaggaagc

SEQ ID NO: 50754 - RNA, 27 nt, Artificial Sequence
  Synthetic Oligonucleotide; BTLA exon 2; Set A
ugacccauugucauuaggaagcacugg

SEQ ID NO: 50755 - RNA, 19 nt, Artificial Sequence
  Synthetic Oligonucleotide; BTLA exon 2; Set C
ccauugucauuaggaagca

SEQ ID NO: 50756 - RNA, 17 nt, Artificial Sequence
  Synthetic Oligonucleotide; BTLA exon 2; Set C
cauugucauuaggaagc

SEQ ID NO: 50757 - RNA, 15 nt, Artificial Sequence
  Synthetic Oligonucleotide; BTLA exon 2; Set C
auugucauuaggaag

SEQ ID NO: 50758 - RNA, 26 nt, Artificial Sequence
  Synthetic Oligonucleotide; BTLA exon 2; Set A
ugacccauugucauuaggaagcacug

SEQ ID NO: 50759 - RNA, 18 nt, Artificial Sequence
  Synthetic Oligonucleotide; BTLA exon 2; Set C
ccauugucauuaggaagc

SEQ ID NO: 50760 - RNA, 16 nt, Artificial Sequence
  Synthetic Oligonucleotide; BTLA exon 2; Set C
cauugucauuaggaag

SEQ ID NO: 50761 - RNA, 25 nt, Artificial Sequence
  Synthetic Oligonucleotide; BTLA exon 2; Set A
ugacccauugucauuaggaagcacu

SEQ ID NO: 50762 - RNA, 17 nt, Artificial Sequence
  Synthetic Oligonucleotide; BTLA exon 2; Set C
ccauugucauuaggaag

SEQ ID NO: 50763 - RNA, 16 nt, Artificial Sequence
  Synthetic Oligonucleotide; BTLA exon 2; Set C
ccauugucauuaggaa

SEQ ID NO: 50764 - RNA, 25 nt, Artificial Sequence
  Synthetic Oligonucleotide; BTLA exon 2; Set A
augacccauugucauuaggaagcac

SEQ ID NO: 50765 - RNA, 23 nt, Artificial Sequence
  Synthetic Oligonucleotide; BTLA exon 2; Set C
uaugacccauugucauuaggaag

SEQ ID NO: 50766 - RNA, 19 nt, Artificial Sequence
  Synthetic Oligonucleotide; BTLA exon 2; Set C
augacccauugucauuagg

SEQ ID NO: 50767 - RNA, 18 nt, Artificial Sequence
  Synthetic Oligonucleotide; BTLA exon 2; Set C
augacccauugucauuag

SEQ ID NO: 50768 - RNA, 17 nt, Artificial Sequence
  Synthetic Oligonucleotide; BTLA exon 2; Set C
augacccauugucauua

SEQ ID NO: 50769 - RNA, 16 nt, Artificial Sequence
  Synthetic Oligonucleotide; BTLA exon 2; Set C
augacccauugucauu

SEQ ID NO: 50770 - RNA, 32 nt, Artificial Sequence
  Synthetic Oligonucleotide; BTLA exon 2; Set C
acagcgguaugacccauugucauuaggaagca

SEQ ID NO: 50771 - RNA, 33 nt, Artificial Sequence
  Synthetic Oligonucleotide; BTLA exon 2; Set C
aacagcgguaugacccauugucauuaggaagca

SEQ ID NO: 50772 - RNA, 31 nt, Artificial Sequence
  Synthetic Oligonucleotide; BTLA exon 2; Set C
acagcgguaugacccauugucauuaggaagc

SEQ ID NO: 50773 - RNA, 24 nt, Artificial Sequence
  Synthetic Oligonucleotide; BTLA exon 2; Set B
gcgguaugacccauugucauuagg

SEQ ID NO: 50774 - RNA, 32 nt, Artificial Sequence
  Synthetic Oligonucleotide; BTLA exon 2; Set C
aacagcgguaugacccauugucauuaggaagc

SEQ ID NO: 50775 - RNA, 30 nt, Artificial Sequence
  Synthetic Oligonucleotide; BTLA exon 2; Set C
acagcgguaugacccauugucauuaggaag

SEQ ID NO: 50776 - RNA, 23 nt, Artificial Sequence
  Synthetic Oligonucleotide; BTLA exon 2; Set B
gcgguaugacccauugucauuag

SEQ ID NO: 50777 - RNA, 25 nt, Artificial Sequence
  Synthetic Oligonucleotide; BTLA exon 2; Set B
agcgguaugacccauugucauuagg

SEQ ID NO: 50778 - RNA, 29 nt, Artificial Sequence
  Synthetic Oligonucleotide; BTLA exon 2; Set C
acagcgguaugacccauugucauuaggaa

SEQ ID NO: 50779 - RNA, 31 nt, Artificial Sequence
  Synthetic Oligonucleotide; BTLA exon 2; Set B
aacagcgguaugacccauugucauuaggaag

SEQ ID NO: 50780 - RNA, 24 nt, Artificial Sequence
  Synthetic Oligonucleotide; BTLA exon 2; Set B
agcgguaugacccauugucauuag

SEQ ID NO: 50781 - RNA, 26 nt, Artificial Sequence
  Synthetic Oligonucleotide; BTLA exon 2; Set B
cagcgguaugacccauugucauuagg

SEQ ID NO: 50782 - RNA, 28 nt, Artificial Sequence
  Synthetic Oligonucleotide; BTLA exon 2; Set C
acagcgguaugacccauugucauuagga

SEQ ID NO: 50783 - RNA, 30 nt, Artificial Sequence
  Synthetic Oligonucleotide; BTLA exon 2; Set B
aacagcgguaugacccauugucauuaggaa

SEQ ID NO: 50784 - RNA, 25 nt, Artificial Sequence
  Synthetic Oligonucleotide; BTLA exon 2; Set B
cagcgguaugacccauugucauuag

SEQ ID NO: 50785 - RNA, 19 nt, Artificial Sequence
  Synthetic Oligonucleotide; BTLA exon 2; Set C
cgguaugacccauugucau

SEQ ID NO: 50786 - RNA, 29 nt, Artificial Sequence
  Synthetic Oligonucleotide; BTLA exon 2; Set C
aacagcgguaugacccauugucauuagga

SEQ ID NO: 50787 - RNA, 20 nt, Artificial Sequence
  Synthetic Oligonucleotide; BTLA exon 2; Set B
gcgguaugacccauugucau

SEQ ID NO: 50788 - RNA, 18 nt, Artificial Sequence
  Synthetic Oligonucleotide; BTLA exon 2; Set C
cgguaugacccauuguca

SEQ ID NO: 50789 - RNA, 21 nt, Artificial Sequence
  Synthetic Oligonucleotide; BTLA exon 2; Set B
agcgguaugacccauugucau

SEQ ID NO: 50790 - RNA, 22 nt, Artificial Sequence
  Synthetic Oligonucleotide; BTLA exon 2; Set B
cagcgguaugacccauugucau

SEQ ID NO: 50791 - RNA, 22 nt, Artificial Sequence
  Synthetic Oligonucleotide; BTLA exon 2; Set B
acagcgguaugacccauuguca

SEQ ID NO: 50792 - RNA, 15 nt, Artificial Sequence
  Synthetic Oligonucleotide; BTLA exon 2; Set C
gcgguaugacccauu

SEQ ID NO: 50793 - RNA, 21 nt, Artificial Sequence
  Synthetic Oligonucleotide; BTLA exon 2; Set B
acagcgguaugacccauuguc

SEQ ID NO: 50794 - RNA, 16 nt, Artificial Sequence
  Synthetic Oligonucleotide; BTLA exon 2; Set C
agcgguaugacccauu

SEQ ID NO: 50795 - RNA, 20 nt, Artificial Sequence
  Synthetic Oligonucleotide; BTLA exon 2; Set B
acagcgguaugacccauugu

SEQ ID NO: 50796 - RNA, 22 nt, Artificial Sequence
  Synthetic Oligonucleotide; BTLA exon 2; Set B
aacagcgguaugacccauuguc

SEQ ID NO: 50797 - RNA, 17 nt, Artificial Sequence
  Synthetic Oligonucleotide; BTLA exon 2; Set C
cagcgguaugacccauu

SEQ ID NO: 50798 - RNA, 15 nt, Artificial Sequence
  Synthetic Oligonucleotide; BTLA exon 2; Set C
agcgguaugacccau

SEQ ID NO: 50799 - RNA, 21 nt, Artificial Sequence
  Synthetic Oligonucleotide; BTLA exon 2; Set B
aacagcgguaugacccauugu

SEQ ID NO: 50800 - RNA, 19 nt, Artificial Sequence
  Synthetic Oligonucleotide; BTLA exon 2; Set C
acagcgguaugacccauug

SEQ ID NO: 50801 - RNA, 16 nt, Artificial Sequence
  Synthetic Oligonucleotide; BTLA exon 2; Set C
cagcgguaugacccau

SEQ ID NO: 50802 - RNA, 20 nt, Artificial Sequence
  Synthetic Oligonucleotide; BTLA exon 2; Set C
aacagcgguaugacccauug

SEQ ID NO: 50803 - RNA, 15 nt, Artificial Sequence
  Synthetic Oligonucleotide; BTLA exon 2; Set C
cagcgguaugaccca

SEQ ID NO: 50804 - RNA, 15 nt, Artificial Sequence
  Synthetic Oligonucleotide; BTLA exon 2; Set C
agaacagcgguauga

SEQ ID NO: 50805 - RNA, 38 nt, Artificial Sequence
  Synthetic Oligonucleotide; BTLA exon 2; Set C
cugaaaauuugcagaacagcgguaugacccauugucau

SEQ ID NO: 50806 - RNA, 36 nt, Artificial Sequence
  Synthetic Oligonucleotide; BTLA exon 2; Set C
ugaaaauuugcagaacagcgguaugacccauuguca

SEQ ID NO: 50807 - RNA, 34 nt, Artificial Sequence
  Synthetic Oligonucleotide; BTLA exon 2; Set C
gaaaauuugcagaacagcgguaugacccauuguc

SEQ ID NO: 50808 - RNA, 16 nt, Artificial Sequence
  Synthetic Oligonucleotide; BTLA exon 2; Set C
cagaacagcgguauga

SEQ ID NO: 50809 - RNA, 39 nt, Artificial Sequence
  Synthetic Oligonucleotide; BTLA exon 2; Set C
acugaaaauuugcagaacagcgguaugacccauugucau

SEQ ID NO: 50810 - RNA, 37 nt, Artificial Sequence
  Synthetic Oligonucleotide; BTLA exon 2; Set C
cugaaaauuugcagaacagcgguaugacccauuguca

SEQ ID NO: 50811 - RNA, 33 nt, Artificial Sequence
  Synthetic Oligonucleotide; BTLA exon 2; Set B
gaaaauuugcagaacagcgguaugacccauugu

SEQ ID NO: 50812 - RNA, 35 nt, Artificial Sequence
  Synthetic Oligonucleotide; BTLA exon 2; Set C
ugaaaauuugcagaacagcgguaugacccauuguc

SEQ ID NO: 50813 - RNA, 17 nt, Artificial Sequence
  Synthetic Oligonucleotide; BTLA exon 2; Set C
gcagaacagcgguauga

SEQ ID NO: 50814 - RNA, 40 nt, Artificial Sequence
  Synthetic Oligonucleotide; BTLA exon 2; Set C
gacugaaaauuugcagaacagcgguaugacccauugucau

SEQ ID NO: 50815 - RNA, 38 nt, Artificial Sequence
  Synthetic Oligonucleotide; BTLA exon 2; Set C
acugaaaauuugcagaacagcgguaugacccauuguca

SEQ ID NO: 50816 - RNA, 34 nt, Artificial Sequence
  Synthetic Oligonucleotide; BTLA exon 2; Set C
ugaaaauuugcagaacagcgguaugacccauugu

SEQ ID NO: 50817 - RNA, 32 nt, Artificial Sequence
  Synthetic Oligonucleotide; BTLA exon 2; Set B
gaaaauuugcagaacagcgguaugacccauug

SEQ ID NO: 50818 - RNA, 36 nt, Artificial Sequence
  Synthetic Oligonucleotide; BTLA exon 2; Set C
cugaaaauuugcagaacagcgguaugacccauuguc

SEQ ID NO: 50819 - RNA, 18 nt, Artificial Sequence
  Synthetic Oligonucleotide; BTLA exon 2; Set C
ugcagaacagcgguauga

SEQ ID NO: 50820 - RNA, 39 nt, Artificial Sequence
  Synthetic Oligonucleotide; BTLA exon 2; Set C
gacugaaaauuugcagaacagcgguaugacccauuguca

SEQ ID NO: 50821 - RNA, 35 nt, Artificial Sequence
  Synthetic Oligonucleotide; BTLA exon 2; Set C
cugaaaauuugcagaacagcgguaugacccauugu

SEQ ID NO: 50822 - RNA, 33 nt, Artificial Sequence
  Synthetic Oligonucleotide; BTLA exon 2; Set B
ugaaaauuugcagaacagcgguaugacccauug

SEQ ID NO: 50823 - RNA, 19 nt, Artificial Sequence
  Synthetic Oligonucleotide; BTLA exon 2; Set C
uugcagaacagcgguauga

SEQ ID NO: 50824 - RNA, 40 nt, Artificial Sequence
  Synthetic Oligonucleotide; BTLA exon 2; Set C
agacugaaaauuugcagaacagcgguaugacccauuguca

SEQ ID NO: 50825 - RNA, 36 nt, Artificial Sequence
  Synthetic Oligonucleotide; BTLA exon 2; Set C
acugaaaauuugcagaacagcgguaugacccauugu

SEQ ID NO: 50826 - RNA, 34 nt, Artificial Sequence
  Synthetic Oligonucleotide; BTLA exon 2; Set B
cugaaaauuugcagaacagcgguaugacccauug

SEQ ID NO: 50827 - RNA, 20 nt, Artificial Sequence
  Synthetic Oligonucleotide; BTLA exon 2; Set C
uuugcagaacagcgguauga

SEQ ID NO: 50828 - RNA, 37 nt, Artificial Sequence
  Synthetic Oligonucleotide; BTLA exon 2; Set C
gacugaaaauuugcagaacagcgguaugacccauugu

SEQ ID NO: 50829 - RNA, 35 nt, Artificial Sequence
  Synthetic Oligonucleotide; BTLA exon 2; Set C
acugaaaauuugcagaacagcgguaugacccauug

SEQ ID NO: 50830 - RNA, 39 nt, Artificial Sequence
  Synthetic Oligonucleotide; BTLA exon 2; Set C
agacugaaaauuugcagaacagcgguaugacccauuguc

SEQ ID NO: 50831 - RNA, 21 nt, Artificial Sequence
  Synthetic Oligonucleotide; BTLA exon 2; Set C
auuugcagaacagcgguauga

SEQ ID NO: 50832 - RNA, 38 nt, Artificial Sequence
  Synthetic Oligonucleotide; BTLA exon 2; Set C
agacugaaaauuugcagaacagcgguaugacccauugu

SEQ ID NO: 50833 - RNA, 36 nt, Artificial Sequence
  Synthetic Oligonucleotide; BTLA exon 2; Set C
gacugaaaauuugcagaacagcgguaugacccauug

SEQ ID NO: 50834 - RNA, 22 nt, Artificial Sequence
  Synthetic Oligonucleotide; BTLA exon 2; Set C
aauuugcagaacagcgguauga

SEQ ID NO: 50835 - RNA, 37 nt, Artificial Sequence
  Synthetic Oligonucleotide; BTLA exon 2; Set C
agacugaaaauuugcagaacagcgguaugacccauug

SEQ ID NO: 50836 - RNA, 23 nt, Artificial Sequence
  Synthetic Oligonucleotide; BTLA exon 2; Set C
aaauuugcagaacagcgguauga

SEQ ID NO: 50837 - RNA, 24 nt, Artificial Sequence
  Synthetic Oligonucleotide; BTLA exon 2; Set C
aaaauuugcagaacagcgguauga

SEQ ID NO: 50838 - RNA, 24 nt, Artificial Sequence
  Synthetic Oligonucleotide; BTLA exon 2; Set C
gaaaauuugcagaacagcgguaug

SEQ ID NO: 50839 - RNA, 25 nt, Artificial Sequence
  Synthetic Oligonucleotide; BTLA exon 2; Set C
ugaaaauuugcagaacagcgguaug

SEQ ID NO: 50840 - RNA, 26 nt, Artificial Sequence
  Synthetic Oligonucleotide; BTLA exon 2; Set C
cugaaaauuugcagaacagcgguaug

SEQ ID NO: 50841 - RNA, 29 nt, Artificial Sequence
  Synthetic Oligonucleotide; BTLA exon 2; Set B
agacugaaaauuugcagaacagcgguaug

SEQ ID NO: 50842 - RNA, 31 nt, Artificial Sequence
  Synthetic Oligonucleotide; BTLA exon 2; Set B
uagacugaaaauuugcagaacagcgguauga

SEQ ID NO: 50843 - RNA, 32 nt, Artificial Sequence
  Synthetic Oligonucleotide; BTLA exon 2; Set B
uuagacugaaaauuugcagaacagcgguauga

SEQ ID NO: 50844 - RNA, 23 nt, Artificial Sequence
  Synthetic Oligonucleotide; BTLA exon 2; Set C
acugaaaauuugcagaacagcgg

SEQ ID NO: 50845 - RNA, 21 nt, Artificial Sequence
  Synthetic Oligonucleotide; BTLA exon 2; Set C
cugaaaauuugcagaacagcg

SEQ ID NO: 50846 - RNA, 19 nt, Artificial Sequence
  Synthetic Oligonucleotide; BTLA exon 2; Set C
ugaaaauuugcagaacagc

SEQ ID NO: 50847 - RNA, 33 nt, Artificial Sequence
  Synthetic Oligonucleotide; BTLA exon 2; Set B
auuagacugaaaauuugcagaacagcgguauga

SEQ ID NO: 50848 - RNA, 24 nt, Artificial Sequence
  Synthetic Oligonucleotide; BTLA exon 2; Set C
gacugaaaauuugcagaacagcgg

SEQ ID NO: 50849 - RNA, 22 nt, Artificial Sequence
  Synthetic Oligonucleotide; BTLA exon 2; Set C
acugaaaauuugcagaacagcg

SEQ ID NO: 50850 - RNA, 20 nt, Artificial Sequence
  Synthetic Oligonucleotide; BTLA exon 2; Set C
cugaaaauuugcagaacagc

SEQ ID NO: 50851 - RNA, 18 nt, Artificial Sequence
  Synthetic Oligonucleotide; BTLA exon 2; Set C
ugaaaauuugcagaacag

SEQ ID NO: 50852 - RNA, 34 nt, Artificial Sequence
  Synthetic Oligonucleotide; BTLA exon 2; Set B
gauuagacugaaaauuugcagaacagcgguauga

SEQ ID NO: 50853 - RNA, 23 nt, Artificial Sequence
  Synthetic Oligonucleotide; BTLA exon 2; Set C
gacugaaaauuugcagaacagcg

SEQ ID NO: 50854 - RNA, 21 nt, Artificial Sequence
  Synthetic Oligonucleotide; BTLA exon 2; Set C
acugaaaauuugcagaacagc

SEQ ID NO: 50855 - RNA, 19 nt, Artificial Sequence
  Synthetic Oligonucleotide; BTLA exon 2; Set C
cugaaaauuugcagaacag

SEQ ID NO: 50856 - RNA, 35 nt, Artificial Sequence
  Synthetic Oligonucleotide; BTLA exon 2; Set B
agauuagacugaaaauuugcagaacagcgguauga

SEQ ID NO: 50857 - RNA, 24 nt, Artificial Sequence
  Synthetic Oligonucleotide; BTLA exon 2; Set C
agacugaaaauuugcagaacagcg

SEQ ID NO: 50858 - RNA, 22 nt, Artificial Sequence
  Synthetic Oligonucleotide; BTLA exon 2; Set C
gacugaaaauuugcagaacagc

SEQ ID NO: 50859 - RNA, 20 nt, Artificial Sequence
  Synthetic Oligonucleotide; BTLA exon 2; Set C
acugaaaauuugcagaacag

SEQ ID NO: 50860 - RNA, 36 nt, Artificial Sequence
  Synthetic Oligonucleotide; BTLA exon 2; Set B
gagauuagacugaaaauuugcagaacagcgguauga

SEQ ID NO: 50861 - RNA, 23 nt, Artificial Sequence
  Synthetic Oligonucleotide; BTLA exon 2; Set C
agacugaaaauuugcagaacagc

SEQ ID NO: 50862 - RNA, 21 nt, Artificial Sequence
  Synthetic Oligonucleotide; BTLA exon 2; Set C
gacugaaaauuugcagaacag

SEQ ID NO: 50863 - RNA, 22 nt, Artificial Sequence
  Synthetic Oligonucleotide; BTLA exon 2; Set C
agacugaaaauuugcagaacag

SEQ ID NO: 50864 - RNA, 36 nt, Artificial Sequence
  Synthetic Oligonucleotide; BTLA exon 2; Set B
ugagauuagacugaaaauuugcagaacagcgguaug

SEQ ID NO: 50865 - RNA, 36 nt, Artificial Sequence
  Synthetic Oligonucleotide; BTLA exon 2; Set B
augagauuagacugaaaauuugcagaacagcgguau

SEQ ID NO: 50866 - RNA, 35 nt, Artificial Sequence
  Synthetic Oligonucleotide; BTLA exon 2; Set B
augagauuagacugaaaauuugcagaacagcggua

SEQ ID NO: 50867 - RNA, 34 nt, Artificial Sequence
  Synthetic Oligonucleotide; BTLA exon 2; Set B
augagauuagacugaaaauuugcagaacagcggu

SEQ ID NO: 50868 - RNA, 38 nt, Artificial Sequence
  Synthetic Oligonucleotide; BTLA exon 2; Set B
uucaaugagauuagacugaaaauuugcagaacagcggu

SEQ ID NO: 50869 - RNA, 27 nt, Artificial Sequence
  Synthetic Oligonucleotide; BTLA exon 2; Set C
augagauuagacugaaaauuugcagaa

SEQ ID NO: 50870 - RNA, 26 nt, Artificial Sequence
  Synthetic Oligonucleotide; BTLA exon 2; Set C
augagauuagacugaaaauuugcaga

SEQ ID NO: 50871 - RNA, 25 nt, Artificial Sequence
  Synthetic Oligonucleotide; BTLA exon 2; Set C
augagauuagacugaaaauuugcag

SEQ ID NO: 50872 - RNA, 24 nt, Artificial Sequence
  Synthetic Oligonucleotide; BTLA exon 2; Set C
augagauuagacugaaaauuugca

SEQ ID NO: 50873 - RNA, 32 nt, Artificial Sequence
  Synthetic Oligonucleotide; BTLA exon 2; Set C
uucaaugagauuagacugaaaauuugcagaac

SEQ ID NO: 50874 - RNA, 34 nt, Artificial Sequence
  Synthetic Oligonucleotide; BTLA exon 2; Set C
uuucaaugagauuagacugaaaauuugcagaaca

SEQ ID NO: 50875 - RNA, 23 nt, Artificial Sequence
  Synthetic Oligonucleotide; BTLA exon 2; Set C
augagauuagacugaaaauuugc

SEQ ID NO: 50876 - RNA, 33 nt, Artificial Sequence
  Synthetic Oligonucleotide; BTLA exon 2; Set C
uuucaaugagauuagacugaaaauuugcagaac

SEQ ID NO: 50877 - RNA, 35 nt, Artificial Sequence
  Synthetic Oligonucleotide; BTLA exon 2; Set B
cuuucaaugagauuagacugaaaauuugcagaaca

SEQ ID NO: 50878 - RNA, 30 nt, Artificial Sequence
  Synthetic Oligonucleotide; BTLA exon 2; Set C
uucaaugagauuagacugaaaauuugcaga

SEQ ID NO: 50879 - RNA, 22 nt, Artificial Sequence
  Synthetic Oligonucleotide; BTLA exon 2; Set C
augagauuagacugaaaauuug

SEQ ID NO: 50880 - RNA, 34 nt, Artificial Sequence
  Synthetic Oligonucleotide; BTLA exon 2; Set C
cuuucaaugagauuagacugaaaauuugcagaac

SEQ ID NO: 50881 - RNA, 21 nt, Artificial Sequence
  Synthetic Oligonucleotide; BTLA exon 2; Set C
augagauuagacugaaaauuu

SEQ ID NO: 50882 - RNA, 29 nt, Artificial Sequence
  Synthetic Oligonucleotide; BTLA exon 2; Set C
uucaaugagauuagacugaaaauuugcag

SEQ ID NO: 50883 - RNA, 20 nt, Artificial Sequence
  Synthetic Oligonucleotide; BTLA exon 2; Set C
augagauuagacugaaaauu

SEQ ID NO: 50884 - RNA, 28 nt, Artificial Sequence
  Synthetic Oligonucleotide; BTLA exon 2; Set C
uucaaugagauuagacugaaaauuugca

SEQ ID NO: 50885 - RNA, 38 nt, Artificial Sequence
  Synthetic Oligonucleotide; BTLA exon 2; Set B
uggcuuucaaugagauuagacugaaaauuugcagaaca

SEQ ID NO: 50886 - RNA, 19 nt, Artificial Sequence
  Synthetic Oligonucleotide; BTLA exon 2; Set C
augagauuagacugaaaau

SEQ ID NO: 50887 - RNA, 27 nt, Artificial Sequence
  Synthetic Oligonucleotide; BTLA exon 2; Set C
uucaaugagauuagacugaaaauuugc

SEQ ID NO: 50888 - RNA, 37 nt, Artificial Sequence
  Synthetic Oligonucleotide; BTLA exon 2; Set B
uggcuuucaaugagauuagacugaaaauuugcagaac

SEQ ID NO: 50889 - RNA, 39 nt, Artificial Sequence
  Synthetic Oligonucleotide; BTLA exon 2; Set B
guggcuuucaaugagauuagacugaaaauuugcagaaca

SEQ ID NO: 50890 - RNA, 18 nt, Artificial Sequence
  Synthetic Oligonucleotide; BTLA exon 2; Set C
augagauuagacugaaaa

SEQ ID NO: 50891 - RNA, 26 nt, Artificial Sequence
  Synthetic Oligonucleotide; BTLA exon 2; Set C
uucaaugagauuagacugaaaauuug

SEQ ID NO: 50892 - RNA, 38 nt, Artificial Sequence
  Synthetic Oligonucleotide; BTLA exon 2; Set B
guggcuuucaaugagauuagacugaaaauuugcagaac

SEQ ID NO: 50893 - RNA, 25 nt, Artificial Sequence
  Synthetic Oligonucleotide; BTLA exon 2; Set C
uucaaugagauuagacugaaaauuu

SEQ ID NO: 50894 - RNA, 17 nt, Artificial Sequence
  Synthetic Oligonucleotide; BTLA exon 2; Set C
augagauuagacugaaa

SEQ ID NO: 50895 - RNA, 24 nt, Artificial Sequence
  Synthetic Oligonucleotide; BTLA exon 2; Set C
uucaaugagauuagacugaaaauu

SEQ ID NO: 50896 - RNA, 23 nt, Artificial Sequence
  Synthetic Oligonucleotide; BTLA exon 2; Set C
uucaaugagauuagacugaaaau

SEQ ID NO: 50897 - RNA, 22 nt, Artificial Sequence
  Synthetic Oligonucleotide; BTLA exon 2; Set C
uucaaugagauuagacugaaaa

SEQ ID NO: 50898 - RNA, 21 nt, Artificial Sequence
  Synthetic Oligonucleotide; BTLA exon 2; Set C
uucaaugagauuagacugaaa

SEQ ID NO: 50899 - RNA, 21 nt, Artificial Sequence
  Synthetic Oligonucleotide; BTLA exon 2; Set C
uuucaaugagauuagacugaa

SEQ ID NO: 50900 - RNA, 22 nt, Artificial Sequence
  Synthetic Oligonucleotide; BTLA exon 2; Set C
cuuucaaugagauuagacugaa

SEQ ID NO: 50901 - RNA, 27 nt, Artificial Sequence
  Synthetic Oligonucleotide; BTLA exon 2; Set C
uggcuuucaaugagauuagacugaaaa

SEQ ID NO: 50902 - RNA, 26 nt, Artificial Sequence
  Synthetic Oligonucleotide; BTLA exon 2; Set C
uggcuuucaaugagauuagacugaaa

SEQ ID NO: 50903 - RNA, 26 nt, Artificial Sequence
  Synthetic Oligonucleotide; BTLA exon 2; Set C
guggcuuucaaugagauuagacugaa

SEQ ID NO: 50904 - RNA, 27 nt, Artificial Sequence
  Synthetic Oligonucleotide; BTLA exon 2; Set B
aguggcuuucaaugagauuagacugaa

SEQ ID NO: 50905 - RNA, 25 nt, Artificial Sequence
  Synthetic Oligonucleotide; BTLA exon 2; Set B
guggcuuucaaugagauuagacuga

SEQ ID NO: 50906 - RNA, 28 nt, Artificial Sequence
  Synthetic Oligonucleotide; BTLA exon 2; Set B
gaguggcuuucaaugagauuagacugaa

SEQ ID NO: 50907 - RNA, 26 nt, Artificial Sequence
  Synthetic Oligonucleotide; BTLA exon 2; Set B
aguggcuuucaaugagauuagacuga

SEQ ID NO: 50908 - RNA, 29 nt, Artificial Sequence
  Synthetic Oligonucleotide; BTLA exon 2; Set B
ugaguggcuuucaaugagauuagacugaa

SEQ ID NO: 50909 - RNA, 27 nt, Artificial Sequence
  Synthetic Oligonucleotide; BTLA exon 2; Set B
gaguggcuuucaaugagauuagacuga

SEQ ID NO: 50910 - RNA, 25 nt, Artificial Sequence
  Synthetic Oligonucleotide; BTLA exon 2; Set C
aguggcuuucaaugagauuagacug

SEQ ID NO: 50911 - RNA, 28 nt, Artificial Sequence
  Synthetic Oligonucleotide; BTLA exon 2; Set B
ugaguggcuuucaaugagauuagacuga

SEQ ID NO: 50912 - RNA, 26 nt, Artificial Sequence
  Synthetic Oligonucleotide; BTLA exon 2; Set B
gaguggcuuucaaugagauuagacug

SEQ ID NO: 50913 - RNA, 19 nt, Artificial Sequence
  Synthetic Oligonucleotide; BTLA exon 2; Set C
uggcuuucaaugagauuag

SEQ ID NO: 50914 - RNA, 27 nt, Artificial Sequence
  Synthetic Oligonucleotide; BTLA exon 2; Set B
ugaguggcuuucaaugagauuagacug

SEQ ID NO: 50915 - RNA, 18 nt, Artificial Sequence
  Synthetic Oligonucleotide; BTLA exon 2; Set C
uggcuuucaaugagauua

SEQ ID NO: 50916 - RNA, 22 nt, Artificial Sequence
  Synthetic Oligonucleotide; BTLA exon 2; Set C
aguggcuuucaaugagauuaga

SEQ ID NO: 50917 - RNA, 26 nt, Artificial Sequence
  Synthetic Oligonucleotide; BTLA exon 2; Set B
ugaguggcuuucaaugagauuagacu

SEQ ID NO: 50918 - RNA, 17 nt, Artificial Sequence
  Synthetic Oligonucleotide; BTLA exon 2; Set C
uggcuuucaaugagauu

SEQ ID NO: 50919 - RNA, 23 nt, Artificial Sequence
  Synthetic Oligonucleotide; BTLA exon 2; Set C
gaguggcuuucaaugagauuaga

SEQ ID NO: 50920 - RNA, 27 nt, Artificial Sequence
  Synthetic Oligonucleotide; BTLA exon 2; Set B
uugaguggcuuucaaugagauuagacu

SEQ ID NO: 50921 - RNA, 16 nt, Artificial Sequence
  Synthetic Oligonucleotide; BTLA exon 2; Set C
uggcuuucaaugagau

SEQ ID NO: 50922 - RNA, 24 nt, Artificial Sequence
  Synthetic Oligonucleotide; BTLA exon 2; Set C
ugaguggcuuucaaugagauuaga

SEQ ID NO: 50923 - RNA, 26 nt, Artificial Sequence
  Synthetic Oligonucleotide; BTLA exon 2; Set C
uugaguggcuuucaaugagauuagac

SEQ ID NO: 50924 - RNA, 17 nt, Artificial Sequence
  Synthetic Oligonucleotide; BTLA exon 2; Set C
guggcuuucaaugagau

SEQ ID NO: 50925 - RNA, 16 nt, Artificial Sequence
  Synthetic Oligonucleotide; BTLA exon 2; Set C
guggcuuucaaugaga

SEQ ID NO: 50926 - RNA, 15 nt, Artificial Sequence
  Synthetic Oligonucleotide; BTLA exon 2; Set C
guggcuuucaaugag

SEQ ID NO: 50927 - RNA, 17 nt, Artificial Sequence
  Synthetic Oligonucleotide; BTLA exon 2; Set C
aguggcuuucaaugaga

SEQ ID NO: 50928 - RNA, 16 nt, Artificial Sequence
  Synthetic Oligonucleotide; BTLA exon 2; Set C
aguggcuuucaaugag

SEQ ID NO: 50929 - RNA, 18 nt, Artificial Sequence
  Synthetic Oligonucleotide; BTLA exon 2; Set C
gaguggcuuucaaugaga

SEQ ID NO: 50930 - RNA, 17 nt, Artificial Sequence
  Synthetic Oligonucleotide; BTLA exon 2; Set C
gaguggcuuucaaugag

SEQ ID NO: 50931 - RNA, 15 nt, Artificial Sequence
  Synthetic Oligonucleotide; BTLA exon 2; Set C
aguggcuuucaauga

SEQ ID NO: 50932 - RNA, 16 nt, Artificial Sequence
  Synthetic Oligonucleotide; BTLA exon 2; Set C
gaguggcuuucaauga

SEQ ID NO: 50933 - RNA, 17 nt, Artificial Sequence
  Synthetic Oligonucleotide; BTLA exon 2; Set C
ugaguggcuuucaauga

SEQ ID NO: 50934 - RNA, 40 nt, Artificial Sequence
  Synthetic Oligonucleotide; BTLA exon 2; Set B
cauaaagaguuguugaguggcuuucaaugagauuagacug

SEQ ID NO: 50935 - RNA, 39 nt, Artificial Sequence
  Synthetic Oligonucleotide; BTLA exon 2; Set B
cauaaagaguuguugaguggcuuucaaugagauuagacu

SEQ ID NO: 50936 - RNA, 40 nt, Artificial Sequence
  Synthetic Oligonucleotide; BTLA exon 2; Set B
acauaaagaguuguugaguggcuuucaaugagauuagacu

SEQ ID NO: 50937 - RNA, 38 nt, Artificial Sequence
  Synthetic Oligonucleotide; BTLA exon 2; Set B
cauaaagaguuguugaguggcuuucaaugagauuagac

SEQ ID NO: 50938 - RNA, 37 nt, Artificial Sequence
  Synthetic Oligonucleotide; BTLA exon 2; Set B
cauaaagaguuguugaguggcuuucaaugagauuaga

SEQ ID NO: 50939 - RNA, 39 nt, Artificial Sequence
  Synthetic Oligonucleotide; BTLA exon 2; Set B
acauaaagaguuguugaguggcuuucaaugagauuagac

SEQ ID NO: 50940 - RNA, 38 nt, Artificial Sequence
  Synthetic Oligonucleotide; BTLA exon 2; Set B
acauaaagaguuguugaguggcuuucaaugagauuaga

SEQ ID NO: 50941 - RNA, 40 nt, Artificial Sequence
  Synthetic Oligonucleotide; BTLA exon 2; Set B
cacauaaagaguuguugaguggcuuucaaugagauuagac

SEQ ID NO: 50942 - RNA, 39 nt, Artificial Sequence
  Synthetic Oligonucleotide; BTLA exon 2; Set B
cacauaaagaguuguugaguggcuuucaaugagauuaga

SEQ ID NO: 50943 - RNA, 15 nt, Artificial Sequence
  Synthetic Oligonucleotide; BTLA exon 2; Set C
uguugaguggcuuuc

SEQ ID NO: 50944 - RNA, 40 nt, Artificial Sequence
  Synthetic Oligonucleotide; BTLA exon 2; Set B
ucacauaaagaguuguugaguggcuuucaaugagauuaga

SEQ ID NO: 50945 - RNA, 16 nt, Artificial Sequence
  Synthetic Oligonucleotide; BTLA exon 2; Set C
uuguugaguggcuuuc

SEQ ID NO: 50946 - RNA, 17 nt, Artificial Sequence
  Synthetic Oligonucleotide; BTLA exon 2; Set C
guuguugaguggcuuuc

SEQ ID NO: 50947 - RNA, 18 nt, Artificial Sequence
  Synthetic Oligonucleotide; BTLA exon 2; Set C
aguuguugaguggcuuuc

SEQ ID NO: 50948 - RNA, 26 nt, Artificial Sequence
  Synthetic Oligonucleotide; BTLA exon 2; Set C
aaagaguuguugaguggcuuucaaug

SEQ ID NO: 50949 - RNA, 19 nt, Artificial Sequence
  Synthetic Oligonucleotide; BTLA exon 2; Set C
gaguuguugaguggcuuuc

SEQ ID NO: 50950 - RNA, 27 nt, Artificial Sequence
  Synthetic Oligonucleotide; BTLA exon 2; Set C
uaaagaguuguugaguggcuuucaaug

SEQ ID NO: 50951 - RNA, 30 nt, Artificial Sequence
  Synthetic Oligonucleotide; BTLA exon 2; Set B
cauaaagaguuguugaguggcuuucaauga

SEQ ID NO: 50952 - RNA, 20 nt, Artificial Sequence
  Synthetic Oligonucleotide; BTLA exon 2; Set C
agaguuguugaguggcuuuc

SEQ ID NO: 50953 - RNA, 31 nt, Artificial Sequence
  Synthetic Oligonucleotide; BTLA exon 2; Set B
acauaaagaguuguugaguggcuuucaauga

SEQ ID NO: 50954 - RNA, 21 nt, Artificial Sequence
  Synthetic Oligonucleotide; BTLA exon 2; Set C
aagaguuguugaguggcuuuc

SEQ ID NO: 50955 - RNA, 32 nt, Artificial Sequence
  Synthetic Oligonucleotide; BTLA exon 2; Set B
cacauaaagaguuguugaguggcuuucaauga

SEQ ID NO: 50956 - RNA, 22 nt, Artificial Sequence
  Synthetic Oligonucleotide; BTLA exon 2; Set C
aaagaguuguugaguggcuuuc

SEQ ID NO: 50957 - RNA, 39 nt, Artificial Sequence
  Synthetic Oligonucleotide; BTLA exon 2; Set B
cugucacauaaagaguuguugaguggcuuucaaugagau

SEQ ID NO: 50958 - RNA, 23 nt, Artificial Sequence
  Synthetic Oligonucleotide; BTLA exon 2; Set C
uaaagaguuguugaguggcuuuc

SEQ ID NO: 50959 - RNA, 38 nt, Artificial Sequence
  Synthetic Oligonucleotide; BTLA exon 2; Set B
cugucacauaaagaguuguugaguggcuuucaaugaga

SEQ ID NO: 50960 - RNA, 37 nt, Artificial Sequence
  Synthetic Oligonucleotide; BTLA exon 2; Set B
cugucacauaaagaguuguugaguggcuuucaaugag

SEQ ID NO: 50961 - RNA, 23 nt, Artificial Sequence
  Synthetic Oligonucleotide; BTLA exon 2; Set C
auaaagaguuguugaguggcuuu

SEQ ID NO: 50962 - RNA, 22 nt, Artificial Sequence
  Synthetic Oligonucleotide; BTLA exon 2; Set C
auaaagaguuguugaguggcuu

SEQ ID NO: 50963 - RNA, 34 nt, Artificial Sequence
  Synthetic Oligonucleotide; BTLA exon 2; Set B
ugucacauaaagaguuguugaguggcuuucaaug

SEQ ID NO: 50964 - RNA, 27 nt, Artificial Sequence
  Synthetic Oligonucleotide; BTLA exon 2; Set B
ucacauaaagaguuguugaguggcuuu

SEQ ID NO: 50965 - RNA, 19 nt, Artificial Sequence
  Synthetic Oligonucleotide; BTLA exon 2; Set C
auaaagaguuguugagugg

SEQ ID NO: 50966 - RNA, 29 nt, Artificial Sequence
  Synthetic Oligonucleotide; BTLA exon 2; Set B
gucacauaaagaguuguugaguggcuuuc

SEQ ID NO: 50967 - RNA, 26 nt, Artificial Sequence
  Synthetic Oligonucleotide; BTLA exon 2; Set B
ucacauaaagaguuguugaguggcuu

SEQ ID NO: 50968 - RNA, 30 nt, Artificial Sequence
  Synthetic Oligonucleotide; BTLA exon 2; Set B
ugucacauaaagaguuguugaguggcuuuc

SEQ ID NO: 50969 - RNA, 19 nt, Artificial Sequence
  Synthetic Oligonucleotide; BTLA exon 2; Set C
cauaaagaguuguugagug

SEQ ID NO: 50970 - RNA, 18 nt, Artificial Sequence
  Synthetic Oligonucleotide; BTLA exon 2; Set C
cauaaagaguuguugagu

SEQ ID NO: 50971 - RNA, 20 nt, Artificial Sequence
  Synthetic Oligonucleotide; BTLA exon 2; Set C
acauaaagaguuguugagug

SEQ ID NO: 50972 - RNA, 19 nt, Artificial Sequence
  Synthetic Oligonucleotide; BTLA exon 2; Set C
acauaaagaguuguugagu

SEQ ID NO: 50973 - RNA, 17 nt, Artificial Sequence
  Synthetic Oligonucleotide; BTLA exon 2; Set C
cauaaagaguuguugag

SEQ ID NO: 50974 - RNA, 21 nt, Artificial Sequence
  Synthetic Oligonucleotide; BTLA exon 2; Set C
cacauaaagaguuguugagug

SEQ ID NO: 50975 - RNA, 16 nt, Artificial Sequence
  Synthetic Oligonucleotide; BTLA exon 2; Set C
cauaaagaguuguuga

SEQ ID NO: 50976 - RNA, 20 nt, Artificial Sequence
  Synthetic Oligonucleotide; BTLA exon 2; Set C
cacauaaagaguuguugagu

SEQ ID NO: 50977 - RNA, 18 nt, Artificial Sequence
  Synthetic Oligonucleotide; BTLA exon 2; Set C
acauaaagaguuguugag

SEQ ID NO: 50978 - RNA, 22 nt, Artificial Sequence
  Synthetic Oligonucleotide; BTLA exon 2; Set C
ucacauaaagaguuguugagug

SEQ ID NO: 50979 - RNA, 17 nt, Artificial Sequence
  Synthetic Oligonucleotide; BTLA exon 2; Set C
acauaaagaguuguuga

SEQ ID NO: 50980 - RNA, 21 nt, Artificial Sequence
  Synthetic Oligonucleotide; BTLA exon 2; Set C
ucacauaaagaguuguugagu

SEQ ID NO: 50981 - RNA, 19 nt, Artificial Sequence
  Synthetic Oligonucleotide; BTLA exon 2; Set C
cacauaaagaguuguugag

SEQ ID NO: 50982 - RNA, 18 nt, Artificial Sequence
  Synthetic Oligonucleotide; BTLA exon 2; Set C
cacauaaagaguuguuga

SEQ ID NO: 50983 - RNA, 20 nt, Artificial Sequence
  Synthetic Oligonucleotide; BTLA exon 2; Set C
ucacauaaagaguuguugag

SEQ ID NO: 50984 - RNA, 36 nt, Artificial Sequence
  Synthetic Oligonucleotide; BTLA exon 2; Set C
acucaccugucacauaaagaguuguugaguggcuuu

SEQ ID NO: 50985 - RNA, 35 nt, Artificial Sequence
  Synthetic Oligonucleotide; BTLA exon 2; Set C
acucaccugucacauaaagaguuguugaguggcuu

SEQ ID NO: 50986 - RNA, 21 nt, Artificial Sequence
  Synthetic Oligonucleotide; BTLA exon 2; Set C
cugucacauaaagaguuguug

SEQ ID NO: 50987 - RNA, 32 nt, Artificial Sequence
  Synthetic Oligonucleotide; BTLA exon 2; Set B
acucaccugucacauaaagaguuguugagugg

SEQ ID NO: 50988 - RNA, 31 nt, Artificial Sequence
  Synthetic Oligonucleotide; BTLA exon 2; Set B
aacucaccugucacauaaagaguuguugagu

SEQ ID NO: 50989 - RNA, 24 nt, Artificial Sequence
  Synthetic Oligonucleotide; BTLA exon 2; Set C
ucaccugucacauaaagaguuguu

SEQ ID NO: 50990 - RNA, 30 nt, Artificial Sequence
  Synthetic Oligonucleotide; BTLA exon 2; Set B
aacucaccugucacauaaagaguuguugag

SEQ ID NO: 50991 - RNA, 25 nt, Artificial Sequence
  Synthetic Oligonucleotide; BTLA exon 2; Set C
cucaccugucacauaaagaguuguu

SEQ ID NO: 50992 - RNA, 23 nt, Artificial Sequence
  Synthetic Oligonucleotide; BTLA exon 2; Set C
ucaccugucacauaaagaguugu

SEQ ID NO: 50993 - RNA, 29 nt, Artificial Sequence
  Synthetic Oligonucleotide; BTLA exon 2; Set B
aacucaccugucacauaaagaguuguuga

SEQ ID NO: 50994 - RNA, 24 nt, Artificial Sequence
  Synthetic Oligonucleotide; BTLA exon 2; Set C
cucaccugucacauaaagaguugu

SEQ ID NO: 50995 - RNA, 22 nt, Artificial Sequence
  Synthetic Oligonucleotide; BTLA exon 2; Set C
ucaccugucacauaaagaguug

SEQ ID NO: 50996 - RNA, 21 nt, Artificial Sequence
  Synthetic Oligonucleotide; BTLA exon 2; Set C
ucaccugucacauaaagaguu

SEQ ID NO: 50997 - RNA, 23 nt, Artificial Sequence
  Synthetic Oligonucleotide; BTLA exon 2; Set C
cucaccugucacauaaagaguug

SEQ ID NO: 50998 - RNA, 29 nt, Artificial Sequence
  Synthetic Oligonucleotide; BTLA exon 2; Set B
gaacucaccugucacauaaagaguuguug

SEQ ID NO: 50999 - RNA, 37 nt, Artificial Sequence
  Synthetic Oligonucleotide; BTLA exon 2; Set B
uugagaacucaccugucacauaaagaguuguugagug

SEQ ID NO: 51000 - RNA, 39 nt, Artificial Sequence
  Synthetic Oligonucleotide; BTLA exon 2; Set C
guugagaacucaccugucacauaaagaguuguugagugg

SEQ ID NO: 51001 - RNA, 20 nt, Artificial Sequence
  Synthetic Oligonucleotide; BTLA exon 2; Set C
ucaccugucacauaaagagu

SEQ ID NO: 51002 - RNA, 22 nt, Artificial Sequence
  Synthetic Oligonucleotide; BTLA exon 2; Set C
cucaccugucacauaaagaguu

SEQ ID NO: 51003 - RNA, 36 nt, Artificial Sequence
  Synthetic Oligonucleotide; BTLA exon 2; Set B
uugagaacucaccugucacauaaagaguuguugagu

SEQ ID NO: 51004 - RNA, 38 nt, Artificial Sequence
  Synthetic Oligonucleotide; BTLA exon 2; Set C
guugagaacucaccugucacauaaagaguuguugagug

SEQ ID NO: 51005 - RNA, 40 nt, Artificial Sequence
  Synthetic Oligonucleotide; BTLA exon 2; Set C
uguugagaacucaccugucacauaaagaguuguugagugg

SEQ ID NO: 51006 - RNA, 21 nt, Artificial Sequence
  Synthetic Oligonucleotide; BTLA exon 2; Set C
cucaccugucacauaaagagu

SEQ ID NO: 51007 - RNA, 29 nt, Artificial Sequence
  Synthetic Oligonucleotide; BTLA exon 2; Set B
agaacucaccugucacauaaagaguuguu

SEQ ID NO: 51008 - RNA, 19 nt, Artificial Sequence
  Synthetic Oligonucleotide; BTLA exon 2; Set C
ucaccugucacauaaagag

SEQ ID NO: 51009 - RNA, 31 nt, Artificial Sequence
  Synthetic Oligonucleotide; BTLA exon 2; Set B
gagaacucaccugucacauaaagaguuguug

SEQ ID NO: 51010 - RNA, 35 nt, Artificial Sequence
  Synthetic Oligonucleotide; BTLA exon 2; Set B
uugagaacucaccugucacauaaagaguuguugag

SEQ ID NO: 51011 - RNA, 39 nt, Artificial Sequence
  Synthetic Oligonucleotide; BTLA exon 2; Set C
uguugagaacucaccugucacauaaagaguuguugagug

SEQ ID NO: 51012 - RNA, 20 nt, Artificial Sequence
  Synthetic Oligonucleotide; BTLA exon 2; Set C
cucaccugucacauaaagag

SEQ ID NO: 51013 - RNA, 18 nt, Artificial Sequence
  Synthetic Oligonucleotide; BTLA exon 2; Set C
ucaccugucacauaaaga

SEQ ID NO: 51014 - RNA, 28 nt, Artificial Sequence
  Synthetic Oligonucleotide; BTLA exon 2; Set B
agaacucaccugucacauaaagaguugu

SEQ ID NO: 51015 - RNA, 32 nt, Artificial Sequence
  Synthetic Oligonucleotide; BTLA exon 2; Set B
ugagaacucaccugucacauaaagaguuguug

SEQ ID NO: 51016 - RNA, 34 nt, Artificial Sequence
  Synthetic Oligonucleotide; BTLA exon 2; Set B
uugagaacucaccugucacauaaagaguuguuga

SEQ ID NO: 51017 - RNA, 40 nt, Artificial Sequence
  Synthetic Oligonucleotide; BTLA exon 2; Set C
guguugagaacucaccugucacauaaagaguuguugagug

SEQ ID NO: 51018 - RNA, 19 nt, Artificial Sequence
  Synthetic Oligonucleotide; BTLA exon 2; Set C
cucaccugucacauaaaga

SEQ ID NO: 51019 - RNA, 17 nt, Artificial Sequence
  Synthetic Oligonucleotide; BTLA exon 2; Set C
ucaccugucacauaaag

SEQ ID NO: 51020 - RNA, 27 nt, Artificial Sequence
  Synthetic Oligonucleotide; BTLA exon 2; Set C
agaacucaccugucacauaaagaguug

SEQ ID NO: 51021 - RNA, 18 nt, Artificial Sequence
  Synthetic Oligonucleotide; BTLA exon 2; Set C
cucaccugucacauaaag

SEQ ID NO: 51022 - RNA, 16 nt, Artificial Sequence
  Synthetic Oligonucleotide; BTLA exon 2; Set C
ucaccugucacauaaa

SEQ ID NO: 51023 - RNA, 26 nt, Artificial Sequence
  Synthetic Oligonucleotide; BTLA exon 2; Set C
agaacucaccugucacauaaagaguu

SEQ ID NO: 51024 - RNA, 40 nt, Artificial Sequence
  Synthetic Oligonucleotide; BTLA exon 2; Set C
gguguugagaacucaccugucacauaaagaguuguugagu

SEQ ID NO: 51025 - RNA, 25 nt, Artificial Sequence
  Synthetic Oligonucleotide; BTLA exon 2; Set C
agaacucaccugucacauaaagagu

SEQ ID NO: 51026 - RNA, 17 nt, Artificial Sequence
  Synthetic Oligonucleotide; BTLA exon 2; Set C
cucaccugucacauaaa

SEQ ID NO: 51027 - RNA, 39 nt, Artificial Sequence
  Synthetic Oligonucleotide; BTLA exon 2; Set C
gguguugagaacucaccugucacauaaagaguuguugag

SEQ ID NO: 51028 - RNA, 24 nt, Artificial Sequence
  Synthetic Oligonucleotide; BTLA exon 2; Set C
agaacucaccugucacauaaagag

SEQ ID NO: 51029 - RNA, 16 nt, Artificial Sequence
  Synthetic Oligonucleotide; BTLA exon 2; Set C
cucaccugucacauaa

SEQ ID NO: 51030 - RNA, 40 nt, Artificial Sequence
  Synthetic Oligonucleotide; BTLA exon 2; Set C
agguguugagaacucaccugucacauaaagaguuguugag

SEQ ID NO: 51031 - RNA, 23 nt, Artificial Sequence
  Synthetic Oligonucleotide; BTLA exon 2; Set C
agaacucaccugucacauaaaga

SEQ ID NO: 51032 - RNA, 39 nt, Artificial Sequence
  Synthetic Oligonucleotide; BTLA exon 2; Set C
agguguugagaacucaccugucacauaaagaguuguuga

SEQ ID NO: 51033 - RNA, 20 nt, Artificial Sequence
  Synthetic Oligonucleotide; BTLA exon 2; Set C
gaacucaccugucacauaaa

SEQ ID NO: 51034 - RNA, 22 nt, Artificial Sequence
  Synthetic Oligonucleotide; BTLA exon 2; Set C
agaacucaccugucacauaaag

SEQ ID NO: 51035 - RNA, 19 nt, Artificial Sequence
  Synthetic Oligonucleotide; BTLA exon 2; Set C
gaacucaccugucacauaa

SEQ ID NO: 51036 - RNA, 21 nt, Artificial Sequence
  Synthetic Oligonucleotide; BTLA exon 2; Set C
agaacucaccugucacauaaa

SEQ ID NO: 51037 - RNA, 17 nt, Artificial Sequence
  Synthetic Oligonucleotide; BTLA exon 2; Set C
aacucaccugucacaua

SEQ ID NO: 51038 - RNA, 20 nt, Artificial Sequence
  Synthetic Oligonucleotide; BTLA exon 2; Set C
agaacucaccugucacauaa

SEQ ID NO: 51039 - RNA, 20 nt, Artificial Sequence
  Synthetic Oligonucleotide; BTLA exon 2; Set C
gagaacucaccugucacaua

SEQ ID NO: 51040 - RNA, 21 nt, Artificial Sequence
  Synthetic Oligonucleotide; BTLA exon 2; Set C
ugagaacucaccugucacaua

SEQ ID NO: 51041 - RNA, 22 nt, Artificial Sequence
  Synthetic Oligonucleotide; BTLA exon 2; Set C
uugagaacucaccugucacaua

SEQ ID NO: 51042 - RNA, 22 nt, Artificial Sequence
  Synthetic Oligonucleotide; BTLA exon 2; Set B
guugagaacucaccugucacau

SEQ ID NO: 51043 - RNA, 15 nt, Artificial Sequence
  Synthetic Oligonucleotide; BTLA exon 2; Set C
gagaacucaccuguc

SEQ ID NO: 51044 - RNA, 23 nt, Artificial Sequence
  Synthetic Oligonucleotide; BTLA exon 2; Set B
uguugagaacucaccugucacau

SEQ ID NO: 51045 - RNA, 21 nt, Artificial Sequence
  Synthetic Oligonucleotide; BTLA exon 2; Set B
guugagaacucaccugucaca

SEQ ID NO: 51046 - RNA, 16 nt, Artificial Sequence
  Synthetic Oligonucleotide; BTLA exon 2; Set C
ugagaacucaccuguc

SEQ ID NO: 51047 - RNA, 18 nt, Artificial Sequence
  Synthetic Oligonucleotide; BTLA exon 2; Set C
uugagaacucaccuguca

SEQ ID NO: 51048 - RNA, 24 nt, Artificial Sequence
  Synthetic Oligonucleotide; BTLA exon 2; Set B
guguugagaacucaccugucacau

SEQ ID NO: 51049 - RNA, 20 nt, Artificial Sequence
  Synthetic Oligonucleotide; BTLA exon 2; Set C
guugagaacucaccugucac

SEQ ID NO: 51050 - RNA, 22 nt, Artificial Sequence
  Synthetic Oligonucleotide; BTLA exon 2; Set B
uguugagaacucaccugucaca

SEQ ID NO: 51051 - RNA, 15 nt, Artificial Sequence
  Synthetic Oligonucleotide; BTLA exon 2; Set C
ugagaacucaccugu

SEQ ID NO: 51052 - RNA, 19 nt, Artificial Sequence
  Synthetic Oligonucleotide; BTLA exon 2; Set C
guugagaacucaccuguca

SEQ ID NO: 51053 - RNA, 25 nt, Artificial Sequence
  Synthetic Oligonucleotide; BTLA exon 2; Set B
gguguugagaacucaccugucacau

SEQ ID NO: 51054 - RNA, 23 nt, Artificial Sequence
  Synthetic Oligonucleotide; BTLA exon 2; Set B
guguugagaacucaccugucaca

SEQ ID NO: 51055 - RNA, 21 nt, Artificial Sequence
  Synthetic Oligonucleotide; BTLA exon 2; Set C
uguugagaacucaccugucac

SEQ ID NO: 51056 - RNA, 20 nt, Artificial Sequence
  Synthetic Oligonucleotide; BTLA exon 2; Set C
uguugagaacucaccuguca

SEQ ID NO: 51057 - RNA, 26 nt, Artificial Sequence
  Synthetic Oligonucleotide; BTLA exon 2; Set B
agguguugagaacucaccugucacau

SEQ ID NO: 51058 - RNA, 22 nt, Artificial Sequence
  Synthetic Oligonucleotide; BTLA exon 2; Set B
guguugagaacucaccugucac

SEQ ID NO: 51059 - RNA, 24 nt, Artificial Sequence
  Synthetic Oligonucleotide; BTLA exon 2; Set B
gguguugagaacucaccugucaca

SEQ ID NO: 51060 - RNA, 21 nt, Artificial Sequence
  Synthetic Oligonucleotide; BTLA exon 2; Set B
guguugagaacucaccuguca

SEQ ID NO: 51061 - RNA, 27 nt, Artificial Sequence
  Synthetic Oligonucleotide; BTLA exon 2; Set B
uagguguugagaacucaccugucacau

SEQ ID NO: 51062 - RNA, 23 nt, Artificial Sequence
  Synthetic Oligonucleotide; BTLA exon 2; Set B
gguguugagaacucaccugucac

SEQ ID NO: 51063 - RNA, 25 nt, Artificial Sequence
  Synthetic Oligonucleotide; BTLA exon 2; Set B
agguguugagaacucaccugucaca

SEQ ID NO: 51064 - RNA, 22 nt, Artificial Sequence
  Synthetic Oligonucleotide; BTLA exon 2; Set B
gguguugagaacucaccuguca

SEQ ID NO: 51065 - RNA, 28 nt, Artificial Sequence
  Synthetic Oligonucleotide; BTLA exon 2; Set B
cuagguguugagaacucaccugucacau

SEQ ID NO: 51066 - RNA, 26 nt, Artificial Sequence
  Synthetic Oligonucleotide; BTLA exon 2; Set B
uagguguugagaacucaccugucaca

SEQ ID NO: 51067 - RNA, 24 nt, Artificial Sequence
  Synthetic Oligonucleotide; BTLA exon 2; Set B
agguguugagaacucaccugucac

SEQ ID NO: 51068 - RNA, 23 nt, Artificial Sequence
  Synthetic Oligonucleotide; BTLA exon 2; Set B
agguguugagaacucaccuguca

SEQ ID NO: 51069 - RNA, 25 nt, Artificial Sequence
  Synthetic Oligonucleotide; BTLA exon 2; Set B
uagguguugagaacucaccugucac

SEQ ID NO: 51070 - RNA, 27 nt, Artificial Sequence
  Synthetic Oligonucleotide; BTLA exon 2; Set B
cuagguguugagaacucaccugucaca

SEQ ID NO: 51071 - RNA, 26 nt, Artificial Sequence
  Synthetic Oligonucleotide; BTLA exon 2; Set B
cuagguguugagaacucaccugucac

SEQ ID NO: 51072 - RNA, 33 nt, Artificial Sequence
  Synthetic Oligonucleotide; BTLA exon 2; Set C
auggucuagguguugagaacucaccugucacau

SEQ ID NO: 51073 - RNA, 34 nt, Artificial Sequence
  Synthetic Oligonucleotide; BTLA exon 2; Set C
gauggucuagguguugagaacucaccugucacau

SEQ ID NO: 51074 - RNA, 32 nt, Artificial Sequence
  Synthetic Oligonucleotide; BTLA exon 2; Set C
auggucuagguguugagaacucaccugucaca

SEQ ID NO: 51075 - RNA, 35 nt, Artificial Sequence
  Synthetic Oligonucleotide; BTLA exon 2; Set C
agauggucuagguguugagaacucaccugucacau

SEQ ID NO: 51076 - RNA, 31 nt, Artificial Sequence
  Synthetic Oligonucleotide; BTLA exon 2; Set C
auggucuagguguugagaacucaccugucac

SEQ ID NO: 51077 - RNA, 33 nt, Artificial Sequence
  Synthetic Oligonucleotide; BTLA exon 2; Set C
gauggucuagguguugagaacucaccugucaca

SEQ ID NO: 51078 - RNA, 23 nt, Artificial Sequence
  Synthetic Oligonucleotide; BTLA exon 2; Set B
ucuagguguugagaacucaccug

SEQ ID NO: 51079 - RNA, 36 nt, Artificial Sequence
  Synthetic Oligonucleotide; BTLA exon 2; Set C
cagauggucuagguguugagaacucaccugucacau

SEQ ID NO: 51080 - RNA, 32 nt, Artificial Sequence
  Synthetic Oligonucleotide; BTLA exon 2; Set C
gauggucuagguguugagaacucaccugucac

SEQ ID NO: 51081 - RNA, 34 nt, Artificial Sequence
  Synthetic Oligonucleotide; BTLA exon 2; Set C
agauggucuagguguugagaacucaccugucaca

SEQ ID NO: 51082 - RNA, 24 nt, Artificial Sequence
  Synthetic Oligonucleotide; BTLA exon 2; Set B
gucuagguguugagaacucaccug

SEQ ID NO: 51083 - RNA, 31 nt, Artificial Sequence
  Synthetic Oligonucleotide; BTLA exon 2; Set C
gauggucuagguguugagaacucaccuguca

SEQ ID NO: 51084 - RNA, 37 nt, Artificial Sequence
  Synthetic Oligonucleotide; BTLA exon 2; Set C
ucagauggucuagguguugagaacucaccugucacau

SEQ ID NO: 51085 - RNA, 33 nt, Artificial Sequence
  Synthetic Oligonucleotide; BTLA exon 2; Set C
agauggucuagguguugagaacucaccugucac

SEQ ID NO: 51086 - RNA, 35 nt, Artificial Sequence
  Synthetic Oligonucleotide; BTLA exon 2; Set C
cagauggucuagguguugagaacucaccugucaca

SEQ ID NO: 51087 - RNA, 25 nt, Artificial Sequence
  Synthetic Oligonucleotide; BTLA exon 2; Set B
ggucuagguguugagaacucaccug

SEQ ID NO: 51088 - RNA, 32 nt, Artificial Sequence
  Synthetic Oligonucleotide; BTLA exon 2; Set C
agauggucuagguguugagaacucaccuguca

SEQ ID NO: 51089 - RNA, 34 nt, Artificial Sequence
  Synthetic Oligonucleotide; BTLA exon 2; Set C
cagauggucuagguguugagaacucaccugucac

SEQ ID NO: 51090 - RNA, 36 nt, Artificial Sequence
  Synthetic Oligonucleotide; BTLA exon 2; Set C
ucagauggucuagguguugagaacucaccugucaca

SEQ ID NO: 51091 - RNA, 26 nt, Artificial Sequence
  Synthetic Oligonucleotide; BTLA exon 2; Set B
uggucuagguguugagaacucaccug

SEQ ID NO: 51092 - RNA, 33 nt, Artificial Sequence
  Synthetic Oligonucleotide; BTLA exon 2; Set C
cagauggucuagguguugagaacucaccuguca

SEQ ID NO: 51093 - RNA, 37 nt, Artificial Sequence
  Synthetic Oligonucleotide; BTLA exon 2; Set C
aucagauggucuagguguugagaacucaccugucaca

SEQ ID NO: 51094 - RNA, 35 nt, Artificial Sequence
  Synthetic Oligonucleotide; BTLA exon 2; Set C
ucagauggucuagguguugagaacucaccugucac

SEQ ID NO: 51095 - RNA, 34 nt, Artificial Sequence
  Synthetic Oligonucleotide; BTLA exon 2; Set C
ucagauggucuagguguugagaacucaccuguca

SEQ ID NO: 51096 - RNA, 36 nt, Artificial Sequence
  Synthetic Oligonucleotide; BTLA exon 2; Set C
aucagauggucuagguguugagaacucaccugucac

SEQ ID NO: 51097 - RNA, 18 nt, Artificial Sequence
  Synthetic Oligonucleotide; BTLA exon 2; Set C
ucuagguguugagaacuc

SEQ ID NO: 51098 - RNA, 19 nt, Artificial Sequence
  Synthetic Oligonucleotide; BTLA exon 2; Set C
gucuagguguugagaacuc

SEQ ID NO: 51099 - RNA, 20 nt, Artificial Sequence
  Synthetic Oligonucleotide; BTLA exon 2; Set C
ggucuagguguugagaacuc

SEQ ID NO: 51100 - RNA, 15 nt, Artificial Sequence
  Synthetic Oligonucleotide; BTLA exon 2; Set C
ucuagguguugagaa

SEQ ID NO: 51101 - RNA, 21 nt, Artificial Sequence
  Synthetic Oligonucleotide; BTLA exon 2; Set C
uggucuagguguugagaacuc

SEQ ID NO: 51102 - RNA, 16 nt, Artificial Sequence
  Synthetic Oligonucleotide; BTLA exon 2; Set C
gucuagguguugagaa

SEQ ID NO: 51103 - RNA, 32 nt, Artificial Sequence
  Synthetic Oligonucleotide; BTLA exon 2; Set C
aucagauggucuagguguugagaacucaccug

SEQ ID NO: 51104 - RNA, 17 nt, Artificial Sequence
  Synthetic Oligonucleotide; BTLA exon 2; Set C
ggucuagguguugagaa

SEQ ID NO: 51105 - RNA, 33 nt, Artificial Sequence
  Synthetic Oligonucleotide; BTLA exon 2; Set C
uaucagauggucuagguguugagaacucaccug

SEQ ID NO: 51106 - RNA, 15 nt, Artificial Sequence
  Synthetic Oligonucleotide; BTLA exon 2; Set C
gucuagguguugaga

SEQ ID NO: 51107 - RNA, 20 nt, Artificial Sequence
  Synthetic Oligonucleotide; BTLA exon 2; Set C
auggucuagguguugagaac

SEQ ID NO: 51108 - RNA, 18 nt, Artificial Sequence
  Synthetic Oligonucleotide; BTLA exon 2; Set C
uggucuagguguugagaa

SEQ ID NO: 51109 - RNA, 34 nt, Artificial Sequence
  Synthetic Oligonucleotide; BTLA exon 2; Set C
auaucagauggucuagguguugagaacucaccug

SEQ ID NO: 51110 - RNA, 16 nt, Artificial Sequence
  Synthetic Oligonucleotide; BTLA exon 2; Set C
ggucuagguguugaga

SEQ ID NO: 51111 - RNA, 21 nt, Artificial Sequence
  Synthetic Oligonucleotide; BTLA exon 2; Set C
gauggucuagguguugagaac

SEQ ID NO: 51112 - RNA, 15 nt, Artificial Sequence
  Synthetic Oligonucleotide; BTLA exon 2; Set C
ggucuagguguugag

SEQ ID NO: 51113 - RNA, 19 nt, Artificial Sequence
  Synthetic Oligonucleotide; BTLA exon 2; Set C
auggucuagguguugagaa

SEQ ID NO: 51114 - RNA, 35 nt, Artificial Sequence
  Synthetic Oligonucleotide; BTLA exon 2; Set B
aauaucagauggucuagguguugagaacucaccug

SEQ ID NO: 51115 - RNA, 17 nt, Artificial Sequence
  Synthetic Oligonucleotide; BTLA exon 2; Set C
uggucuagguguugaga

SEQ ID NO: 51116 - RNA, 22 nt, Artificial Sequence
  Synthetic Oligonucleotide; BTLA exon 2; Set C
agauggucuagguguugagaac

SEQ ID NO: 51117 - RNA, 20 nt, Artificial Sequence
  Synthetic Oligonucleotide; BTLA exon 2; Set C
gauggucuagguguugagaa

SEQ ID NO: 51118 - RNA, 36 nt, Artificial Sequence
  Synthetic Oligonucleotide; BTLA exon 2; Set B
aaauaucagauggucuagguguugagaacucaccug

SEQ ID NO: 51119 - RNA, 23 nt, Artificial Sequence
  Synthetic Oligonucleotide; BTLA exon 2; Set C
cagauggucuagguguugagaac

SEQ ID NO: 51120 - RNA, 17 nt, Artificial Sequence
  Synthetic Oligonucleotide; BTLA exon 2; Set C
auggucuagguguugag

SEQ ID NO: 51121 - RNA, 37 nt, Artificial Sequence
  Synthetic Oligonucleotide; BTLA exon 2; Set B
aaaauaucagauggucuagguguugagaacucaccug

SEQ ID NO: 51122 - RNA, 24 nt, Artificial Sequence
  Synthetic Oligonucleotide; BTLA exon 2; Set B
ucagauggucuagguguugagaac

SEQ ID NO: 51123 - RNA, 16 nt, Artificial Sequence
  Synthetic Oligonucleotide; BTLA exon 2; Set C
auggucuagguguuga

SEQ ID NO: 51124 - RNA, 18 nt, Artificial Sequence
  Synthetic Oligonucleotide; BTLA exon 2; Set C
gauggucuagguguugag

SEQ ID NO: 51125 - RNA, 38 nt, Artificial Sequence
  Synthetic Oligonucleotide; BTLA exon 2; Set B
aaaaauaucagauggucuagguguugagaacucaccug

SEQ ID NO: 51126 - RNA, 28 nt, Artificial Sequence
  Synthetic Oligonucleotide; BTLA exon 2; Set B
uaucagauggucuagguguugagaacuc

SEQ ID NO: 51127 - RNA, 17 nt, Artificial Sequence
  Synthetic Oligonucleotide; BTLA exon 2; Set C
gauggucuagguguuga

SEQ ID NO: 51128 - RNA, 19 nt, Artificial Sequence
  Synthetic Oligonucleotide; BTLA exon 2; Set C
agauggucuagguguugag

SEQ ID NO: 51129 - RNA, 39 nt, Artificial Sequence
  Synthetic Oligonucleotide; BTLA exon 2; Set B
gaaaaauaucagauggucuagguguugagaacucaccug

SEQ ID NO: 51130 - RNA, 29 nt, Artificial Sequence
  Synthetic Oligonucleotide; BTLA exon 2; Set B
auaucagauggucuagguguugagaacuc

SEQ ID NO: 51131 - RNA, 18 nt, Artificial Sequence
  Synthetic Oligonucleotide; BTLA exon 2; Set C
agauggucuagguguuga

SEQ ID NO: 51132 - RNA, 24 nt, Artificial Sequence
  Synthetic Oligonucleotide; BTLA exon 2; Set C
aucagauggucuagguguugagaa

SEQ ID NO: 51133 - RNA, 40 nt, Artificial Sequence
  Synthetic Oligonucleotide; BTLA exon 2; Set B
agaaaaauaucagauggucuagguguugagaacucaccug

SEQ ID NO: 51134 - RNA, 30 nt, Artificial Sequence
  Synthetic Oligonucleotide; BTLA exon 2; Set B
aauaucagauggucuagguguugagaacuc

SEQ ID NO: 51135 - RNA, 17 nt, Artificial Sequence
  Synthetic Oligonucleotide; BTLA exon 2; Set C
agauggucuagguguug

SEQ ID NO: 51136 - RNA, 19 nt, Artificial Sequence
  Synthetic Oligonucleotide; BTLA exon 2; Set C
cagauggucuagguguuga

SEQ ID NO: 51137 - RNA, 25 nt, Artificial Sequence
  Synthetic Oligonucleotide; BTLA exon 2; Set B
uaucagauggucuagguguugagaa

SEQ ID NO: 51138 - RNA, 31 nt, Artificial Sequence
  Synthetic Oligonucleotide; BTLA exon 2; Set B
aaauaucagauggucuagguguugagaacuc

SEQ ID NO: 51139 - RNA, 18 nt, Artificial Sequence
  Synthetic Oligonucleotide; BTLA exon 2; Set C
cagauggucuagguguug

SEQ ID NO: 51140 - RNA, 22 nt, Artificial Sequence
  Synthetic Oligonucleotide; BTLA exon 2; Set C
aucagauggucuagguguugag

SEQ ID NO: 51141 - RNA, 26 nt, Artificial Sequence
  Synthetic Oligonucleotide; BTLA exon 2; Set B
auaucagauggucuagguguugagaa

SEQ ID NO: 51142 - RNA, 32 nt, Artificial Sequence
  Synthetic Oligonucleotide; BTLA exon 2; Set B
aaaauaucagauggucuagguguugagaacuc

SEQ ID NO: 51143 - RNA, 24 nt, Artificial Sequence
  Synthetic Oligonucleotide; BTLA exon 2; Set B
uaucagauggucuagguguugaga

SEQ ID NO: 51144 - RNA, 19 nt, Artificial Sequence
  Synthetic Oligonucleotide; BTLA exon 2; Set C
ucagauggucuagguguug

SEQ ID NO: 51145 - RNA, 21 nt, Artificial Sequence
  Synthetic Oligonucleotide; BTLA exon 2; Set C
aucagauggucuagguguuga

SEQ ID NO: 51146 - RNA, 27 nt, Artificial Sequence
  Synthetic Oligonucleotide; BTLA exon 2; Set C
aauaucagauggucuagguguugagaa

SEQ ID NO: 51147 - RNA, 33 nt, Artificial Sequence
  Synthetic Oligonucleotide; BTLA exon 2; Set B
aaaaauaucagauggucuagguguugagaacuc

SEQ ID NO: 51148 - RNA, 25 nt, Artificial Sequence
  Synthetic Oligonucleotide; BTLA exon 2; Set B
auaucagauggucuagguguugaga

SEQ ID NO: 51149 - RNA, 28 nt, Artificial Sequence
  Synthetic Oligonucleotide; BTLA exon 2; Set C
aaauaucagauggucuagguguugagaa

SEQ ID NO: 51150 - RNA, 34 nt, Artificial Sequence
  Synthetic Oligonucleotide; BTLA exon 2; Set B
gaaaaauaucagauggucuagguguugagaacuc

SEQ ID NO: 51151 - RNA, 26 nt, Artificial Sequence
  Synthetic Oligonucleotide; BTLA exon 2; Set B
aauaucagauggucuagguguugaga

SEQ ID NO: 51152 - RNA, 25 nt, Artificial Sequence
  Synthetic Oligonucleotide; BTLA exon 2; Set C
aauaucagauggucuagguguugag

SEQ ID NO: 51153 - RNA, 29 nt, Artificial Sequence
  Synthetic Oligonucleotide; BTLA exon 2; Set C
aaaauaucagauggucuagguguugagaa

SEQ ID NO: 51154 - RNA, 35 nt, Artificial Sequence
  Synthetic Oligonucleotide; BTLA exon 2; Set B
agaaaaauaucagauggucuagguguugagaacuc

SEQ ID NO: 51155 - RNA, 27 nt, Artificial Sequence
  Synthetic Oligonucleotide; BTLA exon 2; Set C
aaauaucagauggucuagguguugaga

SEQ ID NO: 51156 - RNA, 26 nt, Artificial Sequence
  Synthetic Oligonucleotide; BTLA exon 2; Set C
aaauaucagauggucuagguguugag

SEQ ID NO: 51157 - RNA, 30 nt, Artificial Sequence
  Synthetic Oligonucleotide; BTLA exon 2; Set C
aaaaauaucagauggucuagguguugagaa

SEQ ID NO: 51158 - RNA, 36 nt, Artificial Sequence
  Synthetic Oligonucleotide; BTLA exon 2; Set B
aagaaaaauaucagauggucuagguguugagaacuc

SEQ ID NO: 51159 - RNA, 28 nt, Artificial Sequence
  Synthetic Oligonucleotide; BTLA exon 2; Set C
aaaauaucagauggucuagguguugaga

SEQ ID NO: 51160 - RNA, 38 nt, Artificial Sequence
  Synthetic Oligonucleotide; BTLA exon 2; Set B
uaagaaaaauaucagauggucuagguguugagaacuca

SEQ ID NO: 51161 - RNA, 27 nt, Artificial Sequence
  Synthetic Oligonucleotide; BTLA exon 2; Set C
aaaauaucagauggucuagguguugag

SEQ ID NO: 51162 - RNA, 31 nt, Artificial Sequence
  Synthetic Oligonucleotide; BTLA exon 2; Set C
gaaaaauaucagauggucuagguguugagaa

SEQ ID NO: 51163 - RNA, 37 nt, Artificial Sequence
  Synthetic Oligonucleotide; BTLA exon 2; Set B
uaagaaaaauaucagauggucuagguguugagaacuc

SEQ ID NO: 51164 - RNA, 29 nt, Artificial Sequence
  Synthetic Oligonucleotide; BTLA exon 2; Set C
aaaaauaucagauggucuagguguugaga

SEQ ID NO: 51165 - RNA, 39 nt, Artificial Sequence
  Synthetic Oligonucleotide; BTLA exon 2; Set B
auaagaaaaauaucagauggucuagguguugagaacuca

SEQ ID NO: 51166 - RNA, 28 nt, Artificial Sequence
  Synthetic Oligonucleotide; BTLA exon 2; Set C
aaaaauaucagauggucuagguguugag

SEQ ID NO: 51167 - RNA, 32 nt, Artificial Sequence
  Synthetic Oligonucleotide; BTLA exon 2; Set C
agaaaaauaucagauggucuagguguugagaa

SEQ ID NO: 51168 - RNA, 38 nt, Artificial Sequence
  Synthetic Oligonucleotide; BTLA exon 2; Set B
auaagaaaaauaucagauggucuagguguugagaacuc

SEQ ID NO: 51169 - RNA, 30 nt, Artificial Sequence
  Synthetic Oligonucleotide; BTLA exon 2; Set B
gaaaaauaucagauggucuagguguugaga

SEQ ID NO: 51170 - RNA, 40 nt, Artificial Sequence
  Synthetic Oligonucleotide; BTLA exon 2; Set B
uauaagaaaaauaucagauggucuagguguugagaacuca

SEQ ID NO: 51171 - RNA, 27 nt, Artificial Sequence
  Synthetic Oligonucleotide; BTLA exon 2; Set C
aaaaauaucagauggucuagguguuga

SEQ ID NO: 51172 - RNA, 29 nt, Artificial Sequence
  Synthetic Oligonucleotide; BTLA exon 2; Set C
gaaaaauaucagauggucuagguguugag

SEQ ID NO: 51173 - RNA, 33 nt, Artificial Sequence
  Synthetic Oligonucleotide; BTLA exon 2; Set C
aagaaaaauaucagauggucuagguguugagaa

SEQ ID NO: 51174 - RNA, 39 nt, Artificial Sequence
  Synthetic Oligonucleotide; BTLA exon 2; Set B
uauaagaaaaauaucagauggucuagguguugagaacuc

SEQ ID NO: 51175 - RNA, 31 nt, Artificial Sequence
  Synthetic Oligonucleotide; BTLA exon 2; Set B
agaaaaauaucagauggucuagguguugaga

SEQ ID NO: 51176 - RNA, 28 nt, Artificial Sequence
  Synthetic Oligonucleotide; BTLA exon 2; Set C
gaaaaauaucagauggucuagguguuga

SEQ ID NO: 51177 - RNA, 30 nt, Artificial Sequence
  Synthetic Oligonucleotide; BTLA exon 2; Set C
agaaaaauaucagauggucuagguguugag

SEQ ID NO: 51178 - RNA, 40 nt, Artificial Sequence
  Synthetic Oligonucleotide; BTLA exon 2; Set B
uuauaagaaaaauaucagauggucuagguguugagaacuc

SEQ ID NO: 51179 - RNA, 32 nt, Artificial Sequence
  Synthetic Oligonucleotide; BTLA exon 2; Set C
aagaaaaauaucagauggucuagguguugaga

SEQ ID NO: 51180 - RNA, 29 nt, Artificial Sequence
  Synthetic Oligonucleotide; BTLA exon 2; Set C
agaaaaauaucagauggucuagguguuga

SEQ ID NO: 51181 - RNA, 31 nt, Artificial Sequence
  Synthetic Oligonucleotide; BTLA exon 2; Set C
aagaaaaauaucagauggucuagguguugag

SEQ ID NO: 51182 - RNA, 33 nt, Artificial Sequence
  Synthetic Oligonucleotide; BTLA exon 2; Set B
uaagaaaaauaucagauggucuagguguugaga

SEQ ID NO: 51183 - RNA, 30 nt, Artificial Sequence
  Synthetic Oligonucleotide; BTLA exon 2; Set C
aagaaaaauaucagauggucuagguguuga

SEQ ID NO: 51184 - RNA, 34 nt, Artificial Sequence
  Synthetic Oligonucleotide; BTLA exon 2; Set B
auaagaaaaauaucagauggucuagguguugaga

SEQ ID NO: 51185 - RNA, 35 nt, Artificial Sequence
  Synthetic Oligonucleotide; BTLA exon 2; Set B
uauaagaaaaauaucagauggucuagguguugaga

SEQ ID NO: 51186 - RNA, 40 nt, Artificial Sequence
  Synthetic Oligonucleotide; BTLA exon 2; Set B
cauuauaagaaaaauaucagauggucuagguguugagaac

SEQ ID NO: 51187 - RNA, 38 nt, Artificial Sequence
  Synthetic Oligonucleotide; BTLA exon 2; Set B
auuauaagaaaaauaucagauggucuagguguugagaa

SEQ ID NO: 51188 - RNA, 36 nt, Artificial Sequence
  Synthetic Oligonucleotide; BTLA exon 2; Set B
uuauaagaaaaauaucagauggucuagguguugaga

SEQ ID NO: 51189 - RNA, 39 nt, Artificial Sequence
  Synthetic Oligonucleotide; BTLA exon 2; Set B
cauuauaagaaaaauaucagauggucuagguguugagaa

SEQ ID NO: 51190 - RNA, 37 nt, Artificial Sequence
  Synthetic Oligonucleotide; BTLA exon 2; Set B
auuauaagaaaaauaucagauggucuagguguugaga

SEQ ID NO: 51191 - RNA, 40 nt, Artificial Sequence
  Synthetic Oligonucleotide; BTLA exon 2; Set B
acauuauaagaaaaauaucagauggucuagguguugagaa

SEQ ID NO: 51192 - RNA, 37 nt, Artificial Sequence
  Synthetic Oligonucleotide; BTLA exon 2; Set B
cauuauaagaaaaauaucagauggucuagguguugag

SEQ ID NO: 51193 - RNA, 36 nt, Artificial Sequence
  Synthetic Oligonucleotide; BTLA exon 2; Set B
cauuauaagaaaaauaucagauggucuagguguuga

SEQ ID NO: 51194 - RNA, 38 nt, Artificial Sequence
  Synthetic Oligonucleotide; BTLA exon 2; Set B
acauuauaagaaaaauaucagauggucuagguguugag

SEQ ID NO: 51195 - RNA, 37 nt, Artificial Sequence
  Synthetic Oligonucleotide; BTLA exon 2; Set B
acauuauaagaaaaauaucagauggucuagguguuga

SEQ ID NO: 51196 - RNA, 38 nt, Artificial Sequence
  Synthetic Oligonucleotide; BTLA exon 2; Set B
aacauuauaagaaaaauaucagauggucuagguguuga

SEQ ID NO: 51197 - RNA, 37 nt, Artificial Sequence
  Synthetic Oligonucleotide; BTLA exon 2; Set C
aacauuauaagaaaaauaucagauggucuagguguug

SEQ ID NO: 51198 - RNA, 39 nt, Artificial Sequence
  Synthetic Oligonucleotide; BTLA exon 2; Set B
aaacauuauaagaaaaauaucagauggucuagguguuga

SEQ ID NO: 51199 - RNA, 38 nt, Artificial Sequence
  Synthetic Oligonucleotide; BTLA exon 2; Set C
aaacauuauaagaaaaauaucagauggucuagguguug

SEQ ID NO: 51200 - RNA, 40 nt, Artificial Sequence
  Synthetic Oligonucleotide; BTLA exon 2; Set B
gaaacauuauaagaaaaauaucagauggucuagguguuga

SEQ ID NO: 51201 - RNA, 22 nt, Artificial Sequence
  Synthetic Oligonucleotide; BTLA exon 2; Set C
aacauuauaagaaaaauaucag

SEQ ID NO: 51202 - RNA, 23 nt, Artificial Sequence
  Synthetic Oligonucleotide; BTLA exon 2; Set C
aaacauuauaagaaaaauaucag

SEQ ID NO: 51203 - RNA, 21 nt, Artificial Sequence
  Synthetic Oligonucleotide; BTLA exon 2; Set C
aacauuauaagaaaaauauca

SEQ ID NO: 51204 - RNA, 22 nt, Artificial Sequence
  Synthetic Oligonucleotide; BTLA exon 2; Set C
aaacauuauaagaaaaauauca

SEQ ID NO: 51205 - RNA, 26 nt, Artificial Sequence
  Synthetic Oligonucleotide; BTLA exon 2; Set C
uggaaacauuauaagaaaaauaucag

SEQ ID NO: 51206 - RNA, 25 nt, Artificial Sequence
  Synthetic Oligonucleotide; BTLA exon 2; Set C
uggaaacauuauaagaaaaauauca

SEQ ID NO: 51207 - RNA, 16 nt, Artificial Sequence
  Synthetic Oligonucleotide; BTLA exon 3; Set C
auugggaucagcggca

SEQ ID NO: 51208 - RNA, 15 nt, Artificial Sequence
  Synthetic Oligonucleotide; BTLA exon 3; Set C
auugggaucagcggc

SEQ ID NO: 51209 - RNA, 17 nt, Artificial Sequence
  Synthetic Oligonucleotide; BTLA exon 3; Set C
uauugggaucagcggca

SEQ ID NO: 51210 - RNA, 16 nt, Artificial Sequence
  Synthetic Oligonucleotide; BTLA exon 3; Set C
uauugggaucagcggc

SEQ ID NO: 51211 - RNA, 18 nt, Artificial Sequence
  Synthetic Oligonucleotide; BTLA exon 3; Set C
auauugggaucagcggca

SEQ ID NO: 51212 - RNA, 15 nt, Artificial Sequence
  Synthetic Oligonucleotide; BTLA exon 3; Set C
uauugggaucagcgg

SEQ ID NO: 51213 - RNA, 17 nt, Artificial Sequence
  Synthetic Oligonucleotide; BTLA exon 3; Set C
auauugggaucagcggc

SEQ ID NO: 51214 - RNA, 19 nt, Artificial Sequence
  Synthetic Oligonucleotide; BTLA exon 3; Set C
uauauugggaucagcggca

SEQ ID NO: 51215 - RNA, 16 nt, Artificial Sequence
  Synthetic Oligonucleotide; BTLA exon 3; Set C
auauugggaucagcgg

SEQ ID NO: 51216 - RNA, 18 nt, Artificial Sequence
  Synthetic Oligonucleotide; BTLA exon 3; Set C
uauauugggaucagcggc

SEQ ID NO: 51217 - RNA, 20 nt, Artificial Sequence
  Synthetic Oligonucleotide; BTLA exon 3; Set C
auauauugggaucagcggca

SEQ ID NO: 51218 - RNA, 17 nt, Artificial Sequence
  Synthetic Oligonucleotide; BTLA exon 3; Set C
uauauugggaucagcgg

SEQ ID NO: 51219 - RNA, 19 nt, Artificial Sequence
  Synthetic Oligonucleotide; BTLA exon 3; Set C
auauauugggaucagcggc

SEQ ID NO: 51220 - RNA, 15 nt, Artificial Sequence
  Synthetic Oligonucleotide; BTLA exon 3; Set C
auauugggaucagcg

SEQ ID NO: 51221 - RNA, 21 nt, Artificial Sequence
  Synthetic Oligonucleotide; BTLA exon 3; Set A
gauauauugggaucagcggca

SEQ ID NO: 51222 - RNA, 18 nt, Artificial Sequence
  Synthetic Oligonucleotide; BTLA exon 3; Set C
auauauugggaucagcgg

SEQ ID NO: 51223 - RNA, 20 nt, Artificial Sequence
  Synthetic Oligonucleotide; BTLA exon 3; Set C
gauauauugggaucagcggc

SEQ ID NO: 51224 - RNA, 16 nt, Artificial Sequence
  Synthetic Oligonucleotide; BTLA exon 3; Set C
uauauugggaucagcg

SEQ ID NO: 51225 - RNA, 19 nt, Artificial Sequence
  Synthetic Oligonucleotide; BTLA exon 3; Set C
gauauauugggaucagcgg

SEQ ID NO: 51226 - RNA, 17 nt, Artificial Sequence
  Synthetic Oligonucleotide; BTLA exon 3; Set C
auauauugggaucagcg

SEQ ID NO: 51227 - RNA, 15 nt, Artificial Sequence
  Synthetic Oligonucleotide; BTLA exon 3; Set C
uauauugggaucagc

SEQ ID NO: 51228 - RNA, 18 nt, Artificial Sequence
  Synthetic Oligonucleotide; BTLA exon 3; Set C
gauauauugggaucagcg

SEQ ID NO: 51229 - RNA, 16 nt, Artificial Sequence
  Synthetic Oligonucleotide; BTLA exon 3; Set C
auauauugggaucagc

SEQ ID NO: 51230 - RNA, 17 nt, Artificial Sequence
  Synthetic Oligonucleotide; BTLA exon 3; Set C
gauauauugggaucagc

SEQ ID NO: 51231 - RNA, 27 nt, Artificial Sequence
  Synthetic Oligonucleotide; BTLA exon 3; Set A
aaucugagauauauugggaucagcggc

SEQ ID NO: 51232 - RNA, 26 nt, Artificial Sequence
  Synthetic Oligonucleotide; BTLA exon 3; Set A
aaucugagauauauugggaucagcgg

SEQ ID NO: 51233 - RNA, 28 nt, Artificial Sequence
  Synthetic Oligonucleotide; BTLA exon 3; Set A
aaaucugagauauauugggaucagcggc

SEQ ID NO: 51234 - RNA, 27 nt, Artificial Sequence
  Synthetic Oligonucleotide; BTLA exon 3; Set A
aaaucugagauauauugggaucagcgg

SEQ ID NO: 51235 - RNA, 29 nt, Artificial Sequence
  Synthetic Oligonucleotide; BTLA exon 3; Set A
gaaaucugagauauauugggaucagcggc

SEQ ID NO: 51236 - RNA, 25 nt, Artificial Sequence
  Synthetic Oligonucleotide; BTLA exon 3; Set C
aaucugagauauauugggaucagcg

SEQ ID NO: 51237 - RNA, 28 nt, Artificial Sequence
  Synthetic Oligonucleotide; BTLA exon 3; Set A
gaaaucugagauauauugggaucagcgg

SEQ ID NO: 51238 - RNA, 30 nt, Artificial Sequence
  Synthetic Oligonucleotide; BTLA exon 3; Set A
ggaaaucugagauauauugggaucagcggc

SEQ ID NO: 51239 - RNA, 26 nt, Artificial Sequence
  Synthetic Oligonucleotide; BTLA exon 3; Set C
aaaucugagauauauugggaucagcg

SEQ ID NO: 51240 - RNA, 29 nt, Artificial Sequence
  Synthetic Oligonucleotide; BTLA exon 3; Set A
ggaaaucugagauauauugggaucagcgg

SEQ ID NO: 51241 - RNA, 31 nt, Artificial Sequence
  Synthetic Oligonucleotide; BTLA exon 3; Set A
aggaaaucugagauauauugggaucagcggc

SEQ ID NO: 51242 - RNA, 27 nt, Artificial Sequence
  Synthetic Oligonucleotide; BTLA exon 3; Set C
gaaaucugagauauauugggaucagcg

SEQ ID NO: 51243 - RNA, 25 nt, Artificial Sequence
  Synthetic Oligonucleotide; BTLA exon 3; Set C
aaaucugagauauauugggaucagc

SEQ ID NO: 51244 - RNA, 30 nt, Artificial Sequence
  Synthetic Oligonucleotide; BTLA exon 3; Set A
aggaaaucugagauauauugggaucagcgg

SEQ ID NO: 51245 - RNA, 32 nt, Artificial Sequence
  Synthetic Oligonucleotide; BTLA exon 3; Set A
uaggaaaucugagauauauugggaucagcggc

SEQ ID NO: 51246 - RNA, 28 nt, Artificial Sequence
  Synthetic Oligonucleotide; BTLA exon 3; Set A
ggaaaucugagauauauugggaucagcg

SEQ ID NO: 51247 - RNA, 26 nt, Artificial Sequence
  Synthetic Oligonucleotide; BTLA exon 3; Set C
gaaaucugagauauauugggaucagc

SEQ ID NO: 51248 - RNA, 31 nt, Artificial Sequence
  Synthetic Oligonucleotide; BTLA exon 3; Set A
uaggaaaucugagauauauugggaucagcgg

SEQ ID NO: 51249 - RNA, 33 nt, Artificial Sequence
  Synthetic Oligonucleotide; BTLA exon 3; Set A
uuaggaaaucugagauauauugggaucagcggc

SEQ ID NO: 51250 - RNA, 29 nt, Artificial Sequence
  Synthetic Oligonucleotide; BTLA exon 3; Set A
aggaaaucugagauauauugggaucagcg

SEQ ID NO: 51251 - RNA, 35 nt, Artificial Sequence
  Synthetic Oligonucleotide; BTLA exon 3; Set C
guuaggaaaucugagauauauugggaucagcggca

SEQ ID NO: 51252 - RNA, 32 nt, Artificial Sequence
  Synthetic Oligonucleotide; BTLA exon 3; Set A
uuaggaaaucugagauauauugggaucagcgg

SEQ ID NO: 51253 - RNA, 34 nt, Artificial Sequence
  Synthetic Oligonucleotide; BTLA exon 3; Set A
guuaggaaaucugagauauauugggaucagcggc

SEQ ID NO: 51254 - RNA, 30 nt, Artificial Sequence
  Synthetic Oligonucleotide; BTLA exon 3; Set A
uaggaaaucugagauauauugggaucagcg

SEQ ID NO: 51255 - RNA, 33 nt, Artificial Sequence
  Synthetic Oligonucleotide; BTLA exon 3; Set A
guuaggaaaucugagauauauugggaucagcgg

SEQ ID NO: 51256 - RNA, 35 nt, Artificial Sequence
  Synthetic Oligonucleotide; BTLA exon 3; Set A
aguuaggaaaucugagauauauugggaucagcggc

SEQ ID NO: 51257 - RNA, 19 nt, Artificial Sequence
  Synthetic Oligonucleotide; BTLA exon 3; Set C
aaucugagauauauuggga

SEQ ID NO: 51258 - RNA, 31 nt, Artificial Sequence
  Synthetic Oligonucleotide; BTLA exon 3; Set A
uuaggaaaucugagauauauugggaucagcg

SEQ ID NO: 51259 - RNA, 29 nt, Artificial Sequence
  Synthetic Oligonucleotide; BTLA exon 3; Set A
uaggaaaucugagauauauugggaucagc

SEQ ID NO: 51260 - RNA, 34 nt, Artificial Sequence
  Synthetic Oligonucleotide; BTLA exon 3; Set A
aguuaggaaaucugagauauauugggaucagcgg

SEQ ID NO: 51261 - RNA, 18 nt, Artificial Sequence
  Synthetic Oligonucleotide; BTLA exon 3; Set C
aaucugagauauauuggg

SEQ ID NO: 51262 - RNA, 20 nt, Artificial Sequence
  Synthetic Oligonucleotide; BTLA exon 3; Set C
aaaucugagauauauuggga

SEQ ID NO: 51263 - RNA, 32 nt, Artificial Sequence
  Synthetic Oligonucleotide; BTLA exon 3; Set A
guuaggaaaucugagauauauugggaucagcg

SEQ ID NO: 51264 - RNA, 30 nt, Artificial Sequence
  Synthetic Oligonucleotide; BTLA exon 3; Set A
uuaggaaaucugagauauauugggaucagc

SEQ ID NO: 51265 - RNA, 19 nt, Artificial Sequence
  Synthetic Oligonucleotide; BTLA exon 3; Set C
aaaucugagauauauuggg

SEQ ID NO: 51266 - RNA, 17 nt, Artificial Sequence
  Synthetic Oligonucleotide; BTLA exon 3; Set C
aaucugagauauauugg

SEQ ID NO: 51267 - RNA, 21 nt, Artificial Sequence
  Synthetic Oligonucleotide; BTLA exon 3; Set C
gaaaucugagauauauuggga

SEQ ID NO: 51268 - RNA, 31 nt, Artificial Sequence
  Synthetic Oligonucleotide; BTLA exon 3; Set A
guuaggaaaucugagauauauugggaucagc

SEQ ID NO: 51269 - RNA, 20 nt, Artificial Sequence
  Synthetic Oligonucleotide; BTLA exon 3; Set C
gaaaucugagauauauuggg

SEQ ID NO: 51270 - RNA, 18 nt, Artificial Sequence
  Synthetic Oligonucleotide; BTLA exon 3; Set C
aaaucugagauauauugg

SEQ ID NO: 51271 - RNA, 16 nt, Artificial Sequence
  Synthetic Oligonucleotide; BTLA exon 3; Set C
aaucugagauauauug

SEQ ID NO: 51272 - RNA, 22 nt, Artificial Sequence
  Synthetic Oligonucleotide; BTLA exon 3; Set C
ggaaaucugagauauauuggga

SEQ ID NO: 51273 - RNA, 15 nt, Artificial Sequence
  Synthetic Oligonucleotide; BTLA exon 3; Set C
aaucugagauauauu

SEQ ID NO: 51274 - RNA, 19 nt, Artificial Sequence
  Synthetic Oligonucleotide; BTLA exon 3; Set C
gaaaucugagauauauugg

SEQ ID NO: 51275 - RNA, 17 nt, Artificial Sequence
  Synthetic Oligonucleotide; BTLA exon 3; Set C
aaaucugagauauauug

SEQ ID NO: 51276 - RNA, 21 nt, Artificial Sequence
  Synthetic Oligonucleotide; BTLA exon 3; Set C
ggaaaucugagauauauuggg

SEQ ID NO: 51277 - RNA, 23 nt, Artificial Sequence
  Synthetic Oligonucleotide; BTLA exon 3; Set C
aggaaaucugagauauauuggga

SEQ ID NO: 51278 - RNA, 16 nt, Artificial Sequence
  Synthetic Oligonucleotide; BTLA exon 3; Set C
aaaucugagauauauu

SEQ ID NO: 51279 - RNA, 18 nt, Artificial Sequence
  Synthetic Oligonucleotide; BTLA exon 3; Set C
gaaaucugagauauauug

SEQ ID NO: 51280 - RNA, 22 nt, Artificial Sequence
  Synthetic Oligonucleotide; BTLA exon 3; Set C
aggaaaucugagauauauuggg

SEQ ID NO: 51281 - RNA, 20 nt, Artificial Sequence
  Synthetic Oligonucleotide; BTLA exon 3; Set C
ggaaaucugagauauauugg

SEQ ID NO: 51282 - RNA, 40 nt, Artificial Sequence
  Synthetic Oligonucleotide; BTLA exon 3; Set C
aagagaguuaggaaaucugagauauauugggaucagcggc

SEQ ID NO: 51283 - RNA, 24 nt, Artificial Sequence
  Synthetic Oligonucleotide; BTLA exon 3; Set C
uaggaaaucugagauauauuggga

SEQ ID NO: 51284 - RNA, 17 nt, Artificial Sequence
  Synthetic Oligonucleotide; BTLA exon 3; Set C
gaaaucugagauauauu

SEQ ID NO: 51285 - RNA, 15 nt, Artificial Sequence
  Synthetic Oligonucleotide; BTLA exon 3; Set C
aaaucugagauauau

SEQ ID NO: 51286 - RNA, 39 nt, Artificial Sequence
  Synthetic Oligonucleotide; BTLA exon 3; Set A
aagagaguuaggaaaucugagauauauugggaucagcgg

SEQ ID NO: 51287 - RNA, 23 nt, Artificial Sequence
  Synthetic Oligonucleotide; BTLA exon 3; Set C
uaggaaaucugagauauauuggg

SEQ ID NO: 51288 - RNA, 21 nt, Artificial Sequence
  Synthetic Oligonucleotide; BTLA exon 3; Set C
aggaaaucugagauauauugg

SEQ ID NO: 51289 - RNA, 19 nt, Artificial Sequence
  Synthetic Oligonucleotide; BTLA exon 3; Set C
ggaaaucugagauauauug

SEQ ID NO: 51290 - RNA, 25 nt, Artificial Sequence
  Synthetic Oligonucleotide; BTLA exon 3; Set C
uuaggaaaucugagauauauuggga

SEQ ID NO: 51291 - RNA, 16 nt, Artificial Sequence
  Synthetic Oligonucleotide; BTLA exon 3; Set C
gaaaucugagauauau

SEQ ID NO: 51292 - RNA, 18 nt, Artificial Sequence
  Synthetic Oligonucleotide; BTLA exon 3; Set C
ggaaaucugagauauauu

SEQ ID NO: 51293 - RNA, 40 nt, Artificial Sequence
  Synthetic Oligonucleotide; BTLA exon 3; Set A
aaagagaguuaggaaaucugagauauauugggaucagcgg

SEQ ID NO: 51294 - RNA, 24 nt, Artificial Sequence
  Synthetic Oligonucleotide; BTLA exon 3; Set C
uuaggaaaucugagauauauuggg

SEQ ID NO: 51295 - RNA, 22 nt, Artificial Sequence
  Synthetic Oligonucleotide; BTLA exon 3; Set C
uaggaaaucugagauauauugg

SEQ ID NO: 51296 - RNA, 20 nt, Artificial Sequence
  Synthetic Oligonucleotide; BTLA exon 3; Set C
aggaaaucugagauauauug

SEQ ID NO: 51297 - RNA, 26 nt, Artificial Sequence
  Synthetic Oligonucleotide; BTLA exon 3; Set C
guuaggaaaucugagauauauuggga

SEQ ID NO: 51298 - RNA, 15 nt, Artificial Sequence
  Synthetic Oligonucleotide; BTLA exon 3; Set C
gaaaucugagauaua

SEQ ID NO: 51299 - RNA, 19 nt, Artificial Sequence
  Synthetic Oligonucleotide; BTLA exon 3; Set C
aggaaaucugagauauauu

SEQ ID NO: 51300 - RNA, 17 nt, Artificial Sequence
  Synthetic Oligonucleotide; BTLA exon 3; Set C
ggaaaucugagauauau

SEQ ID NO: 51301 - RNA, 25 nt, Artificial Sequence
  Synthetic Oligonucleotide; BTLA exon 3; Set C
guuaggaaaucugagauauauuggg

SEQ ID NO: 51302 - RNA, 23 nt, Artificial Sequence
  Synthetic Oligonucleotide; BTLA exon 3; Set C
uuaggaaaucugagauauauugg

SEQ ID NO: 51303 - RNA, 21 nt, Artificial Sequence
  Synthetic Oligonucleotide; BTLA exon 3; Set C
uaggaaaucugagauauauug

SEQ ID NO: 51304 - RNA, 27 nt, Artificial Sequence
  Synthetic Oligonucleotide; BTLA exon 3; Set C
aguuaggaaaucugagauauauuggga

SEQ ID NO: 51305 - RNA, 39 nt, Artificial Sequence
  Synthetic Oligonucleotide; BTLA exon 3; Set A
aaagagaguuaggaaaucugagauauauugggaucagcg

SEQ ID NO: 51306 - RNA, 20 nt, Artificial Sequence
  Synthetic Oligonucleotide; BTLA exon 3; Set C
uaggaaaucugagauauauu

SEQ ID NO: 51307 - RNA, 18 nt, Artificial Sequence
  Synthetic Oligonucleotide; BTLA exon 3; Set C
aggaaaucugagauauau

SEQ ID NO: 51308 - RNA, 16 nt, Artificial Sequence
  Synthetic Oligonucleotide; BTLA exon 3; Set C
ggaaaucugagauaua

SEQ ID NO: 51309 - RNA, 24 nt, Artificial Sequence
  Synthetic Oligonucleotide; BTLA exon 3; Set C
guuaggaaaucugagauauauugg

SEQ ID NO: 51310 - RNA, 22 nt, Artificial Sequence
  Synthetic Oligonucleotide; BTLA exon 3; Set C
uuaggaaaucugagauauauug

SEQ ID NO: 51311 - RNA, 26 nt, Artificial Sequence
  Synthetic Oligonucleotide; BTLA exon 3; Set C
aguuaggaaaucugagauauauuggg

SEQ ID NO: 51312 - RNA, 40 nt, Artificial Sequence
  Synthetic Oligonucleotide; BTLA exon 3; Set A
uaaagagaguuaggaaaucugagauauauugggaucagcg

SEQ ID NO: 51313 - RNA, 38 nt, Artificial Sequence
  Synthetic Oligonucleotide; BTLA exon 3; Set A
aaagagaguuaggaaaucugagauauauugggaucagc

SEQ ID NO: 51314 - RNA, 21 nt, Artificial Sequence
  Synthetic Oligonucleotide; BTLA exon 3; Set C
uuaggaaaucugagauauauu

SEQ ID NO: 51315 - RNA, 19 nt, Artificial Sequence
  Synthetic Oligonucleotide; BTLA exon 3; Set C
uaggaaaucugagauauau

SEQ ID NO: 51316 - RNA, 17 nt, Artificial Sequence
  Synthetic Oligonucleotide; BTLA exon 3; Set C
aggaaaucugagauaua

SEQ ID NO: 51317 - RNA, 15 nt, Artificial Sequence
  Synthetic Oligonucleotide; BTLA exon 3; Set C
ggaaaucugagauau

SEQ ID NO: 51318 - RNA, 23 nt, Artificial Sequence
  Synthetic Oligonucleotide; BTLA exon 3; Set C
guuaggaaaucugagauauauug

SEQ ID NO: 51319 - RNA, 25 nt, Artificial Sequence
  Synthetic Oligonucleotide; BTLA exon 3; Set C
aguuaggaaaucugagauauauugg

SEQ ID NO: 51320 - RNA, 39 nt, Artificial Sequence
  Synthetic Oligonucleotide; BTLA exon 3; Set A
uaaagagaguuaggaaaucugagauauauugggaucagc

SEQ ID NO: 51321 - RNA, 22 nt, Artificial Sequence
  Synthetic Oligonucleotide; BTLA exon 3; Set C
guuaggaaaucugagauauauu

SEQ ID NO: 51322 - RNA, 20 nt, Artificial Sequence
  Synthetic Oligonucleotide; BTLA exon 3; Set C
uuaggaaaucugagauauau

SEQ ID NO: 51323 - RNA, 18 nt, Artificial Sequence
  Synthetic Oligonucleotide; BTLA exon 3; Set C
uaggaaaucugagauaua

SEQ ID NO: 51324 - RNA, 16 nt, Artificial Sequence
  Synthetic Oligonucleotide; BTLA exon 3; Set C
aggaaaucugagauau

SEQ ID NO: 51325 - RNA, 24 nt, Artificial Sequence
  Synthetic Oligonucleotide; BTLA exon 3; Set C
aguuaggaaaucugagauauauug

SEQ ID NO: 51326 - RNA, 21 nt, Artificial Sequence
  Synthetic Oligonucleotide; BTLA exon 3; Set C
guuaggaaaucugagauauau

SEQ ID NO: 51327 - RNA, 19 nt, Artificial Sequence
  Synthetic Oligonucleotide; BTLA exon 3; Set C
uuaggaaaucugagauaua

SEQ ID NO: 51328 - RNA, 17 nt, Artificial Sequence
  Synthetic Oligonucleotide; BTLA exon 3; Set C
uaggaaaucugagauau

SEQ ID NO: 51329 - RNA, 15 nt, Artificial Sequence
  Synthetic Oligonucleotide; BTLA exon 3; Set C
aggaaaucugagaua

SEQ ID NO: 51330 - RNA, 23 nt, Artificial Sequence
  Synthetic Oligonucleotide; BTLA exon 3; Set C
aguuaggaaaucugagauauauu

SEQ ID NO: 51331 - RNA, 20 nt, Artificial Sequence
  Synthetic Oligonucleotide; BTLA exon 3; Set C
guuaggaaaucugagauaua

SEQ ID NO: 51332 - RNA, 18 nt, Artificial Sequence
  Synthetic Oligonucleotide; BTLA exon 3; Set C
uuaggaaaucugagauau

SEQ ID NO: 51333 - RNA, 16 nt, Artificial Sequence
  Synthetic Oligonucleotide; BTLA exon 3; Set C
uaggaaaucugagaua

SEQ ID NO: 51334 - RNA, 22 nt, Artificial Sequence
  Synthetic Oligonucleotide; BTLA exon 3; Set C
aguuaggaaaucugagauauau

SEQ ID NO: 51335 - RNA, 32 nt, Artificial Sequence
  Synthetic Oligonucleotide; BTLA exon 3; Set A
aagagaguuaggaaaucugagauauauuggga

SEQ ID NO: 51336 - RNA, 19 nt, Artificial Sequence
  Synthetic Oligonucleotide; BTLA exon 3; Set C
guuaggaaaucugagauau

SEQ ID NO: 51337 - RNA, 17 nt, Artificial Sequence
  Synthetic Oligonucleotide; BTLA exon 3; Set C
uuaggaaaucugagaua

SEQ ID NO: 51338 - RNA, 15 nt, Artificial Sequence
  Synthetic Oligonucleotide; BTLA exon 3; Set C
uaggaaaucugagau

SEQ ID NO: 51339 - RNA, 21 nt, Artificial Sequence
  Synthetic Oligonucleotide; BTLA exon 3; Set C
aguuaggaaaucugagauaua

SEQ ID NO: 51340 - RNA, 31 nt, Artificial Sequence
  Synthetic Oligonucleotide; BTLA exon 3; Set C
aagagaguuaggaaaucugagauauauuggg

SEQ ID NO: 51341 - RNA, 33 nt, Artificial Sequence
  Synthetic Oligonucleotide; BTLA exon 3; Set A
aaagagaguuaggaaaucugagauauauuggga

SEQ ID NO: 51342 - RNA, 18 nt, Artificial Sequence
  Synthetic Oligonucleotide; BTLA exon 3; Set C
guuaggaaaucugagaua

SEQ ID NO: 51343 - RNA, 16 nt, Artificial Sequence
  Synthetic Oligonucleotide; BTLA exon 3; Set C
uuaggaaaucugagau

SEQ ID NO: 51344 - RNA, 20 nt, Artificial Sequence
  Synthetic Oligonucleotide; BTLA exon 3; Set C
aguuaggaaaucugagauau

SEQ ID NO: 51345 - RNA, 32 nt, Artificial Sequence
  Synthetic Oligonucleotide; BTLA exon 3; Set C
aaagagaguuaggaaaucugagauauauuggg

SEQ ID NO: 51346 - RNA, 30 nt, Artificial Sequence
  Synthetic Oligonucleotide; BTLA exon 3; Set C
aagagaguuaggaaaucugagauauauugg

SEQ ID NO: 51347 - RNA, 34 nt, Artificial Sequence
  Synthetic Oligonucleotide; BTLA exon 3; Set A
uaaagagaguuaggaaaucugagauauauuggga

SEQ ID NO: 51348 - RNA, 17 nt, Artificial Sequence
  Synthetic Oligonucleotide; BTLA exon 3; Set C
guuaggaaaucugagau

SEQ ID NO: 51349 - RNA, 19 nt, Artificial Sequence
  Synthetic Oligonucleotide; BTLA exon 3; Set C
aguuaggaaaucugagaua

SEQ ID NO: 51350 - RNA, 33 nt, Artificial Sequence
  Synthetic Oligonucleotide; BTLA exon 3; Set C
uaaagagaguuaggaaaucugagauauauuggg

SEQ ID NO: 51351 - RNA, 31 nt, Artificial Sequence
  Synthetic Oligonucleotide; BTLA exon 3; Set C
aaagagaguuaggaaaucugagauauauugg

SEQ ID NO: 51352 - RNA, 29 nt, Artificial Sequence
  Synthetic Oligonucleotide; BTLA exon 3; Set C
aagagaguuaggaaaucugagauauauug

SEQ ID NO: 51353 - RNA, 18 nt, Artificial Sequence
  Synthetic Oligonucleotide; BTLA exon 3; Set C
aguuaggaaaucugagau

SEQ ID NO: 51354 - RNA, 28 nt, Artificial Sequence
  Synthetic Oligonucleotide; BTLA exon 3; Set C
aagagaguuaggaaaucugagauauauu

SEQ ID NO: 51355 - RNA, 32 nt, Artificial Sequence
  Synthetic Oligonucleotide; BTLA exon 3; Set C
uaaagagaguuaggaaaucugagauauauugg

SEQ ID NO: 51356 - RNA, 30 nt, Artificial Sequence
  Synthetic Oligonucleotide; BTLA exon 3; Set C
aaagagaguuaggaaaucugagauauauug

SEQ ID NO: 51357 - RNA, 29 nt, Artificial Sequence
  Synthetic Oligonucleotide; BTLA exon 3; Set C
aaagagaguuaggaaaucugagauauauu

SEQ ID NO: 51358 - RNA, 27 nt, Artificial Sequence
  Synthetic Oligonucleotide; BTLA exon 3; Set C
aagagaguuaggaaaucugagauauau

SEQ ID NO: 51359 - RNA, 31 nt, Artificial Sequence
  Synthetic Oligonucleotide; BTLA exon 3; Set C
uaaagagaguuaggaaaucugagauauauug

SEQ ID NO: 51360 - RNA, 30 nt, Artificial Sequence
  Synthetic Oligonucleotide; BTLA exon 3; Set C
uaaagagaguuaggaaaucugagauauauu

SEQ ID NO: 51361 - RNA, 28 nt, Artificial Sequence
  Synthetic Oligonucleotide; BTLA exon 3; Set C
aaagagaguuaggaaaucugagauauau

SEQ ID NO: 51362 - RNA, 26 nt, Artificial Sequence
  Synthetic Oligonucleotide; BTLA exon 3; Set C
aagagaguuaggaaaucugagauaua

SEQ ID NO: 51363 - RNA, 29 nt, Artificial Sequence
  Synthetic Oligonucleotide; BTLA exon 3; Set C
uaaagagaguuaggaaaucugagauauau

SEQ ID NO: 51364 - RNA, 27 nt, Artificial Sequence
  Synthetic Oligonucleotide; BTLA exon 3; Set C
aaagagaguuaggaaaucugagauaua

SEQ ID NO: 51365 - RNA, 25 nt, Artificial Sequence
  Synthetic Oligonucleotide; BTLA exon 3; Set C
aagagaguuaggaaaucugagauau

SEQ ID NO: 51366 - RNA, 28 nt, Artificial Sequence
  Synthetic Oligonucleotide; BTLA exon 3; Set C
uaaagagaguuaggaaaucugagauaua

SEQ ID NO: 51367 - RNA, 26 nt, Artificial Sequence
  Synthetic Oligonucleotide; BTLA exon 3; Set C
aaagagaguuaggaaaucugagauau

SEQ ID NO: 51368 - RNA, 24 nt, Artificial Sequence
  Synthetic Oligonucleotide; BTLA exon 3; Set C
aagagaguuaggaaaucugagaua

SEQ ID NO: 51369 - RNA, 27 nt, Artificial Sequence
  Synthetic Oligonucleotide; BTLA exon 3; Set C
uaaagagaguuaggaaaucugagauau

SEQ ID NO: 51370 - RNA, 25 nt, Artificial Sequence
  Synthetic Oligonucleotide; BTLA exon 3; Set C
aaagagaguuaggaaaucugagaua

SEQ ID NO: 51371 - RNA, 23 nt, Artificial Sequence
  Synthetic Oligonucleotide; BTLA exon 3; Set C
aagagaguuaggaaaucugagau

SEQ ID NO: 51372 - RNA, 26 nt, Artificial Sequence
  Synthetic Oligonucleotide; BTLA exon 3; Set C
uaaagagaguuaggaaaucugagaua

SEQ ID NO: 51373 - RNA, 24 nt, Artificial Sequence
  Synthetic Oligonucleotide; BTLA exon 3; Set C
aaagagaguuaggaaaucugagau

SEQ ID NO: 51374 - RNA, 25 nt, Artificial Sequence
  Synthetic Oligonucleotide; BTLA exon 3; Set C
uaaagagaguuaggaaaucugagau

SEQ ID NO: 51375 - RNA, 40 nt, Artificial Sequence
  Synthetic Oligonucleotide; BTLA exon 3; Set A
aguaaaugcuaaagagaguuaggaaaucugagauauauug

SEQ ID NO: 51376 - RNA, 39 nt, Artificial Sequence
  Synthetic Oligonucleotide; BTLA exon 3; Set A
aguaaaugcuaaagagaguuaggaaaucugagauauauu

SEQ ID NO: 51377 - RNA, 15 nt, Artificial Sequence
  Synthetic Oligonucleotide; BTLA exon 3; Set C
agagaguuaggaaau

SEQ ID NO: 51378 - RNA, 40 nt, Artificial Sequence
  Synthetic Oligonucleotide; BTLA exon 3; Set A
uaguaaaugcuaaagagaguuaggaaaucugagauauauu

SEQ ID NO: 51379 - RNA, 38 nt, Artificial Sequence
  Synthetic Oligonucleotide; BTLA exon 3; Set C
aguaaaugcuaaagagaguuaggaaaucugagauauau

SEQ ID NO: 51380 - RNA, 16 nt, Artificial Sequence
  Synthetic Oligonucleotide; BTLA exon 3; Set C
aagagaguuaggaaau

SEQ ID NO: 51381 - RNA, 39 nt, Artificial Sequence
  Synthetic Oligonucleotide; BTLA exon 3; Set A
uaguaaaugcuaaagagaguuaggaaaucugagauauau

SEQ ID NO: 51382 - RNA, 37 nt, Artificial Sequence
  Synthetic Oligonucleotide; BTLA exon 3; Set C
aguaaaugcuaaagagaguuaggaaaucugagauaua

SEQ ID NO: 51383 - RNA, 17 nt, Artificial Sequence
  Synthetic Oligonucleotide; BTLA exon 3; Set C
aaagagaguuaggaaau

SEQ ID NO: 51384 - RNA, 15 nt, Artificial Sequence
  Synthetic Oligonucleotide; BTLA exon 3; Set C
aagagaguuaggaaa

SEQ ID NO: 51385 - RNA, 38 nt, Artificial Sequence
  Synthetic Oligonucleotide; BTLA exon 3; Set A
uaguaaaugcuaaagagaguuaggaaaucugagauaua

SEQ ID NO: 51386 - RNA, 36 nt, Artificial Sequence
  Synthetic Oligonucleotide; BTLA exon 3; Set C
aguaaaugcuaaagagaguuaggaaaucugagauau

SEQ ID NO: 51387 - RNA, 18 nt, Artificial Sequence
  Synthetic Oligonucleotide; BTLA exon 3; Set C
uaaagagaguuaggaaau

SEQ ID NO: 51388 - RNA, 16 nt, Artificial Sequence
  Synthetic Oligonucleotide; BTLA exon 3; Set C
aaagagaguuaggaaa

SEQ ID NO: 51389 - RNA, 37 nt, Artificial Sequence
  Synthetic Oligonucleotide; BTLA exon 3; Set C
uaguaaaugcuaaagagaguuaggaaaucugagauau

SEQ ID NO: 51390 - RNA, 35 nt, Artificial Sequence
  Synthetic Oligonucleotide; BTLA exon 3; Set C
aguaaaugcuaaagagaguuaggaaaucugagaua

SEQ ID NO: 51391 - RNA, 17 nt, Artificial Sequence
  Synthetic Oligonucleotide; BTLA exon 3; Set C
uaaagagaguuaggaaa

SEQ ID NO: 51392 - RNA, 15 nt, Artificial Sequence
  Synthetic Oligonucleotide; BTLA exon 3; Set C
aaagagaguuaggaa

SEQ ID NO: 51393 - RNA, 36 nt, Artificial Sequence
  Synthetic Oligonucleotide; BTLA exon 3; Set C
uaguaaaugcuaaagagaguuaggaaaucugagaua

SEQ ID NO: 51394 - RNA, 34 nt, Artificial Sequence
  Synthetic Oligonucleotide; BTLA exon 3; Set C
aguaaaugcuaaagagaguuaggaaaucugagau

SEQ ID NO: 51395 - RNA, 16 nt, Artificial Sequence
  Synthetic Oligonucleotide; BTLA exon 3; Set C
uaaagagaguuaggaa

SEQ ID NO: 51396 - RNA, 35 nt, Artificial Sequence
  Synthetic Oligonucleotide; BTLA exon 3; Set C
uaguaaaugcuaaagagaguuaggaaaucugagau

SEQ ID NO: 51397 - RNA, 15 nt, Artificial Sequence
  Synthetic Oligonucleotide; BTLA exon 3; Set C
uaaagagaguuagga

SEQ ID NO: 51398 - RNA, 27 nt, Artificial Sequence
  Synthetic Oligonucleotide; BTLA exon 3; Set C
aguaaaugcuaaagagaguuaggaaau

SEQ ID NO: 51399 - RNA, 28 nt, Artificial Sequence
  Synthetic Oligonucleotide; BTLA exon 3; Set C
uaguaaaugcuaaagagaguuaggaaau

SEQ ID NO: 51400 - RNA, 26 nt, Artificial Sequence
  Synthetic Oligonucleotide; BTLA exon 3; Set C
aguaaaugcuaaagagaguuaggaaa

SEQ ID NO: 51401 - RNA, 27 nt, Artificial Sequence
  Synthetic Oligonucleotide; BTLA exon 3; Set C
uaguaaaugcuaaagagaguuaggaaa

SEQ ID NO: 51402 - RNA, 25 nt, Artificial Sequence
  Synthetic Oligonucleotide; BTLA exon 3; Set C
aguaaaugcuaaagagaguuaggaa

SEQ ID NO: 51403 - RNA, 26 nt, Artificial Sequence
  Synthetic Oligonucleotide; BTLA exon 3; Set C
uaguaaaugcuaaagagaguuaggaa

SEQ ID NO: 51404 - RNA, 24 nt, Artificial Sequence
  Synthetic Oligonucleotide; BTLA exon 3; Set C
aguaaaugcuaaagagaguuagga

SEQ ID NO: 51405 - RNA, 25 nt, Artificial Sequence
  Synthetic Oligonucleotide; BTLA exon 3; Set C
uaguaaaugcuaaagagaguuagga

SEQ ID NO: 51406 - RNA, 23 nt, Artificial Sequence
  Synthetic Oligonucleotide; BTLA exon 3; Set C
aguaaaugcuaaagagaguuagg

SEQ ID NO: 51407 - RNA, 22 nt, Artificial Sequence
  Synthetic Oligonucleotide; BTLA exon 3; Set C
aguaaaugcuaaagagaguuag

SEQ ID NO: 51408 - RNA, 24 nt, Artificial Sequence
  Synthetic Oligonucleotide; BTLA exon 3; Set C
uaguaaaugcuaaagagaguuagg

SEQ ID NO: 51409 - RNA, 23 nt, Artificial Sequence
  Synthetic Oligonucleotide; BTLA exon 3; Set C
uaguaaaugcuaaagagaguuag

SEQ ID NO: 51410 - RNA, 21 nt, Artificial Sequence
  Synthetic Oligonucleotide; BTLA exon 3; Set C
aguaaaugcuaaagagaguua

SEQ ID NO: 51411 - RNA, 20 nt, Artificial Sequence
  Synthetic Oligonucleotide; BTLA exon 3; Set C
aguaaaugcuaaagagaguu

SEQ ID NO: 51412 - RNA, 22 nt, Artificial Sequence
  Synthetic Oligonucleotide; BTLA exon 3; Set C
uaguaaaugcuaaagagaguua

SEQ ID NO: 51413 - RNA, 21 nt, Artificial Sequence
  Synthetic Oligonucleotide; BTLA exon 3; Set C
uaguaaaugcuaaagagaguu

SEQ ID NO: 51414 - RNA, 36 nt, Artificial Sequence
  Synthetic Oligonucleotide; BTLA exon 3; Set C
uggaauguuaguaaaugcuaaagagaguuaggaaau

SEQ ID NO: 51415 - RNA, 35 nt, Artificial Sequence
  Synthetic Oligonucleotide; BTLA exon 3; Set C
uggaauguuaguaaaugcuaaagagaguuaggaaa

SEQ ID NO: 51416 - RNA, 34 nt, Artificial Sequence
  Synthetic Oligonucleotide; BTLA exon 3; Set C
uggaauguuaguaaaugcuaaagagaguuaggaa

SEQ ID NO: 51417 - RNA, 33 nt, Artificial Sequence
  Synthetic Oligonucleotide; BTLA exon 3; Set A
uggaauguuaguaaaugcuaaagagaguuagga

SEQ ID NO: 51418 - RNA, 32 nt, Artificial Sequence
  Synthetic Oligonucleotide; BTLA exon 3; Set C
uggaauguuaguaaaugcuaaagagaguuagg

SEQ ID NO: 51419 - RNA, 15 nt, Artificial Sequence
  Synthetic Oligonucleotide; BTLA exon 3; Set C
augaguagaggcaau

SEQ ID NO: 51420 - RNA, 16 nt, Artificial Sequence
  Synthetic Oligonucleotide; BTLA exon 3; Set C
gaugaguagaggcaau

SEQ ID NO: 51421 - RNA, 15 nt, Artificial Sequence
  Synthetic Oligonucleotide; BTLA exon 3; Set C
gaugaguagaggcaa

SEQ ID NO: 51422 - RNA, 17 nt, Artificial Sequence
  Synthetic Oligonucleotide; BTLA exon 3; Set C
ugaugaguagaggcaau

SEQ ID NO: 51423 - RNA, 16 nt, Artificial Sequence
  Synthetic Oligonucleotide; BTLA exon 3; Set C
ugaugaguagaggcaa

SEQ ID NO: 51424 - RNA, 18 nt, Artificial Sequence
  Synthetic Oligonucleotide; BTLA exon 3; Set C
gugaugaguagaggcaau

SEQ ID NO: 51425 - RNA, 17 nt, Artificial Sequence
  Synthetic Oligonucleotide; BTLA exon 3; Set C
gugaugaguagaggcaa

SEQ ID NO: 51426 - RNA, 19 nt, Artificial Sequence
  Synthetic Oligonucleotide; BTLA exon 3; Set C
agugaugaguagaggcaau

SEQ ID NO: 51427 - RNA, 15 nt, Artificial Sequence
  Synthetic Oligonucleotide; BTLA exon 3; Set C
ugaugaguagaggca

SEQ ID NO: 51428 - RNA, 18 nt, Artificial Sequence
  Synthetic Oligonucleotide; BTLA exon 3; Set C
agugaugaguagaggcaa

SEQ ID NO: 51429 - RNA, 20 nt, Artificial Sequence
  Synthetic Oligonucleotide; BTLA exon 3; Set C
uagugaugaguagaggcaau

SEQ ID NO: 51430 - RNA, 16 nt, Artificial Sequence
  Synthetic Oligonucleotide; BTLA exon 3; Set C
gugaugaguagaggca

SEQ ID NO: 51431 - RNA, 19 nt, Artificial Sequence
  Synthetic Oligonucleotide; BTLA exon 3; Set C
uagugaugaguagaggcaa

SEQ ID NO: 51432 - RNA, 21 nt, Artificial Sequence
  Synthetic Oligonucleotide; BTLA exon 3; Set C
guagugaugaguagaggcaau

SEQ ID NO: 51433 - RNA, 15 nt, Artificial Sequence
  Synthetic Oligonucleotide; BTLA exon 3; Set C
gugaugaguagaggc

SEQ ID NO: 51434 - RNA, 17 nt, Artificial Sequence
  Synthetic Oligonucleotide; BTLA exon 3; Set C
agugaugaguagaggca

SEQ ID NO: 51435 - RNA, 20 nt, Artificial Sequence
  Synthetic Oligonucleotide; BTLA exon 3; Set C
guagugaugaguagaggcaa

SEQ ID NO: 51436 - RNA, 22 nt, Artificial Sequence
  Synthetic Oligonucleotide; BTLA exon 3; Set C
gguagugaugaguagaggcaau

SEQ ID NO: 51437 - RNA, 18 nt, Artificial Sequence
  Synthetic Oligonucleotide; BTLA exon 3; Set C
uagugaugaguagaggca

SEQ ID NO: 51438 - RNA, 16 nt, Artificial Sequence
  Synthetic Oligonucleotide; BTLA exon 3; Set C
agugaugaguagaggc

SEQ ID NO: 51439 - RNA, 21 nt, Artificial Sequence
  Synthetic Oligonucleotide; BTLA exon 3; Set C
gguagugaugaguagaggcaa

SEQ ID NO: 51440 - RNA, 23 nt, Artificial Sequence
  Synthetic Oligonucleotide; BTLA exon 3; Set C
agguagugaugaguagaggcaau

SEQ ID NO: 51441 - RNA, 17 nt, Artificial Sequence
  Synthetic Oligonucleotide; BTLA exon 3; Set C
uagugaugaguagaggc

SEQ ID NO: 51442 - RNA, 19 nt, Artificial Sequence
  Synthetic Oligonucleotide; BTLA exon 3; Set C
guagugaugaguagaggca

SEQ ID NO: 51443 - RNA, 22 nt, Artificial Sequence
  Synthetic Oligonucleotide; BTLA exon 3; Set C
agguagugaugaguagaggcaa

SEQ ID NO: 51444 - RNA, 24 nt, Artificial Sequence
  Synthetic Oligonucleotide; BTLA exon 3; Set A
cagguagugaugaguagaggcaau

SEQ ID NO: 51445 - RNA, 20 nt, Artificial Sequence
  Synthetic Oligonucleotide; BTLA exon 3; Set C
gguagugaugaguagaggca

SEQ ID NO: 51446 - RNA, 18 nt, Artificial Sequence
  Synthetic Oligonucleotide; BTLA exon 3; Set C
guagugaugaguagaggc

SEQ ID NO: 51447 - RNA, 16 nt, Artificial Sequence
  Synthetic Oligonucleotide; BTLA exon 3; Set C
uagugaugaguagagg

SEQ ID NO: 51448 - RNA, 23 nt, Artificial Sequence
  Synthetic Oligonucleotide; BTLA exon 3; Set A
cagguagugaugaguagaggcaa

SEQ ID NO: 51449 - RNA, 25 nt, Artificial Sequence
  Synthetic Oligonucleotide; BTLA exon 3; Set A
acagguagugaugaguagaggcaau

SEQ ID NO: 51450 - RNA, 19 nt, Artificial Sequence
  Synthetic Oligonucleotide; BTLA exon 3; Set C
gguagugaugaguagaggc

SEQ ID NO: 51451 - RNA, 21 nt, Artificial Sequence
  Synthetic Oligonucleotide; BTLA exon 3; Set C
agguagugaugaguagaggca

SEQ ID NO: 51452 - RNA, 15 nt, Artificial Sequence
  Synthetic Oligonucleotide; BTLA exon 3; Set C
uagugaugaguagag

SEQ ID NO: 51453 - RNA, 17 nt, Artificial Sequence
  Synthetic Oligonucleotide; BTLA exon 3; Set C
guagugaugaguagagg

SEQ ID NO: 51454 - RNA, 24 nt, Artificial Sequence
  Synthetic Oligonucleotide; BTLA exon 3; Set A
acagguagugaugaguagaggcaa

SEQ ID NO: 51455 - RNA, 26 nt, Artificial Sequence
  Synthetic Oligonucleotide; BTLA exon 3; Set A
aacagguagugaugaguagaggcaau

SEQ ID NO: 51456 - RNA, 20 nt, Artificial Sequence
  Synthetic Oligonucleotide; BTLA exon 3; Set C
agguagugaugaguagaggc

SEQ ID NO: 51457 - RNA, 22 nt, Artificial Sequence
  Synthetic Oligonucleotide; BTLA exon 3; Set A
cagguagugaugaguagaggca

SEQ ID NO: 51458 - RNA, 18 nt, Artificial Sequence
  Synthetic Oligonucleotide; BTLA exon 3; Set C
gguagugaugaguagagg

SEQ ID NO: 51459 - RNA, 16 nt, Artificial Sequence
  Synthetic Oligonucleotide; BTLA exon 3; Set C
guagugaugaguagag

SEQ ID NO: 51460 - RNA, 25 nt, Artificial Sequence
  Synthetic Oligonucleotide; BTLA exon 3; Set A
aacagguagugaugaguagaggcaa

SEQ ID NO: 51461 - RNA, 27 nt, Artificial Sequence
  Synthetic Oligonucleotide; BTLA exon 3; Set A
aaacagguagugaugaguagaggcaau

SEQ ID NO: 51462 - RNA, 23 nt, Artificial Sequence
  Synthetic Oligonucleotide; BTLA exon 3; Set A
acagguagugaugaguagaggca

SEQ ID NO: 51463 - RNA, 21 nt, Artificial Sequence
  Synthetic Oligonucleotide; BTLA exon 3; Set C
cagguagugaugaguagaggc

SEQ ID NO: 51464 - RNA, 15 nt, Artificial Sequence
  Synthetic Oligonucleotide; BTLA exon 3; Set C
guagugaugaguaga

SEQ ID NO: 51465 - RNA, 17 nt, Artificial Sequence
  Synthetic Oligonucleotide; BTLA exon 3; Set C
gguagugaugaguagag

SEQ ID NO: 51466 - RNA, 19 nt, Artificial Sequence
  Synthetic Oligonucleotide; BTLA exon 3; Set C
agguagugaugaguagagg

SEQ ID NO: 51467 - RNA, 26 nt, Artificial Sequence
  Synthetic Oligonucleotide; BTLA exon 3; Set A
aaacagguagugaugaguagaggcaa

SEQ ID NO: 51468 - RNA, 28 nt, Artificial Sequence
  Synthetic Oligonucleotide; BTLA exon 3; Set A
gaaacagguagugaugaguagaggcaau

SEQ ID NO: 51469 - RNA, 24 nt, Artificial Sequence
  Synthetic Oligonucleotide; BTLA exon 3; Set A
aacagguagugaugaguagaggca

SEQ ID NO: 51470 - RNA, 22 nt, Artificial Sequence
  Synthetic Oligonucleotide; BTLA exon 3; Set A
acagguagugaugaguagaggc

SEQ ID NO: 51471 - RNA, 16 nt, Artificial Sequence
  Synthetic Oligonucleotide; BTLA exon 3; Set C
gguagugaugaguaga

SEQ ID NO: 51472 - RNA, 18 nt, Artificial Sequence
  Synthetic Oligonucleotide; BTLA exon 3; Set C
agguagugaugaguagag

SEQ ID NO: 51473 - RNA, 20 nt, Artificial Sequence
  Synthetic Oligonucleotide; BTLA exon 3; Set C
cagguagugaugaguagagg

SEQ ID NO: 51474 - RNA, 27 nt, Artificial Sequence
  Synthetic Oligonucleotide; BTLA exon 3; Set A
gaaacagguagugaugaguagaggcaa

SEQ ID NO: 51475 - RNA, 29 nt, Artificial Sequence
  Synthetic Oligonucleotide; BTLA exon 3; Set A
agaaacagguagugaugaguagaggcaau

SEQ ID NO: 51476 - RNA, 25 nt, Artificial Sequence
  Synthetic Oligonucleotide; BTLA exon 3; Set A
aaacagguagugaugaguagaggca

SEQ ID NO: 51477 - RNA, 23 nt, Artificial Sequence
  Synthetic Oligonucleotide; BTLA exon 3; Set A
aacagguagugaugaguagaggc

SEQ ID NO: 51478 - RNA, 15 nt, Artificial Sequence
  Synthetic Oligonucleotide; BTLA exon 3; Set C
gguagugaugaguag

SEQ ID NO: 51479 - RNA, 17 nt, Artificial Sequence
  Synthetic Oligonucleotide; BTLA exon 3; Set C
agguagugaugaguaga

SEQ ID NO: 51480 - RNA, 21 nt, Artificial Sequence
  Synthetic Oligonucleotide; BTLA exon 3; Set C
acagguagugaugaguagagg

SEQ ID NO: 51481 - RNA, 19 nt, Artificial Sequence
  Synthetic Oligonucleotide; BTLA exon 3; Set C
cagguagugaugaguagag

SEQ ID NO: 51482 - RNA, 28 nt, Artificial Sequence
  Synthetic Oligonucleotide; BTLA exon 3; Set A
agaaacagguagugaugaguagaggcaa

SEQ ID NO: 51483 - RNA, 26 nt, Artificial Sequence
  Synthetic Oligonucleotide; BTLA exon 3; Set A
gaaacagguagugaugaguagaggca

SEQ ID NO: 51484 - RNA, 24 nt, Artificial Sequence
  Synthetic Oligonucleotide; BTLA exon 3; Set C
aaacagguagugaugaguagaggc

SEQ ID NO: 51485 - RNA, 16 nt, Artificial Sequence
  Synthetic Oligonucleotide; BTLA exon 3; Set C
agguagugaugaguag

SEQ ID NO: 51486 - RNA, 18 nt, Artificial Sequence
  Synthetic Oligonucleotide; BTLA exon 3; Set C
cagguagugaugaguaga

SEQ ID NO: 51487 - RNA, 22 nt, Artificial Sequence
  Synthetic Oligonucleotide; BTLA exon 3; Set C
aacagguagugaugaguagagg

SEQ ID NO: 51488 - RNA, 20 nt, Artificial Sequence
  Synthetic Oligonucleotide; BTLA exon 3; Set C
acagguagugaugaguagag

SEQ ID NO: 51489 - RNA, 15 nt, Artificial Sequence
  Synthetic Oligonucleotide; BTLA exon 3; Set C
agguagugaugagua

SEQ ID NO: 51490 - RNA, 27 nt, Artificial Sequence
  Synthetic Oligonucleotide; BTLA exon 3; Set A
agaaacagguagugaugaguagaggca

SEQ ID NO: 51491 - RNA, 25 nt, Artificial Sequence
  Synthetic Oligonucleotide; BTLA exon 3; Set A
gaaacagguagugaugaguagaggc

SEQ ID NO: 51492 - RNA, 17 nt, Artificial Sequence
  Synthetic Oligonucleotide; BTLA exon 3; Set C
cagguagugaugaguag

SEQ ID NO: 51493 - RNA, 19 nt, Artificial Sequence
  Synthetic Oligonucleotide; BTLA exon 3; Set C
acagguagugaugaguaga

SEQ ID NO: 51494 - RNA, 23 nt, Artificial Sequence
  Synthetic Oligonucleotide; BTLA exon 3; Set C
aaacagguagugaugaguagagg

SEQ ID NO: 51495 - RNA, 21 nt, Artificial Sequence
  Synthetic Oligonucleotide; BTLA exon 3; Set C
aacagguagugaugaguagag

SEQ ID NO: 51496 - RNA, 16 nt, Artificial Sequence
  Synthetic Oligonucleotide; BTLA exon 3; Set C
cagguagugaugagua

SEQ ID NO: 51497 - RNA, 26 nt, Artificial Sequence
  Synthetic Oligonucleotide; BTLA exon 3; Set A
agaaacagguagugaugaguagaggc

SEQ ID NO: 51498 - RNA, 18 nt, Artificial Sequence
  Synthetic Oligonucleotide; BTLA exon 3; Set C
acagguagugaugaguag

SEQ ID NO: 51499 - RNA, 20 nt, Artificial Sequence
  Synthetic Oligonucleotide; BTLA exon 3; Set C
aacagguagugaugaguaga

SEQ ID NO: 51500 - RNA, 24 nt, Artificial Sequence
  Synthetic Oligonucleotide; BTLA exon 3; Set C
gaaacagguagugaugaguagagg

SEQ ID NO: 51501 - RNA, 22 nt, Artificial Sequence
  Synthetic Oligonucleotide; BTLA exon 3; Set C
aaacagguagugaugaguagag

SEQ ID NO: 51502 - RNA, 15 nt, Artificial Sequence
  Synthetic Oligonucleotide; BTLA exon 3; Set C
cagguagugaugagu

SEQ ID NO: 51503 - RNA, 17 nt, Artificial Sequence
  Synthetic Oligonucleotide; BTLA exon 3; Set C
acagguagugaugagua

SEQ ID NO: 51504 - RNA, 19 nt, Artificial Sequence
  Synthetic Oligonucleotide; BTLA exon 3; Set C
aacagguagugaugaguag

SEQ ID NO: 51505 - RNA, 21 nt, Artificial Sequence
  Synthetic Oligonucleotide; BTLA exon 3; Set C
aaacagguagugaugaguaga

SEQ ID NO: 51506 - RNA, 25 nt, Artificial Sequence
  Synthetic Oligonucleotide; BTLA exon 3; Set C
agaaacagguagugaugaguagagg

SEQ ID NO: 51507 - RNA, 23 nt, Artificial Sequence
  Synthetic Oligonucleotide; BTLA exon 3; Set C
gaaacagguagugaugaguagag

SEQ ID NO: 51508 - RNA, 16 nt, Artificial Sequence
  Synthetic Oligonucleotide; BTLA exon 3; Set C
acagguagugaugagu

SEQ ID NO: 51509 - RNA, 18 nt, Artificial Sequence
  Synthetic Oligonucleotide; BTLA exon 3; Set C
aacagguagugaugagua

SEQ ID NO: 51510 - RNA, 20 nt, Artificial Sequence
  Synthetic Oligonucleotide; BTLA exon 3; Set C
aaacagguagugaugaguag

SEQ ID NO: 51511 - RNA, 22 nt, Artificial Sequence
  Synthetic Oligonucleotide; BTLA exon 3; Set C
gaaacagguagugaugaguaga

SEQ ID NO: 51512 - RNA, 24 nt, Artificial Sequence
  Synthetic Oligonucleotide; BTLA exon 3; Set C
agaaacagguagugaugaguagag

SEQ ID NO: 51513 - RNA, 15 nt, Artificial Sequence
  Synthetic Oligonucleotide; BTLA exon 3; Set C
acagguagugaugag

SEQ ID NO: 51514 - RNA, 17 nt, Artificial Sequence
  Synthetic Oligonucleotide; BTLA exon 3; Set C
aacagguagugaugagu

SEQ ID NO: 51515 - RNA, 19 nt, Artificial Sequence
  Synthetic Oligonucleotide; BTLA exon 3; Set C
aaacagguagugaugagua

SEQ ID NO: 51516 - RNA, 21 nt, Artificial Sequence
  Synthetic Oligonucleotide; BTLA exon 3; Set C
gaaacagguagugaugaguag

SEQ ID NO: 51517 - RNA, 23 nt, Artificial Sequence
  Synthetic Oligonucleotide; BTLA exon 3; Set C
agaaacagguagugaugaguaga

SEQ ID NO: 51518 - RNA, 16 nt, Artificial Sequence
  Synthetic Oligonucleotide; BTLA exon 3; Set C
aacagguagugaugag

SEQ ID NO: 51519 - RNA, 18 nt, Artificial Sequence
  Synthetic Oligonucleotide; BTLA exon 3; Set C
aaacagguagugaugagu

SEQ ID NO: 51520 - RNA, 20 nt, Artificial Sequence
  Synthetic Oligonucleotide; BTLA exon 3; Set C
gaaacagguagugaugagua

SEQ ID NO: 51521 - RNA, 22 nt, Artificial Sequence
  Synthetic Oligonucleotide; BTLA exon 3; Set C
agaaacagguagugaugaguag

SEQ ID NO: 51522 - RNA, 17 nt, Artificial Sequence
  Synthetic Oligonucleotide; BTLA exon 3; Set C
aaacagguagugaugag

SEQ ID NO: 51523 - RNA, 19 nt, Artificial Sequence
  Synthetic Oligonucleotide; BTLA exon 3; Set C
gaaacagguagugaugagu

SEQ ID NO: 51524 - RNA, 15 nt, Artificial Sequence
  Synthetic Oligonucleotide; BTLA exon 3; Set C
aacagguagugauga

SEQ ID NO: 51525 - RNA, 21 nt, Artificial Sequence
  Synthetic Oligonucleotide; BTLA exon 3; Set C
agaaacagguagugaugagua

SEQ ID NO: 51526 - RNA, 18 nt, Artificial Sequence
  Synthetic Oligonucleotide; BTLA exon 3; Set C
gaaacagguagugaugag

SEQ ID NO: 51527 - RNA, 20 nt, Artificial Sequence
  Synthetic Oligonucleotide; BTLA exon 3; Set C
agaaacagguagugaugagu

SEQ ID NO: 51528 - RNA, 16 nt, Artificial Sequence
  Synthetic Oligonucleotide; BTLA exon 3; Set C
aaacagguagugauga

SEQ ID NO: 51529 - RNA, 19 nt, Artificial Sequence
  Synthetic Oligonucleotide; BTLA exon 3; Set C
agaaacagguagugaugag

SEQ ID NO: 51530 - RNA, 17 nt, Artificial Sequence
  Synthetic Oligonucleotide; BTLA exon 3; Set C
gaaacagguagugauga

SEQ ID NO: 51531 - RNA, 15 nt, Artificial Sequence
  Synthetic Oligonucleotide; BTLA exon 3; Set C
aaacagguagugaug

SEQ ID NO: 51532 - RNA, 18 nt, Artificial Sequence
  Synthetic Oligonucleotide; BTLA exon 3; Set C
agaaacagguagugauga

SEQ ID NO: 51533 - RNA, 16 nt, Artificial Sequence
  Synthetic Oligonucleotide; BTLA exon 3; Set C
gaaacagguagugaug

SEQ ID NO: 51534 - RNA, 17 nt, Artificial Sequence
  Synthetic Oligonucleotide; BTLA exon 3; Set C
agaaacagguagugaug

SEQ ID NO: 51535 - RNA, 15 nt, Artificial Sequence
  Synthetic Oligonucleotide; BTLA exon 3; Set C
gaaacagguagugau

SEQ ID NO: 51536 - RNA, 16 nt, Artificial Sequence
  Synthetic Oligonucleotide; BTLA exon 3; Set C
agaaacagguagugau

SEQ ID NO: 51537 - RNA, 15 nt, Artificial Sequence
  Synthetic Oligonucleotide; BTLA exon 3; Set C
agaaacagguaguga

SEQ ID NO: 51538 - RNA, 15 nt, Artificial Sequence
  Synthetic Oligonucleotide; BTLA exon 3; Set C
agagggaaaauagaa

SEQ ID NO: 51539 - RNA, 15 nt, Artificial Sequence
  Synthetic Oligonucleotide; BTLA exon 3; Set C
ugggaucagcggcac

SEQ ID NO: 51540 - RNA, 16 nt, Artificial Sequence
  Synthetic Oligonucleotide; BTLA exon 3; Set C
uugggaucagcggcac

SEQ ID NO: 51541 - RNA, 15 nt, Artificial Sequence
  Synthetic Oligonucleotide; BTLA exon 3; Set C
uugggaucagcggca

SEQ ID NO: 51542 - RNA, 17 nt, Artificial Sequence
  Synthetic Oligonucleotide; BTLA exon 3; Set C
auugggaucagcggcac

SEQ ID NO: 51543 - RNA, 18 nt, Artificial Sequence
  Synthetic Oligonucleotide; BTLA exon 3; Set A
uauugggaucagcggcac

SEQ ID NO: 51544 - RNA, 19 nt, Artificial Sequence
  Synthetic Oligonucleotide; BTLA exon 3; Set A
auauugggaucagcggcac

SEQ ID NO: 51545 - RNA, 20 nt, Artificial Sequence
  Synthetic Oligonucleotide; BTLA exon 3; Set A
uauauugggaucagcggcac

SEQ ID NO: 51546 - RNA, 21 nt, Artificial Sequence
  Synthetic Oligonucleotide; BTLA exon 3; Set A
auauauugggaucagcggcac

SEQ ID NO: 51547 - RNA, 22 nt, Artificial Sequence
  Synthetic Oligonucleotide; BTLA exon 3; Set A
gauauauugggaucagcggcac

SEQ ID NO: 51548 - RNA, 20 nt, Artificial Sequence
  Synthetic Oligonucleotide; BTLA exon 3; Set C
agauauauugggaucagcgg

SEQ ID NO: 51549 - RNA, 21 nt, Artificial Sequence
  Synthetic Oligonucleotide; BTLA exon 3; Set C
gagauauauugggaucagcgg

SEQ ID NO: 51550 - RNA, 29 nt, Artificial Sequence
  Synthetic Oligonucleotide; BTLA exon 3; Set A
aaucugagauauauugggaucagcggcac

SEQ ID NO: 51551 - RNA, 28 nt, Artificial Sequence
  Synthetic Oligonucleotide; BTLA exon 3; Set A
aaucugagauauauugggaucagcggca

SEQ ID NO: 51552 - RNA, 30 nt, Artificial Sequence
  Synthetic Oligonucleotide; BTLA exon 3; Set A
aaaucugagauauauugggaucagcggcac

SEQ ID NO: 51553 - RNA, 29 nt, Artificial Sequence
  Synthetic Oligonucleotide; BTLA exon 3; Set A
aaaucugagauauauugggaucagcggca

SEQ ID NO: 51554 - RNA, 31 nt, Artificial Sequence
  Synthetic Oligonucleotide; BTLA exon 3; Set A
gaaaucugagauauauugggaucagcggcac

SEQ ID NO: 51555 - RNA, 30 nt, Artificial Sequence
  Synthetic Oligonucleotide; BTLA exon 3; Set A
gaaaucugagauauauugggaucagcggca

SEQ ID NO: 51556 - RNA, 32 nt, Artificial Sequence
  Synthetic Oligonucleotide; BTLA exon 3; Set C
ggaaaucugagauauauugggaucagcggcac

SEQ ID NO: 51557 - RNA, 31 nt, Artificial Sequence
  Synthetic Oligonucleotide; BTLA exon 3; Set C
ggaaaucugagauauauugggaucagcggca

SEQ ID NO: 51558 - RNA, 33 nt, Artificial Sequence
  Synthetic Oligonucleotide; BTLA exon 3; Set C
aggaaaucugagauauauugggaucagcggcac

SEQ ID NO: 51559 - RNA, 24 nt, Artificial Sequence
  Synthetic Oligonucleotide; BTLA exon 3; Set C
aaucugagauauauugggaucagc

SEQ ID NO: 51560 - RNA, 32 nt, Artificial Sequence
  Synthetic Oligonucleotide; BTLA exon 3; Set A
aggaaaucugagauauauugggaucagcggca

SEQ ID NO: 51561 - RNA, 34 nt, Artificial Sequence
  Synthetic Oligonucleotide; BTLA exon 3; Set C
uaggaaaucugagauauauugggaucagcggcac

SEQ ID NO: 51562 - RNA, 33 nt, Artificial Sequence
  Synthetic Oligonucleotide; BTLA exon 3; Set C
uaggaaaucugagauauauugggaucagcggca

SEQ ID NO: 51563 - RNA, 35 nt, Artificial Sequence
  Synthetic Oligonucleotide; BTLA exon 3; Set C
uuaggaaaucugagauauauugggaucagcggcac

SEQ ID NO: 51564 - RNA, 34 nt, Artificial Sequence
  Synthetic Oligonucleotide; BTLA exon 3; Set C
uuaggaaaucugagauauauugggaucagcggca

SEQ ID NO: 51565 - RNA, 36 nt, Artificial Sequence
  Synthetic Oligonucleotide; BTLA exon 3; Set C
guuaggaaaucugagauauauugggaucagcggcac

SEQ ID NO: 51566 - RNA, 27 nt, Artificial Sequence
  Synthetic Oligonucleotide; BTLA exon 3; Set A
ggaaaucugagauauauugggaucagc

SEQ ID NO: 51567 - RNA, 37 nt, Artificial Sequence
  Synthetic Oligonucleotide; BTLA exon 3; Set C
aguuaggaaaucugagauauauugggaucagcggcac

SEQ ID NO: 51568 - RNA, 28 nt, Artificial Sequence
  Synthetic Oligonucleotide; BTLA exon 3; Set A
aggaaaucugagauauauugggaucagc

SEQ ID NO: 51569 - RNA, 36 nt, Artificial Sequence
  Synthetic Oligonucleotide; BTLA exon 3; Set C
aguuaggaaaucugagauauauugggaucagcggca

SEQ ID NO: 51570 - RNA, 38 nt, Artificial Sequence
  Synthetic Oligonucleotide; BTLA exon 3; Set C
gaguuaggaaaucugagauauauugggaucagcggcac

SEQ ID NO: 51571 - RNA, 20 nt, Artificial Sequence
  Synthetic Oligonucleotide; BTLA exon 3; Set C
aaucugagauauauugggau

SEQ ID NO: 51572 - RNA, 37 nt, Artificial Sequence
  Synthetic Oligonucleotide; BTLA exon 3; Set C
gaguuaggaaaucugagauauauugggaucagcggca

SEQ ID NO: 51573 - RNA, 39 nt, Artificial Sequence
  Synthetic Oligonucleotide; BTLA exon 3; Set C
agaguuaggaaaucugagauauauugggaucagcggcac

SEQ ID NO: 51574 - RNA, 21 nt, Artificial Sequence
  Synthetic Oligonucleotide; BTLA exon 3; Set C
aaaucugagauauauugggau

SEQ ID NO: 51575 - RNA, 36 nt, Artificial Sequence
  Synthetic Oligonucleotide; BTLA exon 3; Set C
gaguuaggaaaucugagauauauugggaucagcggc

SEQ ID NO: 51576 - RNA, 38 nt, Artificial Sequence
  Synthetic Oligonucleotide; BTLA exon 3; Set C
agaguuaggaaaucugagauauauugggaucagcggca

SEQ ID NO: 51577 - RNA, 40 nt, Artificial Sequence
  Synthetic Oligonucleotide; BTLA exon 3; Set C
gagaguuaggaaaucugagauauauugggaucagcggcac

SEQ ID NO: 51578 - RNA, 22 nt, Artificial Sequence
  Synthetic Oligonucleotide; BTLA exon 3; Set C
gaaaucugagauauauugggau

SEQ ID NO: 51579 - RNA, 35 nt, Artificial Sequence
  Synthetic Oligonucleotide; BTLA exon 3; Set A
gaguuaggaaaucugagauauauugggaucagcgg

SEQ ID NO: 51580 - RNA, 37 nt, Artificial Sequence
  Synthetic Oligonucleotide; BTLA exon 3; Set C
agaguuaggaaaucugagauauauugggaucagcggc

SEQ ID NO: 51581 - RNA, 33 nt, Artificial Sequence
  Synthetic Oligonucleotide; BTLA exon 3; Set A
aguuaggaaaucugagauauauugggaucagcg

SEQ ID NO: 51582 - RNA, 39 nt, Artificial Sequence
  Synthetic Oligonucleotide; BTLA exon 3; Set C
gagaguuaggaaaucugagauauauugggaucagcggca

SEQ ID NO: 51583 - RNA, 23 nt, Artificial Sequence
  Synthetic Oligonucleotide; BTLA exon 3; Set C
ggaaaucugagauauauugggau

SEQ ID NO: 51584 - RNA, 36 nt, Artificial Sequence
  Synthetic Oligonucleotide; BTLA exon 3; Set A
agaguuaggaaaucugagauauauugggaucagcgg

SEQ ID NO: 51585 - RNA, 38 nt, Artificial Sequence
  Synthetic Oligonucleotide; BTLA exon 3; Set C
gagaguuaggaaaucugagauauauugggaucagcggc

SEQ ID NO: 51586 - RNA, 34 nt, Artificial Sequence
  Synthetic Oligonucleotide; BTLA exon 3; Set A
gaguuaggaaaucugagauauauugggaucagcg

SEQ ID NO: 51587 - RNA, 32 nt, Artificial Sequence
  Synthetic Oligonucleotide; BTLA exon 3; Set A
aguuaggaaaucugagauauauugggaucagc

SEQ ID NO: 51588 - RNA, 40 nt, Artificial Sequence
  Synthetic Oligonucleotide; BTLA exon 3; Set C
agagaguuaggaaaucugagauauauugggaucagcggca

SEQ ID NO: 51589 - RNA, 24 nt, Artificial Sequence
  Synthetic Oligonucleotide; BTLA exon 3; Set C
aggaaaucugagauauauugggau

SEQ ID NO: 51590 - RNA, 37 nt, Artificial Sequence
  Synthetic Oligonucleotide; BTLA exon 3; Set A
gagaguuaggaaaucugagauauauugggaucagcgg

SEQ ID NO: 51591 - RNA, 39 nt, Artificial Sequence
  Synthetic Oligonucleotide; BTLA exon 3; Set C
agagaguuaggaaaucugagauauauugggaucagcggc

SEQ ID NO: 51592 - RNA, 35 nt, Artificial Sequence
  Synthetic Oligonucleotide; BTLA exon 3; Set A
agaguuaggaaaucugagauauauugggaucagcg

SEQ ID NO: 51593 - RNA, 33 nt, Artificial Sequence
  Synthetic Oligonucleotide; BTLA exon 3; Set A
gaguuaggaaaucugagauauauugggaucagc

SEQ ID NO: 51594 - RNA, 25 nt, Artificial Sequence
  Synthetic Oligonucleotide; BTLA exon 3; Set C
uaggaaaucugagauauauugggau

SEQ ID NO: 51595 - RNA, 38 nt, Artificial Sequence
  Synthetic Oligonucleotide; BTLA exon 3; Set A
agagaguuaggaaaucugagauauauugggaucagcgg

SEQ ID NO: 51596 - RNA, 36 nt, Artificial Sequence
  Synthetic Oligonucleotide; BTLA exon 3; Set A
gagaguuaggaaaucugagauauauugggaucagcg

SEQ ID NO: 51597 - RNA, 34 nt, Artificial Sequence
  Synthetic Oligonucleotide; BTLA exon 3; Set A
agaguuaggaaaucugagauauauugggaucagc

SEQ ID NO: 51598 - RNA, 26 nt, Artificial Sequence
  Synthetic Oligonucleotide; BTLA exon 3; Set C
uuaggaaaucugagauauauugggau

SEQ ID NO: 51599 - RNA, 37 nt, Artificial Sequence
  Synthetic Oligonucleotide; BTLA exon 3; Set A
agagaguuaggaaaucugagauauauugggaucagcg

SEQ ID NO: 51600 - RNA, 35 nt, Artificial Sequence
  Synthetic Oligonucleotide; BTLA exon 3; Set A
gagaguuaggaaaucugagauauauugggaucagc

SEQ ID NO: 51601 - RNA, 27 nt, Artificial Sequence
  Synthetic Oligonucleotide; BTLA exon 3; Set C
guuaggaaaucugagauauauugggau

SEQ ID NO: 51602 - RNA, 38 nt, Artificial Sequence
  Synthetic Oligonucleotide; BTLA exon 3; Set A
aagagaguuaggaaaucugagauauauugggaucagcg

SEQ ID NO: 51603 - RNA, 36 nt, Artificial Sequence
  Synthetic Oligonucleotide; BTLA exon 3; Set A
agagaguuaggaaaucugagauauauugggaucagc

SEQ ID NO: 51604 - RNA, 28 nt, Artificial Sequence
  Synthetic Oligonucleotide; BTLA exon 3; Set C
aguuaggaaaucugagauauauugggau

SEQ ID NO: 51605 - RNA, 37 nt, Artificial Sequence
  Synthetic Oligonucleotide; BTLA exon 3; Set A
aagagaguuaggaaaucugagauauauugggaucagc

SEQ ID NO: 51606 - RNA, 28 nt, Artificial Sequence
  Synthetic Oligonucleotide; BTLA exon 3; Set C
gaguuaggaaaucugagauauauuggga

SEQ ID NO: 51607 - RNA, 27 nt, Artificial Sequence
  Synthetic Oligonucleotide; BTLA exon 3; Set C
gaguuaggaaaucugagauauauuggg

SEQ ID NO: 51608 - RNA, 29 nt, Artificial Sequence
  Synthetic Oligonucleotide; BTLA exon 3; Set C
agaguuaggaaaucugagauauauuggga

SEQ ID NO: 51609 - RNA, 26 nt, Artificial Sequence
  Synthetic Oligonucleotide; BTLA exon 3; Set C
gaguuaggaaaucugagauauauugg

SEQ ID NO: 51610 - RNA, 28 nt, Artificial Sequence
  Synthetic Oligonucleotide; BTLA exon 3; Set C
agaguuaggaaaucugagauauauuggg

SEQ ID NO: 51611 - RNA, 30 nt, Artificial Sequence
  Synthetic Oligonucleotide; BTLA exon 3; Set A
gagaguuaggaaaucugagauauauuggga

SEQ ID NO: 51612 - RNA, 29 nt, Artificial Sequence
  Synthetic Oligonucleotide; BTLA exon 3; Set C
gagaguuaggaaaucugagauauauuggg

SEQ ID NO: 51613 - RNA, 25 nt, Artificial Sequence
  Synthetic Oligonucleotide; BTLA exon 3; Set C
gaguuaggaaaucugagauauauug

SEQ ID NO: 51614 - RNA, 27 nt, Artificial Sequence
  Synthetic Oligonucleotide; BTLA exon 3; Set C
agaguuaggaaaucugagauauauugg

SEQ ID NO: 51615 - RNA, 31 nt, Artificial Sequence
  Synthetic Oligonucleotide; BTLA exon 3; Set A
agagaguuaggaaaucugagauauauuggga

SEQ ID NO: 51616 - RNA, 33 nt, Artificial Sequence
  Synthetic Oligonucleotide; BTLA exon 3; Set A
aagagaguuaggaaaucugagauauauugggau

SEQ ID NO: 51617 - RNA, 24 nt, Artificial Sequence
  Synthetic Oligonucleotide; BTLA exon 3; Set C
gaguuaggaaaucugagauauauu

SEQ ID NO: 51618 - RNA, 30 nt, Artificial Sequence
  Synthetic Oligonucleotide; BTLA exon 3; Set C
agagaguuaggaaaucugagauauauuggg

SEQ ID NO: 51619 - RNA, 28 nt, Artificial Sequence
  Synthetic Oligonucleotide; BTLA exon 3; Set C
gagaguuaggaaaucugagauauauugg

SEQ ID NO: 51620 - RNA, 26 nt, Artificial Sequence
  Synthetic Oligonucleotide; BTLA exon 3; Set C
agaguuaggaaaucugagauauauug

SEQ ID NO: 51621 - RNA, 34 nt, Artificial Sequence
  Synthetic Oligonucleotide; BTLA exon 3; Set A
aaagagaguuaggaaaucugagauauauugggau

SEQ ID NO: 51622 - RNA, 23 nt, Artificial Sequence
  Synthetic Oligonucleotide; BTLA exon 3; Set C
gaguuaggaaaucugagauauau

SEQ ID NO: 51623 - RNA, 25 nt, Artificial Sequence
  Synthetic Oligonucleotide; BTLA exon 3; Set C
agaguuaggaaaucugagauauauu

SEQ ID NO: 51624 - RNA, 29 nt, Artificial Sequence
  Synthetic Oligonucleotide; BTLA exon 3; Set C
agagaguuaggaaaucugagauauauugg

SEQ ID NO: 51625 - RNA, 27 nt, Artificial Sequence
  Synthetic Oligonucleotide; BTLA exon 3; Set C
gagaguuaggaaaucugagauauauug

SEQ ID NO: 51626 - RNA, 35 nt, Artificial Sequence
  Synthetic Oligonucleotide; BTLA exon 3; Set A
uaaagagaguuaggaaaucugagauauauugggau

SEQ ID NO: 51627 - RNA, 26 nt, Artificial Sequence
  Synthetic Oligonucleotide; BTLA exon 3; Set C
gagaguuaggaaaucugagauauauu

SEQ ID NO: 51628 - RNA, 22 nt, Artificial Sequence
  Synthetic Oligonucleotide; BTLA exon 3; Set C
gaguuaggaaaucugagauaua

SEQ ID NO: 51629 - RNA, 24 nt, Artificial Sequence
  Synthetic Oligonucleotide; BTLA exon 3; Set C
agaguuaggaaaucugagauauau

SEQ ID NO: 51630 - RNA, 28 nt, Artificial Sequence
  Synthetic Oligonucleotide; BTLA exon 3; Set C
agagaguuaggaaaucugagauauauug

SEQ ID NO: 51631 - RNA, 27 nt, Artificial Sequence
  Synthetic Oligonucleotide; BTLA exon 3; Set C
agagaguuaggaaaucugagauauauu

SEQ ID NO: 51632 - RNA, 25 nt, Artificial Sequence
  Synthetic Oligonucleotide; BTLA exon 3; Set C
gagaguuaggaaaucugagauauau

SEQ ID NO: 51633 - RNA, 21 nt, Artificial Sequence
  Synthetic Oligonucleotide; BTLA exon 3; Set C
gaguuaggaaaucugagauau

SEQ ID NO: 51634 - RNA, 23 nt, Artificial Sequence
  Synthetic Oligonucleotide; BTLA exon 3; Set C
agaguuaggaaaucugagauaua

SEQ ID NO: 51635 - RNA, 26 nt, Artificial Sequence
  Synthetic Oligonucleotide; BTLA exon 3; Set C
agagaguuaggaaaucugagauauau

SEQ ID NO: 51636 - RNA, 24 nt, Artificial Sequence
  Synthetic Oligonucleotide; BTLA exon 3; Set C
gagaguuaggaaaucugagauaua

SEQ ID NO: 51637 - RNA, 20 nt, Artificial Sequence
  Synthetic Oligonucleotide; BTLA exon 3; Set C
gaguuaggaaaucugagaua

SEQ ID NO: 51638 - RNA, 22 nt, Artificial Sequence
  Synthetic Oligonucleotide; BTLA exon 3; Set C
agaguuaggaaaucugagauau

SEQ ID NO: 51639 - RNA, 16 nt, Artificial Sequence
  Synthetic Oligonucleotide; BTLA exon 3; Set C
guuaggaaaucugaga

SEQ ID NO: 51640 - RNA, 25 nt, Artificial Sequence
  Synthetic Oligonucleotide; BTLA exon 3; Set C
agagaguuaggaaaucugagauaua

SEQ ID NO: 51641 - RNA, 23 nt, Artificial Sequence
  Synthetic Oligonucleotide; BTLA exon 3; Set C
gagaguuaggaaaucugagauau

SEQ ID NO: 51642 - RNA, 19 nt, Artificial Sequence
  Synthetic Oligonucleotide; BTLA exon 3; Set C
gaguuaggaaaucugagau

SEQ ID NO: 51643 - RNA, 21 nt, Artificial Sequence
  Synthetic Oligonucleotide; BTLA exon 3; Set C
agaguuaggaaaucugagaua

SEQ ID NO: 51644 - RNA, 24 nt, Artificial Sequence
  Synthetic Oligonucleotide; BTLA exon 3; Set C
agagaguuaggaaaucugagauau

SEQ ID NO: 51645 - RNA, 22 nt, Artificial Sequence
  Synthetic Oligonucleotide; BTLA exon 3; Set C
gagaguuaggaaaucugagaua

SEQ ID NO: 51646 - RNA, 20 nt, Artificial Sequence
  Synthetic Oligonucleotide; BTLA exon 3; Set C
agaguuaggaaaucugagau

SEQ ID NO: 51647 - RNA, 23 nt, Artificial Sequence
  Synthetic Oligonucleotide; BTLA exon 3; Set C
agagaguuaggaaaucugagaua

SEQ ID NO: 51648 - RNA, 21 nt, Artificial Sequence
  Synthetic Oligonucleotide; BTLA exon 3; Set C
gagaguuaggaaaucugagau

SEQ ID NO: 51649 - RNA, 22 nt, Artificial Sequence
  Synthetic Oligonucleotide; BTLA exon 3; Set C
agagaguuaggaaaucugagau

SEQ ID NO: 51650 - RNA, 40 nt, Artificial Sequence
  Synthetic Oligonucleotide; BTLA exon 3; Set A
guaaaugcuaaagagaguuaggaaaucugagauauauugg

SEQ ID NO: 51651 - RNA, 39 nt, Artificial Sequence
  Synthetic Oligonucleotide; BTLA exon 3; Set A
guaaaugcuaaagagaguuaggaaaucugagauauauug

SEQ ID NO: 51652 - RNA, 38 nt, Artificial Sequence
  Synthetic Oligonucleotide; BTLA exon 3; Set C
guaaaugcuaaagagaguuaggaaaucugagauauauu

SEQ ID NO: 51653 - RNA, 37 nt, Artificial Sequence
  Synthetic Oligonucleotide; BTLA exon 3; Set C
guaaaugcuaaagagaguuaggaaaucugagauauau

SEQ ID NO: 51654 - RNA, 36 nt, Artificial Sequence
  Synthetic Oligonucleotide; BTLA exon 3; Set C
guaaaugcuaaagagaguuaggaaaucugagauaua

SEQ ID NO: 51655 - RNA, 35 nt, Artificial Sequence
  Synthetic Oligonucleotide; BTLA exon 3; Set C
guaaaugcuaaagagaguuaggaaaucugagauau

SEQ ID NO: 51656 - RNA, 34 nt, Artificial Sequence
  Synthetic Oligonucleotide; BTLA exon 3; Set C
guaaaugcuaaagagaguuaggaaaucugagaua

SEQ ID NO: 51657 - RNA, 33 nt, Artificial Sequence
  Synthetic Oligonucleotide; BTLA exon 3; Set C
guaaaugcuaaagagaguuaggaaaucugagau

SEQ ID NO: 51658 - RNA, 26 nt, Artificial Sequence
  Synthetic Oligonucleotide; BTLA exon 3; Set C
guaaaugcuaaagagaguuaggaaau

SEQ ID NO: 51659 - RNA, 25 nt, Artificial Sequence
  Synthetic Oligonucleotide; BTLA exon 3; Set C
guaaaugcuaaagagaguuaggaaa

SEQ ID NO: 51660 - RNA, 24 nt, Artificial Sequence
  Synthetic Oligonucleotide; BTLA exon 3; Set C
guaaaugcuaaagagaguuaggaa

SEQ ID NO: 51661 - RNA, 23 nt, Artificial Sequence
  Synthetic Oligonucleotide; BTLA exon 3; Set C
guaaaugcuaaagagaguuagga

SEQ ID NO: 51662 - RNA, 22 nt, Artificial Sequence
  Synthetic Oligonucleotide; BTLA exon 3; Set C
guaaaugcuaaagagaguuagg

SEQ ID NO: 51663 - RNA, 21 nt, Artificial Sequence
  Synthetic Oligonucleotide; BTLA exon 3; Set C
guaaaugcuaaagagaguuag

SEQ ID NO: 51664 - RNA, 20 nt, Artificial Sequence
  Synthetic Oligonucleotide; BTLA exon 3; Set C
guaaaugcuaaagagaguua

SEQ ID NO: 51665 - RNA, 19 nt, Artificial Sequence
  Synthetic Oligonucleotide; BTLA exon 3; Set C
guaaaugcuaaagagaguu

SEQ ID NO: 51666 - RNA, 18 nt, Artificial Sequence
  Synthetic Oligonucleotide; BTLA exon 3; Set C
guaaaugcuaaagagagu

SEQ ID NO: 51667 - RNA, 35 nt, Artificial Sequence
  Synthetic Oligonucleotide; BTLA exon 3; Set C
ggaauguuaguaaaugcuaaagagaguuaggaaau

SEQ ID NO: 51668 - RNA, 19 nt, Artificial Sequence
  Synthetic Oligonucleotide; BTLA exon 3; Set C
aguaaaugcuaaagagagu

SEQ ID NO: 51669 - RNA, 34 nt, Artificial Sequence
  Synthetic Oligonucleotide; BTLA exon 3; Set C
ggaauguuaguaaaugcuaaagagaguuaggaaa

SEQ ID NO: 51670 - RNA, 20 nt, Artificial Sequence
  Synthetic Oligonucleotide; BTLA exon 3; Set C
uaguaaaugcuaaagagagu

SEQ ID NO: 51671 - RNA, 18 nt, Artificial Sequence
  Synthetic Oligonucleotide; BTLA exon 3; Set C
aguaaaugcuaaagagag

SEQ ID NO: 51672 - RNA, 33 nt, Artificial Sequence
  Synthetic Oligonucleotide; BTLA exon 3; Set C
ggaauguuaguaaaugcuaaagagaguuaggaa

SEQ ID NO: 51673 - RNA, 19 nt, Artificial Sequence
  Synthetic Oligonucleotide; BTLA exon 3; Set C
uaguaaaugcuaaagagag

SEQ ID NO: 51674 - RNA, 17 nt, Artificial Sequence
  Synthetic Oligonucleotide; BTLA exon 3; Set C
aguaaaugcuaaagaga

SEQ ID NO: 51675 - RNA, 32 nt, Artificial Sequence
  Synthetic Oligonucleotide; BTLA exon 3; Set C
ggaauguuaguaaaugcuaaagagaguuagga

SEQ ID NO: 51676 - RNA, 16 nt, Artificial Sequence
  Synthetic Oligonucleotide; BTLA exon 3; Set C
aguaaaugcuaaagag

SEQ ID NO: 51677 - RNA, 18 nt, Artificial Sequence
  Synthetic Oligonucleotide; BTLA exon 3; Set C
uaguaaaugcuaaagaga

SEQ ID NO: 51678 - RNA, 31 nt, Artificial Sequence
  Synthetic Oligonucleotide; BTLA exon 3; Set C
ggaauguuaguaaaugcuaaagagaguuagg

SEQ ID NO: 51679 - RNA, 17 nt, Artificial Sequence
  Synthetic Oligonucleotide; BTLA exon 3; Set C
uaguaaaugcuaaagag

SEQ ID NO: 51680 - RNA, 15 nt, Artificial Sequence
  Synthetic Oligonucleotide; BTLA exon 3; Set C
aguaaaugcuaaaga

SEQ ID NO: 51681 - RNA, 30 nt, Artificial Sequence
  Synthetic Oligonucleotide; BTLA exon 3; Set C
ggaauguuaguaaaugcuaaagagaguuag

SEQ ID NO: 51682 - RNA, 16 nt, Artificial Sequence
  Synthetic Oligonucleotide; BTLA exon 3; Set C
uaguaaaugcuaaaga

SEQ ID NO: 51683 - RNA, 31 nt, Artificial Sequence
  Synthetic Oligonucleotide; BTLA exon 3; Set C
uggaauguuaguaaaugcuaaagagaguuag

SEQ ID NO: 51684 - RNA, 29 nt, Artificial Sequence
  Synthetic Oligonucleotide; BTLA exon 3; Set C
ggaauguuaguaaaugcuaaagagaguua

SEQ ID NO: 51685 - RNA, 15 nt, Artificial Sequence
  Synthetic Oligonucleotide; BTLA exon 3; Set C
uaguaaaugcuaaag

SEQ ID NO: 51686 - RNA, 28 nt, Artificial Sequence
  Synthetic Oligonucleotide; BTLA exon 3; Set C
ggaauguuaguaaaugcuaaagagaguu

SEQ ID NO: 51687 - RNA, 30 nt, Artificial Sequence
  Synthetic Oligonucleotide; BTLA exon 3; Set C
uggaauguuaguaaaugcuaaagagaguua

SEQ ID NO: 51688 - RNA, 29 nt, Artificial Sequence
  Synthetic Oligonucleotide; BTLA exon 3; Set C
uggaauguuaguaaaugcuaaagagaguu

SEQ ID NO: 51689 - RNA, 27 nt, Artificial Sequence
  Synthetic Oligonucleotide; BTLA exon 3; Set C
ggaauguuaguaaaugcuaaagagagu

SEQ ID NO: 51690 - RNA, 28 nt, Artificial Sequence
  Synthetic Oligonucleotide; BTLA exon 3; Set C
uggaauguuaguaaaugcuaaagagagu

SEQ ID NO: 51691 - RNA, 27 nt, Artificial Sequence
  Synthetic Oligonucleotide; BTLA exon 3; Set C
uggaauguuaguaaaugcuaaagagag

SEQ ID NO: 51692 - RNA, 26 nt, Artificial Sequence
  Synthetic Oligonucleotide; BTLA exon 3; Set C
uggaauguuaguaaaugcuaaagaga

SEQ ID NO: 51693 - RNA, 25 nt, Artificial Sequence
  Synthetic Oligonucleotide; BTLA exon 3; Set C
uggaauguuaguaaaugcuaaagag

SEQ ID NO: 51694 - RNA, 40 nt, Artificial Sequence
  Synthetic Oligonucleotide; BTLA exon 3; Set A
uuuacaucuggaauguuaguaaaugcuaaagagaguuagg

SEQ ID NO: 51695 - RNA, 24 nt, Artificial Sequence
  Synthetic Oligonucleotide; BTLA exon 3; Set C
uggaauguuaguaaaugcuaaaga

SEQ ID NO: 51696 - RNA, 39 nt, Artificial Sequence
  Synthetic Oligonucleotide; BTLA exon 3; Set A
uuuacaucuggaauguuaguaaaugcuaaagagaguuag

SEQ ID NO: 51697 - RNA, 21 nt, Artificial Sequence
  Synthetic Oligonucleotide; BTLA exon 3; Set C
ggaauguuaguaaaugcuaaa

SEQ ID NO: 51698 - RNA, 23 nt, Artificial Sequence
  Synthetic Oligonucleotide; BTLA exon 3; Set C
uggaauguuaguaaaugcuaaag

SEQ ID NO: 51699 - RNA, 38 nt, Artificial Sequence
  Synthetic Oligonucleotide; BTLA exon 3; Set A
uuuacaucuggaauguuaguaaaugcuaaagagaguua

SEQ ID NO: 51700 - RNA, 20 nt, Artificial Sequence
  Synthetic Oligonucleotide; BTLA exon 3; Set C
ggaauguuaguaaaugcuaa

SEQ ID NO: 51701 - RNA, 22 nt, Artificial Sequence
  Synthetic Oligonucleotide; BTLA exon 3; Set C
uggaauguuaguaaaugcuaaa

SEQ ID NO: 51702 - RNA, 37 nt, Artificial Sequence
  Synthetic Oligonucleotide; BTLA exon 3; Set A
uuuacaucuggaauguuaguaaaugcuaaagagaguu

SEQ ID NO: 51703 - RNA, 21 nt, Artificial Sequence
  Synthetic Oligonucleotide; BTLA exon 3; Set C
uggaauguuaguaaaugcuaa

SEQ ID NO: 51704 - RNA, 36 nt, Artificial Sequence
  Synthetic Oligonucleotide; BTLA exon 3; Set A
uuuacaucuggaauguuaguaaaugcuaaagagagu

SEQ ID NO: 51705 - RNA, 30 nt, Artificial Sequence
  Synthetic Oligonucleotide; BTLA exon 3; Set C
uuuacaucuggaauguuaguaaaugcuaaa

SEQ ID NO: 51706 - RNA, 29 nt, Artificial Sequence
  Synthetic Oligonucleotide; BTLA exon 3; Set C
uuuacaucuggaauguuaguaaaugcuaa

SEQ ID NO: 51707 - RNA, 20 nt, Artificial Sequence
  Synthetic Oligonucleotide; BTLA exon 3; Set C
uuuacaucuggaauguuagu

SEQ ID NO: 51708 - RNA, 19 nt, Artificial Sequence
  Synthetic Oligonucleotide; BTLA exon 3; Set C
uuuacaucuggaauguuag

SEQ ID NO: 51709 - RNA, 18 nt, Artificial Sequence
  Synthetic Oligonucleotide; BTLA exon 3; Set C
cguucugaggcacuuuuu

SEQ ID NO: 51710 - RNA, 19 nt, Artificial Sequence
  Synthetic Oligonucleotide; BTLA exon 3; Set C
ucguucugaggcacuuuuu

SEQ ID NO: 51711 - RNA, 15 nt, Artificial Sequence
  Synthetic Oligonucleotide; BTLA exon 3; Set C
agugaugaguagagg

SEQ ID NO: 51712 - RNA, 40 nt, Artificial Sequence
  Synthetic Oligonucleotide; BTLA exon 3; Set C
cucaggcagcagaacaggcagaaacagguagugaugagua

SEQ ID NO: 51713 - RNA, 39 nt, Artificial Sequence
  Synthetic Oligonucleotide; BTLA exon 3; Set C
cucaggcagcagaacaggcagaaacagguagugaugagu

SEQ ID NO: 51714 - RNA, 38 nt, Artificial Sequence
  Synthetic Oligonucleotide; BTLA exon 3; Set C
cucaggcagcagaacaggcagaaacagguagugaugag

SEQ ID NO: 51715 - RNA, 40 nt, Artificial Sequence
  Synthetic Oligonucleotide; BTLA exon 3; Set C
ucucaggcagcagaacaggcagaaacagguagugaugagu

SEQ ID NO: 51716 - RNA, 39 nt, Artificial Sequence
  Synthetic Oligonucleotide; BTLA exon 3; Set C
ucucaggcagcagaacaggcagaaacagguagugaugag

SEQ ID NO: 51717 - RNA, 37 nt, Artificial Sequence
  Synthetic Oligonucleotide; BTLA exon 3; Set C
cucaggcagcagaacaggcagaaacagguagugauga

SEQ ID NO: 51718 - RNA, 38 nt, Artificial Sequence
  Synthetic Oligonucleotide; BTLA exon 3; Set C
ucucaggcagcagaacaggcagaaacagguagugauga

SEQ ID NO: 51719 - RNA, 36 nt, Artificial Sequence
  Synthetic Oligonucleotide; BTLA exon 3; Set C
cucaggcagcagaacaggcagaaacagguagugaug

SEQ ID NO: 51720 - RNA, 37 nt, Artificial Sequence
  Synthetic Oligonucleotide; BTLA exon 3; Set C
ucucaggcagcagaacaggcagaaacagguagugaug

SEQ ID NO: 51721 - RNA, 35 nt, Artificial Sequence
  Synthetic Oligonucleotide; BTLA exon 3; Set C
cucaggcagcagaacaggcagaaacagguagugau

SEQ ID NO: 51722 - RNA, 36 nt, Artificial Sequence
  Synthetic Oligonucleotide; BTLA exon 3; Set C
ucucaggcagcagaacaggcagaaacagguagugau

SEQ ID NO: 51723 - RNA, 33 nt, Artificial Sequence
  Synthetic Oligonucleotide; BTLA exon 3; Set C
cucaggcagcagaacaggcagaaacagguagug

SEQ ID NO: 51724 - RNA, 35 nt, Artificial Sequence
  Synthetic Oligonucleotide; BTLA exon 3; Set C
ucucaggcagcagaacaggcagaaacagguaguga

SEQ ID NO: 51725 - RNA, 34 nt, Artificial Sequence
  Synthetic Oligonucleotide; BTLA exon 3; Set C
ucucaggcagcagaacaggcagaaacagguagug

SEQ ID NO: 51726 - RNA, 32 nt, Artificial Sequence
  Synthetic Oligonucleotide; BTLA exon 3; Set C
ucucaggcagcagaacaggcagaaacagguag

SEQ ID NO: 51727 - RNA, 30 nt, Artificial Sequence
  Synthetic Oligonucleotide; BTLA exon 3; Set C
ucucaggcagcagaacaggcagaaacaggu

SEQ ID NO: 51728 - RNA, 33 nt, Artificial Sequence
  Synthetic Oligonucleotide; BTLA exon 3; Set C
gagggaaaauagaacccaccuuggugccuucuc

SEQ ID NO: 51729 - RNA, 32 nt, Artificial Sequence
  Synthetic Oligonucleotide; BTLA exon 3; Set C
gagggaaaauagaacccaccuuggugccuucu

SEQ ID NO: 51730 - RNA, 34 nt, Artificial Sequence
  Synthetic Oligonucleotide; BTLA exon 3; Set C
agagggaaaauagaacccaccuuggugccuucuc

SEQ ID NO: 51731 - RNA, 33 nt, Artificial Sequence
  Synthetic Oligonucleotide; BTLA exon 3; Set C
agagggaaaauagaacccaccuuggugccuucu

SEQ ID NO: 51732 - RNA, 22 nt, Artificial Sequence
  Synthetic Oligonucleotide; BTLA exon 3; Set C
gagggaaaauagaacccaccuu

SEQ ID NO: 51733 - RNA, 23 nt, Artificial Sequence
  Synthetic Oligonucleotide; BTLA exon 3; Set C
agagggaaaauagaacccaccuu

SEQ ID NO: 51734 - RNA, 25 nt, Artificial Sequence
  Synthetic Oligonucleotide; BTLA exon 3; Set B
guacugggggcagagggaaaauaga

SEQ ID NO: 51735 - RNA, 24 nt, Artificial Sequence
  Synthetic Oligonucleotide; BTLA exon 3; Set B
guacugggggcagagggaaaauag

SEQ ID NO: 51736 - RNA, 26 nt, Artificial Sequence
  Synthetic Oligonucleotide; BTLA exon 3; Set B
gguacugggggcagagggaaaauaga

SEQ ID NO: 51737 - RNA, 23 nt, Artificial Sequence
  Synthetic Oligonucleotide; BTLA exon 3; Set B
guacugggggcagagggaaaaua

SEQ ID NO: 51738 - RNA, 25 nt, Artificial Sequence
  Synthetic Oligonucleotide; BTLA exon 3; Set B
gguacugggggcagagggaaaauag

SEQ ID NO: 51739 - RNA, 27 nt, Artificial Sequence
  Synthetic Oligonucleotide; BTLA exon 3; Set B
ugguacugggggcagagggaaaauaga

SEQ ID NO: 51740 - RNA, 22 nt, Artificial Sequence
  Synthetic Oligonucleotide; BTLA exon 3; Set B
guacugggggcagagggaaaau

SEQ ID NO: 51741 - RNA, 24 nt, Artificial Sequence
  Synthetic Oligonucleotide; BTLA exon 3; Set B
gguacugggggcagagggaaaaua

SEQ ID NO: 51742 - RNA, 26 nt, Artificial Sequence
  Synthetic Oligonucleotide; BTLA exon 3; Set B
ugguacugggggcagagggaaaauag

SEQ ID NO: 51743 - RNA, 28 nt, Artificial Sequence
  Synthetic Oligonucleotide; BTLA exon 3; Set C
gugguacugggggcagagggaaaauaga

SEQ ID NO: 51744 - RNA, 21 nt, Artificial Sequence
  Synthetic Oligonucleotide; BTLA exon 3; Set B
guacugggggcagagggaaaa

SEQ ID NO: 51745 - RNA, 23 nt, Artificial Sequence
  Synthetic Oligonucleotide; BTLA exon 3; Set B
gguacugggggcagagggaaaau

SEQ ID NO: 51746 - RNA, 29 nt, Artificial Sequence
  Synthetic Oligonucleotide; BTLA exon 3; Set C
ugugguacugggggcagagggaaaauaga

SEQ ID NO: 51747 - RNA, 25 nt, Artificial Sequence
  Synthetic Oligonucleotide; BTLA exon 3; Set B
ugguacugggggcagagggaaaaua

SEQ ID NO: 51748 - RNA, 27 nt, Artificial Sequence
  Synthetic Oligonucleotide; BTLA exon 3; Set B
gugguacugggggcagagggaaaauag

SEQ ID NO: 51749 - RNA, 20 nt, Artificial Sequence
  Synthetic Oligonucleotide; BTLA exon 3; Set B
guacugggggcagagggaaa

SEQ ID NO: 51750 - RNA, 22 nt, Artificial Sequence
  Synthetic Oligonucleotide; BTLA exon 3; Set B
gguacugggggcagagggaaaa

SEQ ID NO: 51751 - RNA, 24 nt, Artificial Sequence
  Synthetic Oligonucleotide; BTLA exon 3; Set B
ugguacugggggcagagggaaaau

SEQ ID NO: 51752 - RNA, 30 nt, Artificial Sequence
  Synthetic Oligonucleotide; BTLA exon 3; Set C
gugugguacugggggcagagggaaaauaga

SEQ ID NO: 51753 - RNA, 28 nt, Artificial Sequence
  Synthetic Oligonucleotide; BTLA exon 3; Set B
ugugguacugggggcagagggaaaauag

SEQ ID NO: 51754 - RNA, 26 nt, Artificial Sequence
  Synthetic Oligonucleotide; BTLA exon 3; Set B
gugguacugggggcagagggaaaaua

SEQ ID NO: 51755 - RNA, 21 nt, Artificial Sequence
  Synthetic Oligonucleotide; BTLA exon 3; Set B
gguacugggggcagagggaaa

SEQ ID NO: 51756 - RNA, 23 nt, Artificial Sequence
  Synthetic Oligonucleotide; BTLA exon 3; Set B
ugguacugggggcagagggaaaa

SEQ ID NO: 51757 - RNA, 25 nt, Artificial Sequence
  Synthetic Oligonucleotide; BTLA exon 3; Set B
gugguacugggggcagagggaaaau

SEQ ID NO: 51758 - RNA, 19 nt, Artificial Sequence
  Synthetic Oligonucleotide; BTLA exon 3; Set B
guacugggggcagagggaa

SEQ ID NO: 51759 - RNA, 29 nt, Artificial Sequence
  Synthetic Oligonucleotide; BTLA exon 3; Set C
gugugguacugggggcagagggaaaauag

SEQ ID NO: 51760 - RNA, 27 nt, Artificial Sequence
  Synthetic Oligonucleotide; BTLA exon 3; Set C
ugugguacugggggcagagggaaaaua

SEQ ID NO: 51761 - RNA, 31 nt, Artificial Sequence
  Synthetic Oligonucleotide; BTLA exon 3; Set C
ugugugguacugggggcagagggaaaauaga

SEQ ID NO: 51762 - RNA, 22 nt, Artificial Sequence
  Synthetic Oligonucleotide; BTLA exon 3; Set B
ugguacugggggcagagggaaa

SEQ ID NO: 51763 - RNA, 24 nt, Artificial Sequence
  Synthetic Oligonucleotide; BTLA exon 3; Set B
gugguacugggggcagagggaaaa

SEQ ID NO: 51764 - RNA, 26 nt, Artificial Sequence
  Synthetic Oligonucleotide; BTLA exon 3; Set B
ugugguacugggggcagagggaaaau

SEQ ID NO: 51765 - RNA, 20 nt, Artificial Sequence
  Synthetic Oligonucleotide; BTLA exon 3; Set B
gguacugggggcagagggaa

SEQ ID NO: 51766 - RNA, 28 nt, Artificial Sequence
  Synthetic Oligonucleotide; BTLA exon 3; Set C
gugugguacugggggcagagggaaaaua

SEQ ID NO: 51767 - RNA, 30 nt, Artificial Sequence
  Synthetic Oligonucleotide; BTLA exon 3; Set C
ugugugguacugggggcagagggaaaauag

SEQ ID NO: 51768 - RNA, 32 nt, Artificial Sequence
  Synthetic Oligonucleotide; BTLA exon 3; Set C
augugugguacugggggcagagggaaaauaga

SEQ ID NO: 51769 - RNA, 18 nt, Artificial Sequence
  Synthetic Oligonucleotide; BTLA exon 3; Set B
guacugggggcagaggga

SEQ ID NO: 51770 - RNA, 25 nt, Artificial Sequence
  Synthetic Oligonucleotide; BTLA exon 3; Set C
ugugguacugggggcagagggaaaa

SEQ ID NO: 51771 - RNA, 23 nt, Artificial Sequence
  Synthetic Oligonucleotide; BTLA exon 3; Set C
gugguacugggggcagagggaaa

SEQ ID NO: 51772 - RNA, 27 nt, Artificial Sequence
  Synthetic Oligonucleotide; BTLA exon 3; Set C
gugugguacugggggcagagggaaaau

SEQ ID NO: 51773 - RNA, 21 nt, Artificial Sequence
  Synthetic Oligonucleotide; BTLA exon 3; Set B
ugguacugggggcagagggaa

SEQ ID NO: 51774 - RNA, 29 nt, Artificial Sequence
  Synthetic Oligonucleotide; BTLA exon 3; Set C
ugugugguacugggggcagagggaaaaua

SEQ ID NO: 51775 - RNA, 31 nt, Artificial Sequence
  Synthetic Oligonucleotide; BTLA exon 3; Set C
augugugguacugggggcagagggaaaauag

SEQ ID NO: 51776 - RNA, 33 nt, Artificial Sequence
  Synthetic Oligonucleotide; BTLA exon 3; Set C
aaugugugguacugggggcagagggaaaauaga

SEQ ID NO: 51777 - RNA, 26 nt, Artificial Sequence
  Synthetic Oligonucleotide; BTLA exon 3; Set C
gugugguacugggggcagagggaaaa

SEQ ID NO: 51778 - RNA, 24 nt, Artificial Sequence
  Synthetic Oligonucleotide; BTLA exon 3; Set C
ugugguacugggggcagagggaaa

SEQ ID NO: 51779 - RNA, 28 nt, Artificial Sequence
  Synthetic Oligonucleotide; BTLA exon 3; Set C
ugugugguacugggggcagagggaaaau

SEQ ID NO: 51780 - RNA, 22 nt, Artificial Sequence
  Synthetic Oligonucleotide; BTLA exon 3; Set C
gugguacugggggcagagggaa

SEQ ID NO: 51781 - RNA, 30 nt, Artificial Sequence
  Synthetic Oligonucleotide; BTLA exon 3; Set C
augugugguacugggggcagagggaaaaua

SEQ ID NO: 51782 - RNA, 32 nt, Artificial Sequence
  Synthetic Oligonucleotide; BTLA exon 3; Set C
aaugugugguacugggggcagagggaaaauag

SEQ ID NO: 51783 - RNA, 34 nt, Artificial Sequence
  Synthetic Oligonucleotide; BTLA exon 3; Set C
aaaugugugguacugggggcagagggaaaauaga

SEQ ID NO: 51784 - RNA, 25 nt, Artificial Sequence
  Synthetic Oligonucleotide; BTLA exon 3; Set C
gugugguacugggggcagagggaaa

SEQ ID NO: 51785 - RNA, 27 nt, Artificial Sequence
  Synthetic Oligonucleotide; BTLA exon 3; Set C
ugugugguacugggggcagagggaaaa

SEQ ID NO: 51786 - RNA, 29 nt, Artificial Sequence
  Synthetic Oligonucleotide; BTLA exon 3; Set C
augugugguacugggggcagagggaaaau

SEQ ID NO: 51787 - RNA, 23 nt, Artificial Sequence
  Synthetic Oligonucleotide; BTLA exon 3; Set C
ugugguacugggggcagagggaa

SEQ ID NO: 51788 - RNA, 31 nt, Artificial Sequence
  Synthetic Oligonucleotide; BTLA exon 3; Set C
aaugugugguacugggggcagagggaaaaua

SEQ ID NO: 51789 - RNA, 33 nt, Artificial Sequence
  Synthetic Oligonucleotide; BTLA exon 3; Set B
aaaugugugguacugggggcagagggaaaauag

SEQ ID NO: 51790 - RNA, 26 nt, Artificial Sequence
  Synthetic Oligonucleotide; BTLA exon 3; Set C
ugugugguacugggggcagagggaaa

SEQ ID NO: 51791 - RNA, 28 nt, Artificial Sequence
  Synthetic Oligonucleotide; BTLA exon 3; Set C
augugugguacugggggcagagggaaaa

SEQ ID NO: 51792 - RNA, 30 nt, Artificial Sequence
  Synthetic Oligonucleotide; BTLA exon 3; Set C
aaugugugguacugggggcagagggaaaau

SEQ ID NO: 51793 - RNA, 24 nt, Artificial Sequence
  Synthetic Oligonucleotide; BTLA exon 3; Set C
gugugguacugggggcagagggaa

SEQ ID NO: 51794 - RNA, 32 nt, Artificial Sequence
  Synthetic Oligonucleotide; BTLA exon 3; Set B
aaaugugugguacugggggcagagggaaaaua

SEQ ID NO: 51795 - RNA, 27 nt, Artificial Sequence
  Synthetic Oligonucleotide; BTLA exon 3; Set C
augugugguacugggggcagagggaaa

SEQ ID NO: 51796 - RNA, 29 nt, Artificial Sequence
  Synthetic Oligonucleotide; BTLA exon 3; Set C
aaugugugguacugggggcagagggaaaa

SEQ ID NO: 51797 - RNA, 31 nt, Artificial Sequence
  Synthetic Oligonucleotide; BTLA exon 3; Set B
aaaugugugguacugggggcagagggaaaau

SEQ ID NO: 51798 - RNA, 25 nt, Artificial Sequence
  Synthetic Oligonucleotide; BTLA exon 3; Set C
ugugugguacugggggcagagggaa

SEQ ID NO: 51799 - RNA, 23 nt, Artificial Sequence
  Synthetic Oligonucleotide; BTLA exon 3; Set C
gugugguacugggggcagaggga

SEQ ID NO: 51800 - RNA, 28 nt, Artificial Sequence
  Synthetic Oligonucleotide; BTLA exon 3; Set C
aaugugugguacugggggcagagggaaa

SEQ ID NO: 51801 - RNA, 30 nt, Artificial Sequence
  Synthetic Oligonucleotide; BTLA exon 3; Set B
aaaugugugguacugggggcagagggaaaa

SEQ ID NO: 51802 - RNA, 26 nt, Artificial Sequence
  Synthetic Oligonucleotide; BTLA exon 3; Set C
augugugguacugggggcagagggaa

SEQ ID NO: 51803 - RNA, 22 nt, Artificial Sequence
  Synthetic Oligonucleotide; BTLA exon 3; Set C
gugugguacugggggcagaggg

SEQ ID NO: 51804 - RNA, 29 nt, Artificial Sequence
  Synthetic Oligonucleotide; BTLA exon 3; Set C
aaaugugugguacugggggcagagggaaa

SEQ ID NO: 51805 - RNA, 27 nt, Artificial Sequence
  Synthetic Oligonucleotide; BTLA exon 3; Set C
aaugugugguacugggggcagagggaa

SEQ ID NO: 51806 - RNA, 21 nt, Artificial Sequence
  Synthetic Oligonucleotide; BTLA exon 3; Set C
gugugguacugggggcagagg

SEQ ID NO: 51807 - RNA, 20 nt, Artificial Sequence
  Synthetic Oligonucleotide; BTLA exon 3; Set B
gugugguacugggggcagag

SEQ ID NO: 51808 - RNA, 28 nt, Artificial Sequence
  Synthetic Oligonucleotide; BTLA exon 3; Set C
aaaugugugguacugggggcagagggaa

SEQ ID NO: 51809 - RNA, 19 nt, Artificial Sequence
  Synthetic Oligonucleotide; BTLA exon 3; Set B
gugugguacugggggcaga

SEQ ID NO: 51810 - RNA, 40 nt, Artificial Sequence
  Synthetic Oligonucleotide; BTLA exon 3; Set C
auggccccaaaugugugguacugggggcagagggaaaaua

SEQ ID NO: 51811 - RNA, 39 nt, Artificial Sequence
  Synthetic Oligonucleotide; BTLA exon 3; Set C
auggccccaaaugugugguacugggggcagagggaaaau

SEQ ID NO: 51812 - RNA, 38 nt, Artificial Sequence
  Synthetic Oligonucleotide; BTLA exon 3; Set C
auggccccaaaugugugguacugggggcagagggaaaa

SEQ ID NO: 51813 - RNA, 40 nt, Artificial Sequence
  Synthetic Oligonucleotide; BTLA exon 3; Set C
aauggccccaaaugugugguacugggggcagagggaaaau

SEQ ID NO: 51814 - RNA, 37 nt, Artificial Sequence
  Synthetic Oligonucleotide; BTLA exon 3; Set C
auggccccaaaugugugguacugggggcagagggaaa

SEQ ID NO: 51815 - RNA, 39 nt, Artificial Sequence
  Synthetic Oligonucleotide; BTLA exon 3; Set C
aauggccccaaaugugugguacugggggcagagggaaaa

SEQ ID NO: 51816 - RNA, 38 nt, Artificial Sequence
  Synthetic Oligonucleotide; BTLA exon 3; Set C
aauggccccaaaugugugguacugggggcagagggaaa

SEQ ID NO: 51817 - RNA, 40 nt, Artificial Sequence
  Synthetic Oligonucleotide; BTLA exon 3; Set C
gaauggccccaaaugugugguacugggggcagagggaaaa

SEQ ID NO: 51818 - RNA, 36 nt, Artificial Sequence
  Synthetic Oligonucleotide; BTLA exon 3; Set C
auggccccaaaugugugguacugggggcagagggaa

SEQ ID NO: 51819 - RNA, 39 nt, Artificial Sequence
  Synthetic Oligonucleotide; BTLA exon 3; Set C
gaauggccccaaaugugugguacugggggcagagggaaa

SEQ ID NO: 51820 - RNA, 37 nt, Artificial Sequence
  Synthetic Oligonucleotide; BTLA exon 3; Set C
aauggccccaaaugugugguacugggggcagagggaa

SEQ ID NO: 51821 - RNA, 35 nt, Artificial Sequence
  Synthetic Oligonucleotide; BTLA exon 3; Set C
auggccccaaaugugugguacugggggcagaggga

SEQ ID NO: 51822 - RNA, 34 nt, Artificial Sequence
  Synthetic Oligonucleotide; BTLA exon 3; Set C
auggccccaaaugugugguacugggggcagaggg

SEQ ID NO: 51823 - RNA, 32 nt, Artificial Sequence
  Synthetic Oligonucleotide; BTLA exon 3; Set C
auggccccaaaugugugguacugggggcagag

SEQ ID NO: 51824 - RNA, 23 nt, Artificial Sequence
  Synthetic Oligonucleotide; BTLA exon 3; Set A
agauauauugggaucagcggcac

SEQ ID NO: 51825 - RNA, 22 nt, Artificial Sequence
  Synthetic Oligonucleotide; BTLA exon 3; Set A
agauauauugggaucagcggca

SEQ ID NO: 51826 - RNA, 24 nt, Artificial Sequence
  Synthetic Oligonucleotide; BTLA exon 3; Set A
gagauauauugggaucagcggcac

SEQ ID NO: 51827 - RNA, 21 nt, Artificial Sequence
  Synthetic Oligonucleotide; BTLA exon 3; Set C
agauauauugggaucagcggc

SEQ ID NO: 51828 - RNA, 23 nt, Artificial Sequence
  Synthetic Oligonucleotide; BTLA exon 3; Set A
gagauauauugggaucagcggca

SEQ ID NO: 51829 - RNA, 22 nt, Artificial Sequence
  Synthetic Oligonucleotide; BTLA exon 3; Set A
gagauauauugggaucagcggc

SEQ ID NO: 51830 - RNA, 23 nt, Artificial Sequence
  Synthetic Oligonucleotide; BTLA exon 3; Set A
ugagauauauugggaucagcggc

SEQ ID NO: 51831 - RNA, 19 nt, Artificial Sequence
  Synthetic Oligonucleotide; BTLA exon 3; Set C
agauauauugggaucagcg

SEQ ID NO: 51832 - RNA, 15 nt, Artificial Sequence
  Synthetic Oligonucleotide; BTLA exon 3; Set C
auauauugggaucag

SEQ ID NO: 51833 - RNA, 22 nt, Artificial Sequence
  Synthetic Oligonucleotide; BTLA exon 3; Set C
ugagauauauugggaucagcgg

SEQ ID NO: 51834 - RNA, 20 nt, Artificial Sequence
  Synthetic Oligonucleotide; BTLA exon 3; Set C
gagauauauugggaucagcg

SEQ ID NO: 51835 - RNA, 18 nt, Artificial Sequence
  Synthetic Oligonucleotide; BTLA exon 3; Set C
agauauauugggaucagc

SEQ ID NO: 51836 - RNA, 16 nt, Artificial Sequence
  Synthetic Oligonucleotide; BTLA exon 3; Set C
gauauauugggaucag

SEQ ID NO: 51837 - RNA, 19 nt, Artificial Sequence
  Synthetic Oligonucleotide; BTLA exon 3; Set C
gagauauauugggaucagc

SEQ ID NO: 51838 - RNA, 24 nt, Artificial Sequence
  Synthetic Oligonucleotide; BTLA exon 3; Set A
ucugagauauauugggaucagcgg

SEQ ID NO: 51839 - RNA, 26 nt, Artificial Sequence
  Synthetic Oligonucleotide; BTLA exon 3; Set A
aucugagauauauugggaucagcggc

SEQ ID NO: 51840 - RNA, 25 nt, Artificial Sequence
  Synthetic Oligonucleotide; BTLA exon 3; Set A
aucugagauauauugggaucagcgg

SEQ ID NO: 51841 - RNA, 24 nt, Artificial Sequence
  Synthetic Oligonucleotide; BTLA exon 3; Set C
aucugagauauauugggaucagcg

SEQ ID NO: 51842 - RNA, 15 nt, Artificial Sequence
  Synthetic Oligonucleotide; BTLA exon 3; Set C
gagauauauugggau

SEQ ID NO: 51843 - RNA, 15 nt, Artificial Sequence
  Synthetic Oligonucleotide; BTLA exon 3; Set C
ugagauauauuggga

SEQ ID NO: 51844 - RNA, 23 nt, Artificial Sequence
  Synthetic Oligonucleotide; BTLA exon 3; Set C
aaucugagauauauugggaucag

SEQ ID NO: 51845 - RNA, 24 nt, Artificial Sequence
  Synthetic Oligonucleotide; BTLA exon 3; Set C
aaaucugagauauauugggaucag

SEQ ID NO: 51846 - RNA, 17 nt, Artificial Sequence
  Synthetic Oligonucleotide; BTLA exon 3; Set C
ucugagauauauuggga

SEQ ID NO: 51847 - RNA, 25 nt, Artificial Sequence
  Synthetic Oligonucleotide; BTLA exon 3; Set C
gaaaucugagauauauugggaucag

SEQ ID NO: 51848 - RNA, 16 nt, Artificial Sequence
  Synthetic Oligonucleotide; BTLA exon 3; Set C
ucugagauauauuggg

SEQ ID NO: 51849 - RNA, 18 nt, Artificial Sequence
  Synthetic Oligonucleotide; BTLA exon 3; Set C
aucugagauauauuggga

SEQ ID NO: 51850 - RNA, 26 nt, Artificial Sequence
  Synthetic Oligonucleotide; BTLA exon 3; Set C
ggaaaucugagauauauugggaucag

SEQ ID NO: 51851 - RNA, 17 nt, Artificial Sequence
  Synthetic Oligonucleotide; BTLA exon 3; Set C
aucugagauauauuggg

SEQ ID NO: 51852 - RNA, 27 nt, Artificial Sequence
  Synthetic Oligonucleotide; BTLA exon 3; Set C
aggaaaucugagauauauugggaucag

SEQ ID NO: 51853 - RNA, 16 nt, Artificial Sequence
  Synthetic Oligonucleotide; BTLA exon 3; Set C
aucugagauauauugg

SEQ ID NO: 51854 - RNA, 28 nt, Artificial Sequence
  Synthetic Oligonucleotide; BTLA exon 3; Set C
uaggaaaucugagauauauugggaucag

SEQ ID NO: 51855 - RNA, 15 nt, Artificial Sequence
  Synthetic Oligonucleotide; BTLA exon 3; Set C
aucugagauauauug

SEQ ID NO: 51856 - RNA, 29 nt, Artificial Sequence
  Synthetic Oligonucleotide; BTLA exon 3; Set C
uuaggaaaucugagauauauugggaucag

SEQ ID NO: 51857 - RNA, 30 nt, Artificial Sequence
  Synthetic Oligonucleotide; BTLA exon 3; Set C
guuaggaaaucugagauauauugggaucag

SEQ ID NO: 51858 - RNA, 29 nt, Artificial Sequence
  Synthetic Oligonucleotide; BTLA exon 3; Set C
gaguuaggaaaucugagauauauugggau

SEQ ID NO: 51859 - RNA, 30 nt, Artificial Sequence
  Synthetic Oligonucleotide; BTLA exon 3; Set C
agaguuaggaaaucugagauauauugggau

SEQ ID NO: 51860 - RNA, 31 nt, Artificial Sequence
  Synthetic Oligonucleotide; BTLA exon 3; Set A
gagaguuaggaaaucugagauauauugggau

SEQ ID NO: 51861 - RNA, 37 nt, Artificial Sequence
  Synthetic Oligonucleotide; BTLA exon 3; Set A
aaagagaguuaggaaaucugagauauauugggaucag

SEQ ID NO: 51862 - RNA, 32 nt, Artificial Sequence
  Synthetic Oligonucleotide; BTLA exon 3; Set A
agagaguuaggaaaucugagauauauugggau

SEQ ID NO: 51863 - RNA, 38 nt, Artificial Sequence
  Synthetic Oligonucleotide; BTLA exon 3; Set A
uaaagagaguuaggaaaucugagauauauugggaucag

SEQ ID NO: 51864 - RNA, 15 nt, Artificial Sequence
  Synthetic Oligonucleotide; BTLA exon 3; Set C
uuaggaaaucugaga

SEQ ID NO: 51865 - RNA, 15 nt, Artificial Sequence
  Synthetic Oligonucleotide; BTLA exon 3; Set C
guuaggaaaucugag

SEQ ID NO: 51866 - RNA, 17 nt, Artificial Sequence
  Synthetic Oligonucleotide; BTLA exon 3; Set C
aguuaggaaaucugaga

SEQ ID NO: 51867 - RNA, 16 nt, Artificial Sequence
  Synthetic Oligonucleotide; BTLA exon 3; Set C
aguuaggaaaucugag

SEQ ID NO: 51868 - RNA, 18 nt, Artificial Sequence
  Synthetic Oligonucleotide; BTLA exon 3; Set C
gaguuaggaaaucugaga

SEQ ID NO: 51869 - RNA, 17 nt, Artificial Sequence
  Synthetic Oligonucleotide; BTLA exon 3; Set C
gaguuaggaaaucugag

SEQ ID NO: 51870 - RNA, 19 nt, Artificial Sequence
  Synthetic Oligonucleotide; BTLA exon 3; Set C
agaguuaggaaaucugaga

SEQ ID NO: 51871 - RNA, 40 nt, Artificial Sequence
  Synthetic Oligonucleotide; BTLA exon 3; Set A
aaaugcuaaagagaguuaggaaaucugagauauauuggga

SEQ ID NO: 51872 - RNA, 20 nt, Artificial Sequence
  Synthetic Oligonucleotide; BTLA exon 3; Set C
gagaguuaggaaaucugaga

SEQ ID NO: 51873 - RNA, 18 nt, Artificial Sequence
  Synthetic Oligonucleotide; BTLA exon 3; Set C
agaguuaggaaaucugag

SEQ ID NO: 51874 - RNA, 39 nt, Artificial Sequence
  Synthetic Oligonucleotide; BTLA exon 3; Set A
aaaugcuaaagagaguuaggaaaucugagauauauuggg

SEQ ID NO: 51875 - RNA, 21 nt, Artificial Sequence
  Synthetic Oligonucleotide; BTLA exon 3; Set C
agagaguuaggaaaucugaga

SEQ ID NO: 51876 - RNA, 19 nt, Artificial Sequence
  Synthetic Oligonucleotide; BTLA exon 3; Set C
gagaguuaggaaaucugag

SEQ ID NO: 51877 - RNA, 40 nt, Artificial Sequence
  Synthetic Oligonucleotide; BTLA exon 3; Set A
uaaaugcuaaagagaguuaggaaaucugagauauauuggg

SEQ ID NO: 51878 - RNA, 38 nt, Artificial Sequence
  Synthetic Oligonucleotide; BTLA exon 3; Set A
aaaugcuaaagagaguuaggaaaucugagauauauugg

SEQ ID NO: 51879 - RNA, 22 nt, Artificial Sequence
  Synthetic Oligonucleotide; BTLA exon 3; Set C
aagagaguuaggaaaucugaga

SEQ ID NO: 51880 - RNA, 20 nt, Artificial Sequence
  Synthetic Oligonucleotide; BTLA exon 3; Set C
agagaguuaggaaaucugag

SEQ ID NO: 51881 - RNA, 39 nt, Artificial Sequence
  Synthetic Oligonucleotide; BTLA exon 3; Set A
uaaaugcuaaagagaguuaggaaaucugagauauauugg

SEQ ID NO: 51882 - RNA, 37 nt, Artificial Sequence
  Synthetic Oligonucleotide; BTLA exon 3; Set C
aaaugcuaaagagaguuaggaaaucugagauauauug

SEQ ID NO: 51883 - RNA, 23 nt, Artificial Sequence
  Synthetic Oligonucleotide; BTLA exon 3; Set C
aaagagaguuaggaaaucugaga

SEQ ID NO: 51884 - RNA, 21 nt, Artificial Sequence
  Synthetic Oligonucleotide; BTLA exon 3; Set C
aagagaguuaggaaaucugag

SEQ ID NO: 51885 - RNA, 36 nt, Artificial Sequence
  Synthetic Oligonucleotide; BTLA exon 3; Set C
aaaugcuaaagagaguuaggaaaucugagauauauu

SEQ ID NO: 51886 - RNA, 38 nt, Artificial Sequence
  Synthetic Oligonucleotide; BTLA exon 3; Set C
uaaaugcuaaagagaguuaggaaaucugagauauauug

SEQ ID NO: 51887 - RNA, 24 nt, Artificial Sequence
  Synthetic Oligonucleotide; BTLA exon 3; Set C
uaaagagaguuaggaaaucugaga

SEQ ID NO: 51888 - RNA, 22 nt, Artificial Sequence
  Synthetic Oligonucleotide; BTLA exon 3; Set C
aaagagaguuaggaaaucugag

SEQ ID NO: 51889 - RNA, 37 nt, Artificial Sequence
  Synthetic Oligonucleotide; BTLA exon 3; Set C
uaaaugcuaaagagaguuaggaaaucugagauauauu

SEQ ID NO: 51890 - RNA, 35 nt, Artificial Sequence
  Synthetic Oligonucleotide; BTLA exon 3; Set C
aaaugcuaaagagaguuaggaaaucugagauauau

SEQ ID NO: 51891 - RNA, 23 nt, Artificial Sequence
  Synthetic Oligonucleotide; BTLA exon 3; Set C
uaaagagaguuaggaaaucugag

SEQ ID NO: 51892 - RNA, 21 nt, Artificial Sequence
  Synthetic Oligonucleotide; BTLA exon 3; Set C
aaagagaguuaggaaaucuga

SEQ ID NO: 51893 - RNA, 36 nt, Artificial Sequence
  Synthetic Oligonucleotide; BTLA exon 3; Set C
uaaaugcuaaagagaguuaggaaaucugagauauau

SEQ ID NO: 51894 - RNA, 34 nt, Artificial Sequence
  Synthetic Oligonucleotide; BTLA exon 3; Set C
aaaugcuaaagagaguuaggaaaucugagauaua

SEQ ID NO: 51895 - RNA, 22 nt, Artificial Sequence
  Synthetic Oligonucleotide; BTLA exon 3; Set C
uaaagagaguuaggaaaucuga

SEQ ID NO: 51896 - RNA, 20 nt, Artificial Sequence
  Synthetic Oligonucleotide; BTLA exon 3; Set C
aaagagaguuaggaaaucug

SEQ ID NO: 51897 - RNA, 35 nt, Artificial Sequence
  Synthetic Oligonucleotide; BTLA exon 3; Set C
uaaaugcuaaagagaguuaggaaaucugagauaua

SEQ ID NO: 51898 - RNA, 33 nt, Artificial Sequence
  Synthetic Oligonucleotide; BTLA exon 3; Set C
aaaugcuaaagagaguuaggaaaucugagauau

SEQ ID NO: 51899 - RNA, 17 nt, Artificial Sequence
  Synthetic Oligonucleotide; BTLA exon 3; Set C
aagagaguuaggaaauc

SEQ ID NO: 51900 - RNA, 19 nt, Artificial Sequence
  Synthetic Oligonucleotide; BTLA exon 3; Set C
aaagagaguuaggaaaucu

SEQ ID NO: 51901 - RNA, 21 nt, Artificial Sequence
  Synthetic Oligonucleotide; BTLA exon 3; Set C
uaaagagaguuaggaaaucug

SEQ ID NO: 51902 - RNA, 34 nt, Artificial Sequence
  Synthetic Oligonucleotide; BTLA exon 3; Set C
uaaaugcuaaagagaguuaggaaaucugagauau

SEQ ID NO: 51903 - RNA, 32 nt, Artificial Sequence
  Synthetic Oligonucleotide; BTLA exon 3; Set C
aaaugcuaaagagaguuaggaaaucugagaua

SEQ ID NO: 51904 - RNA, 18 nt, Artificial Sequence
  Synthetic Oligonucleotide; BTLA exon 3; Set C
aaagagaguuaggaaauc

SEQ ID NO: 51905 - RNA, 20 nt, Artificial Sequence
  Synthetic Oligonucleotide; BTLA exon 3; Set C
uaaagagaguuaggaaaucu

SEQ ID NO: 51906 - RNA, 33 nt, Artificial Sequence
  Synthetic Oligonucleotide; BTLA exon 3; Set C
uaaaugcuaaagagaguuaggaaaucugagaua

SEQ ID NO: 51907 - RNA, 31 nt, Artificial Sequence
  Synthetic Oligonucleotide; BTLA exon 3; Set C
aaaugcuaaagagaguuaggaaaucugagau

SEQ ID NO: 51908 - RNA, 19 nt, Artificial Sequence
  Synthetic Oligonucleotide; BTLA exon 3; Set C
uaaagagaguuaggaaauc

SEQ ID NO: 51909 - RNA, 32 nt, Artificial Sequence
  Synthetic Oligonucleotide; BTLA exon 3; Set C
uaaaugcuaaagagaguuaggaaaucugagau

SEQ ID NO: 51910 - RNA, 32 nt, Artificial Sequence
  Synthetic Oligonucleotide; BTLA exon 3; Set C
guaaaugcuaaagagaguuaggaaaucugaga

SEQ ID NO: 51911 - RNA, 33 nt, Artificial Sequence
  Synthetic Oligonucleotide; BTLA exon 3; Set C
aguaaaugcuaaagagaguuaggaaaucugaga

SEQ ID NO: 51912 - RNA, 31 nt, Artificial Sequence
  Synthetic Oligonucleotide; BTLA exon 3; Set C
guaaaugcuaaagagaguuaggaaaucugag

SEQ ID NO: 51913 - RNA, 34 nt, Artificial Sequence
  Synthetic Oligonucleotide; BTLA exon 3; Set C
uaguaaaugcuaaagagaguuaggaaaucugaga

SEQ ID NO: 51914 - RNA, 32 nt, Artificial Sequence
  Synthetic Oligonucleotide; BTLA exon 3; Set C
aguaaaugcuaaagagaguuaggaaaucugag

SEQ ID NO: 51915 - RNA, 33 nt, Artificial Sequence
  Synthetic Oligonucleotide; BTLA exon 3; Set C
uaguaaaugcuaaagagaguuaggaaaucugag

SEQ ID NO: 51916 - RNA, 31 nt, Artificial Sequence
  Synthetic Oligonucleotide; BTLA exon 3; Set C
aguaaaugcuaaagagaguuaggaaaucuga

SEQ ID NO: 51917 - RNA, 24 nt, Artificial Sequence
  Synthetic Oligonucleotide; BTLA exon 3; Set C
aaaugcuaaagagaguuaggaaau

SEQ ID NO: 51918 - RNA, 32 nt, Artificial Sequence
  Synthetic Oligonucleotide; BTLA exon 3; Set C
uaguaaaugcuaaagagaguuaggaaaucuga

SEQ ID NO: 51919 - RNA, 25 nt, Artificial Sequence
  Synthetic Oligonucleotide; BTLA exon 3; Set C
uaaaugcuaaagagaguuaggaaau

SEQ ID NO: 51920 - RNA, 23 nt, Artificial Sequence
  Synthetic Oligonucleotide; BTLA exon 3; Set C
aaaugcuaaagagaguuaggaaa

SEQ ID NO: 51921 - RNA, 24 nt, Artificial Sequence
  Synthetic Oligonucleotide; BTLA exon 3; Set C
uaaaugcuaaagagaguuaggaaa

SEQ ID NO: 51922 - RNA, 22 nt, Artificial Sequence
  Synthetic Oligonucleotide; BTLA exon 3; Set C
aaaugcuaaagagaguuaggaa

SEQ ID NO: 51923 - RNA, 28 nt, Artificial Sequence
  Synthetic Oligonucleotide; BTLA exon 3; Set C
aguaaaugcuaaagagaguuaggaaauc

SEQ ID NO: 51924 - RNA, 23 nt, Artificial Sequence
  Synthetic Oligonucleotide; BTLA exon 3; Set C
uaaaugcuaaagagaguuaggaa

SEQ ID NO: 51925 - RNA, 21 nt, Artificial Sequence
  Synthetic Oligonucleotide; BTLA exon 3; Set C
aaaugcuaaagagaguuagga

SEQ ID NO: 51926 - RNA, 29 nt, Artificial Sequence
  Synthetic Oligonucleotide; BTLA exon 3; Set C
uaguaaaugcuaaagagaguuaggaaauc

SEQ ID NO: 51927 - RNA, 22 nt, Artificial Sequence
  Synthetic Oligonucleotide; BTLA exon 3; Set C
uaaaugcuaaagagaguuagga

SEQ ID NO: 51928 - RNA, 20 nt, Artificial Sequence
  Synthetic Oligonucleotide; BTLA exon 3; Set C
aaaugcuaaagagaguuagg

SEQ ID NO: 51929 - RNA, 19 nt, Artificial Sequence
  Synthetic Oligonucleotide; BTLA exon 3; Set C
aaaugcuaaagagaguuag

SEQ ID NO: 51930 - RNA, 21 nt, Artificial Sequence
  Synthetic Oligonucleotide; BTLA exon 3; Set C
uaaaugcuaaagagaguuagg

SEQ ID NO: 51931 - RNA, 20 nt, Artificial Sequence
  Synthetic Oligonucleotide; BTLA exon 3; Set C
uaaaugcuaaagagaguuag

SEQ ID NO: 51932 - RNA, 18 nt, Artificial Sequence
  Synthetic Oligonucleotide; BTLA exon 3; Set C
aaaugcuaaagagaguua

SEQ ID NO: 51933 - RNA, 40 nt, Artificial Sequence
  Synthetic Oligonucleotide; BTLA exon 3; Set A
ggaauguuaguaaaugcuaaagagaguuaggaaaucugag

SEQ ID NO: 51934 - RNA, 17 nt, Artificial Sequence
  Synthetic Oligonucleotide; BTLA exon 3; Set C
aaaugcuaaagagaguu

SEQ ID NO: 51935 - RNA, 19 nt, Artificial Sequence
  Synthetic Oligonucleotide; BTLA exon 3; Set C
uaaaugcuaaagagaguua

SEQ ID NO: 51936 - RNA, 18 nt, Artificial Sequence
  Synthetic Oligonucleotide; BTLA exon 3; Set C
uaaaugcuaaagagaguu

SEQ ID NO: 51937 - RNA, 17 nt, Artificial Sequence
  Synthetic Oligonucleotide; BTLA exon 3; Set C
guaaaugcuaaagagag

SEQ ID NO: 51938 - RNA, 37 nt, Artificial Sequence
  Synthetic Oligonucleotide; BTLA exon 3; Set A
uggaauguuaguaaaugcuaaagagaguuaggaaauc

SEQ ID NO: 51939 - RNA, 16 nt, Artificial Sequence
  Synthetic Oligonucleotide; BTLA exon 3; Set C
guaaaugcuaaagaga

SEQ ID NO: 51940 - RNA, 15 nt, Artificial Sequence
  Synthetic Oligonucleotide; BTLA exon 3; Set C
guaaaugcuaaagag

SEQ ID NO: 51941 - RNA, 26 nt, Artificial Sequence
  Synthetic Oligonucleotide; BTLA exon 3; Set C
ggaauguuaguaaaugcuaaagagag

SEQ ID NO: 51942 - RNA, 25 nt, Artificial Sequence
  Synthetic Oligonucleotide; BTLA exon 3; Set C
ggaauguuaguaaaugcuaaagaga

SEQ ID NO: 51943 - RNA, 24 nt, Artificial Sequence
  Synthetic Oligonucleotide; BTLA exon 3; Set C
ggaauguuaguaaaugcuaaagag

SEQ ID NO: 51944 - RNA, 23 nt, Artificial Sequence
  Synthetic Oligonucleotide; BTLA exon 3; Set C
ggaauguuaguaaaugcuaaaga

SEQ ID NO: 51945 - RNA, 22 nt, Artificial Sequence
  Synthetic Oligonucleotide; BTLA exon 3; Set C
ggaauguuaguaaaugcuaaag

SEQ ID NO: 51946 - RNA, 40 nt, Artificial Sequence
  Synthetic Oligonucleotide; BTLA exon 3; Set A
uuuuacaucuggaauguuaguaaaugcuaaagagaguuag

SEQ ID NO: 51947 - RNA, 39 nt, Artificial Sequence
  Synthetic Oligonucleotide; BTLA exon 3; Set A
uuuuacaucuggaauguuaguaaaugcuaaagagaguua

SEQ ID NO: 51948 - RNA, 38 nt, Artificial Sequence
  Synthetic Oligonucleotide; BTLA exon 3; Set A
uuuuacaucuggaauguuaguaaaugcuaaagagaguu

SEQ ID NO: 51949 - RNA, 40 nt, Artificial Sequence
  Synthetic Oligonucleotide; BTLA exon 3; Set A
uuuuuacaucuggaauguuaguaaaugcuaaagagaguua

SEQ ID NO: 51950 - RNA, 39 nt, Artificial Sequence
  Synthetic Oligonucleotide; BTLA exon 3; Set A
uuuuuacaucuggaauguuaguaaaugcuaaagagaguu

SEQ ID NO: 51951 - RNA, 37 nt, Artificial Sequence
  Synthetic Oligonucleotide; BTLA exon 3; Set A
uuuuacaucuggaauguuaguaaaugcuaaagagagu

SEQ ID NO: 51952 - RNA, 35 nt, Artificial Sequence
  Synthetic Oligonucleotide; BTLA exon 3; Set C
uuuacaucuggaauguuaguaaaugcuaaagagag

SEQ ID NO: 51953 - RNA, 34 nt, Artificial Sequence
  Synthetic Oligonucleotide; BTLA exon 3; Set C
uuuacaucuggaauguuaguaaaugcuaaagaga

SEQ ID NO: 51954 - RNA, 33 nt, Artificial Sequence
  Synthetic Oligonucleotide; BTLA exon 3; Set C
uuuacaucuggaauguuaguaaaugcuaaagag

SEQ ID NO: 51955 - RNA, 32 nt, Artificial Sequence
  Synthetic Oligonucleotide; BTLA exon 3; Set C
uuuacaucuggaauguuaguaaaugcuaaaga

SEQ ID NO: 51956 - RNA, 31 nt, Artificial Sequence
  Synthetic Oligonucleotide; BTLA exon 3; Set C
uuuacaucuggaauguuaguaaaugcuaaag

SEQ ID NO: 51957 - RNA, 15 nt, Artificial Sequence
  Synthetic Oligonucleotide; BTLA exon 3; Set C
uggaauguuaguaaa

SEQ ID NO: 51958 - RNA, 32 nt, Artificial Sequence
  Synthetic Oligonucleotide; BTLA exon 3; Set C
uuuuacaucuggaauguuaguaaaugcuaaag

SEQ ID NO: 51959 - RNA, 31 nt, Artificial Sequence
  Synthetic Oligonucleotide; BTLA exon 3; Set C
uuuuacaucuggaauguuaguaaaugcuaaa

SEQ ID NO: 51960 - RNA, 30 nt, Artificial Sequence
  Synthetic Oligonucleotide; BTLA exon 3; Set C
uuuuacaucuggaauguuaguaaaugcuaa

SEQ ID NO: 51961 - RNA, 40 nt, Artificial Sequence
  Synthetic Oligonucleotide; BTLA exon 3; Set A
gaggcacuuuuuacaucuggaauguuaguaaaugcuaaag

SEQ ID NO: 51962 - RNA, 39 nt, Artificial Sequence
  Synthetic Oligonucleotide; BTLA exon 3; Set A
gaggcacuuuuuacaucuggaauguuaguaaaugcuaaa

SEQ ID NO: 51963 - RNA, 21 nt, Artificial Sequence
  Synthetic Oligonucleotide; BTLA exon 3; Set C
uuuacaucuggaauguuagua

SEQ ID NO: 51964 - RNA, 38 nt, Artificial Sequence
  Synthetic Oligonucleotide; BTLA exon 3; Set A
gaggcacuuuuuacaucuggaauguuaguaaaugcuaa

SEQ ID NO: 51965 - RNA, 21 nt, Artificial Sequence
  Synthetic Oligonucleotide; BTLA exon 3; Set C
uuuuacaucuggaauguuagu

SEQ ID NO: 51966 - RNA, 20 nt, Artificial Sequence
  Synthetic Oligonucleotide; BTLA exon 3; Set C
uuuuacaucuggaauguuag

SEQ ID NO: 51967 - RNA, 30 nt, Artificial Sequence
  Synthetic Oligonucleotide; BTLA exon 3; Set A
gaggcacuuuuuacaucuggaauguuagua

SEQ ID NO: 51968 - RNA, 29 nt, Artificial Sequence
  Synthetic Oligonucleotide; BTLA exon 3; Set A
gaggcacuuuuuacaucuggaauguuagu

SEQ ID NO: 51969 - RNA, 28 nt, Artificial Sequence
  Synthetic Oligonucleotide; BTLA exon 3; Set A
gaggcacuuuuuacaucuggaauguuag

SEQ ID NO: 51970 - RNA, 36 nt, Artificial Sequence
  Synthetic Oligonucleotide; BTLA exon 3; Set C
cguucugaggcacuuuuuacaucuggaauguuagua

SEQ ID NO: 51971 - RNA, 35 nt, Artificial Sequence
  Synthetic Oligonucleotide; BTLA exon 3; Set C
cguucugaggcacuuuuuacaucuggaauguuagu

SEQ ID NO: 51972 - RNA, 37 nt, Artificial Sequence
  Synthetic Oligonucleotide; BTLA exon 3; Set C
ucguucugaggcacuuuuuacaucuggaauguuagua

SEQ ID NO: 51973 - RNA, 36 nt, Artificial Sequence
  Synthetic Oligonucleotide; BTLA exon 3; Set C
ucguucugaggcacuuuuuacaucuggaauguuagu

SEQ ID NO: 51974 - RNA, 34 nt, Artificial Sequence
  Synthetic Oligonucleotide; BTLA exon 3; Set A
cguucugaggcacuuuuuacaucuggaauguuag

SEQ ID NO: 51975 - RNA, 35 nt, Artificial Sequence
  Synthetic Oligonucleotide; BTLA exon 3; Set C
ucguucugaggcacuuuuuacaucuggaauguuag

SEQ ID NO: 51976 - RNA, 20 nt, Artificial Sequence
  Synthetic Oligonucleotide; BTLA exon 3; Set C
gaggcacuuuuuacaucugg

SEQ ID NO: 51977 - RNA, 27 nt, Artificial Sequence
  Synthetic Oligonucleotide; BTLA exon 3; Set A
cguucugaggcacuuuuuacaucugga

SEQ ID NO: 51978 - RNA, 26 nt, Artificial Sequence
  Synthetic Oligonucleotide; BTLA exon 3; Set A
cguucugaggcacuuuuuacaucugg

SEQ ID NO: 51979 - RNA, 28 nt, Artificial Sequence
  Synthetic Oligonucleotide; BTLA exon 3; Set A
ucguucugaggcacuuuuuacaucugga

SEQ ID NO: 51980 - RNA, 27 nt, Artificial Sequence
  Synthetic Oligonucleotide; BTLA exon 3; Set A
ucguucugaggcacuuuuuacaucugg

SEQ ID NO: 51981 - RNA, 17 nt, Artificial Sequence
  Synthetic Oligonucleotide; BTLA exon 3; Set C
cguucugaggcacuuuu

SEQ ID NO: 51982 - RNA, 18 nt, Artificial Sequence
  Synthetic Oligonucleotide; BTLA exon 3; Set C
ucguucugaggcacuuuu

SEQ ID NO: 51983 - RNA, 15 nt, Artificial Sequence
  Synthetic Oligonucleotide; BTLA exon 3; Set C
gccagggucugcuug

SEQ ID NO: 51984 - RNA, 16 nt, Artificial Sequence
  Synthetic Oligonucleotide; BTLA exon 3; Set C
agccagggucugcuug

SEQ ID NO: 51985 - RNA, 17 nt, Artificial Sequence
  Synthetic Oligonucleotide; BTLA exon 3; Set A
gagccagggucugcuug

SEQ ID NO: 51986 - RNA, 24 nt, Artificial Sequence
  Synthetic Oligonucleotide; BTLA exon 3; Set A
aguaaacgauacaggagccagggu

SEQ ID NO: 51987 - RNA, 23 nt, Artificial Sequence
  Synthetic Oligonucleotide; BTLA exon 3; Set A
aguaaacgauacaggagccaggg

SEQ ID NO: 51988 - RNA, 22 nt, Artificial Sequence
  Synthetic Oligonucleotide; BTLA exon 3; Set C
aguaaacgauacaggagccagg

SEQ ID NO: 51989 - RNA, 27 nt, Artificial Sequence
  Synthetic Oligonucleotide; BTLA exon 3; Set A
aguagaggcaauccccccaaaggaagu

SEQ ID NO: 51990 - RNA, 28 nt, Artificial Sequence
  Synthetic Oligonucleotide; BTLA exon 3; Set A
gaguagaggcaauccccccaaaggaagu

SEQ ID NO: 51991 - RNA, 29 nt, Artificial Sequence
  Synthetic Oligonucleotide; BTLA exon 3; Set A
ugaguagaggcaauccccccaaaggaagu

SEQ ID NO: 51992 - RNA, 30 nt, Artificial Sequence
  Synthetic Oligonucleotide; BTLA exon 3; Set A
augaguagaggcaauccccccaaaggaagu

SEQ ID NO: 51993 - RNA, 31 nt, Artificial Sequence
  Synthetic Oligonucleotide; BTLA exon 3; Set C
gaugaguagaggcaauccccccaaaggaagu

SEQ ID NO: 51994 - RNA, 32 nt, Artificial Sequence
  Synthetic Oligonucleotide; BTLA exon 3; Set C
ugaugaguagaggcaauccccccaaaggaagu

SEQ ID NO: 51995 - RNA, 33 nt, Artificial Sequence
  Synthetic Oligonucleotide; BTLA exon 3; Set C
gugaugaguagaggcaauccccccaaaggaagu

SEQ ID NO: 51996 - RNA, 34 nt, Artificial Sequence
  Synthetic Oligonucleotide; BTLA exon 3; Set C
agugaugaguagaggcaauccccccaaaggaagu

SEQ ID NO: 51997 - RNA, 35 nt, Artificial Sequence
  Synthetic Oligonucleotide; BTLA exon 3; Set C
uagugaugaguagaggcaauccccccaaaggaagu

SEQ ID NO: 51998 - RNA, 36 nt, Artificial Sequence
  Synthetic Oligonucleotide; BTLA exon 3; Set C
guagugaugaguagaggcaauccccccaaaggaagu

SEQ ID NO: 51999 - RNA, 37 nt, Artificial Sequence
  Synthetic Oligonucleotide; BTLA exon 3; Set C
gguagugaugaguagaggcaauccccccaaaggaagu

SEQ ID NO: 52000 - RNA, 38 nt, Artificial Sequence
  Synthetic Oligonucleotide; BTLA exon 3; Set C
agguagugaugaguagaggcaauccccccaaaggaagu

SEQ ID NO: 52001 - RNA, 39 nt, Artificial Sequence
  Synthetic Oligonucleotide; BTLA exon 3; Set C
cagguagugaugaguagaggcaauccccccaaaggaagu

SEQ ID NO: 52002 - RNA, 40 nt, Artificial Sequence
  Synthetic Oligonucleotide; BTLA exon 3; Set C
acagguagugaugaguagaggcaauccccccaaaggaagu

SEQ ID NO: 52003 - RNA, 34 nt, Artificial Sequence
  Synthetic Oligonucleotide; BTLA exon 3; Set C
caggcagaaacagguagugaugaguagaggcaau

SEQ ID NO: 52004 - RNA, 33 nt, Artificial Sequence
  Synthetic Oligonucleotide; BTLA exon 3; Set C
caggcagaaacagguagugaugaguagaggcaa

SEQ ID NO: 52005 - RNA, 32 nt, Artificial Sequence
  Synthetic Oligonucleotide; BTLA exon 3; Set C
caggcagaaacagguagugaugaguagaggca

SEQ ID NO: 52006 - RNA, 31 nt, Artificial Sequence
  Synthetic Oligonucleotide; BTLA exon 3; Set C
caggcagaaacagguagugaugaguagaggc

SEQ ID NO: 52007 - RNA, 30 nt, Artificial Sequence
  Synthetic Oligonucleotide; BTLA exon 3; Set A
caggcagaaacagguagugaugaguagagg

SEQ ID NO: 52008 - RNA, 29 nt, Artificial Sequence
  Synthetic Oligonucleotide; BTLA exon 3; Set A
caggcagaaacagguagugaugaguagag

SEQ ID NO: 52009 - RNA, 28 nt, Artificial Sequence
  Synthetic Oligonucleotide; BTLA exon 3; Set A
caggcagaaacagguagugaugaguaga

SEQ ID NO: 52010 - RNA, 27 nt, Artificial Sequence
  Synthetic Oligonucleotide; BTLA exon 3; Set A
caggcagaaacagguagugaugaguag

SEQ ID NO: 52011 - RNA, 26 nt, Artificial Sequence
  Synthetic Oligonucleotide; BTLA exon 3; Set A
caggcagaaacagguagugaugagua

SEQ ID NO: 52012 - RNA, 25 nt, Artificial Sequence
  Synthetic Oligonucleotide; BTLA exon 3; Set A
caggcagaaacagguagugaugagu

SEQ ID NO: 52013 - RNA, 24 nt, Artificial Sequence
  Synthetic Oligonucleotide; BTLA exon 3; Set A
caggcagaaacagguagugaugag

SEQ ID NO: 52014 - RNA, 23 nt, Artificial Sequence
  Synthetic Oligonucleotide; BTLA exon 3; Set A
caggcagaaacagguagugauga

SEQ ID NO: 52015 - RNA, 22 nt, Artificial Sequence
  Synthetic Oligonucleotide; BTLA exon 3; Set C
caggcagaaacagguagugaug

SEQ ID NO: 52016 - RNA, 21 nt, Artificial Sequence
  Synthetic Oligonucleotide; BTLA exon 3; Set C
caggcagaaacagguagugau

SEQ ID NO: 52017 - RNA, 20 nt, Artificial Sequence
  Synthetic Oligonucleotide; BTLA exon 3; Set C
caggcagaaacagguaguga

SEQ ID NO: 52018 - RNA, 19 nt, Artificial Sequence
  Synthetic Oligonucleotide; BTLA exon 3; Set C
caggcagaaacagguagug

SEQ ID NO: 52019 - RNA, 18 nt, Artificial Sequence
  Synthetic Oligonucleotide; BTLA exon 3; Set C
caggcagaaacagguagu

SEQ ID NO: 52020 - RNA, 17 nt, Artificial Sequence
  Synthetic Oligonucleotide; BTLA exon 3; Set C
caggcagaaacagguag

SEQ ID NO: 52021 - RNA, 16 nt, Artificial Sequence
  Synthetic Oligonucleotide; BTLA exon 3; Set C
caggcagaaacaggua

SEQ ID NO: 52022 - RNA, 15 nt, Artificial Sequence
  Synthetic Oligonucleotide; BTLA exon 3; Set C
caggcagaaacaggu

SEQ ID NO: 52023 - RNA, 34 nt, Artificial Sequence
  Synthetic Oligonucleotide; BTLA exon 3; Set C
cucaggcagcagaacaggcagaaacagguaguga

SEQ ID NO: 52024 - RNA, 32 nt, Artificial Sequence
  Synthetic Oligonucleotide; BTLA exon 3; Set C
cucaggcagcagaacaggcagaaacagguagu

SEQ ID NO: 52025 - RNA, 31 nt, Artificial Sequence
  Synthetic Oligonucleotide; BTLA exon 3; Set C
cucaggcagcagaacaggcagaaacagguag

SEQ ID NO: 52026 - RNA, 33 nt, Artificial Sequence
  Synthetic Oligonucleotide; BTLA exon 3; Set C
ucucaggcagcagaacaggcagaaacagguagu

SEQ ID NO: 52027 - RNA, 30 nt, Artificial Sequence
  Synthetic Oligonucleotide; BTLA exon 3; Set C
cucaggcagcagaacaggcagaaacaggua

SEQ ID NO: 52028 - RNA, 29 nt, Artificial Sequence
  Synthetic Oligonucleotide; BTLA exon 3; Set C
cucaggcagcagaacaggcagaaacaggu

SEQ ID NO: 52029 - RNA, 31 nt, Artificial Sequence
  Synthetic Oligonucleotide; BTLA exon 3; Set C
ucucaggcagcagaacaggcagaaacaggua

SEQ ID NO: 52030 - RNA, 28 nt, Artificial Sequence
  Synthetic Oligonucleotide; BTLA exon 3; Set C
cucaggcagcagaacaggcagaaacagg

SEQ ID NO: 52031 - RNA, 29 nt, Artificial Sequence
  Synthetic Oligonucleotide; BTLA exon 3; Set C
ucucaggcagcagaacaggcagaaacagg

SEQ ID NO: 52032 - RNA, 27 nt, Artificial Sequence
  Synthetic Oligonucleotide; BTLA exon 3; Set B
cucaggcagcagaacaggcagaaacag

SEQ ID NO: 52033 - RNA, 28 nt, Artificial Sequence
  Synthetic Oligonucleotide; BTLA exon 3; Set B
ucucaggcagcagaacaggcagaaacag

SEQ ID NO: 52034 - RNA, 26 nt, Artificial Sequence
  Synthetic Oligonucleotide; BTLA exon 3; Set B
cucaggcagcagaacaggcagaaaca

SEQ ID NO: 52035 - RNA, 25 nt, Artificial Sequence
  Synthetic Oligonucleotide; BTLA exon 3; Set B
cucaggcagcagaacaggcagaaac

SEQ ID NO: 52036 - RNA, 27 nt, Artificial Sequence
  Synthetic Oligonucleotide; BTLA exon 3; Set C
ucucaggcagcagaacaggcagaaaca

SEQ ID NO: 52037 - RNA, 24 nt, Artificial Sequence
  Synthetic Oligonucleotide; BTLA exon 3; Set B
cucaggcagcagaacaggcagaaa

SEQ ID NO: 52038 - RNA, 26 nt, Artificial Sequence
  Synthetic Oligonucleotide; BTLA exon 3; Set B
ucucaggcagcagaacaggcagaaac

SEQ ID NO: 52039 - RNA, 23 nt, Artificial Sequence
  Synthetic Oligonucleotide; BTLA exon 3; Set B
cucaggcagcagaacaggcagaa

SEQ ID NO: 52040 - RNA, 25 nt, Artificial Sequence
  Synthetic Oligonucleotide; BTLA exon 3; Set B
ucucaggcagcagaacaggcagaaa

SEQ ID NO: 52041 - RNA, 22 nt, Artificial Sequence
  Synthetic Oligonucleotide; BTLA exon 3; Set B
cucaggcagcagaacaggcaga

SEQ ID NO: 52042 - RNA, 24 nt, Artificial Sequence
  Synthetic Oligonucleotide; BTLA exon 3; Set B
ucucaggcagcagaacaggcagaa

SEQ ID NO: 52043 - RNA, 23 nt, Artificial Sequence
  Synthetic Oligonucleotide; BTLA exon 3; Set B
ucucaggcagcagaacaggcaga

SEQ ID NO: 52044 - RNA, 23 nt, Artificial Sequence
  Synthetic Oligonucleotide; BTLA exon 3; Set B
agaacccaccuuggugccuucuc

SEQ ID NO: 52045 - RNA, 22 nt, Artificial Sequence
  Synthetic Oligonucleotide; BTLA exon 3; Set B
agaacccaccuuggugccuucu

SEQ ID NO: 52046 - RNA, 24 nt, Artificial Sequence
  Synthetic Oligonucleotide; BTLA exon 3; Set B
uagaacccaccuuggugccuucuc

SEQ ID NO: 52047 - RNA, 23 nt, Artificial Sequence
  Synthetic Oligonucleotide; BTLA exon 3; Set B
uagaacccaccuuggugccuucu

SEQ ID NO: 52048 - RNA, 25 nt, Artificial Sequence
  Synthetic Oligonucleotide; BTLA exon 3; Set B
auagaacccaccuuggugccuucuc

SEQ ID NO: 52049 - RNA, 24 nt, Artificial Sequence
  Synthetic Oligonucleotide; BTLA exon 3; Set B
auagaacccaccuuggugccuucu

SEQ ID NO: 52050 - RNA, 26 nt, Artificial Sequence
  Synthetic Oligonucleotide; BTLA exon 3; Set B
aauagaacccaccuuggugccuucuc

SEQ ID NO: 52051 - RNA, 25 nt, Artificial Sequence
  Synthetic Oligonucleotide; BTLA exon 3; Set B
aauagaacccaccuuggugccuucu

SEQ ID NO: 52052 - RNA, 27 nt, Artificial Sequence
  Synthetic Oligonucleotide; BTLA exon 3; Set B
aaauagaacccaccuuggugccuucuc

SEQ ID NO: 52053 - RNA, 26 nt, Artificial Sequence
  Synthetic Oligonucleotide; BTLA exon 3; Set B
aaauagaacccaccuuggugccuucu

SEQ ID NO: 52054 - RNA, 28 nt, Artificial Sequence
  Synthetic Oligonucleotide; BTLA exon 3; Set B
aaaauagaacccaccuuggugccuucuc

SEQ ID NO: 52055 - RNA, 27 nt, Artificial Sequence
  Synthetic Oligonucleotide; BTLA exon 3; Set B
aaaauagaacccaccuuggugccuucu

SEQ ID NO: 52056 - RNA, 29 nt, Artificial Sequence
  Synthetic Oligonucleotide; BTLA exon 3; Set B
gaaaauagaacccaccuuggugccuucuc

SEQ ID NO: 52057 - RNA, 28 nt, Artificial Sequence
  Synthetic Oligonucleotide; BTLA exon 3; Set B
gaaaauagaacccaccuuggugccuucu

SEQ ID NO: 52058 - RNA, 30 nt, Artificial Sequence
  Synthetic Oligonucleotide; BTLA exon 3; Set C
ggaaaauagaacccaccuuggugccuucuc

SEQ ID NO: 52059 - RNA, 29 nt, Artificial Sequence
  Synthetic Oligonucleotide; BTLA exon 3; Set B
ggaaaauagaacccaccuuggugccuucu

SEQ ID NO: 52060 - RNA, 31 nt, Artificial Sequence
  Synthetic Oligonucleotide; BTLA exon 3; Set C
gggaaaauagaacccaccuuggugccuucuc

SEQ ID NO: 52061 - RNA, 30 nt, Artificial Sequence
  Synthetic Oligonucleotide; BTLA exon 3; Set C
gggaaaauagaacccaccuuggugccuucu

SEQ ID NO: 52062 - RNA, 32 nt, Artificial Sequence
  Synthetic Oligonucleotide; BTLA exon 3; Set C
agggaaaauagaacccaccuuggugccuucuc

SEQ ID NO: 52063 - RNA, 31 nt, Artificial Sequence
  Synthetic Oligonucleotide; BTLA exon 3; Set C
agggaaaauagaacccaccuuggugccuucu

SEQ ID NO: 52064 - RNA, 15 nt, Artificial Sequence
  Synthetic Oligonucleotide; BTLA exon 3; Set C
aauagaacccaccuu

SEQ ID NO: 52065 - RNA, 16 nt, Artificial Sequence
  Synthetic Oligonucleotide; BTLA exon 3; Set C
aaauagaacccaccuu

SEQ ID NO: 52066 - RNA, 17 nt, Artificial Sequence
  Synthetic Oligonucleotide; BTLA exon 3; Set C
aaaauagaacccaccuu

SEQ ID NO: 52067 - RNA, 18 nt, Artificial Sequence
  Synthetic Oligonucleotide; BTLA exon 3; Set C
gaaaauagaacccaccuu

SEQ ID NO: 52068 - RNA, 19 nt, Artificial Sequence
  Synthetic Oligonucleotide; BTLA exon 3; Set C
ggaaaauagaacccaccuu

SEQ ID NO: 52069 - RNA, 20 nt, Artificial Sequence
  Synthetic Oligonucleotide; BTLA exon 3; Set C
gggaaaauagaacccaccuu

SEQ ID NO: 52070 - RNA, 21 nt, Artificial Sequence
  Synthetic Oligonucleotide; BTLA exon 3; Set C
agggaaaauagaacccaccuu

SEQ ID NO: 52071 - RNA, 34 nt, Artificial Sequence
  Synthetic Oligonucleotide; BTLA exon 3; Set C
guacugggggcagagggaaaauagaacccaccuu

SEQ ID NO: 52072 - RNA, 35 nt, Artificial Sequence
  Synthetic Oligonucleotide; BTLA exon 3; Set C
gguacugggggcagagggaaaauagaacccaccuu

SEQ ID NO: 52073 - RNA, 36 nt, Artificial Sequence
  Synthetic Oligonucleotide; BTLA exon 3; Set C
ugguacugggggcagagggaaaauagaacccaccuu

SEQ ID NO: 52074 - RNA, 37 nt, Artificial Sequence
  Synthetic Oligonucleotide; BTLA exon 3; Set C
gugguacugggggcagagggaaaauagaacccaccuu

SEQ ID NO: 52075 - RNA, 38 nt, Artificial Sequence
  Synthetic Oligonucleotide; BTLA exon 3; Set C
ugugguacugggggcagagggaaaauagaacccaccuu

SEQ ID NO: 52076 - RNA, 39 nt, Artificial Sequence
  Synthetic Oligonucleotide; BTLA exon 3; Set C
gugugguacugggggcagagggaaaauagaacccaccuu

SEQ ID NO: 52077 - RNA, 40 nt, Artificial Sequence
  Synthetic Oligonucleotide; BTLA exon 3; Set C
ugugugguacugggggcagagggaaaauagaacccaccuu

SEQ ID NO: 52078 - RNA, 26 nt, Artificial Sequence
  Synthetic Oligonucleotide; BTLA exon 3; Set B
guacugggggcagagggaaaauagaa

SEQ ID NO: 52079 - RNA, 27 nt, Artificial Sequence
  Synthetic Oligonucleotide; BTLA exon 3; Set B
gguacugggggcagagggaaaauagaa

SEQ ID NO: 52080 - RNA, 28 nt, Artificial Sequence
  Synthetic Oligonucleotide; BTLA exon 3; Set B
ugguacugggggcagagggaaaauagaa

SEQ ID NO: 52081 - RNA, 29 nt, Artificial Sequence
  Synthetic Oligonucleotide; BTLA exon 3; Set C
gugguacugggggcagagggaaaauagaa

SEQ ID NO: 52082 - RNA, 30 nt, Artificial Sequence
  Synthetic Oligonucleotide; BTLA exon 3; Set C
ugugguacugggggcagagggaaaauagaa

SEQ ID NO: 52083 - RNA, 31 nt, Artificial Sequence
  Synthetic Oligonucleotide; BTLA exon 3; Set C
gugugguacugggggcagagggaaaauagaa

SEQ ID NO: 52084 - RNA, 32 nt, Artificial Sequence
  Synthetic Oligonucleotide; BTLA exon 3; Set C
ugugugguacugggggcagagggaaaauagaa

SEQ ID NO: 52085 - RNA, 33 nt, Artificial Sequence
  Synthetic Oligonucleotide; BTLA exon 3; Set C
augugugguacugggggcagagggaaaauagaa

SEQ ID NO: 52086 - RNA, 34 nt, Artificial Sequence
  Synthetic Oligonucleotide; BTLA exon 3; Set C
aaugugugguacugggggcagagggaaaauagaa

SEQ ID NO: 52087 - RNA, 17 nt, Artificial Sequence
  Synthetic Oligonucleotide; BTLA exon 3; Set B
guacugggggcagaggg

SEQ ID NO: 52088 - RNA, 19 nt, Artificial Sequence
  Synthetic Oligonucleotide; BTLA exon 3; Set C
gguacugggggcagaggga

SEQ ID NO: 52089 - RNA, 35 nt, Artificial Sequence
  Synthetic Oligonucleotide; BTLA exon 3; Set C
aaaugugugguacugggggcagagggaaaauagaa

SEQ ID NO: 52090 - RNA, 16 nt, Artificial Sequence
  Synthetic Oligonucleotide; BTLA exon 3; Set B
guacugggggcagagg

SEQ ID NO: 52091 - RNA, 18 nt, Artificial Sequence
  Synthetic Oligonucleotide; BTLA exon 3; Set B
gguacugggggcagaggg

SEQ ID NO: 52092 - RNA, 20 nt, Artificial Sequence
  Synthetic Oligonucleotide; BTLA exon 3; Set C
ugguacugggggcagaggga

SEQ ID NO: 52093 - RNA, 15 nt, Artificial Sequence
  Synthetic Oligonucleotide; BTLA exon 3; Set C
guacugggggcagag

SEQ ID NO: 52094 - RNA, 17 nt, Artificial Sequence
  Synthetic Oligonucleotide; BTLA exon 3; Set B
gguacugggggcagagg

SEQ ID NO: 52095 - RNA, 19 nt, Artificial Sequence
  Synthetic Oligonucleotide; BTLA exon 3; Set B
ugguacugggggcagaggg

SEQ ID NO: 52096 - RNA, 21 nt, Artificial Sequence
  Synthetic Oligonucleotide; BTLA exon 3; Set C
gugguacugggggcagaggga

SEQ ID NO: 52097 - RNA, 16 nt, Artificial Sequence
  Synthetic Oligonucleotide; BTLA exon 3; Set B
gguacugggggcagag

SEQ ID NO: 52098 - RNA, 18 nt, Artificial Sequence
  Synthetic Oligonucleotide; BTLA exon 3; Set B
ugguacugggggcagagg

SEQ ID NO: 52099 - RNA, 22 nt, Artificial Sequence
  Synthetic Oligonucleotide; BTLA exon 3; Set C
ugugguacugggggcagaggga

SEQ ID NO: 52100 - RNA, 20 nt, Artificial Sequence
  Synthetic Oligonucleotide; BTLA exon 3; Set C
gugguacugggggcagaggg

SEQ ID NO: 52101 - RNA, 17 nt, Artificial Sequence
  Synthetic Oligonucleotide; BTLA exon 3; Set B
ugguacugggggcagag

SEQ ID NO: 52102 - RNA, 15 nt, Artificial Sequence
  Synthetic Oligonucleotide; BTLA exon 3; Set B
gguacugggggcaga

SEQ ID NO: 52103 - RNA, 19 nt, Artificial Sequence
  Synthetic Oligonucleotide; BTLA exon 3; Set B
gugguacugggggcagagg

SEQ ID NO: 52104 - RNA, 21 nt, Artificial Sequence
  Synthetic Oligonucleotide; BTLA exon 3; Set C
ugugguacugggggcagaggg

SEQ ID NO: 52105 - RNA, 18 nt, Artificial Sequence
  Synthetic Oligonucleotide; BTLA exon 3; Set B
gugguacugggggcagag

SEQ ID NO: 52106 - RNA, 16 nt, Artificial Sequence
  Synthetic Oligonucleotide; BTLA exon 3; Set B
ugguacugggggcaga

SEQ ID NO: 52107 - RNA, 20 nt, Artificial Sequence
  Synthetic Oligonucleotide; BTLA exon 3; Set B
ugugguacugggggcagagg

SEQ ID NO: 52108 - RNA, 24 nt, Artificial Sequence
  Synthetic Oligonucleotide; BTLA exon 3; Set C
ugugugguacugggggcagaggga

SEQ ID NO: 52109 - RNA, 19 nt, Artificial Sequence
  Synthetic Oligonucleotide; BTLA exon 3; Set B
ugugguacugggggcagag

SEQ ID NO: 52110 - RNA, 17 nt, Artificial Sequence
  Synthetic Oligonucleotide; BTLA exon 3; Set B
gugguacugggggcaga

SEQ ID NO: 52111 - RNA, 23 nt, Artificial Sequence
  Synthetic Oligonucleotide; BTLA exon 3; Set C
ugugugguacugggggcagaggg

SEQ ID NO: 52112 - RNA, 25 nt, Artificial Sequence
  Synthetic Oligonucleotide; BTLA exon 3; Set C
augugugguacugggggcagaggga

SEQ ID NO: 52113 - RNA, 18 nt, Artificial Sequence
  Synthetic Oligonucleotide; BTLA exon 3; Set B
ugugguacugggggcaga

SEQ ID NO: 52114 - RNA, 22 nt, Artificial Sequence
  Synthetic Oligonucleotide; BTLA exon 3; Set C
ugugugguacugggggcagagg

SEQ ID NO: 52115 - RNA, 24 nt, Artificial Sequence
  Synthetic Oligonucleotide; BTLA exon 3; Set C
augugugguacugggggcagaggg

SEQ ID NO: 52116 - RNA, 26 nt, Artificial Sequence
  Synthetic Oligonucleotide; BTLA exon 3; Set C
aaugugugguacugggggcagaggga

SEQ ID NO: 52117 - RNA, 21 nt, Artificial Sequence
  Synthetic Oligonucleotide; BTLA exon 3; Set B
ugugugguacugggggcagag

SEQ ID NO: 52118 - RNA, 23 nt, Artificial Sequence
  Synthetic Oligonucleotide; BTLA exon 3; Set C
augugugguacugggggcagagg

SEQ ID NO: 52119 - RNA, 25 nt, Artificial Sequence
  Synthetic Oligonucleotide; BTLA exon 3; Set C
aaugugugguacugggggcagaggg

SEQ ID NO: 52120 - RNA, 27 nt, Artificial Sequence
  Synthetic Oligonucleotide; BTLA exon 3; Set C
aaaugugugguacugggggcagaggga

SEQ ID NO: 52121 - RNA, 22 nt, Artificial Sequence
  Synthetic Oligonucleotide; BTLA exon 3; Set B
augugugguacugggggcagag

SEQ ID NO: 52122 - RNA, 40 nt, Artificial Sequence
  Synthetic Oligonucleotide; BTLA exon 3; Set C
uggccccaaaugugugguacugggggcagagggaaaauag

SEQ ID NO: 52123 - RNA, 20 nt, Artificial Sequence
  Synthetic Oligonucleotide; BTLA exon 3; Set B
ugugugguacugggggcaga

SEQ ID NO: 52124 - RNA, 24 nt, Artificial Sequence
  Synthetic Oligonucleotide; BTLA exon 3; Set B
aaugugugguacugggggcagagg

SEQ ID NO: 52125 - RNA, 26 nt, Artificial Sequence
  Synthetic Oligonucleotide; BTLA exon 3; Set C
aaaugugugguacugggggcagaggg

SEQ ID NO: 52126 - RNA, 23 nt, Artificial Sequence
  Synthetic Oligonucleotide; BTLA exon 3; Set B
aaugugugguacugggggcagag

SEQ ID NO: 52127 - RNA, 39 nt, Artificial Sequence
  Synthetic Oligonucleotide; BTLA exon 3; Set C
uggccccaaaugugugguacugggggcagagggaaaaua

SEQ ID NO: 52128 - RNA, 21 nt, Artificial Sequence
  Synthetic Oligonucleotide; BTLA exon 3; Set B
augugugguacugggggcaga

SEQ ID NO: 52129 - RNA, 25 nt, Artificial Sequence
  Synthetic Oligonucleotide; BTLA exon 3; Set B
aaaugugugguacugggggcagagg

SEQ ID NO: 52130 - RNA, 38 nt, Artificial Sequence
  Synthetic Oligonucleotide; BTLA exon 3; Set C
uggccccaaaugugugguacugggggcagagggaaaau

SEQ ID NO: 52131 - RNA, 24 nt, Artificial Sequence
  Synthetic Oligonucleotide; BTLA exon 3; Set B
aaaugugugguacugggggcagag

SEQ ID NO: 52132 - RNA, 22 nt, Artificial Sequence
  Synthetic Oligonucleotide; BTLA exon 3; Set B
aaugugugguacugggggcaga

SEQ ID NO: 52133 - RNA, 37 nt, Artificial Sequence
  Synthetic Oligonucleotide; BTLA exon 3; Set C
uggccccaaaugugugguacugggggcagagggaaaa

SEQ ID NO: 52134 - RNA, 23 nt, Artificial Sequence
  Synthetic Oligonucleotide; BTLA exon 3; Set B
aaaugugugguacugggggcaga

SEQ ID NO: 52135 - RNA, 36 nt, Artificial Sequence
  Synthetic Oligonucleotide; BTLA exon 3; Set C
uggccccaaaugugugguacugggggcagagggaaa

SEQ ID NO: 52136 - RNA, 35 nt, Artificial Sequence
  Synthetic Oligonucleotide; BTLA exon 3; Set C
uggccccaaaugugugguacugggggcagagggaa

SEQ ID NO: 52137 - RNA, 34 nt, Artificial Sequence
  Synthetic Oligonucleotide; BTLA exon 3; Set C
uggccccaaaugugugguacugggggcagaggga

SEQ ID NO: 52138 - RNA, 33 nt, Artificial Sequence
  Synthetic Oligonucleotide; BTLA exon 3; Set C
uggccccaaaugugugguacugggggcagaggg

SEQ ID NO: 52139 - RNA, 38 nt, Artificial Sequence
  Synthetic Oligonucleotide; BTLA exon 3; Set C
gaauggccccaaaugugugguacugggggcagagggaa

SEQ ID NO: 52140 - RNA, 32 nt, Artificial Sequence
  Synthetic Oligonucleotide; BTLA exon 3; Set C
uggccccaaaugugugguacugggggcagagg

SEQ ID NO: 52141 - RNA, 36 nt, Artificial Sequence
  Synthetic Oligonucleotide; BTLA exon 3; Set C
aauggccccaaaugugugguacugggggcagaggga

SEQ ID NO: 52142 - RNA, 31 nt, Artificial Sequence
  Synthetic Oligonucleotide; BTLA exon 3; Set C
uggccccaaaugugugguacugggggcagag

SEQ ID NO: 52143 - RNA, 33 nt, Artificial Sequence
  Synthetic Oligonucleotide; BTLA exon 3; Set C
auggccccaaaugugugguacugggggcagagg

SEQ ID NO: 52144 - RNA, 35 nt, Artificial Sequence
  Synthetic Oligonucleotide; BTLA exon 3; Set C
aauggccccaaaugugugguacugggggcagaggg

SEQ ID NO: 52145 - RNA, 37 nt, Artificial Sequence
  Synthetic Oligonucleotide; BTLA exon 3; Set C
gaauggccccaaaugugugguacugggggcagaggga

SEQ ID NO: 52146 - RNA, 30 nt, Artificial Sequence
  Synthetic Oligonucleotide; BTLA exon 3; Set C
uggccccaaaugugugguacugggggcaga

SEQ ID NO: 52147 - RNA, 34 nt, Artificial Sequence
  Synthetic Oligonucleotide; BTLA exon 3; Set C
aauggccccaaaugugugguacugggggcagagg

SEQ ID NO: 52148 - RNA, 36 nt, Artificial Sequence
  Synthetic Oligonucleotide; BTLA exon 3; Set C
gaauggccccaaaugugugguacugggggcagaggg

SEQ ID NO: 52149 - RNA, 33 nt, Artificial Sequence
  Synthetic Oligonucleotide; BTLA exon 3; Set C
aauggccccaaaugugugguacugggggcagag

SEQ ID NO: 52150 - RNA, 31 nt, Artificial Sequence
  Synthetic Oligonucleotide; BTLA exon 3; Set C
auggccccaaaugugugguacugggggcaga

SEQ ID NO: 52151 - RNA, 35 nt, Artificial Sequence
  Synthetic Oligonucleotide; BTLA exon 3; Set C
gaauggccccaaaugugugguacugggggcagagg

SEQ ID NO: 52152 - RNA, 34 nt, Artificial Sequence
  Synthetic Oligonucleotide; BTLA exon 3; Set C
gaauggccccaaaugugugguacugggggcagag

SEQ ID NO: 52153 - RNA, 32 nt, Artificial Sequence
  Synthetic Oligonucleotide; BTLA exon 3; Set C
aauggccccaaaugugugguacugggggcaga

SEQ ID NO: 52154 - RNA, 33 nt, Artificial Sequence
  Synthetic Oligonucleotide; BTLA exon 3; Set C
gaauggccccaaaugugugguacugggggcaga

SEQ ID NO: 52155 - RNA, 19 nt, Artificial Sequence
  Synthetic Oligonucleotide; BTLA exon 3; Set B
uggccccaaauguguggua

SEQ ID NO: 52156 - RNA, 20 nt, Artificial Sequence
  Synthetic Oligonucleotide; BTLA exon 3; Set B
auggccccaaauguguggua

SEQ ID NO: 52157 - RNA, 18 nt, Artificial Sequence
  Synthetic Oligonucleotide; BTLA exon 3; Set C
uggccccaaauguguggu

SEQ ID NO: 52158 - RNA, 21 nt, Artificial Sequence
  Synthetic Oligonucleotide; BTLA exon 3; Set C
aauggccccaaauguguggua

SEQ ID NO: 52159 - RNA, 19 nt, Artificial Sequence
  Synthetic Oligonucleotide; BTLA exon 3; Set C
auggccccaaauguguggu

SEQ ID NO: 52160 - RNA, 17 nt, Artificial Sequence
  Synthetic Oligonucleotide; BTLA exon 3; Set C
uggccccaaaugugugg

SEQ ID NO: 52161 - RNA, 22 nt, Artificial Sequence
  Synthetic Oligonucleotide; BTLA exon 3; Set B
gaauggccccaaauguguggua

SEQ ID NO: 52162 - RNA, 20 nt, Artificial Sequence
  Synthetic Oligonucleotide; BTLA exon 3; Set C
aauggccccaaauguguggu

SEQ ID NO: 52163 - RNA, 18 nt, Artificial Sequence
  Synthetic Oligonucleotide; BTLA exon 3; Set C
auggccccaaaugugugg

SEQ ID NO: 52164 - RNA, 21 nt, Artificial Sequence
  Synthetic Oligonucleotide; BTLA exon 3; Set B
gaauggccccaaauguguggu

SEQ ID NO: 52165 - RNA, 19 nt, Artificial Sequence
  Synthetic Oligonucleotide; BTLA exon 3; Set C
aauggccccaaaugugugg

SEQ ID NO: 52166 - RNA, 17 nt, Artificial Sequence
  Synthetic Oligonucleotide; BTLA exon 3; Set C
auggccccaaaugugug

SEQ ID NO: 52167 - RNA, 16 nt, Artificial Sequence
  Synthetic Oligonucleotide; BTLA exon 3; Set C
auggccccaaaugugu

SEQ ID NO: 52168 - RNA, 20 nt, Artificial Sequence
  Synthetic Oligonucleotide; BTLA exon 3; Set C
gaauggccccaaaugugugg

SEQ ID NO: 52169 - RNA, 18 nt, Artificial Sequence
  Synthetic Oligonucleotide; BTLA exon 3; Set C
aauggccccaaaugugug

SEQ ID NO: 52170 - RNA, 15 nt, Artificial Sequence
  Synthetic Oligonucleotide; BTLA exon 3; Set C
auggccccaaaugug

SEQ ID NO: 52171 - RNA, 17 nt, Artificial Sequence
  Synthetic Oligonucleotide; BTLA exon 3; Set C
aauggccccaaaugugu

SEQ ID NO: 52172 - RNA, 19 nt, Artificial Sequence
  Synthetic Oligonucleotide; BTLA exon 3; Set C
gaauggccccaaaugugug

SEQ ID NO: 52173 - RNA, 16 nt, Artificial Sequence
  Synthetic Oligonucleotide; BTLA exon 3; Set C
aauggccccaaaugug

SEQ ID NO: 52174 - RNA, 18 nt, Artificial Sequence
  Synthetic Oligonucleotide; BTLA exon 3; Set C
gaauggccccaaaugugu

SEQ ID NO: 52175 - RNA, 17 nt, Artificial Sequence
  Synthetic Oligonucleotide; BTLA exon 3; Set C
gaauggccccaaaugug

SEQ ID NO: 52176 - RNA, 15 nt, Artificial Sequence
  Synthetic Oligonucleotide; BTLA exon 3; Set C
aauggccccaaaugu

SEQ ID NO: 52177 - RNA, 16 nt, Artificial Sequence
  Synthetic Oligonucleotide; BTLA exon 3; Set C
gaauggccccaaaugu

SEQ ID NO: 52178 - RNA, 15 nt, Artificial Sequence
  Synthetic Oligonucleotide; BTLA exon 3; Set C
gaauggccccaaaug

SEQ ID NO: 52179 - RNA, 25 nt, Artificial Sequence
  Synthetic Oligonucleotide; BTLA exon 3; Set A
ugagauauauugggaucagcggcac

SEQ ID NO: 52180 - RNA, 24 nt, Artificial Sequence
  Synthetic Oligonucleotide; BTLA exon 3; Set A
ugagauauauugggaucagcggca

SEQ ID NO: 52181 - RNA, 26 nt, Artificial Sequence
  Synthetic Oligonucleotide; BTLA exon 3; Set A
cugagauauauugggaucagcggcac

SEQ ID NO: 52182 - RNA, 25 nt, Artificial Sequence
  Synthetic Oligonucleotide; BTLA exon 3; Set A
cugagauauauugggaucagcggca

SEQ ID NO: 52183 - RNA, 27 nt, Artificial Sequence
  Synthetic Oligonucleotide; BTLA exon 3; Set A
ucugagauauauugggaucagcggcac

SEQ ID NO: 52184 - RNA, 24 nt, Artificial Sequence
  Synthetic Oligonucleotide; BTLA exon 3; Set A
cugagauauauugggaucagcggc

SEQ ID NO: 52185 - RNA, 26 nt, Artificial Sequence
  Synthetic Oligonucleotide; BTLA exon 3; Set A
ucugagauauauugggaucagcggca

SEQ ID NO: 52186 - RNA, 28 nt, Artificial Sequence
  Synthetic Oligonucleotide; BTLA exon 3; Set A
aucugagauauauugggaucagcggcac

SEQ ID NO: 52187 - RNA, 23 nt, Artificial Sequence
  Synthetic Oligonucleotide; BTLA exon 3; Set A
cugagauauauugggaucagcgg

SEQ ID NO: 52188 - RNA, 25 nt, Artificial Sequence
  Synthetic Oligonucleotide; BTLA exon 3; Set A
ucugagauauauugggaucagcggc

SEQ ID NO: 52189 - RNA, 21 nt, Artificial Sequence
  Synthetic Oligonucleotide; BTLA exon 3; Set C
ugagauauauugggaucagcg

SEQ ID NO: 52190 - RNA, 27 nt, Artificial Sequence
  Synthetic Oligonucleotide; BTLA exon 3; Set A
aucugagauauauugggaucagcggca

SEQ ID NO: 52191 - RNA, 15 nt, Artificial Sequence
  Synthetic Oligonucleotide; BTLA exon 3; Set C
gauauauugggauca

SEQ ID NO: 52192 - RNA, 22 nt, Artificial Sequence
  Synthetic Oligonucleotide; BTLA exon 3; Set C
cugagauauauugggaucagcg

SEQ ID NO: 52193 - RNA, 20 nt, Artificial Sequence
  Synthetic Oligonucleotide; BTLA exon 3; Set C
ugagauauauugggaucagc

SEQ ID NO: 52194 - RNA, 23 nt, Artificial Sequence
  Synthetic Oligonucleotide; BTLA exon 3; Set C
ucugagauauauugggaucagcg

SEQ ID NO: 52195 - RNA, 21 nt, Artificial Sequence
  Synthetic Oligonucleotide; BTLA exon 3; Set C
cugagauauauugggaucagc

SEQ ID NO: 52196 - RNA, 22 nt, Artificial Sequence
  Synthetic Oligonucleotide; BTLA exon 3; Set C
ucugagauauauugggaucagc

SEQ ID NO: 52197 - RNA, 23 nt, Artificial Sequence
  Synthetic Oligonucleotide; BTLA exon 3; Set C
aucugagauauauugggaucagc

SEQ ID NO: 52198 - RNA, 16 nt, Artificial Sequence
  Synthetic Oligonucleotide; BTLA exon 3; Set C
ugagauauauugggau

SEQ ID NO: 52199 - RNA, 17 nt, Artificial Sequence
  Synthetic Oligonucleotide; BTLA exon 3; Set C
cugagauauauugggau

SEQ ID NO: 52200 - RNA, 16 nt, Artificial Sequence
  Synthetic Oligonucleotide; BTLA exon 3; Set C
cugagauauauuggga

SEQ ID NO: 52201 - RNA, 18 nt, Artificial Sequence
  Synthetic Oligonucleotide; BTLA exon 3; Set C
ucugagauauauugggau

SEQ ID NO: 52202 - RNA, 22 nt, Artificial Sequence
  Synthetic Oligonucleotide; BTLA exon 3; Set C
aaucugagauauauugggauca

SEQ ID NO: 52203 - RNA, 15 nt, Artificial Sequence
  Synthetic Oligonucleotide; BTLA exon 3; Set C
cugagauauauuggg

SEQ ID NO: 52204 - RNA, 19 nt, Artificial Sequence
  Synthetic Oligonucleotide; BTLA exon 3; Set C
aucugagauauauugggau

SEQ ID NO: 52205 - RNA, 21 nt, Artificial Sequence
  Synthetic Oligonucleotide; BTLA exon 3; Set C
aaucugagauauauugggauc

SEQ ID NO: 52206 - RNA, 23 nt, Artificial Sequence
  Synthetic Oligonucleotide; BTLA exon 3; Set C
aaaucugagauauauugggauca

SEQ ID NO: 52207 - RNA, 22 nt, Artificial Sequence
  Synthetic Oligonucleotide; BTLA exon 3; Set C
aaaucugagauauauugggauc

SEQ ID NO: 52208 - RNA, 24 nt, Artificial Sequence
  Synthetic Oligonucleotide; BTLA exon 3; Set C
gaaaucugagauauauugggauca

SEQ ID NO: 52209 - RNA, 15 nt, Artificial Sequence
  Synthetic Oligonucleotide; BTLA exon 3; Set C
ucugagauauauugg

SEQ ID NO: 52210 - RNA, 23 nt, Artificial Sequence
  Synthetic Oligonucleotide; BTLA exon 3; Set C
gaaaucugagauauauugggauc

SEQ ID NO: 52211 - RNA, 25 nt, Artificial Sequence
  Synthetic Oligonucleotide; BTLA exon 3; Set C
ggaaaucugagauauauugggauca

SEQ ID NO: 52212 - RNA, 24 nt, Artificial Sequence
  Synthetic Oligonucleotide; BTLA exon 3; Set C
ggaaaucugagauauauugggauc

SEQ ID NO: 52213 - RNA, 26 nt, Artificial Sequence
  Synthetic Oligonucleotide; BTLA exon 3; Set C
aggaaaucugagauauauugggauca

SEQ ID NO: 52214 - RNA, 25 nt, Artificial Sequence
  Synthetic Oligonucleotide; BTLA exon 3; Set C
aggaaaucugagauauauugggauc

SEQ ID NO: 52215 - RNA, 27 nt, Artificial Sequence
  Synthetic Oligonucleotide; BTLA exon 3; Set C
uaggaaaucugagauauauugggauca

SEQ ID NO: 52216 - RNA, 26 nt, Artificial Sequence
  Synthetic Oligonucleotide; BTLA exon 3; Set C
uaggaaaucugagauauauugggauc

SEQ ID NO: 52217 - RNA, 28 nt, Artificial Sequence
  Synthetic Oligonucleotide; BTLA exon 3; Set C
uuaggaaaucugagauauauugggauca

SEQ ID NO: 52218 - RNA, 31 nt, Artificial Sequence
  Synthetic Oligonucleotide; BTLA exon 3; Set A
aguuaggaaaucugagauauauugggaucag

SEQ ID NO: 52219 - RNA, 27 nt, Artificial Sequence
  Synthetic Oligonucleotide; BTLA exon 3; Set C
uuaggaaaucugagauauauugggauc

SEQ ID NO: 52220 - RNA, 29 nt, Artificial Sequence
  Synthetic Oligonucleotide; BTLA exon 3; Set C
guuaggaaaucugagauauauugggauca

SEQ ID NO: 52221 - RNA, 32 nt, Artificial Sequence
  Synthetic Oligonucleotide; BTLA exon 3; Set A
gaguuaggaaaucugagauauauugggaucag

SEQ ID NO: 52222 - RNA, 28 nt, Artificial Sequence
  Synthetic Oligonucleotide; BTLA exon 3; Set C
guuaggaaaucugagauauauugggauc

SEQ ID NO: 52223 - RNA, 30 nt, Artificial Sequence
  Synthetic Oligonucleotide; BTLA exon 3; Set A
aguuaggaaaucugagauauauugggauca

SEQ ID NO: 52224 - RNA, 33 nt, Artificial Sequence
  Synthetic Oligonucleotide; BTLA exon 3; Set A
agaguuaggaaaucugagauauauugggaucag

SEQ ID NO: 52225 - RNA, 29 nt, Artificial Sequence
  Synthetic Oligonucleotide; BTLA exon 3; Set C
aguuaggaaaucugagauauauugggauc

SEQ ID NO: 52226 - RNA, 34 nt, Artificial Sequence
  Synthetic Oligonucleotide; BTLA exon 3; Set A
gagaguuaggaaaucugagauauauugggaucag

SEQ ID NO: 52227 - RNA, 35 nt, Artificial Sequence
  Synthetic Oligonucleotide; BTLA exon 3; Set A
agagaguuaggaaaucugagauauauugggaucag

SEQ ID NO: 52228 - RNA, 36 nt, Artificial Sequence
  Synthetic Oligonucleotide; BTLA exon 3; Set A
aagagaguuaggaaaucugagauauauugggaucag

SEQ ID NO: 52229 - RNA, 35 nt, Artificial Sequence
  Synthetic Oligonucleotide; BTLA exon 3; Set A
aagagaguuaggaaaucugagauauauugggauca

SEQ ID NO: 52230 - RNA, 34 nt, Artificial Sequence
  Synthetic Oligonucleotide; BTLA exon 3; Set A
aagagaguuaggaaaucugagauauauugggauc

SEQ ID NO: 52231 - RNA, 36 nt, Artificial Sequence
  Synthetic Oligonucleotide; BTLA exon 3; Set A
aaagagaguuaggaaaucugagauauauugggauca

SEQ ID NO: 52232 - RNA, 35 nt, Artificial Sequence
  Synthetic Oligonucleotide; BTLA exon 3; Set A
aaagagaguuaggaaaucugagauauauugggauc

SEQ ID NO: 52233 - RNA, 37 nt, Artificial Sequence
  Synthetic Oligonucleotide; BTLA exon 3; Set A
uaaagagaguuaggaaaucugagauauauugggauca

SEQ ID NO: 52234 - RNA, 36 nt, Artificial Sequence
  Synthetic Oligonucleotide; BTLA exon 3; Set A
uaaagagaguuaggaaaucugagauauauugggauc

SEQ ID NO: 52235 - RNA, 38 nt, Artificial Sequence
  Synthetic Oligonucleotide; BTLA exon 3; Set A
augcuaaagagaguuaggaaaucugagauauauuggga

SEQ ID NO: 52236 - RNA, 37 nt, Artificial Sequence
  Synthetic Oligonucleotide; BTLA exon 3; Set A
augcuaaagagaguuaggaaaucugagauauauuggg

SEQ ID NO: 52237 - RNA, 39 nt, Artificial Sequence
  Synthetic Oligonucleotide; BTLA exon 3; Set A
aaugcuaaagagaguuaggaaaucugagauauauuggga

SEQ ID NO: 52238 - RNA, 15 nt, Artificial Sequence
  Synthetic Oligonucleotide; BTLA exon 3; Set C
aguuaggaaaucuga

SEQ ID NO: 52239 - RNA, 38 nt, Artificial Sequence
  Synthetic Oligonucleotide; BTLA exon 3; Set A
aaugcuaaagagaguuaggaaaucugagauauauuggg

SEQ ID NO: 52240 - RNA, 36 nt, Artificial Sequence
  Synthetic Oligonucleotide; BTLA exon 3; Set A
augcuaaagagaguuaggaaaucugagauauauugg

SEQ ID NO: 52241 - RNA, 16 nt, Artificial Sequence
  Synthetic Oligonucleotide; BTLA exon 3; Set C
gaguuaggaaaucuga

SEQ ID NO: 52242 - RNA, 37 nt, Artificial Sequence
  Synthetic Oligonucleotide; BTLA exon 3; Set A
aaugcuaaagagaguuaggaaaucugagauauauugg

SEQ ID NO: 52243 - RNA, 35 nt, Artificial Sequence
  Synthetic Oligonucleotide; BTLA exon 3; Set C
augcuaaagagaguuaggaaaucugagauauauug

SEQ ID NO: 52244 - RNA, 17 nt, Artificial Sequence
  Synthetic Oligonucleotide; BTLA exon 3; Set C
agaguuaggaaaucuga

SEQ ID NO: 52245 - RNA, 15 nt, Artificial Sequence
  Synthetic Oligonucleotide; BTLA exon 3; Set C
gaguuaggaaaucug

SEQ ID NO: 52246 - RNA, 34 nt, Artificial Sequence
  Synthetic Oligonucleotide; BTLA exon 3; Set C
augcuaaagagaguuaggaaaucugagauauauu

SEQ ID NO: 52247 - RNA, 36 nt, Artificial Sequence
  Synthetic Oligonucleotide; BTLA exon 3; Set C
aaugcuaaagagaguuaggaaaucugagauauauug

SEQ ID NO: 52248 - RNA, 18 nt, Artificial Sequence
  Synthetic Oligonucleotide; BTLA exon 3; Set C
gagaguuaggaaaucuga

SEQ ID NO: 52249 - RNA, 16 nt, Artificial Sequence
  Synthetic Oligonucleotide; BTLA exon 3; Set C
agaguuaggaaaucug

SEQ ID NO: 52250 - RNA, 35 nt, Artificial Sequence
  Synthetic Oligonucleotide; BTLA exon 3; Set C
aaugcuaaagagaguuaggaaaucugagauauauu

SEQ ID NO: 52251 - RNA, 33 nt, Artificial Sequence
  Synthetic Oligonucleotide; BTLA exon 3; Set C
augcuaaagagaguuaggaaaucugagauauau

SEQ ID NO: 52252 - RNA, 19 nt, Artificial Sequence
  Synthetic Oligonucleotide; BTLA exon 3; Set C
agagaguuaggaaaucuga

SEQ ID NO: 52253 - RNA, 15 nt, Artificial Sequence
  Synthetic Oligonucleotide; BTLA exon 3; Set C
agaguuaggaaaucu

SEQ ID NO: 52254 - RNA, 17 nt, Artificial Sequence
  Synthetic Oligonucleotide; BTLA exon 3; Set C
gagaguuaggaaaucug

SEQ ID NO: 52255 - RNA, 34 nt, Artificial Sequence
  Synthetic Oligonucleotide; BTLA exon 3; Set C
aaugcuaaagagaguuaggaaaucugagauauau

SEQ ID NO: 52256 - RNA, 32 nt, Artificial Sequence
  Synthetic Oligonucleotide; BTLA exon 3; Set C
augcuaaagagaguuaggaaaucugagauaua

SEQ ID NO: 52257 - RNA, 20 nt, Artificial Sequence
  Synthetic Oligonucleotide; BTLA exon 3; Set C
aagagaguuaggaaaucuga

SEQ ID NO: 52258 - RNA, 16 nt, Artificial Sequence
  Synthetic Oligonucleotide; BTLA exon 3; Set C
gagaguuaggaaaucu

SEQ ID NO: 52259 - RNA, 18 nt, Artificial Sequence
  Synthetic Oligonucleotide; BTLA exon 3; Set C
agagaguuaggaaaucug

SEQ ID NO: 52260 - RNA, 33 nt, Artificial Sequence
  Synthetic Oligonucleotide; BTLA exon 3; Set C
aaugcuaaagagaguuaggaaaucugagauaua

SEQ ID NO: 52261 - RNA, 31 nt, Artificial Sequence
  Synthetic Oligonucleotide; BTLA exon 3; Set C
augcuaaagagaguuaggaaaucugagauau

SEQ ID NO: 52262 - RNA, 15 nt, Artificial Sequence
  Synthetic Oligonucleotide; BTLA exon 3; Set C
gagaguuaggaaauc

SEQ ID NO: 52263 - RNA, 17 nt, Artificial Sequence
  Synthetic Oligonucleotide; BTLA exon 3; Set C
agagaguuaggaaaucu

SEQ ID NO: 52264 - RNA, 19 nt, Artificial Sequence
  Synthetic Oligonucleotide; BTLA exon 3; Set C
aagagaguuaggaaaucug

SEQ ID NO: 52265 - RNA, 32 nt, Artificial Sequence
  Synthetic Oligonucleotide; BTLA exon 3; Set C
aaugcuaaagagaguuaggaaaucugagauau

SEQ ID NO: 52266 - RNA, 30 nt, Artificial Sequence
  Synthetic Oligonucleotide; BTLA exon 3; Set C
augcuaaagagaguuaggaaaucugagaua

SEQ ID NO: 52267 - RNA, 16 nt, Artificial Sequence
  Synthetic Oligonucleotide; BTLA exon 3; Set C
agagaguuaggaaauc

SEQ ID NO: 52268 - RNA, 18 nt, Artificial Sequence
  Synthetic Oligonucleotide; BTLA exon 3; Set C
aagagaguuaggaaaucu

SEQ ID NO: 52269 - RNA, 31 nt, Artificial Sequence
  Synthetic Oligonucleotide; BTLA exon 3; Set C
aaugcuaaagagaguuaggaaaucugagaua

SEQ ID NO: 52270 - RNA, 29 nt, Artificial Sequence
  Synthetic Oligonucleotide; BTLA exon 3; Set C
augcuaaagagaguuaggaaaucugagau

SEQ ID NO: 52271 - RNA, 30 nt, Artificial Sequence
  Synthetic Oligonucleotide; BTLA exon 3; Set C
aaugcuaaagagaguuaggaaaucugagau

SEQ ID NO: 52272 - RNA, 22 nt, Artificial Sequence
  Synthetic Oligonucleotide; BTLA exon 3; Set C
augcuaaagagaguuaggaaau

SEQ ID NO: 52273 - RNA, 30 nt, Artificial Sequence
  Synthetic Oligonucleotide; BTLA exon 3; Set C
guaaaugcuaaagagaguuaggaaaucuga

SEQ ID NO: 52274 - RNA, 23 nt, Artificial Sequence
  Synthetic Oligonucleotide; BTLA exon 3; Set C
aaugcuaaagagaguuaggaaau

SEQ ID NO: 52275 - RNA, 21 nt, Artificial Sequence
  Synthetic Oligonucleotide; BTLA exon 3; Set C
augcuaaagagaguuaggaaa

SEQ ID NO: 52276 - RNA, 29 nt, Artificial Sequence
  Synthetic Oligonucleotide; BTLA exon 3; Set C
guaaaugcuaaagagaguuaggaaaucug

SEQ ID NO: 52277 - RNA, 22 nt, Artificial Sequence
  Synthetic Oligonucleotide; BTLA exon 3; Set C
aaugcuaaagagaguuaggaaa

SEQ ID NO: 52278 - RNA, 20 nt, Artificial Sequence
  Synthetic Oligonucleotide; BTLA exon 3; Set C
augcuaaagagaguuaggaa

SEQ ID NO: 52279 - RNA, 28 nt, Artificial Sequence
  Synthetic Oligonucleotide; BTLA exon 3; Set C
guaaaugcuaaagagaguuaggaaaucu

SEQ ID NO: 52280 - RNA, 30 nt, Artificial Sequence
  Synthetic Oligonucleotide; BTLA exon 3; Set C
aguaaaugcuaaagagaguuaggaaaucug

SEQ ID NO: 52281 - RNA, 21 nt, Artificial Sequence
  Synthetic Oligonucleotide; BTLA exon 3; Set C
aaugcuaaagagaguuaggaa

SEQ ID NO: 52282 - RNA, 19 nt, Artificial Sequence
  Synthetic Oligonucleotide; BTLA exon 3; Set C
augcuaaagagaguuagga

SEQ ID NO: 52283 - RNA, 27 nt, Artificial Sequence
  Synthetic Oligonucleotide; BTLA exon 3; Set C
guaaaugcuaaagagaguuaggaaauc

SEQ ID NO: 52284 - RNA, 29 nt, Artificial Sequence
  Synthetic Oligonucleotide; BTLA exon 3; Set C
aguaaaugcuaaagagaguuaggaaaucu

SEQ ID NO: 52285 - RNA, 31 nt, Artificial Sequence
  Synthetic Oligonucleotide; BTLA exon 3; Set C
uaguaaaugcuaaagagaguuaggaaaucug

SEQ ID NO: 52286 - RNA, 20 nt, Artificial Sequence
  Synthetic Oligonucleotide; BTLA exon 3; Set C
aaugcuaaagagaguuagga

SEQ ID NO: 52287 - RNA, 18 nt, Artificial Sequence
  Synthetic Oligonucleotide; BTLA exon 3; Set C
augcuaaagagaguuagg

SEQ ID NO: 52288 - RNA, 30 nt, Artificial Sequence
  Synthetic Oligonucleotide; BTLA exon 3; Set C
uaguaaaugcuaaagagaguuaggaaaucu

SEQ ID NO: 52289 - RNA, 17 nt, Artificial Sequence
  Synthetic Oligonucleotide; BTLA exon 3; Set C
augcuaaagagaguuag

SEQ ID NO: 52290 - RNA, 19 nt, Artificial Sequence
  Synthetic Oligonucleotide; BTLA exon 3; Set C
aaugcuaaagagaguuagg

SEQ ID NO: 52291 - RNA, 18 nt, Artificial Sequence
  Synthetic Oligonucleotide; BTLA exon 3; Set C
aaugcuaaagagaguuag

SEQ ID NO: 52292 - RNA, 16 nt, Artificial Sequence
  Synthetic Oligonucleotide; BTLA exon 3; Set C
augcuaaagagaguua

SEQ ID NO: 52293 - RNA, 15 nt, Artificial Sequence
  Synthetic Oligonucleotide; BTLA exon 3; Set C
augcuaaagagaguu

SEQ ID NO: 52294 - RNA, 17 nt, Artificial Sequence
  Synthetic Oligonucleotide; BTLA exon 3; Set C
aaugcuaaagagaguua

SEQ ID NO: 52295 - RNA, 16 nt, Artificial Sequence
  Synthetic Oligonucleotide; BTLA exon 3; Set C
aaugcuaaagagaguu

SEQ ID NO: 52296 - RNA, 39 nt, Artificial Sequence
  Synthetic Oligonucleotide; BTLA exon 3; Set A
ggaauguuaguaaaugcuaaagagaguuaggaaaucuga

SEQ ID NO: 52297 - RNA, 16 nt, Artificial Sequence
  Synthetic Oligonucleotide; BTLA exon 3; Set C
aaaugcuaaagagagu

SEQ ID NO: 52298 - RNA, 40 nt, Artificial Sequence
  Synthetic Oligonucleotide; BTLA exon 3; Set A
uggaauguuaguaaaugcuaaagagaguuaggaaaucuga

SEQ ID NO: 52299 - RNA, 38 nt, Artificial Sequence
  Synthetic Oligonucleotide; BTLA exon 3; Set A
ggaauguuaguaaaugcuaaagagaguuaggaaaucug

SEQ ID NO: 52300 - RNA, 17 nt, Artificial Sequence
  Synthetic Oligonucleotide; BTLA exon 3; Set C
uaaaugcuaaagagagu

SEQ ID NO: 52301 - RNA, 15 nt, Artificial Sequence
  Synthetic Oligonucleotide; BTLA exon 3; Set C
aaaugcuaaagagag

SEQ ID NO: 52302 - RNA, 37 nt, Artificial Sequence
  Synthetic Oligonucleotide; BTLA exon 3; Set A
ggaauguuaguaaaugcuaaagagaguuaggaaaucu

SEQ ID NO: 52303 - RNA, 39 nt, Artificial Sequence
  Synthetic Oligonucleotide; BTLA exon 3; Set A
uggaauguuaguaaaugcuaaagagaguuaggaaaucug

SEQ ID NO: 52304 - RNA, 34 nt, Artificial Sequence
  Synthetic Oligonucleotide; BTLA exon 3; Set C
gaauguuaguaaaugcuaaagagaguuaggaaau

SEQ ID NO: 52305 - RNA, 16 nt, Artificial Sequence
  Synthetic Oligonucleotide; BTLA exon 3; Set C
uaaaugcuaaagagag

SEQ ID NO: 52306 - RNA, 36 nt, Artificial Sequence
  Synthetic Oligonucleotide; BTLA exon 3; Set C
ggaauguuaguaaaugcuaaagagaguuaggaaauc

SEQ ID NO: 52307 - RNA, 38 nt, Artificial Sequence
  Synthetic Oligonucleotide; BTLA exon 3; Set A
uggaauguuaguaaaugcuaaagagaguuaggaaaucu

SEQ ID NO: 52308 - RNA, 33 nt, Artificial Sequence
  Synthetic Oligonucleotide; BTLA exon 3; Set C
gaauguuaguaaaugcuaaagagaguuaggaaa

SEQ ID NO: 52309 - RNA, 15 nt, Artificial Sequence
  Synthetic Oligonucleotide; BTLA exon 3; Set C
uaaaugcuaaagaga

SEQ ID NO: 52310 - RNA, 32 nt, Artificial Sequence
  Synthetic Oligonucleotide; BTLA exon 3; Set C
gaauguuaguaaaugcuaaagagaguuaggaa

SEQ ID NO: 52311 - RNA, 37 nt, Artificial Sequence
  Synthetic Oligonucleotide; BTLA exon 3; Set A
cuggaauguuaguaaaugcuaaagagaguuaggaaau

SEQ ID NO: 52312 - RNA, 36 nt, Artificial Sequence
  Synthetic Oligonucleotide; BTLA exon 3; Set A
cuggaauguuaguaaaugcuaaagagaguuaggaaa

SEQ ID NO: 52313 - RNA, 38 nt, Artificial Sequence
  Synthetic Oligonucleotide; BTLA exon 3; Set A
ucuggaauguuaguaaaugcuaaagagaguuaggaaau

SEQ ID NO: 52314 - RNA, 35 nt, Artificial Sequence
  Synthetic Oligonucleotide; BTLA exon 3; Set A
cuggaauguuaguaaaugcuaaagagaguuaggaa

SEQ ID NO: 52315 - RNA, 37 nt, Artificial Sequence
  Synthetic Oligonucleotide; BTLA exon 3; Set A
ucuggaauguuaguaaaugcuaaagagaguuaggaaa

SEQ ID NO: 52316 - RNA, 36 nt, Artificial Sequence
  Synthetic Oligonucleotide; BTLA exon 3; Set A
ucuggaauguuaguaaaugcuaaagagaguuaggaa

SEQ ID NO: 52317 - RNA, 34 nt, Artificial Sequence
  Synthetic Oligonucleotide; BTLA exon 3; Set A
cuggaauguuaguaaaugcuaaagagaguuagga

SEQ ID NO: 52318 - RNA, 33 nt, Artificial Sequence
  Synthetic Oligonucleotide; BTLA exon 3; Set C
cuggaauguuaguaaaugcuaaagagaguuagg

SEQ ID NO: 52319 - RNA, 35 nt, Artificial Sequence
  Synthetic Oligonucleotide; BTLA exon 3; Set A
ucuggaauguuaguaaaugcuaaagagaguuagga

SEQ ID NO: 52320 - RNA, 32 nt, Artificial Sequence
  Synthetic Oligonucleotide; BTLA exon 3; Set C
cuggaauguuaguaaaugcuaaagagaguuag

SEQ ID NO: 52321 - RNA, 34 nt, Artificial Sequence
  Synthetic Oligonucleotide; BTLA exon 3; Set A
ucuggaauguuaguaaaugcuaaagagaguuagg

SEQ ID NO: 52322 - RNA, 31 nt, Artificial Sequence
  Synthetic Oligonucleotide; BTLA exon 3; Set C
cuggaauguuaguaaaugcuaaagagaguua

SEQ ID NO: 52323 - RNA, 33 nt, Artificial Sequence
  Synthetic Oligonucleotide; BTLA exon 3; Set C
ucuggaauguuaguaaaugcuaaagagaguuag

SEQ ID NO: 52324 - RNA, 30 nt, Artificial Sequence
  Synthetic Oligonucleotide; BTLA exon 3; Set C
cuggaauguuaguaaaugcuaaagagaguu

SEQ ID NO: 52325 - RNA, 32 nt, Artificial Sequence
  Synthetic Oligonucleotide; BTLA exon 3; Set C
ucuggaauguuaguaaaugcuaaagagaguua

SEQ ID NO: 52326 - RNA, 31 nt, Artificial Sequence
  Synthetic Oligonucleotide; BTLA exon 3; Set C
ucuggaauguuaguaaaugcuaaagagaguu

SEQ ID NO: 52327 - RNA, 23 nt, Artificial Sequence
  Synthetic Oligonucleotide; BTLA exon 3; Set C
cuggaauguuaguaaaugcuaaa

SEQ ID NO: 52328 - RNA, 22 nt, Artificial Sequence
  Synthetic Oligonucleotide; BTLA exon 3; Set C
cuggaauguuaguaaaugcuaa

SEQ ID NO: 52329 - RNA, 40 nt, Artificial Sequence
  Synthetic Oligonucleotide; BTLA exon 3; Set A
cuuuuuacaucuggaauguuaguaaaugcuaaagagaguu

SEQ ID NO: 52330 - RNA, 38 nt, Artificial Sequence
  Synthetic Oligonucleotide; BTLA exon 3; Set A
uuuuuacaucuggaauguuaguaaaugcuaaagagagu

SEQ ID NO: 52331 - RNA, 36 nt, Artificial Sequence
  Synthetic Oligonucleotide; BTLA exon 3; Set A
uuuuacaucuggaauguuaguaaaugcuaaagagag

SEQ ID NO: 52332 - RNA, 39 nt, Artificial Sequence
  Synthetic Oligonucleotide; BTLA exon 3; Set A
cuuuuuacaucuggaauguuaguaaaugcuaaagagagu

SEQ ID NO: 52333 - RNA, 37 nt, Artificial Sequence
  Synthetic Oligonucleotide; BTLA exon 3; Set A
uuuuuacaucuggaauguuaguaaaugcuaaagagag

SEQ ID NO: 52334 - RNA, 35 nt, Artificial Sequence
  Synthetic Oligonucleotide; BTLA exon 3; Set A
uuuuacaucuggaauguuaguaaaugcuaaagaga

SEQ ID NO: 52335 - RNA, 17 nt, Artificial Sequence
  Synthetic Oligonucleotide; BTLA exon 3; Set C
uggaauguuaguaaaug

SEQ ID NO: 52336 - RNA, 40 nt, Artificial Sequence
  Synthetic Oligonucleotide; BTLA exon 3; Set A
acuuuuuacaucuggaauguuaguaaaugcuaaagagagu

SEQ ID NO: 52337 - RNA, 34 nt, Artificial Sequence
  Synthetic Oligonucleotide; BTLA exon 3; Set C
uuuuacaucuggaauguuaguaaaugcuaaagag

SEQ ID NO: 52338 - RNA, 36 nt, Artificial Sequence
  Synthetic Oligonucleotide; BTLA exon 3; Set A
uuuuuacaucuggaauguuaguaaaugcuaaagaga

SEQ ID NO: 52339 - RNA, 16 nt, Artificial Sequence
  Synthetic Oligonucleotide; BTLA exon 3; Set C
uggaauguuaguaaau

SEQ ID NO: 52340 - RNA, 33 nt, Artificial Sequence
  Synthetic Oligonucleotide; BTLA exon 3; Set C
uuuuacaucuggaauguuaguaaaugcuaaaga

SEQ ID NO: 52341 - RNA, 35 nt, Artificial Sequence
  Synthetic Oligonucleotide; BTLA exon 3; Set C
uuuuuacaucuggaauguuaguaaaugcuaaagag

SEQ ID NO: 52342 - RNA, 34 nt, Artificial Sequence
  Synthetic Oligonucleotide; BTLA exon 3; Set C
uuuuuacaucuggaauguuaguaaaugcuaaaga

SEQ ID NO: 52343 - RNA, 33 nt, Artificial Sequence
  Synthetic Oligonucleotide; BTLA exon 3; Set C
uuuuuacaucuggaauguuaguaaaugcuaaag

SEQ ID NO: 52344 - RNA, 32 nt, Artificial Sequence
  Synthetic Oligonucleotide; BTLA exon 3; Set C
uuuuuacaucuggaauguuaguaaaugcuaaa

SEQ ID NO: 52345 - RNA, 34 nt, Artificial Sequence
  Synthetic Oligonucleotide; BTLA exon 3; Set C
cuuuuuacaucuggaauguuaguaaaugcuaaag

SEQ ID NO: 52346 - RNA, 31 nt, Artificial Sequence
  Synthetic Oligonucleotide; BTLA exon 3; Set C
uuuuuacaucuggaauguuaguaaaugcuaa

SEQ ID NO: 52347 - RNA, 33 nt, Artificial Sequence
  Synthetic Oligonucleotide; BTLA exon 3; Set C
cuuuuuacaucuggaauguuaguaaaugcuaaa

SEQ ID NO: 52348 - RNA, 35 nt, Artificial Sequence
  Synthetic Oligonucleotide; BTLA exon 3; Set C
acuuuuuacaucuggaauguuaguaaaugcuaaag

SEQ ID NO: 52349 - RNA, 32 nt, Artificial Sequence
  Synthetic Oligonucleotide; BTLA exon 3; Set C
cuuuuuacaucuggaauguuaguaaaugcuaa

SEQ ID NO: 52350 - RNA, 34 nt, Artificial Sequence
  Synthetic Oligonucleotide; BTLA exon 3; Set C
acuuuuuacaucuggaauguuaguaaaugcuaaa

SEQ ID NO: 52351 - RNA, 33 nt, Artificial Sequence
  Synthetic Oligonucleotide; BTLA exon 3; Set C
acuuuuuacaucuggaauguuaguaaaugcuaa

SEQ ID NO: 52352 - RNA, 23 nt, Artificial Sequence
  Synthetic Oligonucleotide; BTLA exon 3; Set C
uuuacaucuggaauguuaguaaa

SEQ ID NO: 52353 - RNA, 22 nt, Artificial Sequence
  Synthetic Oligonucleotide; BTLA exon 3; Set C
uuuacaucuggaauguuaguaa

SEQ ID NO: 52354 - RNA, 22 nt, Artificial Sequence
  Synthetic Oligonucleotide; BTLA exon 3; Set C
uuuuacaucuggaauguuagua

SEQ ID NO: 52355 - RNA, 23 nt, Artificial Sequence
  Synthetic Oligonucleotide; BTLA exon 3; Set C
uuuuuacaucuggaauguuagua

SEQ ID NO: 52356 - RNA, 22 nt, Artificial Sequence
  Synthetic Oligonucleotide; BTLA exon 3; Set C
uuuuuacaucuggaauguuagu

SEQ ID NO: 52357 - RNA, 24 nt, Artificial Sequence
  Synthetic Oligonucleotide; BTLA exon 3; Set C
cuuuuuacaucuggaauguuagua

SEQ ID NO: 52358 - RNA, 21 nt, Artificial Sequence
  Synthetic Oligonucleotide; BTLA exon 3; Set C
uuuuuacaucuggaauguuag

SEQ ID NO: 52359 - RNA, 23 nt, Artificial Sequence
  Synthetic Oligonucleotide; BTLA exon 3; Set C
cuuuuuacaucuggaauguuagu

SEQ ID NO: 52360 - RNA, 22 nt, Artificial Sequence
  Synthetic Oligonucleotide; BTLA exon 3; Set C
cuuuuuacaucuggaauguuag

SEQ ID NO: 52361 - RNA, 24 nt, Artificial Sequence
  Synthetic Oligonucleotide; BTLA exon 3; Set C
acuuuuuacaucuggaauguuagu

SEQ ID NO: 52362 - RNA, 23 nt, Artificial Sequence
  Synthetic Oligonucleotide; BTLA exon 3; Set C
acuuuuuacaucuggaauguuag

SEQ ID NO: 52363 - RNA, 15 nt, Artificial Sequence
  Synthetic Oligonucleotide; BTLA exon 3; Set C
acuuuuuacaucugg

SEQ ID NO: 52364 - RNA, 39 nt, Artificial Sequence
  Synthetic Oligonucleotide; BTLA exon 3; Set C
ucguucugaggcacuuuuuacaucuggaauguuaguaaa

SEQ ID NO: 52365 - RNA, 38 nt, Artificial Sequence
  Synthetic Oligonucleotide; BTLA exon 3; Set C
ucguucugaggcacuuuuuacaucuggaauguuaguaa

SEQ ID NO: 52366 - RNA, 21 nt, Artificial Sequence
  Synthetic Oligonucleotide; BTLA exon 3; Set C
gaggcacuuuuuacaucugga

SEQ ID NO: 52367 - RNA, 17 nt, Artificial Sequence
  Synthetic Oligonucleotide; BTLA exon 3; Set C
guucugaggcacuuuuu

SEQ ID NO: 52368 - RNA, 16 nt, Artificial Sequence
  Synthetic Oligonucleotide; BTLA exon 3; Set C
cguucugaggcacuuu

SEQ ID NO: 52369 - RNA, 17 nt, Artificial Sequence
  Synthetic Oligonucleotide; BTLA exon 3; Set C
ucguucugaggcacuuu

SEQ ID NO: 52370 - RNA, 15 nt, Artificial Sequence
  Synthetic Oligonucleotide; BTLA exon 3; Set C
cguucugaggcacuu

SEQ ID NO: 52371 - RNA, 16 nt, Artificial Sequence
  Synthetic Oligonucleotide; BTLA exon 3; Set C
ucguucugaggcacuu

SEQ ID NO: 52372 - RNA, 15 nt, Artificial Sequence
  Synthetic Oligonucleotide; BTLA exon 3; Set C
ucguucugaggcacu

SEQ ID NO: 52373 - RNA, 40 nt, Artificial Sequence
  Synthetic Oligonucleotide; BTLA exon 3; Set C
uugccauuucguccuuggagggucguucugaggcacuuuu

SEQ ID NO: 52374 - RNA, 32 nt, Artificial Sequence
  Synthetic Oligonucleotide; BTLA exon 3; Set C
uugccauuucguccuuggagggucguucugag

SEQ ID NO: 52375 - RNA, 39 nt, Artificial Sequence
  Synthetic Oligonucleotide; BTLA exon 3; Set C
ggucugcuugccauuucguccuuggagggucguucugag

SEQ ID NO: 52376 - RNA, 40 nt, Artificial Sequence
  Synthetic Oligonucleotide; BTLA exon 3; Set C
gggucugcuugccauuucguccuuggagggucguucugag

SEQ ID NO: 52377 - RNA, 35 nt, Artificial Sequence
  Synthetic Oligonucleotide; BTLA exon 3; Set C
agggucugcuugccauuucguccuuggagggucgu

SEQ ID NO: 52378 - RNA, 34 nt, Artificial Sequence
  Synthetic Oligonucleotide; BTLA exon 3; Set C
agggucugcuugccauuucguccuuggagggucg

SEQ ID NO: 52379 - RNA, 36 nt, Artificial Sequence
  Synthetic Oligonucleotide; BTLA exon 3; Set C
cagggucugcuugccauuucguccuuggagggucgu

SEQ ID NO: 52380 - RNA, 35 nt, Artificial Sequence
  Synthetic Oligonucleotide; BTLA exon 3; Set C
cagggucugcuugccauuucguccuuggagggucg

SEQ ID NO: 52381 - RNA, 39 nt, Artificial Sequence
  Synthetic Oligonucleotide; BTLA exon 3; Set C
agccagggucugcuugccauuucguccuuggagggucgu

SEQ ID NO: 52382 - RNA, 38 nt, Artificial Sequence
  Synthetic Oligonucleotide; BTLA exon 3; Set C
agccagggucugcuugccauuucguccuuggagggucg

SEQ ID NO: 52383 - RNA, 40 nt, Artificial Sequence
  Synthetic Oligonucleotide; BTLA exon 3; Set C
gagccagggucugcuugccauuucguccuuggagggucgu

SEQ ID NO: 52384 - RNA, 39 nt, Artificial Sequence
  Synthetic Oligonucleotide; BTLA exon 3; Set C
gagccagggucugcuugccauuucguccuuggagggucg

SEQ ID NO: 52385 - RNA, 31 nt, Artificial Sequence
  Synthetic Oligonucleotide; BTLA exon 3; Set C
aguaaacgauacaggagccagggucugcuug

SEQ ID NO: 52386 - RNA, 21 nt, Artificial Sequence
  Synthetic Oligonucleotide; BTLA exon 3; Set C
aguaaacgauacaggagccag

SEQ ID NO: 52387 - RNA, 20 nt, Artificial Sequence
  Synthetic Oligonucleotide; BTLA exon 3; Set C
aguaaacgauacaggagcca

SEQ ID NO: 52388 - RNA, 19 nt, Artificial Sequence
  Synthetic Oligonucleotide; BTLA exon 3; Set C
aguaaacgauacaggagcc

SEQ ID NO: 52389 - RNA, 18 nt, Artificial Sequence
  Synthetic Oligonucleotide; BTLA exon 3; Set C
aguaaacgauacaggagc

SEQ ID NO: 52390 - RNA, 17 nt, Artificial Sequence
  Synthetic Oligonucleotide; BTLA exon 3; Set C
aguaaacgauacaggag

SEQ ID NO: 52391 - RNA, 39 nt, Artificial Sequence
  Synthetic Oligonucleotide; BTLA exon 3; Set C
aauccccccaaaggaaguaaacgauacaggagccagggu

SEQ ID NO: 52392 - RNA, 38 nt, Artificial Sequence
  Synthetic Oligonucleotide; BTLA exon 3; Set C
aauccccccaaaggaaguaaacgauacaggagccaggg

SEQ ID NO: 52393 - RNA, 40 nt, Artificial Sequence
  Synthetic Oligonucleotide; BTLA exon 3; Set C
caauccccccaaaggaaguaaacgauacaggagccagggu

SEQ ID NO: 52394 - RNA, 37 nt, Artificial Sequence
  Synthetic Oligonucleotide; BTLA exon 3; Set C
aauccccccaaaggaaguaaacgauacaggagccagg

SEQ ID NO: 52395 - RNA, 39 nt, Artificial Sequence
  Synthetic Oligonucleotide; BTLA exon 3; Set C
caauccccccaaaggaaguaaacgauacaggagccaggg

SEQ ID NO: 52396 - RNA, 38 nt, Artificial Sequence
  Synthetic Oligonucleotide; BTLA exon 3; Set C
caauccccccaaaggaaguaaacgauacaggagccagg

SEQ ID NO: 52397 - RNA, 40 nt, Artificial Sequence
  Synthetic Oligonucleotide; BTLA exon 3; Set C
gcaauccccccaaaggaaguaaacgauacaggagccaggg

SEQ ID NO: 52398 - RNA, 36 nt, Artificial Sequence
  Synthetic Oligonucleotide; BTLA exon 3; Set C
aauccccccaaaggaaguaaacgauacaggagccag

SEQ ID NO: 52399 - RNA, 39 nt, Artificial Sequence
  Synthetic Oligonucleotide; BTLA exon 3; Set C
gcaauccccccaaaggaaguaaacgauacaggagccagg

SEQ ID NO: 52400 - RNA, 37 nt, Artificial Sequence
  Synthetic Oligonucleotide; BTLA exon 3; Set C
caauccccccaaaggaaguaaacgauacaggagccag

SEQ ID NO: 52401 - RNA, 40 nt, Artificial Sequence
  Synthetic Oligonucleotide; BTLA exon 3; Set C
ggcaauccccccaaaggaaguaaacgauacaggagccagg

SEQ ID NO: 52402 - RNA, 38 nt, Artificial Sequence
  Synthetic Oligonucleotide; BTLA exon 3; Set C
gcaauccccccaaaggaaguaaacgauacaggagccag

SEQ ID NO: 52403 - RNA, 39 nt, Artificial Sequence
  Synthetic Oligonucleotide; BTLA exon 3; Set C
ggcaauccccccaaaggaaguaaacgauacaggagccag

SEQ ID NO: 52404 - RNA, 40 nt, Artificial Sequence
  Synthetic Oligonucleotide; BTLA exon 3; Set C
aggcaauccccccaaaggaaguaaacgauacaggagccag

SEQ ID NO: 52405 - RNA, 38 nt, Artificial Sequence
  Synthetic Oligonucleotide; BTLA exon 3; Set C
ggcaauccccccaaaggaaguaaacgauacaggagcca

SEQ ID NO: 52406 - RNA, 40 nt, Artificial Sequence
  Synthetic Oligonucleotide; BTLA exon 3; Set C
gaggcaauccccccaaaggaaguaaacgauacaggagcca

SEQ ID NO: 52407 - RNA, 40 nt, Artificial Sequence
  Synthetic Oligonucleotide; BTLA exon 3; Set C
agaggcaauccccccaaaggaaguaaacgauacaggagcc

SEQ ID NO: 52408 - RNA, 38 nt, Artificial Sequence
  Synthetic Oligonucleotide; BTLA exon 3; Set C
agaggcaauccccccaaaggaaguaaacgauacaggag

SEQ ID NO: 52409 - RNA, 40 nt, Artificial Sequence
  Synthetic Oligonucleotide; BTLA exon 3; Set C
uagaggcaauccccccaaaggaaguaaacgauacaggagc

SEQ ID NO: 52410 - RNA, 39 nt, Artificial Sequence
  Synthetic Oligonucleotide; BTLA exon 3; Set C
uagaggcaauccccccaaaggaaguaaacgauacaggag

SEQ ID NO: 52411 - RNA, 40 nt, Artificial Sequence
  Synthetic Oligonucleotide; BTLA exon 3; Set C
guagaggcaauccccccaaaggaaguaaacgauacaggag

SEQ ID NO: 52412 - RNA, 19 nt, Artificial Sequence
  Synthetic Oligonucleotide; BTLA exon 3; Set C
caauccccccaaaggaagu

SEQ ID NO: 52413 - RNA, 20 nt, Artificial Sequence
  Synthetic Oligonucleotide; BTLA exon 3; Set C
gcaauccccccaaaggaagu

SEQ ID NO: 52414 - RNA, 21 nt, Artificial Sequence
  Synthetic Oligonucleotide; BTLA exon 3; Set A
ggcaauccccccaaaggaagu

SEQ ID NO: 52415 - RNA, 22 nt, Artificial Sequence
  Synthetic Oligonucleotide; BTLA exon 3; Set A
aggcaauccccccaaaggaagu

SEQ ID NO: 52416 - RNA, 23 nt, Artificial Sequence
  Synthetic Oligonucleotide; BTLA exon 3; Set A
gaggcaauccccccaaaggaagu

SEQ ID NO: 52417 - RNA, 24 nt, Artificial Sequence
  Synthetic Oligonucleotide; BTLA exon 3; Set A
agaggcaauccccccaaaggaagu

SEQ ID NO: 52418 - RNA, 25 nt, Artificial Sequence
  Synthetic Oligonucleotide; BTLA exon 3; Set A
uagaggcaauccccccaaaggaagu

SEQ ID NO: 52419 - RNA, 26 nt, Artificial Sequence
  Synthetic Oligonucleotide; BTLA exon 3; Set A
guagaggcaauccccccaaaggaagu

SEQ ID NO: 52420 - RNA, 40 nt, Artificial Sequence
  Synthetic Oligonucleotide; BTLA exon 3; Set C
aacagguagugaugaguagaggcaauccccccaaaggaag

SEQ ID NO: 52421 - RNA, 39 nt, Artificial Sequence
  Synthetic Oligonucleotide; BTLA exon 3; Set C
aacagguagugaugaguagaggcaauccccccaaaggaa

SEQ ID NO: 52422 - RNA, 40 nt, Artificial Sequence
  Synthetic Oligonucleotide; BTLA exon 3; Set C
aaacagguagugaugaguagaggcaauccccccaaaggaa

SEQ ID NO: 52423 - RNA, 40 nt, Artificial Sequence
  Synthetic Oligonucleotide; BTLA exon 3; Set C
gaaacagguagugaugaguagaggcaauccccccaaagga

SEQ ID NO: 52424 - RNA, 40 nt, Artificial Sequence
  Synthetic Oligonucleotide; BTLA exon 3; Set C
agaaacagguagugaugaguagaggcaauccccccaaagg

SEQ ID NO: 52425 - RNA, 40 nt, Artificial Sequence
  Synthetic Oligonucleotide; BTLA exon 3; Set C
cagcagaacaggcagaaacagguagugaugaguagaggca

SEQ ID NO: 52426 - RNA, 39 nt, Artificial Sequence
  Synthetic Oligonucleotide; BTLA exon 3; Set C
cagcagaacaggcagaaacagguagugaugaguagaggc

SEQ ID NO: 52427 - RNA, 40 nt, Artificial Sequence
  Synthetic Oligonucleotide; BTLA exon 3; Set C
gcagcagaacaggcagaaacagguagugaugaguagaggc

SEQ ID NO: 52428 - RNA, 38 nt, Artificial Sequence
  Synthetic Oligonucleotide; BTLA exon 3; Set C
cagcagaacaggcagaaacagguagugaugaguagagg

SEQ ID NO: 52429 - RNA, 37 nt, Artificial Sequence
  Synthetic Oligonucleotide; BTLA exon 3; Set C
cagcagaacaggcagaaacagguagugaugaguagag

SEQ ID NO: 52430 - RNA, 39 nt, Artificial Sequence
  Synthetic Oligonucleotide; BTLA exon 3; Set C
gcagcagaacaggcagaaacagguagugaugaguagagg

SEQ ID NO: 52431 - RNA, 36 nt, Artificial Sequence
  Synthetic Oligonucleotide; BTLA exon 3; Set C
cagcagaacaggcagaaacagguagugaugaguaga

SEQ ID NO: 52432 - RNA, 38 nt, Artificial Sequence
  Synthetic Oligonucleotide; BTLA exon 3; Set C
gcagcagaacaggcagaaacagguagugaugaguagag

SEQ ID NO: 52433 - RNA, 35 nt, Artificial Sequence
  Synthetic Oligonucleotide; BTLA exon 3; Set C
cagcagaacaggcagaaacagguagugaugaguag

SEQ ID NO: 52434 - RNA, 37 nt, Artificial Sequence
  Synthetic Oligonucleotide; BTLA exon 3; Set C
gcagcagaacaggcagaaacagguagugaugaguaga

SEQ ID NO: 52435 - RNA, 34 nt, Artificial Sequence
  Synthetic Oligonucleotide; BTLA exon 3; Set C
cagcagaacaggcagaaacagguagugaugagua

SEQ ID NO: 52436 - RNA, 33 nt, Artificial Sequence
  Synthetic Oligonucleotide; BTLA exon 3; Set C
cagcagaacaggcagaaacagguagugaugagu

SEQ ID NO: 52437 - RNA, 35 nt, Artificial Sequence
  Synthetic Oligonucleotide; BTLA exon 3; Set C
gcagcagaacaggcagaaacagguagugaugagua

SEQ ID NO: 52438 - RNA, 32 nt, Artificial Sequence
  Synthetic Oligonucleotide; BTLA exon 3; Set A
cagcagaacaggcagaaacagguagugaugag

SEQ ID NO: 52439 - RNA, 34 nt, Artificial Sequence
  Synthetic Oligonucleotide; BTLA exon 3; Set C
gcagcagaacaggcagaaacagguagugaugagu

SEQ ID NO: 52440 - RNA, 33 nt, Artificial Sequence
  Synthetic Oligonucleotide; BTLA exon 3; Set C
gcagcagaacaggcagaaacagguagugaugag

SEQ ID NO: 52441 - RNA, 31 nt, Artificial Sequence
  Synthetic Oligonucleotide; BTLA exon 3; Set C
cagcagaacaggcagaaacagguagugauga

SEQ ID NO: 52442 - RNA, 30 nt, Artificial Sequence
  Synthetic Oligonucleotide; BTLA exon 3; Set A
cagcagaacaggcagaaacagguagugaug

SEQ ID NO: 52443 - RNA, 32 nt, Artificial Sequence
  Synthetic Oligonucleotide; BTLA exon 3; Set C
gcagcagaacaggcagaaacagguagugauga

SEQ ID NO: 52444 - RNA, 31 nt, Artificial Sequence
  Synthetic Oligonucleotide; BTLA exon 3; Set C
gcagcagaacaggcagaaacagguagugaug

SEQ ID NO: 52445 - RNA, 40 nt, Artificial Sequence
  Synthetic Oligonucleotide; BTLA exon 3; Set C
uucucaggcagcagaacaggcagaaacagguagugaugag

SEQ ID NO: 52446 - RNA, 39 nt, Artificial Sequence
  Synthetic Oligonucleotide; BTLA exon 3; Set C
uucucaggcagcagaacaggcagaaacagguagugauga

SEQ ID NO: 52447 - RNA, 40 nt, Artificial Sequence
  Synthetic Oligonucleotide; BTLA exon 3; Set C
cuuggugccuucucaggcagcagaacaggcagaaacaggu

SEQ ID NO: 52448 - RNA, 39 nt, Artificial Sequence
  Synthetic Oligonucleotide; BTLA exon 3; Set C
cuuggugccuucucaggcagcagaacaggcagaaacagg

SEQ ID NO: 52449 - RNA, 17 nt, Artificial Sequence
  Synthetic Oligonucleotide; BTLA exon 3; Set C
cucaggcagcagaacag

SEQ ID NO: 52450 - RNA, 38 nt, Artificial Sequence
  Synthetic Oligonucleotide; BTLA exon 3; Set C
cuuggugccuucucaggcagcagaacaggcagaaacag

SEQ ID NO: 52451 - RNA, 18 nt, Artificial Sequence
  Synthetic Oligonucleotide; BTLA exon 3; Set C
ucucaggcagcagaacag

SEQ ID NO: 52452 - RNA, 37 nt, Artificial Sequence
  Synthetic Oligonucleotide; BTLA exon 3; Set C
cuuggugccuucucaggcagcagaacaggcagaaaca

SEQ ID NO: 52453 - RNA, 36 nt, Artificial Sequence
  Synthetic Oligonucleotide; BTLA exon 3; Set C
cuuggugccuucucaggcagcagaacaggcagaaac

SEQ ID NO: 52454 - RNA, 35 nt, Artificial Sequence
  Synthetic Oligonucleotide; BTLA exon 3; Set C
cuuggugccuucucaggcagcagaacaggcagaaa

SEQ ID NO: 52455 - RNA, 34 nt, Artificial Sequence
  Synthetic Oligonucleotide; BTLA exon 3; Set C
cuuggugccuucucaggcagcagaacaggcagaa

SEQ ID NO: 52456 - RNA, 33 nt, Artificial Sequence
  Synthetic Oligonucleotide; BTLA exon 3; Set C
cuuggugccuucucaggcagcagaacaggcaga

SEQ ID NO: 52457 - RNA, 37 nt, Artificial Sequence
  Synthetic Oligonucleotide; BTLA exon 3; Set C
agaacccaccuuggugccuucucaggcagcagaacag

SEQ ID NO: 52458 - RNA, 38 nt, Artificial Sequence
  Synthetic Oligonucleotide; BTLA exon 3; Set C
uagaacccaccuuggugccuucucaggcagcagaacag

SEQ ID NO: 52459 - RNA, 39 nt, Artificial Sequence
  Synthetic Oligonucleotide; BTLA exon 3; Set C
auagaacccaccuuggugccuucucaggcagcagaacag

SEQ ID NO: 52460 - RNA, 40 nt, Artificial Sequence
  Synthetic Oligonucleotide; BTLA exon 3; Set C
aauagaacccaccuuggugccuucucaggcagcagaacag

SEQ ID NO: 52461 - RNA, 22 nt, Artificial Sequence
  Synthetic Oligonucleotide; BTLA exon 3; Set B
gaacccaccuuggugccuucuc

SEQ ID NO: 52462 - RNA, 21 nt, Artificial Sequence
  Synthetic Oligonucleotide; BTLA exon 3; Set B
gaacccaccuuggugccuucu

SEQ ID NO: 52463 - RNA, 15 nt, Artificial Sequence
  Synthetic Oligonucleotide; BTLA exon 3; Set C
aaauagaacccaccu

SEQ ID NO: 52464 - RNA, 16 nt, Artificial Sequence
  Synthetic Oligonucleotide; BTLA exon 3; Set C
aaaauagaacccaccu

SEQ ID NO: 52465 - RNA, 17 nt, Artificial Sequence
  Synthetic Oligonucleotide; BTLA exon 3; Set C
gaaaauagaacccaccu

SEQ ID NO: 52466 - RNA, 15 nt, Artificial Sequence
  Synthetic Oligonucleotide; BTLA exon 3; Set C
aaaauagaacccacc

SEQ ID NO: 52467 - RNA, 18 nt, Artificial Sequence
  Synthetic Oligonucleotide; BTLA exon 3; Set C
ggaaaauagaacccaccu

SEQ ID NO: 52468 - RNA, 16 nt, Artificial Sequence
  Synthetic Oligonucleotide; BTLA exon 3; Set C
gaaaauagaacccacc

SEQ ID NO: 52469 - RNA, 15 nt, Artificial Sequence
  Synthetic Oligonucleotide; BTLA exon 3; Set C
gaaaauagaacccac

SEQ ID NO: 52470 - RNA, 19 nt, Artificial Sequence
  Synthetic Oligonucleotide; BTLA exon 3; Set C
gggaaaauagaacccaccu

SEQ ID NO: 52471 - RNA, 17 nt, Artificial Sequence
  Synthetic Oligonucleotide; BTLA exon 3; Set C
ggaaaauagaacccacc

SEQ ID NO: 52472 - RNA, 16 nt, Artificial Sequence
  Synthetic Oligonucleotide; BTLA exon 3; Set C
ggaaaauagaacccac

SEQ ID NO: 52473 - RNA, 20 nt, Artificial Sequence
  Synthetic Oligonucleotide; BTLA exon 3; Set C
agggaaaauagaacccaccu

SEQ ID NO: 52474 - RNA, 18 nt, Artificial Sequence
  Synthetic Oligonucleotide; BTLA exon 3; Set C
gggaaaauagaacccacc

SEQ ID NO: 52475 - RNA, 17 nt, Artificial Sequence
  Synthetic Oligonucleotide; BTLA exon 3; Set C
gggaaaauagaacccac

SEQ ID NO: 52476 - RNA, 21 nt, Artificial Sequence
  Synthetic Oligonucleotide; BTLA exon 3; Set C
gagggaaaauagaacccaccu

SEQ ID NO: 52477 - RNA, 19 nt, Artificial Sequence
  Synthetic Oligonucleotide; BTLA exon 3; Set C
agggaaaauagaacccacc

SEQ ID NO: 52478 - RNA, 18 nt, Artificial Sequence
  Synthetic Oligonucleotide; BTLA exon 3; Set C
agggaaaauagaacccac

SEQ ID NO: 52479 - RNA, 22 nt, Artificial Sequence
  Synthetic Oligonucleotide; BTLA exon 3; Set C
agagggaaaauagaacccaccu

SEQ ID NO: 52480 - RNA, 20 nt, Artificial Sequence
  Synthetic Oligonucleotide; BTLA exon 3; Set C
gagggaaaauagaacccacc

SEQ ID NO: 52481 - RNA, 19 nt, Artificial Sequence
  Synthetic Oligonucleotide; BTLA exon 3; Set C
gagggaaaauagaacccac

SEQ ID NO: 52482 - RNA, 21 nt, Artificial Sequence
  Synthetic Oligonucleotide; BTLA exon 3; Set C
agagggaaaauagaacccacc

SEQ ID NO: 52483 - RNA, 20 nt, Artificial Sequence
  Synthetic Oligonucleotide; BTLA exon 3; Set C
agagggaaaauagaacccac

SEQ ID NO: 52484 - RNA, 16 nt, Artificial Sequence
  Synthetic Oligonucleotide; BTLA exon 3; Set C
cagagggaaaauagaa

SEQ ID NO: 52485 - RNA, 15 nt, Artificial Sequence
  Synthetic Oligonucleotide; BTLA exon 3; Set C
cagagggaaaauaga

SEQ ID NO: 52486 - RNA, 38 nt, Artificial Sequence
  Synthetic Oligonucleotide; BTLA exon 3; Set C
gugugguacugggggcagagggaaaauagaacccaccu

SEQ ID NO: 52487 - RNA, 16 nt, Artificial Sequence
  Synthetic Oligonucleotide; BTLA exon 3; Set C
uggccccaaaugugug

SEQ ID NO: 52488 - RNA, 15 nt, Artificial Sequence
  Synthetic Oligonucleotide; BTLA exon 3; Set C
uggccccaaaugugu

SEQ ID NO: 52489 - RNA, 17 nt, Artificial Sequence
  Synthetic Oligonucleotide; BTLA exon 3; Set C
agauauauugggaucag

SEQ ID NO: 52490 - RNA, 18 nt, Artificial Sequence
  Synthetic Oligonucleotide; BTLA exon 3; Set C
gagauauauugggaucag

SEQ ID NO: 52491 - RNA, 19 nt, Artificial Sequence
  Synthetic Oligonucleotide; BTLA exon 3; Set C
ugagauauauugggaucag

SEQ ID NO: 52492 - RNA, 15 nt, Artificial Sequence
  Synthetic Oligonucleotide; BTLA exon 3; Set C
agauauauugggauc

SEQ ID NO: 52493 - RNA, 22 nt, Artificial Sequence
  Synthetic Oligonucleotide; BTLA exon 3; Set C
aucugagauauauugggaucag

SEQ ID NO: 52494 - RNA, 31 nt, Artificial Sequence
  Synthetic Oligonucleotide; BTLA exon 3; Set A
gaguuaggaaaucugagauauauugggauca

SEQ ID NO: 52495 - RNA, 30 nt, Artificial Sequence
  Synthetic Oligonucleotide; BTLA exon 3; Set A
gaguuaggaaaucugagauauauugggauc

SEQ ID NO: 52496 - RNA, 32 nt, Artificial Sequence
  Synthetic Oligonucleotide; BTLA exon 3; Set A
agaguuaggaaaucugagauauauugggauca

SEQ ID NO: 52497 - RNA, 31 nt, Artificial Sequence
  Synthetic Oligonucleotide; BTLA exon 3; Set A
agaguuaggaaaucugagauauauugggauc

SEQ ID NO: 52498 - RNA, 33 nt, Artificial Sequence
  Synthetic Oligonucleotide; BTLA exon 3; Set A
gagaguuaggaaaucugagauauauugggauca

SEQ ID NO: 52499 - RNA, 32 nt, Artificial Sequence
  Synthetic Oligonucleotide; BTLA exon 3; Set A
gagaguuaggaaaucugagauauauugggauc

SEQ ID NO: 52500 - RNA, 34 nt, Artificial Sequence
  Synthetic Oligonucleotide; BTLA exon 3; Set A
agagaguuaggaaaucugagauauauugggauca

SEQ ID NO: 52501 - RNA, 33 nt, Artificial Sequence
  Synthetic Oligonucleotide; BTLA exon 3; Set A
agagaguuaggaaaucugagauauauugggauc

SEQ ID NO: 52502 - RNA, 39 nt, Artificial Sequence
  Synthetic Oligonucleotide; BTLA exon 3; Set A
augcuaaagagaguuaggaaaucugagauauauugggau

SEQ ID NO: 52503 - RNA, 40 nt, Artificial Sequence
  Synthetic Oligonucleotide; BTLA exon 3; Set A
aaugcuaaagagaguuaggaaaucugagauauauugggau

SEQ ID NO: 52504 - RNA, 29 nt, Artificial Sequence
  Synthetic Oligonucleotide; BTLA exon 3; Set C
aaugcuaaagagaguuaggaaaucugaga

SEQ ID NO: 52505 - RNA, 40 nt, Artificial Sequence
  Synthetic Oligonucleotide; BTLA exon 3; Set A
uuaguaaaugcuaaagagaguuaggaaaucugagauauau

SEQ ID NO: 52506 - RNA, 30 nt, Artificial Sequence
  Synthetic Oligonucleotide; BTLA exon 3; Set C
aaaugcuaaagagaguuaggaaaucugaga

SEQ ID NO: 52507 - RNA, 28 nt, Artificial Sequence
  Synthetic Oligonucleotide; BTLA exon 3; Set C
aaugcuaaagagaguuaggaaaucugag

SEQ ID NO: 52508 - RNA, 39 nt, Artificial Sequence
  Synthetic Oligonucleotide; BTLA exon 3; Set A
uuaguaaaugcuaaagagaguuaggaaaucugagauaua

SEQ ID NO: 52509 - RNA, 31 nt, Artificial Sequence
  Synthetic Oligonucleotide; BTLA exon 3; Set C
uaaaugcuaaagagaguuaggaaaucugaga

SEQ ID NO: 52510 - RNA, 29 nt, Artificial Sequence
  Synthetic Oligonucleotide; BTLA exon 3; Set C
aaaugcuaaagagaguuaggaaaucugag

SEQ ID NO: 52511 - RNA, 30 nt, Artificial Sequence
  Synthetic Oligonucleotide; BTLA exon 3; Set C
uaaaugcuaaagagaguuaggaaaucugag

SEQ ID NO: 52512 - RNA, 28 nt, Artificial Sequence
  Synthetic Oligonucleotide; BTLA exon 3; Set C
aaaugcuaaagagaguuaggaaaucuga

SEQ ID NO: 52513 - RNA, 29 nt, Artificial Sequence
  Synthetic Oligonucleotide; BTLA exon 3; Set C
uaaaugcuaaagagaguuaggaaaucuga

SEQ ID NO: 52514 - RNA, 25 nt, Artificial Sequence
  Synthetic Oligonucleotide; BTLA exon 3; Set C
aaaugcuaaagagaguuaggaaauc

SEQ ID NO: 52515 - RNA, 40 nt, Artificial Sequence
  Synthetic Oligonucleotide; BTLA exon 3; Set A
auguuaguaaaugcuaaagagaguuaggaaaucugagaua

SEQ ID NO: 52516 - RNA, 26 nt, Artificial Sequence
  Synthetic Oligonucleotide; BTLA exon 3; Set C
uaaaugcuaaagagaguuaggaaauc

SEQ ID NO: 52517 - RNA, 39 nt, Artificial Sequence
  Synthetic Oligonucleotide; BTLA exon 3; Set A
auguuaguaaaugcuaaagagaguuaggaaaucugagau

SEQ ID NO: 52518 - RNA, 40 nt, Artificial Sequence
  Synthetic Oligonucleotide; BTLA exon 3; Set A
aauguuaguaaaugcuaaagagaguuaggaaaucugagau

SEQ ID NO: 52519 - RNA, 15 nt, Artificial Sequence
  Synthetic Oligonucleotide; BTLA exon 3; Set C
aaugcuaaagagagu

SEQ ID NO: 52520 - RNA, 32 nt, Artificial Sequence
  Synthetic Oligonucleotide; BTLA exon 3; Set C
auguuaguaaaugcuaaagagaguuaggaaau

SEQ ID NO: 52521 - RNA, 31 nt, Artificial Sequence
  Synthetic Oligonucleotide; BTLA exon 3; Set C
auguuaguaaaugcuaaagagaguuaggaaa

SEQ ID NO: 52522 - RNA, 33 nt, Artificial Sequence
  Synthetic Oligonucleotide; BTLA exon 3; Set C
aauguuaguaaaugcuaaagagaguuaggaaau

SEQ ID NO: 52523 - RNA, 30 nt, Artificial Sequence
  Synthetic Oligonucleotide; BTLA exon 3; Set C
auguuaguaaaugcuaaagagaguuaggaa

SEQ ID NO: 52524 - RNA, 32 nt, Artificial Sequence
  Synthetic Oligonucleotide; BTLA exon 3; Set C
aauguuaguaaaugcuaaagagaguuaggaaa

SEQ ID NO: 52525 - RNA, 31 nt, Artificial Sequence
  Synthetic Oligonucleotide; BTLA exon 3; Set C
aauguuaguaaaugcuaaagagaguuaggaa

SEQ ID NO: 52526 - RNA, 29 nt, Artificial Sequence
  Synthetic Oligonucleotide; BTLA exon 3; Set C
auguuaguaaaugcuaaagagaguuagga

SEQ ID NO: 52527 - RNA, 28 nt, Artificial Sequence
  Synthetic Oligonucleotide; BTLA exon 3; Set C
auguuaguaaaugcuaaagagaguuagg

SEQ ID NO: 52528 - RNA, 30 nt, Artificial Sequence
  Synthetic Oligonucleotide; BTLA exon 3; Set C
aauguuaguaaaugcuaaagagaguuagga

SEQ ID NO: 52529 - RNA, 27 nt, Artificial Sequence
  Synthetic Oligonucleotide; BTLA exon 3; Set C
auguuaguaaaugcuaaagagaguuag

SEQ ID NO: 52530 - RNA, 31 nt, Artificial Sequence
  Synthetic Oligonucleotide; BTLA exon 3; Set C
gaauguuaguaaaugcuaaagagaguuagga

SEQ ID NO: 52531 - RNA, 29 nt, Artificial Sequence
  Synthetic Oligonucleotide; BTLA exon 3; Set C
aauguuaguaaaugcuaaagagaguuagg

SEQ ID NO: 52532 - RNA, 26 nt, Artificial Sequence
  Synthetic Oligonucleotide; BTLA exon 3; Set C
auguuaguaaaugcuaaagagaguua

SEQ ID NO: 52533 - RNA, 28 nt, Artificial Sequence
  Synthetic Oligonucleotide; BTLA exon 3; Set C
aauguuaguaaaugcuaaagagaguuag

SEQ ID NO: 52534 - RNA, 30 nt, Artificial Sequence
  Synthetic Oligonucleotide; BTLA exon 3; Set C
gaauguuaguaaaugcuaaagagaguuagg

SEQ ID NO: 52535 - RNA, 25 nt, Artificial Sequence
  Synthetic Oligonucleotide; BTLA exon 3; Set C
auguuaguaaaugcuaaagagaguu

SEQ ID NO: 52536 - RNA, 29 nt, Artificial Sequence
  Synthetic Oligonucleotide; BTLA exon 3; Set C
gaauguuaguaaaugcuaaagagaguuag

SEQ ID NO: 52537 - RNA, 27 nt, Artificial Sequence
  Synthetic Oligonucleotide; BTLA exon 3; Set C
aauguuaguaaaugcuaaagagaguua

SEQ ID NO: 52538 - RNA, 26 nt, Artificial Sequence
  Synthetic Oligonucleotide; BTLA exon 3; Set C
aauguuaguaaaugcuaaagagaguu

SEQ ID NO: 52539 - RNA, 28 nt, Artificial Sequence
  Synthetic Oligonucleotide; BTLA exon 3; Set C
gaauguuaguaaaugcuaaagagaguua

SEQ ID NO: 52540 - RNA, 24 nt, Artificial Sequence
  Synthetic Oligonucleotide; BTLA exon 3; Set C
auguuaguaaaugcuaaagagagu

SEQ ID NO: 52541 - RNA, 27 nt, Artificial Sequence
  Synthetic Oligonucleotide; BTLA exon 3; Set C
gaauguuaguaaaugcuaaagagaguu

SEQ ID NO: 52542 - RNA, 25 nt, Artificial Sequence
  Synthetic Oligonucleotide; BTLA exon 3; Set C
aauguuaguaaaugcuaaagagagu

SEQ ID NO: 52543 - RNA, 26 nt, Artificial Sequence
  Synthetic Oligonucleotide; BTLA exon 3; Set C
gaauguuaguaaaugcuaaagagagu

SEQ ID NO: 52544 - RNA, 25 nt, Artificial Sequence
  Synthetic Oligonucleotide; BTLA exon 3; Set C
gaauguuaguaaaugcuaaagagag

SEQ ID NO: 52545 - RNA, 29 nt, Artificial Sequence
  Synthetic Oligonucleotide; BTLA exon 3; Set C
cuggaauguuaguaaaugcuaaagagagu

SEQ ID NO: 52546 - RNA, 18 nt, Artificial Sequence
  Synthetic Oligonucleotide; BTLA exon 3; Set C
auguuaguaaaugcuaaa

SEQ ID NO: 52547 - RNA, 30 nt, Artificial Sequence
  Synthetic Oligonucleotide; BTLA exon 3; Set C
ucuggaauguuaguaaaugcuaaagagagu

SEQ ID NO: 52548 - RNA, 28 nt, Artificial Sequence
  Synthetic Oligonucleotide; BTLA exon 3; Set C
cuggaauguuaguaaaugcuaaagagag

SEQ ID NO: 52549 - RNA, 19 nt, Artificial Sequence
  Synthetic Oligonucleotide; BTLA exon 3; Set C
aauguuaguaaaugcuaaa

SEQ ID NO: 52550 - RNA, 21 nt, Artificial Sequence
  Synthetic Oligonucleotide; BTLA exon 3; Set C
gaauguuaguaaaugcuaaag

SEQ ID NO: 52551 - RNA, 29 nt, Artificial Sequence
  Synthetic Oligonucleotide; BTLA exon 3; Set C
ucuggaauguuaguaaaugcuaaagagag

SEQ ID NO: 52552 - RNA, 27 nt, Artificial Sequence
  Synthetic Oligonucleotide; BTLA exon 3; Set C
cuggaauguuaguaaaugcuaaagaga

SEQ ID NO: 52553 - RNA, 20 nt, Artificial Sequence
  Synthetic Oligonucleotide; BTLA exon 3; Set C
gaauguuaguaaaugcuaaa

SEQ ID NO: 52554 - RNA, 26 nt, Artificial Sequence
  Synthetic Oligonucleotide; BTLA exon 3; Set C
cuggaauguuaguaaaugcuaaagag

SEQ ID NO: 52555 - RNA, 28 nt, Artificial Sequence
  Synthetic Oligonucleotide; BTLA exon 3; Set C
ucuggaauguuaguaaaugcuaaagaga

SEQ ID NO: 52556 - RNA, 19 nt, Artificial Sequence
  Synthetic Oligonucleotide; BTLA exon 3; Set C
gaauguuaguaaaugcuaa

SEQ ID NO: 52557 - RNA, 25 nt, Artificial Sequence
  Synthetic Oligonucleotide; BTLA exon 3; Set C
cuggaauguuaguaaaugcuaaaga

SEQ ID NO: 52558 - RNA, 27 nt, Artificial Sequence
  Synthetic Oligonucleotide; BTLA exon 3; Set C
ucuggaauguuaguaaaugcuaaagag

SEQ ID NO: 52559 - RNA, 24 nt, Artificial Sequence
  Synthetic Oligonucleotide; BTLA exon 3; Set C
cuggaauguuaguaaaugcuaaag

SEQ ID NO: 52560 - RNA, 26 nt, Artificial Sequence
  Synthetic Oligonucleotide; BTLA exon 3; Set C
ucuggaauguuaguaaaugcuaaaga

SEQ ID NO: 52561 - RNA, 25 nt, Artificial Sequence
  Synthetic Oligonucleotide; BTLA exon 3; Set C
ucuggaauguuaguaaaugcuaaag

SEQ ID NO: 52562 - RNA, 24 nt, Artificial Sequence
  Synthetic Oligonucleotide; BTLA exon 3; Set C
ucuggaauguuaguaaaugcuaaa

SEQ ID NO: 52563 - RNA, 23 nt, Artificial Sequence
  Synthetic Oligonucleotide; BTLA exon 3; Set C
ucuggaauguuaguaaaugcuaa

SEQ ID NO: 52564 - RNA, 16 nt, Artificial Sequence
  Synthetic Oligonucleotide; BTLA exon 3; Set C
ggaauguuaguaaaug

SEQ ID NO: 52565 - RNA, 15 nt, Artificial Sequence
  Synthetic Oligonucleotide; BTLA exon 3; Set C
ggaauguuaguaaau

SEQ ID NO: 52566 - RNA, 38 nt, Artificial Sequence
  Synthetic Oligonucleotide; BTLA exon 3; Set A
cuuuuuacaucuggaauguuaguaaaugcuaaagagag

SEQ ID NO: 52567 - RNA, 39 nt, Artificial Sequence
  Synthetic Oligonucleotide; BTLA exon 3; Set A
acuuuuuacaucuggaauguuaguaaaugcuaaagagag

SEQ ID NO: 52568 - RNA, 37 nt, Artificial Sequence
  Synthetic Oligonucleotide; BTLA exon 3; Set A
cuuuuuacaucuggaauguuaguaaaugcuaaagaga

SEQ ID NO: 52569 - RNA, 36 nt, Artificial Sequence
  Synthetic Oligonucleotide; BTLA exon 3; Set C
cuuuuuacaucuggaauguuaguaaaugcuaaagag

SEQ ID NO: 52570 - RNA, 38 nt, Artificial Sequence
  Synthetic Oligonucleotide; BTLA exon 3; Set A
acuuuuuacaucuggaauguuaguaaaugcuaaagaga

SEQ ID NO: 52571 - RNA, 35 nt, Artificial Sequence
  Synthetic Oligonucleotide; BTLA exon 3; Set C
cuuuuuacaucuggaauguuaguaaaugcuaaaga

SEQ ID NO: 52572 - RNA, 37 nt, Artificial Sequence
  Synthetic Oligonucleotide; BTLA exon 3; Set A
acuuuuuacaucuggaauguuaguaaaugcuaaagag

SEQ ID NO: 52573 - RNA, 36 nt, Artificial Sequence
  Synthetic Oligonucleotide; BTLA exon 3; Set A
acuuuuuacaucuggaauguuaguaaaugcuaaaga

SEQ ID NO: 52574 - RNA, 15 nt, Artificial Sequence
  Synthetic Oligonucleotide; BTLA exon 3; Set C
ucuggaauguuagua

SEQ ID NO: 52575 - RNA, 25 nt, Artificial Sequence
  Synthetic Oligonucleotide; BTLA exon 3; Set C
uuuacaucuggaauguuaguaaaug

SEQ ID NO: 52576 - RNA, 24 nt, Artificial Sequence
  Synthetic Oligonucleotide; BTLA exon 3; Set C
uuuacaucuggaauguuaguaaau

SEQ ID NO: 52577 - RNA, 25 nt, Artificial Sequence
  Synthetic Oligonucleotide; BTLA exon 3; Set C
uuuuacaucuggaauguuaguaaau

SEQ ID NO: 52578 - RNA, 38 nt, Artificial Sequence
  Synthetic Oligonucleotide; BTLA exon 3; Set A
aggcacuuuuuacaucuggaauguuaguaaaugcuaaa

SEQ ID NO: 52579 - RNA, 24 nt, Artificial Sequence
  Synthetic Oligonucleotide; BTLA exon 3; Set C
uuuuacaucuggaauguuaguaaa

SEQ ID NO: 52580 - RNA, 37 nt, Artificial Sequence
  Synthetic Oligonucleotide; BTLA exon 3; Set A
aggcacuuuuuacaucuggaauguuaguaaaugcuaa

SEQ ID NO: 52581 - RNA, 23 nt, Artificial Sequence
  Synthetic Oligonucleotide; BTLA exon 3; Set C
uuuuacaucuggaauguuaguaa

SEQ ID NO: 52582 - RNA, 25 nt, Artificial Sequence
  Synthetic Oligonucleotide; BTLA exon 3; Set C
uuuuuacaucuggaauguuaguaaa

SEQ ID NO: 52583 - RNA, 24 nt, Artificial Sequence
  Synthetic Oligonucleotide; BTLA exon 3; Set C
uuuuuacaucuggaauguuaguaa

SEQ ID NO: 52584 - RNA, 25 nt, Artificial Sequence
  Synthetic Oligonucleotide; BTLA exon 3; Set C
acuuuuuacaucuggaauguuagua

SEQ ID NO: 52585 - RNA, 34 nt, Artificial Sequence
  Synthetic Oligonucleotide; BTLA exon 3; Set A
gaggcacuuuuuacaucuggaauguuaguaaaug

SEQ ID NO: 52586 - RNA, 33 nt, Artificial Sequence
  Synthetic Oligonucleotide; BTLA exon 3; Set A
gaggcacuuuuuacaucuggaauguuaguaaau

SEQ ID NO: 52587 - RNA, 32 nt, Artificial Sequence
  Synthetic Oligonucleotide; BTLA exon 3; Set A
gaggcacuuuuuacaucuggaauguuaguaaa

SEQ ID NO: 52588 - RNA, 31 nt, Artificial Sequence
  Synthetic Oligonucleotide; BTLA exon 3; Set A
gaggcacuuuuuacaucuggaauguuaguaa

SEQ ID NO: 52589 - RNA, 28 nt, Artificial Sequence
  Synthetic Oligonucleotide; BTLA exon 3; Set A
aggcacuuuuuacaucuggaauguuagu

SEQ ID NO: 52590 - RNA, 27 nt, Artificial Sequence
  Synthetic Oligonucleotide; BTLA exon 3; Set A
aggcacuuuuuacaucuggaauguuag

SEQ ID NO: 52591 - RNA, 40 nt, Artificial Sequence
  Synthetic Oligonucleotide; BTLA exon 3; Set A
cguucugaggcacuuuuuacaucuggaauguuaguaaaug

SEQ ID NO: 52592 - RNA, 15 nt, Artificial Sequence
  Synthetic Oligonucleotide; BTLA exon 3; Set C
cuuuuuacaucugga

SEQ ID NO: 52593 - RNA, 39 nt, Artificial Sequence
  Synthetic Oligonucleotide; BTLA exon 3; Set A
cguucugaggcacuuuuuacaucuggaauguuaguaaau

SEQ ID NO: 52594 - RNA, 16 nt, Artificial Sequence
  Synthetic Oligonucleotide; BTLA exon 3; Set C
acuuuuuacaucugga

SEQ ID NO: 52595 - RNA, 38 nt, Artificial Sequence
  Synthetic Oligonucleotide; BTLA exon 3; Set A
cguucugaggcacuuuuuacaucuggaauguuaguaaa

SEQ ID NO: 52596 - RNA, 40 nt, Artificial Sequence
  Synthetic Oligonucleotide; BTLA exon 3; Set C
ucguucugaggcacuuuuuacaucuggaauguuaguaaau

SEQ ID NO: 52597 - RNA, 35 nt, Artificial Sequence
  Synthetic Oligonucleotide; BTLA exon 3; Set C
guucugaggcacuuuuuacaucuggaauguuagua

SEQ ID NO: 52598 - RNA, 37 nt, Artificial Sequence
  Synthetic Oligonucleotide; BTLA exon 3; Set C
cguucugaggcacuuuuuacaucuggaauguuaguaa

SEQ ID NO: 52599 - RNA, 34 nt, Artificial Sequence
  Synthetic Oligonucleotide; BTLA exon 3; Set A
guucugaggcacuuuuuacaucuggaauguuagu

SEQ ID NO: 52600 - RNA, 33 nt, Artificial Sequence
  Synthetic Oligonucleotide; BTLA exon 3; Set A
guucugaggcacuuuuuacaucuggaauguuag

SEQ ID NO: 52601 - RNA, 26 nt, Artificial Sequence
  Synthetic Oligonucleotide; BTLA exon 3; Set A
guucugaggcacuuuuuacaucugga

SEQ ID NO: 52602 - RNA, 25 nt, Artificial Sequence
  Synthetic Oligonucleotide; BTLA exon 3; Set A
guucugaggcacuuuuuacaucugg

SEQ ID NO: 52603 - RNA, 26 nt, Artificial Sequence
  Synthetic Oligonucleotide; BTLA exon 3; Set A
ucguucugaggcacuuuuuacaucug

SEQ ID NO: 52604 - RNA, 15 nt, Artificial Sequence
  Synthetic Oligonucleotide; BTLA exon 3; Set C
ucugaggcacuuuuu

SEQ ID NO: 52605 - RNA, 16 nt, Artificial Sequence
  Synthetic Oligonucleotide; BTLA exon 3; Set C
uucugaggcacuuuuu

SEQ ID NO: 52606 - RNA, 16 nt, Artificial Sequence
  Synthetic Oligonucleotide; BTLA exon 3; Set C
guucugaggcacuuuu

SEQ ID NO: 52607 - RNA, 35 nt, Artificial Sequence
  Synthetic Oligonucleotide; BTLA exon 3; Set C
uuggagggucguucugaggcacuuuuuacaucugg

SEQ ID NO: 52608 - RNA, 27 nt, Artificial Sequence
  Synthetic Oligonucleotide; BTLA exon 3; Set C
uuggagggucguucugaggcacuuuuu

SEQ ID NO: 52609 - RNA, 18 nt, Artificial Sequence
  Synthetic Oligonucleotide; BTLA exon 3; Set C
uuggagggucguucugag

SEQ ID NO: 52610 - RNA, 39 nt, Artificial Sequence
  Synthetic Oligonucleotide; BTLA exon 3; Set C
uugccauuucguccuuggagggucguucugaggcacuuu

SEQ ID NO: 52611 - RNA, 26 nt, Artificial Sequence
  Synthetic Oligonucleotide; BTLA exon 3; Set C
uugccauuucguccuuggagggucgu

SEQ ID NO: 52612 - RNA, 25 nt, Artificial Sequence
  Synthetic Oligonucleotide; BTLA exon 3; Set C
uugccauuucguccuuggagggucg

SEQ ID NO: 52613 - RNA, 33 nt, Artificial Sequence
  Synthetic Oligonucleotide; BTLA exon 3; Set C
ggucugcuugccauuucguccuuggagggucgu

SEQ ID NO: 52614 - RNA, 32 nt, Artificial Sequence
  Synthetic Oligonucleotide; BTLA exon 3; Set C
ggucugcuugccauuucguccuuggagggucg

SEQ ID NO: 52615 - RNA, 34 nt, Artificial Sequence
  Synthetic Oligonucleotide; BTLA exon 3; Set C
gggucugcuugccauuucguccuuggagggucgu

SEQ ID NO: 52616 - RNA, 33 nt, Artificial Sequence
  Synthetic Oligonucleotide; BTLA exon 3; Set C
gggucugcuugccauuucguccuuggagggucg

SEQ ID NO: 52617 - RNA, 37 nt, Artificial Sequence
  Synthetic Oligonucleotide; BTLA exon 3; Set C
ccagggucugcuugccauuucguccuuggagggucgu

SEQ ID NO: 52618 - RNA, 36 nt, Artificial Sequence
  Synthetic Oligonucleotide; BTLA exon 3; Set C
ccagggucugcuugccauuucguccuuggagggucg

SEQ ID NO: 52619 - RNA, 38 nt, Artificial Sequence
  Synthetic Oligonucleotide; BTLA exon 3; Set C
gccagggucugcuugccauuucguccuuggagggucgu

SEQ ID NO: 52620 - RNA, 37 nt, Artificial Sequence
  Synthetic Oligonucleotide; BTLA exon 3; Set C
gccagggucugcuugccauuucguccuuggagggucg

SEQ ID NO: 52621 - RNA, 17 nt, Artificial Sequence
  Synthetic Oligonucleotide; BTLA exon 3; Set C
gauacaggagccagggu

SEQ ID NO: 52622 - RNA, 16 nt, Artificial Sequence
  Synthetic Oligonucleotide; BTLA exon 3; Set C
gauacaggagccaggg

SEQ ID NO: 52623 - RNA, 32 nt, Artificial Sequence
  Synthetic Oligonucleotide; BTLA exon 3; Set C
aaguaaacgauacaggagccagggucugcuug

SEQ ID NO: 52624 - RNA, 15 nt, Artificial Sequence
  Synthetic Oligonucleotide; BTLA exon 3; Set C
gauacaggagccagg

SEQ ID NO: 52625 - RNA, 33 nt, Artificial Sequence
  Synthetic Oligonucleotide; BTLA exon 3; Set C
gaaguaaacgauacaggagccagggucugcuug

SEQ ID NO: 52626 - RNA, 35 nt, Artificial Sequence
  Synthetic Oligonucleotide; BTLA exon 3; Set C
aggaaguaaacgauacaggagccagggucugcuug

SEQ ID NO: 52627 - RNA, 25 nt, Artificial Sequence
  Synthetic Oligonucleotide; BTLA exon 3; Set A
aaguaaacgauacaggagccagggu

SEQ ID NO: 52628 - RNA, 24 nt, Artificial Sequence
  Synthetic Oligonucleotide; BTLA exon 3; Set A
aaguaaacgauacaggagccaggg

SEQ ID NO: 52629 - RNA, 26 nt, Artificial Sequence
  Synthetic Oligonucleotide; BTLA exon 3; Set A
gaaguaaacgauacaggagccagggu

SEQ ID NO: 52630 - RNA, 23 nt, Artificial Sequence
  Synthetic Oligonucleotide; BTLA exon 3; Set C
aaguaaacgauacaggagccagg

SEQ ID NO: 52631 - RNA, 25 nt, Artificial Sequence
  Synthetic Oligonucleotide; BTLA exon 3; Set A
gaaguaaacgauacaggagccaggg

SEQ ID NO: 52632 - RNA, 27 nt, Artificial Sequence
  Synthetic Oligonucleotide; BTLA exon 3; Set A
ggaaguaaacgauacaggagccagggu

SEQ ID NO: 52633 - RNA, 24 nt, Artificial Sequence
  Synthetic Oligonucleotide; BTLA exon 3; Set A
gaaguaaacgauacaggagccagg

SEQ ID NO: 52634 - RNA, 26 nt, Artificial Sequence
  Synthetic Oligonucleotide; BTLA exon 3; Set A
ggaaguaaacgauacaggagccaggg

SEQ ID NO: 52635 - RNA, 22 nt, Artificial Sequence
  Synthetic Oligonucleotide; BTLA exon 3; Set C
aaguaaacgauacaggagccag

SEQ ID NO: 52636 - RNA, 28 nt, Artificial Sequence
  Synthetic Oligonucleotide; BTLA exon 3; Set A
aggaaguaaacgauacaggagccagggu

SEQ ID NO: 52637 - RNA, 25 nt, Artificial Sequence
  Synthetic Oligonucleotide; BTLA exon 3; Set A
ggaaguaaacgauacaggagccagg

SEQ ID NO: 52638 - RNA, 27 nt, Artificial Sequence
  Synthetic Oligonucleotide; BTLA exon 3; Set A
aggaaguaaacgauacaggagccaggg

SEQ ID NO: 52639 - RNA, 23 nt, Artificial Sequence
  Synthetic Oligonucleotide; BTLA exon 3; Set C
gaaguaaacgauacaggagccag

SEQ ID NO: 52640 - RNA, 26 nt, Artificial Sequence
  Synthetic Oligonucleotide; BTLA exon 3; Set A
aggaaguaaacgauacaggagccagg

SEQ ID NO: 52641 - RNA, 24 nt, Artificial Sequence
  Synthetic Oligonucleotide; BTLA exon 3; Set A
ggaaguaaacgauacaggagccag

SEQ ID NO: 52642 - RNA, 25 nt, Artificial Sequence
  Synthetic Oligonucleotide; BTLA exon 3; Set A
aggaaguaaacgauacaggagccag

SEQ ID NO: 52643 - RNA, 35 nt, Artificial Sequence
  Synthetic Oligonucleotide; BTLA exon 3; Set C
aauccccccaaaggaaguaaacgauacaggagcca

SEQ ID NO: 52644 - RNA, 36 nt, Artificial Sequence
  Synthetic Oligonucleotide; BTLA exon 3; Set C
caauccccccaaaggaaguaaacgauacaggagcca

SEQ ID NO: 52645 - RNA, 34 nt, Artificial Sequence
  Synthetic Oligonucleotide; BTLA exon 3; Set C
aauccccccaaaggaaguaaacgauacaggagcc

SEQ ID NO: 52646 - RNA, 37 nt, Artificial Sequence
  Synthetic Oligonucleotide; BTLA exon 3; Set C
gcaauccccccaaaggaaguaaacgauacaggagcca

SEQ ID NO: 52647 - RNA, 35 nt, Artificial Sequence
  Synthetic Oligonucleotide; BTLA exon 3; Set C
caauccccccaaaggaaguaaacgauacaggagcc

SEQ ID NO: 52648 - RNA, 33 nt, Artificial Sequence
  Synthetic Oligonucleotide; BTLA exon 3; Set A
aauccccccaaaggaaguaaacgauacaggagc

SEQ ID NO: 52649 - RNA, 32 nt, Artificial Sequence
  Synthetic Oligonucleotide; BTLA exon 3; Set A
aauccccccaaaggaaguaaacgauacaggag

SEQ ID NO: 52650 - RNA, 36 nt, Artificial Sequence
  Synthetic Oligonucleotide; BTLA exon 3; Set C
gcaauccccccaaaggaaguaaacgauacaggagcc

SEQ ID NO: 52651 - RNA, 34 nt, Artificial Sequence
  Synthetic Oligonucleotide; BTLA exon 3; Set C
caauccccccaaaggaaguaaacgauacaggagc

SEQ ID NO: 52652 - RNA, 33 nt, Artificial Sequence
  Synthetic Oligonucleotide; BTLA exon 3; Set A
caauccccccaaaggaaguaaacgauacaggag

SEQ ID NO: 52653 - RNA, 39 nt, Artificial Sequence
  Synthetic Oligonucleotide; BTLA exon 3; Set C
aggcaauccccccaaaggaaguaaacgauacaggagcca

SEQ ID NO: 52654 - RNA, 37 nt, Artificial Sequence
  Synthetic Oligonucleotide; BTLA exon 3; Set C
ggcaauccccccaaaggaaguaaacgauacaggagcc

SEQ ID NO: 52655 - RNA, 35 nt, Artificial Sequence
  Synthetic Oligonucleotide; BTLA exon 3; Set C
gcaauccccccaaaggaaguaaacgauacaggagc

SEQ ID NO: 52656 - RNA, 34 nt, Artificial Sequence
  Synthetic Oligonucleotide; BTLA exon 3; Set C
gcaauccccccaaaggaaguaaacgauacaggag

SEQ ID NO: 52657 - RNA, 38 nt, Artificial Sequence
  Synthetic Oligonucleotide; BTLA exon 3; Set C
aggcaauccccccaaaggaaguaaacgauacaggagcc

SEQ ID NO: 52658 - RNA, 36 nt, Artificial Sequence
  Synthetic Oligonucleotide; BTLA exon 3; Set C
ggcaauccccccaaaggaaguaaacgauacaggagc

SEQ ID NO: 52659 - RNA, 35 nt, Artificial Sequence
  Synthetic Oligonucleotide; BTLA exon 3; Set C
ggcaauccccccaaaggaaguaaacgauacaggag

SEQ ID NO: 52660 - RNA, 39 nt, Artificial Sequence
  Synthetic Oligonucleotide; BTLA exon 3; Set C
gaggcaauccccccaaaggaaguaaacgauacaggagcc

SEQ ID NO: 52661 - RNA, 37 nt, Artificial Sequence
  Synthetic Oligonucleotide; BTLA exon 3; Set C
aggcaauccccccaaaggaaguaaacgauacaggagc

SEQ ID NO: 52662 - RNA, 36 nt, Artificial Sequence
  Synthetic Oligonucleotide; BTLA exon 3; Set C
aggcaauccccccaaaggaaguaaacgauacaggag

SEQ ID NO: 52663 - RNA, 38 nt, Artificial Sequence
  Synthetic Oligonucleotide; BTLA exon 3; Set C
gaggcaauccccccaaaggaaguaaacgauacaggagc

SEQ ID NO: 52664 - RNA, 37 nt, Artificial Sequence
  Synthetic Oligonucleotide; BTLA exon 3; Set C
gaggcaauccccccaaaggaaguaaacgauacaggag

SEQ ID NO: 52665 - RNA, 39 nt, Artificial Sequence
  Synthetic Oligonucleotide; BTLA exon 3; Set C
agaggcaauccccccaaaggaaguaaacgauacaggagc

SEQ ID NO: 52666 - RNA, 18 nt, Artificial Sequence
  Synthetic Oligonucleotide; BTLA exon 3; Set C
aauccccccaaaggaagu

SEQ ID NO: 52667 - RNA, 25 nt, Artificial Sequence
  Synthetic Oligonucleotide; BTLA exon 3; Set A
guagaggcaauccccccaaaggaag

SEQ ID NO: 52668 - RNA, 26 nt, Artificial Sequence
  Synthetic Oligonucleotide; BTLA exon 3; Set A
aguagaggcaauccccccaaaggaag

SEQ ID NO: 52669 - RNA, 25 nt, Artificial Sequence
  Synthetic Oligonucleotide; BTLA exon 3; Set A
aguagaggcaauccccccaaaggaa

SEQ ID NO: 52670 - RNA, 27 nt, Artificial Sequence
  Synthetic Oligonucleotide; BTLA exon 3; Set A
gaguagaggcaauccccccaaaggaag

SEQ ID NO: 52671 - RNA, 26 nt, Artificial Sequence
  Synthetic Oligonucleotide; BTLA exon 3; Set A
gaguagaggcaauccccccaaaggaa

SEQ ID NO: 52672 - RNA, 28 nt, Artificial Sequence
  Synthetic Oligonucleotide; BTLA exon 3; Set A
ugaguagaggcaauccccccaaaggaag

SEQ ID NO: 52673 - RNA, 27 nt, Artificial Sequence
  Synthetic Oligonucleotide; BTLA exon 3; Set A
ugaguagaggcaauccccccaaaggaa

SEQ ID NO: 52674 - RNA, 29 nt, Artificial Sequence
  Synthetic Oligonucleotide; BTLA exon 3; Set A
augaguagaggcaauccccccaaaggaag

SEQ ID NO: 52675 - RNA, 25 nt, Artificial Sequence
  Synthetic Oligonucleotide; BTLA exon 3; Set A
gaguagaggcaauccccccaaagga

SEQ ID NO: 52676 - RNA, 28 nt, Artificial Sequence
  Synthetic Oligonucleotide; BTLA exon 3; Set A
augaguagaggcaauccccccaaaggaa

SEQ ID NO: 52677 - RNA, 30 nt, Artificial Sequence
  Synthetic Oligonucleotide; BTLA exon 3; Set A
gaugaguagaggcaauccccccaaaggaag

SEQ ID NO: 52678 - RNA, 26 nt, Artificial Sequence
  Synthetic Oligonucleotide; BTLA exon 3; Set A
ugaguagaggcaauccccccaaagga

SEQ ID NO: 52679 - RNA, 24 nt, Artificial Sequence
  Synthetic Oligonucleotide; BTLA exon 3; Set A
gaguagaggcaauccccccaaagg

SEQ ID NO: 52680 - RNA, 29 nt, Artificial Sequence
  Synthetic Oligonucleotide; BTLA exon 3; Set A
gaugaguagaggcaauccccccaaaggaa

SEQ ID NO: 52681 - RNA, 31 nt, Artificial Sequence
  Synthetic Oligonucleotide; BTLA exon 3; Set A
ugaugaguagaggcaauccccccaaaggaag

SEQ ID NO: 52682 - RNA, 27 nt, Artificial Sequence
  Synthetic Oligonucleotide; BTLA exon 3; Set A
augaguagaggcaauccccccaaagga

SEQ ID NO: 52683 - RNA, 30 nt, Artificial Sequence
  Synthetic Oligonucleotide; BTLA exon 3; Set C
ugaugaguagaggcaauccccccaaaggaa

SEQ ID NO: 52684 - RNA, 32 nt, Artificial Sequence
  Synthetic Oligonucleotide; BTLA exon 3; Set C
gugaugaguagaggcaauccccccaaaggaag

SEQ ID NO: 52685 - RNA, 28 nt, Artificial Sequence
  Synthetic Oligonucleotide; BTLA exon 3; Set C
gaugaguagaggcaauccccccaaagga

SEQ ID NO: 52686 - RNA, 26 nt, Artificial Sequence
  Synthetic Oligonucleotide; BTLA exon 3; Set A
augaguagaggcaauccccccaaagg

SEQ ID NO: 52687 - RNA, 31 nt, Artificial Sequence
  Synthetic Oligonucleotide; BTLA exon 3; Set C
gugaugaguagaggcaauccccccaaaggaa

SEQ ID NO: 52688 - RNA, 33 nt, Artificial Sequence
  Synthetic Oligonucleotide; BTLA exon 3; Set C
agugaugaguagaggcaauccccccaaaggaag

SEQ ID NO: 52689 - RNA, 29 nt, Artificial Sequence
  Synthetic Oligonucleotide; BTLA exon 3; Set C
ugaugaguagaggcaauccccccaaagga

SEQ ID NO: 52690 - RNA, 27 nt, Artificial Sequence
  Synthetic Oligonucleotide; BTLA exon 3; Set A
gaugaguagaggcaauccccccaaagg

SEQ ID NO: 52691 - RNA, 32 nt, Artificial Sequence
  Synthetic Oligonucleotide; BTLA exon 3; Set C
agugaugaguagaggcaauccccccaaaggaa

SEQ ID NO: 52692 - RNA, 34 nt, Artificial Sequence
  Synthetic Oligonucleotide; BTLA exon 3; Set C
uagugaugaguagaggcaauccccccaaaggaag

SEQ ID NO: 52693 - RNA, 30 nt, Artificial Sequence
  Synthetic Oligonucleotide; BTLA exon 3; Set C
gugaugaguagaggcaauccccccaaagga

SEQ ID NO: 52694 - RNA, 28 nt, Artificial Sequence
  Synthetic Oligonucleotide; BTLA exon 3; Set A
ugaugaguagaggcaauccccccaaagg

SEQ ID NO: 52695 - RNA, 33 nt, Artificial Sequence
  Synthetic Oligonucleotide; BTLA exon 3; Set C
uagugaugaguagaggcaauccccccaaaggaa

SEQ ID NO: 52696 - RNA, 35 nt, Artificial Sequence
  Synthetic Oligonucleotide; BTLA exon 3; Set C
guagugaugaguagaggcaauccccccaaaggaag

SEQ ID NO: 52697 - RNA, 31 nt, Artificial Sequence
  Synthetic Oligonucleotide; BTLA exon 3; Set C
agugaugaguagaggcaauccccccaaagga

SEQ ID NO: 52698 - RNA, 29 nt, Artificial Sequence
  Synthetic Oligonucleotide; BTLA exon 3; Set C
gugaugaguagaggcaauccccccaaagg

SEQ ID NO: 52699 - RNA, 34 nt, Artificial Sequence
  Synthetic Oligonucleotide; BTLA exon 3; Set C
guagugaugaguagaggcaauccccccaaaggaa

SEQ ID NO: 52700 - RNA, 36 nt, Artificial Sequence
  Synthetic Oligonucleotide; BTLA exon 3; Set C
gguagugaugaguagaggcaauccccccaaaggaag

SEQ ID NO: 52701 - RNA, 32 nt, Artificial Sequence
  Synthetic Oligonucleotide; BTLA exon 3; Set C
uagugaugaguagaggcaauccccccaaagga

SEQ ID NO: 52702 - RNA, 30 nt, Artificial Sequence
  Synthetic Oligonucleotide; BTLA exon 3; Set C
agugaugaguagaggcaauccccccaaagg

SEQ ID NO: 52703 - RNA, 35 nt, Artificial Sequence
  Synthetic Oligonucleotide; BTLA exon 3; Set C
gguagugaugaguagaggcaauccccccaaaggaa

SEQ ID NO: 52704 - RNA, 37 nt, Artificial Sequence
  Synthetic Oligonucleotide; BTLA exon 3; Set C
agguagugaugaguagaggcaauccccccaaaggaag

SEQ ID NO: 52705 - RNA, 33 nt, Artificial Sequence
  Synthetic Oligonucleotide; BTLA exon 3; Set C
guagugaugaguagaggcaauccccccaaagga

SEQ ID NO: 52706 - RNA, 31 nt, Artificial Sequence
  Synthetic Oligonucleotide; BTLA exon 3; Set C
uagugaugaguagaggcaauccccccaaagg

SEQ ID NO: 52707 - RNA, 36 nt, Artificial Sequence
  Synthetic Oligonucleotide; BTLA exon 3; Set C
agguagugaugaguagaggcaauccccccaaaggaa

SEQ ID NO: 52708 - RNA, 38 nt, Artificial Sequence
  Synthetic Oligonucleotide; BTLA exon 3; Set C
cagguagugaugaguagaggcaauccccccaaaggaag

SEQ ID NO: 52709 - RNA, 34 nt, Artificial Sequence
  Synthetic Oligonucleotide; BTLA exon 3; Set C
gguagugaugaguagaggcaauccccccaaagga

SEQ ID NO: 52710 - RNA, 32 nt, Artificial Sequence
  Synthetic Oligonucleotide; BTLA exon 3; Set C
guagugaugaguagaggcaauccccccaaagg

SEQ ID NO: 52711 - RNA, 37 nt, Artificial Sequence
  Synthetic Oligonucleotide; BTLA exon 3; Set C
cagguagugaugaguagaggcaauccccccaaaggaa

SEQ ID NO: 52712 - RNA, 39 nt, Artificial Sequence
  Synthetic Oligonucleotide; BTLA exon 3; Set C
acagguagugaugaguagaggcaauccccccaaaggaag

SEQ ID NO: 52713 - RNA, 35 nt, Artificial Sequence
  Synthetic Oligonucleotide; BTLA exon 3; Set C
agguagugaugaguagaggcaauccccccaaagga

SEQ ID NO: 52714 - RNA, 33 nt, Artificial Sequence
  Synthetic Oligonucleotide; BTLA exon 3; Set C
gguagugaugaguagaggcaauccccccaaagg

SEQ ID NO: 52715 - RNA, 38 nt, Artificial Sequence
  Synthetic Oligonucleotide; BTLA exon 3; Set C
acagguagugaugaguagaggcaauccccccaaaggaa

SEQ ID NO: 52716 - RNA, 36 nt, Artificial Sequence
  Synthetic Oligonucleotide; BTLA exon 3; Set C
cagguagugaugaguagaggcaauccccccaaagga

SEQ ID NO: 52717 - RNA, 34 nt, Artificial Sequence
  Synthetic Oligonucleotide; BTLA exon 3; Set C
agguagugaugaguagaggcaauccccccaaagg

SEQ ID NO: 52718 - RNA, 37 nt, Artificial Sequence
  Synthetic Oligonucleotide; BTLA exon 3; Set C
acagguagugaugaguagaggcaauccccccaaagga

SEQ ID NO: 52719 - RNA, 35 nt, Artificial Sequence
  Synthetic Oligonucleotide; BTLA exon 3; Set C
cagguagugaugaguagaggcaauccccccaaagg

SEQ ID NO: 52720 - RNA, 38 nt, Artificial Sequence
  Synthetic Oligonucleotide; BTLA exon 3; Set C
aacagguagugaugaguagaggcaauccccccaaagga

SEQ ID NO: 52721 - RNA, 36 nt, Artificial Sequence
  Synthetic Oligonucleotide; BTLA exon 3; Set C
acagguagugaugaguagaggcaauccccccaaagg

SEQ ID NO: 52722 - RNA, 39 nt, Artificial Sequence
  Synthetic Oligonucleotide; BTLA exon 3; Set C
aaacagguagugaugaguagaggcaauccccccaaagga

SEQ ID NO: 52723 - RNA, 37 nt, Artificial Sequence
  Synthetic Oligonucleotide; BTLA exon 3; Set C
aacagguagugaugaguagaggcaauccccccaaagg

SEQ ID NO: 52724 - RNA, 38 nt, Artificial Sequence
  Synthetic Oligonucleotide; BTLA exon 3; Set C
aaacagguagugaugaguagaggcaauccccccaaagg

SEQ ID NO: 52725 - RNA, 39 nt, Artificial Sequence
  Synthetic Oligonucleotide; BTLA exon 3; Set C
gaaacagguagugaugaguagaggcaauccccccaaagg

SEQ ID NO: 52726 - RNA, 36 nt, Artificial Sequence
  Synthetic Oligonucleotide; BTLA exon 3; Set C
gcagcagaacaggcagaaacagguagugaugaguag

SEQ ID NO: 52727 - RNA, 29 nt, Artificial Sequence
  Synthetic Oligonucleotide; BTLA exon 3; Set A
cagcagaacaggcagaaacagguagugau

SEQ ID NO: 52728 - RNA, 30 nt, Artificial Sequence
  Synthetic Oligonucleotide; BTLA exon 3; Set C
gcagcagaacaggcagaaacagguagugau

SEQ ID NO: 52729 - RNA, 28 nt, Artificial Sequence
  Synthetic Oligonucleotide; BTLA exon 3; Set A
cagcagaacaggcagaaacagguaguga

SEQ ID NO: 52730 - RNA, 27 nt, Artificial Sequence
  Synthetic Oligonucleotide; BTLA exon 3; Set A
cagcagaacaggcagaaacagguagug

SEQ ID NO: 52731 - RNA, 29 nt, Artificial Sequence
  Synthetic Oligonucleotide; BTLA exon 3; Set C
gcagcagaacaggcagaaacagguaguga

SEQ ID NO: 52732 - RNA, 28 nt, Artificial Sequence
  Synthetic Oligonucleotide; BTLA exon 3; Set A
gcagcagaacaggcagaaacagguagug

SEQ ID NO: 52733 - RNA, 26 nt, Artificial Sequence
  Synthetic Oligonucleotide; BTLA exon 3; Set A
cagcagaacaggcagaaacagguagu

SEQ ID NO: 52734 - RNA, 25 nt, Artificial Sequence
  Synthetic Oligonucleotide; BTLA exon 3; Set A
cagcagaacaggcagaaacagguag

SEQ ID NO: 52735 - RNA, 27 nt, Artificial Sequence
  Synthetic Oligonucleotide; BTLA exon 3; Set A
gcagcagaacaggcagaaacagguagu

SEQ ID NO: 52736 - RNA, 26 nt, Artificial Sequence
  Synthetic Oligonucleotide; BTLA exon 3; Set A
gcagcagaacaggcagaaacagguag

SEQ ID NO: 52737 - RNA, 24 nt, Artificial Sequence
  Synthetic Oligonucleotide; BTLA exon 3; Set A
cagcagaacaggcagaaacaggua

SEQ ID NO: 52738 - RNA, 23 nt, Artificial Sequence
  Synthetic Oligonucleotide; BTLA exon 3; Set A
cagcagaacaggcagaaacaggu

SEQ ID NO: 52739 - RNA, 25 nt, Artificial Sequence
  Synthetic Oligonucleotide; BTLA exon 3; Set A
gcagcagaacaggcagaaacaggua

SEQ ID NO: 52740 - RNA, 24 nt, Artificial Sequence
  Synthetic Oligonucleotide; BTLA exon 3; Set A
gcagcagaacaggcagaaacaggu

SEQ ID NO: 52741 - RNA, 22 nt, Artificial Sequence
  Synthetic Oligonucleotide; BTLA exon 3; Set A
cagcagaacaggcagaaacagg

SEQ ID NO: 52742 - RNA, 38 nt, Artificial Sequence
  Synthetic Oligonucleotide; BTLA exon 3; Set C
uucucaggcagcagaacaggcagaaacagguagugaug

SEQ ID NO: 52743 - RNA, 23 nt, Artificial Sequence
  Synthetic Oligonucleotide; BTLA exon 3; Set A
gcagcagaacaggcagaaacagg

SEQ ID NO: 52744 - RNA, 21 nt, Artificial Sequence
  Synthetic Oligonucleotide; BTLA exon 3; Set C
cagcagaacaggcagaaacag

SEQ ID NO: 52745 - RNA, 37 nt, Artificial Sequence
  Synthetic Oligonucleotide; BTLA exon 3; Set C
uucucaggcagcagaacaggcagaaacagguagugau

SEQ ID NO: 52746 - RNA, 20 nt, Artificial Sequence
  Synthetic Oligonucleotide; BTLA exon 3; Set C
cagcagaacaggcagaaaca

SEQ ID NO: 52747 - RNA, 22 nt, Artificial Sequence
  Synthetic Oligonucleotide; BTLA exon 3; Set B
gcagcagaacaggcagaaacag

SEQ ID NO: 52748 - RNA, 36 nt, Artificial Sequence
  Synthetic Oligonucleotide; BTLA exon 3; Set C
uucucaggcagcagaacaggcagaaacagguaguga

SEQ ID NO: 52749 - RNA, 19 nt, Artificial Sequence
  Synthetic Oligonucleotide; BTLA exon 3; Set C
cagcagaacaggcagaaac

SEQ ID NO: 52750 - RNA, 21 nt, Artificial Sequence
  Synthetic Oligonucleotide; BTLA exon 3; Set B
gcagcagaacaggcagaaaca

SEQ ID NO: 52751 - RNA, 35 nt, Artificial Sequence
  Synthetic Oligonucleotide; BTLA exon 3; Set C
uucucaggcagcagaacaggcagaaacagguagug

SEQ ID NO: 52752 - RNA, 18 nt, Artificial Sequence
  Synthetic Oligonucleotide; BTLA exon 3; Set C
cagcagaacaggcagaaa

SEQ ID NO: 52753 - RNA, 20 nt, Artificial Sequence
  Synthetic Oligonucleotide; BTLA exon 3; Set C
gcagcagaacaggcagaaac

SEQ ID NO: 52754 - RNA, 34 nt, Artificial Sequence
  Synthetic Oligonucleotide; BTLA exon 3; Set C
uucucaggcagcagaacaggcagaaacagguagu

SEQ ID NO: 52755 - RNA, 17 nt, Artificial Sequence
  Synthetic Oligonucleotide; BTLA exon 3; Set C
cagcagaacaggcagaa

SEQ ID NO: 52756 - RNA, 19 nt, Artificial Sequence
  Synthetic Oligonucleotide; BTLA exon 3; Set C
gcagcagaacaggcagaaa

SEQ ID NO: 52757 - RNA, 33 nt, Artificial Sequence
  Synthetic Oligonucleotide; BTLA exon 3; Set C
uucucaggcagcagaacaggcagaaacagguag

SEQ ID NO: 52758 - RNA, 16 nt, Artificial Sequence
  Synthetic Oligonucleotide; BTLA exon 3; Set C
cagcagaacaggcaga

SEQ ID NO: 52759 - RNA, 18 nt, Artificial Sequence
  Synthetic Oligonucleotide; BTLA exon 3; Set C
gcagcagaacaggcagaa

SEQ ID NO: 52760 - RNA, 32 nt, Artificial Sequence
  Synthetic Oligonucleotide; BTLA exon 3; Set C
uucucaggcagcagaacaggcagaaacaggua

SEQ ID NO: 52761 - RNA, 17 nt, Artificial Sequence
  Synthetic Oligonucleotide; BTLA exon 3; Set C
gcagcagaacaggcaga

SEQ ID NO: 52762 - RNA, 31 nt, Artificial Sequence
  Synthetic Oligonucleotide; BTLA exon 3; Set C
uucucaggcagcagaacaggcagaaacaggu

SEQ ID NO: 52763 - RNA, 30 nt, Artificial Sequence
  Synthetic Oligonucleotide; BTLA exon 3; Set C
uucucaggcagcagaacaggcagaaacagg

SEQ ID NO: 52764 - RNA, 29 nt, Artificial Sequence
  Synthetic Oligonucleotide; BTLA exon 3; Set C
uucucaggcagcagaacaggcagaaacag

SEQ ID NO: 52765 - RNA, 28 nt, Artificial Sequence
  Synthetic Oligonucleotide; BTLA exon 3; Set C
uucucaggcagcagaacaggcagaaaca

SEQ ID NO: 52766 - RNA, 27 nt, Artificial Sequence
  Synthetic Oligonucleotide; BTLA exon 3; Set B
uucucaggcagcagaacaggcagaaac

SEQ ID NO: 52767 - RNA, 26 nt, Artificial Sequence
  Synthetic Oligonucleotide; BTLA exon 3; Set B
uucucaggcagcagaacaggcagaaa

SEQ ID NO: 52768 - RNA, 25 nt, Artificial Sequence
  Synthetic Oligonucleotide; BTLA exon 3; Set B
uucucaggcagcagaacaggcagaa

SEQ ID NO: 52769 - RNA, 24 nt, Artificial Sequence
  Synthetic Oligonucleotide; BTLA exon 3; Set B
uucucaggcagcagaacaggcaga

SEQ ID NO: 52770 - RNA, 40 nt, Artificial Sequence
  Synthetic Oligonucleotide; BTLA exon 3; Set C
ccuuggugccuucucaggcagcagaacaggcagaaacagg

SEQ ID NO: 52771 - RNA, 39 nt, Artificial Sequence
  Synthetic Oligonucleotide; BTLA exon 3; Set C
ccuuggugccuucucaggcagcagaacaggcagaaacag

SEQ ID NO: 52772 - RNA, 38 nt, Artificial Sequence
  Synthetic Oligonucleotide; BTLA exon 3; Set C
ccuuggugccuucucaggcagcagaacaggcagaaaca

SEQ ID NO: 52773 - RNA, 40 nt, Artificial Sequence
  Synthetic Oligonucleotide; BTLA exon 3; Set C
accuuggugccuucucaggcagcagaacaggcagaaacag

SEQ ID NO: 52774 - RNA, 37 nt, Artificial Sequence
  Synthetic Oligonucleotide; BTLA exon 3; Set C
ccuuggugccuucucaggcagcagaacaggcagaaac

SEQ ID NO: 52775 - RNA, 39 nt, Artificial Sequence
  Synthetic Oligonucleotide; BTLA exon 3; Set C
accuuggugccuucucaggcagcagaacaggcagaaaca

SEQ ID NO: 52776 - RNA, 36 nt, Artificial Sequence
  Synthetic Oligonucleotide; BTLA exon 3; Set C
ccuuggugccuucucaggcagcagaacaggcagaaa

SEQ ID NO: 52777 - RNA, 38 nt, Artificial Sequence
  Synthetic Oligonucleotide; BTLA exon 3; Set C
accuuggugccuucucaggcagcagaacaggcagaaac

SEQ ID NO: 52778 - RNA, 40 nt, Artificial Sequence
  Synthetic Oligonucleotide; BTLA exon 3; Set C
caccuuggugccuucucaggcagcagaacaggcagaaaca

SEQ ID NO: 52779 - RNA, 35 nt, Artificial Sequence
  Synthetic Oligonucleotide; BTLA exon 3; Set C
ccuuggugccuucucaggcagcagaacaggcagaa

SEQ ID NO: 52780 - RNA, 37 nt, Artificial Sequence
  Synthetic Oligonucleotide; BTLA exon 3; Set C
accuuggugccuucucaggcagcagaacaggcagaaa

SEQ ID NO: 52781 - RNA, 39 nt, Artificial Sequence
  Synthetic Oligonucleotide; BTLA exon 3; Set C
caccuuggugccuucucaggcagcagaacaggcagaaac

SEQ ID NO: 52782 - RNA, 34 nt, Artificial Sequence
  Synthetic Oligonucleotide; BTLA exon 3; Set C
ccuuggugccuucucaggcagcagaacaggcaga

SEQ ID NO: 52783 - RNA, 36 nt, Artificial Sequence
  Synthetic Oligonucleotide; BTLA exon 3; Set C
accuuggugccuucucaggcagcagaacaggcagaa

SEQ ID NO: 52784 - RNA, 38 nt, Artificial Sequence
  Synthetic Oligonucleotide; BTLA exon 3; Set C
caccuuggugccuucucaggcagcagaacaggcagaaa

SEQ ID NO: 52785 - RNA, 35 nt, Artificial Sequence
  Synthetic Oligonucleotide; BTLA exon 3; Set C
accuuggugccuucucaggcagcagaacaggcaga

SEQ ID NO: 52786 - RNA, 37 nt, Artificial Sequence
  Synthetic Oligonucleotide; BTLA exon 3; Set C
caccuuggugccuucucaggcagcagaacaggcagaa

SEQ ID NO: 52787 - RNA, 36 nt, Artificial Sequence
  Synthetic Oligonucleotide; BTLA exon 3; Set C
caccuuggugccuucucaggcagcagaacaggcaga

SEQ ID NO: 52788 - RNA, 28 nt, Artificial Sequence
  Synthetic Oligonucleotide; BTLA exon 3; Set C
cuuggugccuucucaggcagcagaacag

SEQ ID NO: 52789 - RNA, 36 nt, Artificial Sequence
  Synthetic Oligonucleotide; BTLA exon 3; Set C
gaacccaccuuggugccuucucaggcagcagaacag

SEQ ID NO: 52790 - RNA, 15 nt, Artificial Sequence
  Synthetic Oligonucleotide; BTLA exon 3; Set C
ccuuggugccuucuc

SEQ ID NO: 52791 - RNA, 16 nt, Artificial Sequence
  Synthetic Oligonucleotide; BTLA exon 3; Set C
accuuggugccuucuc

SEQ ID NO: 52792 - RNA, 15 nt, Artificial Sequence
  Synthetic Oligonucleotide; BTLA exon 3; Set C
accuuggugccuucu

SEQ ID NO: 52793 - RNA, 17 nt, Artificial Sequence
  Synthetic Oligonucleotide; BTLA exon 3; Set C
caccuuggugccuucuc

SEQ ID NO: 52794 - RNA, 16 nt, Artificial Sequence
  Synthetic Oligonucleotide; BTLA exon 3; Set C
caccuuggugccuucu

SEQ ID NO: 52795 - RNA, 32 nt, Artificial Sequence
  Synthetic Oligonucleotide; BTLA exon 3; Set C
aauagaacccaccuuggugccuucucaggcag

SEQ ID NO: 52796 - RNA, 33 nt, Artificial Sequence
  Synthetic Oligonucleotide; BTLA exon 3; Set C
aaauagaacccaccuuggugccuucucaggcag

SEQ ID NO: 52797 - RNA, 31 nt, Artificial Sequence
  Synthetic Oligonucleotide; BTLA exon 3; Set C
aauagaacccaccuuggugccuucucaggca

SEQ ID NO: 52798 - RNA, 34 nt, Artificial Sequence
  Synthetic Oligonucleotide; BTLA exon 3; Set C
aaaauagaacccaccuuggugccuucucaggcag

SEQ ID NO: 52799 - RNA, 32 nt, Artificial Sequence
  Synthetic Oligonucleotide; BTLA exon 3; Set C
aaauagaacccaccuuggugccuucucaggca

SEQ ID NO: 52800 - RNA, 35 nt, Artificial Sequence
  Synthetic Oligonucleotide; BTLA exon 3; Set C
gaaaauagaacccaccuuggugccuucucaggcag

SEQ ID NO: 52801 - RNA, 33 nt, Artificial Sequence
  Synthetic Oligonucleotide; BTLA exon 3; Set C
aaaauagaacccaccuuggugccuucucaggca

SEQ ID NO: 52802 - RNA, 36 nt, Artificial Sequence
  Synthetic Oligonucleotide; BTLA exon 3; Set C
ggaaaauagaacccaccuuggugccuucucaggcag

SEQ ID NO: 52803 - RNA, 34 nt, Artificial Sequence
  Synthetic Oligonucleotide; BTLA exon 3; Set C
gaaaauagaacccaccuuggugccuucucaggca

SEQ ID NO: 52804 - RNA, 37 nt, Artificial Sequence
  Synthetic Oligonucleotide; BTLA exon 3; Set C
gggaaaauagaacccaccuuggugccuucucaggcag

SEQ ID NO: 52805 - RNA, 35 nt, Artificial Sequence
  Synthetic Oligonucleotide; BTLA exon 3; Set C
ggaaaauagaacccaccuuggugccuucucaggca

SEQ ID NO: 52806 - RNA, 38 nt, Artificial Sequence
  Synthetic Oligonucleotide; BTLA exon 3; Set C
agggaaaauagaacccaccuuggugccuucucaggcag

SEQ ID NO: 52807 - RNA, 36 nt, Artificial Sequence
  Synthetic Oligonucleotide; BTLA exon 3; Set C
gggaaaauagaacccaccuuggugccuucucaggca

SEQ ID NO: 52808 - RNA, 23 nt, Artificial Sequence
  Synthetic Oligonucleotide; BTLA exon 3; Set B
auagaacccaccuuggugccuuc

SEQ ID NO: 52809 - RNA, 39 nt, Artificial Sequence
  Synthetic Oligonucleotide; BTLA exon 3; Set C
gagggaaaauagaacccaccuuggugccuucucaggcag

SEQ ID NO: 52810 - RNA, 37 nt, Artificial Sequence
  Synthetic Oligonucleotide; BTLA exon 3; Set C
agggaaaauagaacccaccuuggugccuucucaggca

SEQ ID NO: 52811 - RNA, 24 nt, Artificial Sequence
  Synthetic Oligonucleotide; BTLA exon 3; Set B
aauagaacccaccuuggugccuuc

SEQ ID NO: 52812 - RNA, 40 nt, Artificial Sequence
  Synthetic Oligonucleotide; BTLA exon 3; Set C
agagggaaaauagaacccaccuuggugccuucucaggcag

SEQ ID NO: 52813 - RNA, 38 nt, Artificial Sequence
  Synthetic Oligonucleotide; BTLA exon 3; Set C
gagggaaaauagaacccaccuuggugccuucucaggca

SEQ ID NO: 52814 - RNA, 25 nt, Artificial Sequence
  Synthetic Oligonucleotide; BTLA exon 3; Set B
aaauagaacccaccuuggugccuuc

SEQ ID NO: 52815 - RNA, 39 nt, Artificial Sequence
  Synthetic Oligonucleotide; BTLA exon 3; Set C
agagggaaaauagaacccaccuuggugccuucucaggca

SEQ ID NO: 52816 - RNA, 26 nt, Artificial Sequence
  Synthetic Oligonucleotide; BTLA exon 3; Set B
aaaauagaacccaccuuggugccuuc

SEQ ID NO: 52817 - RNA, 27 nt, Artificial Sequence
  Synthetic Oligonucleotide; BTLA exon 3; Set B
gaaaauagaacccaccuuggugccuuc

SEQ ID NO: 52818 - RNA, 28 nt, Artificial Sequence
  Synthetic Oligonucleotide; BTLA exon 3; Set B
ggaaaauagaacccaccuuggugccuuc

SEQ ID NO: 52819 - RNA, 29 nt, Artificial Sequence
  Synthetic Oligonucleotide; BTLA exon 3; Set C
gggaaaauagaacccaccuuggugccuuc

SEQ ID NO: 52820 - RNA, 30 nt, Artificial Sequence
  Synthetic Oligonucleotide; BTLA exon 3; Set C
agggaaaauagaacccaccuuggugccuuc

SEQ ID NO: 52821 - RNA, 35 nt, Artificial Sequence
  Synthetic Oligonucleotide; BTLA exon 3; Set C
cagagggaaaauagaacccaccuuggugccuucuc

SEQ ID NO: 52822 - RNA, 31 nt, Artificial Sequence
  Synthetic Oligonucleotide; BTLA exon 3; Set C
gagggaaaauagaacccaccuuggugccuuc

SEQ ID NO: 52823 - RNA, 34 nt, Artificial Sequence
  Synthetic Oligonucleotide; BTLA exon 3; Set C
cagagggaaaauagaacccaccuuggugccuucu

SEQ ID NO: 52824 - RNA, 32 nt, Artificial Sequence
  Synthetic Oligonucleotide; BTLA exon 3; Set C
agagggaaaauagaacccaccuuggugccuuc

SEQ ID NO: 52825 - RNA, 24 nt, Artificial Sequence
  Synthetic Oligonucleotide; BTLA exon 3; Set C
cagagggaaaauagaacccaccuu

SEQ ID NO: 52826 - RNA, 17 nt, Artificial Sequence
  Synthetic Oligonucleotide; BTLA exon 3; Set C
gcagagggaaaauagaa

SEQ ID NO: 52827 - RNA, 16 nt, Artificial Sequence
  Synthetic Oligonucleotide; BTLA exon 3; Set C
gcagagggaaaauaga

SEQ ID NO: 52828 - RNA, 15 nt, Artificial Sequence
  Synthetic Oligonucleotide; BTLA exon 3; Set C
gcagagggaaaauag

SEQ ID NO: 52829 - RNA, 17 nt, Artificial Sequence
  Synthetic Oligonucleotide; BTLA exon 3; Set C
ggcagagggaaaauaga

SEQ ID NO: 52830 - RNA, 33 nt, Artificial Sequence
  Synthetic Oligonucleotide; BTLA exon 3; Set C
guacugggggcagagggaaaauagaacccaccu

SEQ ID NO: 52831 - RNA, 16 nt, Artificial Sequence
  Synthetic Oligonucleotide; BTLA exon 3; Set C
ggcagagggaaaauag

SEQ ID NO: 52832 - RNA, 34 nt, Artificial Sequence
  Synthetic Oligonucleotide; BTLA exon 3; Set C
gguacugggggcagagggaaaauagaacccaccu

SEQ ID NO: 52833 - RNA, 32 nt, Artificial Sequence
  Synthetic Oligonucleotide; BTLA exon 3; Set C
guacugggggcagagggaaaauagaacccacc

SEQ ID NO: 52834 - RNA, 15 nt, Artificial Sequence
  Synthetic Oligonucleotide; BTLA exon 3; Set C
ggcagagggaaaaua

SEQ ID NO: 52835 - RNA, 31 nt, Artificial Sequence
  Synthetic Oligonucleotide; BTLA exon 3; Set C
guacugggggcagagggaaaauagaacccac

SEQ ID NO: 52836 - RNA, 35 nt, Artificial Sequence
  Synthetic Oligonucleotide; BTLA exon 3; Set C
ugguacugggggcagagggaaaauagaacccaccu

SEQ ID NO: 52837 - RNA, 33 nt, Artificial Sequence
  Synthetic Oligonucleotide; BTLA exon 3; Set C
gguacugggggcagagggaaaauagaacccacc

SEQ ID NO: 52838 - RNA, 32 nt, Artificial Sequence
  Synthetic Oligonucleotide; BTLA exon 3; Set C
gguacugggggcagagggaaaauagaacccac

SEQ ID NO: 52839 - RNA, 36 nt, Artificial Sequence
  Synthetic Oligonucleotide; BTLA exon 3; Set C
gugguacugggggcagagggaaaauagaacccaccu

SEQ ID NO: 52840 - RNA, 34 nt, Artificial Sequence
  Synthetic Oligonucleotide; BTLA exon 3; Set C
ugguacugggggcagagggaaaauagaacccacc

SEQ ID NO: 52841 - RNA, 33 nt, Artificial Sequence
  Synthetic Oligonucleotide; BTLA exon 3; Set C
ugguacugggggcagagggaaaauagaacccac

SEQ ID NO: 52842 - RNA, 37 nt, Artificial Sequence
  Synthetic Oligonucleotide; BTLA exon 3; Set C
ugugguacugggggcagagggaaaauagaacccaccu

SEQ ID NO: 52843 - RNA, 35 nt, Artificial Sequence
  Synthetic Oligonucleotide; BTLA exon 3; Set C
gugguacugggggcagagggaaaauagaacccacc

SEQ ID NO: 52844 - RNA, 34 nt, Artificial Sequence
  Synthetic Oligonucleotide; BTLA exon 3; Set C
gugguacugggggcagagggaaaauagaacccac

SEQ ID NO: 52845 - RNA, 36 nt, Artificial Sequence
  Synthetic Oligonucleotide; BTLA exon 3; Set C
ugugguacugggggcagagggaaaauagaacccacc

SEQ ID NO: 52846 - RNA, 35 nt, Artificial Sequence
  Synthetic Oligonucleotide; BTLA exon 3; Set C
ugugguacugggggcagagggaaaauagaacccac

SEQ ID NO: 52847 - RNA, 39 nt, Artificial Sequence
  Synthetic Oligonucleotide; BTLA exon 3; Set C
ugugugguacugggggcagagggaaaauagaacccaccu

SEQ ID NO: 52848 - RNA, 37 nt, Artificial Sequence
  Synthetic Oligonucleotide; BTLA exon 3; Set C
gugugguacugggggcagagggaaaauagaacccacc

SEQ ID NO: 52849 - RNA, 36 nt, Artificial Sequence
  Synthetic Oligonucleotide; BTLA exon 3; Set C
gugugguacugggggcagagggaaaauagaacccac

SEQ ID NO: 52850 - RNA, 40 nt, Artificial Sequence
  Synthetic Oligonucleotide; BTLA exon 3; Set C
augugugguacugggggcagagggaaaauagaacccaccu

SEQ ID NO: 52851 - RNA, 38 nt, Artificial Sequence
  Synthetic Oligonucleotide; BTLA exon 3; Set C
ugugugguacugggggcagagggaaaauagaacccacc

SEQ ID NO: 52852 - RNA, 37 nt, Artificial Sequence
  Synthetic Oligonucleotide; BTLA exon 3; Set C
ugugugguacugggggcagagggaaaauagaacccac

SEQ ID NO: 52853 - RNA, 39 nt, Artificial Sequence
  Synthetic Oligonucleotide; BTLA exon 3; Set C
augugugguacugggggcagagggaaaauagaacccacc

SEQ ID NO: 52854 - RNA, 38 nt, Artificial Sequence
  Synthetic Oligonucleotide; BTLA exon 3; Set C
augugugguacugggggcagagggaaaauagaacccac

SEQ ID NO: 52855 - RNA, 40 nt, Artificial Sequence
  Synthetic Oligonucleotide; BTLA exon 3; Set C
aaugugugguacugggggcagagggaaaauagaacccacc

SEQ ID NO: 52856 - RNA, 39 nt, Artificial Sequence
  Synthetic Oligonucleotide; BTLA exon 3; Set C
aaugugugguacugggggcagagggaaaauagaacccac

SEQ ID NO: 52857 - RNA, 40 nt, Artificial Sequence
  Synthetic Oligonucleotide; BTLA exon 3; Set C
aaaugugugguacugggggcagagggaaaauagaacccac

SEQ ID NO: 52858 - RNA, 17 nt, Artificial Sequence
  Synthetic Oligonucleotide; BTLA exon 3; Set B
ugugguacugggggcag

SEQ ID NO: 52859 - RNA, 18 nt, Artificial Sequence
  Synthetic Oligonucleotide; BTLA exon 3; Set B
gugugguacugggggcag

SEQ ID NO: 52860 - RNA, 19 nt, Artificial Sequence
  Synthetic Oligonucleotide; BTLA exon 3; Set B
ugugugguacugggggcag

SEQ ID NO: 52861 - RNA, 20 nt, Artificial Sequence
  Synthetic Oligonucleotide; BTLA exon 3; Set B
augugugguacugggggcag

SEQ ID NO: 52862 - RNA, 21 nt, Artificial Sequence
  Synthetic Oligonucleotide; BTLA exon 3; Set B
aaugugugguacugggggcag

SEQ ID NO: 52863 - RNA, 22 nt, Artificial Sequence
  Synthetic Oligonucleotide; BTLA exon 3; Set B
aaaugugugguacugggggcag

SEQ ID NO: 52864 - RNA, 30 nt, Artificial Sequence
  Synthetic Oligonucleotide; BTLA exon 3; Set C
auggccccaaaugugugguacugggggcag

SEQ ID NO: 52865 - RNA, 31 nt, Artificial Sequence
  Synthetic Oligonucleotide; BTLA exon 3; Set C
aauggccccaaaugugugguacugggggcag

SEQ ID NO: 52866 - RNA, 32 nt, Artificial Sequence
  Synthetic Oligonucleotide; BTLA exon 3; Set C
gaauggccccaaaugugugguacugggggcag

SEQ ID NO: 52867 - RNA, 19 nt, Artificial Sequence
  Synthetic Oligonucleotide; BTLA exon 4; Set C
aaguaaucaaaaggaguaa

SEQ ID NO: 52868 - RNA, 20 nt, Artificial Sequence
  Synthetic Oligonucleotide; BTLA exon 4; Set C
gaaguaaucaaaaggaguaa

SEQ ID NO: 52869 - RNA, 21 nt, Artificial Sequence
  Synthetic Oligonucleotide; BTLA exon 4; Set C
agaaguaaucaaaaggaguaa

SEQ ID NO: 52870 - RNA, 19 nt, Artificial Sequence
  Synthetic Oligonucleotide; BTLA exon 4; Set C
gaaguaaucaaaaggagua

SEQ ID NO: 52871 - RNA, 22 nt, Artificial Sequence
  Synthetic Oligonucleotide; BTLA exon 4; Set C
aagaaguaaucaaaaggaguaa

SEQ ID NO: 52872 - RNA, 20 nt, Artificial Sequence
  Synthetic Oligonucleotide; BTLA exon 4; Set C
agaaguaaucaaaaggagua

SEQ ID NO: 52873 - RNA, 23 nt, Artificial Sequence
  Synthetic Oligonucleotide; BTLA exon 4; Set C
aaagaaguaaucaaaaggaguaa

SEQ ID NO: 52874 - RNA, 21 nt, Artificial Sequence
  Synthetic Oligonucleotide; BTLA exon 4; Set C
aagaaguaaucaaaaggagua

SEQ ID NO: 52875 - RNA, 22 nt, Artificial Sequence
  Synthetic Oligonucleotide; BTLA exon 4; Set C
aaagaaguaaucaaaaggagua

SEQ ID NO: 52876 - RNA, 24 nt, Artificial Sequence
  Synthetic Oligonucleotide; BTLA exon 4; Set C
aaaagaaguaaucaaaaggaguaa

SEQ ID NO: 52877 - RNA, 23 nt, Artificial Sequence
  Synthetic Oligonucleotide; BTLA exon 4; Set C
aaaagaaguaaucaaaaggagua

SEQ ID NO: 52878 - RNA, 21 nt, Artificial Sequence
  Synthetic Oligonucleotide; BTLA exon 4; Set C
aaagaaguaaucaaaaggagu

SEQ ID NO: 52879 - RNA, 22 nt, Artificial Sequence
  Synthetic Oligonucleotide; BTLA exon 4; Set C
aaaagaaguaaucaaaaggagu

SEQ ID NO: 52880 - RNA, 29 nt, Artificial Sequence
  Synthetic Oligonucleotide; BTLA exon 4; Set C
aaagaaaaagaaguaaucaaaaggaguaa

SEQ ID NO: 52881 - RNA, 28 nt, Artificial Sequence
  Synthetic Oligonucleotide; BTLA exon 4; Set C
aaagaaaaagaaguaaucaaaaggagua

SEQ ID NO: 52882 - RNA, 30 nt, Artificial Sequence
  Synthetic Oligonucleotide; BTLA exon 4; Set C
aaaagaaaaagaaguaaucaaaaggaguaa

SEQ ID NO: 52883 - RNA, 29 nt, Artificial Sequence
  Synthetic Oligonucleotide; BTLA exon 4; Set C
aaaagaaaaagaaguaaucaaaaggagua

SEQ ID NO: 52884 - RNA, 31 nt, Artificial Sequence
  Synthetic Oligonucleotide; BTLA exon 4; Set C
aaaaagaaaaagaaguaaucaaaaggaguaa

SEQ ID NO: 52885 - RNA, 27 nt, Artificial Sequence
  Synthetic Oligonucleotide; BTLA exon 4; Set C
aaagaaaaagaaguaaucaaaaggagu

SEQ ID NO: 52886 - RNA, 30 nt, Artificial Sequence
  Synthetic Oligonucleotide; BTLA exon 4; Set C
aaaaagaaaaagaaguaaucaaaaggagua

SEQ ID NO: 52887 - RNA, 32 nt, Artificial Sequence
  Synthetic Oligonucleotide; BTLA exon 4; Set C
caaaaagaaaaagaaguaaucaaaaggaguaa

SEQ ID NO: 52888 - RNA, 28 nt, Artificial Sequence
  Synthetic Oligonucleotide; BTLA exon 4; Set C
aaaagaaaaagaaguaaucaaaaggagu

SEQ ID NO: 52889 - RNA, 26 nt, Artificial Sequence
  Synthetic Oligonucleotide; BTLA exon 4; Set C
aaagaaaaagaaguaaucaaaaggag

SEQ ID NO: 52890 - RNA, 31 nt, Artificial Sequence
  Synthetic Oligonucleotide; BTLA exon 4; Set C
caaaaagaaaaagaaguaaucaaaaggagua

SEQ ID NO: 52891 - RNA, 29 nt, Artificial Sequence
  Synthetic Oligonucleotide; BTLA exon 4; Set C
aaaaagaaaaagaaguaaucaaaaggagu

SEQ ID NO: 52892 - RNA, 30 nt, Artificial Sequence
  Synthetic Oligonucleotide; BTLA exon 4; Set C
caaaaagaaaaagaaguaaucaaaaggagu

SEQ ID NO: 52893 - RNA, 15 nt, Artificial Sequence
  Synthetic Oligonucleotide; BTLA exon 4; Set C
aaaagaaaaagaagu

SEQ ID NO: 52894 - RNA, 16 nt, Artificial Sequence
  Synthetic Oligonucleotide; BTLA exon 4; Set C
aaaaagaaaaagaagu

SEQ ID NO: 52895 - RNA, 15 nt, Artificial Sequence
  Synthetic Oligonucleotide; BTLA exon 4; Set C
aaaaagaaaaagaag

SEQ ID NO: 52896 - RNA, 17 nt, Artificial Sequence
  Synthetic Oligonucleotide; BTLA exon 4; Set C
caaaaagaaaaagaagu

SEQ ID NO: 52897 - RNA, 16 nt, Artificial Sequence
  Synthetic Oligonucleotide; BTLA exon 4; Set C
caaaaagaaaaagaag

SEQ ID NO: 52898 - RNA, 15 nt, Artificial Sequence
  Synthetic Oligonucleotide; BTLA exon 4; Set C
caaaaagaaaaagaa

SEQ ID NO: 52899 - RNA, 17 nt, Artificial Sequence
  Synthetic Oligonucleotide; BTLA exon 4; Set C
acaaaaagaaaaagaag

SEQ ID NO: 52900 - RNA, 18 nt, Artificial Sequence
  Synthetic Oligonucleotide; BTLA exon 4; Set C
gacaaaaagaaaaagaag

SEQ ID NO: 52901 - RNA, 15 nt, Artificial Sequence
  Synthetic Oligonucleotide; BTLA exon 4; Set C
acaaaaagaaaaaga

SEQ ID NO: 52902 - RNA, 17 nt, Artificial Sequence
  Synthetic Oligonucleotide; BTLA exon 4; Set C
gacaaaaagaaaaagaa

SEQ ID NO: 52903 - RNA, 16 nt, Artificial Sequence
  Synthetic Oligonucleotide; BTLA exon 4; Set C
gacaaaaagaaaaaga

SEQ ID NO: 52904 - RNA, 15 nt, Artificial Sequence
  Synthetic Oligonucleotide; BTLA exon 4; Set C
gacaaaaagaaaaag

SEQ ID NO: 52905 - RNA, 16 nt, Artificial Sequence
  Synthetic Oligonucleotide; BTLA exon 4; Set C
uaaucaaaaggaguaa

SEQ ID NO: 52906 - RNA, 15 nt, Artificial Sequence
  Synthetic Oligonucleotide; BTLA exon 4; Set C
uaaucaaaaggagua

SEQ ID NO: 52907 - RNA, 17 nt, Artificial Sequence
  Synthetic Oligonucleotide; BTLA exon 4; Set C
guaaucaaaaggaguaa

SEQ ID NO: 52908 - RNA, 18 nt, Artificial Sequence
  Synthetic Oligonucleotide; BTLA exon 4; Set C
aguaaucaaaaggaguaa

SEQ ID NO: 52909 - RNA, 16 nt, Artificial Sequence
  Synthetic Oligonucleotide; BTLA exon 4; Set C
guaaucaaaaggagua

SEQ ID NO: 52910 - RNA, 17 nt, Artificial Sequence
  Synthetic Oligonucleotide; BTLA exon 4; Set C
aguaaucaaaaggagua

SEQ ID NO: 52911 - RNA, 15 nt, Artificial Sequence
  Synthetic Oligonucleotide; BTLA exon 4; Set C
guaaucaaaaggagu

SEQ ID NO: 52912 - RNA, 18 nt, Artificial Sequence
  Synthetic Oligonucleotide; BTLA exon 4; Set C
aaguaaucaaaaggagua

SEQ ID NO: 52913 - RNA, 16 nt, Artificial Sequence
  Synthetic Oligonucleotide; BTLA exon 4; Set C
aguaaucaaaaggagu

SEQ ID NO: 52914 - RNA, 17 nt, Artificial Sequence
  Synthetic Oligonucleotide; BTLA exon 4; Set C
aaguaaucaaaaggagu

SEQ ID NO: 52915 - RNA, 15 nt, Artificial Sequence
  Synthetic Oligonucleotide; BTLA exon 4; Set C
aguaaucaaaaggag

SEQ ID NO: 52916 - RNA, 18 nt, Artificial Sequence
  Synthetic Oligonucleotide; BTLA exon 4; Set C
gaaguaaucaaaaggagu

SEQ ID NO: 52917 - RNA, 16 nt, Artificial Sequence
  Synthetic Oligonucleotide; BTLA exon 4; Set C
aaguaaucaaaaggag

SEQ ID NO: 52918 - RNA, 19 nt, Artificial Sequence
  Synthetic Oligonucleotide; BTLA exon 4; Set C
agaaguaaucaaaaggagu

SEQ ID NO: 52919 - RNA, 17 nt, Artificial Sequence
  Synthetic Oligonucleotide; BTLA exon 4; Set C
gaaguaaucaaaaggag

SEQ ID NO: 52920 - RNA, 15 nt, Artificial Sequence
  Synthetic Oligonucleotide; BTLA exon 4; Set C
aaguaaucaaaagga

SEQ ID NO: 52921 - RNA, 20 nt, Artificial Sequence
  Synthetic Oligonucleotide; BTLA exon 4; Set C
aagaaguaaucaaaaggagu

SEQ ID NO: 52922 - RNA, 18 nt, Artificial Sequence
  Synthetic Oligonucleotide; BTLA exon 4; Set C
agaaguaaucaaaaggag

SEQ ID NO: 52923 - RNA, 16 nt, Artificial Sequence
  Synthetic Oligonucleotide; BTLA exon 4; Set C
gaaguaaucaaaagga

SEQ ID NO: 52924 - RNA, 19 nt, Artificial Sequence
  Synthetic Oligonucleotide; BTLA exon 4; Set C
aagaaguaaucaaaaggag

SEQ ID NO: 52925 - RNA, 17 nt, Artificial Sequence
  Synthetic Oligonucleotide; BTLA exon 4; Set C
agaaguaaucaaaagga

SEQ ID NO: 52926 - RNA, 15 nt, Artificial Sequence
  Synthetic Oligonucleotide; BTLA exon 4; Set C
gaaguaaucaaaagg

SEQ ID NO: 52927 - RNA, 20 nt, Artificial Sequence
  Synthetic Oligonucleotide; BTLA exon 4; Set C
aaagaaguaaucaaaaggag

SEQ ID NO: 52928 - RNA, 18 nt, Artificial Sequence
  Synthetic Oligonucleotide; BTLA exon 4; Set C
aagaaguaaucaaaagga

SEQ ID NO: 52929 - RNA, 16 nt, Artificial Sequence
  Synthetic Oligonucleotide; BTLA exon 4; Set C
agaaguaaucaaaagg

SEQ ID NO: 52930 - RNA, 21 nt, Artificial Sequence
  Synthetic Oligonucleotide; BTLA exon 4; Set C
aaaagaaguaaucaaaaggag

SEQ ID NO: 52931 - RNA, 15 nt, Artificial Sequence
  Synthetic Oligonucleotide; BTLA exon 4; Set C
agaaguaaucaaaag

SEQ ID NO: 52932 - RNA, 19 nt, Artificial Sequence
  Synthetic Oligonucleotide; BTLA exon 4; Set C
aaagaaguaaucaaaagga

SEQ ID NO: 52933 - RNA, 17 nt, Artificial Sequence
  Synthetic Oligonucleotide; BTLA exon 4; Set C
aagaaguaaucaaaagg

SEQ ID NO: 52934 - RNA, 16 nt, Artificial Sequence
  Synthetic Oligonucleotide; BTLA exon 4; Set C
aagaaguaaucaaaag

SEQ ID NO: 52935 - RNA, 18 nt, Artificial Sequence
  Synthetic Oligonucleotide; BTLA exon 4; Set C
aaagaaguaaucaaaagg

SEQ ID NO: 52936 - RNA, 20 nt, Artificial Sequence
  Synthetic Oligonucleotide; BTLA exon 4; Set C
aaaagaaguaaucaaaagga

SEQ ID NO: 52937 - RNA, 15 nt, Artificial Sequence
  Synthetic Oligonucleotide; BTLA exon 4; Set C
aagaaguaaucaaaa

SEQ ID NO: 52938 - RNA, 17 nt, Artificial Sequence
  Synthetic Oligonucleotide; BTLA exon 4; Set C
aaagaaguaaucaaaag

SEQ ID NO: 52939 - RNA, 19 nt, Artificial Sequence
  Synthetic Oligonucleotide; BTLA exon 4; Set C
aaaagaaguaaucaaaagg

SEQ ID NO: 52940 - RNA, 16 nt, Artificial Sequence
  Synthetic Oligonucleotide; BTLA exon 4; Set C
aaagaaguaaucaaaa

SEQ ID NO: 52941 - RNA, 18 nt, Artificial Sequence
  Synthetic Oligonucleotide; BTLA exon 4; Set C
aaaagaaguaaucaaaag

SEQ ID NO: 52942 - RNA, 15 nt, Artificial Sequence
  Synthetic Oligonucleotide; BTLA exon 4; Set C
aaagaaguaaucaaa

SEQ ID NO: 52943 - RNA, 17 nt, Artificial Sequence
  Synthetic Oligonucleotide; BTLA exon 4; Set C
aaaagaaguaaucaaaa

SEQ ID NO: 52944 - RNA, 16 nt, Artificial Sequence
  Synthetic Oligonucleotide; BTLA exon 4; Set C
aaaagaaguaaucaaa

SEQ ID NO: 52945 - RNA, 33 nt, Artificial Sequence
  Synthetic Oligonucleotide; BTLA exon 4; Set C
acaaaaagaaaaagaaguaaucaaaaggaguaa

SEQ ID NO: 52946 - RNA, 27 nt, Artificial Sequence
  Synthetic Oligonucleotide; BTLA exon 4; Set C
aaaagaaaaagaaguaaucaaaaggag

SEQ ID NO: 52947 - RNA, 25 nt, Artificial Sequence
  Synthetic Oligonucleotide; BTLA exon 4; Set C
aaagaaaaagaaguaaucaaaagga

SEQ ID NO: 52948 - RNA, 34 nt, Artificial Sequence
  Synthetic Oligonucleotide; BTLA exon 4; Set C
gacaaaaagaaaaagaaguaaucaaaaggaguaa

SEQ ID NO: 52949 - RNA, 32 nt, Artificial Sequence
  Synthetic Oligonucleotide; BTLA exon 4; Set C
acaaaaagaaaaagaaguaaucaaaaggagua

SEQ ID NO: 52950 - RNA, 28 nt, Artificial Sequence
  Synthetic Oligonucleotide; BTLA exon 4; Set C
aaaaagaaaaagaaguaaucaaaaggag

SEQ ID NO: 52951 - RNA, 24 nt, Artificial Sequence
  Synthetic Oligonucleotide; BTLA exon 4; Set C
aaagaaaaagaaguaaucaaaagg

SEQ ID NO: 52952 - RNA, 26 nt, Artificial Sequence
  Synthetic Oligonucleotide; BTLA exon 4; Set C
aaaagaaaaagaaguaaucaaaagga

SEQ ID NO: 52953 - RNA, 33 nt, Artificial Sequence
  Synthetic Oligonucleotide; BTLA exon 4; Set C
gacaaaaagaaaaagaaguaaucaaaaggagua

SEQ ID NO: 52954 - RNA, 35 nt, Artificial Sequence
  Synthetic Oligonucleotide; BTLA exon 4; Set C
agacaaaaagaaaaagaaguaaucaaaaggaguaa

SEQ ID NO: 52955 - RNA, 31 nt, Artificial Sequence
  Synthetic Oligonucleotide; BTLA exon 4; Set C
acaaaaagaaaaagaaguaaucaaaaggagu

SEQ ID NO: 52956 - RNA, 29 nt, Artificial Sequence
  Synthetic Oligonucleotide; BTLA exon 4; Set C
caaaaagaaaaagaaguaaucaaaaggag

SEQ ID NO: 52957 - RNA, 23 nt, Artificial Sequence
  Synthetic Oligonucleotide; BTLA exon 4; Set C
aaagaaaaagaaguaaucaaaag

SEQ ID NO: 52958 - RNA, 25 nt, Artificial Sequence
  Synthetic Oligonucleotide; BTLA exon 4; Set C
aaaagaaaaagaaguaaucaaaagg

SEQ ID NO: 52959 - RNA, 27 nt, Artificial Sequence
  Synthetic Oligonucleotide; BTLA exon 4; Set C
aaaaagaaaaagaaguaaucaaaagga

SEQ ID NO: 52960 - RNA, 34 nt, Artificial Sequence
  Synthetic Oligonucleotide; BTLA exon 4; Set C
agacaaaaagaaaaagaaguaaucaaaaggagua

SEQ ID NO: 52961 - RNA, 36 nt, Artificial Sequence
  Synthetic Oligonucleotide; BTLA exon 4; Set C
aagacaaaaagaaaaagaaguaaucaaaaggaguaa

SEQ ID NO: 52962 - RNA, 32 nt, Artificial Sequence
  Synthetic Oligonucleotide; BTLA exon 4; Set C
gacaaaaagaaaaagaaguaaucaaaaggagu

SEQ ID NO: 52963 - RNA, 30 nt, Artificial Sequence
  Synthetic Oligonucleotide; BTLA exon 4; Set C
acaaaaagaaaaagaaguaaucaaaaggag

SEQ ID NO: 52964 - RNA, 22 nt, Artificial Sequence
  Synthetic Oligonucleotide; BTLA exon 4; Set C
aaagaaaaagaaguaaucaaaa

SEQ ID NO: 52965 - RNA, 24 nt, Artificial Sequence
  Synthetic Oligonucleotide; BTLA exon 4; Set C
aaaagaaaaagaaguaaucaaaag

SEQ ID NO: 52966 - RNA, 26 nt, Artificial Sequence
  Synthetic Oligonucleotide; BTLA exon 4; Set C
aaaaagaaaaagaaguaaucaaaagg

SEQ ID NO: 52967 - RNA, 28 nt, Artificial Sequence
  Synthetic Oligonucleotide; BTLA exon 4; Set C
caaaaagaaaaagaaguaaucaaaagga

SEQ ID NO: 52968 - RNA, 37 nt, Artificial Sequence
  Synthetic Oligonucleotide; BTLA exon 4; Set C
gaagacaaaaagaaaaagaaguaaucaaaaggaguaa

SEQ ID NO: 52969 - RNA, 35 nt, Artificial Sequence
  Synthetic Oligonucleotide; BTLA exon 4; Set C
aagacaaaaagaaaaagaaguaaucaaaaggagua

SEQ ID NO: 52970 - RNA, 33 nt, Artificial Sequence
  Synthetic Oligonucleotide; BTLA exon 4; Set C
agacaaaaagaaaaagaaguaaucaaaaggagu

SEQ ID NO: 52971 - RNA, 31 nt, Artificial Sequence
  Synthetic Oligonucleotide; BTLA exon 4; Set C
gacaaaaagaaaaagaaguaaucaaaaggag

SEQ ID NO: 52972 - RNA, 21 nt, Artificial Sequence
  Synthetic Oligonucleotide; BTLA exon 4; Set C
aaagaaaaagaaguaaucaaa

SEQ ID NO: 52973 - RNA, 23 nt, Artificial Sequence
  Synthetic Oligonucleotide; BTLA exon 4; Set C
aaaagaaaaagaaguaaucaaaa

SEQ ID NO: 52974 - RNA, 25 nt, Artificial Sequence
  Synthetic Oligonucleotide; BTLA exon 4; Set C
aaaaagaaaaagaaguaaucaaaag

SEQ ID NO: 52975 - RNA, 27 nt, Artificial Sequence
  Synthetic Oligonucleotide; BTLA exon 4; Set C
caaaaagaaaaagaaguaaucaaaagg

SEQ ID NO: 52976 - RNA, 29 nt, Artificial Sequence
  Synthetic Oligonucleotide; BTLA exon 4; Set C
acaaaaagaaaaagaaguaaucaaaagga

SEQ ID NO: 52977 - RNA, 38 nt, Artificial Sequence
  Synthetic Oligonucleotide; BTLA exon 4; Set C
ggaagacaaaaagaaaaagaaguaaucaaaaggaguaa

SEQ ID NO: 52978 - RNA, 36 nt, Artificial Sequence
  Synthetic Oligonucleotide; BTLA exon 4; Set C
gaagacaaaaagaaaaagaaguaaucaaaaggagua

SEQ ID NO: 52979 - RNA, 34 nt, Artificial Sequence
  Synthetic Oligonucleotide; BTLA exon 4; Set C
aagacaaaaagaaaaagaaguaaucaaaaggagu

SEQ ID NO: 52980 - RNA, 32 nt, Artificial Sequence
  Synthetic Oligonucleotide; BTLA exon 4; Set C
agacaaaaagaaaaagaaguaaucaaaaggag

SEQ ID NO: 52981 - RNA, 22 nt, Artificial Sequence
  Synthetic Oligonucleotide; BTLA exon 4; Set C
aaaagaaaaagaaguaaucaaa

SEQ ID NO: 52982 - RNA, 24 nt, Artificial Sequence
  Synthetic Oligonucleotide; BTLA exon 4; Set C
aaaaagaaaaagaaguaaucaaaa

SEQ ID NO: 52983 - RNA, 26 nt, Artificial Sequence
  Synthetic Oligonucleotide; BTLA exon 4; Set C
caaaaagaaaaagaaguaaucaaaag

SEQ ID NO: 52984 - RNA, 30 nt, Artificial Sequence
  Synthetic Oligonucleotide; BTLA exon 4; Set C
gacaaaaagaaaaagaaguaaucaaaagga

SEQ ID NO: 52985 - RNA, 28 nt, Artificial Sequence
  Synthetic Oligonucleotide; BTLA exon 4; Set C
acaaaaagaaaaagaaguaaucaaaagg

SEQ ID NO: 52986 - RNA, 37 nt, Artificial Sequence
  Synthetic Oligonucleotide; BTLA exon 4; Set C
ggaagacaaaaagaaaaagaaguaaucaaaaggagua

SEQ ID NO: 52987 - RNA, 39 nt, Artificial Sequence
  Synthetic Oligonucleotide; BTLA exon 4; Set C
uggaagacaaaaagaaaaagaaguaaucaaaaggaguaa

SEQ ID NO: 52988 - RNA, 35 nt, Artificial Sequence
  Synthetic Oligonucleotide; BTLA exon 4; Set C
gaagacaaaaagaaaaagaaguaaucaaaaggagu

SEQ ID NO: 52989 - RNA, 33 nt, Artificial Sequence
  Synthetic Oligonucleotide; BTLA exon 4; Set C
aagacaaaaagaaaaagaaguaaucaaaaggag

SEQ ID NO: 52990 - RNA, 23 nt, Artificial Sequence
  Synthetic Oligonucleotide; BTLA exon 4; Set C
aaaaagaaaaagaaguaaucaaa

SEQ ID NO: 52991 - RNA, 25 nt, Artificial Sequence
  Synthetic Oligonucleotide; BTLA exon 4; Set C
caaaaagaaaaagaaguaaucaaaa

SEQ ID NO: 52992 - RNA, 27 nt, Artificial Sequence
  Synthetic Oligonucleotide; BTLA exon 4; Set C
acaaaaagaaaaagaaguaaucaaaag

SEQ ID NO: 52993 - RNA, 29 nt, Artificial Sequence
  Synthetic Oligonucleotide; BTLA exon 4; Set C
gacaaaaagaaaaagaaguaaucaaaagg

SEQ ID NO: 52994 - RNA, 38 nt, Artificial Sequence
  Synthetic Oligonucleotide; BTLA exon 4; Set C
uggaagacaaaaagaaaaagaaguaaucaaaaggagua

SEQ ID NO: 52995 - RNA, 40 nt, Artificial Sequence
  Synthetic Oligonucleotide; BTLA exon 4; Set C
cuggaagacaaaaagaaaaagaaguaaucaaaaggaguaa

SEQ ID NO: 52996 - RNA, 36 nt, Artificial Sequence
  Synthetic Oligonucleotide; BTLA exon 4; Set C
ggaagacaaaaagaaaaagaaguaaucaaaaggagu

SEQ ID NO: 52997 - RNA, 34 nt, Artificial Sequence
  Synthetic Oligonucleotide; BTLA exon 4; Set C
gaagacaaaaagaaaaagaaguaaucaaaaggag

SEQ ID NO: 52998 - RNA, 24 nt, Artificial Sequence
  Synthetic Oligonucleotide; BTLA exon 4; Set C
caaaaagaaaaagaaguaaucaaa

SEQ ID NO: 52999 - RNA, 26 nt, Artificial Sequence
  Synthetic Oligonucleotide; BTLA exon 4; Set C
acaaaaagaaaaagaaguaaucaaaa

SEQ ID NO: 53000 - RNA, 28 nt, Artificial Sequence
  Synthetic Oligonucleotide; BTLA exon 4; Set C
gacaaaaagaaaaagaaguaaucaaaag

SEQ ID NO: 53001 - RNA, 39 nt, Artificial Sequence
  Synthetic Oligonucleotide; BTLA exon 4; Set C
cuggaagacaaaaagaaaaagaaguaaucaaaaggagua

SEQ ID NO: 53002 - RNA, 37 nt, Artificial Sequence
  Synthetic Oligonucleotide; BTLA exon 4; Set C
uggaagacaaaaagaaaaagaaguaaucaaaaggagu

SEQ ID NO: 53003 - RNA, 35 nt, Artificial Sequence
  Synthetic Oligonucleotide; BTLA exon 4; Set C
ggaagacaaaaagaaaaagaaguaaucaaaaggag

SEQ ID NO: 53004 - RNA, 25 nt, Artificial Sequence
  Synthetic Oligonucleotide; BTLA exon 4; Set C
acaaaaagaaaaagaaguaaucaaa

SEQ ID NO: 53005 - RNA, 27 nt, Artificial Sequence
  Synthetic Oligonucleotide; BTLA exon 4; Set C
gacaaaaagaaaaagaaguaaucaaaa

SEQ ID NO: 53006 - RNA, 33 nt, Artificial Sequence
  Synthetic Oligonucleotide; BTLA exon 4; Set C
gaagacaaaaagaaaaagaaguaaucaaaagga

SEQ ID NO: 53007 - RNA, 38 nt, Artificial Sequence
  Synthetic Oligonucleotide; BTLA exon 4; Set C
cuggaagacaaaaagaaaaagaaguaaucaaaaggagu

SEQ ID NO: 53008 - RNA, 36 nt, Artificial Sequence
  Synthetic Oligonucleotide; BTLA exon 4; Set C
uggaagacaaaaagaaaaagaaguaaucaaaaggag

SEQ ID NO: 53009 - RNA, 26 nt, Artificial Sequence
  Synthetic Oligonucleotide; BTLA exon 4; Set C
gacaaaaagaaaaagaaguaaucaaa

SEQ ID NO: 53010 - RNA, 28 nt, Artificial Sequence
  Synthetic Oligonucleotide; BTLA exon 4; Set C
agacaaaaagaaaaagaaguaaucaaaa

SEQ ID NO: 53011 - RNA, 34 nt, Artificial Sequence
  Synthetic Oligonucleotide; BTLA exon 4; Set C
ggaagacaaaaagaaaaagaaguaaucaaaagga

SEQ ID NO: 53012 - RNA, 32 nt, Artificial Sequence
  Synthetic Oligonucleotide; BTLA exon 4; Set C
gaagacaaaaagaaaaagaaguaaucaaaagg

SEQ ID NO: 53013 - RNA, 16 nt, Artificial Sequence
  Synthetic Oligonucleotide; BTLA exon 4; Set C
aaagaaaaagaaguaa

SEQ ID NO: 53014 - RNA, 37 nt, Artificial Sequence
  Synthetic Oligonucleotide; BTLA exon 4; Set C
cuggaagacaaaaagaaaaagaaguaaucaaaaggag

SEQ ID NO: 53015 - RNA, 27 nt, Artificial Sequence
  Synthetic Oligonucleotide; BTLA exon 4; Set C
agacaaaaagaaaaagaaguaaucaaa

SEQ ID NO: 53016 - RNA, 29 nt, Artificial Sequence
  Synthetic Oligonucleotide; BTLA exon 4; Set C
aagacaaaaagaaaaagaaguaaucaaaa

SEQ ID NO: 53017 - RNA, 31 nt, Artificial Sequence
  Synthetic Oligonucleotide; BTLA exon 4; Set C
gaagacaaaaagaaaaagaaguaaucaaaag

SEQ ID NO: 53018 - RNA, 33 nt, Artificial Sequence
  Synthetic Oligonucleotide; BTLA exon 4; Set C
ggaagacaaaaagaaaaagaaguaaucaaaagg

SEQ ID NO: 53019 - RNA, 17 nt, Artificial Sequence
  Synthetic Oligonucleotide; BTLA exon 4; Set C
aaaagaaaaagaaguaa

SEQ ID NO: 53020 - RNA, 15 nt, Artificial Sequence
  Synthetic Oligonucleotide; BTLA exon 4; Set C
aaagaaaaagaagua

SEQ ID NO: 53021 - RNA, 28 nt, Artificial Sequence
  Synthetic Oligonucleotide; BTLA exon 4; Set C
aagacaaaaagaaaaagaaguaaucaaa

SEQ ID NO: 53022 - RNA, 30 nt, Artificial Sequence
  Synthetic Oligonucleotide; BTLA exon 4; Set C
gaagacaaaaagaaaaagaaguaaucaaaa

SEQ ID NO: 53023 - RNA, 32 nt, Artificial Sequence
  Synthetic Oligonucleotide; BTLA exon 4; Set C
ggaagacaaaaagaaaaagaaguaaucaaaag

SEQ ID NO: 53024 - RNA, 18 nt, Artificial Sequence
  Synthetic Oligonucleotide; BTLA exon 4; Set C
aaaaagaaaaagaaguaa

SEQ ID NO: 53025 - RNA, 16 nt, Artificial Sequence
  Synthetic Oligonucleotide; BTLA exon 4; Set C
aaaagaaaaagaagua

SEQ ID NO: 53026 - RNA, 29 nt, Artificial Sequence
  Synthetic Oligonucleotide; BTLA exon 4; Set C
gaagacaaaaagaaaaagaaguaaucaaa

SEQ ID NO: 53027 - RNA, 31 nt, Artificial Sequence
  Synthetic Oligonucleotide; BTLA exon 4; Set C
ggaagacaaaaagaaaaagaaguaaucaaaa

SEQ ID NO: 53028 - RNA, 19 nt, Artificial Sequence
  Synthetic Oligonucleotide; BTLA exon 4; Set C
caaaaagaaaaagaaguaa

SEQ ID NO: 53029 - RNA, 17 nt, Artificial Sequence
  Synthetic Oligonucleotide; BTLA exon 4; Set C
aaaaagaaaaagaagua

SEQ ID NO: 53030 - RNA, 30 nt, Artificial Sequence
  Synthetic Oligonucleotide; BTLA exon 4; Set C
ggaagacaaaaagaaaaagaaguaaucaaa

SEQ ID NO: 53031 - RNA, 20 nt, Artificial Sequence
  Synthetic Oligonucleotide; BTLA exon 4; Set C
acaaaaagaaaaagaaguaa

SEQ ID NO: 53032 - RNA, 18 nt, Artificial Sequence
  Synthetic Oligonucleotide; BTLA exon 4; Set C
caaaaagaaaaagaagua

SEQ ID NO: 53033 - RNA, 31 nt, Artificial Sequence
  Synthetic Oligonucleotide; BTLA exon 4; Set C
uggaagacaaaaagaaaaagaaguaaucaaa

SEQ ID NO: 53034 - RNA, 21 nt, Artificial Sequence
  Synthetic Oligonucleotide; BTLA exon 4; Set C
gacaaaaagaaaaagaaguaa

SEQ ID NO: 53035 - RNA, 19 nt, Artificial Sequence
  Synthetic Oligonucleotide; BTLA exon 4; Set C
acaaaaagaaaaagaagua

SEQ ID NO: 53036 - RNA, 18 nt, Artificial Sequence
  Synthetic Oligonucleotide; BTLA exon 4; Set C
acaaaaagaaaaagaagu

SEQ ID NO: 53037 - RNA, 22 nt, Artificial Sequence
  Synthetic Oligonucleotide; BTLA exon 4; Set C
agacaaaaagaaaaagaaguaa

SEQ ID NO: 53038 - RNA, 20 nt, Artificial Sequence
  Synthetic Oligonucleotide; BTLA exon 4; Set C
gacaaaaagaaaaagaagua

SEQ ID NO: 53039 - RNA, 19 nt, Artificial Sequence
  Synthetic Oligonucleotide; BTLA exon 4; Set C
gacaaaaagaaaaagaagu

SEQ ID NO: 53040 - RNA, 23 nt, Artificial Sequence
  Synthetic Oligonucleotide; BTLA exon 4; Set C
aagacaaaaagaaaaagaaguaa

SEQ ID NO: 53041 - RNA, 21 nt, Artificial Sequence
  Synthetic Oligonucleotide; BTLA exon 4; Set C
agacaaaaagaaaaagaagua

SEQ ID NO: 53042 - RNA, 16 nt, Artificial Sequence
  Synthetic Oligonucleotide; BTLA exon 4; Set C
acaaaaagaaaaagaa

SEQ ID NO: 53043 - RNA, 20 nt, Artificial Sequence
  Synthetic Oligonucleotide; BTLA exon 4; Set C
agacaaaaagaaaaagaagu

SEQ ID NO: 53044 - RNA, 24 nt, Artificial Sequence
  Synthetic Oligonucleotide; BTLA exon 4; Set C
gaagacaaaaagaaaaagaaguaa

SEQ ID NO: 53045 - RNA, 22 nt, Artificial Sequence
  Synthetic Oligonucleotide; BTLA exon 4; Set C
aagacaaaaagaaaaagaagua

SEQ ID NO: 53046 - RNA, 19 nt, Artificial Sequence
  Synthetic Oligonucleotide; BTLA exon 4; Set C
agacaaaaagaaaaagaag

SEQ ID NO: 53047 - RNA, 21 nt, Artificial Sequence
  Synthetic Oligonucleotide; BTLA exon 4; Set C
aagacaaaaagaaaaagaagu

SEQ ID NO: 53048 - RNA, 25 nt, Artificial Sequence
  Synthetic Oligonucleotide; BTLA exon 4; Set C
ggaagacaaaaagaaaaagaaguaa

SEQ ID NO: 53049 - RNA, 23 nt, Artificial Sequence
  Synthetic Oligonucleotide; BTLA exon 4; Set C
gaagacaaaaagaaaaagaagua

SEQ ID NO: 53050 - RNA, 18 nt, Artificial Sequence
  Synthetic Oligonucleotide; BTLA exon 4; Set C
agacaaaaagaaaaagaa

SEQ ID NO: 53051 - RNA, 20 nt, Artificial Sequence
  Synthetic Oligonucleotide; BTLA exon 4; Set C
aagacaaaaagaaaaagaag

SEQ ID NO: 53052 - RNA, 22 nt, Artificial Sequence
  Synthetic Oligonucleotide; BTLA exon 4; Set C
gaagacaaaaagaaaaagaagu

SEQ ID NO: 53053 - RNA, 26 nt, Artificial Sequence
  Synthetic Oligonucleotide; BTLA exon 4; Set C
uggaagacaaaaagaaaaagaaguaa

SEQ ID NO: 53054 - RNA, 24 nt, Artificial Sequence
  Synthetic Oligonucleotide; BTLA exon 4; Set C
ggaagacaaaaagaaaaagaagua

SEQ ID NO: 53055 - RNA, 17 nt, Artificial Sequence
  Synthetic Oligonucleotide; BTLA exon 4; Set C
agacaaaaagaaaaaga

SEQ ID NO: 53056 - RNA, 21 nt, Artificial Sequence
  Synthetic Oligonucleotide; BTLA exon 4; Set C
gaagacaaaaagaaaaagaag

SEQ ID NO: 53057 - RNA, 19 nt, Artificial Sequence
  Synthetic Oligonucleotide; BTLA exon 4; Set C
aagacaaaaagaaaaagaa

SEQ ID NO: 53058 - RNA, 23 nt, Artificial Sequence
  Synthetic Oligonucleotide; BTLA exon 4; Set C
ggaagacaaaaagaaaaagaagu

SEQ ID NO: 53059 - RNA, 25 nt, Artificial Sequence
  Synthetic Oligonucleotide; BTLA exon 4; Set C
uggaagacaaaaagaaaaagaagua

SEQ ID NO: 53060 - RNA, 16 nt, Artificial Sequence
  Synthetic Oligonucleotide; BTLA exon 4; Set C
agacaaaaagaaaaag

SEQ ID NO: 53061 - RNA, 18 nt, Artificial Sequence
  Synthetic Oligonucleotide; BTLA exon 4; Set C
aagacaaaaagaaaaaga

SEQ ID NO: 53062 - RNA, 22 nt, Artificial Sequence
  Synthetic Oligonucleotide; BTLA exon 4; Set C
ggaagacaaaaagaaaaagaag

SEQ ID NO: 53063 - RNA, 20 nt, Artificial Sequence
  Synthetic Oligonucleotide; BTLA exon 4; Set C
gaagacaaaaagaaaaagaa

SEQ ID NO: 53064 - RNA, 24 nt, Artificial Sequence
  Synthetic Oligonucleotide; BTLA exon 4; Set C
uggaagacaaaaagaaaaagaagu

SEQ ID NO: 53065 - RNA, 15 nt, Artificial Sequence
  Synthetic Oligonucleotide; BTLA exon 4; Set C
agacaaaaagaaaaa

SEQ ID NO: 53066 - RNA, 17 nt, Artificial Sequence
  Synthetic Oligonucleotide; BTLA exon 4; Set C
aagacaaaaagaaaaag

SEQ ID NO: 53067 - RNA, 19 nt, Artificial Sequence
  Synthetic Oligonucleotide; BTLA exon 4; Set C
gaagacaaaaagaaaaaga

SEQ ID NO: 53068 - RNA, 21 nt, Artificial Sequence
  Synthetic Oligonucleotide; BTLA exon 4; Set C
ggaagacaaaaagaaaaagaa

SEQ ID NO: 53069 - RNA, 23 nt, Artificial Sequence
  Synthetic Oligonucleotide; BTLA exon 4; Set C
uggaagacaaaaagaaaaagaag

SEQ ID NO: 53070 - RNA, 25 nt, Artificial Sequence
  Synthetic Oligonucleotide; BTLA exon 4; Set C
cuggaagacaaaaagaaaaagaagu

SEQ ID NO: 53071 - RNA, 16 nt, Artificial Sequence
  Synthetic Oligonucleotide; BTLA exon 4; Set C
aagacaaaaagaaaaa

SEQ ID NO: 53072 - RNA, 18 nt, Artificial Sequence
  Synthetic Oligonucleotide; BTLA exon 4; Set C
gaagacaaaaagaaaaag

SEQ ID NO: 53073 - RNA, 20 nt, Artificial Sequence
  Synthetic Oligonucleotide; BTLA exon 4; Set C
ggaagacaaaaagaaaaaga

SEQ ID NO: 53074 - RNA, 22 nt, Artificial Sequence
  Synthetic Oligonucleotide; BTLA exon 4; Set C
uggaagacaaaaagaaaaagaa

SEQ ID NO: 53075 - RNA, 24 nt, Artificial Sequence
  Synthetic Oligonucleotide; BTLA exon 4; Set C
cuggaagacaaaaagaaaaagaag

SEQ ID NO: 53076 - RNA, 17 nt, Artificial Sequence
  Synthetic Oligonucleotide; BTLA exon 4; Set C
gaagacaaaaagaaaaa

SEQ ID NO: 53077 - RNA, 15 nt, Artificial Sequence
  Synthetic Oligonucleotide; BTLA exon 4; Set C
aagacaaaaagaaaa

SEQ ID NO: 53078 - RNA, 19 nt, Artificial Sequence
  Synthetic Oligonucleotide; BTLA exon 4; Set C
ggaagacaaaaagaaaaag

SEQ ID NO: 53079 - RNA, 21 nt, Artificial Sequence
  Synthetic Oligonucleotide; BTLA exon 4; Set C
uggaagacaaaaagaaaaaga

SEQ ID NO: 53080 - RNA, 23 nt, Artificial Sequence
  Synthetic Oligonucleotide; BTLA exon 4; Set C
cuggaagacaaaaagaaaaagaa

SEQ ID NO: 53081 - RNA, 18 nt, Artificial Sequence
  Synthetic Oligonucleotide; BTLA exon 4; Set C
ggaagacaaaaagaaaaa

SEQ ID NO: 53082 - RNA, 16 nt, Artificial Sequence
  Synthetic Oligonucleotide; BTLA exon 4; Set C
gaagacaaaaagaaaa

SEQ ID NO: 53083 - RNA, 20 nt, Artificial Sequence
  Synthetic Oligonucleotide; BTLA exon 4; Set C
uggaagacaaaaagaaaaag

SEQ ID NO: 53084 - RNA, 22 nt, Artificial Sequence
  Synthetic Oligonucleotide; BTLA exon 4; Set C
cuggaagacaaaaagaaaaaga

SEQ ID NO: 53085 - RNA, 19 nt, Artificial Sequence
  Synthetic Oligonucleotide; BTLA exon 4; Set C
uggaagacaaaaagaaaaa

SEQ ID NO: 53086 - RNA, 17 nt, Artificial Sequence
  Synthetic Oligonucleotide; BTLA exon 4; Set C
ggaagacaaaaagaaaa

SEQ ID NO: 53087 - RNA, 21 nt, Artificial Sequence
  Synthetic Oligonucleotide; BTLA exon 4; Set C
cuggaagacaaaaagaaaaag

SEQ ID NO: 53088 - RNA, 20 nt, Artificial Sequence
  Synthetic Oligonucleotide; BTLA exon 4; Set C
cuggaagacaaaaagaaaaa

SEQ ID NO: 53089 - RNA, 18 nt, Artificial Sequence
  Synthetic Oligonucleotide; BTLA exon 4; Set C
uggaagacaaaaagaaaa

SEQ ID NO: 53090 - RNA, 19 nt, Artificial Sequence
  Synthetic Oligonucleotide; BTLA exon 4; Set C
cuggaagacaaaaagaaaa

SEQ ID NO: 53091 - RNA, 37 nt, Artificial Sequence
  Synthetic Oligonucleotide; BTLA exon 4; Set A
gucagagaguucauuuugcuuuccuggaagacaaaaa

SEQ ID NO: 53092 - RNA, 38 nt, Artificial Sequence
  Synthetic Oligonucleotide; BTLA exon 4; Set A
ugucagagaguucauuuugcuuuccuggaagacaaaaa

SEQ ID NO: 53093 - RNA, 36 nt, Artificial Sequence
  Synthetic Oligonucleotide; BTLA exon 4; Set A
gucagagaguucauuuugcuuuccuggaagacaaaa

SEQ ID NO: 53094 - RNA, 37 nt, Artificial Sequence
  Synthetic Oligonucleotide; BTLA exon 4; Set A
ugucagagaguucauuuugcuuuccuggaagacaaaa

SEQ ID NO: 53095 - RNA, 36 nt, Artificial Sequence
  Synthetic Oligonucleotide; BTLA exon 4; Set A
ugucagagaguucauuuugcuuuccuggaagacaaa

SEQ ID NO: 53096 - RNA, 16 nt, Artificial Sequence
  Synthetic Oligonucleotide; BTLA exon 4; Set C
aauugcauuuguuuca

SEQ ID NO: 53097 - RNA, 15 nt, Artificial Sequence
  Synthetic Oligonucleotide; BTLA exon 4; Set C
aauugcauuuguuuc

SEQ ID NO: 53098 - RNA, 17 nt, Artificial Sequence
  Synthetic Oligonucleotide; BTLA exon 4; Set C
aaauugcauuuguuuca

SEQ ID NO: 53099 - RNA, 16 nt, Artificial Sequence
  Synthetic Oligonucleotide; BTLA exon 4; Set C
aaauugcauuuguuuc

SEQ ID NO: 53100 - RNA, 15 nt, Artificial Sequence
  Synthetic Oligonucleotide; BTLA exon 4; Set C
aguaaagaaagcaga

SEQ ID NO: 53101 - RNA, 16 nt, Artificial Sequence
  Synthetic Oligonucleotide; BTLA exon 4; Set C
gaguaaagaaagcaga

SEQ ID NO: 53102 - RNA, 21 nt, Artificial Sequence
  Synthetic Oligonucleotide; BTLA exon 4; Set C
aaaaggaguaaagaaagcaga

SEQ ID NO: 53103 - RNA, 28 nt, Artificial Sequence
  Synthetic Oligonucleotide; BTLA exon 4; Set C
aguaaucaaaaggaguaaagaaagcaga

SEQ ID NO: 53104 - RNA, 29 nt, Artificial Sequence
  Synthetic Oligonucleotide; BTLA exon 4; Set C
aaguaaucaaaaggaguaaagaaagcaga

SEQ ID NO: 53105 - RNA, 30 nt, Artificial Sequence
  Synthetic Oligonucleotide; BTLA exon 4; Set C
gaaguaaucaaaaggaguaaagaaagcaga

SEQ ID NO: 53106 - RNA, 31 nt, Artificial Sequence
  Synthetic Oligonucleotide; BTLA exon 4; Set C
agaaguaaucaaaaggaguaaagaaagcaga

SEQ ID NO: 53107 - RNA, 32 nt, Artificial Sequence
  Synthetic Oligonucleotide; BTLA exon 4; Set C
aagaaguaaucaaaaggaguaaagaaagcaga

SEQ ID NO: 53108 - RNA, 33 nt, Artificial Sequence
  Synthetic Oligonucleotide; BTLA exon 4; Set C
aaagaaguaaucaaaaggaguaaagaaagcaga

SEQ ID NO: 53109 - RNA, 34 nt, Artificial Sequence
  Synthetic Oligonucleotide; BTLA exon 4; Set C
aaaagaaguaaucaaaaggaguaaagaaagcaga

SEQ ID NO: 53110 - RNA, 20 nt, Artificial Sequence
  Synthetic Oligonucleotide; BTLA exon 4; Set C
aaguaaucaaaaggaguaaa

SEQ ID NO: 53111 - RNA, 39 nt, Artificial Sequence
  Synthetic Oligonucleotide; BTLA exon 4; Set C
aaagaaaaagaaguaaucaaaaggaguaaagaaagcaga

SEQ ID NO: 53112 - RNA, 21 nt, Artificial Sequence
  Synthetic Oligonucleotide; BTLA exon 4; Set C
gaaguaaucaaaaggaguaaa

SEQ ID NO: 53113 - RNA, 40 nt, Artificial Sequence
  Synthetic Oligonucleotide; BTLA exon 4; Set C
aaaagaaaaagaaguaaucaaaaggaguaaagaaagcaga

SEQ ID NO: 53114 - RNA, 22 nt, Artificial Sequence
  Synthetic Oligonucleotide; BTLA exon 4; Set C
agaaguaaucaaaaggaguaaa

SEQ ID NO: 53115 - RNA, 38 nt, Artificial Sequence
  Synthetic Oligonucleotide; BTLA exon 4; Set C
aaagaaaaagaaguaaucaaaaggaguaaagaaagcag

SEQ ID NO: 53116 - RNA, 23 nt, Artificial Sequence
  Synthetic Oligonucleotide; BTLA exon 4; Set C
aagaaguaaucaaaaggaguaaa

SEQ ID NO: 53117 - RNA, 24 nt, Artificial Sequence
  Synthetic Oligonucleotide; BTLA exon 4; Set C
aaagaaguaaucaaaaggaguaaa

SEQ ID NO: 53118 - RNA, 25 nt, Artificial Sequence
  Synthetic Oligonucleotide; BTLA exon 4; Set C
aaaagaaguaaucaaaaggaguaaa

SEQ ID NO: 53119 - RNA, 25 nt, Artificial Sequence
  Synthetic Oligonucleotide; BTLA exon 4; Set C
aaaaagaaguaaucaaaaggaguaa

SEQ ID NO: 53120 - RNA, 24 nt, Artificial Sequence
  Synthetic Oligonucleotide; BTLA exon 4; Set C
aaaaagaaguaaucaaaaggagua

SEQ ID NO: 53121 - RNA, 26 nt, Artificial Sequence
  Synthetic Oligonucleotide; BTLA exon 4; Set C
gaaaaagaaguaaucaaaaggaguaa

SEQ ID NO: 53122 - RNA, 25 nt, Artificial Sequence
  Synthetic Oligonucleotide; BTLA exon 4; Set C
gaaaaagaaguaaucaaaaggagua

SEQ ID NO: 53123 - RNA, 27 nt, Artificial Sequence
  Synthetic Oligonucleotide; BTLA exon 4; Set C
agaaaaagaaguaaucaaaaggaguaa

SEQ ID NO: 53124 - RNA, 23 nt, Artificial Sequence
  Synthetic Oligonucleotide; BTLA exon 4; Set C
aaaaagaaguaaucaaaaggagu

SEQ ID NO: 53125 - RNA, 26 nt, Artificial Sequence
  Synthetic Oligonucleotide; BTLA exon 4; Set C
agaaaaagaaguaaucaaaaggagua

SEQ ID NO: 53126 - RNA, 28 nt, Artificial Sequence
  Synthetic Oligonucleotide; BTLA exon 4; Set C
aagaaaaagaaguaaucaaaaggaguaa

SEQ ID NO: 53127 - RNA, 24 nt, Artificial Sequence
  Synthetic Oligonucleotide; BTLA exon 4; Set C
gaaaaagaaguaaucaaaaggagu

SEQ ID NO: 53128 - RNA, 22 nt, Artificial Sequence
  Synthetic Oligonucleotide; BTLA exon 4; Set C
aaaaagaaguaaucaaaaggag

SEQ ID NO: 53129 - RNA, 30 nt, Artificial Sequence
  Synthetic Oligonucleotide; BTLA exon 4; Set C
aaagaaaaagaaguaaucaaaaggaguaaa

SEQ ID NO: 53130 - RNA, 27 nt, Artificial Sequence
  Synthetic Oligonucleotide; BTLA exon 4; Set C
aagaaaaagaaguaaucaaaaggagua

SEQ ID NO: 53131 - RNA, 25 nt, Artificial Sequence
  Synthetic Oligonucleotide; BTLA exon 4; Set C
agaaaaagaaguaaucaaaaggagu

SEQ ID NO: 53132 - RNA, 23 nt, Artificial Sequence
  Synthetic Oligonucleotide; BTLA exon 4; Set C
gaaaaagaaguaaucaaaaggag

SEQ ID NO: 53133 - RNA, 31 nt, Artificial Sequence
  Synthetic Oligonucleotide; BTLA exon 4; Set C
aaaagaaaaagaaguaaucaaaaggaguaaa

SEQ ID NO: 53134 - RNA, 26 nt, Artificial Sequence
  Synthetic Oligonucleotide; BTLA exon 4; Set C
aagaaaaagaaguaaucaaaaggagu

SEQ ID NO: 53135 - RNA, 24 nt, Artificial Sequence
  Synthetic Oligonucleotide; BTLA exon 4; Set C
agaaaaagaaguaaucaaaaggag

SEQ ID NO: 53136 - RNA, 32 nt, Artificial Sequence
  Synthetic Oligonucleotide; BTLA exon 4; Set C
aaaaagaaaaagaaguaaucaaaaggaguaaa

SEQ ID NO: 53137 - RNA, 25 nt, Artificial Sequence
  Synthetic Oligonucleotide; BTLA exon 4; Set C
aagaaaaagaaguaaucaaaaggag

SEQ ID NO: 53138 - RNA, 33 nt, Artificial Sequence
  Synthetic Oligonucleotide; BTLA exon 4; Set C
caaaaagaaaaagaaguaaucaaaaggaguaaa

SEQ ID NO: 53139 - RNA, 15 nt, Artificial Sequence
  Synthetic Oligonucleotide; BTLA exon 4; Set C
aaaagaaguaaucaa

SEQ ID NO: 53140 - RNA, 20 nt, Artificial Sequence
  Synthetic Oligonucleotide; BTLA exon 4; Set C
aaagaaaaagaaguaaucaa

SEQ ID NO: 53141 - RNA, 31 nt, Artificial Sequence
  Synthetic Oligonucleotide; BTLA exon 4; Set C
agacaaaaagaaaaagaaguaaucaaaagga

SEQ ID NO: 53142 - RNA, 21 nt, Artificial Sequence
  Synthetic Oligonucleotide; BTLA exon 4; Set C
aaaagaaaaagaaguaaucaa

SEQ ID NO: 53143 - RNA, 30 nt, Artificial Sequence
  Synthetic Oligonucleotide; BTLA exon 4; Set C
agacaaaaagaaaaagaaguaaucaaaagg

SEQ ID NO: 53144 - RNA, 32 nt, Artificial Sequence
  Synthetic Oligonucleotide; BTLA exon 4; Set C
aagacaaaaagaaaaagaaguaaucaaaagga

SEQ ID NO: 53145 - RNA, 22 nt, Artificial Sequence
  Synthetic Oligonucleotide; BTLA exon 4; Set C
aaaaagaaaaagaaguaaucaa

SEQ ID NO: 53146 - RNA, 29 nt, Artificial Sequence
  Synthetic Oligonucleotide; BTLA exon 4; Set C
agacaaaaagaaaaagaaguaaucaaaag

SEQ ID NO: 53147 - RNA, 31 nt, Artificial Sequence
  Synthetic Oligonucleotide; BTLA exon 4; Set C
aagacaaaaagaaaaagaaguaaucaaaagg

SEQ ID NO: 53148 - RNA, 23 nt, Artificial Sequence
  Synthetic Oligonucleotide; BTLA exon 4; Set C
caaaaagaaaaagaaguaaucaa

SEQ ID NO: 53149 - RNA, 30 nt, Artificial Sequence
  Synthetic Oligonucleotide; BTLA exon 4; Set C
aagacaaaaagaaaaagaaguaaucaaaag

SEQ ID NO: 53150 - RNA, 24 nt, Artificial Sequence
  Synthetic Oligonucleotide; BTLA exon 4; Set C
acaaaaagaaaaagaaguaaucaa

SEQ ID NO: 53151 - RNA, 35 nt, Artificial Sequence
  Synthetic Oligonucleotide; BTLA exon 4; Set C
uggaagacaaaaagaaaaagaaguaaucaaaagga

SEQ ID NO: 53152 - RNA, 25 nt, Artificial Sequence
  Synthetic Oligonucleotide; BTLA exon 4; Set C
gacaaaaagaaaaagaaguaaucaa

SEQ ID NO: 53153 - RNA, 34 nt, Artificial Sequence
  Synthetic Oligonucleotide; BTLA exon 4; Set C
uggaagacaaaaagaaaaagaaguaaucaaaagg

SEQ ID NO: 53154 - RNA, 36 nt, Artificial Sequence
  Synthetic Oligonucleotide; BTLA exon 4; Set C
cuggaagacaaaaagaaaaagaaguaaucaaaagga

SEQ ID NO: 53155 - RNA, 33 nt, Artificial Sequence
  Synthetic Oligonucleotide; BTLA exon 4; Set C
uggaagacaaaaagaaaaagaaguaaucaaaag

SEQ ID NO: 53156 - RNA, 35 nt, Artificial Sequence
  Synthetic Oligonucleotide; BTLA exon 4; Set C
cuggaagacaaaaagaaaaagaaguaaucaaaagg

SEQ ID NO: 53157 - RNA, 32 nt, Artificial Sequence
  Synthetic Oligonucleotide; BTLA exon 4; Set C
uggaagacaaaaagaaaaagaaguaaucaaaa

SEQ ID NO: 53158 - RNA, 34 nt, Artificial Sequence
  Synthetic Oligonucleotide; BTLA exon 4; Set C
cuggaagacaaaaagaaaaagaaguaaucaaaag

SEQ ID NO: 53159 - RNA, 28 nt, Artificial Sequence
  Synthetic Oligonucleotide; BTLA exon 4; Set C
gaagacaaaaagaaaaagaaguaaucaa

SEQ ID NO: 53160 - RNA, 33 nt, Artificial Sequence
  Synthetic Oligonucleotide; BTLA exon 4; Set C
cuggaagacaaaaagaaaaagaaguaaucaaaa

SEQ ID NO: 53161 - RNA, 29 nt, Artificial Sequence
  Synthetic Oligonucleotide; BTLA exon 4; Set C
ggaagacaaaaagaaaaagaaguaaucaa

SEQ ID NO: 53162 - RNA, 32 nt, Artificial Sequence
  Synthetic Oligonucleotide; BTLA exon 4; Set C
cuggaagacaaaaagaaaaagaaguaaucaaa

SEQ ID NO: 53163 - RNA, 27 nt, Artificial Sequence
  Synthetic Oligonucleotide; BTLA exon 4; Set C
cuggaagacaaaaagaaaaagaaguaa

SEQ ID NO: 53164 - RNA, 26 nt, Artificial Sequence
  Synthetic Oligonucleotide; BTLA exon 4; Set C
cuggaagacaaaaagaaaaagaagua

SEQ ID NO: 53165 - RNA, 15 nt, Artificial Sequence
  Synthetic Oligonucleotide; BTLA exon 4; Set C
gaagacaaaaagaaa

SEQ ID NO: 53166 - RNA, 16 nt, Artificial Sequence
  Synthetic Oligonucleotide; BTLA exon 4; Set C
ggaagacaaaaagaaa

SEQ ID NO: 53167 - RNA, 17 nt, Artificial Sequence
  Synthetic Oligonucleotide; BTLA exon 4; Set C
uggaagacaaaaagaaa

SEQ ID NO: 53168 - RNA, 15 nt, Artificial Sequence
  Synthetic Oligonucleotide; BTLA exon 4; Set C
ggaagacaaaaagaa

SEQ ID NO: 53169 - RNA, 40 nt, Artificial Sequence
  Synthetic Oligonucleotide; BTLA exon 4; Set C
ucauuuugcuuuccuggaagacaaaaagaaaaagaaguaa

SEQ ID NO: 53170 - RNA, 39 nt, Artificial Sequence
  Synthetic Oligonucleotide; BTLA exon 4; Set A
ucauuuugcuuuccuggaagacaaaaagaaaaagaagua

SEQ ID NO: 53171 - RNA, 38 nt, Artificial Sequence
  Synthetic Oligonucleotide; BTLA exon 4; Set C
ucauuuugcuuuccuggaagacaaaaagaaaaagaagu

SEQ ID NO: 53172 - RNA, 37 nt, Artificial Sequence
  Synthetic Oligonucleotide; BTLA exon 4; Set C
ucauuuugcuuuccuggaagacaaaaagaaaaagaag

SEQ ID NO: 53173 - RNA, 36 nt, Artificial Sequence
  Synthetic Oligonucleotide; BTLA exon 4; Set C
ucauuuugcuuuccuggaagacaaaaagaaaaagaa

SEQ ID NO: 53174 - RNA, 35 nt, Artificial Sequence
  Synthetic Oligonucleotide; BTLA exon 4; Set C
ucauuuugcuuuccuggaagacaaaaagaaaaaga

SEQ ID NO: 53175 - RNA, 34 nt, Artificial Sequence
  Synthetic Oligonucleotide; BTLA exon 4; Set C
ucauuuugcuuuccuggaagacaaaaagaaaaag

SEQ ID NO: 53176 - RNA, 33 nt, Artificial Sequence
  Synthetic Oligonucleotide; BTLA exon 4; Set C
ucauuuugcuuuccuggaagacaaaaagaaaaa

SEQ ID NO: 53177 - RNA, 32 nt, Artificial Sequence
  Synthetic Oligonucleotide; BTLA exon 4; Set C
ucauuuugcuuuccuggaagacaaaaagaaaa

SEQ ID NO: 53178 - RNA, 40 nt, Artificial Sequence
  Synthetic Oligonucleotide; BTLA exon 4; Set A
gaguucauuuugcuuuccuggaagacaaaaagaaaaagaa

SEQ ID NO: 53179 - RNA, 39 nt, Artificial Sequence
  Synthetic Oligonucleotide; BTLA exon 4; Set A
gaguucauuuugcuuuccuggaagacaaaaagaaaaaga

SEQ ID NO: 53180 - RNA, 38 nt, Artificial Sequence
  Synthetic Oligonucleotide; BTLA exon 4; Set A
gaguucauuuugcuuuccuggaagacaaaaagaaaaag

SEQ ID NO: 53181 - RNA, 40 nt, Artificial Sequence
  Synthetic Oligonucleotide; BTLA exon 4; Set A
agaguucauuuugcuuuccuggaagacaaaaagaaaaaga

SEQ ID NO: 53182 - RNA, 37 nt, Artificial Sequence
  Synthetic Oligonucleotide; BTLA exon 4; Set A
gaguucauuuugcuuuccuggaagacaaaaagaaaaa

SEQ ID NO: 53183 - RNA, 39 nt, Artificial Sequence
  Synthetic Oligonucleotide; BTLA exon 4; Set A
agaguucauuuugcuuuccuggaagacaaaaagaaaaag

SEQ ID NO: 53184 - RNA, 38 nt, Artificial Sequence
  Synthetic Oligonucleotide; BTLA exon 4; Set A
agaguucauuuugcuuuccuggaagacaaaaagaaaaa

SEQ ID NO: 53185 - RNA, 36 nt, Artificial Sequence
  Synthetic Oligonucleotide; BTLA exon 4; Set A
gaguucauuuugcuuuccuggaagacaaaaagaaaa

SEQ ID NO: 53186 - RNA, 27 nt, Artificial Sequence
  Synthetic Oligonucleotide; BTLA exon 4; Set C
ucauuuugcuuuccuggaagacaaaaa

SEQ ID NO: 53187 - RNA, 37 nt, Artificial Sequence
  Synthetic Oligonucleotide; BTLA exon 4; Set A
agaguucauuuugcuuuccuggaagacaaaaagaaaa

SEQ ID NO: 53188 - RNA, 26 nt, Artificial Sequence
  Synthetic Oligonucleotide; BTLA exon 4; Set C
ucauuuugcuuuccuggaagacaaaa

SEQ ID NO: 53189 - RNA, 25 nt, Artificial Sequence
  Synthetic Oligonucleotide; BTLA exon 4; Set C
ucauuuugcuuuccuggaagacaaa

SEQ ID NO: 53190 - RNA, 24 nt, Artificial Sequence
  Synthetic Oligonucleotide; BTLA exon 4; Set C
ucauuuugcuuuccuggaagacaa

SEQ ID NO: 53191 - RNA, 31 nt, Artificial Sequence
  Synthetic Oligonucleotide; BTLA exon 4; Set A
gaguucauuuugcuuuccuggaagacaaaaa

SEQ ID NO: 53192 - RNA, 32 nt, Artificial Sequence
  Synthetic Oligonucleotide; BTLA exon 4; Set A
agaguucauuuugcuuuccuggaagacaaaaa

SEQ ID NO: 53193 - RNA, 30 nt, Artificial Sequence
  Synthetic Oligonucleotide; BTLA exon 4; Set A
gaguucauuuugcuuuccuggaagacaaaa

SEQ ID NO: 53194 - RNA, 31 nt, Artificial Sequence
  Synthetic Oligonucleotide; BTLA exon 4; Set A
agaguucauuuugcuuuccuggaagacaaaa

SEQ ID NO: 53195 - RNA, 29 nt, Artificial Sequence
  Synthetic Oligonucleotide; BTLA exon 4; Set A
gaguucauuuugcuuuccuggaagacaaa

SEQ ID NO: 53196 - RNA, 30 nt, Artificial Sequence
  Synthetic Oligonucleotide; BTLA exon 4; Set A
agaguucauuuugcuuuccuggaagacaaa

SEQ ID NO: 53197 - RNA, 28 nt, Artificial Sequence
  Synthetic Oligonucleotide; BTLA exon 4; Set A
gaguucauuuugcuuuccuggaagacaa

SEQ ID NO: 53198 - RNA, 29 nt, Artificial Sequence
  Synthetic Oligonucleotide; BTLA exon 4; Set A
agaguucauuuugcuuuccuggaagacaa

SEQ ID NO: 53199 - RNA, 27 nt, Artificial Sequence
  Synthetic Oligonucleotide; BTLA exon 4; Set A
gaguucauuuugcuuuccuggaagaca

SEQ ID NO: 53200 - RNA, 26 nt, Artificial Sequence
  Synthetic Oligonucleotide; BTLA exon 4; Set A
gaguucauuuugcuuuccuggaagac

SEQ ID NO: 53201 - RNA, 39 nt, Artificial Sequence
  Synthetic Oligonucleotide; BTLA exon 4; Set A
gugucagagaguucauuuugcuuuccuggaagacaaaaa

SEQ ID NO: 53202 - RNA, 35 nt, Artificial Sequence
  Synthetic Oligonucleotide; BTLA exon 4; Set A
gucagagaguucauuuugcuuuccuggaagacaaa

SEQ ID NO: 53203 - RNA, 40 nt, Artificial Sequence
  Synthetic Oligonucleotide; BTLA exon 4; Set A
ugugucagagaguucauuuugcuuuccuggaagacaaaaa

SEQ ID NO: 53204 - RNA, 38 nt, Artificial Sequence
  Synthetic Oligonucleotide; BTLA exon 4; Set A
gugucagagaguucauuuugcuuuccuggaagacaaaa

SEQ ID NO: 53205 - RNA, 34 nt, Artificial Sequence
  Synthetic Oligonucleotide; BTLA exon 4; Set A
gucagagaguucauuuugcuuuccuggaagacaa

SEQ ID NO: 53206 - RNA, 39 nt, Artificial Sequence
  Synthetic Oligonucleotide; BTLA exon 4; Set C
ugugucagagaguucauuuugcuuuccuggaagacaaaa

SEQ ID NO: 53207 - RNA, 37 nt, Artificial Sequence
  Synthetic Oligonucleotide; BTLA exon 4; Set C
gugucagagaguucauuuugcuuuccuggaagacaaa

SEQ ID NO: 53208 - RNA, 35 nt, Artificial Sequence
  Synthetic Oligonucleotide; BTLA exon 4; Set C
ugucagagaguucauuuugcuuuccuggaagacaa

SEQ ID NO: 53209 - RNA, 33 nt, Artificial Sequence
  Synthetic Oligonucleotide; BTLA exon 4; Set C
gucagagaguucauuuugcuuuccuggaagaca

SEQ ID NO: 53210 - RNA, 40 nt, Artificial Sequence
  Synthetic Oligonucleotide; BTLA exon 4; Set C
cugugucagagaguucauuuugcuuuccuggaagacaaaa

SEQ ID NO: 53211 - RNA, 38 nt, Artificial Sequence
  Synthetic Oligonucleotide; BTLA exon 4; Set C
ugugucagagaguucauuuugcuuuccuggaagacaaa

SEQ ID NO: 53212 - RNA, 36 nt, Artificial Sequence
  Synthetic Oligonucleotide; BTLA exon 4; Set C
gugucagagaguucauuuugcuuuccuggaagacaa

SEQ ID NO: 53213 - RNA, 32 nt, Artificial Sequence
  Synthetic Oligonucleotide; BTLA exon 4; Set A
gucagagaguucauuuugcuuuccuggaagac

SEQ ID NO: 53214 - RNA, 34 nt, Artificial Sequence
  Synthetic Oligonucleotide; BTLA exon 4; Set C
ugucagagaguucauuuugcuuuccuggaagaca

SEQ ID NO: 53215 - RNA, 39 nt, Artificial Sequence
  Synthetic Oligonucleotide; BTLA exon 4; Set C
cugugucagagaguucauuuugcuuuccuggaagacaaa

SEQ ID NO: 53216 - RNA, 37 nt, Artificial Sequence
  Synthetic Oligonucleotide; BTLA exon 4; Set C
ugugucagagaguucauuuugcuuuccuggaagacaa

SEQ ID NO: 53217 - RNA, 33 nt, Artificial Sequence
  Synthetic Oligonucleotide; BTLA exon 4; Set A
ugucagagaguucauuuugcuuuccuggaagac

SEQ ID NO: 53218 - RNA, 35 nt, Artificial Sequence
  Synthetic Oligonucleotide; BTLA exon 4; Set C
gugucagagaguucauuuugcuuuccuggaagaca

SEQ ID NO: 53219 - RNA, 31 nt, Artificial Sequence
  Synthetic Oligonucleotide; BTLA exon 4; Set A
gucagagaguucauuuugcuuuccuggaaga

SEQ ID NO: 53220 - RNA, 38 nt, Artificial Sequence
  Synthetic Oligonucleotide; BTLA exon 4; Set C
cugugucagagaguucauuuugcuuuccuggaagacaa

SEQ ID NO: 53221 - RNA, 34 nt, Artificial Sequence
  Synthetic Oligonucleotide; BTLA exon 4; Set C
gugucagagaguucauuuugcuuuccuggaagac

SEQ ID NO: 53222 - RNA, 32 nt, Artificial Sequence
  Synthetic Oligonucleotide; BTLA exon 4; Set A
ugucagagaguucauuuugcuuuccuggaaga

SEQ ID NO: 53223 - RNA, 30 nt, Artificial Sequence
  Synthetic Oligonucleotide; BTLA exon 4; Set A
gucagagaguucauuuugcuuuccuggaag

SEQ ID NO: 53224 - RNA, 29 nt, Artificial Sequence
  Synthetic Oligonucleotide; BTLA exon 4; Set A
gucagagaguucauuuugcuuuccuggaa

SEQ ID NO: 53225 - RNA, 33 nt, Artificial Sequence
  Synthetic Oligonucleotide; BTLA exon 4; Set A
gugucagagaguucauuuugcuuuccuggaaga

SEQ ID NO: 53226 - RNA, 31 nt, Artificial Sequence
  Synthetic Oligonucleotide; BTLA exon 4; Set A
ugucagagaguucauuuugcuuuccuggaag

SEQ ID NO: 53227 - RNA, 30 nt, Artificial Sequence
  Synthetic Oligonucleotide; BTLA exon 4; Set A
ugucagagaguucauuuugcuuuccuggaa

SEQ ID NO: 53228 - RNA, 28 nt, Artificial Sequence
  Synthetic Oligonucleotide; BTLA exon 4; Set A
gucagagaguucauuuugcuuuccugga

SEQ ID NO: 53229 - RNA, 29 nt, Artificial Sequence
  Synthetic Oligonucleotide; BTLA exon 4; Set A
ugucagagaguucauuuugcuuuccugga

SEQ ID NO: 53230 - RNA, 28 nt, Artificial Sequence
  Synthetic Oligonucleotide; BTLA exon 4; Set A
ugucagagaguucauuuugcuuuccugg

SEQ ID NO: 53231 - RNA, 15 nt, Artificial Sequence
  Synthetic Oligonucleotide; BTLA exon 4; Set C
gugucagagaguuca

SEQ ID NO: 53232 - RNA, 16 nt, Artificial Sequence
  Synthetic Oligonucleotide; BTLA exon 4; Set C
ugugucagagaguuca

SEQ ID NO: 53233 - RNA, 17 nt, Artificial Sequence
  Synthetic Oligonucleotide; BTLA exon 4; Set C
cugugucagagaguuca

SEQ ID NO: 53234 - RNA, 29 nt, Artificial Sequence
  Synthetic Oligonucleotide; BTLA exon 4; Set C
uuucccuuccugcugugucagagaguuca

SEQ ID NO: 53235 - RNA, 30 nt, Artificial Sequence
  Synthetic Oligonucleotide; BTLA exon 4; Set C
auuucccuuccugcugugucagagaguuca

SEQ ID NO: 53236 - RNA, 31 nt, Artificial Sequence
  Synthetic Oligonucleotide; BTLA exon 4; Set C
aauuucccuuccugcugugucagagaguuca

SEQ ID NO: 53237 - RNA, 32 nt, Artificial Sequence
  Synthetic Oligonucleotide; BTLA exon 4; Set C
uaauuucccuuccugcugugucagagaguuca

SEQ ID NO: 53238 - RNA, 25 nt, Artificial Sequence
  Synthetic Oligonucleotide; BTLA exon 4; Set A
uuucccuuccugcugugucagagag

SEQ ID NO: 53239 - RNA, 33 nt, Artificial Sequence
  Synthetic Oligonucleotide; BTLA exon 4; Set C
uuaauuucccuuccugcugugucagagaguuca

SEQ ID NO: 53240 - RNA, 26 nt, Artificial Sequence
  Synthetic Oligonucleotide; BTLA exon 4; Set A
auuucccuuccugcugugucagagag

SEQ ID NO: 53241 - RNA, 34 nt, Artificial Sequence
  Synthetic Oligonucleotide; BTLA exon 4; Set C
guuaauuucccuuccugcugugucagagaguuca

SEQ ID NO: 53242 - RNA, 24 nt, Artificial Sequence
  Synthetic Oligonucleotide; BTLA exon 4; Set A
uuucccuuccugcugugucagaga

SEQ ID NO: 53243 - RNA, 27 nt, Artificial Sequence
  Synthetic Oligonucleotide; BTLA exon 4; Set A
aauuucccuuccugcugugucagagag

SEQ ID NO: 53244 - RNA, 25 nt, Artificial Sequence
  Synthetic Oligonucleotide; BTLA exon 4; Set A
auuucccuuccugcugugucagaga

SEQ ID NO: 53245 - RNA, 28 nt, Artificial Sequence
  Synthetic Oligonucleotide; BTLA exon 4; Set A
uaauuucccuuccugcugugucagagag

SEQ ID NO: 53246 - RNA, 26 nt, Artificial Sequence
  Synthetic Oligonucleotide; BTLA exon 4; Set A
aauuucccuuccugcugugucagaga

SEQ ID NO: 53247 - RNA, 29 nt, Artificial Sequence
  Synthetic Oligonucleotide; BTLA exon 4; Set A
uuaauuucccuuccugcugugucagagag

SEQ ID NO: 53248 - RNA, 27 nt, Artificial Sequence
  Synthetic Oligonucleotide; BTLA exon 4; Set A
uaauuucccuuccugcugugucagaga

SEQ ID NO: 53249 - RNA, 30 nt, Artificial Sequence
  Synthetic Oligonucleotide; BTLA exon 4; Set A
guuaauuucccuuccugcugugucagagag

SEQ ID NO: 53250 - RNA, 28 nt, Artificial Sequence
  Synthetic Oligonucleotide; BTLA exon 4; Set A
uuaauuucccuuccugcugugucagaga

SEQ ID NO: 53251 - RNA, 19 nt, Artificial Sequence
  Synthetic Oligonucleotide; BTLA exon 4; Set A
uuucccuuccugcuguguc

SEQ ID NO: 53252 - RNA, 29 nt, Artificial Sequence
  Synthetic Oligonucleotide; BTLA exon 4; Set A
guuaauuucccuuccugcugugucagaga

SEQ ID NO: 53253 - RNA, 18 nt, Artificial Sequence
  Synthetic Oligonucleotide; BTLA exon 4; Set C
uuucccuuccugcugugu

SEQ ID NO: 53254 - RNA, 20 nt, Artificial Sequence
  Synthetic Oligonucleotide; BTLA exon 4; Set A
auuucccuuccugcuguguc

SEQ ID NO: 53255 - RNA, 19 nt, Artificial Sequence
  Synthetic Oligonucleotide; BTLA exon 4; Set C
auuucccuuccugcugugu

SEQ ID NO: 53256 - RNA, 21 nt, Artificial Sequence
  Synthetic Oligonucleotide; BTLA exon 4; Set C
aauuucccuuccugcuguguc

SEQ ID NO: 53257 - RNA, 20 nt, Artificial Sequence
  Synthetic Oligonucleotide; BTLA exon 4; Set C
aauuucccuuccugcugugu

SEQ ID NO: 53258 - RNA, 22 nt, Artificial Sequence
  Synthetic Oligonucleotide; BTLA exon 4; Set C
uaauuucccuuccugcuguguc

SEQ ID NO: 53259 - RNA, 18 nt, Artificial Sequence
  Synthetic Oligonucleotide; BTLA exon 4; Set C
auuucccuuccugcugug

SEQ ID NO: 53260 - RNA, 21 nt, Artificial Sequence
  Synthetic Oligonucleotide; BTLA exon 4; Set C
uaauuucccuuccugcugugu

SEQ ID NO: 53261 - RNA, 23 nt, Artificial Sequence
  Synthetic Oligonucleotide; BTLA exon 4; Set A
uuaauuucccuuccugcuguguc

SEQ ID NO: 53262 - RNA, 19 nt, Artificial Sequence
  Synthetic Oligonucleotide; BTLA exon 4; Set C
aauuucccuuccugcugug

SEQ ID NO: 53263 - RNA, 22 nt, Artificial Sequence
  Synthetic Oligonucleotide; BTLA exon 4; Set C
uuaauuucccuuccugcugugu

SEQ ID NO: 53264 - RNA, 24 nt, Artificial Sequence
  Synthetic Oligonucleotide; BTLA exon 4; Set A
guuaauuucccuuccugcuguguc

SEQ ID NO: 53265 - RNA, 20 nt, Artificial Sequence
  Synthetic Oligonucleotide; BTLA exon 4; Set C
uaauuucccuuccugcugug

SEQ ID NO: 53266 - RNA, 23 nt, Artificial Sequence
  Synthetic Oligonucleotide; BTLA exon 4; Set A
guuaauuucccuuccugcugugu

SEQ ID NO: 53267 - RNA, 21 nt, Artificial Sequence
  Synthetic Oligonucleotide; BTLA exon 4; Set C
uuaauuucccuuccugcugug

SEQ ID NO: 53268 - RNA, 36 nt, Artificial Sequence
  Synthetic Oligonucleotide; BTLA exon 4; Set C
caagcuuaccagguuaauuucccuuccugcuguguc

SEQ ID NO: 53269 - RNA, 35 nt, Artificial Sequence
  Synthetic Oligonucleotide; BTLA exon 4; Set C
caagcuuaccagguuaauuucccuuccugcugugu

SEQ ID NO: 53270 - RNA, 37 nt, Artificial Sequence
  Synthetic Oligonucleotide; BTLA exon 4; Set C
ucaagcuuaccagguuaauuucccuuccugcuguguc

SEQ ID NO: 53271 - RNA, 36 nt, Artificial Sequence
  Synthetic Oligonucleotide; BTLA exon 4; Set C
ucaagcuuaccagguuaauuucccuuccugcugugu

SEQ ID NO: 53272 - RNA, 18 nt, Artificial Sequence
  Synthetic Oligonucleotide; BTLA exon 4; Set C
agcuuaccagguuaauuu

SEQ ID NO: 53273 - RNA, 17 nt, Artificial Sequence
  Synthetic Oligonucleotide; BTLA exon 4; Set C
agcuuaccagguuaauu

SEQ ID NO: 53274 - RNA, 19 nt, Artificial Sequence
  Synthetic Oligonucleotide; BTLA exon 4; Set C
aagcuuaccagguuaauuu

SEQ ID NO: 53275 - RNA, 18 nt, Artificial Sequence
  Synthetic Oligonucleotide; BTLA exon 4; Set C
aagcuuaccagguuaauu

SEQ ID NO: 53276 - RNA, 20 nt, Artificial Sequence
  Synthetic Oligonucleotide; BTLA exon 4; Set C
caagcuuaccagguuaauuu

SEQ ID NO: 53277 - RNA, 17 nt, Artificial Sequence
  Synthetic Oligonucleotide; BTLA exon 4; Set C
aagcuuaccagguuaau

SEQ ID NO: 53278 - RNA, 19 nt, Artificial Sequence
  Synthetic Oligonucleotide; BTLA exon 4; Set C
caagcuuaccagguuaauu

SEQ ID NO: 53279 - RNA, 21 nt, Artificial Sequence
  Synthetic Oligonucleotide; BTLA exon 4; Set C
ucaagcuuaccagguuaauuu

SEQ ID NO: 53280 - RNA, 18 nt, Artificial Sequence
  Synthetic Oligonucleotide; BTLA exon 4; Set C
caagcuuaccagguuaau

SEQ ID NO: 53281 - RNA, 16 nt, Artificial Sequence
  Synthetic Oligonucleotide; BTLA exon 4; Set C
aagcuuaccagguuaa

SEQ ID NO: 53282 - RNA, 20 nt, Artificial Sequence
  Synthetic Oligonucleotide; BTLA exon 4; Set C
ucaagcuuaccagguuaauu

SEQ ID NO: 53283 - RNA, 19 nt, Artificial Sequence
  Synthetic Oligonucleotide; BTLA exon 4; Set C
ucaagcuuaccagguuaau

SEQ ID NO: 53284 - RNA, 17 nt, Artificial Sequence
  Synthetic Oligonucleotide; BTLA exon 4; Set C
caagcuuaccagguuaa

SEQ ID NO: 53285 - RNA, 18 nt, Artificial Sequence
  Synthetic Oligonucleotide; BTLA exon 4; Set C
ucaagcuuaccagguuaa

SEQ ID NO: 53286 - RNA, 16 nt, Artificial Sequence
  Synthetic Oligonucleotide; BTLA exon 4; Set C
caagcuuaccagguua

SEQ ID NO: 53287 - RNA, 17 nt, Artificial Sequence
  Synthetic Oligonucleotide; BTLA exon 4; Set C
ucaagcuuaccagguua

SEQ ID NO: 53288 - RNA, 33 nt, Artificial Sequence
  Synthetic Oligonucleotide; BTLA exon 4; Set A
ucaacagcuacaucaagcuuaccagguuaauuu

SEQ ID NO: 53289 - RNA, 32 nt, Artificial Sequence
  Synthetic Oligonucleotide; BTLA exon 4; Set A
ucaacagcuacaucaagcuuaccagguuaauu

SEQ ID NO: 53290 - RNA, 34 nt, Artificial Sequence
  Synthetic Oligonucleotide; BTLA exon 4; Set A
uucaacagcuacaucaagcuuaccagguuaauuu

SEQ ID NO: 53291 - RNA, 31 nt, Artificial Sequence
  Synthetic Oligonucleotide; BTLA exon 4; Set A
ucaacagcuacaucaagcuuaccagguuaau

SEQ ID NO: 53292 - RNA, 33 nt, Artificial Sequence
  Synthetic Oligonucleotide; BTLA exon 4; Set A
uucaacagcuacaucaagcuuaccagguuaauu

SEQ ID NO: 53293 - RNA, 32 nt, Artificial Sequence
  Synthetic Oligonucleotide; BTLA exon 4; Set A
uucaacagcuacaucaagcuuaccagguuaau

SEQ ID NO: 53294 - RNA, 30 nt, Artificial Sequence
  Synthetic Oligonucleotide; BTLA exon 4; Set A
ucaacagcuacaucaagcuuaccagguuaa

SEQ ID NO: 53295 - RNA, 31 nt, Artificial Sequence
  Synthetic Oligonucleotide; BTLA exon 4; Set A
uucaacagcuacaucaagcuuaccagguuaa

SEQ ID NO: 53296 - RNA, 29 nt, Artificial Sequence
  Synthetic Oligonucleotide; BTLA exon 4; Set A
ucaacagcuacaucaagcuuaccagguua

SEQ ID NO: 53297 - RNA, 30 nt, Artificial Sequence
  Synthetic Oligonucleotide; BTLA exon 4; Set A
uucaacagcuacaucaagcuuaccagguua

SEQ ID NO: 53298 - RNA, 19 nt, Artificial Sequence
  Synthetic Oligonucleotide; BTLA exon 4; Set C
ucaacagcuacaucaagcu

SEQ ID NO: 53299 - RNA, 20 nt, Artificial Sequence
  Synthetic Oligonucleotide; BTLA exon 4; Set C
uucaacagcuacaucaagcu

SEQ ID NO: 53300 - RNA, 18 nt, Artificial Sequence
  Synthetic Oligonucleotide; BTLA exon 4; Set C
ucaacagcuacaucaagc

SEQ ID NO: 53301 - RNA, 17 nt, Artificial Sequence
  Synthetic Oligonucleotide; BTLA exon 4; Set C
ucaacagcuacaucaag

SEQ ID NO: 53302 - RNA, 19 nt, Artificial Sequence
  Synthetic Oligonucleotide; BTLA exon 4; Set C
uucaacagcuacaucaagc

SEQ ID NO: 53303 - RNA, 16 nt, Artificial Sequence
  Synthetic Oligonucleotide; BTLA exon 4; Set C
ucaacagcuacaucaa

SEQ ID NO: 53304 - RNA, 18 nt, Artificial Sequence
  Synthetic Oligonucleotide; BTLA exon 4; Set C
uucaacagcuacaucaag

SEQ ID NO: 53305 - RNA, 15 nt, Artificial Sequence
  Synthetic Oligonucleotide; BTLA exon 4; Set C
ucaacagcuacauca

SEQ ID NO: 53306 - RNA, 17 nt, Artificial Sequence
  Synthetic Oligonucleotide; BTLA exon 4; Set C
uucaacagcuacaucaa

SEQ ID NO: 53307 - RNA, 16 nt, Artificial Sequence
  Synthetic Oligonucleotide; BTLA exon 4; Set C
uucaacagcuacauca

SEQ ID NO: 53308 - RNA, 32 nt, Artificial Sequence
  Synthetic Oligonucleotide; BTLA exon 4; Set B
aauugcauuuguuucaacagcuacaucaagcu

SEQ ID NO: 53309 - RNA, 33 nt, Artificial Sequence
  Synthetic Oligonucleotide; BTLA exon 4; Set B
aaauugcauuuguuucaacagcuacaucaagcu

SEQ ID NO: 53310 - RNA, 31 nt, Artificial Sequence
  Synthetic Oligonucleotide; BTLA exon 4; Set B
aauugcauuuguuucaacagcuacaucaagc

SEQ ID NO: 53311 - RNA, 30 nt, Artificial Sequence
  Synthetic Oligonucleotide; BTLA exon 4; Set B
aauugcauuuguuucaacagcuacaucaag

SEQ ID NO: 53312 - RNA, 32 nt, Artificial Sequence
  Synthetic Oligonucleotide; BTLA exon 4; Set B
aaauugcauuuguuucaacagcuacaucaagc

SEQ ID NO: 53313 - RNA, 29 nt, Artificial Sequence
  Synthetic Oligonucleotide; BTLA exon 4; Set B
aauugcauuuguuucaacagcuacaucaa

SEQ ID NO: 53314 - RNA, 31 nt, Artificial Sequence
  Synthetic Oligonucleotide; BTLA exon 4; Set C
aaauugcauuuguuucaacagcuacaucaag

SEQ ID NO: 53315 - RNA, 28 nt, Artificial Sequence
  Synthetic Oligonucleotide; BTLA exon 4; Set B
aauugcauuuguuucaacagcuacauca

SEQ ID NO: 53316 - RNA, 30 nt, Artificial Sequence
  Synthetic Oligonucleotide; BTLA exon 4; Set C
aaauugcauuuguuucaacagcuacaucaa

SEQ ID NO: 53317 - RNA, 29 nt, Artificial Sequence
  Synthetic Oligonucleotide; BTLA exon 4; Set B
aaauugcauuuguuucaacagcuacauca

SEQ ID NO: 53318 - RNA, 40 nt, Artificial Sequence
  Synthetic Oligonucleotide; BTLA exon 4; Set B
caguauaacacaaauugcauuuguuucaacagcuacauca

SEQ ID NO: 53319 - RNA, 28 nt, Artificial Sequence
  Synthetic Oligonucleotide; BTLA exon 4; Set C
caguauaacacaaauugcauuuguuuca

SEQ ID NO: 53320 - RNA, 29 nt, Artificial Sequence
  Synthetic Oligonucleotide; BTLA exon 4; Set C
acaguauaacacaaauugcauuuguuuca

SEQ ID NO: 53321 - RNA, 28 nt, Artificial Sequence
  Synthetic Oligonucleotide; BTLA exon 4; Set C
acaguauaacacaaauugcauuuguuuc

SEQ ID NO: 53322 - RNA, 17 nt, Artificial Sequence
  Synthetic Oligonucleotide; BTLA exon 4; Set C
ggaguaaagaaagcaga

SEQ ID NO: 53323 - RNA, 15 nt, Artificial Sequence
  Synthetic Oligonucleotide; BTLA exon 4; Set C
gaguaaagaaagcag

SEQ ID NO: 53324 - RNA, 18 nt, Artificial Sequence
  Synthetic Oligonucleotide; BTLA exon 4; Set C
aggaguaaagaaagcaga

SEQ ID NO: 53325 - RNA, 19 nt, Artificial Sequence
  Synthetic Oligonucleotide; BTLA exon 4; Set C
aaggaguaaagaaagcaga

SEQ ID NO: 53326 - RNA, 20 nt, Artificial Sequence
  Synthetic Oligonucleotide; BTLA exon 4; Set C
aaaggaguaaagaaagcaga

SEQ ID NO: 53327 - RNA, 18 nt, Artificial Sequence
  Synthetic Oligonucleotide; BTLA exon 4; Set C
aaggaguaaagaaagcag

SEQ ID NO: 53328 - RNA, 19 nt, Artificial Sequence
  Synthetic Oligonucleotide; BTLA exon 4; Set C
aaaggaguaaagaaagcag

SEQ ID NO: 53329 - RNA, 20 nt, Artificial Sequence
  Synthetic Oligonucleotide; BTLA exon 4; Set C
aaaaggaguaaagaaagcag

SEQ ID NO: 53330 - RNA, 26 nt, Artificial Sequence
  Synthetic Oligonucleotide; BTLA exon 4; Set C
uaaucaaaaggaguaaagaaagcaga

SEQ ID NO: 53331 - RNA, 27 nt, Artificial Sequence
  Synthetic Oligonucleotide; BTLA exon 4; Set C
guaaucaaaaggaguaaagaaagcaga

SEQ ID NO: 53332 - RNA, 27 nt, Artificial Sequence
  Synthetic Oligonucleotide; BTLA exon 4; Set C
aguaaucaaaaggaguaaagaaagcag

SEQ ID NO: 53333 - RNA, 28 nt, Artificial Sequence
  Synthetic Oligonucleotide; BTLA exon 4; Set C
aaguaaucaaaaggaguaaagaaagcag

SEQ ID NO: 53334 - RNA, 29 nt, Artificial Sequence
  Synthetic Oligonucleotide; BTLA exon 4; Set C
gaaguaaucaaaaggaguaaagaaagcag

SEQ ID NO: 53335 - RNA, 30 nt, Artificial Sequence
  Synthetic Oligonucleotide; BTLA exon 4; Set C
agaaguaaucaaaaggaguaaagaaagcag

SEQ ID NO: 53336 - RNA, 31 nt, Artificial Sequence
  Synthetic Oligonucleotide; BTLA exon 4; Set C
aagaaguaaucaaaaggaguaaagaaagcag

SEQ ID NO: 53337 - RNA, 32 nt, Artificial Sequence
  Synthetic Oligonucleotide; BTLA exon 4; Set C
aaagaaguaaucaaaaggaguaaagaaagcag

SEQ ID NO: 53338 - RNA, 17 nt, Artificial Sequence
  Synthetic Oligonucleotide; BTLA exon 4; Set C
uaaucaaaaggaguaaa

SEQ ID NO: 53339 - RNA, 33 nt, Artificial Sequence
  Synthetic Oligonucleotide; BTLA exon 4; Set C
aaaagaaguaaucaaaaggaguaaagaaagcag

SEQ ID NO: 53340 - RNA, 18 nt, Artificial Sequence
  Synthetic Oligonucleotide; BTLA exon 4; Set C
guaaucaaaaggaguaaa

SEQ ID NO: 53341 - RNA, 19 nt, Artificial Sequence
  Synthetic Oligonucleotide; BTLA exon 4; Set C
aguaaucaaaaggaguaaa

SEQ ID NO: 53342 - RNA, 39 nt, Artificial Sequence
  Synthetic Oligonucleotide; BTLA exon 4; Set C
aaaagaaaaagaaguaaucaaaaggaguaaagaaagcag

SEQ ID NO: 53343 - RNA, 40 nt, Artificial Sequence
  Synthetic Oligonucleotide; BTLA exon 4; Set C
aaaaagaaaaagaaguaaucaaaaggaguaaagaaagcag

SEQ ID NO: 53344 - RNA, 21 nt, Artificial Sequence
  Synthetic Oligonucleotide; BTLA exon 4; Set C
aaaaagaaguaaucaaaagga

SEQ ID NO: 53345 - RNA, 20 nt, Artificial Sequence
  Synthetic Oligonucleotide; BTLA exon 4; Set C
aaaaagaaguaaucaaaagg

SEQ ID NO: 53346 - RNA, 22 nt, Artificial Sequence
  Synthetic Oligonucleotide; BTLA exon 4; Set C
gaaaaagaaguaaucaaaagga

SEQ ID NO: 53347 - RNA, 19 nt, Artificial Sequence
  Synthetic Oligonucleotide; BTLA exon 4; Set C
aaaaagaaguaaucaaaag

SEQ ID NO: 53348 - RNA, 21 nt, Artificial Sequence
  Synthetic Oligonucleotide; BTLA exon 4; Set C
gaaaaagaaguaaucaaaagg

SEQ ID NO: 53349 - RNA, 23 nt, Artificial Sequence
  Synthetic Oligonucleotide; BTLA exon 4; Set C
agaaaaagaaguaaucaaaagga

SEQ ID NO: 53350 - RNA, 18 nt, Artificial Sequence
  Synthetic Oligonucleotide; BTLA exon 4; Set C
aaaaagaaguaaucaaaa

SEQ ID NO: 53351 - RNA, 20 nt, Artificial Sequence
  Synthetic Oligonucleotide; BTLA exon 4; Set C
gaaaaagaaguaaucaaaag

SEQ ID NO: 53352 - RNA, 22 nt, Artificial Sequence
  Synthetic Oligonucleotide; BTLA exon 4; Set C
agaaaaagaaguaaucaaaagg

SEQ ID NO: 53353 - RNA, 24 nt, Artificial Sequence
  Synthetic Oligonucleotide; BTLA exon 4; Set C
aagaaaaagaaguaaucaaaagga

SEQ ID NO: 53354 - RNA, 34 nt, Artificial Sequence
  Synthetic Oligonucleotide; BTLA exon 4; Set C
acaaaaagaaaaagaaguaaucaaaaggaguaaa

SEQ ID NO: 53355 - RNA, 17 nt, Artificial Sequence
  Synthetic Oligonucleotide; BTLA exon 4; Set C
aaaaagaaguaaucaaa

SEQ ID NO: 53356 - RNA, 19 nt, Artificial Sequence
  Synthetic Oligonucleotide; BTLA exon 4; Set C
gaaaaagaaguaaucaaaa

SEQ ID NO: 53357 - RNA, 21 nt, Artificial Sequence
  Synthetic Oligonucleotide; BTLA exon 4; Set C
agaaaaagaaguaaucaaaag

SEQ ID NO: 53358 - RNA, 23 nt, Artificial Sequence
  Synthetic Oligonucleotide; BTLA exon 4; Set C
aagaaaaagaaguaaucaaaagg

SEQ ID NO: 53359 - RNA, 35 nt, Artificial Sequence
  Synthetic Oligonucleotide; BTLA exon 4; Set C
gacaaaaagaaaaagaaguaaucaaaaggaguaaa

SEQ ID NO: 53360 - RNA, 18 nt, Artificial Sequence
  Synthetic Oligonucleotide; BTLA exon 4; Set C
gaaaaagaaguaaucaaa

SEQ ID NO: 53361 - RNA, 20 nt, Artificial Sequence
  Synthetic Oligonucleotide; BTLA exon 4; Set C
agaaaaagaaguaaucaaaa

SEQ ID NO: 53362 - RNA, 22 nt, Artificial Sequence
  Synthetic Oligonucleotide; BTLA exon 4; Set C
aagaaaaagaaguaaucaaaag

SEQ ID NO: 53363 - RNA, 36 nt, Artificial Sequence
  Synthetic Oligonucleotide; BTLA exon 4; Set C
agacaaaaagaaaaagaaguaaucaaaaggaguaaa

SEQ ID NO: 53364 - RNA, 19 nt, Artificial Sequence
  Synthetic Oligonucleotide; BTLA exon 4; Set C
agaaaaagaaguaaucaaa

SEQ ID NO: 53365 - RNA, 21 nt, Artificial Sequence
  Synthetic Oligonucleotide; BTLA exon 4; Set C
aagaaaaagaaguaaucaaaa

SEQ ID NO: 53366 - RNA, 37 nt, Artificial Sequence
  Synthetic Oligonucleotide; BTLA exon 4; Set C
aagacaaaaagaaaaagaaguaaucaaaaggaguaaa

SEQ ID NO: 53367 - RNA, 20 nt, Artificial Sequence
  Synthetic Oligonucleotide; BTLA exon 4; Set C
aagaaaaagaaguaaucaaa

SEQ ID NO: 53368 - RNA, 38 nt, Artificial Sequence
  Synthetic Oligonucleotide; BTLA exon 4; Set C
gaagacaaaaagaaaaagaaguaaucaaaaggaguaaa

SEQ ID NO: 53369 - RNA, 39 nt, Artificial Sequence
  Synthetic Oligonucleotide; BTLA exon 4; Set C
ggaagacaaaaagaaaaagaaguaaucaaaaggaguaaa

SEQ ID NO: 53370 - RNA, 40 nt, Artificial Sequence
  Synthetic Oligonucleotide; BTLA exon 4; Set C
uggaagacaaaaagaaaaagaaguaaucaaaaggaguaaa

SEQ ID NO: 53371 - RNA, 15 nt, Artificial Sequence
  Synthetic Oligonucleotide; BTLA exon 4; Set C
aagaaaaagaaguaa

SEQ ID NO: 53372 - RNA, 26 nt, Artificial Sequence
  Synthetic Oligonucleotide; BTLA exon 4; Set C
agacaaaaagaaaaagaaguaaucaa

SEQ ID NO: 53373 - RNA, 27 nt, Artificial Sequence
  Synthetic Oligonucleotide; BTLA exon 4; Set C
aagacaaaaagaaaaagaaguaaucaa

SEQ ID NO: 53374 - RNA, 30 nt, Artificial Sequence
  Synthetic Oligonucleotide; BTLA exon 4; Set C
uggaagacaaaaagaaaaagaaguaaucaa

SEQ ID NO: 53375 - RNA, 31 nt, Artificial Sequence
  Synthetic Oligonucleotide; BTLA exon 4; Set C
cuggaagacaaaaagaaaaagaaguaaucaa

SEQ ID NO: 53376 - RNA, 18 nt, Artificial Sequence
  Synthetic Oligonucleotide; BTLA exon 4; Set C
cuggaagacaaaaagaaa

SEQ ID NO: 53377 - RNA, 16 nt, Artificial Sequence
  Synthetic Oligonucleotide; BTLA exon 4; Set C
uggaagacaaaaagaa

SEQ ID NO: 53378 - RNA, 17 nt, Artificial Sequence
  Synthetic Oligonucleotide; BTLA exon 4; Set C
cuggaagacaaaaagaa

SEQ ID NO: 53379 - RNA, 15 nt, Artificial Sequence
  Synthetic Oligonucleotide; BTLA exon 4; Set C
uggaagacaaaaaga

SEQ ID NO: 53380 - RNA, 16 nt, Artificial Sequence
  Synthetic Oligonucleotide; BTLA exon 4; Set C
cuggaagacaaaaaga

SEQ ID NO: 53381 - RNA, 15 nt, Artificial Sequence
  Synthetic Oligonucleotide; BTLA exon 4; Set C
cuggaagacaaaaag

SEQ ID NO: 53382 - RNA, 40 nt, Artificial Sequence
  Synthetic Oligonucleotide; BTLA exon 4; Set A
gagaguucauuuugcuuuccuggaagacaaaaagaaaaag

SEQ ID NO: 53383 - RNA, 39 nt, Artificial Sequence
  Synthetic Oligonucleotide; BTLA exon 4; Set A
gagaguucauuuugcuuuccuggaagacaaaaagaaaaa

SEQ ID NO: 53384 - RNA, 35 nt, Artificial Sequence
  Synthetic Oligonucleotide; BTLA exon 4; Set A
gaguucauuuugcuuuccuggaagacaaaaagaaa

SEQ ID NO: 53385 - RNA, 38 nt, Artificial Sequence
  Synthetic Oligonucleotide; BTLA exon 4; Set A
gagaguucauuuugcuuuccuggaagacaaaaagaaaa

SEQ ID NO: 53386 - RNA, 23 nt, Artificial Sequence
  Synthetic Oligonucleotide; BTLA exon 4; Set C
ucauuuugcuuuccuggaagaca

SEQ ID NO: 53387 - RNA, 22 nt, Artificial Sequence
  Synthetic Oligonucleotide; BTLA exon 4; Set C
ucauuuugcuuuccuggaagac

SEQ ID NO: 53388 - RNA, 33 nt, Artificial Sequence
  Synthetic Oligonucleotide; BTLA exon 4; Set A
gagaguucauuuugcuuuccuggaagacaaaaa

SEQ ID NO: 53389 - RNA, 21 nt, Artificial Sequence
  Synthetic Oligonucleotide; BTLA exon 4; Set C
ucauuuugcuuuccuggaaga

SEQ ID NO: 53390 - RNA, 32 nt, Artificial Sequence
  Synthetic Oligonucleotide; BTLA exon 4; Set A
gagaguucauuuugcuuuccuggaagacaaaa

SEQ ID NO: 53391 - RNA, 20 nt, Artificial Sequence
  Synthetic Oligonucleotide; BTLA exon 4; Set C
ucauuuugcuuuccuggaag

SEQ ID NO: 53392 - RNA, 40 nt, Artificial Sequence
  Synthetic Oligonucleotide; BTLA exon 4; Set A
gucagagaguucauuuugcuuuccuggaagacaaaaagaa

SEQ ID NO: 53393 - RNA, 31 nt, Artificial Sequence
  Synthetic Oligonucleotide; BTLA exon 4; Set A
gagaguucauuuugcuuuccuggaagacaaa

SEQ ID NO: 53394 - RNA, 19 nt, Artificial Sequence
  Synthetic Oligonucleotide; BTLA exon 4; Set C
ucauuuugcuuuccuggaa

SEQ ID NO: 53395 - RNA, 39 nt, Artificial Sequence
  Synthetic Oligonucleotide; BTLA exon 4; Set A
gucagagaguucauuuugcuuuccuggaagacaaaaaga

SEQ ID NO: 53396 - RNA, 36 nt, Artificial Sequence
  Synthetic Oligonucleotide; BTLA exon 4; Set A
ucagagaguucauuuugcuuuccuggaagacaaaaa

SEQ ID NO: 53397 - RNA, 30 nt, Artificial Sequence
  Synthetic Oligonucleotide; BTLA exon 4; Set A
gagaguucauuuugcuuuccuggaagacaa

SEQ ID NO: 53398 - RNA, 28 nt, Artificial Sequence
  Synthetic Oligonucleotide; BTLA exon 4; Set A
agaguucauuuugcuuuccuggaagaca

SEQ ID NO: 53399 - RNA, 18 nt, Artificial Sequence
  Synthetic Oligonucleotide; BTLA exon 4; Set C
ucauuuugcuuuccugga

SEQ ID NO: 53400 - RNA, 40 nt, Artificial Sequence
  Synthetic Oligonucleotide; BTLA exon 4; Set A
ugucagagaguucauuuugcuuuccuggaagacaaaaaga

SEQ ID NO: 53401 - RNA, 38 nt, Artificial Sequence
  Synthetic Oligonucleotide; BTLA exon 4; Set A
gucagagaguucauuuugcuuuccuggaagacaaaaag

SEQ ID NO: 53402 - RNA, 35 nt, Artificial Sequence
  Synthetic Oligonucleotide; BTLA exon 4; Set A
ucagagaguucauuuugcuuuccuggaagacaaaa

SEQ ID NO: 53403 - RNA, 27 nt, Artificial Sequence
  Synthetic Oligonucleotide; BTLA exon 4; Set A
agaguucauuuugcuuuccuggaagac

SEQ ID NO: 53404 - RNA, 25 nt, Artificial Sequence
  Synthetic Oligonucleotide; BTLA exon 4; Set A
gaguucauuuugcuuuccuggaaga

SEQ ID NO: 53405 - RNA, 39 nt, Artificial Sequence
  Synthetic Oligonucleotide; BTLA exon 4; Set A
ugucagagaguucauuuugcuuuccuggaagacaaaaag

SEQ ID NO: 53406 - RNA, 34 nt, Artificial Sequence
  Synthetic Oligonucleotide; BTLA exon 4; Set A
ucagagaguucauuuugcuuuccuggaagacaaa

SEQ ID NO: 53407 - RNA, 26 nt, Artificial Sequence
  Synthetic Oligonucleotide; BTLA exon 4; Set A
agaguucauuuugcuuuccuggaaga

SEQ ID NO: 53408 - RNA, 24 nt, Artificial Sequence
  Synthetic Oligonucleotide; BTLA exon 4; Set C
gaguucauuuugcuuuccuggaag

SEQ ID NO: 53409 - RNA, 33 nt, Artificial Sequence
  Synthetic Oligonucleotide; BTLA exon 4; Set A
ucagagaguucauuuugcuuuccuggaagacaa

SEQ ID NO: 53410 - RNA, 23 nt, Artificial Sequence
  Synthetic Oligonucleotide; BTLA exon 4; Set C
gaguucauuuugcuuuccuggaa

SEQ ID NO: 53411 - RNA, 25 nt, Artificial Sequence
  Synthetic Oligonucleotide; BTLA exon 4; Set C
agaguucauuuugcuuuccuggaag

SEQ ID NO: 53412 - RNA, 32 nt, Artificial Sequence
  Synthetic Oligonucleotide; BTLA exon 4; Set A
ucagagaguucauuuugcuuuccuggaagaca

SEQ ID NO: 53413 - RNA, 22 nt, Artificial Sequence
  Synthetic Oligonucleotide; BTLA exon 4; Set C
gaguucauuuugcuuuccugga

SEQ ID NO: 53414 - RNA, 24 nt, Artificial Sequence
  Synthetic Oligonucleotide; BTLA exon 4; Set C
agaguucauuuugcuuuccuggaa

SEQ ID NO: 53415 - RNA, 23 nt, Artificial Sequence
  Synthetic Oligonucleotide; BTLA exon 4; Set C
agaguucauuuugcuuuccugga

SEQ ID NO: 53416 - RNA, 21 nt, Artificial Sequence
  Synthetic Oligonucleotide; BTLA exon 4; Set C
gaguucauuuugcuuuccugg

SEQ ID NO: 53417 - RNA, 22 nt, Artificial Sequence
  Synthetic Oligonucleotide; BTLA exon 4; Set C
agaguucauuuugcuuuccugg

SEQ ID NO: 53418 - RNA, 20 nt, Artificial Sequence
  Synthetic Oligonucleotide; BTLA exon 4; Set C
gaguucauuuugcuuuccug

SEQ ID NO: 53419 - RNA, 36 nt, Artificial Sequence
  Synthetic Oligonucleotide; BTLA exon 4; Set C
ugugucagagaguucauuuugcuuuccuggaagaca

SEQ ID NO: 53420 - RNA, 35 nt, Artificial Sequence
  Synthetic Oligonucleotide; BTLA exon 4; Set C
ugugucagagaguucauuuugcuuuccuggaagac

SEQ ID NO: 53421 - RNA, 37 nt, Artificial Sequence
  Synthetic Oligonucleotide; BTLA exon 4; Set C
cugugucagagaguucauuuugcuuuccuggaagaca

SEQ ID NO: 53422 - RNA, 36 nt, Artificial Sequence
  Synthetic Oligonucleotide; BTLA exon 4; Set C
cugugucagagaguucauuuugcuuuccuggaagac

SEQ ID NO: 53423 - RNA, 34 nt, Artificial Sequence
  Synthetic Oligonucleotide; BTLA exon 4; Set C
ugugucagagaguucauuuugcuuuccuggaaga

SEQ ID NO: 53424 - RNA, 32 nt, Artificial Sequence
  Synthetic Oligonucleotide; BTLA exon 4; Set A
gugucagagaguucauuuugcuuuccuggaag

SEQ ID NO: 53425 - RNA, 31 nt, Artificial Sequence
  Synthetic Oligonucleotide; BTLA exon 4; Set A
gugucagagaguucauuuugcuuuccuggaa

SEQ ID NO: 53426 - RNA, 35 nt, Artificial Sequence
  Synthetic Oligonucleotide; BTLA exon 4; Set C
cugugucagagaguucauuuugcuuuccuggaaga

SEQ ID NO: 53427 - RNA, 33 nt, Artificial Sequence
  Synthetic Oligonucleotide; BTLA exon 4; Set A
ugugucagagaguucauuuugcuuuccuggaag

SEQ ID NO: 53428 - RNA, 27 nt, Artificial Sequence
  Synthetic Oligonucleotide; BTLA exon 4; Set A
gucagagaguucauuuugcuuuccugg

SEQ ID NO: 53429 - RNA, 30 nt, Artificial Sequence
  Synthetic Oligonucleotide; BTLA exon 4; Set A
gugucagagaguucauuuugcuuuccugga

SEQ ID NO: 53430 - RNA, 32 nt, Artificial Sequence
  Synthetic Oligonucleotide; BTLA exon 4; Set A
ugugucagagaguucauuuugcuuuccuggaa

SEQ ID NO: 53431 - RNA, 34 nt, Artificial Sequence
  Synthetic Oligonucleotide; BTLA exon 4; Set A
cugugucagagaguucauuuugcuuuccuggaag

SEQ ID NO: 53432 - RNA, 26 nt, Artificial Sequence
  Synthetic Oligonucleotide; BTLA exon 4; Set A
gucagagaguucauuuugcuuuccug

SEQ ID NO: 53433 - RNA, 31 nt, Artificial Sequence
  Synthetic Oligonucleotide; BTLA exon 4; Set A
ugugucagagaguucauuuugcuuuccugga

SEQ ID NO: 53434 - RNA, 33 nt, Artificial Sequence
  Synthetic Oligonucleotide; BTLA exon 4; Set A
cugugucagagaguucauuuugcuuuccuggaa

SEQ ID NO: 53435 - RNA, 29 nt, Artificial Sequence
  Synthetic Oligonucleotide; BTLA exon 4; Set A
gugucagagaguucauuuugcuuuccugg

SEQ ID NO: 53436 - RNA, 27 nt, Artificial Sequence
  Synthetic Oligonucleotide; BTLA exon 4; Set A
ugucagagaguucauuuugcuuuccug

SEQ ID NO: 53437 - RNA, 32 nt, Artificial Sequence
  Synthetic Oligonucleotide; BTLA exon 4; Set C
cugugucagagaguucauuuugcuuuccugga

SEQ ID NO: 53438 - RNA, 30 nt, Artificial Sequence
  Synthetic Oligonucleotide; BTLA exon 4; Set A
ugugucagagaguucauuuugcuuuccugg

SEQ ID NO: 53439 - RNA, 28 nt, Artificial Sequence
  Synthetic Oligonucleotide; BTLA exon 4; Set A
gugucagagaguucauuuugcuuuccug

SEQ ID NO: 53440 - RNA, 31 nt, Artificial Sequence
  Synthetic Oligonucleotide; BTLA exon 4; Set A
cugugucagagaguucauuuugcuuuccugg

SEQ ID NO: 53441 - RNA, 29 nt, Artificial Sequence
  Synthetic Oligonucleotide; BTLA exon 4; Set A
ugugucagagaguucauuuugcuuuccug

SEQ ID NO: 53442 - RNA, 30 nt, Artificial Sequence
  Synthetic Oligonucleotide; BTLA exon 4; Set A
cugugucagagaguucauuuugcuuuccug

SEQ ID NO: 53443 - RNA, 18 nt, Artificial Sequence
  Synthetic Oligonucleotide; BTLA exon 4; Set C
gcugugucagagaguuca

SEQ ID NO: 53444 - RNA, 23 nt, Artificial Sequence
  Synthetic Oligonucleotide; BTLA exon 4; Set A
uuucccuuccugcugugucagag

SEQ ID NO: 53445 - RNA, 24 nt, Artificial Sequence
  Synthetic Oligonucleotide; BTLA exon 4; Set A
auuucccuuccugcugugucagag

SEQ ID NO: 53446 - RNA, 25 nt, Artificial Sequence
  Synthetic Oligonucleotide; BTLA exon 4; Set A
aauuucccuuccugcugugucagag

SEQ ID NO: 53447 - RNA, 26 nt, Artificial Sequence
  Synthetic Oligonucleotide; BTLA exon 4; Set A
uaauuucccuuccugcugugucagag

SEQ ID NO: 53448 - RNA, 21 nt, Artificial Sequence
  Synthetic Oligonucleotide; BTLA exon 4; Set A
auuucccuuccugcuguguca

SEQ ID NO: 53449 - RNA, 27 nt, Artificial Sequence
  Synthetic Oligonucleotide; BTLA exon 4; Set A
uuaauuucccuuccugcugugucagag

SEQ ID NO: 53450 - RNA, 22 nt, Artificial Sequence
  Synthetic Oligonucleotide; BTLA exon 4; Set A
aauuucccuuccugcuguguca

SEQ ID NO: 53451 - RNA, 17 nt, Artificial Sequence
  Synthetic Oligonucleotide; BTLA exon 4; Set C
uuucccuuccugcugug

SEQ ID NO: 53452 - RNA, 23 nt, Artificial Sequence
  Synthetic Oligonucleotide; BTLA exon 4; Set A
uaauuucccuuccugcuguguca

SEQ ID NO: 53453 - RNA, 16 nt, Artificial Sequence
  Synthetic Oligonucleotide; BTLA exon 4; Set C
uuucccuuccugcugu

SEQ ID NO: 53454 - RNA, 24 nt, Artificial Sequence
  Synthetic Oligonucleotide; BTLA exon 4; Set A
uuaauuucccuuccugcuguguca

SEQ ID NO: 53455 - RNA, 17 nt, Artificial Sequence
  Synthetic Oligonucleotide; BTLA exon 4; Set C
auuucccuuccugcugu

SEQ ID NO: 53456 - RNA, 15 nt, Artificial Sequence
  Synthetic Oligonucleotide; BTLA exon 4; Set C
uuucccuuccugcug

SEQ ID NO: 53457 - RNA, 18 nt, Artificial Sequence
  Synthetic Oligonucleotide; BTLA exon 4; Set C
aauuucccuuccugcugu

SEQ ID NO: 53458 - RNA, 16 nt, Artificial Sequence
  Synthetic Oligonucleotide; BTLA exon 4; Set C
auuucccuuccugcug

SEQ ID NO: 53459 - RNA, 19 nt, Artificial Sequence
  Synthetic Oligonucleotide; BTLA exon 4; Set C
uaauuucccuuccugcugu

SEQ ID NO: 53460 - RNA, 17 nt, Artificial Sequence
  Synthetic Oligonucleotide; BTLA exon 4; Set C
aauuucccuuccugcug

SEQ ID NO: 53461 - RNA, 22 nt, Artificial Sequence
  Synthetic Oligonucleotide; BTLA exon 4; Set C
guuaauuucccuuccugcugug

SEQ ID NO: 53462 - RNA, 20 nt, Artificial Sequence
  Synthetic Oligonucleotide; BTLA exon 4; Set C
uuaauuucccuuccugcugu

SEQ ID NO: 53463 - RNA, 18 nt, Artificial Sequence
  Synthetic Oligonucleotide; BTLA exon 4; Set C
uaauuucccuuccugcug

SEQ ID NO: 53464 - RNA, 39 nt, Artificial Sequence
  Synthetic Oligonucleotide; BTLA exon 4; Set C
gcuuaccagguuaauuucccuuccugcugugucagagag

SEQ ID NO: 53465 - RNA, 21 nt, Artificial Sequence
  Synthetic Oligonucleotide; BTLA exon 4; Set C
guuaauuucccuuccugcugu

SEQ ID NO: 53466 - RNA, 19 nt, Artificial Sequence
  Synthetic Oligonucleotide; BTLA exon 4; Set C
uuaauuucccuuccugcug

SEQ ID NO: 53467 - RNA, 40 nt, Artificial Sequence
  Synthetic Oligonucleotide; BTLA exon 4; Set C
agcuuaccagguuaauuucccuuccugcugugucagagag

SEQ ID NO: 53468 - RNA, 38 nt, Artificial Sequence
  Synthetic Oligonucleotide; BTLA exon 4; Set C
gcuuaccagguuaauuucccuuccugcugugucagaga

SEQ ID NO: 53469 - RNA, 20 nt, Artificial Sequence
  Synthetic Oligonucleotide; BTLA exon 4; Set C
guuaauuucccuuccugcug

SEQ ID NO: 53470 - RNA, 39 nt, Artificial Sequence
  Synthetic Oligonucleotide; BTLA exon 4; Set C
agcuuaccagguuaauuucccuuccugcugugucagaga

SEQ ID NO: 53471 - RNA, 40 nt, Artificial Sequence
  Synthetic Oligonucleotide; BTLA exon 4; Set C
aagcuuaccagguuaauuucccuuccugcugugucagaga

SEQ ID NO: 53472 - RNA, 33 nt, Artificial Sequence
  Synthetic Oligonucleotide; BTLA exon 4; Set C
gcuuaccagguuaauuucccuuccugcuguguc

SEQ ID NO: 53473 - RNA, 32 nt, Artificial Sequence
  Synthetic Oligonucleotide; BTLA exon 4; Set C
gcuuaccagguuaauuucccuuccugcugugu

SEQ ID NO: 53474 - RNA, 34 nt, Artificial Sequence
  Synthetic Oligonucleotide; BTLA exon 4; Set C
agcuuaccagguuaauuucccuuccugcuguguc

SEQ ID NO: 53475 - RNA, 33 nt, Artificial Sequence
  Synthetic Oligonucleotide; BTLA exon 4; Set C
agcuuaccagguuaauuucccuuccugcugugu

SEQ ID NO: 53476 - RNA, 35 nt, Artificial Sequence
  Synthetic Oligonucleotide; BTLA exon 4; Set C
aagcuuaccagguuaauuucccuuccugcuguguc

SEQ ID NO: 53477 - RNA, 31 nt, Artificial Sequence
  Synthetic Oligonucleotide; BTLA exon 4; Set C
gcuuaccagguuaauuucccuuccugcugug

SEQ ID NO: 53478 - RNA, 34 nt, Artificial Sequence
  Synthetic Oligonucleotide; BTLA exon 4; Set C
aagcuuaccagguuaauuucccuuccugcugugu

SEQ ID NO: 53479 - RNA, 32 nt, Artificial Sequence
  Synthetic Oligonucleotide; BTLA exon 4; Set C
agcuuaccagguuaauuucccuuccugcugug

SEQ ID NO: 53480 - RNA, 38 nt, Artificial Sequence
  Synthetic Oligonucleotide; BTLA exon 4; Set C
ucaagcuuaccagguuaauuucccuuccugcuguguca

SEQ ID NO: 53481 - RNA, 33 nt, Artificial Sequence
  Synthetic Oligonucleotide; BTLA exon 4; Set C
aagcuuaccagguuaauuucccuuccugcugug

SEQ ID NO: 53482 - RNA, 34 nt, Artificial Sequence
  Synthetic Oligonucleotide; BTLA exon 4; Set C
caagcuuaccagguuaauuucccuuccugcugug

SEQ ID NO: 53483 - RNA, 32 nt, Artificial Sequence
  Synthetic Oligonucleotide; BTLA exon 4; Set C
aagcuuaccagguuaauuucccuuccugcugu

SEQ ID NO: 53484 - RNA, 35 nt, Artificial Sequence
  Synthetic Oligonucleotide; BTLA exon 4; Set C
ucaagcuuaccagguuaauuucccuuccugcugug

SEQ ID NO: 53485 - RNA, 33 nt, Artificial Sequence
  Synthetic Oligonucleotide; BTLA exon 4; Set C
caagcuuaccagguuaauuucccuuccugcugu

SEQ ID NO: 53486 - RNA, 34 nt, Artificial Sequence
  Synthetic Oligonucleotide; BTLA exon 4; Set C
ucaagcuuaccagguuaauuucccuuccugcugu

SEQ ID NO: 53487 - RNA, 32 nt, Artificial Sequence
  Synthetic Oligonucleotide; BTLA exon 4; Set C
caagcuuaccagguuaauuucccuuccugcug

SEQ ID NO: 53488 - RNA, 33 nt, Artificial Sequence
  Synthetic Oligonucleotide; BTLA exon 4; Set C
ucaagcuuaccagguuaauuucccuuccugcug

SEQ ID NO: 53489 - RNA, 17 nt, Artificial Sequence
  Synthetic Oligonucleotide; BTLA exon 4; Set C
gcuuaccagguuaauuu

SEQ ID NO: 53490 - RNA, 16 nt, Artificial Sequence
  Synthetic Oligonucleotide; BTLA exon 4; Set C
gcuuaccagguuaauu

SEQ ID NO: 53491 - RNA, 15 nt, Artificial Sequence
  Synthetic Oligonucleotide; BTLA exon 4; Set C
gcuuaccagguuaau

SEQ ID NO: 53492 - RNA, 16 nt, Artificial Sequence
  Synthetic Oligonucleotide; BTLA exon 4; Set C
agcuuaccagguuaau

SEQ ID NO: 53493 - RNA, 15 nt, Artificial Sequence
  Synthetic Oligonucleotide; BTLA exon 4; Set C
agcuuaccagguuaa

SEQ ID NO: 53494 - RNA, 15 nt, Artificial Sequence
  Synthetic Oligonucleotide; BTLA exon 4; Set C
aagcuuaccagguua

SEQ ID NO: 53495 - RNA, 15 nt, Artificial Sequence
  Synthetic Oligonucleotide; BTLA exon 4; Set C
caagcuuaccagguu

SEQ ID NO: 53496 - RNA, 16 nt, Artificial Sequence
  Synthetic Oligonucleotide; BTLA exon 4; Set C
ucaagcuuaccagguu

SEQ ID NO: 53497 - RNA, 28 nt, Artificial Sequence
  Synthetic Oligonucleotide; BTLA exon 4; Set A
ucaacagcuacaucaagcuuaccagguu

SEQ ID NO: 53498 - RNA, 29 nt, Artificial Sequence
  Synthetic Oligonucleotide; BTLA exon 4; Set A
uucaacagcuacaucaagcuuaccagguu

SEQ ID NO: 53499 - RNA, 27 nt, Artificial Sequence
  Synthetic Oligonucleotide; BTLA exon 4; Set C
caguauaacacaaauugcauuuguuuc

SEQ ID NO: 53500 - RNA, 15 nt, Artificial Sequence
  Synthetic Oligonucleotide; BTLA exon 4; Set C
caguauaacacaaau

SEQ ID NO: 53501 - RNA, 16 nt, Artificial Sequence
  Synthetic Oligonucleotide; BTLA exon 4; Set C
acaguauaacacaaau

SEQ ID NO: 53502 - RNA, 15 nt, Artificial Sequence
  Synthetic Oligonucleotide; BTLA exon 4; Set C
acaguauaacacaaa

SEQ ID NO: 53503 - RNA, 16 nt, Artificial Sequence
  Synthetic Oligonucleotide; BTLA exon 4; Set C
ggaguaaagaaagcag

SEQ ID NO: 53504 - RNA, 17 nt, Artificial Sequence
  Synthetic Oligonucleotide; BTLA exon 4; Set C
aggaguaaagaaagcag

SEQ ID NO: 53505 - RNA, 22 nt, Artificial Sequence
  Synthetic Oligonucleotide; BTLA exon 4; Set C
caaaaggaguaaagaaagcaga

SEQ ID NO: 53506 - RNA, 21 nt, Artificial Sequence
  Synthetic Oligonucleotide; BTLA exon 4; Set C
caaaaggaguaaagaaagcag

SEQ ID NO: 53507 - RNA, 25 nt, Artificial Sequence
  Synthetic Oligonucleotide; BTLA exon 4; Set C
uaaucaaaaggaguaaagaaagcag

SEQ ID NO: 53508 - RNA, 15 nt, Artificial Sequence
  Synthetic Oligonucleotide; BTLA exon 4; Set C
aaaaggaguaaagaa

SEQ ID NO: 53509 - RNA, 26 nt, Artificial Sequence
  Synthetic Oligonucleotide; BTLA exon 4; Set C
guaaucaaaaggaguaaagaaagcag

SEQ ID NO: 53510 - RNA, 22 nt, Artificial Sequence
  Synthetic Oligonucleotide; BTLA exon 4; Set C
aguaaucaaaaggaguaaagaa

SEQ ID NO: 53511 - RNA, 35 nt, Artificial Sequence
  Synthetic Oligonucleotide; BTLA exon 4; Set C
aaaaagaaguaaucaaaaggaguaaagaaagcaga

SEQ ID NO: 53512 - RNA, 21 nt, Artificial Sequence
  Synthetic Oligonucleotide; BTLA exon 4; Set C
aguaaucaaaaggaguaaaga

SEQ ID NO: 53513 - RNA, 23 nt, Artificial Sequence
  Synthetic Oligonucleotide; BTLA exon 4; Set C
aaguaaucaaaaggaguaaagaa

SEQ ID NO: 53514 - RNA, 36 nt, Artificial Sequence
  Synthetic Oligonucleotide; BTLA exon 4; Set C
gaaaaagaaguaaucaaaaggaguaaagaaagcaga

SEQ ID NO: 53515 - RNA, 34 nt, Artificial Sequence
  Synthetic Oligonucleotide; BTLA exon 4; Set C
aaaaagaaguaaucaaaaggaguaaagaaagcag

SEQ ID NO: 53516 - RNA, 20 nt, Artificial Sequence
  Synthetic Oligonucleotide; BTLA exon 4; Set C
aguaaucaaaaggaguaaag

SEQ ID NO: 53517 - RNA, 22 nt, Artificial Sequence
  Synthetic Oligonucleotide; BTLA exon 4; Set C
aaguaaucaaaaggaguaaaga

SEQ ID NO: 53518 - RNA, 24 nt, Artificial Sequence
  Synthetic Oligonucleotide; BTLA exon 4; Set C
gaaguaaucaaaaggaguaaagaa

SEQ ID NO: 53519 - RNA, 37 nt, Artificial Sequence
  Synthetic Oligonucleotide; BTLA exon 4; Set C
agaaaaagaaguaaucaaaaggaguaaagaaagcaga

SEQ ID NO: 53520 - RNA, 35 nt, Artificial Sequence
  Synthetic Oligonucleotide; BTLA exon 4; Set C
gaaaaagaaguaaucaaaaggaguaaagaaagcag

SEQ ID NO: 53521 - RNA, 21 nt, Artificial Sequence
  Synthetic Oligonucleotide; BTLA exon 4; Set C
aaguaaucaaaaggaguaaag

SEQ ID NO: 53522 - RNA, 23 nt, Artificial Sequence
  Synthetic Oligonucleotide; BTLA exon 4; Set C
gaaguaaucaaaaggaguaaaga

SEQ ID NO: 53523 - RNA, 25 nt, Artificial Sequence
  Synthetic Oligonucleotide; BTLA exon 4; Set C
agaaguaaucaaaaggaguaaagaa

SEQ ID NO: 53524 - RNA, 38 nt, Artificial Sequence
  Synthetic Oligonucleotide; BTLA exon 4; Set C
aagaaaaagaaguaaucaaaaggaguaaagaaagcaga

SEQ ID NO: 53525 - RNA, 36 nt, Artificial Sequence
  Synthetic Oligonucleotide; BTLA exon 4; Set C
agaaaaagaaguaaucaaaaggaguaaagaaagcag

SEQ ID NO: 53526 - RNA, 22 nt, Artificial Sequence
  Synthetic Oligonucleotide; BTLA exon 4; Set C
gaaguaaucaaaaggaguaaag

SEQ ID NO: 53527 - RNA, 24 nt, Artificial Sequence
  Synthetic Oligonucleotide; BTLA exon 4; Set C
agaaguaaucaaaaggaguaaaga

SEQ ID NO: 53528 - RNA, 26 nt, Artificial Sequence
  Synthetic Oligonucleotide; BTLA exon 4; Set C
aagaaguaaucaaaaggaguaaagaa

SEQ ID NO: 53529 - RNA, 37 nt, Artificial Sequence
  Synthetic Oligonucleotide; BTLA exon 4; Set C
aagaaaaagaaguaaucaaaaggaguaaagaaagcag

SEQ ID NO: 53530 - RNA, 23 nt, Artificial Sequence
  Synthetic Oligonucleotide; BTLA exon 4; Set C
agaaguaaucaaaaggaguaaag

SEQ ID NO: 53531 - RNA, 25 nt, Artificial Sequence
  Synthetic Oligonucleotide; BTLA exon 4; Set C
aagaaguaaucaaaaggaguaaaga

SEQ ID NO: 53532 - RNA, 27 nt, Artificial Sequence
  Synthetic Oligonucleotide; BTLA exon 4; Set C
aaagaaguaaucaaaaggaguaaagaa

SEQ ID NO: 53533 - RNA, 24 nt, Artificial Sequence
  Synthetic Oligonucleotide; BTLA exon 4; Set C
aagaaguaaucaaaaggaguaaag

SEQ ID NO: 53534 - RNA, 26 nt, Artificial Sequence
  Synthetic Oligonucleotide; BTLA exon 4; Set C
aaagaaguaaucaaaaggaguaaaga

SEQ ID NO: 53535 - RNA, 28 nt, Artificial Sequence
  Synthetic Oligonucleotide; BTLA exon 4; Set C
aaaagaaguaaucaaaaggaguaaagaa

SEQ ID NO: 53536 - RNA, 25 nt, Artificial Sequence
  Synthetic Oligonucleotide; BTLA exon 4; Set C
aaagaaguaaucaaaaggaguaaag

SEQ ID NO: 53537 - RNA, 27 nt, Artificial Sequence
  Synthetic Oligonucleotide; BTLA exon 4; Set C
aaaagaaguaaucaaaaggaguaaaga

SEQ ID NO: 53538 - RNA, 26 nt, Artificial Sequence
  Synthetic Oligonucleotide; BTLA exon 4; Set C
aaaagaaguaaucaaaaggaguaaag

SEQ ID NO: 53539 - RNA, 26 nt, Artificial Sequence
  Synthetic Oligonucleotide; BTLA exon 4; Set C
aaaaagaaguaaucaaaaggaguaaa

SEQ ID NO: 53540 - RNA, 27 nt, Artificial Sequence
  Synthetic Oligonucleotide; BTLA exon 4; Set C
gaaaaagaaguaaucaaaaggaguaaa

SEQ ID NO: 53541 - RNA, 33 nt, Artificial Sequence
  Synthetic Oligonucleotide; BTLA exon 4; Set C
aaagaaaaagaaguaaucaaaaggaguaaagaa

SEQ ID NO: 53542 - RNA, 28 nt, Artificial Sequence
  Synthetic Oligonucleotide; BTLA exon 4; Set C
agaaaaagaaguaaucaaaaggaguaaa

SEQ ID NO: 53543 - RNA, 32 nt, Artificial Sequence
  Synthetic Oligonucleotide; BTLA exon 4; Set C
aaagaaaaagaaguaaucaaaaggaguaaaga

SEQ ID NO: 53544 - RNA, 34 nt, Artificial Sequence
  Synthetic Oligonucleotide; BTLA exon 4; Set C
aaaagaaaaagaaguaaucaaaaggaguaaagaa

SEQ ID NO: 53545 - RNA, 29 nt, Artificial Sequence
  Synthetic Oligonucleotide; BTLA exon 4; Set C
aagaaaaagaaguaaucaaaaggaguaaa

SEQ ID NO: 53546 - RNA, 31 nt, Artificial Sequence
  Synthetic Oligonucleotide; BTLA exon 4; Set C
aaagaaaaagaaguaaucaaaaggaguaaag

SEQ ID NO: 53547 - RNA, 33 nt, Artificial Sequence
  Synthetic Oligonucleotide; BTLA exon 4; Set C
aaaagaaaaagaaguaaucaaaaggaguaaaga

SEQ ID NO: 53548 - RNA, 35 nt, Artificial Sequence
  Synthetic Oligonucleotide; BTLA exon 4; Set C
aaaaagaaaaagaaguaaucaaaaggaguaaagaa

SEQ ID NO: 53549 - RNA, 32 nt, Artificial Sequence
  Synthetic Oligonucleotide; BTLA exon 4; Set C
aaaagaaaaagaaguaaucaaaaggaguaaag

SEQ ID NO: 53550 - RNA, 34 nt, Artificial Sequence
  Synthetic Oligonucleotide; BTLA exon 4; Set C
aaaaagaaaaagaaguaaucaaaaggaguaaaga

SEQ ID NO: 53551 - RNA, 36 nt, Artificial Sequence
  Synthetic Oligonucleotide; BTLA exon 4; Set C
caaaaagaaaaagaaguaaucaaaaggaguaaagaa

SEQ ID NO: 53552 - RNA, 33 nt, Artificial Sequence
  Synthetic Oligonucleotide; BTLA exon 4; Set C
aaaaagaaaaagaaguaaucaaaaggaguaaag

SEQ ID NO: 53553 - RNA, 35 nt, Artificial Sequence
  Synthetic Oligonucleotide; BTLA exon 4; Set C
caaaaagaaaaagaaguaaucaaaaggaguaaaga

SEQ ID NO: 53554 - RNA, 37 nt, Artificial Sequence
  Synthetic Oligonucleotide; BTLA exon 4; Set C
acaaaaagaaaaagaaguaaucaaaaggaguaaagaa

SEQ ID NO: 53555 - RNA, 34 nt, Artificial Sequence
  Synthetic Oligonucleotide; BTLA exon 4; Set C
caaaaagaaaaagaaguaaucaaaaggaguaaag

SEQ ID NO: 53556 - RNA, 36 nt, Artificial Sequence
  Synthetic Oligonucleotide; BTLA exon 4; Set C
acaaaaagaaaaagaaguaaucaaaaggaguaaaga

SEQ ID NO: 53557 - RNA, 38 nt, Artificial Sequence
  Synthetic Oligonucleotide; BTLA exon 4; Set C
gacaaaaagaaaaagaaguaaucaaaaggaguaaagaa

SEQ ID NO: 53558 - RNA, 35 nt, Artificial Sequence
  Synthetic Oligonucleotide; BTLA exon 4; Set C
acaaaaagaaaaagaaguaaucaaaaggaguaaag

SEQ ID NO: 53559 - RNA, 37 nt, Artificial Sequence
  Synthetic Oligonucleotide; BTLA exon 4; Set C
gacaaaaagaaaaagaaguaaucaaaaggaguaaaga

SEQ ID NO: 53560 - RNA, 39 nt, Artificial Sequence
  Synthetic Oligonucleotide; BTLA exon 4; Set C
agacaaaaagaaaaagaaguaaucaaaaggaguaaagaa

SEQ ID NO: 53561 - RNA, 36 nt, Artificial Sequence
  Synthetic Oligonucleotide; BTLA exon 4; Set C
gacaaaaagaaaaagaaguaaucaaaaggaguaaag

SEQ ID NO: 53562 - RNA, 38 nt, Artificial Sequence
  Synthetic Oligonucleotide; BTLA exon 4; Set C
agacaaaaagaaaaagaaguaaucaaaaggaguaaaga

SEQ ID NO: 53563 - RNA, 40 nt, Artificial Sequence
  Synthetic Oligonucleotide; BTLA exon 4; Set C
aagacaaaaagaaaaagaaguaaucaaaaggaguaaagaa

SEQ ID NO: 53564 - RNA, 37 nt, Artificial Sequence
  Synthetic Oligonucleotide; BTLA exon 4; Set C
agacaaaaagaaaaagaaguaaucaaaaggaguaaag

SEQ ID NO: 53565 - RNA, 39 nt, Artificial Sequence
  Synthetic Oligonucleotide; BTLA exon 4; Set C
aagacaaaaagaaaaagaaguaaucaaaaggaguaaaga

SEQ ID NO: 53566 - RNA, 16 nt, Artificial Sequence
  Synthetic Oligonucleotide; BTLA exon 4; Set C
aaaaagaaguaaucaa

SEQ ID NO: 53567 - RNA, 38 nt, Artificial Sequence
  Synthetic Oligonucleotide; BTLA exon 4; Set C
aagacaaaaagaaaaagaaguaaucaaaaggaguaaag

SEQ ID NO: 53568 - RNA, 40 nt, Artificial Sequence
  Synthetic Oligonucleotide; BTLA exon 4; Set C
gaagacaaaaagaaaaagaaguaaucaaaaggaguaaaga

SEQ ID NO: 53569 - RNA, 17 nt, Artificial Sequence
  Synthetic Oligonucleotide; BTLA exon 4; Set C
gaaaaagaaguaaucaa

SEQ ID NO: 53570 - RNA, 39 nt, Artificial Sequence
  Synthetic Oligonucleotide; BTLA exon 4; Set C
gaagacaaaaagaaaaagaaguaaucaaaaggaguaaag

SEQ ID NO: 53571 - RNA, 18 nt, Artificial Sequence
  Synthetic Oligonucleotide; BTLA exon 4; Set C
agaaaaagaaguaaucaa

SEQ ID NO: 53572 - RNA, 40 nt, Artificial Sequence
  Synthetic Oligonucleotide; BTLA exon 4; Set C
ggaagacaaaaagaaaaagaaguaaucaaaaggaguaaag

SEQ ID NO: 53573 - RNA, 19 nt, Artificial Sequence
  Synthetic Oligonucleotide; BTLA exon 4; Set C
aagaaaaagaaguaaucaa

SEQ ID NO: 53574 - RNA, 30 nt, Artificial Sequence
  Synthetic Oligonucleotide; BTLA exon 4; Set C
cuuuccuggaagacaaaaagaaaaagaagu

SEQ ID NO: 53575 - RNA, 29 nt, Artificial Sequence
  Synthetic Oligonucleotide; BTLA exon 4; Set C
cuuuccuggaagacaaaaagaaaaagaag

SEQ ID NO: 53576 - RNA, 28 nt, Artificial Sequence
  Synthetic Oligonucleotide; BTLA exon 4; Set C
cuuuccuggaagacaaaaagaaaaagaa

SEQ ID NO: 53577 - RNA, 27 nt, Artificial Sequence
  Synthetic Oligonucleotide; BTLA exon 4; Set C
cuuuccuggaagacaaaaagaaaaaga

SEQ ID NO: 53578 - RNA, 26 nt, Artificial Sequence
  Synthetic Oligonucleotide; BTLA exon 4; Set C
cuuuccuggaagacaaaaagaaaaag

SEQ ID NO: 53579 - RNA, 25 nt, Artificial Sequence
  Synthetic Oligonucleotide; BTLA exon 4; Set C
cuuuccuggaagacaaaaagaaaaa

SEQ ID NO: 53580 - RNA, 24 nt, Artificial Sequence
  Synthetic Oligonucleotide; BTLA exon 4; Set C
cuuuccuggaagacaaaaagaaaa

SEQ ID NO: 53581 - RNA, 19 nt, Artificial Sequence
  Synthetic Oligonucleotide; BTLA exon 4; Set C
cuuuccuggaagacaaaaa

SEQ ID NO: 53582 - RNA, 18 nt, Artificial Sequence
  Synthetic Oligonucleotide; BTLA exon 4; Set C
cuuuccuggaagacaaaa

SEQ ID NO: 53583 - RNA, 17 nt, Artificial Sequence
  Synthetic Oligonucleotide; BTLA exon 4; Set C
cuuuccuggaagacaaa

SEQ ID NO: 53584 - RNA, 31 nt, Artificial Sequence
  Synthetic Oligonucleotide; BTLA exon 4; Set C
ucauuuugcuuuccuggaagacaaaaagaaa

SEQ ID NO: 53585 - RNA, 30 nt, Artificial Sequence
  Synthetic Oligonucleotide; BTLA exon 4; Set C
ucauuuugcuuuccuggaagacaaaaagaa

SEQ ID NO: 53586 - RNA, 29 nt, Artificial Sequence
  Synthetic Oligonucleotide; BTLA exon 4; Set C
ucauuuugcuuuccuggaagacaaaaaga

SEQ ID NO: 53587 - RNA, 28 nt, Artificial Sequence
  Synthetic Oligonucleotide; BTLA exon 4; Set C
ucauuuugcuuuccuggaagacaaaaag

SEQ ID NO: 53588 - RNA, 40 nt, Artificial Sequence
  Synthetic Oligonucleotide; BTLA exon 4; Set A
agagaguucauuuugcuuuccuggaagacaaaaagaaaaa

SEQ ID NO: 53589 - RNA, 36 nt, Artificial Sequence
  Synthetic Oligonucleotide; BTLA exon 4; Set A
agaguucauuuugcuuuccuggaagacaaaaagaaa

SEQ ID NO: 53590 - RNA, 34 nt, Artificial Sequence
  Synthetic Oligonucleotide; BTLA exon 4; Set A
gaguucauuuugcuuuccuggaagacaaaaagaa

SEQ ID NO: 53591 - RNA, 39 nt, Artificial Sequence
  Synthetic Oligonucleotide; BTLA exon 4; Set A
agagaguucauuuugcuuuccuggaagacaaaaagaaaa

SEQ ID NO: 53592 - RNA, 35 nt, Artificial Sequence
  Synthetic Oligonucleotide; BTLA exon 4; Set A
agaguucauuuugcuuuccuggaagacaaaaagaa

SEQ ID NO: 53593 - RNA, 33 nt, Artificial Sequence
  Synthetic Oligonucleotide; BTLA exon 4; Set A
gaguucauuuugcuuuccuggaagacaaaaaga

SEQ ID NO: 53594 - RNA, 40 nt, Artificial Sequence
  Synthetic Oligonucleotide; BTLA exon 4; Set A
cagagaguucauuuugcuuuccuggaagacaaaaagaaaa

SEQ ID NO: 53595 - RNA, 34 nt, Artificial Sequence
  Synthetic Oligonucleotide; BTLA exon 4; Set A
agaguucauuuugcuuuccuggaagacaaaaaga

SEQ ID NO: 53596 - RNA, 32 nt, Artificial Sequence
  Synthetic Oligonucleotide; BTLA exon 4; Set A
gaguucauuuugcuuuccuggaagacaaaaag

SEQ ID NO: 53597 - RNA, 33 nt, Artificial Sequence
  Synthetic Oligonucleotide; BTLA exon 4; Set A
agaguucauuuugcuuuccuggaagacaaaaag

SEQ ID NO: 53598 - RNA, 34 nt, Artificial Sequence
  Synthetic Oligonucleotide; BTLA exon 4; Set A
agagaguucauuuugcuuuccuggaagacaaaaa

SEQ ID NO: 53599 - RNA, 35 nt, Artificial Sequence
  Synthetic Oligonucleotide; BTLA exon 4; Set A
cagagaguucauuuugcuuuccuggaagacaaaaa

SEQ ID NO: 53600 - RNA, 33 nt, Artificial Sequence
  Synthetic Oligonucleotide; BTLA exon 4; Set A
agagaguucauuuugcuuuccuggaagacaaaa

SEQ ID NO: 53601 - RNA, 34 nt, Artificial Sequence
  Synthetic Oligonucleotide; BTLA exon 4; Set A
cagagaguucauuuugcuuuccuggaagacaaaa

SEQ ID NO: 53602 - RNA, 32 nt, Artificial Sequence
  Synthetic Oligonucleotide; BTLA exon 4; Set A
agagaguucauuuugcuuuccuggaagacaaa

SEQ ID NO: 53603 - RNA, 33 nt, Artificial Sequence
  Synthetic Oligonucleotide; BTLA exon 4; Set A
cagagaguucauuuugcuuuccuggaagacaaa

SEQ ID NO: 53604 - RNA, 31 nt, Artificial Sequence
  Synthetic Oligonucleotide; BTLA exon 4; Set A
agagaguucauuuugcuuuccuggaagacaa

SEQ ID NO: 53605 - RNA, 29 nt, Artificial Sequence
  Synthetic Oligonucleotide; BTLA exon 4; Set A
gagaguucauuuugcuuuccuggaagaca

SEQ ID NO: 53606 - RNA, 17 nt, Artificial Sequence
  Synthetic Oligonucleotide; BTLA exon 4; Set C
ucauuuugcuuuccugg

SEQ ID NO: 53607 - RNA, 32 nt, Artificial Sequence
  Synthetic Oligonucleotide; BTLA exon 4; Set A
cagagaguucauuuugcuuuccuggaagacaa

SEQ ID NO: 53608 - RNA, 28 nt, Artificial Sequence
  Synthetic Oligonucleotide; BTLA exon 4; Set A
gagaguucauuuugcuuuccuggaagac

SEQ ID NO: 53609 - RNA, 30 nt, Artificial Sequence
  Synthetic Oligonucleotide; BTLA exon 4; Set A
agagaguucauuuugcuuuccuggaagaca

SEQ ID NO: 53610 - RNA, 16 nt, Artificial Sequence
  Synthetic Oligonucleotide; BTLA exon 4; Set C
ucauuuugcuuuccug

SEQ ID NO: 53611 - RNA, 40 nt, Artificial Sequence
  Synthetic Oligonucleotide; BTLA exon 4; Set A
gugucagagaguucauuuugcuuuccuggaagacaaaaag

SEQ ID NO: 53612 - RNA, 29 nt, Artificial Sequence
  Synthetic Oligonucleotide; BTLA exon 4; Set A
agagaguucauuuugcuuuccuggaagac

SEQ ID NO: 53613 - RNA, 31 nt, Artificial Sequence
  Synthetic Oligonucleotide; BTLA exon 4; Set A
cagagaguucauuuugcuuuccuggaagaca

SEQ ID NO: 53614 - RNA, 27 nt, Artificial Sequence
  Synthetic Oligonucleotide; BTLA exon 4; Set A
gagaguucauuuugcuuuccuggaaga

SEQ ID NO: 53615 - RNA, 30 nt, Artificial Sequence
  Synthetic Oligonucleotide; BTLA exon 4; Set A
cagagaguucauuuugcuuuccuggaagac

SEQ ID NO: 53616 - RNA, 26 nt, Artificial Sequence
  Synthetic Oligonucleotide; BTLA exon 4; Set A
gagaguucauuuugcuuuccuggaag

SEQ ID NO: 53617 - RNA, 31 nt, Artificial Sequence
  Synthetic Oligonucleotide; BTLA exon 4; Set A
ucagagaguucauuuugcuuuccuggaagac

SEQ ID NO: 53618 - RNA, 25 nt, Artificial Sequence
  Synthetic Oligonucleotide; BTLA exon 4; Set A
gagaguucauuuugcuuuccuggaa

SEQ ID NO: 53619 - RNA, 24 nt, Artificial Sequence
  Synthetic Oligonucleotide; BTLA exon 4; Set A
gagaguucauuuugcuuuccugga

SEQ ID NO: 53620 - RNA, 30 nt, Artificial Sequence
  Synthetic Oligonucleotide; BTLA exon 4; Set A
ucagagaguucauuuugcuuuccuggaaga

SEQ ID NO: 53621 - RNA, 29 nt, Artificial Sequence
  Synthetic Oligonucleotide; BTLA exon 4; Set A
ucagagaguucauuuugcuuuccuggaag

SEQ ID NO: 53622 - RNA, 23 nt, Artificial Sequence
  Synthetic Oligonucleotide; BTLA exon 4; Set C
gagaguucauuuugcuuuccugg

SEQ ID NO: 53623 - RNA, 21 nt, Artificial Sequence
  Synthetic Oligonucleotide; BTLA exon 4; Set C
agaguucauuuugcuuuccug

SEQ ID NO: 53624 - RNA, 40 nt, Artificial Sequence
  Synthetic Oligonucleotide; BTLA exon 4; Set C
gcugugucagagaguucauuuugcuuuccuggaagacaaa

SEQ ID NO: 53625 - RNA, 28 nt, Artificial Sequence
  Synthetic Oligonucleotide; BTLA exon 4; Set A
ucagagaguucauuuugcuuuccuggaa

SEQ ID NO: 53626 - RNA, 39 nt, Artificial Sequence
  Synthetic Oligonucleotide; BTLA exon 4; Set C
gcugugucagagaguucauuuugcuuuccuggaagacaa

SEQ ID NO: 53627 - RNA, 27 nt, Artificial Sequence
  Synthetic Oligonucleotide; BTLA exon 4; Set A
ucagagaguucauuuugcuuuccugga

SEQ ID NO: 53628 - RNA, 38 nt, Artificial Sequence
  Synthetic Oligonucleotide; BTLA exon 4; Set C
gcugugucagagaguucauuuugcuuuccuggaagaca

SEQ ID NO: 53629 - RNA, 26 nt, Artificial Sequence
  Synthetic Oligonucleotide; BTLA exon 4; Set A
ucagagaguucauuuugcuuuccugg

SEQ ID NO: 53630 - RNA, 37 nt, Artificial Sequence
  Synthetic Oligonucleotide; BTLA exon 4; Set C
gcugugucagagaguucauuuugcuuuccuggaagac

SEQ ID NO: 53631 - RNA, 25 nt, Artificial Sequence
  Synthetic Oligonucleotide; BTLA exon 4; Set C
ucagagaguucauuuugcuuuccug

SEQ ID NO: 53632 - RNA, 36 nt, Artificial Sequence
  Synthetic Oligonucleotide; BTLA exon 4; Set C
gcugugucagagaguucauuuugcuuuccuggaaga

SEQ ID NO: 53633 - RNA, 35 nt, Artificial Sequence
  Synthetic Oligonucleotide; BTLA exon 4; Set C
gcugugucagagaguucauuuugcuuuccuggaag

SEQ ID NO: 53634 - RNA, 34 nt, Artificial Sequence
  Synthetic Oligonucleotide; BTLA exon 4; Set C
gcugugucagagaguucauuuugcuuuccuggaa

SEQ ID NO: 53635 - RNA, 33 nt, Artificial Sequence
  Synthetic Oligonucleotide; BTLA exon 4; Set C
gcugugucagagaguucauuuugcuuuccugga

SEQ ID NO: 53636 - RNA, 22 nt, Artificial Sequence
  Synthetic Oligonucleotide; BTLA exon 4; Set A
uuucccuuccugcugugucaga

SEQ ID NO: 53637 - RNA, 23 nt, Artificial Sequence
  Synthetic Oligonucleotide; BTLA exon 4; Set A
auuucccuuccugcugugucaga

SEQ ID NO: 53638 - RNA, 21 nt, Artificial Sequence
  Synthetic Oligonucleotide; BTLA exon 4; Set A
uuucccuuccugcugugucag

SEQ ID NO: 53639 - RNA, 20 nt, Artificial Sequence
  Synthetic Oligonucleotide; BTLA exon 4; Set A
uuucccuuccugcuguguca

SEQ ID NO: 53640 - RNA, 24 nt, Artificial Sequence
  Synthetic Oligonucleotide; BTLA exon 4; Set A
aauuucccuuccugcugugucaga

SEQ ID NO: 53641 - RNA, 22 nt, Artificial Sequence
  Synthetic Oligonucleotide; BTLA exon 4; Set A
auuucccuuccugcugugucag

SEQ ID NO: 53642 - RNA, 23 nt, Artificial Sequence
  Synthetic Oligonucleotide; BTLA exon 4; Set A
aauuucccuuccugcugugucag

SEQ ID NO: 53643 - RNA, 25 nt, Artificial Sequence
  Synthetic Oligonucleotide; BTLA exon 4; Set A
uaauuucccuuccugcugugucaga

SEQ ID NO: 53644 - RNA, 28 nt, Artificial Sequence
  Synthetic Oligonucleotide; BTLA exon 4; Set A
guuaauuucccuuccugcugugucagag

SEQ ID NO: 53645 - RNA, 24 nt, Artificial Sequence
  Synthetic Oligonucleotide; BTLA exon 4; Set A
uaauuucccuuccugcugugucag

SEQ ID NO: 53646 - RNA, 26 nt, Artificial Sequence
  Synthetic Oligonucleotide; BTLA exon 4; Set A
uuaauuucccuuccugcugugucaga

SEQ ID NO: 53647 - RNA, 25 nt, Artificial Sequence
  Synthetic Oligonucleotide; BTLA exon 4; Set A
uuaauuucccuuccugcugugucag

SEQ ID NO: 53648 - RNA, 27 nt, Artificial Sequence
  Synthetic Oligonucleotide; BTLA exon 4; Set A
guuaauuucccuuccugcugugucaga

SEQ ID NO: 53649 - RNA, 26 nt, Artificial Sequence
  Synthetic Oligonucleotide; BTLA exon 4; Set A
guuaauuucccuuccugcugugucag

SEQ ID NO: 53650 - RNA, 25 nt, Artificial Sequence
  Synthetic Oligonucleotide; BTLA exon 4; Set A
guuaauuucccuuccugcuguguca

SEQ ID NO: 53651 - RNA, 17 nt, Artificial Sequence
  Synthetic Oligonucleotide; BTLA exon 4; Set C
uaauuucccuuccugcu

SEQ ID NO: 53652 - RNA, 18 nt, Artificial Sequence
  Synthetic Oligonucleotide; BTLA exon 4; Set C
uuaauuucccuuccugcu

SEQ ID NO: 53653 - RNA, 37 nt, Artificial Sequence
  Synthetic Oligonucleotide; BTLA exon 4; Set C
gcuuaccagguuaauuucccuuccugcugugucagag

SEQ ID NO: 53654 - RNA, 38 nt, Artificial Sequence
  Synthetic Oligonucleotide; BTLA exon 4; Set C
agcuuaccagguuaauuucccuuccugcugugucagag

SEQ ID NO: 53655 - RNA, 39 nt, Artificial Sequence
  Synthetic Oligonucleotide; BTLA exon 4; Set C
aagcuuaccagguuaauuucccuuccugcugugucagag

SEQ ID NO: 53656 - RNA, 34 nt, Artificial Sequence
  Synthetic Oligonucleotide; BTLA exon 4; Set C
gcuuaccagguuaauuucccuuccugcuguguca

SEQ ID NO: 53657 - RNA, 40 nt, Artificial Sequence
  Synthetic Oligonucleotide; BTLA exon 4; Set C
caagcuuaccagguuaauuucccuuccugcugugucagag

SEQ ID NO: 53658 - RNA, 35 nt, Artificial Sequence
  Synthetic Oligonucleotide; BTLA exon 4; Set C
agcuuaccagguuaauuucccuuccugcuguguca

SEQ ID NO: 53659 - RNA, 36 nt, Artificial Sequence
  Synthetic Oligonucleotide; BTLA exon 4; Set C
aagcuuaccagguuaauuucccuuccugcuguguca

SEQ ID NO: 53660 - RNA, 40 nt, Artificial Sequence
  Synthetic Oligonucleotide; BTLA exon 4; Set C
ucaagcuuaccagguuaauuucccuuccugcugugucaga

SEQ ID NO: 53661 - RNA, 37 nt, Artificial Sequence
  Synthetic Oligonucleotide; BTLA exon 4; Set C
caagcuuaccagguuaauuucccuuccugcuguguca

SEQ ID NO: 53662 - RNA, 39 nt, Artificial Sequence
  Synthetic Oligonucleotide; BTLA exon 4; Set C
ucaagcuuaccagguuaauuucccuuccugcugugucag

SEQ ID NO: 53663 - RNA, 30 nt, Artificial Sequence
  Synthetic Oligonucleotide; BTLA exon 4; Set C
gcuuaccagguuaauuucccuuccugcugu

SEQ ID NO: 53664 - RNA, 31 nt, Artificial Sequence
  Synthetic Oligonucleotide; BTLA exon 4; Set C
agcuuaccagguuaauuucccuuccugcugu

SEQ ID NO: 53665 - RNA, 29 nt, Artificial Sequence
  Synthetic Oligonucleotide; BTLA exon 4; Set C
gcuuaccagguuaauuucccuuccugcug

SEQ ID NO: 53666 - RNA, 38 nt, Artificial Sequence
  Synthetic Oligonucleotide; BTLA exon 4; Set C
aucaagcuuaccagguuaauuucccuuccugcuguguc

SEQ ID NO: 53667 - RNA, 30 nt, Artificial Sequence
  Synthetic Oligonucleotide; BTLA exon 4; Set C
agcuuaccagguuaauuucccuuccugcug

SEQ ID NO: 53668 - RNA, 37 nt, Artificial Sequence
  Synthetic Oligonucleotide; BTLA exon 4; Set C
aucaagcuuaccagguuaauuucccuuccugcugugu

SEQ ID NO: 53669 - RNA, 31 nt, Artificial Sequence
  Synthetic Oligonucleotide; BTLA exon 4; Set A
aagcuuaccagguuaauuucccuuccugcug

SEQ ID NO: 53670 - RNA, 22 nt, Artificial Sequence
  Synthetic Oligonucleotide; BTLA exon 4; Set C
aucaagcuuaccagguuaauuu

SEQ ID NO: 53671 - RNA, 21 nt, Artificial Sequence
  Synthetic Oligonucleotide; BTLA exon 4; Set C
aucaagcuuaccagguuaauu

SEQ ID NO: 53672 - RNA, 23 nt, Artificial Sequence
  Synthetic Oligonucleotide; BTLA exon 4; Set C
caucaagcuuaccagguuaauuu

SEQ ID NO: 53673 - RNA, 20 nt, Artificial Sequence
  Synthetic Oligonucleotide; BTLA exon 4; Set C
aucaagcuuaccagguuaau

SEQ ID NO: 53674 - RNA, 22 nt, Artificial Sequence
  Synthetic Oligonucleotide; BTLA exon 4; Set C
caucaagcuuaccagguuaauu

SEQ ID NO: 53675 - RNA, 24 nt, Artificial Sequence
  Synthetic Oligonucleotide; BTLA exon 4; Set C
acaucaagcuuaccagguuaauuu

SEQ ID NO: 53676 - RNA, 21 nt, Artificial Sequence
  Synthetic Oligonucleotide; BTLA exon 4; Set C
caucaagcuuaccagguuaau

SEQ ID NO: 53677 - RNA, 19 nt, Artificial Sequence
  Synthetic Oligonucleotide; BTLA exon 4; Set C
aucaagcuuaccagguuaa

SEQ ID NO: 53678 - RNA, 23 nt, Artificial Sequence
  Synthetic Oligonucleotide; BTLA exon 4; Set C
acaucaagcuuaccagguuaauu

SEQ ID NO: 53679 - RNA, 22 nt, Artificial Sequence
  Synthetic Oligonucleotide; BTLA exon 4; Set C
acaucaagcuuaccagguuaau

SEQ ID NO: 53680 - RNA, 20 nt, Artificial Sequence
  Synthetic Oligonucleotide; BTLA exon 4; Set C
caucaagcuuaccagguuaa

SEQ ID NO: 53681 - RNA, 18 nt, Artificial Sequence
  Synthetic Oligonucleotide; BTLA exon 4; Set C
aucaagcuuaccagguua

SEQ ID NO: 53682 - RNA, 21 nt, Artificial Sequence
  Synthetic Oligonucleotide; BTLA exon 4; Set C
acaucaagcuuaccagguuaa

SEQ ID NO: 53683 - RNA, 19 nt, Artificial Sequence
  Synthetic Oligonucleotide; BTLA exon 4; Set C
caucaagcuuaccagguua

SEQ ID NO: 53684 - RNA, 15 nt, Artificial Sequence
  Synthetic Oligonucleotide; BTLA exon 4; Set C
uucaacagcuacauc

SEQ ID NO: 53685 - RNA, 27 nt, Artificial Sequence
  Synthetic Oligonucleotide; BTLA exon 4; Set C
aauugcauuuguuucaacagcuacauc

SEQ ID NO: 53686 - RNA, 28 nt, Artificial Sequence
  Synthetic Oligonucleotide; BTLA exon 4; Set C
aaauugcauuuguuucaacagcuacauc

SEQ ID NO: 53687 - RNA, 26 nt, Artificial Sequence
  Synthetic Oligonucleotide; BTLA exon 4; Set C
aauugcauuuguuucaacagcuacau

SEQ ID NO: 53688 - RNA, 27 nt, Artificial Sequence
  Synthetic Oligonucleotide; BTLA exon 4; Set C
aaauugcauuuguuucaacagcuacau

SEQ ID NO: 53689 - RNA, 26 nt, Artificial Sequence
  Synthetic Oligonucleotide; BTLA exon 4; Set C
aaauugcauuuguuucaacagcuaca

SEQ ID NO: 53690 - RNA, 15 nt, Artificial Sequence
  Synthetic Oligonucleotide; BTLA exon 4; Set C
auugcauuuguuuca

SEQ ID NO: 53691 - RNA, 20 nt, Artificial Sequence
  Synthetic Oligonucleotide; CD80 exon 2; Set C
gaaggaaggugugccuacuu

SEQ ID NO: 53692 - RNA, 23 nt, Artificial Sequence
  Synthetic Oligonucleotide; CD80 exon 2; Set C
aaagucauucaggaaggaaggug

SEQ ID NO: 53693 - RNA, 24 nt, Artificial Sequence
  Synthetic Oligonucleotide; CD80 exon 2; Set C
aaaagucauucaggaaggaaggug

SEQ ID NO: 53694 - RNA, 22 nt, Artificial Sequence
  Synthetic Oligonucleotide; CD80 exon 2; Set C
aaagucauucaggaaggaaggu

SEQ ID NO: 53695 - RNA, 25 nt, Artificial Sequence
  Synthetic Oligonucleotide; CD80 exon 2; Set C
uaaaagucauucaggaaggaaggug

SEQ ID NO: 53696 - RNA, 23 nt, Artificial Sequence
  Synthetic Oligonucleotide; CD80 exon 2; Set C
aaaagucauucaggaaggaaggu

SEQ ID NO: 53697 - RNA, 27 nt, Artificial Sequence
  Synthetic Oligonucleotide; CD80 exon 2; Set C
auaaaagucauucaggaaggaaggugu

SEQ ID NO: 53698 - RNA, 26 nt, Artificial Sequence
  Synthetic Oligonucleotide; CD80 exon 2; Set C
auaaaagucauucaggaaggaaggug

SEQ ID NO: 53699 - RNA, 24 nt, Artificial Sequence
  Synthetic Oligonucleotide; CD80 exon 2; Set C
uaaaagucauucaggaaggaaggu

SEQ ID NO: 53700 - RNA, 22 nt, Artificial Sequence
  Synthetic Oligonucleotide; CD80 exon 2; Set C
aaaagucauucaggaaggaagg

SEQ ID NO: 53701 - RNA, 28 nt, Artificial Sequence
  Synthetic Oligonucleotide; CD80 exon 2; Set C
aauaaaagucauucaggaaggaaggugu

SEQ ID NO: 53702 - RNA, 27 nt, Artificial Sequence
  Synthetic Oligonucleotide; CD80 exon 2; Set C
aauaaaagucauucaggaaggaaggug

SEQ ID NO: 53703 - RNA, 25 nt, Artificial Sequence
  Synthetic Oligonucleotide; CD80 exon 2; Set C
auaaaagucauucaggaaggaaggu

SEQ ID NO: 53704 - RNA, 23 nt, Artificial Sequence
  Synthetic Oligonucleotide; CD80 exon 2; Set C
uaaaagucauucaggaaggaagg

SEQ ID NO: 53705 - RNA, 29 nt, Artificial Sequence
  Synthetic Oligonucleotide; CD80 exon 2; Set C
aaauaaaagucauucaggaaggaaggugu

SEQ ID NO: 53706 - RNA, 28 nt, Artificial Sequence
  Synthetic Oligonucleotide; CD80 exon 2; Set C
aaauaaaagucauucaggaaggaaggug

SEQ ID NO: 53707 - RNA, 26 nt, Artificial Sequence
  Synthetic Oligonucleotide; CD80 exon 2; Set C
aauaaaagucauucaggaaggaaggu

SEQ ID NO: 53708 - RNA, 22 nt, Artificial Sequence
  Synthetic Oligonucleotide; CD80 exon 2; Set C
uaaaagucauucaggaaggaag

SEQ ID NO: 53709 - RNA, 24 nt, Artificial Sequence
  Synthetic Oligonucleotide; CD80 exon 2; Set C
auaaaagucauucaggaaggaagg

SEQ ID NO: 53710 - RNA, 27 nt, Artificial Sequence
  Synthetic Oligonucleotide; CD80 exon 2; Set C
aaauaaaagucauucaggaaggaaggu

SEQ ID NO: 53711 - RNA, 23 nt, Artificial Sequence
  Synthetic Oligonucleotide; CD80 exon 2; Set C
auaaaagucauucaggaaggaag

SEQ ID NO: 53712 - RNA, 21 nt, Artificial Sequence
  Synthetic Oligonucleotide; CD80 exon 2; Set C
uaaaagucauucaggaaggaa

SEQ ID NO: 53713 - RNA, 25 nt, Artificial Sequence
  Synthetic Oligonucleotide; CD80 exon 2; Set C
aauaaaagucauucaggaaggaagg

SEQ ID NO: 53714 - RNA, 20 nt, Artificial Sequence
  Synthetic Oligonucleotide; CD80 exon 2; Set C
uaaaagucauucaggaagga

SEQ ID NO: 53715 - RNA, 24 nt, Artificial Sequence
  Synthetic Oligonucleotide; CD80 exon 2; Set C
aauaaaagucauucaggaaggaag

SEQ ID NO: 53716 - RNA, 22 nt, Artificial Sequence
  Synthetic Oligonucleotide; CD80 exon 2; Set C
auaaaagucauucaggaaggaa

SEQ ID NO: 53717 - RNA, 26 nt, Artificial Sequence
  Synthetic Oligonucleotide; CD80 exon 2; Set C
aaauaaaagucauucaggaaggaagg

SEQ ID NO: 53718 - RNA, 21 nt, Artificial Sequence
  Synthetic Oligonucleotide; CD80 exon 2; Set C
auaaaagucauucaggaagga

SEQ ID NO: 53719 - RNA, 25 nt, Artificial Sequence
  Synthetic Oligonucleotide; CD80 exon 2; Set C
aaauaaaagucauucaggaaggaag

SEQ ID NO: 53720 - RNA, 23 nt, Artificial Sequence
  Synthetic Oligonucleotide; CD80 exon 2; Set C
aauaaaagucauucaggaaggaa

SEQ ID NO: 53721 - RNA, 20 nt, Artificial Sequence
  Synthetic Oligonucleotide; CD80 exon 2; Set C
auaaaagucauucaggaagg

SEQ ID NO: 53722 - RNA, 22 nt, Artificial Sequence
  Synthetic Oligonucleotide; CD80 exon 2; Set C
aauaaaagucauucaggaagga

SEQ ID NO: 53723 - RNA, 24 nt, Artificial Sequence
  Synthetic Oligonucleotide; CD80 exon 2; Set C
aaauaaaagucauucaggaaggaa

SEQ ID NO: 53724 - RNA, 21 nt, Artificial Sequence
  Synthetic Oligonucleotide; CD80 exon 2; Set C
aauaaaagucauucaggaagg

SEQ ID NO: 53725 - RNA, 23 nt, Artificial Sequence
  Synthetic Oligonucleotide; CD80 exon 2; Set C
aaauaaaagucauucaggaagga

SEQ ID NO: 53726 - RNA, 20 nt, Artificial Sequence
  Synthetic Oligonucleotide; CD80 exon 2; Set C
aauaaaagucauucaggaag

SEQ ID NO: 53727 - RNA, 22 nt, Artificial Sequence
  Synthetic Oligonucleotide; CD80 exon 2; Set C
aaauaaaagucauucaggaagg

SEQ ID NO: 53728 - RNA, 35 nt, Artificial Sequence
  Synthetic Oligonucleotide; CD80 exon 2; Set C
aaggaacaaauaaaagucauucaggaaggaaggug

SEQ ID NO: 53729 - RNA, 21 nt, Artificial Sequence
  Synthetic Oligonucleotide; CD80 exon 2; Set C
aaauaaaagucauucaggaag

SEQ ID NO: 53730 - RNA, 36 nt, Artificial Sequence
  Synthetic Oligonucleotide; CD80 exon 2; Set C
aaaggaacaaauaaaagucauucaggaaggaaggug

SEQ ID NO: 53731 - RNA, 20 nt, Artificial Sequence
  Synthetic Oligonucleotide; CD80 exon 2; Set C
aaauaaaagucauucaggaa

SEQ ID NO: 53732 - RNA, 35 nt, Artificial Sequence
  Synthetic Oligonucleotide; CD80 exon 2; Set C
aaaggaacaaauaaaagucauucaggaaggaaggu

SEQ ID NO: 53733 - RNA, 15 nt, Artificial Sequence
  Synthetic Oligonucleotide; CD80 exon 2; Set C
aaggaacaaauaaaa

SEQ ID NO: 53734 - RNA, 16 nt, Artificial Sequence
  Synthetic Oligonucleotide; CD80 exon 2; Set C
aaaggaacaaauaaaa

SEQ ID NO: 53735 - RNA, 15 nt, Artificial Sequence
  Synthetic Oligonucleotide; CD80 exon 2; Set C
aaaggaacaaauaaa

SEQ ID NO: 53736 - RNA, 17 nt, Artificial Sequence
  Synthetic Oligonucleotide; CD80 exon 2; Set C
agguuguggauuuaguu

SEQ ID NO: 53737 - RNA, 18 nt, Artificial Sequence
  Synthetic Oligonucleotide; CD80 exon 2; Set C
aagguuguggauuuaguu

SEQ ID NO: 53738 - RNA, 17 nt, Artificial Sequence
  Synthetic Oligonucleotide; CD80 exon 2; Set C
aagguuguggauuuagu

SEQ ID NO: 53739 - RNA, 15 nt, Artificial Sequence
  Synthetic Oligonucleotide; CD80 exon 2; Set C
gaaauugagguaugg

SEQ ID NO: 53740 - RNA, 16 nt, Artificial Sequence
  Synthetic Oligonucleotide; CD80 exon 2; Set C
agaaauugagguaugg

SEQ ID NO: 53741 - RNA, 15 nt, Artificial Sequence
  Synthetic Oligonucleotide; CD80 exon 2; Set C
agaaauugagguaug

SEQ ID NO: 53742 - RNA, 17 nt, Artificial Sequence
  Synthetic Oligonucleotide; CD80 exon 2; Set C
aagaaauugagguaugg

SEQ ID NO: 53743 - RNA, 16 nt, Artificial Sequence
  Synthetic Oligonucleotide; CD80 exon 2; Set C
aagaaauugagguaug

SEQ ID NO: 53744 - RNA, 18 nt, Artificial Sequence
  Synthetic Oligonucleotide; CD80 exon 2; Set C
aaagaaauugagguaugg

SEQ ID NO: 53745 - RNA, 15 nt, Artificial Sequence
  Synthetic Oligonucleotide; CD80 exon 2; Set C
aagaaauugagguau

SEQ ID NO: 53746 - RNA, 17 nt, Artificial Sequence
  Synthetic Oligonucleotide; CD80 exon 2; Set C
aaagaaauugagguaug

SEQ ID NO: 53747 - RNA, 19 nt, Artificial Sequence
  Synthetic Oligonucleotide; CD80 exon 2; Set C
gaaagaaauugagguaugg

SEQ ID NO: 53748 - RNA, 16 nt, Artificial Sequence
  Synthetic Oligonucleotide; CD80 exon 2; Set C
aaagaaauugagguau

SEQ ID NO: 53749 - RNA, 18 nt, Artificial Sequence
  Synthetic Oligonucleotide; CD80 exon 2; Set C
gaaagaaauugagguaug

SEQ ID NO: 53750 - RNA, 20 nt, Artificial Sequence
  Synthetic Oligonucleotide; CD80 exon 2; Set C
ugaaagaaauugagguaugg

SEQ ID NO: 53751 - RNA, 17 nt, Artificial Sequence
  Synthetic Oligonucleotide; CD80 exon 2; Set C
gaaagaaauugagguau

SEQ ID NO: 53752 - RNA, 19 nt, Artificial Sequence
  Synthetic Oligonucleotide; CD80 exon 2; Set C
ugaaagaaauugagguaug

SEQ ID NO: 53753 - RNA, 15 nt, Artificial Sequence
  Synthetic Oligonucleotide; CD80 exon 2; Set C
aaagaaauugaggua

SEQ ID NO: 53754 - RNA, 18 nt, Artificial Sequence
  Synthetic Oligonucleotide; CD80 exon 2; Set C
ugaaagaaauugagguau

SEQ ID NO: 53755 - RNA, 16 nt, Artificial Sequence
  Synthetic Oligonucleotide; CD80 exon 2; Set C
gaaagaaauugaggua

SEQ ID NO: 53756 - RNA, 17 nt, Artificial Sequence
  Synthetic Oligonucleotide; CD80 exon 2; Set C
ugaaagaaauugaggua

SEQ ID NO: 53757 - RNA, 15 nt, Artificial Sequence
  Synthetic Oligonucleotide; CD80 exon 2; Set C
gaaagaaauugaggu

SEQ ID NO: 53758 - RNA, 16 nt, Artificial Sequence
  Synthetic Oligonucleotide; CD80 exon 2; Set C
ugaaagaaauugaggu

SEQ ID NO: 53759 - RNA, 25 nt, Artificial Sequence
  Synthetic Oligonucleotide; CD80 exon 2; Set C
agagcugaaagaaauugagguaugg

SEQ ID NO: 53760 - RNA, 15 nt, Artificial Sequence
  Synthetic Oligonucleotide; CD80 exon 2; Set C
ugaaagaaauugagg

SEQ ID NO: 53761 - RNA, 24 nt, Artificial Sequence
  Synthetic Oligonucleotide; CD80 exon 2; Set C
agagcugaaagaaauugagguaug

SEQ ID NO: 53762 - RNA, 23 nt, Artificial Sequence
  Synthetic Oligonucleotide; CD80 exon 2; Set C
agagcugaaagaaauugagguau

SEQ ID NO: 53763 - RNA, 25 nt, Artificial Sequence
  Synthetic Oligonucleotide; CD80 exon 2; Set C
aagagcugaaagaaauugagguaug

SEQ ID NO: 53764 - RNA, 24 nt, Artificial Sequence
  Synthetic Oligonucleotide; CD80 exon 2; Set C
aagagcugaaagaaauugagguau

SEQ ID NO: 53765 - RNA, 31 nt, Artificial Sequence
  Synthetic Oligonucleotide; CD80 exon 2; Set B
gcaccaagagcugaaagaaauugagguaugg

SEQ ID NO: 53766 - RNA, 30 nt, Artificial Sequence
  Synthetic Oligonucleotide; CD80 exon 2; Set B
gcaccaagagcugaaagaaauugagguaug

SEQ ID NO: 53767 - RNA, 29 nt, Artificial Sequence
  Synthetic Oligonucleotide; CD80 exon 2; Set B
gcaccaagagcugaaagaaauugagguau

SEQ ID NO: 53768 - RNA, 15 nt, Artificial Sequence
  Synthetic Oligonucleotide; CD80 exon 2; Set C
aaggugugccuacuu

SEQ ID NO: 53769 - RNA, 16 nt, Artificial Sequence
  Synthetic Oligonucleotide; CD80 exon 2; Set C
gaaggugugccuacuu

SEQ ID NO: 53770 - RNA, 17 nt, Artificial Sequence
  Synthetic Oligonucleotide; CD80 exon 2; Set C
ggaaggugugccuacuu

SEQ ID NO: 53771 - RNA, 15 nt, Artificial Sequence
  Synthetic Oligonucleotide; CD80 exon 2; Set C
gaaggugugccuacu

SEQ ID NO: 53772 - RNA, 18 nt, Artificial Sequence
  Synthetic Oligonucleotide; CD80 exon 2; Set C
aggaaggugugccuacuu

SEQ ID NO: 53773 - RNA, 16 nt, Artificial Sequence
  Synthetic Oligonucleotide; CD80 exon 2; Set C
ggaaggugugccuacu

SEQ ID NO: 53774 - RNA, 19 nt, Artificial Sequence
  Synthetic Oligonucleotide; CD80 exon 2; Set C
aaggaaggugugccuacuu

SEQ ID NO: 53775 - RNA, 17 nt, Artificial Sequence
  Synthetic Oligonucleotide; CD80 exon 2; Set C
aggaaggugugccuacu

SEQ ID NO: 53776 - RNA, 18 nt, Artificial Sequence
  Synthetic Oligonucleotide; CD80 exon 2; Set C
aaggaaggugugccuacu

SEQ ID NO: 53777 - RNA, 19 nt, Artificial Sequence
  Synthetic Oligonucleotide; CD80 exon 2; Set C
gaaggaaggugugccuacu

SEQ ID NO: 53778 - RNA, 32 nt, Artificial Sequence
  Synthetic Oligonucleotide; CD80 exon 2; Set A
aaagucauucaggaaggaaggugugccuacuu

SEQ ID NO: 53779 - RNA, 33 nt, Artificial Sequence
  Synthetic Oligonucleotide; CD80 exon 2; Set A
aaaagucauucaggaaggaaggugugccuacuu

SEQ ID NO: 53780 - RNA, 31 nt, Artificial Sequence
  Synthetic Oligonucleotide; CD80 exon 2; Set A
aaagucauucaggaaggaaggugugccuacu

SEQ ID NO: 53781 - RNA, 34 nt, Artificial Sequence
  Synthetic Oligonucleotide; CD80 exon 2; Set A
uaaaagucauucaggaaggaaggugugccuacuu

SEQ ID NO: 53782 - RNA, 32 nt, Artificial Sequence
  Synthetic Oligonucleotide; CD80 exon 2; Set A
aaaagucauucaggaaggaaggugugccuacu

SEQ ID NO: 53783 - RNA, 35 nt, Artificial Sequence
  Synthetic Oligonucleotide; CD80 exon 2; Set A
auaaaagucauucaggaaggaaggugugccuacuu

SEQ ID NO: 53784 - RNA, 33 nt, Artificial Sequence
  Synthetic Oligonucleotide; CD80 exon 2; Set A
uaaaagucauucaggaaggaaggugugccuacu

SEQ ID NO: 53785 - RNA, 36 nt, Artificial Sequence
  Synthetic Oligonucleotide; CD80 exon 2; Set A
aauaaaagucauucaggaaggaaggugugccuacuu

SEQ ID NO: 53786 - RNA, 34 nt, Artificial Sequence
  Synthetic Oligonucleotide; CD80 exon 2; Set A
auaaaagucauucaggaaggaaggugugccuacu

SEQ ID NO: 53787 - RNA, 37 nt, Artificial Sequence
  Synthetic Oligonucleotide; CD80 exon 2; Set A
aaauaaaagucauucaggaaggaaggugugccuacuu

SEQ ID NO: 53788 - RNA, 35 nt, Artificial Sequence
  Synthetic Oligonucleotide; CD80 exon 2; Set A
aauaaaagucauucaggaaggaaggugugccuacu

SEQ ID NO: 53789 - RNA, 36 nt, Artificial Sequence
  Synthetic Oligonucleotide; CD80 exon 2; Set A
aaauaaaagucauucaggaaggaaggugugccuacu

SEQ ID NO: 53790 - RNA, 25 nt, Artificial Sequence
  Synthetic Oligonucleotide; CD80 exon 2; Set C
aaagucauucaggaaggaaggugug

SEQ ID NO: 53791 - RNA, 24 nt, Artificial Sequence
  Synthetic Oligonucleotide; CD80 exon 2; Set C
aaagucauucaggaaggaaggugu

SEQ ID NO: 53792 - RNA, 26 nt, Artificial Sequence
  Synthetic Oligonucleotide; CD80 exon 2; Set C
aaaagucauucaggaaggaaggugug

SEQ ID NO: 53793 - RNA, 25 nt, Artificial Sequence
  Synthetic Oligonucleotide; CD80 exon 2; Set C
aaaagucauucaggaaggaaggugu

SEQ ID NO: 53794 - RNA, 27 nt, Artificial Sequence
  Synthetic Oligonucleotide; CD80 exon 2; Set C
uaaaagucauucaggaaggaaggugug

SEQ ID NO: 53795 - RNA, 26 nt, Artificial Sequence
  Synthetic Oligonucleotide; CD80 exon 2; Set C
uaaaagucauucaggaaggaaggugu

SEQ ID NO: 53796 - RNA, 28 nt, Artificial Sequence
  Synthetic Oligonucleotide; CD80 exon 2; Set C
auaaaagucauucaggaaggaaggugug

SEQ ID NO: 53797 - RNA, 21 nt, Artificial Sequence
  Synthetic Oligonucleotide; CD80 exon 2; Set C
aaagucauucaggaaggaagg

SEQ ID NO: 53798 - RNA, 29 nt, Artificial Sequence
  Synthetic Oligonucleotide; CD80 exon 2; Set C
aauaaaagucauucaggaaggaaggugug

SEQ ID NO: 53799 - RNA, 20 nt, Artificial Sequence
  Synthetic Oligonucleotide; CD80 exon 2; Set C
aaagucauucaggaaggaag

SEQ ID NO: 53800 - RNA, 30 nt, Artificial Sequence
  Synthetic Oligonucleotide; CD80 exon 2; Set C
aaauaaaagucauucaggaaggaaggugug

SEQ ID NO: 53801 - RNA, 21 nt, Artificial Sequence
  Synthetic Oligonucleotide; CD80 exon 2; Set C
aaaagucauucaggaaggaag

SEQ ID NO: 53802 - RNA, 19 nt, Artificial Sequence
  Synthetic Oligonucleotide; CD80 exon 2; Set C
aaagucauucaggaaggaa

SEQ ID NO: 53803 - RNA, 18 nt, Artificial Sequence
  Synthetic Oligonucleotide; CD80 exon 2; Set C
aaagucauucaggaagga

SEQ ID NO: 53804 - RNA, 20 nt, Artificial Sequence
  Synthetic Oligonucleotide; CD80 exon 2; Set C
aaaagucauucaggaaggaa

SEQ ID NO: 53805 - RNA, 17 nt, Artificial Sequence
  Synthetic Oligonucleotide; CD80 exon 2; Set C
aaagucauucaggaagg

SEQ ID NO: 53806 - RNA, 19 nt, Artificial Sequence
  Synthetic Oligonucleotide; CD80 exon 2; Set C
aaaagucauucaggaagga

SEQ ID NO: 53807 - RNA, 16 nt, Artificial Sequence
  Synthetic Oligonucleotide; CD80 exon 2; Set C
aaagucauucaggaag

SEQ ID NO: 53808 - RNA, 18 nt, Artificial Sequence
  Synthetic Oligonucleotide; CD80 exon 2; Set C
aaaagucauucaggaagg

SEQ ID NO: 53809 - RNA, 17 nt, Artificial Sequence
  Synthetic Oligonucleotide; CD80 exon 2; Set C
aaaagucauucaggaag

SEQ ID NO: 53810 - RNA, 19 nt, Artificial Sequence
  Synthetic Oligonucleotide; CD80 exon 2; Set C
uaaaagucauucaggaagg

SEQ ID NO: 53811 - RNA, 15 nt, Artificial Sequence
  Synthetic Oligonucleotide; CD80 exon 2; Set C
aaagucauucaggaa

SEQ ID NO: 53812 - RNA, 18 nt, Artificial Sequence
  Synthetic Oligonucleotide; CD80 exon 2; Set C
uaaaagucauucaggaag

SEQ ID NO: 53813 - RNA, 16 nt, Artificial Sequence
  Synthetic Oligonucleotide; CD80 exon 2; Set C
aaaagucauucaggaa

SEQ ID NO: 53814 - RNA, 36 nt, Artificial Sequence
  Synthetic Oligonucleotide; CD80 exon 2; Set A
aggaacaaauaaaagucauucaggaaggaaggugug

SEQ ID NO: 53815 - RNA, 19 nt, Artificial Sequence
  Synthetic Oligonucleotide; CD80 exon 2; Set C
auaaaagucauucaggaag

SEQ ID NO: 53816 - RNA, 17 nt, Artificial Sequence
  Synthetic Oligonucleotide; CD80 exon 2; Set C
uaaaagucauucaggaa

SEQ ID NO: 53817 - RNA, 35 nt, Artificial Sequence
  Synthetic Oligonucleotide; CD80 exon 2; Set A
aggaacaaauaaaagucauucaggaaggaaggugu

SEQ ID NO: 53818 - RNA, 37 nt, Artificial Sequence
  Synthetic Oligonucleotide; CD80 exon 2; Set A
aaggaacaaauaaaagucauucaggaaggaaggugug

SEQ ID NO: 53819 - RNA, 34 nt, Artificial Sequence
  Synthetic Oligonucleotide; CD80 exon 2; Set A
aggaacaaauaaaagucauucaggaaggaaggug

SEQ ID NO: 53820 - RNA, 18 nt, Artificial Sequence
  Synthetic Oligonucleotide; CD80 exon 2; Set C
auaaaagucauucaggaa

SEQ ID NO: 53821 - RNA, 36 nt, Artificial Sequence
  Synthetic Oligonucleotide; CD80 exon 2; Set A
aaggaacaaauaaaagucauucaggaaggaaggugu

SEQ ID NO: 53822 - RNA, 38 nt, Artificial Sequence
  Synthetic Oligonucleotide; CD80 exon 2; Set A
aaaggaacaaauaaaagucauucaggaaggaaggugug

SEQ ID NO: 53823 - RNA, 19 nt, Artificial Sequence
  Synthetic Oligonucleotide; CD80 exon 2; Set C
aauaaaagucauucaggaa

SEQ ID NO: 53824 - RNA, 33 nt, Artificial Sequence
  Synthetic Oligonucleotide; CD80 exon 2; Set C
aggaacaaauaaaagucauucaggaaggaaggu

SEQ ID NO: 53825 - RNA, 37 nt, Artificial Sequence
  Synthetic Oligonucleotide; CD80 exon 2; Set A
aaaggaacaaauaaaagucauucaggaaggaaggugu

SEQ ID NO: 53826 - RNA, 34 nt, Artificial Sequence
  Synthetic Oligonucleotide; CD80 exon 2; Set C
aaggaacaaauaaaagucauucaggaaggaaggu

SEQ ID NO: 53827 - RNA, 32 nt, Artificial Sequence
  Synthetic Oligonucleotide; CD80 exon 2; Set C
aggaacaaauaaaagucauucaggaaggaagg

SEQ ID NO: 53828 - RNA, 31 nt, Artificial Sequence
  Synthetic Oligonucleotide; CD80 exon 2; Set C
aggaacaaauaaaagucauucaggaaggaag

SEQ ID NO: 53829 - RNA, 33 nt, Artificial Sequence
  Synthetic Oligonucleotide; CD80 exon 2; Set C
aaggaacaaauaaaagucauucaggaaggaagg

SEQ ID NO: 53830 - RNA, 32 nt, Artificial Sequence
  Synthetic Oligonucleotide; CD80 exon 2; Set C
aaggaacaaauaaaagucauucaggaaggaag

SEQ ID NO: 53831 - RNA, 30 nt, Artificial Sequence
  Synthetic Oligonucleotide; CD80 exon 2; Set C
aggaacaaauaaaagucauucaggaaggaa

SEQ ID NO: 53832 - RNA, 34 nt, Artificial Sequence
  Synthetic Oligonucleotide; CD80 exon 2; Set C
aaaggaacaaauaaaagucauucaggaaggaagg

SEQ ID NO: 53833 - RNA, 29 nt, Artificial Sequence
  Synthetic Oligonucleotide; CD80 exon 2; Set C
aggaacaaauaaaagucauucaggaagga

SEQ ID NO: 53834 - RNA, 33 nt, Artificial Sequence
  Synthetic Oligonucleotide; CD80 exon 2; Set C
aaaggaacaaauaaaagucauucaggaaggaag

SEQ ID NO: 53835 - RNA, 31 nt, Artificial Sequence
  Synthetic Oligonucleotide; CD80 exon 2; Set C
aaggaacaaauaaaagucauucaggaaggaa

SEQ ID NO: 53836 - RNA, 28 nt, Artificial Sequence
  Synthetic Oligonucleotide; CD80 exon 2; Set C
aggaacaaauaaaagucauucaggaagg

SEQ ID NO: 53837 - RNA, 30 nt, Artificial Sequence
  Synthetic Oligonucleotide; CD80 exon 2; Set C
aaggaacaaauaaaagucauucaggaagga

SEQ ID NO: 53838 - RNA, 32 nt, Artificial Sequence
  Synthetic Oligonucleotide; CD80 exon 2; Set C
aaaggaacaaauaaaagucauucaggaaggaa

SEQ ID NO: 53839 - RNA, 27 nt, Artificial Sequence
  Synthetic Oligonucleotide; CD80 exon 2; Set C
aggaacaaauaaaagucauucaggaag

SEQ ID NO: 53840 - RNA, 29 nt, Artificial Sequence
  Synthetic Oligonucleotide; CD80 exon 2; Set C
aaggaacaaauaaaagucauucaggaagg

SEQ ID NO: 53841 - RNA, 31 nt, Artificial Sequence
  Synthetic Oligonucleotide; CD80 exon 2; Set C
aaaggaacaaauaaaagucauucaggaagga

SEQ ID NO: 53842 - RNA, 28 nt, Artificial Sequence
  Synthetic Oligonucleotide; CD80 exon 2; Set C
aaggaacaaauaaaagucauucaggaag

SEQ ID NO: 53843 - RNA, 30 nt, Artificial Sequence
  Synthetic Oligonucleotide; CD80 exon 2; Set C
aaaggaacaaauaaaagucauucaggaagg

SEQ ID NO: 53844 - RNA, 26 nt, Artificial Sequence
  Synthetic Oligonucleotide; CD80 exon 2; Set C
aggaacaaauaaaagucauucaggaa

SEQ ID NO: 53845 - RNA, 29 nt, Artificial Sequence
  Synthetic Oligonucleotide; CD80 exon 2; Set C
aaaggaacaaauaaaagucauucaggaag

SEQ ID NO: 53846 - RNA, 27 nt, Artificial Sequence
  Synthetic Oligonucleotide; CD80 exon 2; Set C
aaggaacaaauaaaagucauucaggaa

SEQ ID NO: 53847 - RNA, 28 nt, Artificial Sequence
  Synthetic Oligonucleotide; CD80 exon 2; Set C
aaaggaacaaauaaaagucauucaggaa

SEQ ID NO: 53848 - RNA, 33 nt, Artificial Sequence
  Synthetic Oligonucleotide; CD80 exon 2; Set C
uaguuucacagccugaaaaaggaacaaauaaaa

SEQ ID NO: 53849 - RNA, 34 nt, Artificial Sequence
  Synthetic Oligonucleotide; CD80 exon 2; Set C
uuaguuucacagccugaaaaaggaacaaauaaaa

SEQ ID NO: 53850 - RNA, 33 nt, Artificial Sequence
  Synthetic Oligonucleotide; CD80 exon 2; Set C
uuaguuucacagccugaaaaaggaacaaauaaa

SEQ ID NO: 53851 - RNA, 35 nt, Artificial Sequence
  Synthetic Oligonucleotide; CD80 exon 2; Set C
uuuaguuucacagccugaaaaaggaacaaauaaaa

SEQ ID NO: 53852 - RNA, 36 nt, Artificial Sequence
  Synthetic Oligonucleotide; CD80 exon 2; Set C
auuuaguuucacagccugaaaaaggaacaaauaaaa

SEQ ID NO: 53853 - RNA, 34 nt, Artificial Sequence
  Synthetic Oligonucleotide; CD80 exon 2; Set C
uuuaguuucacagccugaaaaaggaacaaauaaa

SEQ ID NO: 53854 - RNA, 33 nt, Artificial Sequence
  Synthetic Oligonucleotide; CD80 exon 2; Set C
uuuaguuucacagccugaaaaaggaacaaauaa

SEQ ID NO: 53855 - RNA, 37 nt, Artificial Sequence
  Synthetic Oligonucleotide; CD80 exon 2; Set C
gauuuaguuucacagccugaaaaaggaacaaauaaaa

SEQ ID NO: 53856 - RNA, 35 nt, Artificial Sequence
  Synthetic Oligonucleotide; CD80 exon 2; Set C
auuuaguuucacagccugaaaaaggaacaaauaaa

SEQ ID NO: 53857 - RNA, 34 nt, Artificial Sequence
  Synthetic Oligonucleotide; CD80 exon 2; Set C
auuuaguuucacagccugaaaaaggaacaaauaa

SEQ ID NO: 53858 - RNA, 36 nt, Artificial Sequence
  Synthetic Oligonucleotide; CD80 exon 2; Set C
gauuuaguuucacagccugaaaaaggaacaaauaaa

SEQ ID NO: 53859 - RNA, 35 nt, Artificial Sequence
  Synthetic Oligonucleotide; CD80 exon 2; Set C
gauuuaguuucacagccugaaaaaggaacaaauaa

SEQ ID NO: 53860 - RNA, 33 nt, Artificial Sequence
  Synthetic Oligonucleotide; CD80 exon 2; Set C
auuuaguuucacagccugaaaaaggaacaaaua

SEQ ID NO: 53861 - RNA, 34 nt, Artificial Sequence
  Synthetic Oligonucleotide; CD80 exon 2; Set A
gauuuaguuucacagccugaaaaaggaacaaaua

SEQ ID NO: 53862 - RNA, 33 nt, Artificial Sequence
  Synthetic Oligonucleotide; CD80 exon 2; Set C
gauuuaguuucacagccugaaaaaggaacaaau

SEQ ID NO: 53863 - RNA, 16 nt, Artificial Sequence
  Synthetic Oligonucleotide; CD80 exon 2; Set C
guuguggauuuaguuu

SEQ ID NO: 53864 - RNA, 15 nt, Artificial Sequence
  Synthetic Oligonucleotide; CD80 exon 2; Set C
guuguggauuuaguu

SEQ ID NO: 53865 - RNA, 17 nt, Artificial Sequence
  Synthetic Oligonucleotide; CD80 exon 2; Set C
gguuguggauuuaguuu

SEQ ID NO: 53866 - RNA, 16 nt, Artificial Sequence
  Synthetic Oligonucleotide; CD80 exon 2; Set C
gguuguggauuuaguu

SEQ ID NO: 53867 - RNA, 18 nt, Artificial Sequence
  Synthetic Oligonucleotide; CD80 exon 2; Set C
agguuguggauuuaguuu

SEQ ID NO: 53868 - RNA, 15 nt, Artificial Sequence
  Synthetic Oligonucleotide; CD80 exon 2; Set C
gguuguggauuuagu

SEQ ID NO: 53869 - RNA, 19 nt, Artificial Sequence
  Synthetic Oligonucleotide; CD80 exon 2; Set C
aagguuguggauuuaguuu

SEQ ID NO: 53870 - RNA, 16 nt, Artificial Sequence
  Synthetic Oligonucleotide; CD80 exon 2; Set C
agguuguggauuuagu

SEQ ID NO: 53871 - RNA, 20 nt, Artificial Sequence
  Synthetic Oligonucleotide; CD80 exon 2; Set C
aaagguuguggauuuaguuu

SEQ ID NO: 53872 - RNA, 19 nt, Artificial Sequence
  Synthetic Oligonucleotide; CD80 exon 2; Set C
aaagguuguggauuuaguu

SEQ ID NO: 53873 - RNA, 15 nt, Artificial Sequence
  Synthetic Oligonucleotide; CD80 exon 2; Set C
agguuguggauuuag

SEQ ID NO: 53874 - RNA, 16 nt, Artificial Sequence
  Synthetic Oligonucleotide; CD80 exon 2; Set C
aagguuguggauuuag

SEQ ID NO: 53875 - RNA, 18 nt, Artificial Sequence
  Synthetic Oligonucleotide; CD80 exon 2; Set C
aaagguuguggauuuagu

SEQ ID NO: 53876 - RNA, 15 nt, Artificial Sequence
  Synthetic Oligonucleotide; CD80 exon 2; Set C
aagguuguggauuua

SEQ ID NO: 53877 - RNA, 17 nt, Artificial Sequence
  Synthetic Oligonucleotide; CD80 exon 2; Set C
aaagguuguggauuuag

SEQ ID NO: 53878 - RNA, 16 nt, Artificial Sequence
  Synthetic Oligonucleotide; CD80 exon 2; Set C
aaagguuguggauuua

SEQ ID NO: 53879 - RNA, 15 nt, Artificial Sequence
  Synthetic Oligonucleotide; CD80 exon 2; Set C
aaagguuguggauuu

SEQ ID NO: 53880 - RNA, 28 nt, Artificial Sequence
  Synthetic Oligonucleotide; CD80 exon 2; Set A
gggucuccaaagguuguggauuuaguuu

SEQ ID NO: 53881 - RNA, 27 nt, Artificial Sequence
  Synthetic Oligonucleotide; CD80 exon 2; Set A
gggucuccaaagguuguggauuuaguu

SEQ ID NO: 53882 - RNA, 29 nt, Artificial Sequence
  Synthetic Oligonucleotide; CD80 exon 2; Set A
ugggucuccaaagguuguggauuuaguuu

SEQ ID NO: 53883 - RNA, 28 nt, Artificial Sequence
  Synthetic Oligonucleotide; CD80 exon 2; Set A
ugggucuccaaagguuguggauuuaguu

SEQ ID NO: 53884 - RNA, 26 nt, Artificial Sequence
  Synthetic Oligonucleotide; CD80 exon 2; Set A
gggucuccaaagguuguggauuuagu

SEQ ID NO: 53885 - RNA, 25 nt, Artificial Sequence
  Synthetic Oligonucleotide; CD80 exon 2; Set A
gggucuccaaagguuguggauuuag

SEQ ID NO: 53886 - RNA, 27 nt, Artificial Sequence
  Synthetic Oligonucleotide; CD80 exon 2; Set A
ugggucuccaaagguuguggauuuagu

SEQ ID NO: 53887 - RNA, 24 nt, Artificial Sequence
  Synthetic Oligonucleotide; CD80 exon 2; Set A
gggucuccaaagguuguggauuua

SEQ ID NO: 53888 - RNA, 26 nt, Artificial Sequence
  Synthetic Oligonucleotide; CD80 exon 2; Set A
ugggucuccaaagguuguggauuuag

SEQ ID NO: 53889 - RNA, 25 nt, Artificial Sequence
  Synthetic Oligonucleotide; CD80 exon 2; Set A
ugggucuccaaagguuguggauuua

SEQ ID NO: 53890 - RNA, 23 nt, Artificial Sequence
  Synthetic Oligonucleotide; CD80 exon 2; Set A
gggucuccaaagguuguggauuu

SEQ ID NO: 53891 - RNA, 22 nt, Artificial Sequence
  Synthetic Oligonucleotide; CD80 exon 2; Set A
gggucuccaaagguuguggauu

SEQ ID NO: 53892 - RNA, 24 nt, Artificial Sequence
  Synthetic Oligonucleotide; CD80 exon 2; Set A
ugggucuccaaagguuguggauuu

SEQ ID NO: 53893 - RNA, 21 nt, Artificial Sequence
  Synthetic Oligonucleotide; CD80 exon 2; Set A
gggucuccaaagguuguggau

SEQ ID NO: 53894 - RNA, 23 nt, Artificial Sequence
  Synthetic Oligonucleotide; CD80 exon 2; Set A
ugggucuccaaagguuguggauu

SEQ ID NO: 53895 - RNA, 22 nt, Artificial Sequence
  Synthetic Oligonucleotide; CD80 exon 2; Set A
ugggucuccaaagguuguggau

SEQ ID NO: 53896 - RNA, 36 nt, Artificial Sequence
  Synthetic Oligonucleotide; CD80 exon 2; Set C
aacaggcagggcugaugacaauccaauugcucacgu

SEQ ID NO: 53897 - RNA, 37 nt, Artificial Sequence
  Synthetic Oligonucleotide; CD80 exon 2; Set C
aaacaggcagggcugaugacaauccaauugcucacgu

SEQ ID NO: 53898 - RNA, 38 nt, Artificial Sequence
  Synthetic Oligonucleotide; CD80 exon 2; Set C
aaaacaggcagggcugaugacaauccaauugcucacgu

SEQ ID NO: 53899 - RNA, 39 nt, Artificial Sequence
  Synthetic Oligonucleotide; CD80 exon 2; Set C
caaaacaggcagggcugaugacaauccaauugcucacgu

SEQ ID NO: 53900 - RNA, 40 nt, Artificial Sequence
  Synthetic Oligonucleotide; CD80 exon 2; Set C
gcaaaacaggcagggcugaugacaauccaauugcucacgu

SEQ ID NO: 53901 - RNA, 38 nt, Artificial Sequence
  Synthetic Oligonucleotide; CD80 exon 2; Set C
caaaacaggcagggcugaugacaauccaauugcucacg

SEQ ID NO: 53902 - RNA, 39 nt, Artificial Sequence
  Synthetic Oligonucleotide; CD80 exon 2; Set C
gcaaaacaggcagggcugaugacaauccaauugcucacg

SEQ ID NO: 53903 - RNA, 27 nt, Artificial Sequence
  Synthetic Oligonucleotide; CD80 exon 2; Set A
aacaggcagggcugaugacaauccaau

SEQ ID NO: 53904 - RNA, 28 nt, Artificial Sequence
  Synthetic Oligonucleotide; CD80 exon 2; Set A
aaacaggcagggcugaugacaauccaau

SEQ ID NO: 53905 - RNA, 29 nt, Artificial Sequence
  Synthetic Oligonucleotide; CD80 exon 2; Set A
aaaacaggcagggcugaugacaauccaau

SEQ ID NO: 53906 - RNA, 30 nt, Artificial Sequence
  Synthetic Oligonucleotide; CD80 exon 2; Set A
caaaacaggcagggcugaugacaauccaau

SEQ ID NO: 53907 - RNA, 28 nt, Artificial Sequence
  Synthetic Oligonucleotide; CD80 exon 2; Set A
aaaacaggcagggcugaugacaauccaa

SEQ ID NO: 53908 - RNA, 31 nt, Artificial Sequence
  Synthetic Oligonucleotide; CD80 exon 2; Set C
gcaaaacaggcagggcugaugacaauccaau

SEQ ID NO: 53909 - RNA, 29 nt, Artificial Sequence
  Synthetic Oligonucleotide; CD80 exon 2; Set A
caaaacaggcagggcugaugacaauccaa

SEQ ID NO: 53910 - RNA, 32 nt, Artificial Sequence
  Synthetic Oligonucleotide; CD80 exon 2; Set C
ugcaaaacaggcagggcugaugacaauccaau

SEQ ID NO: 53911 - RNA, 30 nt, Artificial Sequence
  Synthetic Oligonucleotide; CD80 exon 2; Set C
gcaaaacaggcagggcugaugacaauccaa

SEQ ID NO: 53912 - RNA, 33 nt, Artificial Sequence
  Synthetic Oligonucleotide; CD80 exon 2; Set C
gugcaaaacaggcagggcugaugacaauccaau

SEQ ID NO: 53913 - RNA, 31 nt, Artificial Sequence
  Synthetic Oligonucleotide; CD80 exon 2; Set C
ugcaaaacaggcagggcugaugacaauccaa

SEQ ID NO: 53914 - RNA, 32 nt, Artificial Sequence
  Synthetic Oligonucleotide; CD80 exon 2; Set C
gugcaaaacaggcagggcugaugacaauccaa

SEQ ID NO: 53915 - RNA, 39 nt, Artificial Sequence
  Synthetic Oligonucleotide; CD80 exon 2; Set C
ucccaggugcaaaacaggcagggcugaugacaauccaau

SEQ ID NO: 53916 - RNA, 40 nt, Artificial Sequence
  Synthetic Oligonucleotide; CD80 exon 2; Set C
uucccaggugcaaaacaggcagggcugaugacaauccaau

SEQ ID NO: 53917 - RNA, 16 nt, Artificial Sequence
  Synthetic Oligonucleotide; CD80 exon 2; Set C
aaaacaggcagggcug

SEQ ID NO: 53918 - RNA, 17 nt, Artificial Sequence
  Synthetic Oligonucleotide; CD80 exon 2; Set C
caaaacaggcagggcug

SEQ ID NO: 53919 - RNA, 18 nt, Artificial Sequence
  Synthetic Oligonucleotide; CD80 exon 2; Set C
gcaaaacaggcagggcug

SEQ ID NO: 53920 - RNA, 19 nt, Artificial Sequence
  Synthetic Oligonucleotide; CD80 exon 2; Set A
ugcaaaacaggcagggcug

SEQ ID NO: 53921 - RNA, 20 nt, Artificial Sequence
  Synthetic Oligonucleotide; CD80 exon 2; Set A
gugcaaaacaggcagggcug

SEQ ID NO: 53922 - RNA, 15 nt, Artificial Sequence
  Synthetic Oligonucleotide; CD80 exon 2; Set C
gcaaaacaggcaggg

SEQ ID NO: 53923 - RNA, 17 nt, Artificial Sequence
  Synthetic Oligonucleotide; CD80 exon 2; Set C
gugcaaaacaggcaggg

SEQ ID NO: 53924 - RNA, 15 nt, Artificial Sequence
  Synthetic Oligonucleotide; CD80 exon 2; Set C
ucccaggugcaaaac

SEQ ID NO: 53925 - RNA, 16 nt, Artificial Sequence
  Synthetic Oligonucleotide; CD80 exon 2; Set C
uucccaggugcaaaac

SEQ ID NO: 53926 - RNA, 15 nt, Artificial Sequence
  Synthetic Oligonucleotide; CD80 exon 2; Set C
uucccaggugcaaaa

SEQ ID NO: 53927 - RNA, 27 nt, Artificial Sequence
  Synthetic Oligonucleotide; CD80 exon 2; Set C
augcuuagggucaaaagugaaagccaa

SEQ ID NO: 53928 - RNA, 26 nt, Artificial Sequence
  Synthetic Oligonucleotide; CD80 exon 2; Set A
augcuuagggucaaaagugaaagcca

SEQ ID NO: 53929 - RNA, 28 nt, Artificial Sequence
  Synthetic Oligonucleotide; CD80 exon 2; Set A
gaugcuuagggucaaaagugaaagccaa

SEQ ID NO: 53930 - RNA, 27 nt, Artificial Sequence
  Synthetic Oligonucleotide; CD80 exon 2; Set A
gaugcuuagggucaaaagugaaagcca

SEQ ID NO: 53931 - RNA, 25 nt, Artificial Sequence
  Synthetic Oligonucleotide; CD80 exon 2; Set C
augcuuagggucaaaagugaaagcc

SEQ ID NO: 53932 - RNA, 26 nt, Artificial Sequence
  Synthetic Oligonucleotide; CD80 exon 2; Set A
gaugcuuagggucaaaagugaaagcc

SEQ ID NO: 53933 - RNA, 22 nt, Artificial Sequence
  Synthetic Oligonucleotide; CD80 exon 2; Set B
uggacacuuggauggugauguu

SEQ ID NO: 53934 - RNA, 23 nt, Artificial Sequence
  Synthetic Oligonucleotide; CD80 exon 2; Set B
auggacacuuggauggugauguu

SEQ ID NO: 53935 - RNA, 24 nt, Artificial Sequence
  Synthetic Oligonucleotide; CD80 exon 2; Set B
uauggacacuuggauggugauguu

SEQ ID NO: 53936 - RNA, 25 nt, Artificial Sequence
  Synthetic Oligonucleotide; CD80 exon 2; Set B
guauggacacuuggauggugauguu

SEQ ID NO: 53937 - RNA, 26 nt, Artificial Sequence
  Synthetic Oligonucleotide; CD80 exon 2; Set B
gguauggacacuuggauggugauguu

SEQ ID NO: 53938 - RNA, 27 nt, Artificial Sequence
  Synthetic Oligonucleotide; CD80 exon 2; Set B
agguauggacacuuggauggugauguu

SEQ ID NO: 53939 - RNA, 28 nt, Artificial Sequence
  Synthetic Oligonucleotide; CD80 exon 2; Set C
gagguauggacacuuggauggugauguu

SEQ ID NO: 53940 - RNA, 29 nt, Artificial Sequence
  Synthetic Oligonucleotide; CD80 exon 2; Set C
ugagguauggacacuuggauggugauguu

SEQ ID NO: 53941 - RNA, 30 nt, Artificial Sequence
  Synthetic Oligonucleotide; CD80 exon 2; Set C
uugagguauggacacuuggauggugauguu

SEQ ID NO: 53942 - RNA, 31 nt, Artificial Sequence
  Synthetic Oligonucleotide; CD80 exon 2; Set C
auugagguauggacacuuggauggugauguu

SEQ ID NO: 53943 - RNA, 32 nt, Artificial Sequence
  Synthetic Oligonucleotide; CD80 exon 2; Set B
aauugagguauggacacuuggauggugauguu

SEQ ID NO: 53944 - RNA, 33 nt, Artificial Sequence
  Synthetic Oligonucleotide; CD80 exon 2; Set B
aaauugagguauggacacuuggauggugauguu

SEQ ID NO: 53945 - RNA, 34 nt, Artificial Sequence
  Synthetic Oligonucleotide; CD80 exon 2; Set C
gaaauugagguauggacacuuggauggugauguu

SEQ ID NO: 53946 - RNA, 35 nt, Artificial Sequence
  Synthetic Oligonucleotide; CD80 exon 2; Set B
agaaauugagguauggacacuuggauggugauguu

SEQ ID NO: 53947 - RNA, 36 nt, Artificial Sequence
  Synthetic Oligonucleotide; CD80 exon 2; Set B
aagaaauugagguauggacacuuggauggugauguu

SEQ ID NO: 53948 - RNA, 37 nt, Artificial Sequence
  Synthetic Oligonucleotide; CD80 exon 2; Set B
aaagaaauugagguauggacacuuggauggugauguu

SEQ ID NO: 53949 - RNA, 38 nt, Artificial Sequence
  Synthetic Oligonucleotide; CD80 exon 2; Set B
gaaagaaauugagguauggacacuuggauggugauguu

SEQ ID NO: 53950 - RNA, 39 nt, Artificial Sequence
  Synthetic Oligonucleotide; CD80 exon 2; Set B
ugaaagaaauugagguauggacacuuggauggugauguu

SEQ ID NO: 53951 - RNA, 15 nt, Artificial Sequence
  Synthetic Oligonucleotide; CD80 exon 2; Set C
aaauugagguaugga

SEQ ID NO: 53952 - RNA, 16 nt, Artificial Sequence
  Synthetic Oligonucleotide; CD80 exon 2; Set C
gaaauugagguaugga

SEQ ID NO: 53953 - RNA, 17 nt, Artificial Sequence
  Synthetic Oligonucleotide; CD80 exon 2; Set C
agaaauugagguaugga

SEQ ID NO: 53954 - RNA, 18 nt, Artificial Sequence
  Synthetic Oligonucleotide; CD80 exon 2; Set C
aagaaauugagguaugga

SEQ ID NO: 53955 - RNA, 19 nt, Artificial Sequence
  Synthetic Oligonucleotide; CD80 exon 2; Set C
aaagaaauugagguaugga

SEQ ID NO: 53956 - RNA, 20 nt, Artificial Sequence
  Synthetic Oligonucleotide; CD80 exon 2; Set C
gaaagaaauugagguaugga

SEQ ID NO: 53957 - RNA, 21 nt, Artificial Sequence
  Synthetic Oligonucleotide; CD80 exon 2; Set C
ugaaagaaauugagguaugga

SEQ ID NO: 53958 - RNA, 26 nt, Artificial Sequence
  Synthetic Oligonucleotide; CD80 exon 2; Set C
agagcugaaagaaauugagguaugga

SEQ ID NO: 53959 - RNA, 27 nt, Artificial Sequence
  Synthetic Oligonucleotide; CD80 exon 2; Set C
aagagcugaaagaaauugagguaugga

SEQ ID NO: 53960 - RNA, 26 nt, Artificial Sequence
  Synthetic Oligonucleotide; CD80 exon 2; Set C
aagagcugaaagaaauugagguaugg

SEQ ID NO: 53961 - RNA, 27 nt, Artificial Sequence
  Synthetic Oligonucleotide; CD80 exon 2; Set C
caagagcugaaagaaauugagguaugg

SEQ ID NO: 53962 - RNA, 26 nt, Artificial Sequence
  Synthetic Oligonucleotide; CD80 exon 2; Set C
caagagcugaaagaaauugagguaug

SEQ ID NO: 53963 - RNA, 22 nt, Artificial Sequence
  Synthetic Oligonucleotide; CD80 exon 2; Set C
agagcugaaagaaauugaggua

SEQ ID NO: 53964 - RNA, 25 nt, Artificial Sequence
  Synthetic Oligonucleotide; CD80 exon 2; Set C
caagagcugaaagaaauugagguau

SEQ ID NO: 53965 - RNA, 27 nt, Artificial Sequence
  Synthetic Oligonucleotide; CD80 exon 2; Set C
ccaagagcugaaagaaauugagguaug

SEQ ID NO: 53966 - RNA, 23 nt, Artificial Sequence
  Synthetic Oligonucleotide; CD80 exon 2; Set C
aagagcugaaagaaauugaggua

SEQ ID NO: 53967 - RNA, 21 nt, Artificial Sequence
  Synthetic Oligonucleotide; CD80 exon 2; Set C
agagcugaaagaaauugaggu

SEQ ID NO: 53968 - RNA, 26 nt, Artificial Sequence
  Synthetic Oligonucleotide; CD80 exon 2; Set C
ccaagagcugaaagaaauugagguau

SEQ ID NO: 53969 - RNA, 28 nt, Artificial Sequence
  Synthetic Oligonucleotide; CD80 exon 2; Set C
accaagagcugaaagaaauugagguaug

SEQ ID NO: 53970 - RNA, 24 nt, Artificial Sequence
  Synthetic Oligonucleotide; CD80 exon 2; Set C
caagagcugaaagaaauugaggua

SEQ ID NO: 53971 - RNA, 20 nt, Artificial Sequence
  Synthetic Oligonucleotide; CD80 exon 2; Set C
agagcugaaagaaauugagg

SEQ ID NO: 53972 - RNA, 22 nt, Artificial Sequence
  Synthetic Oligonucleotide; CD80 exon 2; Set C
aagagcugaaagaaauugaggu

SEQ ID NO: 53973 - RNA, 32 nt, Artificial Sequence
  Synthetic Oligonucleotide; CD80 exon 2; Set B
gcaccaagagcugaaagaaauugagguaugga

SEQ ID NO: 53974 - RNA, 27 nt, Artificial Sequence
  Synthetic Oligonucleotide; CD80 exon 2; Set C
accaagagcugaaagaaauugagguau

SEQ ID NO: 53975 - RNA, 29 nt, Artificial Sequence
  Synthetic Oligonucleotide; CD80 exon 2; Set C
caccaagagcugaaagaaauugagguaug

SEQ ID NO: 53976 - RNA, 19 nt, Artificial Sequence
  Synthetic Oligonucleotide; CD80 exon 2; Set C
agagcugaaagaaauugag

SEQ ID NO: 53977 - RNA, 21 nt, Artificial Sequence
  Synthetic Oligonucleotide; CD80 exon 2; Set C
aagagcugaaagaaauugagg

SEQ ID NO: 53978 - RNA, 28 nt, Artificial Sequence
  Synthetic Oligonucleotide; CD80 exon 2; Set C
caccaagagcugaaagaaauugagguau

SEQ ID NO: 53979 - RNA, 18 nt, Artificial Sequence
  Synthetic Oligonucleotide; CD80 exon 2; Set C
agagcugaaagaaauuga

SEQ ID NO: 53980 - RNA, 20 nt, Artificial Sequence
  Synthetic Oligonucleotide; CD80 exon 2; Set C
aagagcugaaagaaauugag

SEQ ID NO: 53981 - RNA, 17 nt, Artificial Sequence
  Synthetic Oligonucleotide; CD80 exon 2; Set C
agagcugaaagaaauug

SEQ ID NO: 53982 - RNA, 19 nt, Artificial Sequence
  Synthetic Oligonucleotide; CD80 exon 2; Set C
aagagcugaaagaaauuga

SEQ ID NO: 53983 - RNA, 16 nt, Artificial Sequence
  Synthetic Oligonucleotide; CD80 exon 2; Set C
agagcugaaagaaauu

SEQ ID NO: 53984 - RNA, 18 nt, Artificial Sequence
  Synthetic Oligonucleotide; CD80 exon 2; Set C
aagagcugaaagaaauug

SEQ ID NO: 53985 - RNA, 28 nt, Artificial Sequence
  Synthetic Oligonucleotide; CD80 exon 2; Set B
gcaccaagagcugaaagaaauugaggua

SEQ ID NO: 53986 - RNA, 15 nt, Artificial Sequence
  Synthetic Oligonucleotide; CD80 exon 2; Set C
agagcugaaagaaau

SEQ ID NO: 53987 - RNA, 17 nt, Artificial Sequence
  Synthetic Oligonucleotide; CD80 exon 2; Set C
aagagcugaaagaaauu

SEQ ID NO: 53988 - RNA, 27 nt, Artificial Sequence
  Synthetic Oligonucleotide; CD80 exon 2; Set B
gcaccaagagcugaaagaaauugaggu

SEQ ID NO: 53989 - RNA, 16 nt, Artificial Sequence
  Synthetic Oligonucleotide; CD80 exon 2; Set C
aagagcugaaagaaau

SEQ ID NO: 53990 - RNA, 26 nt, Artificial Sequence
  Synthetic Oligonucleotide; CD80 exon 2; Set C
gcaccaagagcugaaagaaauugagg

SEQ ID NO: 53991 - RNA, 15 nt, Artificial Sequence
  Synthetic Oligonucleotide; CD80 exon 2; Set C
aagagcugaaagaaa

SEQ ID NO: 53992 - RNA, 25 nt, Artificial Sequence
  Synthetic Oligonucleotide; CD80 exon 2; Set C
gcaccaagagcugaaagaaauugag

SEQ ID NO: 53993 - RNA, 24 nt, Artificial Sequence
  Synthetic Oligonucleotide; CD80 exon 2; Set C
gcaccaagagcugaaagaaauuga

SEQ ID NO: 53994 - RNA, 23 nt, Artificial Sequence
  Synthetic Oligonucleotide; CD80 exon 2; Set C
gcaccaagagcugaaagaaauug

SEQ ID NO: 53995 - RNA, 40 nt, Artificial Sequence
  Synthetic Oligonucleotide; CD80 exon 2; Set C
gaccagccagcaccaagagcugaaagaaauugagguaugg

SEQ ID NO: 53996 - RNA, 22 nt, Artificial Sequence
  Synthetic Oligonucleotide; CD80 exon 2; Set C
gcaccaagagcugaaagaaauu

SEQ ID NO: 53997 - RNA, 39 nt, Artificial Sequence
  Synthetic Oligonucleotide; CD80 exon 2; Set C
gaccagccagcaccaagagcugaaagaaauugagguaug

SEQ ID NO: 53998 - RNA, 21 nt, Artificial Sequence
  Synthetic Oligonucleotide; CD80 exon 2; Set C
gcaccaagagcugaaagaaau

SEQ ID NO: 53999 - RNA, 38 nt, Artificial Sequence
  Synthetic Oligonucleotide; CD80 exon 2; Set C
gaccagccagcaccaagagcugaaagaaauugagguau

SEQ ID NO: 54000 - RNA, 20 nt, Artificial Sequence
  Synthetic Oligonucleotide; CD80 exon 2; Set C
gcaccaagagcugaaagaaa

SEQ ID NO: 54001 - RNA, 19 nt, Artificial Sequence
  Synthetic Oligonucleotide; CD80 exon 2; Set C
gcaccaagagcugaaagaa

SEQ ID NO: 54002 - RNA, 18 nt, Artificial Sequence
  Synthetic Oligonucleotide; CD80 exon 2; Set C
gcaccaagagcugaaaga

SEQ ID NO: 54003 - RNA, 17 nt, Artificial Sequence
  Synthetic Oligonucleotide; CD80 exon 2; Set C
gcaccaagagcugaaag

SEQ ID NO: 54004 - RNA, 16 nt, Artificial Sequence
  Synthetic Oligonucleotide; CD80 exon 2; Set C
gcaccaagagcugaaa

SEQ ID NO: 54005 - RNA, 15 nt, Artificial Sequence
  Synthetic Oligonucleotide; CD80 exon 2; Set C
gcaccaagagcugaa

SEQ ID NO: 54006 - RNA, 18 nt, Artificial Sequence
  Synthetic Oligonucleotide; CD80 exon 2; Set B
gaccagccagcaccaaga

SEQ ID NO: 54007 - RNA, 17 nt, Artificial Sequence
  Synthetic Oligonucleotide; CD80 exon 2; Set B
gaccagccagcaccaag

SEQ ID NO: 54008 - RNA, 40 nt, Artificial Sequence
  Synthetic Oligonucleotide; CD80 exon 2; Set C
uuaccugaacagaagugagaaagaccagccagcaccaaga

SEQ ID NO: 54009 - RNA, 40 nt, Artificial Sequence
  Synthetic Oligonucleotide; CD80 exon 2; Set C
aguugcuuaccugaacagaagugagaaagaccagccagca

SEQ ID NO: 54010 - RNA, 22 nt, Artificial Sequence
  Synthetic Oligonucleotide; CD80 exon 2; Set C
uuaaguuccugaaaguugcuua

SEQ ID NO: 54011 - RNA, 15 nt, Artificial Sequence
  Synthetic Oligonucleotide; CD80 exon 2; Set C
uaaguuccugaaagu

SEQ ID NO: 54012 - RNA, 16 nt, Artificial Sequence
  Synthetic Oligonucleotide; CD80 exon 2; Set C
uuaaguuccugaaagu

SEQ ID NO: 54013 - RNA, 17 nt, Artificial Sequence
  Synthetic Oligonucleotide; CD80 exon 2; Set C
guuaaguuccugaaagu

SEQ ID NO: 54014 - RNA, 15 nt, Artificial Sequence
  Synthetic Oligonucleotide; CD80 exon 2; Set C
uuaaguuccugaaag

SEQ ID NO: 54015 - RNA, 24 nt, Artificial Sequence
  Synthetic Oligonucleotide; CD80 exon 2; Set C
ugacucaguuaaguuccugaaagu

SEQ ID NO: 54016 - RNA, 25 nt, Artificial Sequence
  Synthetic Oligonucleotide; CD80 exon 2; Set C
uugacucaguuaaguuccugaaagu

SEQ ID NO: 54017 - RNA, 26 nt, Artificial Sequence
  Synthetic Oligonucleotide; CD80 exon 2; Set C
guugacucaguuaaguuccugaaagu

SEQ ID NO: 54018 - RNA, 16 nt, Artificial Sequence
  Synthetic Oligonucleotide; CD80 exon 2; Set C
ugacucaguuaaguuc

SEQ ID NO: 54019 - RNA, 17 nt, Artificial Sequence
  Synthetic Oligonucleotide; CD80 exon 2; Set C
uugacucaguuaaguuc

SEQ ID NO: 54020 - RNA, 16 nt, Artificial Sequence
  Synthetic Oligonucleotide; CD80 exon 2; Set C
uugacucaguuaaguu

SEQ ID NO: 54021 - RNA, 18 nt, Artificial Sequence
  Synthetic Oligonucleotide; CD80 exon 2; Set C
guugacucaguuaaguuc

SEQ ID NO: 54022 - RNA, 17 nt, Artificial Sequence
  Synthetic Oligonucleotide; CD80 exon 2; Set C
guugacucaguuaaguu

SEQ ID NO: 54023 - RNA, 16 nt, Artificial Sequence
  Synthetic Oligonucleotide; CD80 exon 2; Set C
guugacucaguuaagu

SEQ ID NO: 54024 - RNA, 16 nt, Artificial Sequence
  Synthetic Oligonucleotide; CD80 exon 2; Set C
aggaaggugugccuac

SEQ ID NO: 54025 - RNA, 17 nt, Artificial Sequence
  Synthetic Oligonucleotide; CD80 exon 2; Set C
aaggaaggugugccuac

SEQ ID NO: 54026 - RNA, 18 nt, Artificial Sequence
  Synthetic Oligonucleotide; CD80 exon 2; Set C
gaaggaaggugugccuac

SEQ ID NO: 54027 - RNA, 31 nt, Artificial Sequence
  Synthetic Oligonucleotide; CD80 exon 2; Set A
aagucauucaggaaggaaggugugccuacuu

SEQ ID NO: 54028 - RNA, 30 nt, Artificial Sequence
  Synthetic Oligonucleotide; CD80 exon 2; Set A
aagucauucaggaaggaaggugugccuacu

SEQ ID NO: 54029 - RNA, 17 nt, Artificial Sequence
  Synthetic Oligonucleotide; CD80 exon 2; Set C
auucaggaaggaaggug

SEQ ID NO: 54030 - RNA, 16 nt, Artificial Sequence
  Synthetic Oligonucleotide; CD80 exon 2; Set C
auucaggaaggaaggu

SEQ ID NO: 54031 - RNA, 19 nt, Artificial Sequence
  Synthetic Oligonucleotide; CD80 exon 2; Set C
ucauucaggaaggaaggug

SEQ ID NO: 54032 - RNA, 15 nt, Artificial Sequence
  Synthetic Oligonucleotide; CD80 exon 2; Set C
auucaggaaggaagg

SEQ ID NO: 54033 - RNA, 33 nt, Artificial Sequence
  Synthetic Oligonucleotide; CD80 exon 2; Set A
auaaaagucauucaggaaggaaggugugccuac

SEQ ID NO: 54034 - RNA, 22 nt, Artificial Sequence
  Synthetic Oligonucleotide; CD80 exon 2; Set C
agucauucaggaaggaaggugu

SEQ ID NO: 54035 - RNA, 24 nt, Artificial Sequence
  Synthetic Oligonucleotide; CD80 exon 2; Set C
aagucauucaggaaggaaggugug

SEQ ID NO: 54036 - RNA, 34 nt, Artificial Sequence
  Synthetic Oligonucleotide; CD80 exon 2; Set A
aauaaaagucauucaggaaggaaggugugccuac

SEQ ID NO: 54037 - RNA, 21 nt, Artificial Sequence
  Synthetic Oligonucleotide; CD80 exon 2; Set C
agucauucaggaaggaaggug

SEQ ID NO: 54038 - RNA, 23 nt, Artificial Sequence
  Synthetic Oligonucleotide; CD80 exon 2; Set C
aagucauucaggaaggaaggugu

SEQ ID NO: 54039 - RNA, 35 nt, Artificial Sequence
  Synthetic Oligonucleotide; CD80 exon 2; Set A
aaauaaaagucauucaggaaggaaggugugccuac

SEQ ID NO: 54040 - RNA, 22 nt, Artificial Sequence
  Synthetic Oligonucleotide; CD80 exon 2; Set C
aagucauucaggaaggaaggug

SEQ ID NO: 54041 - RNA, 20 nt, Artificial Sequence
  Synthetic Oligonucleotide; CD80 exon 2; Set C
agucauucaggaaggaaggu

SEQ ID NO: 54042 - RNA, 21 nt, Artificial Sequence
  Synthetic Oligonucleotide; CD80 exon 2; Set C
aagucauucaggaaggaaggu

SEQ ID NO: 54043 - RNA, 19 nt, Artificial Sequence
  Synthetic Oligonucleotide; CD80 exon 2; Set C
agucauucaggaaggaagg

SEQ ID NO: 54044 - RNA, 18 nt, Artificial Sequence
  Synthetic Oligonucleotide; CD80 exon 2; Set C
agucauucaggaaggaag

SEQ ID NO: 54045 - RNA, 20 nt, Artificial Sequence
  Synthetic Oligonucleotide; CD80 exon 2; Set C
aagucauucaggaaggaagg

SEQ ID NO: 54046 - RNA, 19 nt, Artificial Sequence
  Synthetic Oligonucleotide; CD80 exon 2; Set C
aagucauucaggaaggaag

SEQ ID NO: 54047 - RNA, 18 nt, Artificial Sequence
  Synthetic Oligonucleotide; CD80 exon 2; Set C
aagucauucaggaaggaa

SEQ ID NO: 54048 - RNA, 17 nt, Artificial Sequence
  Synthetic Oligonucleotide; CD80 exon 2; Set C
aagucauucaggaagga

SEQ ID NO: 54049 - RNA, 16 nt, Artificial Sequence
  Synthetic Oligonucleotide; CD80 exon 2; Set C
aagucauucaggaagg

SEQ ID NO: 54050 - RNA, 15 nt, Artificial Sequence
  Synthetic Oligonucleotide; CD80 exon 2; Set C
aagucauucaggaag

SEQ ID NO: 54051 - RNA, 21 nt, Artificial Sequence
  Synthetic Oligonucleotide; CD80 exon 2; Set C
aaggaacaaauaaaagucauu

SEQ ID NO: 54052 - RNA, 22 nt, Artificial Sequence
  Synthetic Oligonucleotide; CD80 exon 2; Set C
aaaggaacaaauaaaagucauu

SEQ ID NO: 54053 - RNA, 19 nt, Artificial Sequence
  Synthetic Oligonucleotide; CD80 exon 2; Set C
aaggaacaaauaaaaguca

SEQ ID NO: 54054 - RNA, 16 nt, Artificial Sequence
  Synthetic Oligonucleotide; CD80 exon 2; Set C
aggaacaaauaaaagu

SEQ ID NO: 54055 - RNA, 20 nt, Artificial Sequence
  Synthetic Oligonucleotide; CD80 exon 2; Set C
aaaggaacaaauaaaaguca

SEQ ID NO: 54056 - RNA, 15 nt, Artificial Sequence
  Synthetic Oligonucleotide; CD80 exon 2; Set C
aggaacaaauaaaag

SEQ ID NO: 54057 - RNA, 17 nt, Artificial Sequence
  Synthetic Oligonucleotide; CD80 exon 2; Set C
aaggaacaaauaaaagu

SEQ ID NO: 54058 - RNA, 19 nt, Artificial Sequence
  Synthetic Oligonucleotide; CD80 exon 2; Set C
aaaggaacaaauaaaaguc

SEQ ID NO: 54059 - RNA, 16 nt, Artificial Sequence
  Synthetic Oligonucleotide; CD80 exon 2; Set C
aaggaacaaauaaaag

SEQ ID NO: 54060 - RNA, 18 nt, Artificial Sequence
  Synthetic Oligonucleotide; CD80 exon 2; Set C
aaaggaacaaauaaaagu

SEQ ID NO: 54061 - RNA, 17 nt, Artificial Sequence
  Synthetic Oligonucleotide; CD80 exon 2; Set C
aaaggaacaaauaaaag

SEQ ID NO: 54062 - RNA, 30 nt, Artificial Sequence
  Synthetic Oligonucleotide; CD80 exon 2; Set C
uuucacagccugaaaaaggaacaaauaaaa

SEQ ID NO: 54063 - RNA, 31 nt, Artificial Sequence
  Synthetic Oligonucleotide; CD80 exon 2; Set C
guuucacagccugaaaaaggaacaaauaaaa

SEQ ID NO: 54064 - RNA, 29 nt, Artificial Sequence
  Synthetic Oligonucleotide; CD80 exon 2; Set C
uuucacagccugaaaaaggaacaaauaaa

SEQ ID NO: 54065 - RNA, 28 nt, Artificial Sequence
  Synthetic Oligonucleotide; CD80 exon 2; Set C
uuucacagccugaaaaaggaacaaauaa

SEQ ID NO: 54066 - RNA, 30 nt, Artificial Sequence
  Synthetic Oligonucleotide; CD80 exon 2; Set C
guuucacagccugaaaaaggaacaaauaaa

SEQ ID NO: 54067 - RNA, 32 nt, Artificial Sequence
  Synthetic Oligonucleotide; CD80 exon 2; Set C
aguuucacagccugaaaaaggaacaaauaaaa

SEQ ID NO: 54068 - RNA, 29 nt, Artificial Sequence
  Synthetic Oligonucleotide; CD80 exon 2; Set C
guuucacagccugaaaaaggaacaaauaa

SEQ ID NO: 54069 - RNA, 27 nt, Artificial Sequence
  Synthetic Oligonucleotide; CD80 exon 2; Set C
uuucacagccugaaaaaggaacaaaua

SEQ ID NO: 54070 - RNA, 31 nt, Artificial Sequence
  Synthetic Oligonucleotide; CD80 exon 2; Set C
aguuucacagccugaaaaaggaacaaauaaa

SEQ ID NO: 54071 - RNA, 28 nt, Artificial Sequence
  Synthetic Oligonucleotide; CD80 exon 2; Set C
guuucacagccugaaaaaggaacaaaua

SEQ ID NO: 54072 - RNA, 30 nt, Artificial Sequence
  Synthetic Oligonucleotide; CD80 exon 2; Set C
aguuucacagccugaaaaaggaacaaauaa

SEQ ID NO: 54073 - RNA, 26 nt, Artificial Sequence
  Synthetic Oligonucleotide; CD80 exon 2; Set C
uuucacagccugaaaaaggaacaaau

SEQ ID NO: 54074 - RNA, 32 nt, Artificial Sequence
  Synthetic Oligonucleotide; CD80 exon 2; Set C
uaguuucacagccugaaaaaggaacaaauaaa

SEQ ID NO: 54075 - RNA, 27 nt, Artificial Sequence
  Synthetic Oligonucleotide; CD80 exon 2; Set C
guuucacagccugaaaaaggaacaaau

SEQ ID NO: 54076 - RNA, 31 nt, Artificial Sequence
  Synthetic Oligonucleotide; CD80 exon 2; Set C
uaguuucacagccugaaaaaggaacaaauaa

SEQ ID NO: 54077 - RNA, 29 nt, Artificial Sequence
  Synthetic Oligonucleotide; CD80 exon 2; Set C
aguuucacagccugaaaaaggaacaaaua

SEQ ID NO: 54078 - RNA, 25 nt, Artificial Sequence
  Synthetic Oligonucleotide; CD80 exon 2; Set C
uuucacagccugaaaaaggaacaaa

SEQ ID NO: 54079 - RNA, 26 nt, Artificial Sequence
  Synthetic Oligonucleotide; CD80 exon 2; Set C
guuucacagccugaaaaaggaacaaa

SEQ ID NO: 54080 - RNA, 32 nt, Artificial Sequence
  Synthetic Oligonucleotide; CD80 exon 2; Set C
uuaguuucacagccugaaaaaggaacaaauaa

SEQ ID NO: 54081 - RNA, 30 nt, Artificial Sequence
  Synthetic Oligonucleotide; CD80 exon 2; Set C
uaguuucacagccugaaaaaggaacaaaua

SEQ ID NO: 54082 - RNA, 28 nt, Artificial Sequence
  Synthetic Oligonucleotide; CD80 exon 2; Set C
aguuucacagccugaaaaaggaacaaau

SEQ ID NO: 54083 - RNA, 31 nt, Artificial Sequence
  Synthetic Oligonucleotide; CD80 exon 2; Set C
uuaguuucacagccugaaaaaggaacaaaua

SEQ ID NO: 54084 - RNA, 29 nt, Artificial Sequence
  Synthetic Oligonucleotide; CD80 exon 2; Set C
uaguuucacagccugaaaaaggaacaaau

SEQ ID NO: 54085 - RNA, 27 nt, Artificial Sequence
  Synthetic Oligonucleotide; CD80 exon 2; Set C
aguuucacagccugaaaaaggaacaaa

SEQ ID NO: 54086 - RNA, 30 nt, Artificial Sequence
  Synthetic Oligonucleotide; CD80 exon 2; Set C
uuaguuucacagccugaaaaaggaacaaau

SEQ ID NO: 54087 - RNA, 28 nt, Artificial Sequence
  Synthetic Oligonucleotide; CD80 exon 2; Set C
uaguuucacagccugaaaaaggaacaaa

SEQ ID NO: 54088 - RNA, 32 nt, Artificial Sequence
  Synthetic Oligonucleotide; CD80 exon 2; Set C
uuuaguuucacagccugaaaaaggaacaaaua

SEQ ID NO: 54089 - RNA, 29 nt, Artificial Sequence
  Synthetic Oligonucleotide; CD80 exon 2; Set C
uuaguuucacagccugaaaaaggaacaaa

SEQ ID NO: 54090 - RNA, 31 nt, Artificial Sequence
  Synthetic Oligonucleotide; CD80 exon 2; Set C
uuuaguuucacagccugaaaaaggaacaaau

SEQ ID NO: 54091 - RNA, 32 nt, Artificial Sequence
  Synthetic Oligonucleotide; CD80 exon 2; Set C
auuuaguuucacagccugaaaaaggaacaaau

SEQ ID NO: 54092 - RNA, 30 nt, Artificial Sequence
  Synthetic Oligonucleotide; CD80 exon 2; Set C
uuuaguuucacagccugaaaaaggaacaaa

SEQ ID NO: 54093 - RNA, 31 nt, Artificial Sequence
  Synthetic Oligonucleotide; CD80 exon 2; Set C
auuuaguuucacagccugaaaaaggaacaaa

SEQ ID NO: 54094 - RNA, 19 nt, Artificial Sequence
  Synthetic Oligonucleotide; CD80 exon 2; Set C
uuucacagccugaaaaagg

SEQ ID NO: 54095 - RNA, 32 nt, Artificial Sequence
  Synthetic Oligonucleotide; CD80 exon 2; Set C
gauuuaguuucacagccugaaaaaggaacaaa

SEQ ID NO: 54096 - RNA, 18 nt, Artificial Sequence
  Synthetic Oligonucleotide; CD80 exon 2; Set C
uuucacagccugaaaaag

SEQ ID NO: 54097 - RNA, 20 nt, Artificial Sequence
  Synthetic Oligonucleotide; CD80 exon 2; Set C
guuucacagccugaaaaagg

SEQ ID NO: 54098 - RNA, 19 nt, Artificial Sequence
  Synthetic Oligonucleotide; CD80 exon 2; Set C
guuucacagccugaaaaag

SEQ ID NO: 54099 - RNA, 21 nt, Artificial Sequence
  Synthetic Oligonucleotide; CD80 exon 2; Set C
aguuucacagccugaaaaagg

SEQ ID NO: 54100 - RNA, 18 nt, Artificial Sequence
  Synthetic Oligonucleotide; CD80 exon 2; Set C
guuucacagccugaaaaa

SEQ ID NO: 54101 - RNA, 20 nt, Artificial Sequence
  Synthetic Oligonucleotide; CD80 exon 2; Set C
aguuucacagccugaaaaag

SEQ ID NO: 54102 - RNA, 22 nt, Artificial Sequence
  Synthetic Oligonucleotide; CD80 exon 2; Set C
uaguuucacagccugaaaaagg

SEQ ID NO: 54103 - RNA, 19 nt, Artificial Sequence
  Synthetic Oligonucleotide; CD80 exon 2; Set C
aguuucacagccugaaaaa

SEQ ID NO: 54104 - RNA, 21 nt, Artificial Sequence
  Synthetic Oligonucleotide; CD80 exon 2; Set C
uaguuucacagccugaaaaag

SEQ ID NO: 54105 - RNA, 23 nt, Artificial Sequence
  Synthetic Oligonucleotide; CD80 exon 2; Set C
uuaguuucacagccugaaaaagg

SEQ ID NO: 54106 - RNA, 20 nt, Artificial Sequence
  Synthetic Oligonucleotide; CD80 exon 2; Set C
uaguuucacagccugaaaaa

SEQ ID NO: 54107 - RNA, 22 nt, Artificial Sequence
  Synthetic Oligonucleotide; CD80 exon 2; Set C
uuaguuucacagccugaaaaag

SEQ ID NO: 54108 - RNA, 24 nt, Artificial Sequence
  Synthetic Oligonucleotide; CD80 exon 2; Set C
uuuaguuucacagccugaaaaagg

SEQ ID NO: 54109 - RNA, 21 nt, Artificial Sequence
  Synthetic Oligonucleotide; CD80 exon 2; Set C
uuaguuucacagccugaaaaa

SEQ ID NO: 54110 - RNA, 23 nt, Artificial Sequence
  Synthetic Oligonucleotide; CD80 exon 2; Set C
uuuaguuucacagccugaaaaag

SEQ ID NO: 54111 - RNA, 25 nt, Artificial Sequence
  Synthetic Oligonucleotide; CD80 exon 2; Set C
auuuaguuucacagccugaaaaagg

SEQ ID NO: 54112 - RNA, 22 nt, Artificial Sequence
  Synthetic Oligonucleotide; CD80 exon 2; Set C
uuuaguuucacagccugaaaaa

SEQ ID NO: 54113 - RNA, 40 nt, Artificial Sequence
  Synthetic Oligonucleotide; CD80 exon 2; Set A
gguuguggauuuaguuucacagccugaaaaaggaacaaau

SEQ ID NO: 54114 - RNA, 24 nt, Artificial Sequence
  Synthetic Oligonucleotide; CD80 exon 2; Set C
auuuaguuucacagccugaaaaag

SEQ ID NO: 54115 - RNA, 26 nt, Artificial Sequence
  Synthetic Oligonucleotide; CD80 exon 2; Set C
gauuuaguuucacagccugaaaaagg

SEQ ID NO: 54116 - RNA, 23 nt, Artificial Sequence
  Synthetic Oligonucleotide; CD80 exon 2; Set C
auuuaguuucacagccugaaaaa

SEQ ID NO: 54117 - RNA, 39 nt, Artificial Sequence
  Synthetic Oligonucleotide; CD80 exon 2; Set A
gguuguggauuuaguuucacagccugaaaaaggaacaaa

SEQ ID NO: 54118 - RNA, 25 nt, Artificial Sequence
  Synthetic Oligonucleotide; CD80 exon 2; Set C
gauuuaguuucacagccugaaaaag

SEQ ID NO: 54119 - RNA, 24 nt, Artificial Sequence
  Synthetic Oligonucleotide; CD80 exon 2; Set C
gauuuaguuucacagccugaaaaa

SEQ ID NO: 54120 - RNA, 40 nt, Artificial Sequence
  Synthetic Oligonucleotide; CD80 exon 2; Set A
agguuguggauuuaguuucacagccugaaaaaggaacaaa

SEQ ID NO: 54121 - RNA, 33 nt, Artificial Sequence
  Synthetic Oligonucleotide; CD80 exon 2; Set A
gguuguggauuuaguuucacagccugaaaaagg

SEQ ID NO: 54122 - RNA, 32 nt, Artificial Sequence
  Synthetic Oligonucleotide; CD80 exon 2; Set A
gguuguggauuuaguuucacagccugaaaaag

SEQ ID NO: 54123 - RNA, 34 nt, Artificial Sequence
  Synthetic Oligonucleotide; CD80 exon 2; Set A
agguuguggauuuaguuucacagccugaaaaagg

SEQ ID NO: 54124 - RNA, 31 nt, Artificial Sequence
  Synthetic Oligonucleotide; CD80 exon 2; Set A
gguuguggauuuaguuucacagccugaaaaa

SEQ ID NO: 54125 - RNA, 33 nt, Artificial Sequence
  Synthetic Oligonucleotide; CD80 exon 2; Set A
agguuguggauuuaguuucacagccugaaaaag

SEQ ID NO: 54126 - RNA, 35 nt, Artificial Sequence
  Synthetic Oligonucleotide; CD80 exon 2; Set A
aagguuguggauuuaguuucacagccugaaaaagg

SEQ ID NO: 54127 - RNA, 32 nt, Artificial Sequence
  Synthetic Oligonucleotide; CD80 exon 2; Set A
agguuguggauuuaguuucacagccugaaaaa

SEQ ID NO: 54128 - RNA, 34 nt, Artificial Sequence
  Synthetic Oligonucleotide; CD80 exon 2; Set A
aagguuguggauuuaguuucacagccugaaaaag

SEQ ID NO: 54129 - RNA, 36 nt, Artificial Sequence
  Synthetic Oligonucleotide; CD80 exon 2; Set A
aaagguuguggauuuaguuucacagccugaaaaagg

SEQ ID NO: 54130 - RNA, 33 nt, Artificial Sequence
  Synthetic Oligonucleotide; CD80 exon 2; Set A
aagguuguggauuuaguuucacagccugaaaaa

SEQ ID NO: 54131 - RNA, 35 nt, Artificial Sequence
  Synthetic Oligonucleotide; CD80 exon 2; Set A
aaagguuguggauuuaguuucacagccugaaaaag

SEQ ID NO: 54132 - RNA, 34 nt, Artificial Sequence
  Synthetic Oligonucleotide; CD80 exon 2; Set A
aaagguuguggauuuaguuucacagccugaaaaa

SEQ ID NO: 54133 - RNA, 15 nt, Artificial Sequence
  Synthetic Oligonucleotide; CD80 exon 2; Set C
uuguggauuuaguuu

SEQ ID NO: 54134 - RNA, 18 nt, Artificial Sequence
  Synthetic Oligonucleotide; CD80 exon 2; Set C
gguuguggauuuaguuuc

SEQ ID NO: 54135 - RNA, 19 nt, Artificial Sequence
  Synthetic Oligonucleotide; CD80 exon 2; Set C
agguuguggauuuaguuuc

SEQ ID NO: 54136 - RNA, 20 nt, Artificial Sequence
  Synthetic Oligonucleotide; CD80 exon 2; Set C
aagguuguggauuuaguuuc

SEQ ID NO: 54137 - RNA, 29 nt, Artificial Sequence
  Synthetic Oligonucleotide; CD80 exon 2; Set A
gggucuccaaagguuguggauuuaguuuc

SEQ ID NO: 54138 - RNA, 15 nt, Artificial Sequence
  Synthetic Oligonucleotide; CD80 exon 2; Set C
gggucuccaaagguu

SEQ ID NO: 54139 - RNA, 16 nt, Artificial Sequence
  Synthetic Oligonucleotide; CD80 exon 2; Set C
ugggucuccaaagguu

SEQ ID NO: 54140 - RNA, 15 nt, Artificial Sequence
  Synthetic Oligonucleotide; CD80 exon 2; Set C
ugggucuccaaaggu

SEQ ID NO: 54141 - RNA, 40 nt, Artificial Sequence
  Synthetic Oligonucleotide; CD80 exon 2; Set C
gauuggaggguguuccugggucuccaaagguuguggauuu

SEQ ID NO: 54142 - RNA, 39 nt, Artificial Sequence
  Synthetic Oligonucleotide; CD80 exon 2; Set C
gauuggaggguguuccugggucuccaaagguuguggauu

SEQ ID NO: 54143 - RNA, 40 nt, Artificial Sequence
  Synthetic Oligonucleotide; CD80 exon 2; Set C
agauuggaggguguuccugggucuccaaagguuguggauu

SEQ ID NO: 54144 - RNA, 38 nt, Artificial Sequence
  Synthetic Oligonucleotide; CD80 exon 2; Set C
gauuggaggguguuccugggucuccaaagguuguggau

SEQ ID NO: 54145 - RNA, 39 nt, Artificial Sequence
  Synthetic Oligonucleotide; CD80 exon 2; Set C
agauuggaggguguuccugggucuccaaagguuguggau

SEQ ID NO: 54146 - RNA, 40 nt, Artificial Sequence
  Synthetic Oligonucleotide; CD80 exon 2; Set C
gagauuggaggguguuccugggucuccaaagguuguggau

SEQ ID NO: 54147 - RNA, 25 nt, Artificial Sequence
  Synthetic Oligonucleotide; CD80 exon 2; Set A
cugaugacaauccaauugcucacgu

SEQ ID NO: 54148 - RNA, 26 nt, Artificial Sequence
  Synthetic Oligonucleotide; CD80 exon 2; Set A
gcugaugacaauccaauugcucacgu

SEQ ID NO: 54149 - RNA, 24 nt, Artificial Sequence
  Synthetic Oligonucleotide; CD80 exon 2; Set A
cugaugacaauccaauugcucacg

SEQ ID NO: 54150 - RNA, 27 nt, Artificial Sequence
  Synthetic Oligonucleotide; CD80 exon 2; Set A
ggcugaugacaauccaauugcucacgu

SEQ ID NO: 54151 - RNA, 28 nt, Artificial Sequence
  Synthetic Oligonucleotide; CD80 exon 2; Set C
gggcugaugacaauccaauugcucacgu

SEQ ID NO: 54152 - RNA, 26 nt, Artificial Sequence
  Synthetic Oligonucleotide; CD80 exon 2; Set A
ggcugaugacaauccaauugcucacg

SEQ ID NO: 54153 - RNA, 27 nt, Artificial Sequence
  Synthetic Oligonucleotide; CD80 exon 2; Set A
gggcugaugacaauccaauugcucacg

SEQ ID NO: 54154 - RNA, 16 nt, Artificial Sequence
  Synthetic Oligonucleotide; CD80 exon 2; Set C
cugaugacaauccaau

SEQ ID NO: 54155 - RNA, 35 nt, Artificial Sequence
  Synthetic Oligonucleotide; CD80 exon 2; Set C
acaggcagggcugaugacaauccaauugcucacgu

SEQ ID NO: 54156 - RNA, 17 nt, Artificial Sequence
  Synthetic Oligonucleotide; CD80 exon 2; Set C
gcugaugacaauccaau

SEQ ID NO: 54157 - RNA, 15 nt, Artificial Sequence
  Synthetic Oligonucleotide; CD80 exon 2; Set C
cugaugacaauccaa

SEQ ID NO: 54158 - RNA, 18 nt, Artificial Sequence
  Synthetic Oligonucleotide; CD80 exon 2; Set C
ggcugaugacaauccaau

SEQ ID NO: 54159 - RNA, 19 nt, Artificial Sequence
  Synthetic Oligonucleotide; CD80 exon 2; Set C
gggcugaugacaauccaau

SEQ ID NO: 54160 - RNA, 17 nt, Artificial Sequence
  Synthetic Oligonucleotide; CD80 exon 2; Set C
ggcugaugacaauccaa

SEQ ID NO: 54161 - RNA, 35 nt, Artificial Sequence
  Synthetic Oligonucleotide; CD80 exon 2; Set C
aacaggcagggcugaugacaauccaauugcucacg

SEQ ID NO: 54162 - RNA, 39 nt, Artificial Sequence
  Synthetic Oligonucleotide; CD80 exon 2; Set C
aaaacaggcagggcugaugacaauccaauugcucacgua

SEQ ID NO: 54163 - RNA, 18 nt, Artificial Sequence
  Synthetic Oligonucleotide; CD80 exon 2; Set C
gggcugaugacaauccaa

SEQ ID NO: 54164 - RNA, 36 nt, Artificial Sequence
  Synthetic Oligonucleotide; CD80 exon 2; Set C
aaacaggcagggcugaugacaauccaauugcucacg

SEQ ID NO: 54165 - RNA, 40 nt, Artificial Sequence
  Synthetic Oligonucleotide; CD80 exon 2; Set C
caaaacaggcagggcugaugacaauccaauugcucacgua

SEQ ID NO: 54166 - RNA, 37 nt, Artificial Sequence
  Synthetic Oligonucleotide; CD80 exon 2; Set C
aaaacaggcagggcugaugacaauccaauugcucacg

SEQ ID NO: 54167 - RNA, 40 nt, Artificial Sequence
  Synthetic Oligonucleotide; CD80 exon 2; Set C
ugcaaaacaggcagggcugaugacaauccaauugcucacg

SEQ ID NO: 54168 - RNA, 26 nt, Artificial Sequence
  Synthetic Oligonucleotide; CD80 exon 2; Set A
acaggcagggcugaugacaauccaau

SEQ ID NO: 54169 - RNA, 26 nt, Artificial Sequence
  Synthetic Oligonucleotide; CD80 exon 2; Set A
aacaggcagggcugaugacaauccaa

SEQ ID NO: 54170 - RNA, 27 nt, Artificial Sequence
  Synthetic Oligonucleotide; CD80 exon 2; Set A
aaacaggcagggcugaugacaauccaa

SEQ ID NO: 54171 - RNA, 24 nt, Artificial Sequence
  Synthetic Oligonucleotide; CD80 exon 2; Set A
caaaacaggcagggcugaugacaa

SEQ ID NO: 54172 - RNA, 25 nt, Artificial Sequence
  Synthetic Oligonucleotide; CD80 exon 2; Set A
gcaaaacaggcagggcugaugacaa

SEQ ID NO: 54173 - RNA, 16 nt, Artificial Sequence
  Synthetic Oligonucleotide; CD80 exon 2; Set C
aacaggcagggcugau

SEQ ID NO: 54174 - RNA, 18 nt, Artificial Sequence
  Synthetic Oligonucleotide; CD80 exon 2; Set C
aaacaggcagggcugaug

SEQ ID NO: 54175 - RNA, 17 nt, Artificial Sequence
  Synthetic Oligonucleotide; CD80 exon 2; Set C
aaacaggcagggcugau

SEQ ID NO: 54176 - RNA, 15 nt, Artificial Sequence
  Synthetic Oligonucleotide; CD80 exon 2; Set C
aacaggcagggcuga

SEQ ID NO: 54177 - RNA, 19 nt, Artificial Sequence
  Synthetic Oligonucleotide; CD80 exon 2; Set C
aaaacaggcagggcugaug

SEQ ID NO: 54178 - RNA, 27 nt, Artificial Sequence
  Synthetic Oligonucleotide; CD80 exon 2; Set C
gugcaaaacaggcagggcugaugacaa

SEQ ID NO: 54179 - RNA, 38 nt, Artificial Sequence
  Synthetic Oligonucleotide; CD80 exon 2; Set C
ucccaggugcaaaacaggcagggcugaugacaauccaa

SEQ ID NO: 54180 - RNA, 18 nt, Artificial Sequence
  Synthetic Oligonucleotide; CD80 exon 2; Set C
aaaacaggcagggcugau

SEQ ID NO: 54181 - RNA, 16 nt, Artificial Sequence
  Synthetic Oligonucleotide; CD80 exon 2; Set C
aaacaggcagggcuga

SEQ ID NO: 54182 - RNA, 20 nt, Artificial Sequence
  Synthetic Oligonucleotide; CD80 exon 2; Set C
caaaacaggcagggcugaug

SEQ ID NO: 54183 - RNA, 39 nt, Artificial Sequence
  Synthetic Oligonucleotide; CD80 exon 2; Set C
uucccaggugcaaaacaggcagggcugaugacaauccaa

SEQ ID NO: 54184 - RNA, 15 nt, Artificial Sequence
  Synthetic Oligonucleotide; CD80 exon 2; Set C
aaacaggcagggcug

SEQ ID NO: 54185 - RNA, 19 nt, Artificial Sequence
  Synthetic Oligonucleotide; CD80 exon 2; Set C
caaaacaggcagggcugau

SEQ ID NO: 54186 - RNA, 17 nt, Artificial Sequence
  Synthetic Oligonucleotide; CD80 exon 2; Set C
aaaacaggcagggcuga

SEQ ID NO: 54187 - RNA, 21 nt, Artificial Sequence
  Synthetic Oligonucleotide; CD80 exon 2; Set A
gcaaaacaggcagggcugaug

SEQ ID NO: 54188 - RNA, 20 nt, Artificial Sequence
  Synthetic Oligonucleotide; CD80 exon 2; Set A
gcaaaacaggcagggcugau

SEQ ID NO: 54189 - RNA, 18 nt, Artificial Sequence
  Synthetic Oligonucleotide; CD80 exon 2; Set C
caaaacaggcagggcuga

SEQ ID NO: 54190 - RNA, 22 nt, Artificial Sequence
  Synthetic Oligonucleotide; CD80 exon 2; Set A
ugcaaaacaggcagggcugaug

SEQ ID NO: 54191 - RNA, 15 nt, Artificial Sequence
  Synthetic Oligonucleotide; CD80 exon 2; Set C
aaaacaggcagggcu

SEQ ID NO: 54192 - RNA, 21 nt, Artificial Sequence
  Synthetic Oligonucleotide; CD80 exon 2; Set A
ugcaaaacaggcagggcugau

SEQ ID NO: 54193 - RNA, 19 nt, Artificial Sequence
  Synthetic Oligonucleotide; CD80 exon 2; Set A
gcaaaacaggcagggcuga

SEQ ID NO: 54194 - RNA, 23 nt, Artificial Sequence
  Synthetic Oligonucleotide; CD80 exon 2; Set A
gugcaaaacaggcagggcugaug

SEQ ID NO: 54195 - RNA, 16 nt, Artificial Sequence
  Synthetic Oligonucleotide; CD80 exon 2; Set C
caaaacaggcagggcu

SEQ ID NO: 54196 - RNA, 22 nt, Artificial Sequence
  Synthetic Oligonucleotide; CD80 exon 2; Set A
gugcaaaacaggcagggcugau

SEQ ID NO: 54197 - RNA, 20 nt, Artificial Sequence
  Synthetic Oligonucleotide; CD80 exon 2; Set A
ugcaaaacaggcagggcuga

SEQ ID NO: 54198 - RNA, 15 nt, Artificial Sequence
  Synthetic Oligonucleotide; CD80 exon 2; Set C
caaaacaggcagggc

SEQ ID NO: 54199 - RNA, 17 nt, Artificial Sequence
  Synthetic Oligonucleotide; CD80 exon 2; Set C
gcaaaacaggcagggcu

SEQ ID NO: 54200 - RNA, 21 nt, Artificial Sequence
  Synthetic Oligonucleotide; CD80 exon 2; Set A
gugcaaaacaggcagggcuga

SEQ ID NO: 54201 - RNA, 16 nt, Artificial Sequence
  Synthetic Oligonucleotide; CD80 exon 2; Set C
gcaaaacaggcagggc

SEQ ID NO: 54202 - RNA, 18 nt, Artificial Sequence
  Synthetic Oligonucleotide; CD80 exon 2; Set C
ugcaaaacaggcagggcu

SEQ ID NO: 54203 - RNA, 17 nt, Artificial Sequence
  Synthetic Oligonucleotide; CD80 exon 2; Set C
ugcaaaacaggcagggc

SEQ ID NO: 54204 - RNA, 19 nt, Artificial Sequence
  Synthetic Oligonucleotide; CD80 exon 2; Set A
gugcaaaacaggcagggcu

SEQ ID NO: 54205 - RNA, 16 nt, Artificial Sequence
  Synthetic Oligonucleotide; CD80 exon 2; Set C
ugcaaaacaggcaggg

SEQ ID NO: 54206 - RNA, 18 nt, Artificial Sequence
  Synthetic Oligonucleotide; CD80 exon 2; Set C
gugcaaaacaggcagggc

SEQ ID NO: 54207 - RNA, 28 nt, Artificial Sequence
  Synthetic Oligonucleotide; CD80 exon 2; Set C
ucccaggugcaaaacaggcagggcugau

SEQ ID NO: 54208 - RNA, 29 nt, Artificial Sequence
  Synthetic Oligonucleotide; CD80 exon 2; Set C
uucccaggugcaaaacaggcagggcugau

SEQ ID NO: 54209 - RNA, 26 nt, Artificial Sequence
  Synthetic Oligonucleotide; CD80 exon 2; Set C
ucccaggugcaaaacaggcagggcug

SEQ ID NO: 54210 - RNA, 27 nt, Artificial Sequence
  Synthetic Oligonucleotide; CD80 exon 2; Set C
uucccaggugcaaaacaggcagggcug

SEQ ID NO: 54211 - RNA, 25 nt, Artificial Sequence
  Synthetic Oligonucleotide; CD80 exon 2; Set C
ucccaggugcaaaacaggcagggcu

SEQ ID NO: 54212 - RNA, 24 nt, Artificial Sequence
  Synthetic Oligonucleotide; CD80 exon 2; Set C
ucccaggugcaaaacaggcagggc

SEQ ID NO: 54213 - RNA, 26 nt, Artificial Sequence
  Synthetic Oligonucleotide; CD80 exon 2; Set C
uucccaggugcaaaacaggcagggcu

SEQ ID NO: 54214 - RNA, 23 nt, Artificial Sequence
  Synthetic Oligonucleotide; CD80 exon 2; Set A
ucccaggugcaaaacaggcaggg

SEQ ID NO: 54215 - RNA, 25 nt, Artificial Sequence
  Synthetic Oligonucleotide; CD80 exon 2; Set C
uucccaggugcaaaacaggcagggc

SEQ ID NO: 54216 - RNA, 24 nt, Artificial Sequence
  Synthetic Oligonucleotide; CD80 exon 2; Set A
uucccaggugcaaaacaggcaggg

SEQ ID NO: 54217 - RNA, 16 nt, Artificial Sequence
  Synthetic Oligonucleotide; CD80 exon 2; Set C
ucccaggugcaaaaca

SEQ ID NO: 54218 - RNA, 17 nt, Artificial Sequence
  Synthetic Oligonucleotide; CD80 exon 2; Set C
uucccaggugcaaaaca

SEQ ID NO: 54219 - RNA, 23 nt, Artificial Sequence
  Synthetic Oligonucleotide; CD80 exon 2; Set A
agggcacuucccaggugcaaaac

SEQ ID NO: 54220 - RNA, 22 nt, Artificial Sequence
  Synthetic Oligonucleotide; CD80 exon 2; Set A
agggcacuucccaggugcaaaa

SEQ ID NO: 54221 - RNA, 21 nt, Artificial Sequence
  Synthetic Oligonucleotide; CD80 exon 2; Set A
agggcacuucccaggugcaaa

SEQ ID NO: 54222 - RNA, 20 nt, Artificial Sequence
  Synthetic Oligonucleotide; CD80 exon 2; Set A
agggcacuucccaggugcaa

SEQ ID NO: 54223 - RNA, 19 nt, Artificial Sequence
  Synthetic Oligonucleotide; CD80 exon 2; Set C
agggcacuucccaggugca

SEQ ID NO: 54224 - RNA, 18 nt, Artificial Sequence
  Synthetic Oligonucleotide; CD80 exon 2; Set A
agggcacuucccaggugc

SEQ ID NO: 54225 - RNA, 17 nt, Artificial Sequence
  Synthetic Oligonucleotide; CD80 exon 2; Set A
agggcacuucccaggug

SEQ ID NO: 54226 - RNA, 23 nt, Artificial Sequence
  Synthetic Oligonucleotide; CD80 exon 2; Set C
uuagggucaaaagugaaagccaa

SEQ ID NO: 54227 - RNA, 22 nt, Artificial Sequence
  Synthetic Oligonucleotide; CD80 exon 2; Set C
uuagggucaaaagugaaagcca

SEQ ID NO: 54228 - RNA, 24 nt, Artificial Sequence
  Synthetic Oligonucleotide; CD80 exon 2; Set C
cuuagggucaaaagugaaagccaa

SEQ ID NO: 54229 - RNA, 23 nt, Artificial Sequence
  Synthetic Oligonucleotide; CD80 exon 2; Set C
cuuagggucaaaagugaaagcca

SEQ ID NO: 54230 - RNA, 25 nt, Artificial Sequence
  Synthetic Oligonucleotide; CD80 exon 2; Set C
gcuuagggucaaaagugaaagccaa

SEQ ID NO: 54231 - RNA, 21 nt, Artificial Sequence
  Synthetic Oligonucleotide; CD80 exon 2; Set C
uuagggucaaaagugaaagcc

SEQ ID NO: 54232 - RNA, 24 nt, Artificial Sequence
  Synthetic Oligonucleotide; CD80 exon 2; Set C
gcuuagggucaaaagugaaagcca

SEQ ID NO: 54233 - RNA, 26 nt, Artificial Sequence
  Synthetic Oligonucleotide; CD80 exon 2; Set C
ugcuuagggucaaaagugaaagccaa

SEQ ID NO: 54234 - RNA, 22 nt, Artificial Sequence
  Synthetic Oligonucleotide; CD80 exon 2; Set C
cuuagggucaaaagugaaagcc

SEQ ID NO: 54235 - RNA, 20 nt, Artificial Sequence
  Synthetic Oligonucleotide; CD80 exon 2; Set C
uuagggucaaaagugaaagc

SEQ ID NO: 54236 - RNA, 25 nt, Artificial Sequence
  Synthetic Oligonucleotide; CD80 exon 2; Set A
ugcuuagggucaaaagugaaagcca

SEQ ID NO: 54237 - RNA, 23 nt, Artificial Sequence
  Synthetic Oligonucleotide; CD80 exon 2; Set C
gcuuagggucaaaagugaaagcc

SEQ ID NO: 54238 - RNA, 21 nt, Artificial Sequence
  Synthetic Oligonucleotide; CD80 exon 2; Set C
cuuagggucaaaagugaaagc

SEQ ID NO: 54239 - RNA, 19 nt, Artificial Sequence
  Synthetic Oligonucleotide; CD80 exon 2; Set C
uuagggucaaaagugaaag

SEQ ID NO: 54240 - RNA, 24 nt, Artificial Sequence
  Synthetic Oligonucleotide; CD80 exon 2; Set C
ugcuuagggucaaaagugaaagcc

SEQ ID NO: 54241 - RNA, 18 nt, Artificial Sequence
  Synthetic Oligonucleotide; CD80 exon 2; Set C
uuagggucaaaagugaaa

SEQ ID NO: 54242 - RNA, 22 nt, Artificial Sequence
  Synthetic Oligonucleotide; CD80 exon 2; Set C
gcuuagggucaaaagugaaagc

SEQ ID NO: 54243 - RNA, 20 nt, Artificial Sequence
  Synthetic Oligonucleotide; CD80 exon 2; Set C
cuuagggucaaaagugaaag

SEQ ID NO: 54244 - RNA, 23 nt, Artificial Sequence
  Synthetic Oligonucleotide; CD80 exon 2; Set C
ugcuuagggucaaaagugaaagc

SEQ ID NO: 54245 - RNA, 21 nt, Artificial Sequence
  Synthetic Oligonucleotide; CD80 exon 2; Set C
gcuuagggucaaaagugaaag

SEQ ID NO: 54246 - RNA, 20 nt, Artificial Sequence
  Synthetic Oligonucleotide; CD80 exon 2; Set C
gcuuagggucaaaagugaaa

SEQ ID NO: 54247 - RNA, 24 nt, Artificial Sequence
  Synthetic Oligonucleotide; CD80 exon 2; Set C
augcuuagggucaaaagugaaagc

SEQ ID NO: 54248 - RNA, 22 nt, Artificial Sequence
  Synthetic Oligonucleotide; CD80 exon 2; Set C
ugcuuagggucaaaagugaaag

SEQ ID NO: 54249 - RNA, 21 nt, Artificial Sequence
  Synthetic Oligonucleotide; CD80 exon 2; Set C
ugcuuagggucaaaagugaaa

SEQ ID NO: 54250 - RNA, 25 nt, Artificial Sequence
  Synthetic Oligonucleotide; CD80 exon 2; Set C
gaugcuuagggucaaaagugaaagc

SEQ ID NO: 54251 - RNA, 23 nt, Artificial Sequence
  Synthetic Oligonucleotide; CD80 exon 2; Set C
augcuuagggucaaaagugaaag

SEQ ID NO: 54252 - RNA, 22 nt, Artificial Sequence
  Synthetic Oligonucleotide; CD80 exon 2; Set C
augcuuagggucaaaagugaaa

SEQ ID NO: 54253 - RNA, 24 nt, Artificial Sequence
  Synthetic Oligonucleotide; CD80 exon 2; Set C
gaugcuuagggucaaaagugaaag

SEQ ID NO: 54254 - RNA, 23 nt, Artificial Sequence
  Synthetic Oligonucleotide; CD80 exon 2; Set C
gaugcuuagggucaaaagugaaa

SEQ ID NO: 54255 - RNA, 40 nt, Artificial Sequence
  Synthetic Oligonucleotide; CD80 exon 2; Set C
uggcccauggcuucagaugcuuagggucaaaagugaaagc

SEQ ID NO: 54256 - RNA, 40 nt, Artificial Sequence
  Synthetic Oligonucleotide; CD80 exon 2; Set C
guggcccauggcuucagaugcuuagggucaaaagugaaag

SEQ ID NO: 54257 - RNA, 39 nt, Artificial Sequence
  Synthetic Oligonucleotide; CD80 exon 2; Set C
guggcccauggcuucagaugcuuagggucaaaagugaaa

SEQ ID NO: 54258 - RNA, 40 nt, Artificial Sequence
  Synthetic Oligonucleotide; CD80 exon 2; Set C
uguggcccauggcuucagaugcuuagggucaaaagugaaa

SEQ ID NO: 54259 - RNA, 27 nt, Artificial Sequence
  Synthetic Oligonucleotide; CD80 exon 2; Set C
uguguggcccauggcuucagaugcuua

SEQ ID NO: 54260 - RNA, 22 nt, Artificial Sequence
  Synthetic Oligonucleotide; CD80 exon 2; Set A
guguggcccauggcuucagaug

SEQ ID NO: 54261 - RNA, 23 nt, Artificial Sequence
  Synthetic Oligonucleotide; CD80 exon 2; Set A
uguguggcccauggcuucagaug

SEQ ID NO: 54262 - RNA, 22 nt, Artificial Sequence
  Synthetic Oligonucleotide; CD80 exon 2; Set A
uguguggcccauggcuucagau

SEQ ID NO: 54263 - RNA, 40 nt, Artificial Sequence
  Synthetic Oligonucleotide; CD80 exon 2; Set C
uggacacuuggauggugauguucccugccuccgugugugg

SEQ ID NO: 54264 - RNA, 39 nt, Artificial Sequence
  Synthetic Oligonucleotide; CD80 exon 2; Set C
uggacacuuggauggugauguucccugccuccgugugug

SEQ ID NO: 54265 - RNA, 38 nt, Artificial Sequence
  Synthetic Oligonucleotide; CD80 exon 2; Set C
uggacacuuggauggugauguucccugccuccgugugu

SEQ ID NO: 54266 - RNA, 40 nt, Artificial Sequence
  Synthetic Oligonucleotide; CD80 exon 2; Set C
auggacacuuggauggugauguucccugccuccgugugug

SEQ ID NO: 54267 - RNA, 39 nt, Artificial Sequence
  Synthetic Oligonucleotide; CD80 exon 2; Set C
auggacacuuggauggugauguucccugccuccgugugu

SEQ ID NO: 54268 - RNA, 37 nt, Artificial Sequence
  Synthetic Oligonucleotide; CD80 exon 2; Set C
uggacacuuggauggugauguucccugccuccgugug

SEQ ID NO: 54269 - RNA, 36 nt, Artificial Sequence
  Synthetic Oligonucleotide; CD80 exon 2; Set C
uggacacuuggauggugauguucccugccuccgugu

SEQ ID NO: 54270 - RNA, 40 nt, Artificial Sequence
  Synthetic Oligonucleotide; CD80 exon 2; Set C
uauggacacuuggauggugauguucccugccuccgugugu

SEQ ID NO: 54271 - RNA, 38 nt, Artificial Sequence
  Synthetic Oligonucleotide; CD80 exon 2; Set C
auggacacuuggauggugauguucccugccuccgugug

SEQ ID NO: 54272 - RNA, 37 nt, Artificial Sequence
  Synthetic Oligonucleotide; CD80 exon 2; Set C
auggacacuuggauggugauguucccugccuccgugu

SEQ ID NO: 54273 - RNA, 39 nt, Artificial Sequence
  Synthetic Oligonucleotide; CD80 exon 2; Set C
uauggacacuuggauggugauguucccugccuccgugug

SEQ ID NO: 54274 - RNA, 38 nt, Artificial Sequence
  Synthetic Oligonucleotide; CD80 exon 2; Set C
uauggacacuuggauggugauguucccugccuccgugu

SEQ ID NO: 54275 - RNA, 40 nt, Artificial Sequence
  Synthetic Oligonucleotide; CD80 exon 2; Set C
guauggacacuuggauggugauguucccugccuccgugug

SEQ ID NO: 54276 - RNA, 39 nt, Artificial Sequence
  Synthetic Oligonucleotide; CD80 exon 2; Set C
guauggacacuuggauggugauguucccugccuccgugu

SEQ ID NO: 54277 - RNA, 40 nt, Artificial Sequence
  Synthetic Oligonucleotide; CD80 exon 2; Set C
gguauggacacuuggauggugauguucccugccuccgugu

SEQ ID NO: 54278 - RNA, 21 nt, Artificial Sequence
  Synthetic Oligonucleotide; CD80 exon 2; Set B
ggacacuuggauggugauguu

SEQ ID NO: 54279 - RNA, 28 nt, Artificial Sequence
  Synthetic Oligonucleotide; CD80 exon 2; Set C
caagagcugaaagaaauugagguaugga

SEQ ID NO: 54280 - RNA, 29 nt, Artificial Sequence
  Synthetic Oligonucleotide; CD80 exon 2; Set B
ccaagagcugaaagaaauugagguaugga

SEQ ID NO: 54281 - RNA, 28 nt, Artificial Sequence
  Synthetic Oligonucleotide; CD80 exon 2; Set C
ccaagagcugaaagaaauugagguaugg

SEQ ID NO: 54282 - RNA, 30 nt, Artificial Sequence
  Synthetic Oligonucleotide; CD80 exon 2; Set B
accaagagcugaaagaaauugagguaugga

SEQ ID NO: 54283 - RNA, 29 nt, Artificial Sequence
  Synthetic Oligonucleotide; CD80 exon 2; Set B
accaagagcugaaagaaauugagguaugg

SEQ ID NO: 54284 - RNA, 31 nt, Artificial Sequence
  Synthetic Oligonucleotide; CD80 exon 2; Set B
caccaagagcugaaagaaauugagguaugga

SEQ ID NO: 54285 - RNA, 30 nt, Artificial Sequence
  Synthetic Oligonucleotide; CD80 exon 2; Set B
caccaagagcugaaagaaauugagguaugg

SEQ ID NO: 54286 - RNA, 25 nt, Artificial Sequence
  Synthetic Oligonucleotide; CD80 exon 2; Set C
ccaagagcugaaagaaauugaggua

SEQ ID NO: 54287 - RNA, 23 nt, Artificial Sequence
  Synthetic Oligonucleotide; CD80 exon 2; Set C
caagagcugaaagaaauugaggu

SEQ ID NO: 54288 - RNA, 32 nt, Artificial Sequence
  Synthetic Oligonucleotide; CD80 exon 2; Set B
agcaccaagagcugaaagaaauugagguaugg

SEQ ID NO: 54289 - RNA, 26 nt, Artificial Sequence
  Synthetic Oligonucleotide; CD80 exon 2; Set C
accaagagcugaaagaaauugaggua

SEQ ID NO: 54290 - RNA, 22 nt, Artificial Sequence
  Synthetic Oligonucleotide; CD80 exon 2; Set C
caagagcugaaagaaauugagg

SEQ ID NO: 54291 - RNA, 24 nt, Artificial Sequence
  Synthetic Oligonucleotide; CD80 exon 2; Set C
ccaagagcugaaagaaauugaggu

SEQ ID NO: 54292 - RNA, 31 nt, Artificial Sequence
  Synthetic Oligonucleotide; CD80 exon 2; Set B
agcaccaagagcugaaagaaauugagguaug

SEQ ID NO: 54293 - RNA, 27 nt, Artificial Sequence
  Synthetic Oligonucleotide; CD80 exon 2; Set C
caccaagagcugaaagaaauugaggua

SEQ ID NO: 54294 - RNA, 21 nt, Artificial Sequence
  Synthetic Oligonucleotide; CD80 exon 2; Set C
caagagcugaaagaaauugag

SEQ ID NO: 54295 - RNA, 23 nt, Artificial Sequence
  Synthetic Oligonucleotide; CD80 exon 2; Set C
ccaagagcugaaagaaauugagg

SEQ ID NO: 54296 - RNA, 25 nt, Artificial Sequence
  Synthetic Oligonucleotide; CD80 exon 2; Set C
accaagagcugaaagaaauugaggu

SEQ ID NO: 54297 - RNA, 30 nt, Artificial Sequence
  Synthetic Oligonucleotide; CD80 exon 2; Set B
agcaccaagagcugaaagaaauugagguau

SEQ ID NO: 54298 - RNA, 20 nt, Artificial Sequence
  Synthetic Oligonucleotide; CD80 exon 2; Set C
caagagcugaaagaaauuga

SEQ ID NO: 54299 - RNA, 26 nt, Artificial Sequence
  Synthetic Oligonucleotide; CD80 exon 2; Set C
caccaagagcugaaagaaauugaggu

SEQ ID NO: 54300 - RNA, 22 nt, Artificial Sequence
  Synthetic Oligonucleotide; CD80 exon 2; Set C
ccaagagcugaaagaaauugag

SEQ ID NO: 54301 - RNA, 24 nt, Artificial Sequence
  Synthetic Oligonucleotide; CD80 exon 2; Set C
accaagagcugaaagaaauugagg

SEQ ID NO: 54302 - RNA, 35 nt, Artificial Sequence
  Synthetic Oligonucleotide; CD80 exon 2; Set C
gccagcaccaagagcugaaagaaauugagguaugg

SEQ ID NO: 54303 - RNA, 19 nt, Artificial Sequence
  Synthetic Oligonucleotide; CD80 exon 2; Set C
caagagcugaaagaaauug

SEQ ID NO: 54304 - RNA, 29 nt, Artificial Sequence
  Synthetic Oligonucleotide; CD80 exon 2; Set B
agcaccaagagcugaaagaaauugaggua

SEQ ID NO: 54305 - RNA, 21 nt, Artificial Sequence
  Synthetic Oligonucleotide; CD80 exon 2; Set C
ccaagagcugaaagaaauuga

SEQ ID NO: 54306 - RNA, 25 nt, Artificial Sequence
  Synthetic Oligonucleotide; CD80 exon 2; Set C
caccaagagcugaaagaaauugagg

SEQ ID NO: 54307 - RNA, 23 nt, Artificial Sequence
  Synthetic Oligonucleotide; CD80 exon 2; Set C
accaagagcugaaagaaauugag

SEQ ID NO: 54308 - RNA, 37 nt, Artificial Sequence
  Synthetic Oligonucleotide; CD80 exon 2; Set C
agccagcaccaagagcugaaagaaauugagguaugga

SEQ ID NO: 54309 - RNA, 34 nt, Artificial Sequence
  Synthetic Oligonucleotide; CD80 exon 2; Set B
gccagcaccaagagcugaaagaaauugagguaug

SEQ ID NO: 54310 - RNA, 36 nt, Artificial Sequence
  Synthetic Oligonucleotide; CD80 exon 2; Set C
agccagcaccaagagcugaaagaaauugagguaugg

SEQ ID NO: 54311 - RNA, 18 nt, Artificial Sequence
  Synthetic Oligonucleotide; CD80 exon 2; Set C
caagagcugaaagaaauu

SEQ ID NO: 54312 - RNA, 20 nt, Artificial Sequence
  Synthetic Oligonucleotide; CD80 exon 2; Set C
ccaagagcugaaagaaauug

SEQ ID NO: 54313 - RNA, 22 nt, Artificial Sequence
  Synthetic Oligonucleotide; CD80 exon 2; Set C
accaagagcugaaagaaauuga

SEQ ID NO: 54314 - RNA, 24 nt, Artificial Sequence
  Synthetic Oligonucleotide; CD80 exon 2; Set C
caccaagagcugaaagaaauugag

SEQ ID NO: 54315 - RNA, 28 nt, Artificial Sequence
  Synthetic Oligonucleotide; CD80 exon 2; Set B
agcaccaagagcugaaagaaauugaggu

SEQ ID NO: 54316 - RNA, 33 nt, Artificial Sequence
  Synthetic Oligonucleotide; CD80 exon 2; Set B
gccagcaccaagagcugaaagaaauugagguau

SEQ ID NO: 54317 - RNA, 35 nt, Artificial Sequence
  Synthetic Oligonucleotide; CD80 exon 2; Set B
agccagcaccaagagcugaaagaaauugagguaug

SEQ ID NO: 54318 - RNA, 17 nt, Artificial Sequence
  Synthetic Oligonucleotide; CD80 exon 2; Set C
caagagcugaaagaaau

SEQ ID NO: 54319 - RNA, 19 nt, Artificial Sequence
  Synthetic Oligonucleotide; CD80 exon 2; Set C
ccaagagcugaaagaaauu

SEQ ID NO: 54320 - RNA, 21 nt, Artificial Sequence
  Synthetic Oligonucleotide; CD80 exon 2; Set C
accaagagcugaaagaaauug

SEQ ID NO: 54321 - RNA, 23 nt, Artificial Sequence
  Synthetic Oligonucleotide; CD80 exon 2; Set C
caccaagagcugaaagaaauuga

SEQ ID NO: 54322 - RNA, 27 nt, Artificial Sequence
  Synthetic Oligonucleotide; CD80 exon 2; Set C
agcaccaagagcugaaagaaauugagg

SEQ ID NO: 54323 - RNA, 34 nt, Artificial Sequence
  Synthetic Oligonucleotide; CD80 exon 2; Set B
agccagcaccaagagcugaaagaaauugagguau

SEQ ID NO: 54324 - RNA, 16 nt, Artificial Sequence
  Synthetic Oligonucleotide; CD80 exon 2; Set C
caagagcugaaagaaa

SEQ ID NO: 54325 - RNA, 18 nt, Artificial Sequence
  Synthetic Oligonucleotide; CD80 exon 2; Set C
ccaagagcugaaagaaau

SEQ ID NO: 54326 - RNA, 20 nt, Artificial Sequence
  Synthetic Oligonucleotide; CD80 exon 2; Set C
accaagagcugaaagaaauu

SEQ ID NO: 54327 - RNA, 22 nt, Artificial Sequence
  Synthetic Oligonucleotide; CD80 exon 2; Set C
caccaagagcugaaagaaauug

SEQ ID NO: 54328 - RNA, 26 nt, Artificial Sequence
  Synthetic Oligonucleotide; CD80 exon 2; Set C
agcaccaagagcugaaagaaauugag

SEQ ID NO: 54329 - RNA, 15 nt, Artificial Sequence
  Synthetic Oligonucleotide; CD80 exon 2; Set C
caagagcugaaagaa

SEQ ID NO: 54330 - RNA, 21 nt, Artificial Sequence
  Synthetic Oligonucleotide; CD80 exon 2; Set C
caccaagagcugaaagaaauu

SEQ ID NO: 54331 - RNA, 17 nt, Artificial Sequence
  Synthetic Oligonucleotide; CD80 exon 2; Set C
ccaagagcugaaagaaa

SEQ ID NO: 54332 - RNA, 19 nt, Artificial Sequence
  Synthetic Oligonucleotide; CD80 exon 2; Set C
accaagagcugaaagaaau

SEQ ID NO: 54333 - RNA, 33 nt, Artificial Sequence
  Synthetic Oligonucleotide; CD80 exon 2; Set B
agccagcaccaagagcugaaagaaauugaggua

SEQ ID NO: 54334 - RNA, 25 nt, Artificial Sequence
  Synthetic Oligonucleotide; CD80 exon 2; Set C
agcaccaagagcugaaagaaauuga

SEQ ID NO: 54335 - RNA, 20 nt, Artificial Sequence
  Synthetic Oligonucleotide; CD80 exon 2; Set C
caccaagagcugaaagaaau

SEQ ID NO: 54336 - RNA, 16 nt, Artificial Sequence
  Synthetic Oligonucleotide; CD80 exon 2; Set C
ccaagagcugaaagaa

SEQ ID NO: 54337 - RNA, 18 nt, Artificial Sequence
  Synthetic Oligonucleotide; CD80 exon 2; Set C
accaagagcugaaagaaa

SEQ ID NO: 54338 - RNA, 24 nt, Artificial Sequence
  Synthetic Oligonucleotide; CD80 exon 2; Set C
agcaccaagagcugaaagaaauug

SEQ ID NO: 54339 - RNA, 32 nt, Artificial Sequence
  Synthetic Oligonucleotide; CD80 exon 2; Set B
agccagcaccaagagcugaaagaaauugaggu

SEQ ID NO: 54340 - RNA, 19 nt, Artificial Sequence
  Synthetic Oligonucleotide; CD80 exon 2; Set C
caccaagagcugaaagaaa

SEQ ID NO: 54341 - RNA, 15 nt, Artificial Sequence
  Synthetic Oligonucleotide; CD80 exon 2; Set C
ccaagagcugaaaga

SEQ ID NO: 54342 - RNA, 17 nt, Artificial Sequence
  Synthetic Oligonucleotide; CD80 exon 2; Set C
accaagagcugaaagaa

SEQ ID NO: 54343 - RNA, 23 nt, Artificial Sequence
  Synthetic Oligonucleotide; CD80 exon 2; Set C
agcaccaagagcugaaagaaauu

SEQ ID NO: 54344 - RNA, 31 nt, Artificial Sequence
  Synthetic Oligonucleotide; CD80 exon 2; Set B
agccagcaccaagagcugaaagaaauugagg

SEQ ID NO: 54345 - RNA, 18 nt, Artificial Sequence
  Synthetic Oligonucleotide; CD80 exon 2; Set C
caccaagagcugaaagaa

SEQ ID NO: 54346 - RNA, 16 nt, Artificial Sequence
  Synthetic Oligonucleotide; CD80 exon 2; Set C
accaagagcugaaaga

SEQ ID NO: 54347 - RNA, 22 nt, Artificial Sequence
  Synthetic Oligonucleotide; CD80 exon 2; Set C
agcaccaagagcugaaagaaau

SEQ ID NO: 54348 - RNA, 30 nt, Artificial Sequence
  Synthetic Oligonucleotide; CD80 exon 2; Set B
agccagcaccaagagcugaaagaaauugag

SEQ ID NO: 54349 - RNA, 17 nt, Artificial Sequence
  Synthetic Oligonucleotide; CD80 exon 2; Set C
caccaagagcugaaaga

SEQ ID NO: 54350 - RNA, 15 nt, Artificial Sequence
  Synthetic Oligonucleotide; CD80 exon 2; Set C
accaagagcugaaag

SEQ ID NO: 54351 - RNA, 21 nt, Artificial Sequence
  Synthetic Oligonucleotide; CD80 exon 2; Set C
agcaccaagagcugaaagaaa

SEQ ID NO: 54352 - RNA, 37 nt, Artificial Sequence
  Synthetic Oligonucleotide; CD80 exon 2; Set C
gaccagccagcaccaagagcugaaagaaauugaggua

SEQ ID NO: 54353 - RNA, 29 nt, Artificial Sequence
  Synthetic Oligonucleotide; CD80 exon 2; Set B
agccagcaccaagagcugaaagaaauuga

SEQ ID NO: 54354 - RNA, 16 nt, Artificial Sequence
  Synthetic Oligonucleotide; CD80 exon 2; Set C
caccaagagcugaaag

SEQ ID NO: 54355 - RNA, 20 nt, Artificial Sequence
  Synthetic Oligonucleotide; CD80 exon 2; Set C
agcaccaagagcugaaagaa

SEQ ID NO: 54356 - RNA, 28 nt, Artificial Sequence
  Synthetic Oligonucleotide; CD80 exon 2; Set B
agccagcaccaagagcugaaagaaauug

SEQ ID NO: 54357 - RNA, 36 nt, Artificial Sequence
  Synthetic Oligonucleotide; CD80 exon 2; Set C
gaccagccagcaccaagagcugaaagaaauugaggu

SEQ ID NO: 54358 - RNA, 15 nt, Artificial Sequence
  Synthetic Oligonucleotide; CD80 exon 2; Set C
caccaagagcugaaa

SEQ ID NO: 54359 - RNA, 27 nt, Artificial Sequence
  Synthetic Oligonucleotide; CD80 exon 2; Set B
agccagcaccaagagcugaaagaaauu

SEQ ID NO: 54360 - RNA, 19 nt, Artificial Sequence
  Synthetic Oligonucleotide; CD80 exon 2; Set C
agcaccaagagcugaaaga

SEQ ID NO: 54361 - RNA, 35 nt, Artificial Sequence
  Synthetic Oligonucleotide; CD80 exon 2; Set C
gaccagccagcaccaagagcugaaagaaauugagg

SEQ ID NO: 54362 - RNA, 26 nt, Artificial Sequence
  Synthetic Oligonucleotide; CD80 exon 2; Set B
agccagcaccaagagcugaaagaaau

SEQ ID NO: 54363 - RNA, 18 nt, Artificial Sequence
  Synthetic Oligonucleotide; CD80 exon 2; Set C
agcaccaagagcugaaag

SEQ ID NO: 54364 - RNA, 34 nt, Artificial Sequence
  Synthetic Oligonucleotide; CD80 exon 2; Set C
gaccagccagcaccaagagcugaaagaaauugag

SEQ ID NO: 54365 - RNA, 17 nt, Artificial Sequence
  Synthetic Oligonucleotide; CD80 exon 2; Set C
agcaccaagagcugaaa

SEQ ID NO: 54366 - RNA, 25 nt, Artificial Sequence
  Synthetic Oligonucleotide; CD80 exon 2; Set B
agccagcaccaagagcugaaagaaa

SEQ ID NO: 54367 - RNA, 33 nt, Artificial Sequence
  Synthetic Oligonucleotide; CD80 exon 2; Set C
gaccagccagcaccaagagcugaaagaaauuga

SEQ ID NO: 54368 - RNA, 16 nt, Artificial Sequence
  Synthetic Oligonucleotide; CD80 exon 2; Set C
agcaccaagagcugaa

SEQ ID NO: 54369 - RNA, 24 nt, Artificial Sequence
  Synthetic Oligonucleotide; CD80 exon 2; Set B
agccagcaccaagagcugaaagaa

SEQ ID NO: 54370 - RNA, 32 nt, Artificial Sequence
  Synthetic Oligonucleotide; CD80 exon 2; Set B
gaccagccagcaccaagagcugaaagaaauug

SEQ ID NO: 54371 - RNA, 15 nt, Artificial Sequence
  Synthetic Oligonucleotide; CD80 exon 2; Set C
agcaccaagagcuga

SEQ ID NO: 54372 - RNA, 31 nt, Artificial Sequence
  Synthetic Oligonucleotide; CD80 exon 2; Set C
gaccagccagcaccaagagcugaaagaaauu

SEQ ID NO: 54373 - RNA, 23 nt, Artificial Sequence
  Synthetic Oligonucleotide; CD80 exon 2; Set B
agccagcaccaagagcugaaaga

SEQ ID NO: 54374 - RNA, 30 nt, Artificial Sequence
  Synthetic Oligonucleotide; CD80 exon 2; Set B
gaccagccagcaccaagagcugaaagaaau

SEQ ID NO: 54375 - RNA, 22 nt, Artificial Sequence
  Synthetic Oligonucleotide; CD80 exon 2; Set B
agccagcaccaagagcugaaag

SEQ ID NO: 54376 - RNA, 21 nt, Artificial Sequence
  Synthetic Oligonucleotide; CD80 exon 2; Set B
agccagcaccaagagcugaaa

SEQ ID NO: 54377 - RNA, 29 nt, Artificial Sequence
  Synthetic Oligonucleotide; CD80 exon 2; Set C
gaccagccagcaccaagagcugaaagaaa

SEQ ID NO: 54378 - RNA, 20 nt, Artificial Sequence
  Synthetic Oligonucleotide; CD80 exon 2; Set B
agccagcaccaagagcugaa

SEQ ID NO: 54379 - RNA, 28 nt, Artificial Sequence
  Synthetic Oligonucleotide; CD80 exon 2; Set C
gaccagccagcaccaagagcugaaagaa

SEQ ID NO: 54380 - RNA, 40 nt, Artificial Sequence
  Synthetic Oligonucleotide; CD80 exon 2; Set C
gagaaagaccagccagcaccaagagcugaaagaaauugag

SEQ ID NO: 54381 - RNA, 19 nt, Artificial Sequence
  Synthetic Oligonucleotide; CD80 exon 2; Set B
agccagcaccaagagcuga

SEQ ID NO: 54382 - RNA, 27 nt, Artificial Sequence
  Synthetic Oligonucleotide; CD80 exon 2; Set C
gaccagccagcaccaagagcugaaaga

SEQ ID NO: 54383 - RNA, 39 nt, Artificial Sequence
  Synthetic Oligonucleotide; CD80 exon 2; Set C
gagaaagaccagccagcaccaagagcugaaagaaauuga

SEQ ID NO: 54384 - RNA, 26 nt, Artificial Sequence
  Synthetic Oligonucleotide; CD80 exon 2; Set B
gaccagccagcaccaagagcugaaag

SEQ ID NO: 54385 - RNA, 38 nt, Artificial Sequence
  Synthetic Oligonucleotide; CD80 exon 2; Set C
gagaaagaccagccagcaccaagagcugaaagaaauug

SEQ ID NO: 54386 - RNA, 40 nt, Artificial Sequence
  Synthetic Oligonucleotide; CD80 exon 2; Set C
ugagaaagaccagccagcaccaagagcugaaagaaauuga

SEQ ID NO: 54387 - RNA, 25 nt, Artificial Sequence
  Synthetic Oligonucleotide; CD80 exon 2; Set C
gaccagccagcaccaagagcugaaa

SEQ ID NO: 54388 - RNA, 37 nt, Artificial Sequence
  Synthetic Oligonucleotide; CD80 exon 2; Set C
gagaaagaccagccagcaccaagagcugaaagaaauu

SEQ ID NO: 54389 - RNA, 39 nt, Artificial Sequence
  Synthetic Oligonucleotide; CD80 exon 2; Set C
ugagaaagaccagccagcaccaagagcugaaagaaauug

SEQ ID NO: 54390 - RNA, 24 nt, Artificial Sequence
  Synthetic Oligonucleotide; CD80 exon 2; Set C
gaccagccagcaccaagagcugaa

SEQ ID NO: 54391 - RNA, 38 nt, Artificial Sequence
  Synthetic Oligonucleotide; CD80 exon 2; Set C
ugagaaagaccagccagcaccaagagcugaaagaaauu

SEQ ID NO: 54392 - RNA, 36 nt, Artificial Sequence
  Synthetic Oligonucleotide; CD80 exon 2; Set C
gagaaagaccagccagcaccaagagcugaaagaaau

SEQ ID NO: 54393 - RNA, 23 nt, Artificial Sequence
  Synthetic Oligonucleotide; CD80 exon 2; Set C
gaccagccagcaccaagagcuga

SEQ ID NO: 54394 - RNA, 37 nt, Artificial Sequence
  Synthetic Oligonucleotide; CD80 exon 2; Set C
ugagaaagaccagccagcaccaagagcugaaagaaau

SEQ ID NO: 54395 - RNA, 35 nt, Artificial Sequence
  Synthetic Oligonucleotide; CD80 exon 2; Set C
gagaaagaccagccagcaccaagagcugaaagaaa

SEQ ID NO: 54396 - RNA, 36 nt, Artificial Sequence
  Synthetic Oligonucleotide; CD80 exon 2; Set C
ugagaaagaccagccagcaccaagagcugaaagaaa

SEQ ID NO: 54397 - RNA, 34 nt, Artificial Sequence
  Synthetic Oligonucleotide; CD80 exon 2; Set C
gagaaagaccagccagcaccaagagcugaaagaa

SEQ ID NO: 54398 - RNA, 35 nt, Artificial Sequence
  Synthetic Oligonucleotide; CD80 exon 2; Set C
ugagaaagaccagccagcaccaagagcugaaagaa

SEQ ID NO: 54399 - RNA, 33 nt, Artificial Sequence
  Synthetic Oligonucleotide; CD80 exon 2; Set C
gagaaagaccagccagcaccaagagcugaaaga

SEQ ID NO: 54400 - RNA, 34 nt, Artificial Sequence
  Synthetic Oligonucleotide; CD80 exon 2; Set C
ugagaaagaccagccagcaccaagagcugaaaga

SEQ ID NO: 54401 - RNA, 32 nt, Artificial Sequence
  Synthetic Oligonucleotide; CD80 exon 2; Set C
gagaaagaccagccagcaccaagagcugaaag

SEQ ID NO: 54402 - RNA, 31 nt, Artificial Sequence
  Synthetic Oligonucleotide; CD80 exon 2; Set C
gagaaagaccagccagcaccaagagcugaaa

SEQ ID NO: 54403 - RNA, 33 nt, Artificial Sequence
  Synthetic Oligonucleotide; CD80 exon 2; Set C
ugagaaagaccagccagcaccaagagcugaaag

SEQ ID NO: 54404 - RNA, 32 nt, Artificial Sequence
  Synthetic Oligonucleotide; CD80 exon 2; Set C
ugagaaagaccagccagcaccaagagcugaaa

SEQ ID NO: 54405 - RNA, 30 nt, Artificial Sequence
  Synthetic Oligonucleotide; CD80 exon 2; Set C
gagaaagaccagccagcaccaagagcugaa

SEQ ID NO: 54406 - RNA, 29 nt, Artificial Sequence
  Synthetic Oligonucleotide; CD80 exon 2; Set C
gagaaagaccagccagcaccaagagcuga

SEQ ID NO: 54407 - RNA, 31 nt, Artificial Sequence
  Synthetic Oligonucleotide; CD80 exon 2; Set C
ugagaaagaccagccagcaccaagagcugaa

SEQ ID NO: 54408 - RNA, 30 nt, Artificial Sequence
  Synthetic Oligonucleotide; CD80 exon 2; Set C
ugagaaagaccagccagcaccaagagcuga

SEQ ID NO: 54409 - RNA, 16 nt, Artificial Sequence
  Synthetic Oligonucleotide; CD80 exon 2; Set B
gaccagccagcaccaa

SEQ ID NO: 54410 - RNA, 24 nt, Artificial Sequence
  Synthetic Oligonucleotide; CD80 exon 2; Set B
gagaaagaccagccagcaccaaga

SEQ ID NO: 54411 - RNA, 25 nt, Artificial Sequence
  Synthetic Oligonucleotide; CD80 exon 2; Set B
ugagaaagaccagccagcaccaaga

SEQ ID NO: 54412 - RNA, 23 nt, Artificial Sequence
  Synthetic Oligonucleotide; CD80 exon 2; Set B
gagaaagaccagccagcaccaag

SEQ ID NO: 54413 - RNA, 24 nt, Artificial Sequence
  Synthetic Oligonucleotide; CD80 exon 2; Set B
ugagaaagaccagccagcaccaag

SEQ ID NO: 54414 - RNA, 18 nt, Artificial Sequence
  Synthetic Oligonucleotide; CD80 exon 2; Set C
gagaaagaccagccagca

SEQ ID NO: 54415 - RNA, 19 nt, Artificial Sequence
  Synthetic Oligonucleotide; CD80 exon 2; Set C
ugagaaagaccagccagca

SEQ ID NO: 54416 - RNA, 38 nt, Artificial Sequence
  Synthetic Oligonucleotide; CD80 exon 2; Set C
accugaacagaagugagaaagaccagccagcaccaaga

SEQ ID NO: 54417 - RNA, 39 nt, Artificial Sequence
  Synthetic Oligonucleotide; CD80 exon 2; Set C
uaccugaacagaagugagaaagaccagccagcaccaaga

SEQ ID NO: 54418 - RNA, 37 nt, Artificial Sequence
  Synthetic Oligonucleotide; CD80 exon 2; Set C
accugaacagaagugagaaagaccagccagcaccaag

SEQ ID NO: 54419 - RNA, 38 nt, Artificial Sequence
  Synthetic Oligonucleotide; CD80 exon 2; Set C
uaccugaacagaagugagaaagaccagccagcaccaag

SEQ ID NO: 54420 - RNA, 39 nt, Artificial Sequence
  Synthetic Oligonucleotide; CD80 exon 2; Set C
uuaccugaacagaagugagaaagaccagccagcaccaag

SEQ ID NO: 54421 - RNA, 38 nt, Artificial Sequence
  Synthetic Oligonucleotide; CD80 exon 2; Set C
uuaccugaacagaagugagaaagaccagccagcaccaa

SEQ ID NO: 54422 - RNA, 32 nt, Artificial Sequence
  Synthetic Oligonucleotide; CD80 exon 2; Set C
accugaacagaagugagaaagaccagccagca

SEQ ID NO: 54423 - RNA, 33 nt, Artificial Sequence
  Synthetic Oligonucleotide; CD80 exon 2; Set C
uaccugaacagaagugagaaagaccagccagca

SEQ ID NO: 54424 - RNA, 34 nt, Artificial Sequence
  Synthetic Oligonucleotide; CD80 exon 2; Set C
uuaccugaacagaagugagaaagaccagccagca

SEQ ID NO: 54425 - RNA, 31 nt, Artificial Sequence
  Synthetic Oligonucleotide; CD80 exon 2; Set B
aguugcuuaccugaacagaagugagaaagac

SEQ ID NO: 54426 - RNA, 25 nt, Artificial Sequence
  Synthetic Oligonucleotide; CD80 exon 2; Set B
aguugcuuaccugaacagaagugag

SEQ ID NO: 54427 - RNA, 24 nt, Artificial Sequence
  Synthetic Oligonucleotide; CD80 exon 2; Set B
aguugcuuaccugaacagaaguga

SEQ ID NO: 54428 - RNA, 39 nt, Artificial Sequence
  Synthetic Oligonucleotide; CD80 exon 2; Set B
uuccugaaaguugcuuaccugaacagaagugagaaagac

SEQ ID NO: 54429 - RNA, 40 nt, Artificial Sequence
  Synthetic Oligonucleotide; CD80 exon 2; Set B
guuccugaaaguugcuuaccugaacagaagugagaaagac

SEQ ID NO: 54430 - RNA, 33 nt, Artificial Sequence
  Synthetic Oligonucleotide; CD80 exon 2; Set B
uuccugaaaguugcuuaccugaacagaagugag

SEQ ID NO: 54431 - RNA, 32 nt, Artificial Sequence
  Synthetic Oligonucleotide; CD80 exon 2; Set B
uuccugaaaguugcuuaccugaacagaaguga

SEQ ID NO: 54432 - RNA, 34 nt, Artificial Sequence
  Synthetic Oligonucleotide; CD80 exon 2; Set B
guuccugaaaguugcuuaccugaacagaagugag

SEQ ID NO: 54433 - RNA, 33 nt, Artificial Sequence
  Synthetic Oligonucleotide; CD80 exon 2; Set B
guuccugaaaguugcuuaccugaacagaaguga

SEQ ID NO: 54434 - RNA, 35 nt, Artificial Sequence
  Synthetic Oligonucleotide; CD80 exon 2; Set B
aguuccugaaaguugcuuaccugaacagaagugag

SEQ ID NO: 54435 - RNA, 34 nt, Artificial Sequence
  Synthetic Oligonucleotide; CD80 exon 2; Set B
aguuccugaaaguugcuuaccugaacagaaguga

SEQ ID NO: 54436 - RNA, 36 nt, Artificial Sequence
  Synthetic Oligonucleotide; CD80 exon 2; Set B
aaguuccugaaaguugcuuaccugaacagaagugag

SEQ ID NO: 54437 - RNA, 35 nt, Artificial Sequence
  Synthetic Oligonucleotide; CD80 exon 2; Set B
aaguuccugaaaguugcuuaccugaacagaaguga

SEQ ID NO: 54438 - RNA, 37 nt, Artificial Sequence
  Synthetic Oligonucleotide; CD80 exon 2; Set B
uaaguuccugaaaguugcuuaccugaacagaagugag

SEQ ID NO: 54439 - RNA, 36 nt, Artificial Sequence
  Synthetic Oligonucleotide; CD80 exon 2; Set B
uaaguuccugaaaguugcuuaccugaacagaaguga

SEQ ID NO: 54440 - RNA, 38 nt, Artificial Sequence
  Synthetic Oligonucleotide; CD80 exon 2; Set B
uuaaguuccugaaaguugcuuaccugaacagaagugag

SEQ ID NO: 54441 - RNA, 37 nt, Artificial Sequence
  Synthetic Oligonucleotide; CD80 exon 2; Set B
uuaaguuccugaaaguugcuuaccugaacagaaguga

SEQ ID NO: 54442 - RNA, 19 nt, Artificial Sequence
  Synthetic Oligonucleotide; CD80 exon 2; Set C
uuccugaaaguugcuuacc

SEQ ID NO: 54443 - RNA, 18 nt, Artificial Sequence
  Synthetic Oligonucleotide; CD80 exon 2; Set C
uuccugaaaguugcuuac

SEQ ID NO: 54444 - RNA, 20 nt, Artificial Sequence
  Synthetic Oligonucleotide; CD80 exon 2; Set C
guuccugaaaguugcuuacc

SEQ ID NO: 54445 - RNA, 17 nt, Artificial Sequence
  Synthetic Oligonucleotide; CD80 exon 2; Set C
uuccugaaaguugcuua

SEQ ID NO: 54446 - RNA, 19 nt, Artificial Sequence
  Synthetic Oligonucleotide; CD80 exon 2; Set C
guuccugaaaguugcuuac

SEQ ID NO: 54447 - RNA, 21 nt, Artificial Sequence
  Synthetic Oligonucleotide; CD80 exon 2; Set C
aguuccugaaaguugcuuacc

SEQ ID NO: 54448 - RNA, 18 nt, Artificial Sequence
  Synthetic Oligonucleotide; CD80 exon 2; Set C
guuccugaaaguugcuua

SEQ ID NO: 54449 - RNA, 20 nt, Artificial Sequence
  Synthetic Oligonucleotide; CD80 exon 2; Set C
aguuccugaaaguugcuuac

SEQ ID NO: 54450 - RNA, 22 nt, Artificial Sequence
  Synthetic Oligonucleotide; CD80 exon 2; Set C
aaguuccugaaaguugcuuacc

SEQ ID NO: 54451 - RNA, 19 nt, Artificial Sequence
  Synthetic Oligonucleotide; CD80 exon 2; Set C
aguuccugaaaguugcuua

SEQ ID NO: 54452 - RNA, 21 nt, Artificial Sequence
  Synthetic Oligonucleotide; CD80 exon 2; Set C
aaguuccugaaaguugcuuac

SEQ ID NO: 54453 - RNA, 23 nt, Artificial Sequence
  Synthetic Oligonucleotide; CD80 exon 2; Set C
uaaguuccugaaaguugcuuacc

SEQ ID NO: 54454 - RNA, 20 nt, Artificial Sequence
  Synthetic Oligonucleotide; CD80 exon 2; Set C
aaguuccugaaaguugcuua

SEQ ID NO: 54455 - RNA, 22 nt, Artificial Sequence
  Synthetic Oligonucleotide; CD80 exon 2; Set C
uaaguuccugaaaguugcuuac

SEQ ID NO: 54456 - RNA, 24 nt, Artificial Sequence
  Synthetic Oligonucleotide; CD80 exon 2; Set C
uuaaguuccugaaaguugcuuacc

SEQ ID NO: 54457 - RNA, 21 nt, Artificial Sequence
  Synthetic Oligonucleotide; CD80 exon 2; Set C
uaaguuccugaaaguugcuua

SEQ ID NO: 54458 - RNA, 23 nt, Artificial Sequence
  Synthetic Oligonucleotide; CD80 exon 2; Set C
uuaaguuccugaaaguugcuuac

SEQ ID NO: 54459 - RNA, 24 nt, Artificial Sequence
  Synthetic Oligonucleotide; CD80 exon 2; Set C
guuaaguuccugaaaguugcuuac

SEQ ID NO: 54460 - RNA, 23 nt, Artificial Sequence
  Synthetic Oligonucleotide; CD80 exon 2; Set C
guuaaguuccugaaaguugcuua

SEQ ID NO: 54461 - RNA, 24 nt, Artificial Sequence
  Synthetic Oligonucleotide; CD80 exon 2; Set C
aguuaaguuccugaaaguugcuua

SEQ ID NO: 54462 - RNA, 32 nt, Artificial Sequence
  Synthetic Oligonucleotide; CD80 exon 2; Set B
ugacucaguuaaguuccugaaaguugcuuacc

SEQ ID NO: 54463 - RNA, 31 nt, Artificial Sequence
  Synthetic Oligonucleotide; CD80 exon 2; Set B
ugacucaguuaaguuccugaaaguugcuuac

SEQ ID NO: 54464 - RNA, 33 nt, Artificial Sequence
  Synthetic Oligonucleotide; CD80 exon 2; Set B
uugacucaguuaaguuccugaaaguugcuuacc

SEQ ID NO: 54465 - RNA, 18 nt, Artificial Sequence
  Synthetic Oligonucleotide; CD80 exon 2; Set C
aguuaaguuccugaaagu

SEQ ID NO: 54466 - RNA, 30 nt, Artificial Sequence
  Synthetic Oligonucleotide; CD80 exon 2; Set B
ugacucaguuaaguuccugaaaguugcuua

SEQ ID NO: 54467 - RNA, 16 nt, Artificial Sequence
  Synthetic Oligonucleotide; CD80 exon 2; Set C
guuaaguuccugaaag

SEQ ID NO: 54468 - RNA, 32 nt, Artificial Sequence
  Synthetic Oligonucleotide; CD80 exon 2; Set B
uugacucaguuaaguuccugaaaguugcuuac

SEQ ID NO: 54469 - RNA, 34 nt, Artificial Sequence
  Synthetic Oligonucleotide; CD80 exon 2; Set B
guugacucaguuaaguuccugaaaguugcuuacc

SEQ ID NO: 54470 - RNA, 31 nt, Artificial Sequence
  Synthetic Oligonucleotide; CD80 exon 2; Set B
uugacucaguuaaguuccugaaaguugcuua

SEQ ID NO: 54471 - RNA, 15 nt, Artificial Sequence
  Synthetic Oligonucleotide; CD80 exon 2; Set C
guuaaguuccugaaa

SEQ ID NO: 54472 - RNA, 17 nt, Artificial Sequence
  Synthetic Oligonucleotide; CD80 exon 2; Set C
aguuaaguuccugaaag

SEQ ID NO: 54473 - RNA, 33 nt, Artificial Sequence
  Synthetic Oligonucleotide; CD80 exon 2; Set B
guugacucaguuaaguuccugaaaguugcuuac

SEQ ID NO: 54474 - RNA, 32 nt, Artificial Sequence
  Synthetic Oligonucleotide; CD80 exon 2; Set B
guugacucaguuaaguuccugaaaguugcuua

SEQ ID NO: 54475 - RNA, 16 nt, Artificial Sequence
  Synthetic Oligonucleotide; CD80 exon 2; Set C
aguuaaguuccugaaa

SEQ ID NO: 54476 - RNA, 15 nt, Artificial Sequence
  Synthetic Oligonucleotide; CD80 exon 2; Set C
aguuaaguuccugaa

SEQ ID NO: 54477 - RNA, 23 nt, Artificial Sequence
  Synthetic Oligonucleotide; CD80 exon 2; Set C
ugacucaguuaaguuccugaaag

SEQ ID NO: 54478 - RNA, 22 nt, Artificial Sequence
  Synthetic Oligonucleotide; CD80 exon 2; Set C
ugacucaguuaaguuccugaaa

SEQ ID NO: 54479 - RNA, 24 nt, Artificial Sequence
  Synthetic Oligonucleotide; CD80 exon 2; Set C
uugacucaguuaaguuccugaaag

SEQ ID NO: 54480 - RNA, 27 nt, Artificial Sequence
  Synthetic Oligonucleotide; CD80 exon 2; Set C
aguugacucaguuaaguuccugaaagu

SEQ ID NO: 54481 - RNA, 25 nt, Artificial Sequence
  Synthetic Oligonucleotide; CD80 exon 2; Set C
guugacucaguuaaguuccugaaag

SEQ ID NO: 54482 - RNA, 23 nt, Artificial Sequence
  Synthetic Oligonucleotide; CD80 exon 2; Set C
uugacucaguuaaguuccugaaa

SEQ ID NO: 54483 - RNA, 21 nt, Artificial Sequence
  Synthetic Oligonucleotide; CD80 exon 2; Set C
ugacucaguuaaguuccugaa

SEQ ID NO: 54484 - RNA, 28 nt, Artificial Sequence
  Synthetic Oligonucleotide; CD80 exon 2; Set B
caguugacucaguuaaguuccugaaagu

SEQ ID NO: 54485 - RNA, 24 nt, Artificial Sequence
  Synthetic Oligonucleotide; CD80 exon 2; Set C
guugacucaguuaaguuccugaaa

SEQ ID NO: 54486 - RNA, 22 nt, Artificial Sequence
  Synthetic Oligonucleotide; CD80 exon 2; Set C
uugacucaguuaaguuccugaa

SEQ ID NO: 54487 - RNA, 23 nt, Artificial Sequence
  Synthetic Oligonucleotide; CD80 exon 2; Set C
guugacucaguuaaguuccugaa

SEQ ID NO: 54488 - RNA, 15 nt, Artificial Sequence
  Synthetic Oligonucleotide; CD80 exon 2; Set C
ugacucaguuaaguu

SEQ ID NO: 54489 - RNA, 33 nt, Artificial Sequence
  Synthetic Oligonucleotide; CD80 exon 2; Set B
uguagcaguugacucaguuaaguuccugaaagu

SEQ ID NO: 54490 - RNA, 15 nt, Artificial Sequence
  Synthetic Oligonucleotide; CD80 exon 2; Set C
uugacucaguuaagu

SEQ ID NO: 54491 - RNA, 19 nt, Artificial Sequence
  Synthetic Oligonucleotide; CD80 exon 2; Set C
aguugacucaguuaaguuc

SEQ ID NO: 54492 - RNA, 18 nt, Artificial Sequence
  Synthetic Oligonucleotide; CD80 exon 2; Set C
aguugacucaguuaaguu

SEQ ID NO: 54493 - RNA, 20 nt, Artificial Sequence
  Synthetic Oligonucleotide; CD80 exon 2; Set C
caguugacucaguuaaguuc

SEQ ID NO: 54494 - RNA, 19 nt, Artificial Sequence
  Synthetic Oligonucleotide; CD80 exon 2; Set C
caguugacucaguuaaguu

SEQ ID NO: 54495 - RNA, 15 nt, Artificial Sequence
  Synthetic Oligonucleotide; CD80 exon 2; Set C
guugacucaguuaag

SEQ ID NO: 54496 - RNA, 17 nt, Artificial Sequence
  Synthetic Oligonucleotide; CD80 exon 2; Set C
aguugacucaguuaagu

SEQ ID NO: 54497 - RNA, 16 nt, Artificial Sequence
  Synthetic Oligonucleotide; CD80 exon 2; Set C
aguugacucaguuaag

SEQ ID NO: 54498 - RNA, 18 nt, Artificial Sequence
  Synthetic Oligonucleotide; CD80 exon 2; Set C
caguugacucaguuaagu

SEQ ID NO: 54499 - RNA, 39 nt, Artificial Sequence
  Synthetic Oligonucleotide; CD80 exon 2; Set C
uaacccuguagcaguugacucaguuaaguuccugaaagu

SEQ ID NO: 54500 - RNA, 15 nt, Artificial Sequence
  Synthetic Oligonucleotide; CD80 exon 2; Set C
aguugacucaguuaa

SEQ ID NO: 54501 - RNA, 17 nt, Artificial Sequence
  Synthetic Oligonucleotide; CD80 exon 2; Set C
caguugacucaguuaag

SEQ ID NO: 54502 - RNA, 40 nt, Artificial Sequence
  Synthetic Oligonucleotide; CD80 exon 2; Set C
uuaacccuguagcaguugacucaguuaaguuccugaaagu

SEQ ID NO: 54503 - RNA, 16 nt, Artificial Sequence
  Synthetic Oligonucleotide; CD80 exon 2; Set C
caguugacucaguuaa

SEQ ID NO: 54504 - RNA, 25 nt, Artificial Sequence
  Synthetic Oligonucleotide; CD80 exon 2; Set C
uguagcaguugacucaguuaaguuc

SEQ ID NO: 54505 - RNA, 15 nt, Artificial Sequence
  Synthetic Oligonucleotide; CD80 exon 2; Set C
caguugacucaguua

SEQ ID NO: 54506 - RNA, 24 nt, Artificial Sequence
  Synthetic Oligonucleotide; CD80 exon 2; Set C
uguagcaguugacucaguuaaguu

SEQ ID NO: 54507 - RNA, 23 nt, Artificial Sequence
  Synthetic Oligonucleotide; CD80 exon 2; Set C
uguagcaguugacucaguuaagu

SEQ ID NO: 54508 - RNA, 22 nt, Artificial Sequence
  Synthetic Oligonucleotide; CD80 exon 2; Set C
uguagcaguugacucaguuaag

SEQ ID NO: 54509 - RNA, 21 nt, Artificial Sequence
  Synthetic Oligonucleotide; CD80 exon 2; Set C
uguagcaguugacucaguuaa

SEQ ID NO: 54510 - RNA, 31 nt, Artificial Sequence
  Synthetic Oligonucleotide; CD80 exon 2; Set B
uaacccuguagcaguugacucaguuaaguuc

SEQ ID NO: 54511 - RNA, 30 nt, Artificial Sequence
  Synthetic Oligonucleotide; CD80 exon 2; Set B
uaacccuguagcaguugacucaguuaaguu

SEQ ID NO: 54512 - RNA, 32 nt, Artificial Sequence
  Synthetic Oligonucleotide; CD80 exon 2; Set B
uuaacccuguagcaguugacucaguuaaguuc

SEQ ID NO: 54513 - RNA, 31 nt, Artificial Sequence
  Synthetic Oligonucleotide; CD80 exon 2; Set B
uuaacccuguagcaguugacucaguuaaguu

SEQ ID NO: 54514 - RNA, 29 nt, Artificial Sequence
  Synthetic Oligonucleotide; CD80 exon 2; Set B
uaacccuguagcaguugacucaguuaagu

SEQ ID NO: 54515 - RNA, 28 nt, Artificial Sequence
  Synthetic Oligonucleotide; CD80 exon 2; Set B
uaacccuguagcaguugacucaguuaag

SEQ ID NO: 54516 - RNA, 30 nt, Artificial Sequence
  Synthetic Oligonucleotide; CD80 exon 2; Set B
uuaacccuguagcaguugacucaguuaagu

SEQ ID NO: 54517 - RNA, 27 nt, Artificial Sequence
  Synthetic Oligonucleotide; CD80 exon 2; Set B
uaacccuguagcaguugacucaguuaa

SEQ ID NO: 54518 - RNA, 29 nt, Artificial Sequence
  Synthetic Oligonucleotide; CD80 exon 2; Set B
uuaacccuguagcaguugacucaguuaag

SEQ ID NO: 54519 - RNA, 28 nt, Artificial Sequence
  Synthetic Oligonucleotide; CD80 exon 2; Set B
uuaacccuguagcaguugacucaguuaa

SEQ ID NO: 54520 - RNA, 26 nt, Artificial Sequence
  Synthetic Oligonucleotide; CD80 exon 2; Set B
uaacccuguagcaguugacucaguua

SEQ ID NO: 54521 - RNA, 27 nt, Artificial Sequence
  Synthetic Oligonucleotide; CD80 exon 2; Set B
uuaacccuguagcaguugacucaguua

SEQ ID NO: 54522 - RNA, 18 nt, Artificial Sequence
  Synthetic Oligonucleotide; CD80 exon 2; Set C
uaacccuguagcaguuga

SEQ ID NO: 54523 - RNA, 19 nt, Artificial Sequence
  Synthetic Oligonucleotide; CD80 exon 2; Set C
uuaacccuguagcaguuga

SEQ ID NO: 54524 - RNA, 17 nt, Artificial Sequence
  Synthetic Oligonucleotide; CD80 exon 2; Set C
uaacccuguagcaguug

SEQ ID NO: 54525 - RNA, 20 nt, Artificial Sequence
  Synthetic Oligonucleotide; CD80 exon 2; Set C
cuuaacccuguagcaguuga

SEQ ID NO: 54526 - RNA, 16 nt, Artificial Sequence
  Synthetic Oligonucleotide; CD80 exon 2; Set C
uaacccuguagcaguu

SEQ ID NO: 54527 - RNA, 18 nt, Artificial Sequence
  Synthetic Oligonucleotide; CD80 exon 2; Set C
uuaacccuguagcaguug

SEQ ID NO: 54528 - RNA, 17 nt, Artificial Sequence
  Synthetic Oligonucleotide; CD80 exon 2; Set C
uuaacccuguagcaguu

SEQ ID NO: 54529 - RNA, 19 nt, Artificial Sequence
  Synthetic Oligonucleotide; CD80 exon 2; Set C
cuuaacccuguagcaguug

SEQ ID NO: 54530 - RNA, 18 nt, Artificial Sequence
  Synthetic Oligonucleotide; CD80 exon 2; Set C
cuuaacccuguagcaguu

SEQ ID NO: 54531 - RNA, 15 nt, Artificial Sequence
  Synthetic Oligonucleotide; CD80 exon 2; Set C
ggaaggugugccuac

SEQ ID NO: 54532 - RNA, 26 nt, Artificial Sequence
  Synthetic Oligonucleotide; CD80 exon 2; Set A
auucaggaaggaaggugugccuacuu

SEQ ID NO: 54533 - RNA, 27 nt, Artificial Sequence
  Synthetic Oligonucleotide; CD80 exon 2; Set A
cauucaggaaggaaggugugccuacuu

SEQ ID NO: 54534 - RNA, 25 nt, Artificial Sequence
  Synthetic Oligonucleotide; CD80 exon 2; Set A
auucaggaaggaaggugugccuacu

SEQ ID NO: 54535 - RNA, 28 nt, Artificial Sequence
  Synthetic Oligonucleotide; CD80 exon 2; Set A
ucauucaggaaggaaggugugccuacuu

SEQ ID NO: 54536 - RNA, 26 nt, Artificial Sequence
  Synthetic Oligonucleotide; CD80 exon 2; Set A
cauucaggaaggaaggugugccuacu

SEQ ID NO: 54537 - RNA, 29 nt, Artificial Sequence
  Synthetic Oligonucleotide; CD80 exon 2; Set A
gucauucaggaaggaaggugugccuacuu

SEQ ID NO: 54538 - RNA, 27 nt, Artificial Sequence
  Synthetic Oligonucleotide; CD80 exon 2; Set A
ucauucaggaaggaaggugugccuacu

SEQ ID NO: 54539 - RNA, 30 nt, Artificial Sequence
  Synthetic Oligonucleotide; CD80 exon 2; Set A
agucauucaggaaggaaggugugccuacuu

SEQ ID NO: 54540 - RNA, 28 nt, Artificial Sequence
  Synthetic Oligonucleotide; CD80 exon 2; Set A
gucauucaggaaggaaggugugccuacu

SEQ ID NO: 54541 - RNA, 29 nt, Artificial Sequence
  Synthetic Oligonucleotide; CD80 exon 2; Set A
agucauucaggaaggaaggugugccuacu

SEQ ID NO: 54542 - RNA, 19 nt, Artificial Sequence
  Synthetic Oligonucleotide; CD80 exon 2; Set C
auucaggaaggaaggugug

SEQ ID NO: 54543 - RNA, 16 nt, Artificial Sequence
  Synthetic Oligonucleotide; CD80 exon 2; Set C
uucaggaaggaaggug

SEQ ID NO: 54544 - RNA, 18 nt, Artificial Sequence
  Synthetic Oligonucleotide; CD80 exon 2; Set C
auucaggaaggaaggugu

SEQ ID NO: 54545 - RNA, 20 nt, Artificial Sequence
  Synthetic Oligonucleotide; CD80 exon 2; Set C
cauucaggaaggaaggugug

SEQ ID NO: 54546 - RNA, 30 nt, Artificial Sequence
  Synthetic Oligonucleotide; CD80 exon 2; Set A
aaagucauucaggaaggaaggugugccuac

SEQ ID NO: 54547 - RNA, 19 nt, Artificial Sequence
  Synthetic Oligonucleotide; CD80 exon 2; Set C
cauucaggaaggaaggugu

SEQ ID NO: 54548 - RNA, 21 nt, Artificial Sequence
  Synthetic Oligonucleotide; CD80 exon 2; Set C
ucauucaggaaggaaggugug

SEQ ID NO: 54549 - RNA, 31 nt, Artificial Sequence
  Synthetic Oligonucleotide; CD80 exon 2; Set A
aaaagucauucaggaaggaaggugugccuac

SEQ ID NO: 54550 - RNA, 18 nt, Artificial Sequence
  Synthetic Oligonucleotide; CD80 exon 2; Set C
cauucaggaaggaaggug

SEQ ID NO: 54551 - RNA, 20 nt, Artificial Sequence
  Synthetic Oligonucleotide; CD80 exon 2; Set C
ucauucaggaaggaaggugu

SEQ ID NO: 54552 - RNA, 22 nt, Artificial Sequence
  Synthetic Oligonucleotide; CD80 exon 2; Set C
gucauucaggaaggaaggugug

SEQ ID NO: 54553 - RNA, 32 nt, Artificial Sequence
  Synthetic Oligonucleotide; CD80 exon 2; Set A
uaaaagucauucaggaaggaaggugugccuac

SEQ ID NO: 54554 - RNA, 17 nt, Artificial Sequence
  Synthetic Oligonucleotide; CD80 exon 2; Set C
cauucaggaaggaaggu

SEQ ID NO: 54555 - RNA, 21 nt, Artificial Sequence
  Synthetic Oligonucleotide; CD80 exon 2; Set C
gucauucaggaaggaaggugu

SEQ ID NO: 54556 - RNA, 23 nt, Artificial Sequence
  Synthetic Oligonucleotide; CD80 exon 2; Set C
agucauucaggaaggaaggugug

SEQ ID NO: 54557 - RNA, 20 nt, Artificial Sequence
  Synthetic Oligonucleotide; CD80 exon 2; Set C
gucauucaggaaggaaggug

SEQ ID NO: 54558 - RNA, 18 nt, Artificial Sequence
  Synthetic Oligonucleotide; CD80 exon 2; Set C
ucauucaggaaggaaggu

SEQ ID NO: 54559 - RNA, 16 nt, Artificial Sequence
  Synthetic Oligonucleotide; CD80 exon 2; Set C
cauucaggaaggaagg

SEQ ID NO: 54560 - RNA, 19 nt, Artificial Sequence
  Synthetic Oligonucleotide; CD80 exon 2; Set C
gucauucaggaaggaaggu

SEQ ID NO: 54561 - RNA, 15 nt, Artificial Sequence
  Synthetic Oligonucleotide; CD80 exon 2; Set C
cauucaggaaggaag

SEQ ID NO: 54562 - RNA, 17 nt, Artificial Sequence
  Synthetic Oligonucleotide; CD80 exon 2; Set C
ucauucaggaaggaagg

SEQ ID NO: 54563 - RNA, 16 nt, Artificial Sequence
  Synthetic Oligonucleotide; CD80 exon 2; Set C
ucauucaggaaggaag

SEQ ID NO: 54564 - RNA, 18 nt, Artificial Sequence
  Synthetic Oligonucleotide; CD80 exon 2; Set C
gucauucaggaaggaagg

SEQ ID NO: 54565 - RNA, 17 nt, Artificial Sequence
  Synthetic Oligonucleotide; CD80 exon 2; Set C
gucauucaggaaggaag

SEQ ID NO: 54566 - RNA, 15 nt, Artificial Sequence
  Synthetic Oligonucleotide; CD80 exon 2; Set C
ucauucaggaaggaa

SEQ ID NO: 54567 - RNA, 16 nt, Artificial Sequence
  Synthetic Oligonucleotide; CD80 exon 2; Set C
gucauucaggaaggaa

SEQ ID NO: 54568 - RNA, 15 nt, Artificial Sequence
  Synthetic Oligonucleotide; CD80 exon 2; Set C
gucauucaggaagga

SEQ ID NO: 54569 - RNA, 17 nt, Artificial Sequence
  Synthetic Oligonucleotide; CD80 exon 2; Set C
agucauucaggaaggaa

SEQ ID NO: 54570 - RNA, 16 nt, Artificial Sequence
  Synthetic Oligonucleotide; CD80 exon 2; Set C
agucauucaggaagga

SEQ ID NO: 54571 - RNA, 15 nt, Artificial Sequence
  Synthetic Oligonucleotide; CD80 exon 2; Set C
agucauucaggaagg

SEQ ID NO: 54572 - RNA, 39 nt, Artificial Sequence
  Synthetic Oligonucleotide; CD80 exon 2; Set A
aaaaggaacaaauaaaagucauucaggaaggaaggugug

SEQ ID NO: 54573 - RNA, 38 nt, Artificial Sequence
  Synthetic Oligonucleotide; CD80 exon 2; Set A
aaaaggaacaaauaaaagucauucaggaaggaaggugu

SEQ ID NO: 54574 - RNA, 40 nt, Artificial Sequence
  Synthetic Oligonucleotide; CD80 exon 2; Set A
aaaaaggaacaaauaaaagucauucaggaaggaaggugug

SEQ ID NO: 54575 - RNA, 37 nt, Artificial Sequence
  Synthetic Oligonucleotide; CD80 exon 2; Set C
aaaaggaacaaauaaaagucauucaggaaggaaggug

SEQ ID NO: 54576 - RNA, 39 nt, Artificial Sequence
  Synthetic Oligonucleotide; CD80 exon 2; Set C
aaaaaggaacaaauaaaagucauucaggaaggaaggugu

SEQ ID NO: 54577 - RNA, 38 nt, Artificial Sequence
  Synthetic Oligonucleotide; CD80 exon 2; Set C
aaaaaggaacaaauaaaagucauucaggaaggaaggug

SEQ ID NO: 54578 - RNA, 36 nt, Artificial Sequence
  Synthetic Oligonucleotide; CD80 exon 2; Set C
aaaaggaacaaauaaaagucauucaggaaggaaggu

SEQ ID NO: 54579 - RNA, 37 nt, Artificial Sequence
  Synthetic Oligonucleotide; CD80 exon 2; Set C
aaaaaggaacaaauaaaagucauucaggaaggaaggu

SEQ ID NO: 54580 - RNA, 35 nt, Artificial Sequence
  Synthetic Oligonucleotide; CD80 exon 2; Set C
aaaaggaacaaauaaaagucauucaggaaggaagg

SEQ ID NO: 54581 - RNA, 34 nt, Artificial Sequence
  Synthetic Oligonucleotide; CD80 exon 2; Set C
aaaaggaacaaauaaaagucauucaggaaggaag

SEQ ID NO: 54582 - RNA, 36 nt, Artificial Sequence
  Synthetic Oligonucleotide; CD80 exon 2; Set C
aaaaaggaacaaauaaaagucauucaggaaggaagg

SEQ ID NO: 54583 - RNA, 33 nt, Artificial Sequence
  Synthetic Oligonucleotide; CD80 exon 2; Set C
aaaaggaacaaauaaaagucauucaggaaggaa

SEQ ID NO: 54584 - RNA, 35 nt, Artificial Sequence
  Synthetic Oligonucleotide; CD80 exon 2; Set C
aaaaaggaacaaauaaaagucauucaggaaggaag

SEQ ID NO: 54585 - RNA, 15 nt, Artificial Sequence
  Synthetic Oligonucleotide; CD80 exon 2; Set C
aaauaaaagucauuc

SEQ ID NO: 54586 - RNA, 32 nt, Artificial Sequence
  Synthetic Oligonucleotide; CD80 exon 2; Set C
aaaaggaacaaauaaaagucauucaggaagga

SEQ ID NO: 54587 - RNA, 34 nt, Artificial Sequence
  Synthetic Oligonucleotide; CD80 exon 2; Set C
aaaaaggaacaaauaaaagucauucaggaaggaa

SEQ ID NO: 54588 - RNA, 31 nt, Artificial Sequence
  Synthetic Oligonucleotide; CD80 exon 2; Set C
aaaaggaacaaauaaaagucauucaggaagg

SEQ ID NO: 54589 - RNA, 33 nt, Artificial Sequence
  Synthetic Oligonucleotide; CD80 exon 2; Set C
aaaaaggaacaaauaaaagucauucaggaagga

SEQ ID NO: 54590 - RNA, 30 nt, Artificial Sequence
  Synthetic Oligonucleotide; CD80 exon 2; Set C
aaaaggaacaaauaaaagucauucaggaag

SEQ ID NO: 54591 - RNA, 32 nt, Artificial Sequence
  Synthetic Oligonucleotide; CD80 exon 2; Set C
aaaaaggaacaaauaaaagucauucaggaagg

SEQ ID NO: 54592 - RNA, 31 nt, Artificial Sequence
  Synthetic Oligonucleotide; CD80 exon 2; Set C
aaaaaggaacaaauaaaagucauucaggaag

SEQ ID NO: 54593 - RNA, 29 nt, Artificial Sequence
  Synthetic Oligonucleotide; CD80 exon 2; Set C
aaaaggaacaaauaaaagucauucaggaa

SEQ ID NO: 54594 - RNA, 30 nt, Artificial Sequence
  Synthetic Oligonucleotide; CD80 exon 2; Set C
aaaaaggaacaaauaaaagucauucaggaa

SEQ ID NO: 54595 - RNA, 20 nt, Artificial Sequence
  Synthetic Oligonucleotide; CD80 exon 2; Set C
aggaacaaauaaaagucauu

SEQ ID NO: 54596 - RNA, 19 nt, Artificial Sequence
  Synthetic Oligonucleotide; CD80 exon 2; Set C
aggaacaaauaaaagucau

SEQ ID NO: 54597 - RNA, 18 nt, Artificial Sequence
  Synthetic Oligonucleotide; CD80 exon 2; Set C
aggaacaaauaaaaguca

SEQ ID NO: 54598 - RNA, 20 nt, Artificial Sequence
  Synthetic Oligonucleotide; CD80 exon 2; Set C
aaggaacaaauaaaagucau

SEQ ID NO: 54599 - RNA, 17 nt, Artificial Sequence
  Synthetic Oligonucleotide; CD80 exon 2; Set C
aggaacaaauaaaaguc

SEQ ID NO: 54600 - RNA, 21 nt, Artificial Sequence
  Synthetic Oligonucleotide; CD80 exon 2; Set C
aaaggaacaaauaaaagucau

SEQ ID NO: 54601 - RNA, 18 nt, Artificial Sequence
  Synthetic Oligonucleotide; CD80 exon 2; Set C
aaggaacaaauaaaaguc

SEQ ID NO: 54602 - RNA, 17 nt, Artificial Sequence
  Synthetic Oligonucleotide; CD80 exon 2; Set C
aaaaggaacaaauaaaa

SEQ ID NO: 54603 - RNA, 16 nt, Artificial Sequence
  Synthetic Oligonucleotide; CD80 exon 2; Set C
aaaaggaacaaauaaa

SEQ ID NO: 54604 - RNA, 18 nt, Artificial Sequence
  Synthetic Oligonucleotide; CD80 exon 2; Set C
aaaaaggaacaaauaaaa

SEQ ID NO: 54605 - RNA, 15 nt, Artificial Sequence
  Synthetic Oligonucleotide; CD80 exon 2; Set C
aaaaggaacaaauaa

SEQ ID NO: 54606 - RNA, 17 nt, Artificial Sequence
  Synthetic Oligonucleotide; CD80 exon 2; Set C
aaaaaggaacaaauaaa

SEQ ID NO: 54607 - RNA, 16 nt, Artificial Sequence
  Synthetic Oligonucleotide; CD80 exon 2; Set C
aaaaaggaacaaauaa

SEQ ID NO: 54608 - RNA, 15 nt, Artificial Sequence
  Synthetic Oligonucleotide; CD80 exon 2; Set C
aaaaaggaacaaaua

SEQ ID NO: 54609 - RNA, 37 nt, Artificial Sequence
  Synthetic Oligonucleotide; CD80 exon 2; Set A
guuucacagccugaaaaaggaacaaauaaaagucauu

SEQ ID NO: 54610 - RNA, 38 nt, Artificial Sequence
  Synthetic Oligonucleotide; CD80 exon 2; Set A
aguuucacagccugaaaaaggaacaaauaaaagucauu

SEQ ID NO: 54611 - RNA, 39 nt, Artificial Sequence
  Synthetic Oligonucleotide; CD80 exon 2; Set A
uaguuucacagccugaaaaaggaacaaauaaaagucauu

SEQ ID NO: 54612 - RNA, 40 nt, Artificial Sequence
  Synthetic Oligonucleotide; CD80 exon 2; Set A
uuaguuucacagccugaaaaaggaacaaauaaaagucauu

SEQ ID NO: 54613 - RNA, 36 nt, Artificial Sequence
  Synthetic Oligonucleotide; CD80 exon 2; Set A
aguuucacagccugaaaaaggaacaaauaaaaguca

SEQ ID NO: 54614 - RNA, 31 nt, Artificial Sequence
  Synthetic Oligonucleotide; CD80 exon 2; Set C
uuucacagccugaaaaaggaacaaauaaaag

SEQ ID NO: 54615 - RNA, 33 nt, Artificial Sequence
  Synthetic Oligonucleotide; CD80 exon 2; Set C
guuucacagccugaaaaaggaacaaauaaaagu

SEQ ID NO: 54616 - RNA, 37 nt, Artificial Sequence
  Synthetic Oligonucleotide; CD80 exon 2; Set A
uaguuucacagccugaaaaaggaacaaauaaaaguca

SEQ ID NO: 54617 - RNA, 32 nt, Artificial Sequence
  Synthetic Oligonucleotide; CD80 exon 2; Set C
guuucacagccugaaaaaggaacaaauaaaag

SEQ ID NO: 54618 - RNA, 34 nt, Artificial Sequence
  Synthetic Oligonucleotide; CD80 exon 2; Set C
aguuucacagccugaaaaaggaacaaauaaaagu

SEQ ID NO: 54619 - RNA, 36 nt, Artificial Sequence
  Synthetic Oligonucleotide; CD80 exon 2; Set C
uaguuucacagccugaaaaaggaacaaauaaaaguc

SEQ ID NO: 54620 - RNA, 38 nt, Artificial Sequence
  Synthetic Oligonucleotide; CD80 exon 2; Set A
uuaguuucacagccugaaaaaggaacaaauaaaaguca

SEQ ID NO: 54621 - RNA, 40 nt, Artificial Sequence
  Synthetic Oligonucleotide; CD80 exon 2; Set A
uuuaguuucacagccugaaaaaggaacaaauaaaagucau

SEQ ID NO: 54622 - RNA, 33 nt, Artificial Sequence
  Synthetic Oligonucleotide; CD80 exon 2; Set C
aguuucacagccugaaaaaggaacaaauaaaag

SEQ ID NO: 54623 - RNA, 35 nt, Artificial Sequence
  Synthetic Oligonucleotide; CD80 exon 2; Set C
uaguuucacagccugaaaaaggaacaaauaaaagu

SEQ ID NO: 54624 - RNA, 37 nt, Artificial Sequence
  Synthetic Oligonucleotide; CD80 exon 2; Set C
uuaguuucacagccugaaaaaggaacaaauaaaaguc

SEQ ID NO: 54625 - RNA, 39 nt, Artificial Sequence
  Synthetic Oligonucleotide; CD80 exon 2; Set A
uuuaguuucacagccugaaaaaggaacaaauaaaaguca

SEQ ID NO: 54626 - RNA, 34 nt, Artificial Sequence
  Synthetic Oligonucleotide; CD80 exon 2; Set C
uaguuucacagccugaaaaaggaacaaauaaaag

SEQ ID NO: 54627 - RNA, 36 nt, Artificial Sequence
  Synthetic Oligonucleotide; CD80 exon 2; Set C
uuaguuucacagccugaaaaaggaacaaauaaaagu

SEQ ID NO: 54628 - RNA, 38 nt, Artificial Sequence
  Synthetic Oligonucleotide; CD80 exon 2; Set C
uuuaguuucacagccugaaaaaggaacaaauaaaaguc

SEQ ID NO: 54629 - RNA, 40 nt, Artificial Sequence
  Synthetic Oligonucleotide; CD80 exon 2; Set A
auuuaguuucacagccugaaaaaggaacaaauaaaaguca

SEQ ID NO: 54630 - RNA, 35 nt, Artificial Sequence
  Synthetic Oligonucleotide; CD80 exon 2; Set C
uuaguuucacagccugaaaaaggaacaaauaaaag

SEQ ID NO: 54631 - RNA, 37 nt, Artificial Sequence
  Synthetic Oligonucleotide; CD80 exon 2; Set C
uuuaguuucacagccugaaaaaggaacaaauaaaagu

SEQ ID NO: 54632 - RNA, 39 nt, Artificial Sequence
  Synthetic Oligonucleotide; CD80 exon 2; Set C
auuuaguuucacagccugaaaaaggaacaaauaaaaguc

SEQ ID NO: 54633 - RNA, 36 nt, Artificial Sequence
  Synthetic Oligonucleotide; CD80 exon 2; Set C
uuuaguuucacagccugaaaaaggaacaaauaaaag

SEQ ID NO: 54634 - RNA, 38 nt, Artificial Sequence
  Synthetic Oligonucleotide; CD80 exon 2; Set C
auuuaguuucacagccugaaaaaggaacaaauaaaagu

SEQ ID NO: 54635 - RNA, 40 nt, Artificial Sequence
  Synthetic Oligonucleotide; CD80 exon 2; Set A
gauuuaguuucacagccugaaaaaggaacaaauaaaaguc

SEQ ID NO: 54636 - RNA, 37 nt, Artificial Sequence
  Synthetic Oligonucleotide; CD80 exon 2; Set C
auuuaguuucacagccugaaaaaggaacaaauaaaag

SEQ ID NO: 54637 - RNA, 39 nt, Artificial Sequence
  Synthetic Oligonucleotide; CD80 exon 2; Set A
gauuuaguuucacagccugaaaaaggaacaaauaaaagu

SEQ ID NO: 54638 - RNA, 38 nt, Artificial Sequence
  Synthetic Oligonucleotide; CD80 exon 2; Set C
gauuuaguuucacagccugaaaaaggaacaaauaaaag

SEQ ID NO: 54639 - RNA, 38 nt, Artificial Sequence
  Synthetic Oligonucleotide; CD80 exon 2; Set A
ggauuuaguuucacagccugaaaaaggaacaaauaaaa

SEQ ID NO: 54640 - RNA, 39 nt, Artificial Sequence
  Synthetic Oligonucleotide; CD80 exon 2; Set A
uggauuuaguuucacagccugaaaaaggaacaaauaaaa

SEQ ID NO: 54641 - RNA, 37 nt, Artificial Sequence
  Synthetic Oligonucleotide; CD80 exon 2; Set A
ggauuuaguuucacagccugaaaaaggaacaaauaaa

SEQ ID NO: 54642 - RNA, 36 nt, Artificial Sequence
  Synthetic Oligonucleotide; CD80 exon 2; Set A
ggauuuaguuucacagccugaaaaaggaacaaauaa

SEQ ID NO: 54643 - RNA, 38 nt, Artificial Sequence
  Synthetic Oligonucleotide; CD80 exon 2; Set A
uggauuuaguuucacagccugaaaaaggaacaaauaaa

SEQ ID NO: 54644 - RNA, 40 nt, Artificial Sequence
  Synthetic Oligonucleotide; CD80 exon 2; Set A
guggauuuaguuucacagccugaaaaaggaacaaauaaaa

SEQ ID NO: 54645 - RNA, 37 nt, Artificial Sequence
  Synthetic Oligonucleotide; CD80 exon 2; Set A
uggauuuaguuucacagccugaaaaaggaacaaauaa

SEQ ID NO: 54646 - RNA, 35 nt, Artificial Sequence
  Synthetic Oligonucleotide; CD80 exon 2; Set A
ggauuuaguuucacagccugaaaaaggaacaaaua

SEQ ID NO: 54647 - RNA, 39 nt, Artificial Sequence
  Synthetic Oligonucleotide; CD80 exon 2; Set A
guggauuuaguuucacagccugaaaaaggaacaaauaaa

SEQ ID NO: 54648 - RNA, 36 nt, Artificial Sequence
  Synthetic Oligonucleotide; CD80 exon 2; Set A
uggauuuaguuucacagccugaaaaaggaacaaaua

SEQ ID NO: 54649 - RNA, 34 nt, Artificial Sequence
  Synthetic Oligonucleotide; CD80 exon 2; Set A
ggauuuaguuucacagccugaaaaaggaacaaau

SEQ ID NO: 54650 - RNA, 38 nt, Artificial Sequence
  Synthetic Oligonucleotide; CD80 exon 2; Set A
guggauuuaguuucacagccugaaaaaggaacaaauaa

SEQ ID NO: 54651 - RNA, 40 nt, Artificial Sequence
  Synthetic Oligonucleotide; CD80 exon 2; Set A
uguggauuuaguuucacagccugaaaaaggaacaaauaaa

SEQ ID NO: 54652 - RNA, 17 nt, Artificial Sequence
  Synthetic Oligonucleotide; CD80 exon 2; Set C
uuucacagccugaaaaa

SEQ ID NO: 54653 - RNA, 39 nt, Artificial Sequence
  Synthetic Oligonucleotide; CD80 exon 2; Set A
uguggauuuaguuucacagccugaaaaaggaacaaauaa

SEQ ID NO: 54654 - RNA, 35 nt, Artificial Sequence
  Synthetic Oligonucleotide; CD80 exon 2; Set A
uggauuuaguuucacagccugaaaaaggaacaaau

SEQ ID NO: 54655 - RNA, 33 nt, Artificial Sequence
  Synthetic Oligonucleotide; CD80 exon 2; Set A
ggauuuaguuucacagccugaaaaaggaacaaa

SEQ ID NO: 54656 - RNA, 37 nt, Artificial Sequence
  Synthetic Oligonucleotide; CD80 exon 2; Set A
guggauuuaguuucacagccugaaaaaggaacaaaua

SEQ ID NO: 54657 - RNA, 40 nt, Artificial Sequence
  Synthetic Oligonucleotide; CD80 exon 2; Set A
uuguggauuuaguuucacagccugaaaaaggaacaaauaa

SEQ ID NO: 54658 - RNA, 38 nt, Artificial Sequence
  Synthetic Oligonucleotide; CD80 exon 2; Set A
uguggauuuaguuucacagccugaaaaaggaacaaaua

SEQ ID NO: 54659 - RNA, 34 nt, Artificial Sequence
  Synthetic Oligonucleotide; CD80 exon 2; Set A
uggauuuaguuucacagccugaaaaaggaacaaa

SEQ ID NO: 54660 - RNA, 36 nt, Artificial Sequence
  Synthetic Oligonucleotide; CD80 exon 2; Set A
guggauuuaguuucacagccugaaaaaggaacaaau

SEQ ID NO: 54661 - RNA, 39 nt, Artificial Sequence
  Synthetic Oligonucleotide; CD80 exon 2; Set A
uuguggauuuaguuucacagccugaaaaaggaacaaaua

SEQ ID NO: 54662 - RNA, 37 nt, Artificial Sequence
  Synthetic Oligonucleotide; CD80 exon 2; Set A
uguggauuuaguuucacagccugaaaaaggaacaaau

SEQ ID NO: 54663 - RNA, 35 nt, Artificial Sequence
  Synthetic Oligonucleotide; CD80 exon 2; Set A
guggauuuaguuucacagccugaaaaaggaacaaa

SEQ ID NO: 54664 - RNA, 40 nt, Artificial Sequence
  Synthetic Oligonucleotide; CD80 exon 2; Set A
guuguggauuuaguuucacagccugaaaaaggaacaaaua

SEQ ID NO: 54665 - RNA, 38 nt, Artificial Sequence
  Synthetic Oligonucleotide; CD80 exon 2; Set A
uuguggauuuaguuucacagccugaaaaaggaacaaau

SEQ ID NO: 54666 - RNA, 36 nt, Artificial Sequence
  Synthetic Oligonucleotide; CD80 exon 2; Set A
uguggauuuaguuucacagccugaaaaaggaacaaa

SEQ ID NO: 54667 - RNA, 39 nt, Artificial Sequence
  Synthetic Oligonucleotide; CD80 exon 2; Set A
guuguggauuuaguuucacagccugaaaaaggaacaaau

SEQ ID NO: 54668 - RNA, 37 nt, Artificial Sequence
  Synthetic Oligonucleotide; CD80 exon 2; Set A
uuguggauuuaguuucacagccugaaaaaggaacaaa

SEQ ID NO: 54669 - RNA, 38 nt, Artificial Sequence
  Synthetic Oligonucleotide; CD80 exon 2; Set A
guuguggauuuaguuucacagccugaaaaaggaacaaa

SEQ ID NO: 54670 - RNA, 27 nt, Artificial Sequence
  Synthetic Oligonucleotide; CD80 exon 2; Set C
ggauuuaguuucacagccugaaaaagg

SEQ ID NO: 54671 - RNA, 26 nt, Artificial Sequence
  Synthetic Oligonucleotide; CD80 exon 2; Set C
ggauuuaguuucacagccugaaaaag

SEQ ID NO: 54672 - RNA, 28 nt, Artificial Sequence
  Synthetic Oligonucleotide; CD80 exon 2; Set C
uggauuuaguuucacagccugaaaaagg

SEQ ID NO: 54673 - RNA, 25 nt, Artificial Sequence
  Synthetic Oligonucleotide; CD80 exon 2; Set C
ggauuuaguuucacagccugaaaaa

SEQ ID NO: 54674 - RNA, 27 nt, Artificial Sequence
  Synthetic Oligonucleotide; CD80 exon 2; Set C
uggauuuaguuucacagccugaaaaag

SEQ ID NO: 54675 - RNA, 29 nt, Artificial Sequence
  Synthetic Oligonucleotide; CD80 exon 2; Set A
guggauuuaguuucacagccugaaaaagg

SEQ ID NO: 54676 - RNA, 26 nt, Artificial Sequence
  Synthetic Oligonucleotide; CD80 exon 2; Set C
uggauuuaguuucacagccugaaaaa

SEQ ID NO: 54677 - RNA, 28 nt, Artificial Sequence
  Synthetic Oligonucleotide; CD80 exon 2; Set C
guggauuuaguuucacagccugaaaaag

SEQ ID NO: 54678 - RNA, 30 nt, Artificial Sequence
  Synthetic Oligonucleotide; CD80 exon 2; Set A
uguggauuuaguuucacagccugaaaaagg

SEQ ID NO: 54679 - RNA, 27 nt, Artificial Sequence
  Synthetic Oligonucleotide; CD80 exon 2; Set C
guggauuuaguuucacagccugaaaaa

SEQ ID NO: 54680 - RNA, 29 nt, Artificial Sequence
  Synthetic Oligonucleotide; CD80 exon 2; Set C
uguggauuuaguuucacagccugaaaaag

SEQ ID NO: 54681 - RNA, 31 nt, Artificial Sequence
  Synthetic Oligonucleotide; CD80 exon 2; Set A
uuguggauuuaguuucacagccugaaaaagg

SEQ ID NO: 54682 - RNA, 28 nt, Artificial Sequence
  Synthetic Oligonucleotide; CD80 exon 2; Set C
uguggauuuaguuucacagccugaaaaa

SEQ ID NO: 54683 - RNA, 30 nt, Artificial Sequence
  Synthetic Oligonucleotide; CD80 exon 2; Set A
uuguggauuuaguuucacagccugaaaaag

SEQ ID NO: 54684 - RNA, 32 nt, Artificial Sequence
  Synthetic Oligonucleotide; CD80 exon 2; Set A
guuguggauuuaguuucacagccugaaaaagg

SEQ ID NO: 54685 - RNA, 29 nt, Artificial Sequence
  Synthetic Oligonucleotide; CD80 exon 2; Set A
uuguggauuuaguuucacagccugaaaaa

SEQ ID NO: 54686 - RNA, 31 nt, Artificial Sequence
  Synthetic Oligonucleotide; CD80 exon 2; Set A
guuguggauuuaguuucacagccugaaaaag

SEQ ID NO: 54687 - RNA, 30 nt, Artificial Sequence
  Synthetic Oligonucleotide; CD80 exon 2; Set A
guuguggauuuaguuucacagccugaaaaa

SEQ ID NO: 54688 - RNA, 16 nt, Artificial Sequence
  Synthetic Oligonucleotide; CD80 exon 2; Set C
uuguggauuuaguuuc

SEQ ID NO: 54689 - RNA, 17 nt, Artificial Sequence
  Synthetic Oligonucleotide; CD80 exon 2; Set C
guuguggauuuaguuuc

SEQ ID NO: 54690 - RNA, 19 nt, Artificial Sequence
  Synthetic Oligonucleotide; CD80 exon 2; Set C
gguuguggauuuaguuuca

SEQ ID NO: 54691 - RNA, 20 nt, Artificial Sequence
  Synthetic Oligonucleotide; CD80 exon 2; Set C
agguuguggauuuaguuuca

SEQ ID NO: 54692 - RNA, 21 nt, Artificial Sequence
  Synthetic Oligonucleotide; CD80 exon 2; Set C
aagguuguggauuuaguuuca

SEQ ID NO: 54693 - RNA, 22 nt, Artificial Sequence
  Synthetic Oligonucleotide; CD80 exon 2; Set C
aaagguuguggauuuaguuuca

SEQ ID NO: 54694 - RNA, 21 nt, Artificial Sequence
  Synthetic Oligonucleotide; CD80 exon 2; Set C
aaagguuguggauuuaguuuc

SEQ ID NO: 54695 - RNA, 21 nt, Artificial Sequence
  Synthetic Oligonucleotide; CD80 exon 2; Set C
caaagguuguggauuuaguuu

SEQ ID NO: 54696 - RNA, 20 nt, Artificial Sequence
  Synthetic Oligonucleotide; CD80 exon 2; Set C
caaagguuguggauuuaguu

SEQ ID NO: 54697 - RNA, 19 nt, Artificial Sequence
  Synthetic Oligonucleotide; CD80 exon 2; Set C
caaagguuguggauuuagu

SEQ ID NO: 54698 - RNA, 18 nt, Artificial Sequence
  Synthetic Oligonucleotide; CD80 exon 2; Set C
caaagguuguggauuuag

SEQ ID NO: 54699 - RNA, 17 nt, Artificial Sequence
  Synthetic Oligonucleotide; CD80 exon 2; Set C
caaagguuguggauuua

SEQ ID NO: 54700 - RNA, 16 nt, Artificial Sequence
  Synthetic Oligonucleotide; CD80 exon 2; Set C
caaagguuguggauuu

SEQ ID NO: 54701 - RNA, 30 nt, Artificial Sequence
  Synthetic Oligonucleotide; CD80 exon 2; Set A
gggucuccaaagguuguggauuuaguuuca

SEQ ID NO: 54702 - RNA, 15 nt, Artificial Sequence
  Synthetic Oligonucleotide; CD80 exon 2; Set C
caaagguuguggauu

SEQ ID NO: 54703 - RNA, 27 nt, Artificial Sequence
  Synthetic Oligonucleotide; CD80 exon 2; Set A
ggucuccaaagguuguggauuuaguuu

SEQ ID NO: 54704 - RNA, 31 nt, Artificial Sequence
  Synthetic Oligonucleotide; CD80 exon 2; Set A
ugggucuccaaagguuguggauuuaguuuca

SEQ ID NO: 54705 - RNA, 26 nt, Artificial Sequence
  Synthetic Oligonucleotide; CD80 exon 2; Set A
ggucuccaaagguuguggauuuaguu

SEQ ID NO: 54706 - RNA, 30 nt, Artificial Sequence
  Synthetic Oligonucleotide; CD80 exon 2; Set A
ugggucuccaaagguuguggauuuaguuuc

SEQ ID NO: 54707 - RNA, 25 nt, Artificial Sequence
  Synthetic Oligonucleotide; CD80 exon 2; Set A
ggucuccaaagguuguggauuuagu

SEQ ID NO: 54708 - RNA, 24 nt, Artificial Sequence
  Synthetic Oligonucleotide; CD80 exon 2; Set C
ggucuccaaagguuguggauuuag

SEQ ID NO: 54709 - RNA, 23 nt, Artificial Sequence
  Synthetic Oligonucleotide; CD80 exon 2; Set C
ggucuccaaagguuguggauuua

SEQ ID NO: 54710 - RNA, 22 nt, Artificial Sequence
  Synthetic Oligonucleotide; CD80 exon 2; Set C
ggucuccaaagguuguggauuu

SEQ ID NO: 54711 - RNA, 21 nt, Artificial Sequence
  Synthetic Oligonucleotide; CD80 exon 2; Set C
ggucuccaaagguuguggauu

SEQ ID NO: 54712 - RNA, 20 nt, Artificial Sequence
  Synthetic Oligonucleotide; CD80 exon 2; Set C
ggucuccaaagguuguggau

SEQ ID NO: 54713 - RNA, 20 nt, Artificial Sequence
  Synthetic Oligonucleotide; CD80 exon 2; Set A
gggucuccaaagguugugga

SEQ ID NO: 54714 - RNA, 19 nt, Artificial Sequence
  Synthetic Oligonucleotide; CD80 exon 2; Set C
gggucuccaaagguugugg

SEQ ID NO: 54715 - RNA, 21 nt, Artificial Sequence
  Synthetic Oligonucleotide; CD80 exon 2; Set A
ugggucuccaaagguugugga

SEQ ID NO: 54716 - RNA, 20 nt, Artificial Sequence
  Synthetic Oligonucleotide; CD80 exon 2; Set C
ugggucuccaaagguugugg

SEQ ID NO: 54717 - RNA, 18 nt, Artificial Sequence
  Synthetic Oligonucleotide; CD80 exon 2; Set C
gggucuccaaagguugug

SEQ ID NO: 54718 - RNA, 17 nt, Artificial Sequence
  Synthetic Oligonucleotide; CD80 exon 2; Set C
gggucuccaaagguugu

SEQ ID NO: 54719 - RNA, 19 nt, Artificial Sequence
  Synthetic Oligonucleotide; CD80 exon 2; Set C
ugggucuccaaagguugug

SEQ ID NO: 54720 - RNA, 16 nt, Artificial Sequence
  Synthetic Oligonucleotide; CD80 exon 2; Set C
gggucuccaaagguug

SEQ ID NO: 54721 - RNA, 18 nt, Artificial Sequence
  Synthetic Oligonucleotide; CD80 exon 2; Set C
ugggucuccaaagguugu

SEQ ID NO: 54722 - RNA, 17 nt, Artificial Sequence
  Synthetic Oligonucleotide; CD80 exon 2; Set C
ugggucuccaaagguug

SEQ ID NO: 54723 - RNA, 31 nt, Artificial Sequence
  Synthetic Oligonucleotide; CD80 exon 2; Set C
gauuggaggguguuccugggucuccaaaggu

SEQ ID NO: 54724 - RNA, 32 nt, Artificial Sequence
  Synthetic Oligonucleotide; CD80 exon 2; Set C
agauuggaggguguuccugggucuccaaaggu

SEQ ID NO: 54725 - RNA, 30 nt, Artificial Sequence
  Synthetic Oligonucleotide; CD80 exon 2; Set C
gauuggaggguguuccugggucuccaaagg

SEQ ID NO: 54726 - RNA, 31 nt, Artificial Sequence
  Synthetic Oligonucleotide; CD80 exon 2; Set C
agauuggaggguguuccugggucuccaaagg

SEQ ID NO: 54727 - RNA, 29 nt, Artificial Sequence
  Synthetic Oligonucleotide; CD80 exon 2; Set C
gauuggaggguguuccugggucuccaaag

SEQ ID NO: 54728 - RNA, 33 nt, Artificial Sequence
  Synthetic Oligonucleotide; CD80 exon 2; Set C
gagauuggaggguguuccugggucuccaaaggu

SEQ ID NO: 54729 - RNA, 30 nt, Artificial Sequence
  Synthetic Oligonucleotide; CD80 exon 2; Set C
agauuggaggguguuccugggucuccaaag

SEQ ID NO: 54730 - RNA, 34 nt, Artificial Sequence
  Synthetic Oligonucleotide; CD80 exon 2; Set C
agagauuggaggguguuccugggucuccaaaggu

SEQ ID NO: 54731 - RNA, 32 nt, Artificial Sequence
  Synthetic Oligonucleotide; CD80 exon 2; Set C
gagauuggaggguguuccugggucuccaaagg

SEQ ID NO: 54732 - RNA, 33 nt, Artificial Sequence
  Synthetic Oligonucleotide; CD80 exon 2; Set C
agagauuggaggguguuccugggucuccaaagg

SEQ ID NO: 54733 - RNA, 31 nt, Artificial Sequence
  Synthetic Oligonucleotide; CD80 exon 2; Set C
gagauuggaggguguuccugggucuccaaag

SEQ ID NO: 54734 - RNA, 32 nt, Artificial Sequence
  Synthetic Oligonucleotide; CD80 exon 2; Set C
agagauuggaggguguuccugggucuccaaag

SEQ ID NO: 54735 - RNA, 30 nt, Artificial Sequence
  Synthetic Oligonucleotide; CD80 exon 2; Set C
gagauuggaggguguuccugggucuccaaa

SEQ ID NO: 54736 - RNA, 31 nt, Artificial Sequence
  Synthetic Oligonucleotide; CD80 exon 2; Set C
agagauuggaggguguuccugggucuccaaa

SEQ ID NO: 54737 - RNA, 20 nt, Artificial Sequence
  Synthetic Oligonucleotide; CD80 exon 2; Set A
gauuggaggguguuccuggg

SEQ ID NO: 54738 - RNA, 21 nt, Artificial Sequence
  Synthetic Oligonucleotide; CD80 exon 2; Set A
agauuggaggguguuccuggg

SEQ ID NO: 54739 - RNA, 22 nt, Artificial Sequence
  Synthetic Oligonucleotide; CD80 exon 2; Set A
gagauuggaggguguuccuggg

SEQ ID NO: 54740 - RNA, 23 nt, Artificial Sequence
  Synthetic Oligonucleotide; CD80 exon 2; Set A
agagauuggaggguguuccuggg

SEQ ID NO: 54741 - RNA, 21 nt, Artificial Sequence
  Synthetic Oligonucleotide; CD80 exon 2; Set A
gagauuggaggguguuccugg

SEQ ID NO: 54742 - RNA, 22 nt, Artificial Sequence
  Synthetic Oligonucleotide; CD80 exon 2; Set A
agagauuggaggguguuccugg

SEQ ID NO: 54743 - RNA, 37 nt, Artificial Sequence
  Synthetic Oligonucleotide; CD80 exon 2; Set C
aauugcucacguagaagacccuccagugauguuuaca

SEQ ID NO: 54744 - RNA, 17 nt, Artificial Sequence
  Synthetic Oligonucleotide; CD80 exon 2; Set C
aauugcucacguagaag

SEQ ID NO: 54745 - RNA, 18 nt, Artificial Sequence
  Synthetic Oligonucleotide; CD80 exon 2; Set C
caauugcucacguagaag

SEQ ID NO: 54746 - RNA, 16 nt, Artificial Sequence
  Synthetic Oligonucleotide; CD80 exon 2; Set C
aauugcucacguagaa

SEQ ID NO: 54747 - RNA, 17 nt, Artificial Sequence
  Synthetic Oligonucleotide; CD80 exon 2; Set C
caauugcucacguagaa

SEQ ID NO: 54748 - RNA, 15 nt, Artificial Sequence
  Synthetic Oligonucleotide; CD80 exon 2; Set C
aauugcucacguaga

SEQ ID NO: 54749 - RNA, 16 nt, Artificial Sequence
  Synthetic Oligonucleotide; CD80 exon 2; Set C
caauugcucacguaga

SEQ ID NO: 54750 - RNA, 15 nt, Artificial Sequence
  Synthetic Oligonucleotide; CD80 exon 2; Set C
caauugcucacguag

SEQ ID NO: 54751 - RNA, 18 nt, Artificial Sequence
  Synthetic Oligonucleotide; CD80 exon 2; Set C
caauccaauugcucacgu

SEQ ID NO: 54752 - RNA, 22 nt, Artificial Sequence
  Synthetic Oligonucleotide; CD80 exon 2; Set C
augacaauccaauugcucacgu

SEQ ID NO: 54753 - RNA, 23 nt, Artificial Sequence
  Synthetic Oligonucleotide; CD80 exon 2; Set A
gaugacaauccaauugcucacgu

SEQ ID NO: 54754 - RNA, 21 nt, Artificial Sequence
  Synthetic Oligonucleotide; CD80 exon 2; Set C
augacaauccaauugcucacg

SEQ ID NO: 54755 - RNA, 24 nt, Artificial Sequence
  Synthetic Oligonucleotide; CD80 exon 2; Set A
ugaugacaauccaauugcucacgu

SEQ ID NO: 54756 - RNA, 22 nt, Artificial Sequence
  Synthetic Oligonucleotide; CD80 exon 2; Set C
gaugacaauccaauugcucacg

SEQ ID NO: 54757 - RNA, 26 nt, Artificial Sequence
  Synthetic Oligonucleotide; CD80 exon 2; Set A
cugaugacaauccaauugcucacgua

SEQ ID NO: 54758 - RNA, 23 nt, Artificial Sequence
  Synthetic Oligonucleotide; CD80 exon 2; Set C
ugaugacaauccaauugcucacg

SEQ ID NO: 54759 - RNA, 28 nt, Artificial Sequence
  Synthetic Oligonucleotide; CD80 exon 2; Set C
ggcugaugacaauccaauugcucacgua

SEQ ID NO: 54760 - RNA, 25 nt, Artificial Sequence
  Synthetic Oligonucleotide; CD80 exon 2; Set A
gcugaugacaauccaauugcucacg

SEQ ID NO: 54761 - RNA, 29 nt, Artificial Sequence
  Synthetic Oligonucleotide; CD80 exon 2; Set C
gggcugaugacaauccaauugcucacgua

SEQ ID NO: 54762 - RNA, 29 nt, Artificial Sequence
  Synthetic Oligonucleotide; CD80 exon 2; Set C
agggcugaugacaauccaauugcucacgu

SEQ ID NO: 54763 - RNA, 40 nt, Artificial Sequence
  Synthetic Oligonucleotide; CD80 exon 2; Set C
aacaggcagggcugaugacaauccaauugcucacguagaa

SEQ ID NO: 54764 - RNA, 15 nt, Artificial Sequence
  Synthetic Oligonucleotide; CD80 exon 2; Set C
ugaugacaauccaau

SEQ ID NO: 54765 - RNA, 39 nt, Artificial Sequence
  Synthetic Oligonucleotide; CD80 exon 2; Set C
aacaggcagggcugaugacaauccaauugcucacguaga

SEQ ID NO: 54766 - RNA, 40 nt, Artificial Sequence
  Synthetic Oligonucleotide; CD80 exon 2; Set C
aaacaggcagggcugaugacaauccaauugcucacguaga

SEQ ID NO: 54767 - RNA, 38 nt, Artificial Sequence
  Synthetic Oligonucleotide; CD80 exon 2; Set C
aacaggcagggcugaugacaauccaauugcucacguag

SEQ ID NO: 54768 - RNA, 37 nt, Artificial Sequence
  Synthetic Oligonucleotide; CD80 exon 2; Set C
aacaggcagggcugaugacaauccaauugcucacgua

SEQ ID NO: 54769 - RNA, 39 nt, Artificial Sequence
  Synthetic Oligonucleotide; CD80 exon 2; Set C
aaacaggcagggcugaugacaauccaauugcucacguag

SEQ ID NO: 54770 - RNA, 16 nt, Artificial Sequence
  Synthetic Oligonucleotide; CD80 exon 2; Set C
gcugaugacaauccaa

SEQ ID NO: 54771 - RNA, 34 nt, Artificial Sequence
  Synthetic Oligonucleotide; CD80 exon 2; Set C
acaggcagggcugaugacaauccaauugcucacg

SEQ ID NO: 54772 - RNA, 38 nt, Artificial Sequence
  Synthetic Oligonucleotide; CD80 exon 2; Set C
aaacaggcagggcugaugacaauccaauugcucacgua

SEQ ID NO: 54773 - RNA, 40 nt, Artificial Sequence
  Synthetic Oligonucleotide; CD80 exon 2; Set C
aaaacaggcagggcugaugacaauccaauugcucacguag

SEQ ID NO: 54774 - RNA, 20 nt, Artificial Sequence
  Synthetic Oligonucleotide; CD80 exon 2; Set C
agggcugaugacaauccaau

SEQ ID NO: 54775 - RNA, 19 nt, Artificial Sequence
  Synthetic Oligonucleotide; CD80 exon 2; Set C
agggcugaugacaauccaa

SEQ ID NO: 54776 - RNA, 28 nt, Artificial Sequence
  Synthetic Oligonucleotide; CD80 exon 2; Set A
aacaggcagggcugaugacaauccaauu

SEQ ID NO: 54777 - RNA, 25 nt, Artificial Sequence
  Synthetic Oligonucleotide; CD80 exon 2; Set C
acaggcagggcugaugacaauccaa

SEQ ID NO: 54778 - RNA, 29 nt, Artificial Sequence
  Synthetic Oligonucleotide; CD80 exon 2; Set A
aaacaggcagggcugaugacaauccaauu

SEQ ID NO: 54779 - RNA, 30 nt, Artificial Sequence
  Synthetic Oligonucleotide; CD80 exon 2; Set A
aaaacaggcagggcugaugacaauccaauu

SEQ ID NO: 54780 - RNA, 31 nt, Artificial Sequence
  Synthetic Oligonucleotide; CD80 exon 2; Set A
caaaacaggcagggcugaugacaauccaauu

SEQ ID NO: 54781 - RNA, 32 nt, Artificial Sequence
  Synthetic Oligonucleotide; CD80 exon 2; Set C
gcaaaacaggcagggcugaugacaauccaauu

SEQ ID NO: 54782 - RNA, 33 nt, Artificial Sequence
  Synthetic Oligonucleotide; CD80 exon 2; Set C
ugcaaaacaggcagggcugaugacaauccaauu

SEQ ID NO: 54783 - RNA, 34 nt, Artificial Sequence
  Synthetic Oligonucleotide; CD80 exon 2; Set C
gugcaaaacaggcagggcugaugacaauccaauu

SEQ ID NO: 54784 - RNA, 21 nt, Artificial Sequence
  Synthetic Oligonucleotide; CD80 exon 2; Set A
aacaggcagggcugaugacaa

SEQ ID NO: 54785 - RNA, 22 nt, Artificial Sequence
  Synthetic Oligonucleotide; CD80 exon 2; Set A
aaacaggcagggcugaugacaa

SEQ ID NO: 54786 - RNA, 23 nt, Artificial Sequence
  Synthetic Oligonucleotide; CD80 exon 2; Set A
aaaacaggcagggcugaugacaa

SEQ ID NO: 54787 - RNA, 37 nt, Artificial Sequence
  Synthetic Oligonucleotide; CD80 exon 2; Set C
ccaggugcaaaacaggcagggcugaugacaauccaau

SEQ ID NO: 54788 - RNA, 15 nt, Artificial Sequence
  Synthetic Oligonucleotide; CD80 exon 2; Set C
acaggcagggcugau

SEQ ID NO: 54789 - RNA, 17 nt, Artificial Sequence
  Synthetic Oligonucleotide; CD80 exon 2; Set C
aacaggcagggcugaug

SEQ ID NO: 54790 - RNA, 38 nt, Artificial Sequence
  Synthetic Oligonucleotide; CD80 exon 2; Set C
cccaggugcaaaacaggcagggcugaugacaauccaau

SEQ ID NO: 54791 - RNA, 40 nt, Artificial Sequence
  Synthetic Oligonucleotide; CD80 exon 2; Set C
ucccaggugcaaaacaggcagggcugaugacaauccaauu

SEQ ID NO: 54792 - RNA, 26 nt, Artificial Sequence
  Synthetic Oligonucleotide; CD80 exon 2; Set A
ugcaaaacaggcagggcugaugacaa

SEQ ID NO: 54793 - RNA, 33 nt, Artificial Sequence
  Synthetic Oligonucleotide; CD80 exon 2; Set C
ucccaggugcaaaacaggcagggcugaugacaa

SEQ ID NO: 54794 - RNA, 34 nt, Artificial Sequence
  Synthetic Oligonucleotide; CD80 exon 2; Set C
uucccaggugcaaaacaggcagggcugaugacaa

SEQ ID NO: 54795 - RNA, 29 nt, Artificial Sequence
  Synthetic Oligonucleotide; CD80 exon 2; Set C
ucccaggugcaaaacaggcagggcugaug

SEQ ID NO: 54796 - RNA, 15 nt, Artificial Sequence
  Synthetic Oligonucleotide; CD80 exon 2; Set C
ugcaaaacaggcagg

SEQ ID NO: 54797 - RNA, 30 nt, Artificial Sequence
  Synthetic Oligonucleotide; CD80 exon 2; Set C
uucccaggugcaaaacaggcagggcugaug

SEQ ID NO: 54798 - RNA, 16 nt, Artificial Sequence
  Synthetic Oligonucleotide; CD80 exon 2; Set C
gugcaaaacaggcagg

SEQ ID NO: 54799 - RNA, 27 nt, Artificial Sequence
  Synthetic Oligonucleotide; CD80 exon 2; Set C
ucccaggugcaaaacaggcagggcuga

SEQ ID NO: 54800 - RNA, 28 nt, Artificial Sequence
  Synthetic Oligonucleotide; CD80 exon 2; Set C
uucccaggugcaaaacaggcagggcuga

SEQ ID NO: 54801 - RNA, 22 nt, Artificial Sequence
  Synthetic Oligonucleotide; CD80 exon 2; Set A
ucccaggugcaaaacaggcagg

SEQ ID NO: 54802 - RNA, 37 nt, Artificial Sequence
  Synthetic Oligonucleotide; CD80 exon 2; Set C
agggcacuucccaggugcaaaacaggcagggcugaug

SEQ ID NO: 54803 - RNA, 23 nt, Artificial Sequence
  Synthetic Oligonucleotide; CD80 exon 2; Set A
uucccaggugcaaaacaggcagg

SEQ ID NO: 54804 - RNA, 36 nt, Artificial Sequence
  Synthetic Oligonucleotide; CD80 exon 2; Set C
agggcacuucccaggugcaaaacaggcagggcugau

SEQ ID NO: 54805 - RNA, 35 nt, Artificial Sequence
  Synthetic Oligonucleotide; CD80 exon 2; Set C
agggcacuucccaggugcaaaacaggcagggcuga

SEQ ID NO: 54806 - RNA, 34 nt, Artificial Sequence
  Synthetic Oligonucleotide; CD80 exon 2; Set C
agggcacuucccaggugcaaaacaggcagggcug

SEQ ID NO: 54807 - RNA, 33 nt, Artificial Sequence
  Synthetic Oligonucleotide; CD80 exon 2; Set C
agggcacuucccaggugcaaaacaggcagggcu

SEQ ID NO: 54808 - RNA, 32 nt, Artificial Sequence
  Synthetic Oligonucleotide; CD80 exon 2; Set C
agggcacuucccaggugcaaaacaggcagggc

SEQ ID NO: 54809 - RNA, 31 nt, Artificial Sequence
  Synthetic Oligonucleotide; CD80 exon 2; Set C
agggcacuucccaggugcaaaacaggcaggg

SEQ ID NO: 54810 - RNA, 24 nt, Artificial Sequence
  Synthetic Oligonucleotide; CD80 exon 2; Set A
agggcacuucccaggugcaaaaca

SEQ ID NO: 54811 - RNA, 24 nt, Artificial Sequence
  Synthetic Oligonucleotide; CD80 exon 2; Set A
cagggcacuucccaggugcaaaac

SEQ ID NO: 54812 - RNA, 23 nt, Artificial Sequence
  Synthetic Oligonucleotide; CD80 exon 2; Set A
cagggcacuucccaggugcaaaa

SEQ ID NO: 54813 - RNA, 22 nt, Artificial Sequence
  Synthetic Oligonucleotide; CD80 exon 2; Set A
cagggcacuucccaggugcaaa

SEQ ID NO: 54814 - RNA, 21 nt, Artificial Sequence
  Synthetic Oligonucleotide; CD80 exon 2; Set C
cagggcacuucccaggugcaa

SEQ ID NO: 54815 - RNA, 20 nt, Artificial Sequence
  Synthetic Oligonucleotide; CD80 exon 2; Set C
cagggcacuucccaggugca

SEQ ID NO: 54816 - RNA, 19 nt, Artificial Sequence
  Synthetic Oligonucleotide; CD80 exon 2; Set A
cagggcacuucccaggugc

SEQ ID NO: 54817 - RNA, 36 nt, Artificial Sequence
  Synthetic Oligonucleotide; CD80 exon 2; Set C
caacaauuuggacccaaguaagaccagggcacuucc

SEQ ID NO: 54818 - RNA, 35 nt, Artificial Sequence
  Synthetic Oligonucleotide; CD80 exon 2; Set C
caacaauuuggacccaaguaagaccagggcacuuc

SEQ ID NO: 54819 - RNA, 37 nt, Artificial Sequence
  Synthetic Oligonucleotide; CD80 exon 2; Set C
ccaacaauuuggacccaaguaagaccagggcacuucc

SEQ ID NO: 54820 - RNA, 36 nt, Artificial Sequence
  Synthetic Oligonucleotide; CD80 exon 2; Set C
ccaacaauuuggacccaaguaagaccagggcacuuc

SEQ ID NO: 54821 - RNA, 38 nt, Artificial Sequence
  Synthetic Oligonucleotide; CD80 exon 2; Set C
gccaacaauuuggacccaaguaagaccagggcacuucc

SEQ ID NO: 54822 - RNA, 37 nt, Artificial Sequence
  Synthetic Oligonucleotide; CD80 exon 2; Set C
gccaacaauuuggacccaaguaagaccagggcacuuc

SEQ ID NO: 54823 - RNA, 39 nt, Artificial Sequence
  Synthetic Oligonucleotide; CD80 exon 2; Set C
agccaacaauuuggacccaaguaagaccagggcacuucc

SEQ ID NO: 54824 - RNA, 38 nt, Artificial Sequence
  Synthetic Oligonucleotide; CD80 exon 2; Set C
agccaacaauuuggacccaaguaagaccagggcacuuc

SEQ ID NO: 54825 - RNA, 40 nt, Artificial Sequence
  Synthetic Oligonucleotide; CD80 exon 2; Set C
aagccaacaauuuggacccaaguaagaccagggcacuucc

SEQ ID NO: 54826 - RNA, 39 nt, Artificial Sequence
  Synthetic Oligonucleotide; CD80 exon 2; Set C
aagccaacaauuuggacccaaguaagaccagggcacuuc

SEQ ID NO: 54827 - RNA, 40 nt, Artificial Sequence
  Synthetic Oligonucleotide; CD80 exon 2; Set C
aaagccaacaauuuggacccaaguaagaccagggcacuuc

SEQ ID NO: 54828 - RNA, 31 nt, Artificial Sequence
  Synthetic Oligonucleotide; CD80 exon 2; Set C
agccaacaauuuggacccaaguaagaccagg

SEQ ID NO: 54829 - RNA, 32 nt, Artificial Sequence
  Synthetic Oligonucleotide; CD80 exon 2; Set A
aagccaacaauuuggacccaaguaagaccagg

SEQ ID NO: 54830 - RNA, 33 nt, Artificial Sequence
  Synthetic Oligonucleotide; CD80 exon 2; Set A
aaagccaacaauuuggacccaaguaagaccagg

SEQ ID NO: 54831 - RNA, 19 nt, Artificial Sequence
  Synthetic Oligonucleotide; CD80 exon 2; Set C
cuuagggucaaaagugaaa

SEQ ID NO: 54832 - RNA, 22 nt, Artificial Sequence
  Synthetic Oligonucleotide; CD80 exon 2; Set C
gaugcuuagggucaaaagugaa

SEQ ID NO: 54833 - RNA, 38 nt, Artificial Sequence
  Synthetic Oligonucleotide; CD80 exon 2; Set C
cauggcuucagaugcuuagggucaaaagugaaagccaa

SEQ ID NO: 54834 - RNA, 37 nt, Artificial Sequence
  Synthetic Oligonucleotide; CD80 exon 2; Set C
cauggcuucagaugcuuagggucaaaagugaaagcca

SEQ ID NO: 54835 - RNA, 36 nt, Artificial Sequence
  Synthetic Oligonucleotide; CD80 exon 2; Set C
cauggcuucagaugcuuagggucaaaagugaaagcc

SEQ ID NO: 54836 - RNA, 35 nt, Artificial Sequence
  Synthetic Oligonucleotide; CD80 exon 2; Set A
cauggcuucagaugcuuagggucaaaagugaaagc

SEQ ID NO: 54837 - RNA, 34 nt, Artificial Sequence
  Synthetic Oligonucleotide; CD80 exon 2; Set A
cauggcuucagaugcuuagggucaaaagugaaag

SEQ ID NO: 54838 - RNA, 33 nt, Artificial Sequence
  Synthetic Oligonucleotide; CD80 exon 2; Set A
cauggcuucagaugcuuagggucaaaagugaaa

SEQ ID NO: 54839 - RNA, 39 nt, Artificial Sequence
  Synthetic Oligonucleotide; CD80 exon 2; Set C
uggcccauggcuucagaugcuuagggucaaaagugaaag

SEQ ID NO: 54840 - RNA, 38 nt, Artificial Sequence
  Synthetic Oligonucleotide; CD80 exon 2; Set C
uggcccauggcuucagaugcuuagggucaaaagugaaa

SEQ ID NO: 54841 - RNA, 18 nt, Artificial Sequence
  Synthetic Oligonucleotide; CD80 exon 2; Set C
cauggcuucagaugcuua

SEQ ID NO: 54842 - RNA, 23 nt, Artificial Sequence
  Synthetic Oligonucleotide; CD80 exon 2; Set C
uggcccauggcuucagaugcuua

SEQ ID NO: 54843 - RNA, 24 nt, Artificial Sequence
  Synthetic Oligonucleotide; CD80 exon 2; Set C
guggcccauggcuucagaugcuua

SEQ ID NO: 54844 - RNA, 22 nt, Artificial Sequence
  Synthetic Oligonucleotide; CD80 exon 2; Set A
uggcccauggcuucagaugcuu

SEQ ID NO: 54845 - RNA, 25 nt, Artificial Sequence
  Synthetic Oligonucleotide; CD80 exon 2; Set C
uguggcccauggcuucagaugcuua

SEQ ID NO: 54846 - RNA, 23 nt, Artificial Sequence
  Synthetic Oligonucleotide; CD80 exon 2; Set C
guggcccauggcuucagaugcuu

SEQ ID NO: 54847 - RNA, 21 nt, Artificial Sequence
  Synthetic Oligonucleotide; CD80 exon 2; Set A
uggcccauggcuucagaugcu

SEQ ID NO: 54848 - RNA, 26 nt, Artificial Sequence
  Synthetic Oligonucleotide; CD80 exon 2; Set C
guguggcccauggcuucagaugcuua

SEQ ID NO: 54849 - RNA, 24 nt, Artificial Sequence
  Synthetic Oligonucleotide; CD80 exon 2; Set C
uguggcccauggcuucagaugcuu

SEQ ID NO: 54850 - RNA, 22 nt, Artificial Sequence
  Synthetic Oligonucleotide; CD80 exon 2; Set C
guggcccauggcuucagaugcu

SEQ ID NO: 54851 - RNA, 19 nt, Artificial Sequence
  Synthetic Oligonucleotide; CD80 exon 2; Set A
uggcccauggcuucagaug

SEQ ID NO: 54852 - RNA, 23 nt, Artificial Sequence
  Synthetic Oligonucleotide; CD80 exon 2; Set C
uguggcccauggcuucagaugcu

SEQ ID NO: 54853 - RNA, 25 nt, Artificial Sequence
  Synthetic Oligonucleotide; CD80 exon 2; Set C
guguggcccauggcuucagaugcuu

SEQ ID NO: 54854 - RNA, 21 nt, Artificial Sequence
  Synthetic Oligonucleotide; CD80 exon 2; Set C
guggcccauggcuucagaugc

SEQ ID NO: 54855 - RNA, 20 nt, Artificial Sequence
  Synthetic Oligonucleotide; CD80 exon 2; Set A
guggcccauggcuucagaug

SEQ ID NO: 54856 - RNA, 18 nt, Artificial Sequence
  Synthetic Oligonucleotide; CD80 exon 2; Set A
uggcccauggcuucagau

SEQ ID NO: 54857 - RNA, 26 nt, Artificial Sequence
  Synthetic Oligonucleotide; CD80 exon 2; Set C
uguguggcccauggcuucagaugcuu

SEQ ID NO: 54858 - RNA, 24 nt, Artificial Sequence
  Synthetic Oligonucleotide; CD80 exon 2; Set C
guguggcccauggcuucagaugcu

SEQ ID NO: 54859 - RNA, 22 nt, Artificial Sequence
  Synthetic Oligonucleotide; CD80 exon 2; Set C
uguggcccauggcuucagaugc

SEQ ID NO: 54860 - RNA, 21 nt, Artificial Sequence
  Synthetic Oligonucleotide; CD80 exon 2; Set A
uguggcccauggcuucagaug

SEQ ID NO: 54861 - RNA, 19 nt, Artificial Sequence
  Synthetic Oligonucleotide; CD80 exon 2; Set A
guggcccauggcuucagau

SEQ ID NO: 54862 - RNA, 25 nt, Artificial Sequence
  Synthetic Oligonucleotide; CD80 exon 2; Set C
uguguggcccauggcuucagaugcu

SEQ ID NO: 54863 - RNA, 23 nt, Artificial Sequence
  Synthetic Oligonucleotide; CD80 exon 2; Set C
guguggcccauggcuucagaugc

SEQ ID NO: 54864 - RNA, 20 nt, Artificial Sequence
  Synthetic Oligonucleotide; CD80 exon 2; Set A
uguggcccauggcuucagau

SEQ ID NO: 54865 - RNA, 24 nt, Artificial Sequence
  Synthetic Oligonucleotide; CD80 exon 2; Set C
uguguggcccauggcuucagaugc

SEQ ID NO: 54866 - RNA, 21 nt, Artificial Sequence
  Synthetic Oligonucleotide; CD80 exon 2; Set A
guguggcccauggcuucagau

SEQ ID NO: 54867 - RNA, 24 nt, Artificial Sequence
  Synthetic Oligonucleotide; CD80 exon 2; Set C
guguguggcccauggcuucagaug

SEQ ID NO: 54868 - RNA, 40 nt, Artificial Sequence
  Synthetic Oligonucleotide; CD80 exon 2; Set C
guucccugccuccguguguggcccauggcuucagaugcuu

SEQ ID NO: 54869 - RNA, 39 nt, Artificial Sequence
  Synthetic Oligonucleotide; CD80 exon 2; Set C
guucccugccuccguguguggcccauggcuucagaugcu

SEQ ID NO: 54870 - RNA, 38 nt, Artificial Sequence
  Synthetic Oligonucleotide; CD80 exon 2; Set C
guucccugccuccguguguggcccauggcuucagaugc

SEQ ID NO: 54871 - RNA, 37 nt, Artificial Sequence
  Synthetic Oligonucleotide; CD80 exon 2; Set C
guucccugccuccguguguggcccauggcuucagaug

SEQ ID NO: 54872 - RNA, 36 nt, Artificial Sequence
  Synthetic Oligonucleotide; CD80 exon 2; Set C
guucccugccuccguguguggcccauggcuucagau

SEQ ID NO: 54873 - RNA, 26 nt, Artificial Sequence
  Synthetic Oligonucleotide; CD80 exon 2; Set C
guucccugccuccguguguggcccau

SEQ ID NO: 54874 - RNA, 21 nt, Artificial Sequence
  Synthetic Oligonucleotide; CD80 exon 2; Set C
guucccugccuccgugugugg

SEQ ID NO: 54875 - RNA, 20 nt, Artificial Sequence
  Synthetic Oligonucleotide; CD80 exon 2; Set A
guucccugccuccgugugug

SEQ ID NO: 54876 - RNA, 19 nt, Artificial Sequence
  Synthetic Oligonucleotide; CD80 exon 2; Set A
guucccugccuccgugugu

SEQ ID NO: 54877 - RNA, 18 nt, Artificial Sequence
  Synthetic Oligonucleotide; CD80 exon 2; Set A
guucccugccuccgugug

SEQ ID NO: 54878 - RNA, 17 nt, Artificial Sequence
  Synthetic Oligonucleotide; CD80 exon 2; Set A
guucccugccuccgugu

SEQ ID NO: 54879 - RNA, 39 nt, Artificial Sequence
  Synthetic Oligonucleotide; CD80 exon 2; Set C
ggacacuuggauggugauguucccugccuccgugugugg

SEQ ID NO: 54880 - RNA, 38 nt, Artificial Sequence
  Synthetic Oligonucleotide; CD80 exon 2; Set C
ggacacuuggauggugauguucccugccuccgugugug

SEQ ID NO: 54881 - RNA, 37 nt, Artificial Sequence
  Synthetic Oligonucleotide; CD80 exon 2; Set C
ggacacuuggauggugauguucccugccuccgugugu

SEQ ID NO: 54882 - RNA, 36 nt, Artificial Sequence
  Synthetic Oligonucleotide; CD80 exon 2; Set C
ggacacuuggauggugauguucccugccuccgugug

SEQ ID NO: 54883 - RNA, 35 nt, Artificial Sequence
  Synthetic Oligonucleotide; CD80 exon 2; Set C
ggacacuuggauggugauguucccugccuccgugu

SEQ ID NO: 54884 - RNA, 36 nt, Artificial Sequence
  Synthetic Oligonucleotide; CD80 exon 2; Set C
auggacacuuggauggugauguucccugccuccgug

SEQ ID NO: 54885 - RNA, 37 nt, Artificial Sequence
  Synthetic Oligonucleotide; CD80 exon 2; Set C
uauggacacuuggauggugauguucccugccuccgug

SEQ ID NO: 54886 - RNA, 35 nt, Artificial Sequence
  Synthetic Oligonucleotide; CD80 exon 2; Set C
auggacacuuggauggugauguucccugccuccgu

SEQ ID NO: 54887 - RNA, 38 nt, Artificial Sequence
  Synthetic Oligonucleotide; CD80 exon 2; Set C
guauggacacuuggauggugauguucccugccuccgug

SEQ ID NO: 54888 - RNA, 36 nt, Artificial Sequence
  Synthetic Oligonucleotide; CD80 exon 2; Set C
uauggacacuuggauggugauguucccugccuccgu

SEQ ID NO: 54889 - RNA, 39 nt, Artificial Sequence
  Synthetic Oligonucleotide; CD80 exon 2; Set C
gguauggacacuuggauggugauguucccugccuccgug

SEQ ID NO: 54890 - RNA, 40 nt, Artificial Sequence
  Synthetic Oligonucleotide; CD80 exon 2; Set C
agguauggacacuuggauggugauguucccugccuccgug

SEQ ID NO: 54891 - RNA, 15 nt, Artificial Sequence
  Synthetic Oligonucleotide; CD80 exon 2; Set C
auggacacuuggaug

SEQ ID NO: 54892 - RNA, 16 nt, Artificial Sequence
  Synthetic Oligonucleotide; CD80 exon 2; Set C
uauggacacuuggaug

SEQ ID NO: 54893 - RNA, 33 nt, Artificial Sequence
  Synthetic Oligonucleotide; CD80 exon 2; Set B
gaaauugagguauggacacuuggauggugaugu

SEQ ID NO: 54894 - RNA, 34 nt, Artificial Sequence
  Synthetic Oligonucleotide; CD80 exon 2; Set B
agaaauugagguauggacacuuggauggugaugu

SEQ ID NO: 54895 - RNA, 35 nt, Artificial Sequence
  Synthetic Oligonucleotide; CD80 exon 2; Set B
aagaaauugagguauggacacuuggauggugaugu

SEQ ID NO: 54896 - RNA, 22 nt, Artificial Sequence
  Synthetic Oligonucleotide; CD80 exon 2; Set C
uugagguauggacacuuggaug

SEQ ID NO: 54897 - RNA, 36 nt, Artificial Sequence
  Synthetic Oligonucleotide; CD80 exon 2; Set B
aaagaaauugagguauggacacuuggauggugaugu

SEQ ID NO: 54898 - RNA, 23 nt, Artificial Sequence
  Synthetic Oligonucleotide; CD80 exon 2; Set C
auugagguauggacacuuggaug

SEQ ID NO: 54899 - RNA, 37 nt, Artificial Sequence
  Synthetic Oligonucleotide; CD80 exon 2; Set B
gaaagaaauugagguauggacacuuggauggugaugu

SEQ ID NO: 54900 - RNA, 24 nt, Artificial Sequence
  Synthetic Oligonucleotide; CD80 exon 2; Set C
aauugagguauggacacuuggaug

SEQ ID NO: 54901 - RNA, 38 nt, Artificial Sequence
  Synthetic Oligonucleotide; CD80 exon 2; Set B
ugaaagaaauugagguauggacacuuggauggugaugu

SEQ ID NO: 54902 - RNA, 25 nt, Artificial Sequence
  Synthetic Oligonucleotide; CD80 exon 2; Set C
aaauugagguauggacacuuggaug

SEQ ID NO: 54903 - RNA, 26 nt, Artificial Sequence
  Synthetic Oligonucleotide; CD80 exon 2; Set B
gaaauugagguauggacacuuggaug

SEQ ID NO: 54904 - RNA, 27 nt, Artificial Sequence
  Synthetic Oligonucleotide; CD80 exon 2; Set B
agaaauugagguauggacacuuggaug

SEQ ID NO: 54905 - RNA, 28 nt, Artificial Sequence
  Synthetic Oligonucleotide; CD80 exon 2; Set C
aagaaauugagguauggacacuuggaug

SEQ ID NO: 54906 - RNA, 16 nt, Artificial Sequence
  Synthetic Oligonucleotide; CD80 exon 2; Set C
uugagguauggacacu

SEQ ID NO: 54907 - RNA, 29 nt, Artificial Sequence
  Synthetic Oligonucleotide; CD80 exon 2; Set C
aaagaaauugagguauggacacuuggaug

SEQ ID NO: 54908 - RNA, 17 nt, Artificial Sequence
  Synthetic Oligonucleotide; CD80 exon 2; Set C
auugagguauggacacu

SEQ ID NO: 54909 - RNA, 30 nt, Artificial Sequence
  Synthetic Oligonucleotide; CD80 exon 2; Set B
gaaagaaauugagguauggacacuuggaug

SEQ ID NO: 54910 - RNA, 28 nt, Artificial Sequence
  Synthetic Oligonucleotide; CD80 exon 2; Set C
aaagaaauugagguauggacacuuggau

SEQ ID NO: 54911 - RNA, 18 nt, Artificial Sequence
  Synthetic Oligonucleotide; CD80 exon 2; Set C
aauugagguauggacacu

SEQ ID NO: 54912 - RNA, 31 nt, Artificial Sequence
  Synthetic Oligonucleotide; CD80 exon 2; Set B
ugaaagaaauugagguauggacacuuggaug

SEQ ID NO: 54913 - RNA, 29 nt, Artificial Sequence
  Synthetic Oligonucleotide; CD80 exon 2; Set B
gaaagaaauugagguauggacacuuggau

SEQ ID NO: 54914 - RNA, 19 nt, Artificial Sequence
  Synthetic Oligonucleotide; CD80 exon 2; Set C
aaauugagguauggacacu

SEQ ID NO: 54915 - RNA, 27 nt, Artificial Sequence
  Synthetic Oligonucleotide; CD80 exon 2; Set C
aaagaaauugagguauggacacuugga

SEQ ID NO: 54916 - RNA, 30 nt, Artificial Sequence
  Synthetic Oligonucleotide; CD80 exon 2; Set B
ugaaagaaauugagguauggacacuuggau

SEQ ID NO: 54917 - RNA, 20 nt, Artificial Sequence
  Synthetic Oligonucleotide; CD80 exon 2; Set C
gaaauugagguauggacacu

SEQ ID NO: 54918 - RNA, 26 nt, Artificial Sequence
  Synthetic Oligonucleotide; CD80 exon 2; Set C
aaagaaauugagguauggacacuugg

SEQ ID NO: 54919 - RNA, 28 nt, Artificial Sequence
  Synthetic Oligonucleotide; CD80 exon 2; Set B
gaaagaaauugagguauggacacuugga

SEQ ID NO: 54920 - RNA, 21 nt, Artificial Sequence
  Synthetic Oligonucleotide; CD80 exon 2; Set C
agaaauugagguauggacacu

SEQ ID NO: 54921 - RNA, 27 nt, Artificial Sequence
  Synthetic Oligonucleotide; CD80 exon 2; Set C
gaaagaaauugagguauggacacuugg

SEQ ID NO: 54922 - RNA, 29 nt, Artificial Sequence
  Synthetic Oligonucleotide; CD80 exon 2; Set B
ugaaagaaauugagguauggacacuugga

SEQ ID NO: 54923 - RNA, 25 nt, Artificial Sequence
  Synthetic Oligonucleotide; CD80 exon 2; Set C
aaagaaauugagguauggacacuug

SEQ ID NO: 54924 - RNA, 22 nt, Artificial Sequence
  Synthetic Oligonucleotide; CD80 exon 2; Set C
aagaaauugagguauggacacu

SEQ ID NO: 54925 - RNA, 28 nt, Artificial Sequence
  Synthetic Oligonucleotide; CD80 exon 2; Set C
ugaaagaaauugagguauggacacuugg

SEQ ID NO: 54926 - RNA, 26 nt, Artificial Sequence
  Synthetic Oligonucleotide; CD80 exon 2; Set C
gaaagaaauugagguauggacacuug

SEQ ID NO: 54927 - RNA, 24 nt, Artificial Sequence
  Synthetic Oligonucleotide; CD80 exon 2; Set C
aaagaaauugagguauggacacuu

SEQ ID NO: 54928 - RNA, 23 nt, Artificial Sequence
  Synthetic Oligonucleotide; CD80 exon 2; Set C
aaagaaauugagguauggacacu

SEQ ID NO: 54929 - RNA, 27 nt, Artificial Sequence
  Synthetic Oligonucleotide; CD80 exon 2; Set C
ugaaagaaauugagguauggacacuug

SEQ ID NO: 54930 - RNA, 25 nt, Artificial Sequence
  Synthetic Oligonucleotide; CD80 exon 2; Set C
gaaagaaauugagguauggacacuu

SEQ ID NO: 54931 - RNA, 36 nt, Artificial Sequence
  Synthetic Oligonucleotide; CD80 exon 2; Set B
agagcugaaagaaauugagguauggacacuuggaug

SEQ ID NO: 54932 - RNA, 24 nt, Artificial Sequence
  Synthetic Oligonucleotide; CD80 exon 2; Set C
gaaagaaauugagguauggacacu

SEQ ID NO: 54933 - RNA, 26 nt, Artificial Sequence
  Synthetic Oligonucleotide; CD80 exon 2; Set C
ugaaagaaauugagguauggacacuu

SEQ ID NO: 54934 - RNA, 37 nt, Artificial Sequence
  Synthetic Oligonucleotide; CD80 exon 2; Set B
aagagcugaaagaaauugagguauggacacuuggaug

SEQ ID NO: 54935 - RNA, 35 nt, Artificial Sequence
  Synthetic Oligonucleotide; CD80 exon 2; Set B
agagcugaaagaaauugagguauggacacuuggau

SEQ ID NO: 54936 - RNA, 25 nt, Artificial Sequence
  Synthetic Oligonucleotide; CD80 exon 2; Set C
ugaaagaaauugagguauggacacu

SEQ ID NO: 54937 - RNA, 30 nt, Artificial Sequence
  Synthetic Oligonucleotide; CD80 exon 2; Set B
agagcugaaagaaauugagguauggacacu

SEQ ID NO: 54938 - RNA, 31 nt, Artificial Sequence
  Synthetic Oligonucleotide; CD80 exon 2; Set B
aagagcugaaagaaauugagguauggacacu

SEQ ID NO: 54939 - RNA, 40 nt, Artificial Sequence
  Synthetic Oligonucleotide; CD80 exon 2; Set C
gcaccaagagcugaaagaaauugagguauggacacuugga

SEQ ID NO: 54940 - RNA, 39 nt, Artificial Sequence
  Synthetic Oligonucleotide; CD80 exon 2; Set C
gcaccaagagcugaaagaaauugagguauggacacuugg

SEQ ID NO: 54941 - RNA, 38 nt, Artificial Sequence
  Synthetic Oligonucleotide; CD80 exon 2; Set C
gcaccaagagcugaaagaaauugagguauggacacuug

SEQ ID NO: 54942 - RNA, 37 nt, Artificial Sequence
  Synthetic Oligonucleotide; CD80 exon 2; Set C
gcaccaagagcugaaagaaauugagguauggacacuu

SEQ ID NO: 54943 - RNA, 36 nt, Artificial Sequence
  Synthetic Oligonucleotide; CD80 exon 2; Set C
gcaccaagagcugaaagaaauugagguauggacacu

SEQ ID NO: 54944 - RNA, 33 nt, Artificial Sequence
  Synthetic Oligonucleotide; CD80 exon 2; Set B
agcaccaagagcugaaagaaauugagguaugga

SEQ ID NO: 54945 - RNA, 34 nt, Artificial Sequence
  Synthetic Oligonucleotide; CD80 exon 2; Set B
cagcaccaagagcugaaagaaauugagguaugga

SEQ ID NO: 54946 - RNA, 33 nt, Artificial Sequence
  Synthetic Oligonucleotide; CD80 exon 2; Set B
cagcaccaagagcugaaagaaauugagguaugg

SEQ ID NO: 54947 - RNA, 32 nt, Artificial Sequence
  Synthetic Oligonucleotide; CD80 exon 2; Set B
cagcaccaagagcugaaagaaauugagguaug

SEQ ID NO: 54948 - RNA, 34 nt, Artificial Sequence
  Synthetic Oligonucleotide; CD80 exon 2; Set B
ccagcaccaagagcugaaagaaauugagguaugg

SEQ ID NO: 54949 - RNA, 36 nt, Artificial Sequence
  Synthetic Oligonucleotide; CD80 exon 2; Set C
gccagcaccaagagcugaaagaaauugagguaugga

SEQ ID NO: 54950 - RNA, 31 nt, Artificial Sequence
  Synthetic Oligonucleotide; CD80 exon 2; Set B
cagcaccaagagcugaaagaaauugagguau

SEQ ID NO: 54951 - RNA, 33 nt, Artificial Sequence
  Synthetic Oligonucleotide; CD80 exon 2; Set B
ccagcaccaagagcugaaagaaauugagguaug

SEQ ID NO: 54952 - RNA, 32 nt, Artificial Sequence
  Synthetic Oligonucleotide; CD80 exon 2; Set B
ccagcaccaagagcugaaagaaauugagguau

SEQ ID NO: 54953 - RNA, 30 nt, Artificial Sequence
  Synthetic Oligonucleotide; CD80 exon 2; Set B
cagcaccaagagcugaaagaaauugaggua

SEQ ID NO: 54954 - RNA, 31 nt, Artificial Sequence
  Synthetic Oligonucleotide; CD80 exon 2; Set B
ccagcaccaagagcugaaagaaauugaggua

SEQ ID NO: 54955 - RNA, 29 nt, Artificial Sequence
  Synthetic Oligonucleotide; CD80 exon 2; Set B
cagcaccaagagcugaaagaaauugaggu

SEQ ID NO: 54956 - RNA, 32 nt, Artificial Sequence
  Synthetic Oligonucleotide; CD80 exon 2; Set B
gccagcaccaagagcugaaagaaauugaggua

SEQ ID NO: 54957 - RNA, 28 nt, Artificial Sequence
  Synthetic Oligonucleotide; CD80 exon 2; Set B
cagcaccaagagcugaaagaaauugagg

SEQ ID NO: 54958 - RNA, 30 nt, Artificial Sequence
  Synthetic Oligonucleotide; CD80 exon 2; Set B
ccagcaccaagagcugaaagaaauugaggu

SEQ ID NO: 54959 - RNA, 31 nt, Artificial Sequence
  Synthetic Oligonucleotide; CD80 exon 2; Set B
gccagcaccaagagcugaaagaaauugaggu

SEQ ID NO: 54960 - RNA, 27 nt, Artificial Sequence
  Synthetic Oligonucleotide; CD80 exon 2; Set C
cagcaccaagagcugaaagaaauugag

SEQ ID NO: 54961 - RNA, 29 nt, Artificial Sequence
  Synthetic Oligonucleotide; CD80 exon 2; Set B
ccagcaccaagagcugaaagaaauugagg

SEQ ID NO: 54962 - RNA, 26 nt, Artificial Sequence
  Synthetic Oligonucleotide; CD80 exon 2; Set C
cagcaccaagagcugaaagaaauuga

SEQ ID NO: 54963 - RNA, 30 nt, Artificial Sequence
  Synthetic Oligonucleotide; CD80 exon 2; Set B
gccagcaccaagagcugaaagaaauugagg

SEQ ID NO: 54964 - RNA, 25 nt, Artificial Sequence
  Synthetic Oligonucleotide; CD80 exon 2; Set C
cagcaccaagagcugaaagaaauug

SEQ ID NO: 54965 - RNA, 29 nt, Artificial Sequence
  Synthetic Oligonucleotide; CD80 exon 2; Set B
gccagcaccaagagcugaaagaaauugag

SEQ ID NO: 54966 - RNA, 24 nt, Artificial Sequence
  Synthetic Oligonucleotide; CD80 exon 2; Set C
cagcaccaagagcugaaagaaauu

SEQ ID NO: 54967 - RNA, 26 nt, Artificial Sequence
  Synthetic Oligonucleotide; CD80 exon 2; Set C
ccagcaccaagagcugaaagaaauug

SEQ ID NO: 54968 - RNA, 28 nt, Artificial Sequence
  Synthetic Oligonucleotide; CD80 exon 2; Set B
gccagcaccaagagcugaaagaaauuga

SEQ ID NO: 54969 - RNA, 23 nt, Artificial Sequence
  Synthetic Oligonucleotide; CD80 exon 2; Set C
cagcaccaagagcugaaagaaau

SEQ ID NO: 54970 - RNA, 25 nt, Artificial Sequence
  Synthetic Oligonucleotide; CD80 exon 2; Set C
ccagcaccaagagcugaaagaaauu

SEQ ID NO: 54971 - RNA, 27 nt, Artificial Sequence
  Synthetic Oligonucleotide; CD80 exon 2; Set B
gccagcaccaagagcugaaagaaauug

SEQ ID NO: 54972 - RNA, 26 nt, Artificial Sequence
  Synthetic Oligonucleotide; CD80 exon 2; Set B
gccagcaccaagagcugaaagaaauu

SEQ ID NO: 54973 - RNA, 22 nt, Artificial Sequence
  Synthetic Oligonucleotide; CD80 exon 2; Set C
cagcaccaagagcugaaagaaa

SEQ ID NO: 54974 - RNA, 24 nt, Artificial Sequence
  Synthetic Oligonucleotide; CD80 exon 2; Set C
ccagcaccaagagcugaaagaaau

SEQ ID NO: 54975 - RNA, 25 nt, Artificial Sequence
  Synthetic Oligonucleotide; CD80 exon 2; Set B
gccagcaccaagagcugaaagaaau

SEQ ID NO: 54976 - RNA, 21 nt, Artificial Sequence
  Synthetic Oligonucleotide; CD80 exon 2; Set C
cagcaccaagagcugaaagaa

SEQ ID NO: 54977 - RNA, 24 nt, Artificial Sequence
  Synthetic Oligonucleotide; CD80 exon 2; Set B
gccagcaccaagagcugaaagaaa

SEQ ID NO: 54978 - RNA, 20 nt, Artificial Sequence
  Synthetic Oligonucleotide; CD80 exon 2; Set C
cagcaccaagagcugaaaga

SEQ ID NO: 54979 - RNA, 23 nt, Artificial Sequence
  Synthetic Oligonucleotide; CD80 exon 2; Set B
gccagcaccaagagcugaaagaa

SEQ ID NO: 54980 - RNA, 19 nt, Artificial Sequence
  Synthetic Oligonucleotide; CD80 exon 2; Set C
cagcaccaagagcugaaag

SEQ ID NO: 54981 - RNA, 18 nt, Artificial Sequence
  Synthetic Oligonucleotide; CD80 exon 2; Set C
cagcaccaagagcugaaa

SEQ ID NO: 54982 - RNA, 22 nt, Artificial Sequence
  Synthetic Oligonucleotide; CD80 exon 2; Set B
gccagcaccaagagcugaaaga

SEQ ID NO: 54983 - RNA, 17 nt, Artificial Sequence
  Synthetic Oligonucleotide; CD80 exon 2; Set C
cagcaccaagagcugaa

SEQ ID NO: 54984 - RNA, 19 nt, Artificial Sequence
  Synthetic Oligonucleotide; CD80 exon 2; Set C
ccagcaccaagagcugaaa

SEQ ID NO: 54985 - RNA, 21 nt, Artificial Sequence
  Synthetic Oligonucleotide; CD80 exon 2; Set B
gccagcaccaagagcugaaag

SEQ ID NO: 54986 - RNA, 16 nt, Artificial Sequence
  Synthetic Oligonucleotide; CD80 exon 2; Set C
cagcaccaagagcuga

SEQ ID NO: 54987 - RNA, 20 nt, Artificial Sequence
  Synthetic Oligonucleotide; CD80 exon 2; Set B
gccagcaccaagagcugaaa

SEQ ID NO: 54988 - RNA, 18 nt, Artificial Sequence
  Synthetic Oligonucleotide; CD80 exon 2; Set C
ccagcaccaagagcugaa

SEQ ID NO: 54989 - RNA, 40 nt, Artificial Sequence
  Synthetic Oligonucleotide; CD80 exon 2; Set C
agaaagaccagccagcaccaagagcugaaagaaauugagg

SEQ ID NO: 54990 - RNA, 17 nt, Artificial Sequence
  Synthetic Oligonucleotide; CD80 exon 2; Set C
ccagcaccaagagcuga

SEQ ID NO: 54991 - RNA, 19 nt, Artificial Sequence
  Synthetic Oligonucleotide; CD80 exon 2; Set B
gccagcaccaagagcugaa

SEQ ID NO: 54992 - RNA, 39 nt, Artificial Sequence
  Synthetic Oligonucleotide; CD80 exon 2; Set C
agaaagaccagccagcaccaagagcugaaagaaauugag

SEQ ID NO: 54993 - RNA, 18 nt, Artificial Sequence
  Synthetic Oligonucleotide; CD80 exon 2; Set B
gccagcaccaagagcuga

SEQ ID NO: 54994 - RNA, 38 nt, Artificial Sequence
  Synthetic Oligonucleotide; CD80 exon 2; Set C
agaaagaccagccagcaccaagagcugaaagaaauuga

SEQ ID NO: 54995 - RNA, 37 nt, Artificial Sequence
  Synthetic Oligonucleotide; CD80 exon 2; Set B
agaaagaccagccagcaccaagagcugaaagaaauug

SEQ ID NO: 54996 - RNA, 36 nt, Artificial Sequence
  Synthetic Oligonucleotide; CD80 exon 2; Set B
agaaagaccagccagcaccaagagcugaaagaaauu

SEQ ID NO: 54997 - RNA, 35 nt, Artificial Sequence
  Synthetic Oligonucleotide; CD80 exon 2; Set B
agaaagaccagccagcaccaagagcugaaagaaau

SEQ ID NO: 54998 - RNA, 34 nt, Artificial Sequence
  Synthetic Oligonucleotide; CD80 exon 2; Set B
agaaagaccagccagcaccaagagcugaaagaaa

SEQ ID NO: 54999 - RNA, 33 nt, Artificial Sequence
  Synthetic Oligonucleotide; CD80 exon 2; Set C
agaaagaccagccagcaccaagagcugaaagaa

SEQ ID NO: 55000 - RNA, 32 nt, Artificial Sequence
  Synthetic Oligonucleotide; CD80 exon 2; Set C
agaaagaccagccagcaccaagagcugaaaga

SEQ ID NO: 55001 - RNA, 31 nt, Artificial Sequence
  Synthetic Oligonucleotide; CD80 exon 2; Set B
agaaagaccagccagcaccaagagcugaaag

SEQ ID NO: 55002 - RNA, 30 nt, Artificial Sequence
  Synthetic Oligonucleotide; CD80 exon 2; Set B
agaaagaccagccagcaccaagagcugaaa

SEQ ID NO: 55003 - RNA, 29 nt, Artificial Sequence
  Synthetic Oligonucleotide; CD80 exon 2; Set C
agaaagaccagccagcaccaagagcugaa

SEQ ID NO: 55004 - RNA, 28 nt, Artificial Sequence
  Synthetic Oligonucleotide; CD80 exon 2; Set C
agaaagaccagccagcaccaagagcuga

SEQ ID NO: 55005 - RNA, 15 nt, Artificial Sequence
  Synthetic Oligonucleotide; CD80 exon 2; Set B
gaccagccagcacca

SEQ ID NO: 55006 - RNA, 23 nt, Artificial Sequence
  Synthetic Oligonucleotide; CD80 exon 2; Set B
agaaagaccagccagcaccaaga

SEQ ID NO: 55007 - RNA, 22 nt, Artificial Sequence
  Synthetic Oligonucleotide; CD80 exon 2; Set B
agaaagaccagccagcaccaag

SEQ ID NO: 55008 - RNA, 22 nt, Artificial Sequence
  Synthetic Oligonucleotide; CD80 exon 2; Set B
gagaaagaccagccagcaccaa

SEQ ID NO: 55009 - RNA, 23 nt, Artificial Sequence
  Synthetic Oligonucleotide; CD80 exon 2; Set B
ugagaaagaccagccagcaccaa

SEQ ID NO: 55010 - RNA, 21 nt, Artificial Sequence
  Synthetic Oligonucleotide; CD80 exon 2; Set B
gagaaagaccagccagcacca

SEQ ID NO: 55011 - RNA, 22 nt, Artificial Sequence
  Synthetic Oligonucleotide; CD80 exon 2; Set B
ugagaaagaccagccagcacca

SEQ ID NO: 55012 - RNA, 20 nt, Artificial Sequence
  Synthetic Oligonucleotide; CD80 exon 2; Set B
gagaaagaccagccagcacc

SEQ ID NO: 55013 - RNA, 17 nt, Artificial Sequence
  Synthetic Oligonucleotide; CD80 exon 2; Set C
agaaagaccagccagca

SEQ ID NO: 55014 - RNA, 19 nt, Artificial Sequence
  Synthetic Oligonucleotide; CD80 exon 2; Set C
gagaaagaccagccagcac

SEQ ID NO: 55015 - RNA, 21 nt, Artificial Sequence
  Synthetic Oligonucleotide; CD80 exon 2; Set B
ugagaaagaccagccagcacc

SEQ ID NO: 55016 - RNA, 20 nt, Artificial Sequence
  Synthetic Oligonucleotide; CD80 exon 2; Set B
ugagaaagaccagccagcac

SEQ ID NO: 55017 - RNA, 36 nt, Artificial Sequence
  Synthetic Oligonucleotide; CD80 exon 2; Set C
accugaacagaagugagaaagaccagccagcaccaa

SEQ ID NO: 55018 - RNA, 37 nt, Artificial Sequence
  Synthetic Oligonucleotide; CD80 exon 2; Set C
uaccugaacagaagugagaaagaccagccagcaccaa

SEQ ID NO: 55019 - RNA, 35 nt, Artificial Sequence
  Synthetic Oligonucleotide; CD80 exon 2; Set C
accugaacagaagugagaaagaccagccagcacca

SEQ ID NO: 55020 - RNA, 36 nt, Artificial Sequence
  Synthetic Oligonucleotide; CD80 exon 2; Set C
uaccugaacagaagugagaaagaccagccagcacca

SEQ ID NO: 55021 - RNA, 34 nt, Artificial Sequence
  Synthetic Oligonucleotide; CD80 exon 2; Set C
accugaacagaagugagaaagaccagccagcacc

SEQ ID NO: 55022 - RNA, 37 nt, Artificial Sequence
  Synthetic Oligonucleotide; CD80 exon 2; Set C
uuaccugaacagaagugagaaagaccagccagcacca

SEQ ID NO: 55023 - RNA, 33 nt, Artificial Sequence
  Synthetic Oligonucleotide; CD80 exon 2; Set C
accugaacagaagugagaaagaccagccagcac

SEQ ID NO: 55024 - RNA, 35 nt, Artificial Sequence
  Synthetic Oligonucleotide; CD80 exon 2; Set C
uaccugaacagaagugagaaagaccagccagcacc

SEQ ID NO: 55025 - RNA, 34 nt, Artificial Sequence
  Synthetic Oligonucleotide; CD80 exon 2; Set C
uaccugaacagaagugagaaagaccagccagcac

SEQ ID NO: 55026 - RNA, 36 nt, Artificial Sequence
  Synthetic Oligonucleotide; CD80 exon 2; Set C
uuaccugaacagaagugagaaagaccagccagcacc

SEQ ID NO: 55027 - RNA, 35 nt, Artificial Sequence
  Synthetic Oligonucleotide; CD80 exon 2; Set C
uuaccugaacagaagugagaaagaccagccagcac

SEQ ID NO: 55028 - RNA, 33 nt, Artificial Sequence
  Synthetic Oligonucleotide; CD80 exon 2; Set C
uuaccugaacagaagugagaaagaccagccagc

SEQ ID NO: 55029 - RNA, 28 nt, Artificial Sequence
  Synthetic Oligonucleotide; CD80 exon 2; Set B
uaccugaacagaagugagaaagaccagc

SEQ ID NO: 55030 - RNA, 29 nt, Artificial Sequence
  Synthetic Oligonucleotide; CD80 exon 2; Set B
uuaccugaacagaagugagaaagaccagc

SEQ ID NO: 55031 - RNA, 23 nt, Artificial Sequence
  Synthetic Oligonucleotide; CD80 exon 2; Set C
accugaacagaagugagaaagac

SEQ ID NO: 55032 - RNA, 39 nt, Artificial Sequence
  Synthetic Oligonucleotide; CD80 exon 2; Set C
aguugcuuaccugaacagaagugagaaagaccagccagc

SEQ ID NO: 55033 - RNA, 24 nt, Artificial Sequence
  Synthetic Oligonucleotide; CD80 exon 2; Set C
uaccugaacagaagugagaaagac

SEQ ID NO: 55034 - RNA, 40 nt, Artificial Sequence
  Synthetic Oligonucleotide; CD80 exon 2; Set C
aaguugcuuaccugaacagaagugagaaagaccagccagc

SEQ ID NO: 55035 - RNA, 25 nt, Artificial Sequence
  Synthetic Oligonucleotide; CD80 exon 2; Set C
uuaccugaacagaagugagaaagac

SEQ ID NO: 55036 - RNA, 36 nt, Artificial Sequence
  Synthetic Oligonucleotide; CD80 exon 2; Set C
aguugcuuaccugaacagaagugagaaagaccagcc

SEQ ID NO: 55037 - RNA, 35 nt, Artificial Sequence
  Synthetic Oligonucleotide; CD80 exon 2; Set C
aguugcuuaccugaacagaagugagaaagaccagc

SEQ ID NO: 55038 - RNA, 36 nt, Artificial Sequence
  Synthetic Oligonucleotide; CD80 exon 2; Set B
aaguugcuuaccugaacagaagugagaaagaccagc

SEQ ID NO: 55039 - RNA, 17 nt, Artificial Sequence
  Synthetic Oligonucleotide; CD80 exon 2; Set C
accugaacagaagugag

SEQ ID NO: 55040 - RNA, 37 nt, Artificial Sequence
  Synthetic Oligonucleotide; CD80 exon 2; Set B
aaaguugcuuaccugaacagaagugagaaagaccagc

SEQ ID NO: 55041 - RNA, 16 nt, Artificial Sequence
  Synthetic Oligonucleotide; CD80 exon 2; Set C
accugaacagaaguga

SEQ ID NO: 55042 - RNA, 18 nt, Artificial Sequence
  Synthetic Oligonucleotide; CD80 exon 2; Set C
uaccugaacagaagugag

SEQ ID NO: 55043 - RNA, 38 nt, Artificial Sequence
  Synthetic Oligonucleotide; CD80 exon 2; Set C
gaaaguugcuuaccugaacagaagugagaaagaccagc

SEQ ID NO: 55044 - RNA, 17 nt, Artificial Sequence
  Synthetic Oligonucleotide; CD80 exon 2; Set C
uaccugaacagaaguga

SEQ ID NO: 55045 - RNA, 19 nt, Artificial Sequence
  Synthetic Oligonucleotide; CD80 exon 2; Set C
uuaccugaacagaagugag

SEQ ID NO: 55046 - RNA, 32 nt, Artificial Sequence
  Synthetic Oligonucleotide; CD80 exon 2; Set B
aaguugcuuaccugaacagaagugagaaagac

SEQ ID NO: 55047 - RNA, 18 nt, Artificial Sequence
  Synthetic Oligonucleotide; CD80 exon 2; Set C
uuaccugaacagaaguga

SEQ ID NO: 55048 - RNA, 33 nt, Artificial Sequence
  Synthetic Oligonucleotide; CD80 exon 2; Set B
aaaguugcuuaccugaacagaagugagaaagac

SEQ ID NO: 55049 - RNA, 34 nt, Artificial Sequence
  Synthetic Oligonucleotide; CD80 exon 2; Set B
gaaaguugcuuaccugaacagaagugagaaagac

SEQ ID NO: 55050 - RNA, 26 nt, Artificial Sequence
  Synthetic Oligonucleotide; CD80 exon 2; Set B
aguugcuuaccugaacagaagugaga

SEQ ID NO: 55051 - RNA, 26 nt, Artificial Sequence
  Synthetic Oligonucleotide; CD80 exon 2; Set C
aaguugcuuaccugaacagaagugag

SEQ ID NO: 55052 - RNA, 25 nt, Artificial Sequence
  Synthetic Oligonucleotide; CD80 exon 2; Set C
aaguugcuuaccugaacagaaguga

SEQ ID NO: 55053 - RNA, 27 nt, Artificial Sequence
  Synthetic Oligonucleotide; CD80 exon 2; Set C
aaaguugcuuaccugaacagaagugag

SEQ ID NO: 55054 - RNA, 26 nt, Artificial Sequence
  Synthetic Oligonucleotide; CD80 exon 2; Set C
aaaguugcuuaccugaacagaaguga

SEQ ID NO: 55055 - RNA, 28 nt, Artificial Sequence
  Synthetic Oligonucleotide; CD80 exon 2; Set B
gaaaguugcuuaccugaacagaagugag

SEQ ID NO: 55056 - RNA, 27 nt, Artificial Sequence
  Synthetic Oligonucleotide; CD80 exon 2; Set B
gaaaguugcuuaccugaacagaaguga

SEQ ID NO: 55057 - RNA, 34 nt, Artificial Sequence
  Synthetic Oligonucleotide; CD80 exon 2; Set B
uuccugaaaguugcuuaccugaacagaagugaga

SEQ ID NO: 55058 - RNA, 35 nt, Artificial Sequence
  Synthetic Oligonucleotide; CD80 exon 2; Set B
guuccugaaaguugcuuaccugaacagaagugaga

SEQ ID NO: 55059 - RNA, 36 nt, Artificial Sequence
  Synthetic Oligonucleotide; CD80 exon 2; Set B
aguuccugaaaguugcuuaccugaacagaagugaga

SEQ ID NO: 55060 - RNA, 37 nt, Artificial Sequence
  Synthetic Oligonucleotide; CD80 exon 2; Set B
aaguuccugaaaguugcuuaccugaacagaagugaga

SEQ ID NO: 55061 - RNA, 38 nt, Artificial Sequence
  Synthetic Oligonucleotide; CD80 exon 2; Set B
uaaguuccugaaaguugcuuaccugaacagaagugaga

SEQ ID NO: 55062 - RNA, 39 nt, Artificial Sequence
  Synthetic Oligonucleotide; CD80 exon 2; Set B
uuaaguuccugaaaguugcuuaccugaacagaagugaga

SEQ ID NO: 55063 - RNA, 39 nt, Artificial Sequence
  Synthetic Oligonucleotide; CD80 exon 2; Set B
guuaaguuccugaaaguugcuuaccugaacagaagugag

SEQ ID NO: 55064 - RNA, 38 nt, Artificial Sequence
  Synthetic Oligonucleotide; CD80 exon 2; Set B
guuaaguuccugaaaguugcuuaccugaacagaaguga

SEQ ID NO: 55065 - RNA, 40 nt, Artificial Sequence
  Synthetic Oligonucleotide; CD80 exon 2; Set B
aguuaaguuccugaaaguugcuuaccugaacagaagugag

SEQ ID NO: 55066 - RNA, 39 nt, Artificial Sequence
  Synthetic Oligonucleotide; CD80 exon 2; Set B
aguuaaguuccugaaaguugcuuaccugaacagaaguga

SEQ ID NO: 55067 - RNA, 25 nt, Artificial Sequence
  Synthetic Oligonucleotide; CD80 exon 2; Set C
aaguuccugaaaguugcuuaccuga

SEQ ID NO: 55068 - RNA, 26 nt, Artificial Sequence
  Synthetic Oligonucleotide; CD80 exon 2; Set B
uaaguuccugaaaguugcuuaccuga

SEQ ID NO: 55069 - RNA, 27 nt, Artificial Sequence
  Synthetic Oligonucleotide; CD80 exon 2; Set B
uuaaguuccugaaaguugcuuaccuga

SEQ ID NO: 55070 - RNA, 25 nt, Artificial Sequence
  Synthetic Oligonucleotide; CD80 exon 2; Set C
uaaguuccugaaaguugcuuaccug

SEQ ID NO: 55071 - RNA, 26 nt, Artificial Sequence
  Synthetic Oligonucleotide; CD80 exon 2; Set C
uuaaguuccugaaaguugcuuaccug

SEQ ID NO: 55072 - RNA, 24 nt, Artificial Sequence
  Synthetic Oligonucleotide; CD80 exon 2; Set C
uaaguuccugaaaguugcuuaccu

SEQ ID NO: 55073 - RNA, 25 nt, Artificial Sequence
  Synthetic Oligonucleotide; CD80 exon 2; Set C
uuaaguuccugaaaguugcuuaccu

SEQ ID NO: 55074 - RNA, 25 nt, Artificial Sequence
  Synthetic Oligonucleotide; CD80 exon 2; Set C
guuaaguuccugaaaguugcuuacc

SEQ ID NO: 55075 - RNA, 26 nt, Artificial Sequence
  Synthetic Oligonucleotide; CD80 exon 2; Set C
aguuaaguuccugaaaguugcuuacc

SEQ ID NO: 55076 - RNA, 25 nt, Artificial Sequence
  Synthetic Oligonucleotide; CD80 exon 2; Set C
aguuaaguuccugaaaguugcuuac

SEQ ID NO: 55077 - RNA, 35 nt, Artificial Sequence
  Synthetic Oligonucleotide; CD80 exon 2; Set B
aguugacucaguuaaguuccugaaaguugcuuacc

SEQ ID NO: 55078 - RNA, 34 nt, Artificial Sequence
  Synthetic Oligonucleotide; CD80 exon 2; Set B
aguugacucaguuaaguuccugaaaguugcuuac

SEQ ID NO: 55079 - RNA, 36 nt, Artificial Sequence
  Synthetic Oligonucleotide; CD80 exon 2; Set B
caguugacucaguuaaguuccugaaaguugcuuacc

SEQ ID NO: 55080 - RNA, 33 nt, Artificial Sequence
  Synthetic Oligonucleotide; CD80 exon 2; Set B
aguugacucaguuaaguuccugaaaguugcuua

SEQ ID NO: 55081 - RNA, 35 nt, Artificial Sequence
  Synthetic Oligonucleotide; CD80 exon 2; Set B
caguugacucaguuaaguuccugaaaguugcuuac

SEQ ID NO: 55082 - RNA, 34 nt, Artificial Sequence
  Synthetic Oligonucleotide; CD80 exon 2; Set B
caguugacucaguuaaguuccugaaaguugcuua

SEQ ID NO: 55083 - RNA, 40 nt, Artificial Sequence
  Synthetic Oligonucleotide; CD80 exon 2; Set C
uguagcaguugacucaguuaaguuccugaaaguugcuuac

SEQ ID NO: 55084 - RNA, 39 nt, Artificial Sequence
  Synthetic Oligonucleotide; CD80 exon 2; Set C
uguagcaguugacucaguuaaguuccugaaaguugcuua

SEQ ID NO: 55085 - RNA, 26 nt, Artificial Sequence
  Synthetic Oligonucleotide; CD80 exon 2; Set C
aguugacucaguuaaguuccugaaag

SEQ ID NO: 55086 - RNA, 25 nt, Artificial Sequence
  Synthetic Oligonucleotide; CD80 exon 2; Set C
aguugacucaguuaaguuccugaaa

SEQ ID NO: 55087 - RNA, 27 nt, Artificial Sequence
  Synthetic Oligonucleotide; CD80 exon 2; Set C
caguugacucaguuaaguuccugaaag

SEQ ID NO: 55088 - RNA, 30 nt, Artificial Sequence
  Synthetic Oligonucleotide; CD80 exon 2; Set B
agcaguugacucaguuaaguuccugaaagu

SEQ ID NO: 55089 - RNA, 26 nt, Artificial Sequence
  Synthetic Oligonucleotide; CD80 exon 2; Set C
caguugacucaguuaaguuccugaaa

SEQ ID NO: 55090 - RNA, 24 nt, Artificial Sequence
  Synthetic Oligonucleotide; CD80 exon 2; Set C
aguugacucaguuaaguuccugaa

SEQ ID NO: 55091 - RNA, 31 nt, Artificial Sequence
  Synthetic Oligonucleotide; CD80 exon 2; Set B
uagcaguugacucaguuaaguuccugaaagu

SEQ ID NO: 55092 - RNA, 25 nt, Artificial Sequence
  Synthetic Oligonucleotide; CD80 exon 2; Set C
caguugacucaguuaaguuccugaa

SEQ ID NO: 55093 - RNA, 32 nt, Artificial Sequence
  Synthetic Oligonucleotide; CD80 exon 2; Set B
guagcaguugacucaguuaaguuccugaaagu

SEQ ID NO: 55094 - RNA, 34 nt, Artificial Sequence
  Synthetic Oligonucleotide; CD80 exon 2; Set B
cuguagcaguugacucaguuaaguuccugaaagu

SEQ ID NO: 55095 - RNA, 32 nt, Artificial Sequence
  Synthetic Oligonucleotide; CD80 exon 2; Set B
uguagcaguugacucaguuaaguuccugaaag

SEQ ID NO: 55096 - RNA, 31 nt, Artificial Sequence
  Synthetic Oligonucleotide; CD80 exon 2; Set B
uguagcaguugacucaguuaaguuccugaaa

SEQ ID NO: 55097 - RNA, 30 nt, Artificial Sequence
  Synthetic Oligonucleotide; CD80 exon 2; Set B
uguagcaguugacucaguuaaguuccugaa

SEQ ID NO: 55098 - RNA, 22 nt, Artificial Sequence
  Synthetic Oligonucleotide; CD80 exon 2; Set C
agcaguugacucaguuaaguuc

SEQ ID NO: 55099 - RNA, 21 nt, Artificial Sequence
  Synthetic Oligonucleotide; CD80 exon 2; Set C
agcaguugacucaguuaaguu

SEQ ID NO: 55100 - RNA, 23 nt, Artificial Sequence
  Synthetic Oligonucleotide; CD80 exon 2; Set C
uagcaguugacucaguuaaguuc

SEQ ID NO: 55101 - RNA, 22 nt, Artificial Sequence
  Synthetic Oligonucleotide; CD80 exon 2; Set C
uagcaguugacucaguuaaguu

SEQ ID NO: 55102 - RNA, 24 nt, Artificial Sequence
  Synthetic Oligonucleotide; CD80 exon 2; Set C
guagcaguugacucaguuaaguuc

SEQ ID NO: 55103 - RNA, 20 nt, Artificial Sequence
  Synthetic Oligonucleotide; CD80 exon 2; Set C
agcaguugacucaguuaagu

SEQ ID NO: 55104 - RNA, 38 nt, Artificial Sequence
  Synthetic Oligonucleotide; CD80 exon 2; Set C
uaacccuguagcaguugacucaguuaaguuccugaaag

SEQ ID NO: 55105 - RNA, 23 nt, Artificial Sequence
  Synthetic Oligonucleotide; CD80 exon 2; Set C
guagcaguugacucaguuaaguu

SEQ ID NO: 55106 - RNA, 21 nt, Artificial Sequence
  Synthetic Oligonucleotide; CD80 exon 2; Set C
uagcaguugacucaguuaagu

SEQ ID NO: 55107 - RNA, 19 nt, Artificial Sequence
  Synthetic Oligonucleotide; CD80 exon 2; Set C
agcaguugacucaguuaag

SEQ ID NO: 55108 - RNA, 37 nt, Artificial Sequence
  Synthetic Oligonucleotide; CD80 exon 2; Set C
uaacccuguagcaguugacucaguuaaguuccugaaa

SEQ ID NO: 55109 - RNA, 39 nt, Artificial Sequence
  Synthetic Oligonucleotide; CD80 exon 2; Set C
uuaacccuguagcaguugacucaguuaaguuccugaaag

SEQ ID NO: 55110 - RNA, 26 nt, Artificial Sequence
  Synthetic Oligonucleotide; CD80 exon 2; Set B
cuguagcaguugacucaguuaaguuc

SEQ ID NO: 55111 - RNA, 22 nt, Artificial Sequence
  Synthetic Oligonucleotide; CD80 exon 2; Set C
guagcaguugacucaguuaagu

SEQ ID NO: 55112 - RNA, 20 nt, Artificial Sequence
  Synthetic Oligonucleotide; CD80 exon 2; Set C
uagcaguugacucaguuaag

SEQ ID NO: 55113 - RNA, 18 nt, Artificial Sequence
  Synthetic Oligonucleotide; CD80 exon 2; Set C
agcaguugacucaguuaa

SEQ ID NO: 55114 - RNA, 38 nt, Artificial Sequence
  Synthetic Oligonucleotide; CD80 exon 2; Set C
uuaacccuguagcaguugacucaguuaaguuccugaaa

SEQ ID NO: 55115 - RNA, 36 nt, Artificial Sequence
  Synthetic Oligonucleotide; CD80 exon 2; Set C
uaacccuguagcaguugacucaguuaaguuccugaa

SEQ ID NO: 55116 - RNA, 25 nt, Artificial Sequence
  Synthetic Oligonucleotide; CD80 exon 2; Set B
cuguagcaguugacucaguuaaguu

SEQ ID NO: 55117 - RNA, 21 nt, Artificial Sequence
  Synthetic Oligonucleotide; CD80 exon 2; Set C
guagcaguugacucaguuaag

SEQ ID NO: 55118 - RNA, 19 nt, Artificial Sequence
  Synthetic Oligonucleotide; CD80 exon 2; Set C
uagcaguugacucaguuaa

SEQ ID NO: 55119 - RNA, 37 nt, Artificial Sequence
  Synthetic Oligonucleotide; CD80 exon 2; Set C
uuaacccuguagcaguugacucaguuaaguuccugaa

SEQ ID NO: 55120 - RNA, 24 nt, Artificial Sequence
  Synthetic Oligonucleotide; CD80 exon 2; Set C
cuguagcaguugacucaguuaagu

SEQ ID NO: 55121 - RNA, 20 nt, Artificial Sequence
  Synthetic Oligonucleotide; CD80 exon 2; Set C
guagcaguugacucaguuaa

SEQ ID NO: 55122 - RNA, 18 nt, Artificial Sequence
  Synthetic Oligonucleotide; CD80 exon 2; Set C
uagcaguugacucaguua

SEQ ID NO: 55123 - RNA, 23 nt, Artificial Sequence
  Synthetic Oligonucleotide; CD80 exon 2; Set C
cuguagcaguugacucaguuaag

SEQ ID NO: 55124 - RNA, 19 nt, Artificial Sequence
  Synthetic Oligonucleotide; CD80 exon 2; Set C
guagcaguugacucaguua

SEQ ID NO: 55125 - RNA, 22 nt, Artificial Sequence
  Synthetic Oligonucleotide; CD80 exon 2; Set C
cuguagcaguugacucaguuaa

SEQ ID NO: 55126 - RNA, 20 nt, Artificial Sequence
  Synthetic Oligonucleotide; CD80 exon 2; Set C
uguagcaguugacucaguua

SEQ ID NO: 55127 - RNA, 21 nt, Artificial Sequence
  Synthetic Oligonucleotide; CD80 exon 2; Set C
cuguagcaguugacucaguua

SEQ ID NO: 55128 - RNA, 33 nt, Artificial Sequence
  Synthetic Oligonucleotide; CD80 exon 2; Set B
cuuaacccuguagcaguugacucaguuaaguuc

SEQ ID NO: 55129 - RNA, 32 nt, Artificial Sequence
  Synthetic Oligonucleotide; CD80 exon 2; Set B
cuuaacccuguagcaguugacucaguuaaguu

SEQ ID NO: 55130 - RNA, 31 nt, Artificial Sequence
  Synthetic Oligonucleotide; CD80 exon 2; Set B
cuuaacccuguagcaguugacucaguuaagu

SEQ ID NO: 55131 - RNA, 30 nt, Artificial Sequence
  Synthetic Oligonucleotide; CD80 exon 2; Set B
cuuaacccuguagcaguugacucaguuaag

SEQ ID NO: 55132 - RNA, 29 nt, Artificial Sequence
  Synthetic Oligonucleotide; CD80 exon 2; Set B
cuuaacccuguagcaguugacucaguuaa

SEQ ID NO: 55133 - RNA, 25 nt, Artificial Sequence
  Synthetic Oligonucleotide; CD80 exon 2; Set B
uaacccuguagcaguugacucaguu

SEQ ID NO: 55134 - RNA, 28 nt, Artificial Sequence
  Synthetic Oligonucleotide; CD80 exon 2; Set B
cuuaacccuguagcaguugacucaguua

SEQ ID NO: 55135 - RNA, 26 nt, Artificial Sequence
  Synthetic Oligonucleotide; CD80 exon 2; Set B
uuaacccuguagcaguugacucaguu

SEQ ID NO: 55136 - RNA, 15 nt, Artificial Sequence
  Synthetic Oligonucleotide; CD80 exon 2; Set C
uaacccuguagcagu

SEQ ID NO: 55137 - RNA, 16 nt, Artificial Sequence
  Synthetic Oligonucleotide; CD80 exon 2; Set C
uuaacccuguagcagu

SEQ ID NO: 55138 - RNA, 17 nt, Artificial Sequence
  Synthetic Oligonucleotide; CD80 exon 2; Set C
cuuaacccuguagcagu

SEQ ID NO: 55139 - RNA, 15 nt, Artificial Sequence
  Synthetic Oligonucleotide; CD80 exon 2; Set C
uuaacccuguagcag

SEQ ID NO: 55140 - RNA, 16 nt, Artificial Sequence
  Synthetic Oligonucleotide; CD80 exon 2; Set C
cuuaacccuguagcag

SEQ ID NO: 55141 - RNA, 21 nt, Artificial Sequence
  Synthetic Oligonucleotide; CD80 exon 2; Set A
ggaaggaaggugugccuacuu

SEQ ID NO: 55142 - RNA, 25 nt, Artificial Sequence
  Synthetic Oligonucleotide; CD80 exon 2; Set A
uucaggaaggaaggugugccuacuu

SEQ ID NO: 55143 - RNA, 24 nt, Artificial Sequence
  Synthetic Oligonucleotide; CD80 exon 2; Set A
uucaggaaggaaggugugccuacu

SEQ ID NO: 55144 - RNA, 18 nt, Artificial Sequence
  Synthetic Oligonucleotide; CD80 exon 2; Set C
uucaggaaggaaggugug

SEQ ID NO: 55145 - RNA, 28 nt, Artificial Sequence
  Synthetic Oligonucleotide; CD80 exon 2; Set A
agucauucaggaaggaaggugugccuac

SEQ ID NO: 55146 - RNA, 17 nt, Artificial Sequence
  Synthetic Oligonucleotide; CD80 exon 2; Set C
uucaggaaggaaggugu

SEQ ID NO: 55147 - RNA, 29 nt, Artificial Sequence
  Synthetic Oligonucleotide; CD80 exon 2; Set A
aagucauucaggaaggaaggugugccuac

SEQ ID NO: 55148 - RNA, 15 nt, Artificial Sequence
  Synthetic Oligonucleotide; CD80 exon 2; Set C
uucaggaaggaaggu

SEQ ID NO: 55149 - RNA, 15 nt, Artificial Sequence
  Synthetic Oligonucleotide; CD80 exon 2; Set C
aaaagucauucagga

SEQ ID NO: 55150 - RNA, 16 nt, Artificial Sequence
  Synthetic Oligonucleotide; CD80 exon 2; Set C
uaaaagucauucagga

SEQ ID NO: 55151 - RNA, 17 nt, Artificial Sequence
  Synthetic Oligonucleotide; CD80 exon 2; Set C
auaaaagucauucagga

SEQ ID NO: 55152 - RNA, 18 nt, Artificial Sequence
  Synthetic Oligonucleotide; CD80 exon 2; Set C
aauaaaagucauucagga

SEQ ID NO: 55153 - RNA, 19 nt, Artificial Sequence
  Synthetic Oligonucleotide; CD80 exon 2; Set C
aaauaaaagucauucagga

SEQ ID NO: 55154 - RNA, 40 nt, Artificial Sequence
  Synthetic Oligonucleotide; CD80 exon 2; Set A
gaaaaaggaacaaauaaaagucauucaggaaggaaggugu

SEQ ID NO: 55155 - RNA, 39 nt, Artificial Sequence
  Synthetic Oligonucleotide; CD80 exon 2; Set C
gaaaaaggaacaaauaaaagucauucaggaaggaaggug

SEQ ID NO: 55156 - RNA, 38 nt, Artificial Sequence
  Synthetic Oligonucleotide; CD80 exon 2; Set C
gaaaaaggaacaaauaaaagucauucaggaaggaaggu

SEQ ID NO: 55157 - RNA, 37 nt, Artificial Sequence
  Synthetic Oligonucleotide; CD80 exon 2; Set C
gaaaaaggaacaaauaaaagucauucaggaaggaagg

SEQ ID NO: 55158 - RNA, 36 nt, Artificial Sequence
  Synthetic Oligonucleotide; CD80 exon 2; Set C
gaaaaaggaacaaauaaaagucauucaggaaggaag

SEQ ID NO: 55159 - RNA, 35 nt, Artificial Sequence
  Synthetic Oligonucleotide; CD80 exon 2; Set C
gaaaaaggaacaaauaaaagucauucaggaaggaa

SEQ ID NO: 55160 - RNA, 34 nt, Artificial Sequence
  Synthetic Oligonucleotide; CD80 exon 2; Set C
gaaaaaggaacaaauaaaagucauucaggaagga

SEQ ID NO: 55161 - RNA, 26 nt, Artificial Sequence
  Synthetic Oligonucleotide; CD80 exon 2; Set C
aaggaacaaauaaaagucauucagga

SEQ ID NO: 55162 - RNA, 33 nt, Artificial Sequence
  Synthetic Oligonucleotide; CD80 exon 2; Set C
gaaaaaggaacaaauaaaagucauucaggaagg

SEQ ID NO: 55163 - RNA, 27 nt, Artificial Sequence
  Synthetic Oligonucleotide; CD80 exon 2; Set C
aaaggaacaaauaaaagucauucagga

SEQ ID NO: 55164 - RNA, 32 nt, Artificial Sequence
  Synthetic Oligonucleotide; CD80 exon 2; Set C
gaaaaaggaacaaauaaaagucauucaggaag

SEQ ID NO: 55165 - RNA, 31 nt, Artificial Sequence
  Synthetic Oligonucleotide; CD80 exon 2; Set C
gaaaaaggaacaaauaaaagucauucaggaa

SEQ ID NO: 55166 - RNA, 21 nt, Artificial Sequence
  Synthetic Oligonucleotide; CD80 exon 2; Set C
aggaacaaauaaaagucauuc

SEQ ID NO: 55167 - RNA, 22 nt, Artificial Sequence
  Synthetic Oligonucleotide; CD80 exon 2; Set C
aaggaacaaauaaaagucauuc

SEQ ID NO: 55168 - RNA, 23 nt, Artificial Sequence
  Synthetic Oligonucleotide; CD80 exon 2; Set C
aaaggaacaaauaaaagucauuc

SEQ ID NO: 55169 - RNA, 40 nt, Artificial Sequence
  Synthetic Oligonucleotide; CD80 exon 2; Set A
ucacagccugaaaaaggaacaaauaaaagucauucaggaa

SEQ ID NO: 55170 - RNA, 18 nt, Artificial Sequence
  Synthetic Oligonucleotide; CD80 exon 2; Set C
aaaaggaacaaauaaaag

SEQ ID NO: 55171 - RNA, 19 nt, Artificial Sequence
  Synthetic Oligonucleotide; CD80 exon 2; Set C
aaaaaggaacaaauaaaag

SEQ ID NO: 55172 - RNA, 19 nt, Artificial Sequence
  Synthetic Oligonucleotide; CD80 exon 2; Set C
gaaaaaggaacaaauaaaa

SEQ ID NO: 55173 - RNA, 18 nt, Artificial Sequence
  Synthetic Oligonucleotide; CD80 exon 2; Set C
gaaaaaggaacaaauaaa

SEQ ID NO: 55174 - RNA, 17 nt, Artificial Sequence
  Synthetic Oligonucleotide; CD80 exon 2; Set C
gaaaaaggaacaaauaa

SEQ ID NO: 55175 - RNA, 16 nt, Artificial Sequence
  Synthetic Oligonucleotide; CD80 exon 2; Set C
gaaaaaggaacaaaua

SEQ ID NO: 55176 - RNA, 15 nt, Artificial Sequence
  Synthetic Oligonucleotide; CD80 exon 2; Set C
gaaaaaggaacaaau

SEQ ID NO: 55177 - RNA, 36 nt, Artificial Sequence
  Synthetic Oligonucleotide; CD80 exon 2; Set C
uuucacagccugaaaaaggaacaaauaaaagucauu

SEQ ID NO: 55178 - RNA, 35 nt, Artificial Sequence
  Synthetic Oligonucleotide; CD80 exon 2; Set C
uuucacagccugaaaaaggaacaaauaaaagucau

SEQ ID NO: 55179 - RNA, 39 nt, Artificial Sequence
  Synthetic Oligonucleotide; CD80 exon 2; Set A
aguuucacagccugaaaaaggaacaaauaaaagucauuc

SEQ ID NO: 55180 - RNA, 34 nt, Artificial Sequence
  Synthetic Oligonucleotide; CD80 exon 2; Set C
uuucacagccugaaaaaggaacaaauaaaaguca

SEQ ID NO: 55181 - RNA, 36 nt, Artificial Sequence
  Synthetic Oligonucleotide; CD80 exon 2; Set A
guuucacagccugaaaaaggaacaaauaaaagucau

SEQ ID NO: 55182 - RNA, 40 nt, Artificial Sequence
  Synthetic Oligonucleotide; CD80 exon 2; Set A
uaguuucacagccugaaaaaggaacaaauaaaagucauuc

SEQ ID NO: 55183 - RNA, 33 nt, Artificial Sequence
  Synthetic Oligonucleotide; CD80 exon 2; Set C
uuucacagccugaaaaaggaacaaauaaaaguc

SEQ ID NO: 55184 - RNA, 35 nt, Artificial Sequence
  Synthetic Oligonucleotide; CD80 exon 2; Set A
guuucacagccugaaaaaggaacaaauaaaaguca

SEQ ID NO: 55185 - RNA, 37 nt, Artificial Sequence
  Synthetic Oligonucleotide; CD80 exon 2; Set A
aguuucacagccugaaaaaggaacaaauaaaagucau

SEQ ID NO: 55186 - RNA, 28 nt, Artificial Sequence
  Synthetic Oligonucleotide; CD80 exon 2; Set C
ucacagccugaaaaaggaacaaauaaaa

SEQ ID NO: 55187 - RNA, 32 nt, Artificial Sequence
  Synthetic Oligonucleotide; CD80 exon 2; Set C
uuucacagccugaaaaaggaacaaauaaaagu

SEQ ID NO: 55188 - RNA, 34 nt, Artificial Sequence
  Synthetic Oligonucleotide; CD80 exon 2; Set C
guuucacagccugaaaaaggaacaaauaaaaguc

SEQ ID NO: 55189 - RNA, 38 nt, Artificial Sequence
  Synthetic Oligonucleotide; CD80 exon 2; Set A
uaguuucacagccugaaaaaggaacaaauaaaagucau

SEQ ID NO: 55190 - RNA, 29 nt, Artificial Sequence
  Synthetic Oligonucleotide; CD80 exon 2; Set C
uucacagccugaaaaaggaacaaauaaaa

SEQ ID NO: 55191 - RNA, 27 nt, Artificial Sequence
  Synthetic Oligonucleotide; CD80 exon 2; Set C
ucacagccugaaaaaggaacaaauaaa

SEQ ID NO: 55192 - RNA, 35 nt, Artificial Sequence
  Synthetic Oligonucleotide; CD80 exon 2; Set C
aguuucacagccugaaaaaggaacaaauaaaaguc

SEQ ID NO: 55193 - RNA, 39 nt, Artificial Sequence
  Synthetic Oligonucleotide; CD80 exon 2; Set A
uuaguuucacagccugaaaaaggaacaaauaaaagucau

SEQ ID NO: 55194 - RNA, 26 nt, Artificial Sequence
  Synthetic Oligonucleotide; CD80 exon 2; Set C
ucacagccugaaaaaggaacaaauaa

SEQ ID NO: 55195 - RNA, 28 nt, Artificial Sequence
  Synthetic Oligonucleotide; CD80 exon 2; Set C
uucacagccugaaaaaggaacaaauaaa

SEQ ID NO: 55196 - RNA, 27 nt, Artificial Sequence
  Synthetic Oligonucleotide; CD80 exon 2; Set C
uucacagccugaaaaaggaacaaauaa

SEQ ID NO: 55197 - RNA, 25 nt, Artificial Sequence
  Synthetic Oligonucleotide; CD80 exon 2; Set C
ucacagccugaaaaaggaacaaaua

SEQ ID NO: 55198 - RNA, 26 nt, Artificial Sequence
  Synthetic Oligonucleotide; CD80 exon 2; Set C
uucacagccugaaaaaggaacaaaua

SEQ ID NO: 55199 - RNA, 24 nt, Artificial Sequence
  Synthetic Oligonucleotide; CD80 exon 2; Set C
ucacagccugaaaaaggaacaaau

SEQ ID NO: 55200 - RNA, 25 nt, Artificial Sequence
  Synthetic Oligonucleotide; CD80 exon 2; Set C
uucacagccugaaaaaggaacaaau

SEQ ID NO: 55201 - RNA, 24 nt, Artificial Sequence
  Synthetic Oligonucleotide; CD80 exon 2; Set C
uucacagccugaaaaaggaacaaa

SEQ ID NO: 55202 - RNA, 39 nt, Artificial Sequence
  Synthetic Oligonucleotide; CD80 exon 2; Set A
ggauuuaguuucacagccugaaaaaggaacaaauaaaag

SEQ ID NO: 55203 - RNA, 40 nt, Artificial Sequence
  Synthetic Oligonucleotide; CD80 exon 2; Set A
uggauuuaguuucacagccugaaaaaggaacaaauaaaag

SEQ ID NO: 55204 - RNA, 18 nt, Artificial Sequence
  Synthetic Oligonucleotide; CD80 exon 2; Set C
uucacagccugaaaaagg

SEQ ID NO: 55205 - RNA, 17 nt, Artificial Sequence
  Synthetic Oligonucleotide; CD80 exon 2; Set C
uucacagccugaaaaag

SEQ ID NO: 55206 - RNA, 20 nt, Artificial Sequence
  Synthetic Oligonucleotide; CD80 exon 2; Set C
uuaguuucacagccugaaaa

SEQ ID NO: 55207 - RNA, 21 nt, Artificial Sequence
  Synthetic Oligonucleotide; CD80 exon 2; Set C
uuuaguuucacagccugaaaa

SEQ ID NO: 55208 - RNA, 22 nt, Artificial Sequence
  Synthetic Oligonucleotide; CD80 exon 2; Set C
auuuaguuucacagccugaaaa

SEQ ID NO: 55209 - RNA, 20 nt, Artificial Sequence
  Synthetic Oligonucleotide; CD80 exon 2; Set C
uuuaguuucacagccugaaa

SEQ ID NO: 55210 - RNA, 23 nt, Artificial Sequence
  Synthetic Oligonucleotide; CD80 exon 2; Set C
gauuuaguuucacagccugaaaa

SEQ ID NO: 55211 - RNA, 21 nt, Artificial Sequence
  Synthetic Oligonucleotide; CD80 exon 2; Set C
auuuaguuucacagccugaaa

SEQ ID NO: 55212 - RNA, 22 nt, Artificial Sequence
  Synthetic Oligonucleotide; CD80 exon 2; Set C
gauuuaguuucacagccugaaa

SEQ ID NO: 55213 - RNA, 30 nt, Artificial Sequence
  Synthetic Oligonucleotide; CD80 exon 2; Set A
gguuguggauuuaguuucacagccugaaaa

SEQ ID NO: 55214 - RNA, 37 nt, Artificial Sequence
  Synthetic Oligonucleotide; CD80 exon 2; Set A
caaagguuguggauuuaguuucacagccugaaaaagg

SEQ ID NO: 55215 - RNA, 31 nt, Artificial Sequence
  Synthetic Oligonucleotide; CD80 exon 2; Set A
agguuguggauuuaguuucacagccugaaaa

SEQ ID NO: 55216 - RNA, 29 nt, Artificial Sequence
  Synthetic Oligonucleotide; CD80 exon 2; Set A
gguuguggauuuaguuucacagccugaaa

SEQ ID NO: 55217 - RNA, 36 nt, Artificial Sequence
  Synthetic Oligonucleotide; CD80 exon 2; Set A
caaagguuguggauuuaguuucacagccugaaaaag

SEQ ID NO: 55218 - RNA, 32 nt, Artificial Sequence
  Synthetic Oligonucleotide; CD80 exon 2; Set A
aagguuguggauuuaguuucacagccugaaaa

SEQ ID NO: 55219 - RNA, 30 nt, Artificial Sequence
  Synthetic Oligonucleotide; CD80 exon 2; Set A
agguuguggauuuaguuucacagccugaaa

SEQ ID NO: 55220 - RNA, 35 nt, Artificial Sequence
  Synthetic Oligonucleotide; CD80 exon 2; Set A
caaagguuguggauuuaguuucacagccugaaaaa

SEQ ID NO: 55221 - RNA, 33 nt, Artificial Sequence
  Synthetic Oligonucleotide; CD80 exon 2; Set A
aaagguuguggauuuaguuucacagccugaaaa

SEQ ID NO: 55222 - RNA, 31 nt, Artificial Sequence
  Synthetic Oligonucleotide; CD80 exon 2; Set A
aagguuguggauuuaguuucacagccugaaa

SEQ ID NO: 55223 - RNA, 32 nt, Artificial Sequence
  Synthetic Oligonucleotide; CD80 exon 2; Set A
aaagguuguggauuuaguuucacagccugaaa

SEQ ID NO: 55224 - RNA, 15 nt, Artificial Sequence
  Synthetic Oligonucleotide; CD80 exon 2; Set C
guggauuuaguuuca

SEQ ID NO: 55225 - RNA, 16 nt, Artificial Sequence
  Synthetic Oligonucleotide; CD80 exon 2; Set C
uguggauuuaguuuca

SEQ ID NO: 55226 - RNA, 15 nt, Artificial Sequence
  Synthetic Oligonucleotide; CD80 exon 2; Set C
uguggauuuaguuuc

SEQ ID NO: 55227 - RNA, 17 nt, Artificial Sequence
  Synthetic Oligonucleotide; CD80 exon 2; Set C
uuguggauuuaguuuca

SEQ ID NO: 55228 - RNA, 18 nt, Artificial Sequence
  Synthetic Oligonucleotide; CD80 exon 2; Set C
guuguggauuuaguuuca

SEQ ID NO: 55229 - RNA, 40 nt, Artificial Sequence
  Synthetic Oligonucleotide; CD80 exon 2; Set C
gggucuccaaagguuguggauuuaguuucacagccugaaa

SEQ ID NO: 55230 - RNA, 26 nt, Artificial Sequence
  Synthetic Oligonucleotide; CD80 exon 2; Set C
gucuccaaagguuguggauuuaguuu

SEQ ID NO: 55231 - RNA, 25 nt, Artificial Sequence
  Synthetic Oligonucleotide; CD80 exon 2; Set C
gucuccaaagguuguggauuuaguu

SEQ ID NO: 55232 - RNA, 24 nt, Artificial Sequence
  Synthetic Oligonucleotide; CD80 exon 2; Set C
gucuccaaagguuguggauuuagu

SEQ ID NO: 55233 - RNA, 23 nt, Artificial Sequence
  Synthetic Oligonucleotide; CD80 exon 2; Set C
gucuccaaagguuguggauuuag

SEQ ID NO: 55234 - RNA, 37 nt, Artificial Sequence
  Synthetic Oligonucleotide; CD80 exon 2; Set C
gauuggaggguguuccugggucuccaaagguugugga

SEQ ID NO: 55235 - RNA, 38 nt, Artificial Sequence
  Synthetic Oligonucleotide; CD80 exon 2; Set C
agauuggaggguguuccugggucuccaaagguugugga

SEQ ID NO: 55236 - RNA, 36 nt, Artificial Sequence
  Synthetic Oligonucleotide; CD80 exon 2; Set C
gauuggaggguguuccugggucuccaaagguugugg

SEQ ID NO: 55237 - RNA, 37 nt, Artificial Sequence
  Synthetic Oligonucleotide; CD80 exon 2; Set C
agauuggaggguguuccugggucuccaaagguugugg

SEQ ID NO: 55238 - RNA, 39 nt, Artificial Sequence
  Synthetic Oligonucleotide; CD80 exon 2; Set C
gagauuggaggguguuccugggucuccaaagguugugga

SEQ ID NO: 55239 - RNA, 35 nt, Artificial Sequence
  Synthetic Oligonucleotide; CD80 exon 2; Set C
gauuggaggguguuccugggucuccaaagguugug

SEQ ID NO: 55240 - RNA, 34 nt, Artificial Sequence
  Synthetic Oligonucleotide; CD80 exon 2; Set C
gauuggaggguguuccugggucuccaaagguugu

SEQ ID NO: 55241 - RNA, 40 nt, Artificial Sequence
  Synthetic Oligonucleotide; CD80 exon 2; Set C
agagauuggaggguguuccugggucuccaaagguugugga

SEQ ID NO: 55242 - RNA, 38 nt, Artificial Sequence
  Synthetic Oligonucleotide; CD80 exon 2; Set C
gagauuggaggguguuccugggucuccaaagguugugg

SEQ ID NO: 55243 - RNA, 36 nt, Artificial Sequence
  Synthetic Oligonucleotide; CD80 exon 2; Set C
agauuggaggguguuccugggucuccaaagguugug

SEQ ID NO: 55244 - RNA, 33 nt, Artificial Sequence
  Synthetic Oligonucleotide; CD80 exon 2; Set C
gauuggaggguguuccugggucuccaaagguug

SEQ ID NO: 55245 - RNA, 35 nt, Artificial Sequence
  Synthetic Oligonucleotide; CD80 exon 2; Set C
agauuggaggguguuccugggucuccaaagguugu

SEQ ID NO: 55246 - RNA, 39 nt, Artificial Sequence
  Synthetic Oligonucleotide; CD80 exon 2; Set C
agagauuggaggguguuccugggucuccaaagguugugg

SEQ ID NO: 55247 - RNA, 37 nt, Artificial Sequence
  Synthetic Oligonucleotide; CD80 exon 2; Set C
gagauuggaggguguuccugggucuccaaagguugug

SEQ ID NO: 55248 - RNA, 32 nt, Artificial Sequence
  Synthetic Oligonucleotide; CD80 exon 2; Set C
gauuggaggguguuccugggucuccaaagguu

SEQ ID NO: 55249 - RNA, 34 nt, Artificial Sequence
  Synthetic Oligonucleotide; CD80 exon 2; Set C
agauuggaggguguuccugggucuccaaagguug

SEQ ID NO: 55250 - RNA, 36 nt, Artificial Sequence
  Synthetic Oligonucleotide; CD80 exon 2; Set C
gagauuggaggguguuccugggucuccaaagguugu

SEQ ID NO: 55251 - RNA, 38 nt, Artificial Sequence
  Synthetic Oligonucleotide; CD80 exon 2; Set C
agagauuggaggguguuccugggucuccaaagguugug

SEQ ID NO: 55252 - RNA, 33 nt, Artificial Sequence
  Synthetic Oligonucleotide; CD80 exon 2; Set C
agauuggaggguguuccugggucuccaaagguu

SEQ ID NO: 55253 - RNA, 35 nt, Artificial Sequence
  Synthetic Oligonucleotide; CD80 exon 2; Set C
gagauuggaggguguuccugggucuccaaagguug

SEQ ID NO: 55254 - RNA, 37 nt, Artificial Sequence
  Synthetic Oligonucleotide; CD80 exon 2; Set C
agagauuggaggguguuccugggucuccaaagguugu

SEQ ID NO: 55255 - RNA, 34 nt, Artificial Sequence
  Synthetic Oligonucleotide; CD80 exon 2; Set C
gagauuggaggguguuccugggucuccaaagguu

SEQ ID NO: 55256 - RNA, 36 nt, Artificial Sequence
  Synthetic Oligonucleotide; CD80 exon 2; Set C
agagauuggaggguguuccugggucuccaaagguug

SEQ ID NO: 55257 - RNA, 35 nt, Artificial Sequence
  Synthetic Oligonucleotide; CD80 exon 2; Set C
agagauuggaggguguuccugggucuccaaagguu

SEQ ID NO: 55258 - RNA, 28 nt, Artificial Sequence
  Synthetic Oligonucleotide; CD80 exon 2; Set C
gauuggaggguguuccugggucuccaaa

SEQ ID NO: 55259 - RNA, 29 nt, Artificial Sequence
  Synthetic Oligonucleotide; CD80 exon 2; Set C
agauuggaggguguuccugggucuccaaa

SEQ ID NO: 55260 - RNA, 19 nt, Artificial Sequence
  Synthetic Oligonucleotide; CD80 exon 2; Set A
gauuggaggguguuccugg

SEQ ID NO: 55261 - RNA, 20 nt, Artificial Sequence
  Synthetic Oligonucleotide; CD80 exon 2; Set A
agauuggaggguguuccugg

SEQ ID NO: 55262 - RNA, 34 nt, Artificial Sequence
  Synthetic Oligonucleotide; CD80 exon 2; Set C
acaaaacacacagagauuggaggguguuccuggg

SEQ ID NO: 55263 - RNA, 33 nt, Artificial Sequence
  Synthetic Oligonucleotide; CD80 exon 2; Set C
acaaaacacacagagauuggaggguguuccugg

SEQ ID NO: 55264 - RNA, 17 nt, Artificial Sequence
  Synthetic Oligonucleotide; CD80 exon 2; Set C
acaaaacacacagagau

SEQ ID NO: 55265 - RNA, 16 nt, Artificial Sequence
  Synthetic Oligonucleotide; CD80 exon 2; Set C
acaaaacacacagaga

SEQ ID NO: 55266 - RNA, 15 nt, Artificial Sequence
  Synthetic Oligonucleotide; CD80 exon 2; Set C
acaaaacacacagag

SEQ ID NO: 55267 - RNA, 40 nt, Artificial Sequence
  Synthetic Oligonucleotide; CD80 exon 2; Set C
cguagaagacccuccagugauguuuacaaaacacacagag

SEQ ID NO: 55268 - RNA, 39 nt, Artificial Sequence
  Synthetic Oligonucleotide; CD80 exon 2; Set C
cguagaagacccuccagugauguuuacaaaacacacaga

SEQ ID NO: 55269 - RNA, 28 nt, Artificial Sequence
  Synthetic Oligonucleotide; CD80 exon 2; Set A
cguagaagacccuccagugauguuuaca

SEQ ID NO: 55270 - RNA, 29 nt, Artificial Sequence
  Synthetic Oligonucleotide; CD80 exon 2; Set A
acguagaagacccuccagugauguuuaca

SEQ ID NO: 55271 - RNA, 38 nt, Artificial Sequence
  Synthetic Oligonucleotide; CD80 exon 2; Set C
caauugcucacguagaagacccuccagugauguuuaca

SEQ ID NO: 55272 - RNA, 16 nt, Artificial Sequence
  Synthetic Oligonucleotide; CD80 exon 2; Set C
auugcucacguagaag

SEQ ID NO: 55273 - RNA, 18 nt, Artificial Sequence
  Synthetic Oligonucleotide; CD80 exon 2; Set C
aauugcucacguagaaga

SEQ ID NO: 55274 - RNA, 19 nt, Artificial Sequence
  Synthetic Oligonucleotide; CD80 exon 2; Set C
caauugcucacguagaaga

SEQ ID NO: 55275 - RNA, 28 nt, Artificial Sequence
  Synthetic Oligonucleotide; CD80 exon 2; Set A
gaugacaauccaauugcucacguagaag

SEQ ID NO: 55276 - RNA, 17 nt, Artificial Sequence
  Synthetic Oligonucleotide; CD80 exon 2; Set C
caauccaauugcucacg

SEQ ID NO: 55277 - RNA, 29 nt, Artificial Sequence
  Synthetic Oligonucleotide; CD80 exon 2; Set A
ugaugacaauccaauugcucacguagaag

SEQ ID NO: 55278 - RNA, 30 nt, Artificial Sequence
  Synthetic Oligonucleotide; CD80 exon 2; Set A
cugaugacaauccaauugcucacguagaag

SEQ ID NO: 55279 - RNA, 23 nt, Artificial Sequence
  Synthetic Oligonucleotide; CD80 exon 2; Set C
augacaauccaauugcucacgua

SEQ ID NO: 55280 - RNA, 31 nt, Artificial Sequence
  Synthetic Oligonucleotide; CD80 exon 2; Set A
gcugaugacaauccaauugcucacguagaag

SEQ ID NO: 55281 - RNA, 29 nt, Artificial Sequence
  Synthetic Oligonucleotide; CD80 exon 2; Set A
cugaugacaauccaauugcucacguagaa

SEQ ID NO: 55282 - RNA, 24 nt, Artificial Sequence
  Synthetic Oligonucleotide; CD80 exon 2; Set A
gaugacaauccaauugcucacgua

SEQ ID NO: 55283 - RNA, 32 nt, Artificial Sequence
  Synthetic Oligonucleotide; CD80 exon 2; Set A
ggcugaugacaauccaauugcucacguagaag

SEQ ID NO: 55284 - RNA, 30 nt, Artificial Sequence
  Synthetic Oligonucleotide; CD80 exon 2; Set A
gcugaugacaauccaauugcucacguagaa

SEQ ID NO: 55285 - RNA, 28 nt, Artificial Sequence
  Synthetic Oligonucleotide; CD80 exon 2; Set A
cugaugacaauccaauugcucacguaga

SEQ ID NO: 55286 - RNA, 25 nt, Artificial Sequence
  Synthetic Oligonucleotide; CD80 exon 2; Set A
ugaugacaauccaauugcucacgua

SEQ ID NO: 55287 - RNA, 33 nt, Artificial Sequence
  Synthetic Oligonucleotide; CD80 exon 2; Set C
gggcugaugacaauccaauugcucacguagaag

SEQ ID NO: 55288 - RNA, 31 nt, Artificial Sequence
  Synthetic Oligonucleotide; CD80 exon 2; Set C
ggcugaugacaauccaauugcucacguagaa

SEQ ID NO: 55289 - RNA, 27 nt, Artificial Sequence
  Synthetic Oligonucleotide; CD80 exon 2; Set A
cugaugacaauccaauugcucacguag

SEQ ID NO: 55290 - RNA, 29 nt, Artificial Sequence
  Synthetic Oligonucleotide; CD80 exon 2; Set A
gcugaugacaauccaauugcucacguaga

SEQ ID NO: 55291 - RNA, 32 nt, Artificial Sequence
  Synthetic Oligonucleotide; CD80 exon 2; Set C
gggcugaugacaauccaauugcucacguagaa

SEQ ID NO: 55292 - RNA, 30 nt, Artificial Sequence
  Synthetic Oligonucleotide; CD80 exon 2; Set C
ggcugaugacaauccaauugcucacguaga

SEQ ID NO: 55293 - RNA, 28 nt, Artificial Sequence
  Synthetic Oligonucleotide; CD80 exon 2; Set A
gcugaugacaauccaauugcucacguag

SEQ ID NO: 55294 - RNA, 27 nt, Artificial Sequence
  Synthetic Oligonucleotide; CD80 exon 2; Set A
gcugaugacaauccaauugcucacgua

SEQ ID NO: 55295 - RNA, 31 nt, Artificial Sequence
  Synthetic Oligonucleotide; CD80 exon 2; Set C
gggcugaugacaauccaauugcucacguaga

SEQ ID NO: 55296 - RNA, 29 nt, Artificial Sequence
  Synthetic Oligonucleotide; CD80 exon 2; Set A
ggcugaugacaauccaauugcucacguag

SEQ ID NO: 55297 - RNA, 30 nt, Artificial Sequence
  Synthetic Oligonucleotide; CD80 exon 2; Set C
gggcugaugacaauccaauugcucacguag

SEQ ID NO: 55298 - RNA, 30 nt, Artificial Sequence
  Synthetic Oligonucleotide; CD80 exon 2; Set C
cagggcugaugacaauccaauugcucacgu

SEQ ID NO: 55299 - RNA, 28 nt, Artificial Sequence
  Synthetic Oligonucleotide; CD80 exon 2; Set A
agggcugaugacaauccaauugcucacg

SEQ ID NO: 55300 - RNA, 40 nt, Artificial Sequence
  Synthetic Oligonucleotide; CD80 exon 2; Set C
acaggcagggcugaugacaauccaauugcucacguagaag

SEQ ID NO: 55301 - RNA, 15 nt, Artificial Sequence
  Synthetic Oligonucleotide; CD80 exon 2; Set C
gaugacaauccaauu

SEQ ID NO: 55302 - RNA, 39 nt, Artificial Sequence
  Synthetic Oligonucleotide; CD80 exon 2; Set C
acaggcagggcugaugacaauccaauugcucacguagaa

SEQ ID NO: 55303 - RNA, 16 nt, Artificial Sequence
  Synthetic Oligonucleotide; CD80 exon 2; Set C
ugaugacaauccaauu

SEQ ID NO: 55304 - RNA, 38 nt, Artificial Sequence
  Synthetic Oligonucleotide; CD80 exon 2; Set C
acaggcagggcugaugacaauccaauugcucacguaga

SEQ ID NO: 55305 - RNA, 17 nt, Artificial Sequence
  Synthetic Oligonucleotide; CD80 exon 2; Set C
cugaugacaauccaauu

SEQ ID NO: 55306 - RNA, 37 nt, Artificial Sequence
  Synthetic Oligonucleotide; CD80 exon 2; Set C
acaggcagggcugaugacaauccaauugcucacguag

SEQ ID NO: 55307 - RNA, 34 nt, Artificial Sequence
  Synthetic Oligonucleotide; CD80 exon 2; Set C
caggcagggcugaugacaauccaauugcucacgu

SEQ ID NO: 55308 - RNA, 36 nt, Artificial Sequence
  Synthetic Oligonucleotide; CD80 exon 2; Set C
acaggcagggcugaugacaauccaauugcucacgua

SEQ ID NO: 55309 - RNA, 18 nt, Artificial Sequence
  Synthetic Oligonucleotide; CD80 exon 2; Set C
gcugaugacaauccaauu

SEQ ID NO: 55310 - RNA, 19 nt, Artificial Sequence
  Synthetic Oligonucleotide; CD80 exon 2; Set C
ggcugaugacaauccaauu

SEQ ID NO: 55311 - RNA, 20 nt, Artificial Sequence
  Synthetic Oligonucleotide; CD80 exon 2; Set C
gggcugaugacaauccaauu

SEQ ID NO: 55312 - RNA, 21 nt, Artificial Sequence
  Synthetic Oligonucleotide; CD80 exon 2; Set C
cagggcugaugacaauccaau

SEQ ID NO: 55313 - RNA, 27 nt, Artificial Sequence
  Synthetic Oligonucleotide; CD80 exon 2; Set A
acaggcagggcugaugacaauccaauu

SEQ ID NO: 55314 - RNA, 20 nt, Artificial Sequence
  Synthetic Oligonucleotide; CD80 exon 2; Set A
acaggcagggcugaugacaa

SEQ ID NO: 55315 - RNA, 16 nt, Artificial Sequence
  Synthetic Oligonucleotide; CD80 exon 2; Set C
acaggcagggcugaug

SEQ ID NO: 55316 - RNA, 19 nt, Artificial Sequence
  Synthetic Oligonucleotide; CD80 exon 2; Set C
aaacaggcagggcugauga

SEQ ID NO: 55317 - RNA, 36 nt, Artificial Sequence
  Synthetic Oligonucleotide; CD80 exon 2; Set C
ccaggugcaaaacaggcagggcugaugacaauccaa

SEQ ID NO: 55318 - RNA, 20 nt, Artificial Sequence
  Synthetic Oligonucleotide; CD80 exon 2; Set C
aaaacaggcagggcugauga

SEQ ID NO: 55319 - RNA, 37 nt, Artificial Sequence
  Synthetic Oligonucleotide; CD80 exon 2; Set C
cccaggugcaaaacaggcagggcugaugacaauccaa

SEQ ID NO: 55320 - RNA, 21 nt, Artificial Sequence
  Synthetic Oligonucleotide; CD80 exon 2; Set A
caaaacaggcagggcugauga

SEQ ID NO: 55321 - RNA, 22 nt, Artificial Sequence
  Synthetic Oligonucleotide; CD80 exon 2; Set A
gcaaaacaggcagggcugauga

SEQ ID NO: 55322 - RNA, 23 nt, Artificial Sequence
  Synthetic Oligonucleotide; CD80 exon 2; Set A
ugcaaaacaggcagggcugauga

SEQ ID NO: 55323 - RNA, 24 nt, Artificial Sequence
  Synthetic Oligonucleotide; CD80 exon 2; Set A
gugcaaaacaggcagggcugauga

SEQ ID NO: 55324 - RNA, 26 nt, Artificial Sequence
  Synthetic Oligonucleotide; CD80 exon 2; Set C
ccaggugcaaaacaggcagggcugau

SEQ ID NO: 55325 - RNA, 27 nt, Artificial Sequence
  Synthetic Oligonucleotide; CD80 exon 2; Set C
cccaggugcaaaacaggcagggcugau

SEQ ID NO: 55326 - RNA, 25 nt, Artificial Sequence
  Synthetic Oligonucleotide; CD80 exon 2; Set C
ccaggugcaaaacaggcagggcuga

SEQ ID NO: 55327 - RNA, 24 nt, Artificial Sequence
  Synthetic Oligonucleotide; CD80 exon 2; Set C
ccaggugcaaaacaggcagggcug

SEQ ID NO: 55328 - RNA, 26 nt, Artificial Sequence
  Synthetic Oligonucleotide; CD80 exon 2; Set C
cccaggugcaaaacaggcagggcuga

SEQ ID NO: 55329 - RNA, 25 nt, Artificial Sequence
  Synthetic Oligonucleotide; CD80 exon 2; Set C
cccaggugcaaaacaggcagggcug

SEQ ID NO: 55330 - RNA, 23 nt, Artificial Sequence
  Synthetic Oligonucleotide; CD80 exon 2; Set C
ccaggugcaaaacaggcagggcu

SEQ ID NO: 55331 - RNA, 15 nt, Artificial Sequence
  Synthetic Oligonucleotide; CD80 exon 2; Set C
gugcaaaacaggcag

SEQ ID NO: 55332 - RNA, 22 nt, Artificial Sequence
  Synthetic Oligonucleotide; CD80 exon 2; Set A
ccaggugcaaaacaggcagggc

SEQ ID NO: 55333 - RNA, 24 nt, Artificial Sequence
  Synthetic Oligonucleotide; CD80 exon 2; Set C
cccaggugcaaaacaggcagggcu

SEQ ID NO: 55334 - RNA, 21 nt, Artificial Sequence
  Synthetic Oligonucleotide; CD80 exon 2; Set A
ccaggugcaaaacaggcaggg

SEQ ID NO: 55335 - RNA, 23 nt, Artificial Sequence
  Synthetic Oligonucleotide; CD80 exon 2; Set C
cccaggugcaaaacaggcagggc

SEQ ID NO: 55336 - RNA, 22 nt, Artificial Sequence
  Synthetic Oligonucleotide; CD80 exon 2; Set A
cccaggugcaaaacaggcaggg

SEQ ID NO: 55337 - RNA, 21 nt, Artificial Sequence
  Synthetic Oligonucleotide; CD80 exon 2; Set A
ucccaggugcaaaacaggcag

SEQ ID NO: 55338 - RNA, 22 nt, Artificial Sequence
  Synthetic Oligonucleotide; CD80 exon 2; Set A
uucccaggugcaaaacaggcag

SEQ ID NO: 55339 - RNA, 37 nt, Artificial Sequence
  Synthetic Oligonucleotide; CD80 exon 2; Set C
cagggcacuucccaggugcaaaacaggcagggcugau

SEQ ID NO: 55340 - RNA, 36 nt, Artificial Sequence
  Synthetic Oligonucleotide; CD80 exon 2; Set C
cagggcacuucccaggugcaaaacaggcagggcuga

SEQ ID NO: 55341 - RNA, 35 nt, Artificial Sequence
  Synthetic Oligonucleotide; CD80 exon 2; Set C
cagggcacuucccaggugcaaaacaggcagggcug

SEQ ID NO: 55342 - RNA, 15 nt, Artificial Sequence
  Synthetic Oligonucleotide; CD80 exon 2; Set C
cccaggugcaaaaca

SEQ ID NO: 55343 - RNA, 17 nt, Artificial Sequence
  Synthetic Oligonucleotide; CD80 exon 2; Set C
ucccaggugcaaaacag

SEQ ID NO: 55344 - RNA, 34 nt, Artificial Sequence
  Synthetic Oligonucleotide; CD80 exon 2; Set C
cagggcacuucccaggugcaaaacaggcagggcu

SEQ ID NO: 55345 - RNA, 18 nt, Artificial Sequence
  Synthetic Oligonucleotide; CD80 exon 2; Set C
uucccaggugcaaaacag

SEQ ID NO: 55346 - RNA, 33 nt, Artificial Sequence
  Synthetic Oligonucleotide; CD80 exon 2; Set C
cagggcacuucccaggugcaaaacaggcagggc

SEQ ID NO: 55347 - RNA, 32 nt, Artificial Sequence
  Synthetic Oligonucleotide; CD80 exon 2; Set C
cagggcacuucccaggugcaaaacaggcaggg

SEQ ID NO: 55348 - RNA, 30 nt, Artificial Sequence
  Synthetic Oligonucleotide; CD80 exon 2; Set C
agggcacuucccaggugcaaaacaggcagg

SEQ ID NO: 55349 - RNA, 25 nt, Artificial Sequence
  Synthetic Oligonucleotide; CD80 exon 2; Set C
cagggcacuucccaggugcaaaaca

SEQ ID NO: 55350 - RNA, 18 nt, Artificial Sequence
  Synthetic Oligonucleotide; CD80 exon 2; Set A
cagggcacuucccaggug

SEQ ID NO: 55351 - RNA, 28 nt, Artificial Sequence
  Synthetic Oligonucleotide; CD80 exon 2; Set A
caacaauuuggacccaaguaagaccagg

SEQ ID NO: 55352 - RNA, 29 nt, Artificial Sequence
  Synthetic Oligonucleotide; CD80 exon 2; Set A
ccaacaauuuggacccaaguaagaccagg

SEQ ID NO: 55353 - RNA, 30 nt, Artificial Sequence
  Synthetic Oligonucleotide; CD80 exon 2; Set C
gccaacaauuuggacccaaguaagaccagg

SEQ ID NO: 55354 - RNA, 32 nt, Artificial Sequence
  Synthetic Oligonucleotide; CD80 exon 2; Set A
aaagccaacaauuuggacccaaguaagaccag

SEQ ID NO: 55355 - RNA, 26 nt, Artificial Sequence
  Synthetic Oligonucleotide; CD80 exon 2; Set C
uuagggucaaaagugaaagccaacaa

SEQ ID NO: 55356 - RNA, 27 nt, Artificial Sequence
  Synthetic Oligonucleotide; CD80 exon 2; Set C
cuuagggucaaaagugaaagccaacaa

SEQ ID NO: 55357 - RNA, 25 nt, Artificial Sequence
  Synthetic Oligonucleotide; CD80 exon 2; Set C
uuagggucaaaagugaaagccaaca

SEQ ID NO: 55358 - RNA, 28 nt, Artificial Sequence
  Synthetic Oligonucleotide; CD80 exon 2; Set A
gcuuagggucaaaagugaaagccaacaa

SEQ ID NO: 55359 - RNA, 26 nt, Artificial Sequence
  Synthetic Oligonucleotide; CD80 exon 2; Set C
cuuagggucaaaagugaaagccaaca

SEQ ID NO: 55360 - RNA, 29 nt, Artificial Sequence
  Synthetic Oligonucleotide; CD80 exon 2; Set A
ugcuuagggucaaaagugaaagccaacaa

SEQ ID NO: 55361 - RNA, 27 nt, Artificial Sequence
  Synthetic Oligonucleotide; CD80 exon 2; Set A
gcuuagggucaaaagugaaagccaaca

SEQ ID NO: 55362 - RNA, 30 nt, Artificial Sequence
  Synthetic Oligonucleotide; CD80 exon 2; Set A
augcuuagggucaaaagugaaagccaacaa

SEQ ID NO: 55363 - RNA, 28 nt, Artificial Sequence
  Synthetic Oligonucleotide; CD80 exon 2; Set A
ugcuuagggucaaaagugaaagccaaca

SEQ ID NO: 55364 - RNA, 31 nt, Artificial Sequence
  Synthetic Oligonucleotide; CD80 exon 2; Set A
gaugcuuagggucaaaagugaaagccaacaa

SEQ ID NO: 55365 - RNA, 29 nt, Artificial Sequence
  Synthetic Oligonucleotide; CD80 exon 2; Set A
augcuuagggucaaaagugaaagccaaca

SEQ ID NO: 55366 - RNA, 27 nt, Artificial Sequence
  Synthetic Oligonucleotide; CD80 exon 2; Set A
ugcuuagggucaaaagugaaagccaac

SEQ ID NO: 55367 - RNA, 30 nt, Artificial Sequence
  Synthetic Oligonucleotide; CD80 exon 2; Set A
gaugcuuagggucaaaagugaaagccaaca

SEQ ID NO: 55368 - RNA, 28 nt, Artificial Sequence
  Synthetic Oligonucleotide; CD80 exon 2; Set A
augcuuagggucaaaagugaaagccaac

SEQ ID NO: 55369 - RNA, 29 nt, Artificial Sequence
  Synthetic Oligonucleotide; CD80 exon 2; Set A
gaugcuuagggucaaaagugaaagccaac

SEQ ID NO: 55370 - RNA, 17 nt, Artificial Sequence
  Synthetic Oligonucleotide; CD80 exon 2; Set C
uuagggucaaaagugaa

SEQ ID NO: 55371 - RNA, 16 nt, Artificial Sequence
  Synthetic Oligonucleotide; CD80 exon 2; Set C
uuagggucaaaaguga

SEQ ID NO: 55372 - RNA, 18 nt, Artificial Sequence
  Synthetic Oligonucleotide; CD80 exon 2; Set C
cuuagggucaaaagugaa

SEQ ID NO: 55373 - RNA, 17 nt, Artificial Sequence
  Synthetic Oligonucleotide; CD80 exon 2; Set C
cuuagggucaaaaguga

SEQ ID NO: 55374 - RNA, 19 nt, Artificial Sequence
  Synthetic Oligonucleotide; CD80 exon 2; Set C
gcuuagggucaaaagugaa

SEQ ID NO: 55375 - RNA, 18 nt, Artificial Sequence
  Synthetic Oligonucleotide; CD80 exon 2; Set C
gcuuagggucaaaaguga

SEQ ID NO: 55376 - RNA, 20 nt, Artificial Sequence
  Synthetic Oligonucleotide; CD80 exon 2; Set C
ugcuuagggucaaaagugaa

SEQ ID NO: 55377 - RNA, 17 nt, Artificial Sequence
  Synthetic Oligonucleotide; CD80 exon 2; Set C
gcuuagggucaaaagug

SEQ ID NO: 55378 - RNA, 19 nt, Artificial Sequence
  Synthetic Oligonucleotide; CD80 exon 2; Set C
ugcuuagggucaaaaguga

SEQ ID NO: 55379 - RNA, 21 nt, Artificial Sequence
  Synthetic Oligonucleotide; CD80 exon 2; Set C
augcuuagggucaaaagugaa

SEQ ID NO: 55380 - RNA, 18 nt, Artificial Sequence
  Synthetic Oligonucleotide; CD80 exon 2; Set C
ugcuuagggucaaaagug

SEQ ID NO: 55381 - RNA, 20 nt, Artificial Sequence
  Synthetic Oligonucleotide; CD80 exon 2; Set C
augcuuagggucaaaaguga

SEQ ID NO: 55382 - RNA, 19 nt, Artificial Sequence
  Synthetic Oligonucleotide; CD80 exon 2; Set C
augcuuagggucaaaagug

SEQ ID NO: 55383 - RNA, 21 nt, Artificial Sequence
  Synthetic Oligonucleotide; CD80 exon 2; Set C
gaugcuuagggucaaaaguga

SEQ ID NO: 55384 - RNA, 20 nt, Artificial Sequence
  Synthetic Oligonucleotide; CD80 exon 2; Set C
gaugcuuagggucaaaagug

SEQ ID NO: 55385 - RNA, 18 nt, Artificial Sequence
  Synthetic Oligonucleotide; CD80 exon 2; Set C
augcuuagggucaaaagu

SEQ ID NO: 55386 - RNA, 37 nt, Artificial Sequence
  Synthetic Oligonucleotide; CD80 exon 2; Set C
auggcuucagaugcuuagggucaaaagugaaagccaa

SEQ ID NO: 55387 - RNA, 19 nt, Artificial Sequence
  Synthetic Oligonucleotide; CD80 exon 2; Set C
gaugcuuagggucaaaagu

SEQ ID NO: 55388 - RNA, 36 nt, Artificial Sequence
  Synthetic Oligonucleotide; CD80 exon 2; Set C
auggcuucagaugcuuagggucaaaagugaaagcca

SEQ ID NO: 55389 - RNA, 35 nt, Artificial Sequence
  Synthetic Oligonucleotide; CD80 exon 2; Set A
auggcuucagaugcuuagggucaaaagugaaagcc

SEQ ID NO: 55390 - RNA, 34 nt, Artificial Sequence
  Synthetic Oligonucleotide; CD80 exon 2; Set A
auggcuucagaugcuuagggucaaaagugaaagc

SEQ ID NO: 55391 - RNA, 33 nt, Artificial Sequence
  Synthetic Oligonucleotide; CD80 exon 2; Set A
auggcuucagaugcuuagggucaaaagugaaag

SEQ ID NO: 55392 - RNA, 37 nt, Artificial Sequence
  Synthetic Oligonucleotide; CD80 exon 2; Set C
uggcccauggcuucagaugcuuagggucaaaagugaa

SEQ ID NO: 55393 - RNA, 36 nt, Artificial Sequence
  Synthetic Oligonucleotide; CD80 exon 2; Set C
uggcccauggcuucagaugcuuagggucaaaaguga

SEQ ID NO: 55394 - RNA, 38 nt, Artificial Sequence
  Synthetic Oligonucleotide; CD80 exon 2; Set C
guggcccauggcuucagaugcuuagggucaaaagugaa

SEQ ID NO: 55395 - RNA, 35 nt, Artificial Sequence
  Synthetic Oligonucleotide; CD80 exon 2; Set C
uggcccauggcuucagaugcuuagggucaaaagug

SEQ ID NO: 55396 - RNA, 37 nt, Artificial Sequence
  Synthetic Oligonucleotide; CD80 exon 2; Set C
guggcccauggcuucagaugcuuagggucaaaaguga

SEQ ID NO: 55397 - RNA, 39 nt, Artificial Sequence
  Synthetic Oligonucleotide; CD80 exon 2; Set C
uguggcccauggcuucagaugcuuagggucaaaagugaa

SEQ ID NO: 55398 - RNA, 36 nt, Artificial Sequence
  Synthetic Oligonucleotide; CD80 exon 2; Set C
guggcccauggcuucagaugcuuagggucaaaagug

SEQ ID NO: 55399 - RNA, 38 nt, Artificial Sequence
  Synthetic Oligonucleotide; CD80 exon 2; Set C
uguggcccauggcuucagaugcuuagggucaaaaguga

SEQ ID NO: 55400 - RNA, 40 nt, Artificial Sequence
  Synthetic Oligonucleotide; CD80 exon 2; Set C
guguggcccauggcuucagaugcuuagggucaaaagugaa

SEQ ID NO: 55401 - RNA, 37 nt, Artificial Sequence
  Synthetic Oligonucleotide; CD80 exon 2; Set C
uguggcccauggcuucagaugcuuagggucaaaagug

SEQ ID NO: 55402 - RNA, 39 nt, Artificial Sequence
  Synthetic Oligonucleotide; CD80 exon 2; Set C
guguggcccauggcuucagaugcuuagggucaaaaguga

SEQ ID NO: 55403 - RNA, 38 nt, Artificial Sequence
  Synthetic Oligonucleotide; CD80 exon 2; Set C
guguggcccauggcuucagaugcuuagggucaaaagug

SEQ ID NO: 55404 - RNA, 40 nt, Artificial Sequence
  Synthetic Oligonucleotide; CD80 exon 2; Set C
uguguggcccauggcuucagaugcuuagggucaaaaguga

SEQ ID NO: 55405 - RNA, 36 nt, Artificial Sequence
  Synthetic Oligonucleotide; CD80 exon 2; Set C
uguggcccauggcuucagaugcuuagggucaaaagu

SEQ ID NO: 55406 - RNA, 39 nt, Artificial Sequence
  Synthetic Oligonucleotide; CD80 exon 2; Set C
uguguggcccauggcuucagaugcuuagggucaaaagug

SEQ ID NO: 55407 - RNA, 37 nt, Artificial Sequence
  Synthetic Oligonucleotide; CD80 exon 2; Set C
guguggcccauggcuucagaugcuuagggucaaaagu

SEQ ID NO: 55408 - RNA, 38 nt, Artificial Sequence
  Synthetic Oligonucleotide; CD80 exon 2; Set C
uguguggcccauggcuucagaugcuuagggucaaaagu

SEQ ID NO: 55409 - RNA, 17 nt, Artificial Sequence
  Synthetic Oligonucleotide; CD80 exon 2; Set C
cauggcuucagaugcuu

SEQ ID NO: 55410 - RNA, 16 nt, Artificial Sequence
  Synthetic Oligonucleotide; CD80 exon 2; Set C
cauggcuucagaugcu

SEQ ID NO: 55411 - RNA, 15 nt, Artificial Sequence
  Synthetic Oligonucleotide; CD80 exon 2; Set C
cauggcuucagaugc

SEQ ID NO: 55412 - RNA, 20 nt, Artificial Sequence
  Synthetic Oligonucleotide; CD80 exon 2; Set A
uggcccauggcuucagaugc

SEQ ID NO: 55413 - RNA, 28 nt, Artificial Sequence
  Synthetic Oligonucleotide; CD80 exon 2; Set C
guguguggcccauggcuucagaugcuua

SEQ ID NO: 55414 - RNA, 29 nt, Artificial Sequence
  Synthetic Oligonucleotide; CD80 exon 2; Set C
cguguguggcccauggcuucagaugcuua

SEQ ID NO: 55415 - RNA, 27 nt, Artificial Sequence
  Synthetic Oligonucleotide; CD80 exon 2; Set C
guguguggcccauggcuucagaugcuu

SEQ ID NO: 55416 - RNA, 26 nt, Artificial Sequence
  Synthetic Oligonucleotide; CD80 exon 2; Set C
guguguggcccauggcuucagaugcu

SEQ ID NO: 55417 - RNA, 28 nt, Artificial Sequence
  Synthetic Oligonucleotide; CD80 exon 2; Set C
cguguguggcccauggcuucagaugcuu

SEQ ID NO: 55418 - RNA, 27 nt, Artificial Sequence
  Synthetic Oligonucleotide; CD80 exon 2; Set C
cguguguggcccauggcuucagaugcu

SEQ ID NO: 55419 - RNA, 25 nt, Artificial Sequence
  Synthetic Oligonucleotide; CD80 exon 2; Set C
guguguggcccauggcuucagaugc

SEQ ID NO: 55420 - RNA, 26 nt, Artificial Sequence
  Synthetic Oligonucleotide; CD80 exon 2; Set C
cguguguggcccauggcuucagaugc

SEQ ID NO: 55421 - RNA, 25 nt, Artificial Sequence
  Synthetic Oligonucleotide; CD80 exon 2; Set C
cguguguggcccauggcuucagaug

SEQ ID NO: 55422 - RNA, 23 nt, Artificial Sequence
  Synthetic Oligonucleotide; CD80 exon 2; Set C
guguguggcccauggcuucagau

SEQ ID NO: 55423 - RNA, 24 nt, Artificial Sequence
  Synthetic Oligonucleotide; CD80 exon 2; Set C
cguguguggcccauggcuucagau

SEQ ID NO: 55424 - RNA, 16 nt, Artificial Sequence
  Synthetic Oligonucleotide; CD80 exon 2; Set A
guucccugccuccgug

SEQ ID NO: 55425 - RNA, 34 nt, Artificial Sequence
  Synthetic Oligonucleotide; CD80 exon 2; Set C
ggacacuuggauggugauguucccugccuccgug

SEQ ID NO: 55426 - RNA, 35 nt, Artificial Sequence
  Synthetic Oligonucleotide; CD80 exon 2; Set C
uggacacuuggauggugauguucccugccuccgug

SEQ ID NO: 55427 - RNA, 33 nt, Artificial Sequence
  Synthetic Oligonucleotide; CD80 exon 2; Set C
ggacacuuggauggugauguucccugccuccgu

SEQ ID NO: 55428 - RNA, 34 nt, Artificial Sequence
  Synthetic Oligonucleotide; CD80 exon 2; Set C
uggacacuuggauggugauguucccugccuccgu

SEQ ID NO: 55429 - RNA, 37 nt, Artificial Sequence
  Synthetic Oligonucleotide; CD80 exon 2; Set C
guauggacacuuggauggugauguucccugccuccgu

SEQ ID NO: 55430 - RNA, 38 nt, Artificial Sequence
  Synthetic Oligonucleotide; CD80 exon 2; Set C
gguauggacacuuggauggugauguucccugccuccgu

SEQ ID NO: 55431 - RNA, 15 nt, Artificial Sequence
  Synthetic Oligonucleotide; CD80 exon 2; Set C
uuggauggugauguu

SEQ ID NO: 55432 - RNA, 39 nt, Artificial Sequence
  Synthetic Oligonucleotide; CD80 exon 2; Set C
agguauggacacuuggauggugauguucccugccuccgu

SEQ ID NO: 55433 - RNA, 16 nt, Artificial Sequence
  Synthetic Oligonucleotide; CD80 exon 2; Set C
cuuggauggugauguu

SEQ ID NO: 55434 - RNA, 40 nt, Artificial Sequence
  Synthetic Oligonucleotide; CD80 exon 2; Set C
gagguauggacacuuggauggugauguucccugccuccgu

SEQ ID NO: 55435 - RNA, 17 nt, Artificial Sequence
  Synthetic Oligonucleotide; CD80 exon 2; Set C
acuuggauggugauguu

SEQ ID NO: 55436 - RNA, 29 nt, Artificial Sequence
  Synthetic Oligonucleotide; CD80 exon 2; Set C
uauggacacuuggauggugauguucccug

SEQ ID NO: 55437 - RNA, 21 nt, Artificial Sequence
  Synthetic Oligonucleotide; CD80 exon 2; Set B
uggacacuuggauggugaugu

SEQ ID NO: 55438 - RNA, 22 nt, Artificial Sequence
  Synthetic Oligonucleotide; CD80 exon 2; Set B
auggacacuuggauggugaugu

SEQ ID NO: 55439 - RNA, 20 nt, Artificial Sequence
  Synthetic Oligonucleotide; CD80 exon 2; Set C
uggacacuuggauggugaug

SEQ ID NO: 55440 - RNA, 23 nt, Artificial Sequence
  Synthetic Oligonucleotide; CD80 exon 2; Set B
uauggacacuuggauggugaugu

SEQ ID NO: 55441 - RNA, 19 nt, Artificial Sequence
  Synthetic Oligonucleotide; CD80 exon 2; Set C
uggacacuuggauggugau

SEQ ID NO: 55442 - RNA, 21 nt, Artificial Sequence
  Synthetic Oligonucleotide; CD80 exon 2; Set C
auggacacuuggauggugaug

SEQ ID NO: 55443 - RNA, 24 nt, Artificial Sequence
  Synthetic Oligonucleotide; CD80 exon 2; Set B
guauggacacuuggauggugaugu

SEQ ID NO: 55444 - RNA, 20 nt, Artificial Sequence
  Synthetic Oligonucleotide; CD80 exon 2; Set C
auggacacuuggauggugau

SEQ ID NO: 55445 - RNA, 22 nt, Artificial Sequence
  Synthetic Oligonucleotide; CD80 exon 2; Set C
uauggacacuuggauggugaug

SEQ ID NO: 55446 - RNA, 36 nt, Artificial Sequence
  Synthetic Oligonucleotide; CD80 exon 2; Set C
auugagguauggacacuuggauggugauguucccug

SEQ ID NO: 55447 - RNA, 25 nt, Artificial Sequence
  Synthetic Oligonucleotide; CD80 exon 2; Set B
gguauggacacuuggauggugaugu

SEQ ID NO: 55448 - RNA, 21 nt, Artificial Sequence
  Synthetic Oligonucleotide; CD80 exon 2; Set C
uauggacacuuggauggugau

SEQ ID NO: 55449 - RNA, 23 nt, Artificial Sequence
  Synthetic Oligonucleotide; CD80 exon 2; Set B
guauggacacuuggauggugaug

SEQ ID NO: 55450 - RNA, 37 nt, Artificial Sequence
  Synthetic Oligonucleotide; CD80 exon 2; Set C
aauugagguauggacacuuggauggugauguucccug

SEQ ID NO: 55451 - RNA, 26 nt, Artificial Sequence
  Synthetic Oligonucleotide; CD80 exon 2; Set B
agguauggacacuuggauggugaugu

SEQ ID NO: 55452 - RNA, 22 nt, Artificial Sequence
  Synthetic Oligonucleotide; CD80 exon 2; Set B
guauggacacuuggauggugau

SEQ ID NO: 55453 - RNA, 24 nt, Artificial Sequence
  Synthetic Oligonucleotide; CD80 exon 2; Set B
gguauggacacuuggauggugaug

SEQ ID NO: 55454 - RNA, 38 nt, Artificial Sequence
  Synthetic Oligonucleotide; CD80 exon 2; Set C
aaauugagguauggacacuuggauggugauguucccug

SEQ ID NO: 55455 - RNA, 18 nt, Artificial Sequence
  Synthetic Oligonucleotide; CD80 exon 2; Set C
auggacacuuggauggug

SEQ ID NO: 55456 - RNA, 27 nt, Artificial Sequence
  Synthetic Oligonucleotide; CD80 exon 2; Set B
gagguauggacacuuggauggugaugu

SEQ ID NO: 55457 - RNA, 23 nt, Artificial Sequence
  Synthetic Oligonucleotide; CD80 exon 2; Set B
gguauggacacuuggauggugau

SEQ ID NO: 55458 - RNA, 25 nt, Artificial Sequence
  Synthetic Oligonucleotide; CD80 exon 2; Set B
agguauggacacuuggauggugaug

SEQ ID NO: 55459 - RNA, 39 nt, Artificial Sequence
  Synthetic Oligonucleotide; CD80 exon 2; Set C
gaaauugagguauggacacuuggauggugauguucccug

SEQ ID NO: 55460 - RNA, 17 nt, Artificial Sequence
  Synthetic Oligonucleotide; CD80 exon 2; Set C
auggacacuuggauggu

SEQ ID NO: 55461 - RNA, 19 nt, Artificial Sequence
  Synthetic Oligonucleotide; CD80 exon 2; Set C
uauggacacuuggauggug

SEQ ID NO: 55462 - RNA, 28 nt, Artificial Sequence
  Synthetic Oligonucleotide; CD80 exon 2; Set C
ugagguauggacacuuggauggugaugu

SEQ ID NO: 55463 - RNA, 24 nt, Artificial Sequence
  Synthetic Oligonucleotide; CD80 exon 2; Set B
agguauggacacuuggauggugau

SEQ ID NO: 55464 - RNA, 26 nt, Artificial Sequence
  Synthetic Oligonucleotide; CD80 exon 2; Set B
gagguauggacacuuggauggugaug

SEQ ID NO: 55465 - RNA, 40 nt, Artificial Sequence
  Synthetic Oligonucleotide; CD80 exon 2; Set C
agaaauugagguauggacacuuggauggugauguucccug

SEQ ID NO: 55466 - RNA, 18 nt, Artificial Sequence
  Synthetic Oligonucleotide; CD80 exon 2; Set C
uauggacacuuggauggu

SEQ ID NO: 55467 - RNA, 16 nt, Artificial Sequence
  Synthetic Oligonucleotide; CD80 exon 2; Set C
auggacacuuggaugg

SEQ ID NO: 55468 - RNA, 20 nt, Artificial Sequence
  Synthetic Oligonucleotide; CD80 exon 2; Set C
guauggacacuuggauggug

SEQ ID NO: 55469 - RNA, 29 nt, Artificial Sequence
  Synthetic Oligonucleotide; CD80 exon 2; Set C
uugagguauggacacuuggauggugaugu

SEQ ID NO: 55470 - RNA, 25 nt, Artificial Sequence
  Synthetic Oligonucleotide; CD80 exon 2; Set B
gagguauggacacuuggauggugau

SEQ ID NO: 55471 - RNA, 27 nt, Artificial Sequence
  Synthetic Oligonucleotide; CD80 exon 2; Set B
ugagguauggacacuuggauggugaug

SEQ ID NO: 55472 - RNA, 17 nt, Artificial Sequence
  Synthetic Oligonucleotide; CD80 exon 2; Set C
uauggacacuuggaugg

SEQ ID NO: 55473 - RNA, 21 nt, Artificial Sequence
  Synthetic Oligonucleotide; CD80 exon 2; Set B
gguauggacacuuggauggug

SEQ ID NO: 55474 - RNA, 30 nt, Artificial Sequence
  Synthetic Oligonucleotide; CD80 exon 2; Set C
auugagguauggacacuuggauggugaugu

SEQ ID NO: 55475 - RNA, 26 nt, Artificial Sequence
  Synthetic Oligonucleotide; CD80 exon 2; Set B
ugagguauggacacuuggauggugau

SEQ ID NO: 55476 - RNA, 28 nt, Artificial Sequence
  Synthetic Oligonucleotide; CD80 exon 2; Set B
uugagguauggacacuuggauggugaug

SEQ ID NO: 55477 - RNA, 18 nt, Artificial Sequence
  Synthetic Oligonucleotide; CD80 exon 2; Set C
guauggacacuuggaugg

SEQ ID NO: 55478 - RNA, 22 nt, Artificial Sequence
  Synthetic Oligonucleotide; CD80 exon 2; Set B
agguauggacacuuggauggug

SEQ ID NO: 55479 - RNA, 17 nt, Artificial Sequence
  Synthetic Oligonucleotide; CD80 exon 2; Set C
guauggacacuuggaug

SEQ ID NO: 55480 - RNA, 31 nt, Artificial Sequence
  Synthetic Oligonucleotide; CD80 exon 2; Set B
aauugagguauggacacuuggauggugaugu

SEQ ID NO: 55481 - RNA, 15 nt, Artificial Sequence
  Synthetic Oligonucleotide; CD80 exon 2; Set C
uauggacacuuggau

SEQ ID NO: 55482 - RNA, 27 nt, Artificial Sequence
  Synthetic Oligonucleotide; CD80 exon 2; Set B
uugagguauggacacuuggauggugau

SEQ ID NO: 55483 - RNA, 29 nt, Artificial Sequence
  Synthetic Oligonucleotide; CD80 exon 2; Set B
auugagguauggacacuuggauggugaug

SEQ ID NO: 55484 - RNA, 19 nt, Artificial Sequence
  Synthetic Oligonucleotide; CD80 exon 2; Set C
gguauggacacuuggaugg

SEQ ID NO: 55485 - RNA, 21 nt, Artificial Sequence
  Synthetic Oligonucleotide; CD80 exon 2; Set B
agguauggacacuuggauggu

SEQ ID NO: 55486 - RNA, 23 nt, Artificial Sequence
  Synthetic Oligonucleotide; CD80 exon 2; Set B
gagguauggacacuuggauggug

SEQ ID NO: 55487 - RNA, 18 nt, Artificial Sequence
  Synthetic Oligonucleotide; CD80 exon 2; Set C
gguauggacacuuggaug

SEQ ID NO: 55488 - RNA, 32 nt, Artificial Sequence
  Synthetic Oligonucleotide; CD80 exon 2; Set B
aaauugagguauggacacuuggauggugaugu

SEQ ID NO: 55489 - RNA, 16 nt, Artificial Sequence
  Synthetic Oligonucleotide; CD80 exon 2; Set C
guauggacacuuggau

SEQ ID NO: 55490 - RNA, 28 nt, Artificial Sequence
  Synthetic Oligonucleotide; CD80 exon 2; Set B
auugagguauggacacuuggauggugau

SEQ ID NO: 55491 - RNA, 30 nt, Artificial Sequence
  Synthetic Oligonucleotide; CD80 exon 2; Set B
aauugagguauggacacuuggauggugaug

SEQ ID NO: 55492 - RNA, 20 nt, Artificial Sequence
  Synthetic Oligonucleotide; CD80 exon 2; Set C
agguauggacacuuggaugg

SEQ ID NO: 55493 - RNA, 22 nt, Artificial Sequence
  Synthetic Oligonucleotide; CD80 exon 2; Set B
gagguauggacacuuggauggu

SEQ ID NO: 55494 - RNA, 24 nt, Artificial Sequence
  Synthetic Oligonucleotide; CD80 exon 2; Set B
ugagguauggacacuuggauggug

SEQ ID NO: 55495 - RNA, 19 nt, Artificial Sequence
  Synthetic Oligonucleotide; CD80 exon 2; Set C
agguauggacacuuggaug

SEQ ID NO: 55496 - RNA, 17 nt, Artificial Sequence
  Synthetic Oligonucleotide; CD80 exon 2; Set C
gguauggacacuuggau

SEQ ID NO: 55497 - RNA, 15 nt, Artificial Sequence
  Synthetic Oligonucleotide; CD80 exon 2; Set C
guauggacacuugga

SEQ ID NO: 55498 - RNA, 29 nt, Artificial Sequence
  Synthetic Oligonucleotide; CD80 exon 2; Set B
aauugagguauggacacuuggauggugau

SEQ ID NO: 55499 - RNA, 31 nt, Artificial Sequence
  Synthetic Oligonucleotide; CD80 exon 2; Set B
aaauugagguauggacacuuggauggugaug

SEQ ID NO: 55500 - RNA, 23 nt, Artificial Sequence
  Synthetic Oligonucleotide; CD80 exon 2; Set B
ugagguauggacacuuggauggu

SEQ ID NO: 55501 - RNA, 21 nt, Artificial Sequence
  Synthetic Oligonucleotide; CD80 exon 2; Set B
gagguauggacacuuggaugg

SEQ ID NO: 55502 - RNA, 25 nt, Artificial Sequence
  Synthetic Oligonucleotide; CD80 exon 2; Set B
uugagguauggacacuuggauggug

SEQ ID NO: 55503 - RNA, 20 nt, Artificial Sequence
  Synthetic Oligonucleotide; CD80 exon 2; Set C
gagguauggacacuuggaug

SEQ ID NO: 55504 - RNA, 18 nt, Artificial Sequence
  Synthetic Oligonucleotide; CD80 exon 2; Set C
agguauggacacuuggau

SEQ ID NO: 55505 - RNA, 16 nt, Artificial Sequence
  Synthetic Oligonucleotide; CD80 exon 2; Set C
gguauggacacuugga

SEQ ID NO: 55506 - RNA, 30 nt, Artificial Sequence
  Synthetic Oligonucleotide; CD80 exon 2; Set B
aaauugagguauggacacuuggauggugau

SEQ ID NO: 55507 - RNA, 32 nt, Artificial Sequence
  Synthetic Oligonucleotide; CD80 exon 2; Set B
gaaauugagguauggacacuuggauggugaug

SEQ ID NO: 55508 - RNA, 24 nt, Artificial Sequence
  Synthetic Oligonucleotide; CD80 exon 2; Set B
uugagguauggacacuuggauggu

SEQ ID NO: 55509 - RNA, 22 nt, Artificial Sequence
  Synthetic Oligonucleotide; CD80 exon 2; Set B
ugagguauggacacuuggaugg

SEQ ID NO: 55510 - RNA, 26 nt, Artificial Sequence
  Synthetic Oligonucleotide; CD80 exon 2; Set B
auugagguauggacacuuggauggug

SEQ ID NO: 55511 - RNA, 21 nt, Artificial Sequence
  Synthetic Oligonucleotide; CD80 exon 2; Set C
ugagguauggacacuuggaug

SEQ ID NO: 55512 - RNA, 19 nt, Artificial Sequence
  Synthetic Oligonucleotide; CD80 exon 2; Set C
gagguauggacacuuggau

SEQ ID NO: 55513 - RNA, 15 nt, Artificial Sequence
  Synthetic Oligonucleotide; CD80 exon 2; Set C
gguauggacacuugg

SEQ ID NO: 55514 - RNA, 17 nt, Artificial Sequence
  Synthetic Oligonucleotide; CD80 exon 2; Set C
agguauggacacuugga

SEQ ID NO: 55515 - RNA, 31 nt, Artificial Sequence
  Synthetic Oligonucleotide; CD80 exon 2; Set B
gaaauugagguauggacacuuggauggugau

SEQ ID NO: 55516 - RNA, 33 nt, Artificial Sequence
  Synthetic Oligonucleotide; CD80 exon 2; Set B
agaaauugagguauggacacuuggauggugaug

SEQ ID NO: 55517 - RNA, 25 nt, Artificial Sequence
  Synthetic Oligonucleotide; CD80 exon 2; Set B
auugagguauggacacuuggauggu

SEQ ID NO: 55518 - RNA, 23 nt, Artificial Sequence
  Synthetic Oligonucleotide; CD80 exon 2; Set B
uugagguauggacacuuggaugg

SEQ ID NO: 55519 - RNA, 27 nt, Artificial Sequence
  Synthetic Oligonucleotide; CD80 exon 2; Set B
aauugagguauggacacuuggauggug

SEQ ID NO: 55520 - RNA, 20 nt, Artificial Sequence
  Synthetic Oligonucleotide; CD80 exon 2; Set C
ugagguauggacacuuggau

SEQ ID NO: 55521 - RNA, 16 nt, Artificial Sequence
  Synthetic Oligonucleotide; CD80 exon 2; Set C
agguauggacacuugg

SEQ ID NO: 55522 - RNA, 18 nt, Artificial Sequence
  Synthetic Oligonucleotide; CD80 exon 2; Set C
gagguauggacacuugga

SEQ ID NO: 55523 - RNA, 32 nt, Artificial Sequence
  Synthetic Oligonucleotide; CD80 exon 2; Set B
agaaauugagguauggacacuuggauggugau

SEQ ID NO: 55524 - RNA, 34 nt, Artificial Sequence
  Synthetic Oligonucleotide; CD80 exon 2; Set B
aagaaauugagguauggacacuuggauggugaug

SEQ ID NO: 55525 - RNA, 24 nt, Artificial Sequence
  Synthetic Oligonucleotide; CD80 exon 2; Set B
auugagguauggacacuuggaugg

SEQ ID NO: 55526 - RNA, 26 nt, Artificial Sequence
  Synthetic Oligonucleotide; CD80 exon 2; Set B
aauugagguauggacacuuggauggu

SEQ ID NO: 55527 - RNA, 28 nt, Artificial Sequence
  Synthetic Oligonucleotide; CD80 exon 2; Set B
aaauugagguauggacacuuggauggug

SEQ ID NO: 55528 - RNA, 21 nt, Artificial Sequence
  Synthetic Oligonucleotide; CD80 exon 2; Set C
uugagguauggacacuuggau

SEQ ID NO: 55529 - RNA, 17 nt, Artificial Sequence
  Synthetic Oligonucleotide; CD80 exon 2; Set C
gagguauggacacuugg

SEQ ID NO: 55530 - RNA, 19 nt, Artificial Sequence
  Synthetic Oligonucleotide; CD80 exon 2; Set C
ugagguauggacacuugga

SEQ ID NO: 55531 - RNA, 15 nt, Artificial Sequence
  Synthetic Oligonucleotide; CD80 exon 2; Set C
agguauggacacuug

SEQ ID NO: 55532 - RNA, 33 nt, Artificial Sequence
  Synthetic Oligonucleotide; CD80 exon 2; Set B
aagaaauugagguauggacacuuggauggugau

SEQ ID NO: 55533 - RNA, 35 nt, Artificial Sequence
  Synthetic Oligonucleotide; CD80 exon 2; Set B
aaagaaauugagguauggacacuuggauggugaug

SEQ ID NO: 55534 - RNA, 25 nt, Artificial Sequence
  Synthetic Oligonucleotide; CD80 exon 2; Set B
aauugagguauggacacuuggaugg

SEQ ID NO: 55535 - RNA, 27 nt, Artificial Sequence
  Synthetic Oligonucleotide; CD80 exon 2; Set B
aaauugagguauggacacuuggauggu

SEQ ID NO: 55536 - RNA, 29 nt, Artificial Sequence
  Synthetic Oligonucleotide; CD80 exon 2; Set B
gaaauugagguauggacacuuggauggug

SEQ ID NO: 55537 - RNA, 22 nt, Artificial Sequence
  Synthetic Oligonucleotide; CD80 exon 2; Set C
auugagguauggacacuuggau

SEQ ID NO: 55538 - RNA, 18 nt, Artificial Sequence
  Synthetic Oligonucleotide; CD80 exon 2; Set C
ugagguauggacacuugg

SEQ ID NO: 55539 - RNA, 20 nt, Artificial Sequence
  Synthetic Oligonucleotide; CD80 exon 2; Set C
uugagguauggacacuugga

SEQ ID NO: 55540 - RNA, 16 nt, Artificial Sequence
  Synthetic Oligonucleotide; CD80 exon 2; Set C
gagguauggacacuug

SEQ ID NO: 55541 - RNA, 34 nt, Artificial Sequence
  Synthetic Oligonucleotide; CD80 exon 2; Set B
aaagaaauugagguauggacacuuggauggugau

SEQ ID NO: 55542 - RNA, 36 nt, Artificial Sequence
  Synthetic Oligonucleotide; CD80 exon 2; Set B
gaaagaaauugagguauggacacuuggauggugaug

SEQ ID NO: 55543 - RNA, 26 nt, Artificial Sequence
  Synthetic Oligonucleotide; CD80 exon 2; Set B
aaauugagguauggacacuuggaugg

SEQ ID NO: 55544 - RNA, 28 nt, Artificial Sequence
  Synthetic Oligonucleotide; CD80 exon 2; Set B
gaaauugagguauggacacuuggauggu

SEQ ID NO: 55545 - RNA, 30 nt, Artificial Sequence
  Synthetic Oligonucleotide; CD80 exon 2; Set B
agaaauugagguauggacacuuggauggug

SEQ ID NO: 55546 - RNA, 23 nt, Artificial Sequence
  Synthetic Oligonucleotide; CD80 exon 2; Set C
aauugagguauggacacuuggau

SEQ ID NO: 55547 - RNA, 19 nt, Artificial Sequence
  Synthetic Oligonucleotide; CD80 exon 2; Set C
uugagguauggacacuugg

SEQ ID NO: 55548 - RNA, 21 nt, Artificial Sequence
  Synthetic Oligonucleotide; CD80 exon 2; Set C
auugagguauggacacuugga

SEQ ID NO: 55549 - RNA, 17 nt, Artificial Sequence
  Synthetic Oligonucleotide; CD80 exon 2; Set C
ugagguauggacacuug

SEQ ID NO: 55550 - RNA, 35 nt, Artificial Sequence
  Synthetic Oligonucleotide; CD80 exon 2; Set B
gaaagaaauugagguauggacacuuggauggugau

SEQ ID NO: 55551 - RNA, 15 nt, Artificial Sequence
  Synthetic Oligonucleotide; CD80 exon 2; Set C
gagguauggacacuu

SEQ ID NO: 55552 - RNA, 37 nt, Artificial Sequence
  Synthetic Oligonucleotide; CD80 exon 2; Set B
ugaaagaaauugagguauggacacuuggauggugaug

SEQ ID NO: 55553 - RNA, 27 nt, Artificial Sequence
  Synthetic Oligonucleotide; CD80 exon 2; Set B
gaaauugagguauggacacuuggaugg

SEQ ID NO: 55554 - RNA, 29 nt, Artificial Sequence
  Synthetic Oligonucleotide; CD80 exon 2; Set B
agaaauugagguauggacacuuggauggu

SEQ ID NO: 55555 - RNA, 31 nt, Artificial Sequence
  Synthetic Oligonucleotide; CD80 exon 2; Set B
aagaaauugagguauggacacuuggauggug

SEQ ID NO: 55556 - RNA, 33 nt, Artificial Sequence
  Synthetic Oligonucleotide; CD80 exon 2; Set B
aaagaaauugagguauggacacuuggaugguga

SEQ ID NO: 55557 - RNA, 24 nt, Artificial Sequence
  Synthetic Oligonucleotide; CD80 exon 2; Set C
aaauugagguauggacacuuggau

SEQ ID NO: 55558 - RNA, 20 nt, Artificial Sequence
  Synthetic Oligonucleotide; CD80 exon 2; Set C
auugagguauggacacuugg

SEQ ID NO: 55559 - RNA, 22 nt, Artificial Sequence
  Synthetic Oligonucleotide; CD80 exon 2; Set C
aauugagguauggacacuugga

SEQ ID NO: 55560 - RNA, 18 nt, Artificial Sequence
  Synthetic Oligonucleotide; CD80 exon 2; Set C
uugagguauggacacuug

SEQ ID NO: 55561 - RNA, 36 nt, Artificial Sequence
  Synthetic Oligonucleotide; CD80 exon 2; Set B
ugaaagaaauugagguauggacacuuggauggugau

SEQ ID NO: 55562 - RNA, 16 nt, Artificial Sequence
  Synthetic Oligonucleotide; CD80 exon 2; Set C
ugagguauggacacuu

SEQ ID NO: 55563 - RNA, 28 nt, Artificial Sequence
  Synthetic Oligonucleotide; CD80 exon 2; Set B
agaaauugagguauggacacuuggaugg

SEQ ID NO: 55564 - RNA, 30 nt, Artificial Sequence
  Synthetic Oligonucleotide; CD80 exon 2; Set B
aagaaauugagguauggacacuuggauggu

SEQ ID NO: 55565 - RNA, 32 nt, Artificial Sequence
  Synthetic Oligonucleotide; CD80 exon 2; Set B
aaagaaauugagguauggacacuuggauggug

SEQ ID NO: 55566 - RNA, 34 nt, Artificial Sequence
  Synthetic Oligonucleotide; CD80 exon 2; Set B
gaaagaaauugagguauggacacuuggaugguga

SEQ ID NO: 55567 - RNA, 25 nt, Artificial Sequence
  Synthetic Oligonucleotide; CD80 exon 2; Set C
gaaauugagguauggacacuuggau

SEQ ID NO: 55568 - RNA, 15 nt, Artificial Sequence
  Synthetic Oligonucleotide; CD80 exon 2; Set C
ugagguauggacacu

SEQ ID NO: 55569 - RNA, 21 nt, Artificial Sequence
  Synthetic Oligonucleotide; CD80 exon 2; Set C
aauugagguauggacacuugg

SEQ ID NO: 55570 - RNA, 23 nt, Artificial Sequence
  Synthetic Oligonucleotide; CD80 exon 2; Set C
aaauugagguauggacacuugga

SEQ ID NO: 55571 - RNA, 19 nt, Artificial Sequence
  Synthetic Oligonucleotide; CD80 exon 2; Set C
auugagguauggacacuug

SEQ ID NO: 55572 - RNA, 17 nt, Artificial Sequence
  Synthetic Oligonucleotide; CD80 exon 2; Set C
uugagguauggacacuu

SEQ ID NO: 55573 - RNA, 31 nt, Artificial Sequence
  Synthetic Oligonucleotide; CD80 exon 2; Set B
aaagaaauugagguauggacacuuggauggu

SEQ ID NO: 55574 - RNA, 29 nt, Artificial Sequence
  Synthetic Oligonucleotide; CD80 exon 2; Set B
aagaaauugagguauggacacuuggaugg

SEQ ID NO: 55575 - RNA, 33 nt, Artificial Sequence
  Synthetic Oligonucleotide; CD80 exon 2; Set B
gaaagaaauugagguauggacacuuggauggug

SEQ ID NO: 55576 - RNA, 35 nt, Artificial Sequence
  Synthetic Oligonucleotide; CD80 exon 2; Set B
ugaaagaaauugagguauggacacuuggaugguga

SEQ ID NO: 55577 - RNA, 26 nt, Artificial Sequence
  Synthetic Oligonucleotide; CD80 exon 2; Set C
agaaauugagguauggacacuuggau

SEQ ID NO: 55578 - RNA, 22 nt, Artificial Sequence
  Synthetic Oligonucleotide; CD80 exon 2; Set C
aaauugagguauggacacuugg

SEQ ID NO: 55579 - RNA, 24 nt, Artificial Sequence
  Synthetic Oligonucleotide; CD80 exon 2; Set C
gaaauugagguauggacacuugga

SEQ ID NO: 55580 - RNA, 20 nt, Artificial Sequence
  Synthetic Oligonucleotide; CD80 exon 2; Set C
aauugagguauggacacuug

SEQ ID NO: 55581 - RNA, 18 nt, Artificial Sequence
  Synthetic Oligonucleotide; CD80 exon 2; Set C
auugagguauggacacuu

SEQ ID NO: 55582 - RNA, 30 nt, Artificial Sequence
  Synthetic Oligonucleotide; CD80 exon 2; Set B
aaagaaauugagguauggacacuuggaugg

SEQ ID NO: 55583 - RNA, 32 nt, Artificial Sequence
  Synthetic Oligonucleotide; CD80 exon 2; Set B
gaaagaaauugagguauggacacuuggauggu

SEQ ID NO: 55584 - RNA, 34 nt, Artificial Sequence
  Synthetic Oligonucleotide; CD80 exon 2; Set B
ugaaagaaauugagguauggacacuuggauggug

SEQ ID NO: 55585 - RNA, 27 nt, Artificial Sequence
  Synthetic Oligonucleotide; CD80 exon 2; Set C
aagaaauugagguauggacacuuggau

SEQ ID NO: 55586 - RNA, 23 nt, Artificial Sequence
  Synthetic Oligonucleotide; CD80 exon 2; Set C
gaaauugagguauggacacuugg

SEQ ID NO: 55587 - RNA, 25 nt, Artificial Sequence
  Synthetic Oligonucleotide; CD80 exon 2; Set C
agaaauugagguauggacacuugga

SEQ ID NO: 55588 - RNA, 21 nt, Artificial Sequence
  Synthetic Oligonucleotide; CD80 exon 2; Set C
aaauugagguauggacacuug

SEQ ID NO: 55589 - RNA, 19 nt, Artificial Sequence
  Synthetic Oligonucleotide; CD80 exon 2; Set C
aauugagguauggacacuu

SEQ ID NO: 55590 - RNA, 33 nt, Artificial Sequence
  Synthetic Oligonucleotide; CD80 exon 2; Set B
ugaaagaaauugagguauggacacuuggauggu

SEQ ID NO: 55591 - RNA, 31 nt, Artificial Sequence
  Synthetic Oligonucleotide; CD80 exon 2; Set B
gaaagaaauugagguauggacacuuggaugg

SEQ ID NO: 55592 - RNA, 15 nt, Artificial Sequence
  Synthetic Oligonucleotide; CD80 exon 2; Set C
uugagguauggacac

SEQ ID NO: 55593 - RNA, 24 nt, Artificial Sequence
  Synthetic Oligonucleotide; CD80 exon 2; Set C
agaaauugagguauggacacuugg

SEQ ID NO: 55594 - RNA, 26 nt, Artificial Sequence
  Synthetic Oligonucleotide; CD80 exon 2; Set C
aagaaauugagguauggacacuugga

SEQ ID NO: 55595 - RNA, 22 nt, Artificial Sequence
  Synthetic Oligonucleotide; CD80 exon 2; Set C
gaaauugagguauggacacuug

SEQ ID NO: 55596 - RNA, 20 nt, Artificial Sequence
  Synthetic Oligonucleotide; CD80 exon 2; Set C
aaauugagguauggacacuu

SEQ ID NO: 55597 - RNA, 32 nt, Artificial Sequence
  Synthetic Oligonucleotide; CD80 exon 2; Set B
ugaaagaaauugagguauggacacuuggaugg

SEQ ID NO: 55598 - RNA, 16 nt, Artificial Sequence
  Synthetic Oligonucleotide; CD80 exon 2; Set C
auugagguauggacac

SEQ ID NO: 55599 - RNA, 25 nt, Artificial Sequence
  Synthetic Oligonucleotide; CD80 exon 2; Set C
aagaaauugagguauggacacuugg

SEQ ID NO: 55600 - RNA, 23 nt, Artificial Sequence
  Synthetic Oligonucleotide; CD80 exon 2; Set C
agaaauugagguauggacacuug

SEQ ID NO: 55601 - RNA, 21 nt, Artificial Sequence
  Synthetic Oligonucleotide; CD80 exon 2; Set C
gaaauugagguauggacacuu

SEQ ID NO: 55602 - RNA, 17 nt, Artificial Sequence
  Synthetic Oligonucleotide; CD80 exon 2; Set C
aauugagguauggacac

SEQ ID NO: 55603 - RNA, 15 nt, Artificial Sequence
  Synthetic Oligonucleotide; CD80 exon 2; Set C
auugagguauggaca

SEQ ID NO: 55604 - RNA, 24 nt, Artificial Sequence
  Synthetic Oligonucleotide; CD80 exon 2; Set C
aagaaauugagguauggacacuug

SEQ ID NO: 55605 - RNA, 22 nt, Artificial Sequence
  Synthetic Oligonucleotide; CD80 exon 2; Set C
agaaauugagguauggacacuu

SEQ ID NO: 55606 - RNA, 40 nt, Artificial Sequence
  Synthetic Oligonucleotide; CD80 exon 2; Set C
agagcugaaagaaauugagguauggacacuuggaugguga

SEQ ID NO: 55607 - RNA, 18 nt, Artificial Sequence
  Synthetic Oligonucleotide; CD80 exon 2; Set C
aaauugagguauggacac

SEQ ID NO: 55608 - RNA, 16 nt, Artificial Sequence
  Synthetic Oligonucleotide; CD80 exon 2; Set C
aauugagguauggaca

SEQ ID NO: 55609 - RNA, 23 nt, Artificial Sequence
  Synthetic Oligonucleotide; CD80 exon 2; Set C
aagaaauugagguauggacacuu

SEQ ID NO: 55610 - RNA, 39 nt, Artificial Sequence
  Synthetic Oligonucleotide; CD80 exon 2; Set C
agagcugaaagaaauugagguauggacacuuggauggug

SEQ ID NO: 55611 - RNA, 19 nt, Artificial Sequence
  Synthetic Oligonucleotide; CD80 exon 2; Set C
gaaauugagguauggacac

SEQ ID NO: 55612 - RNA, 17 nt, Artificial Sequence
  Synthetic Oligonucleotide; CD80 exon 2; Set C
aaauugagguauggaca

SEQ ID NO: 55613 - RNA, 15 nt, Artificial Sequence
  Synthetic Oligonucleotide; CD80 exon 2; Set C
aauugagguauggac

SEQ ID NO: 55614 - RNA, 38 nt, Artificial Sequence
  Synthetic Oligonucleotide; CD80 exon 2; Set C
agagcugaaagaaauugagguauggacacuuggauggu

SEQ ID NO: 55615 - RNA, 40 nt, Artificial Sequence
  Synthetic Oligonucleotide; CD80 exon 2; Set C
aagagcugaaagaaauugagguauggacacuuggauggug

SEQ ID NO: 55616 - RNA, 20 nt, Artificial Sequence
  Synthetic Oligonucleotide; CD80 exon 2; Set C
agaaauugagguauggacac

SEQ ID NO: 55617 - RNA, 18 nt, Artificial Sequence
  Synthetic Oligonucleotide; CD80 exon 2; Set C
gaaauugagguauggaca

SEQ ID NO: 55618 - RNA, 16 nt, Artificial Sequence
  Synthetic Oligonucleotide; CD80 exon 2; Set C
aaauugagguauggac

SEQ ID NO: 55619 - RNA, 37 nt, Artificial Sequence
  Synthetic Oligonucleotide; CD80 exon 2; Set B
agagcugaaagaaauugagguauggacacuuggaugg

SEQ ID NO: 55620 - RNA, 39 nt, Artificial Sequence
  Synthetic Oligonucleotide; CD80 exon 2; Set C
aagagcugaaagaaauugagguauggacacuuggauggu

SEQ ID NO: 55621 - RNA, 21 nt, Artificial Sequence
  Synthetic Oligonucleotide; CD80 exon 2; Set C
aagaaauugagguauggacac

SEQ ID NO: 55622 - RNA, 19 nt, Artificial Sequence
  Synthetic Oligonucleotide; CD80 exon 2; Set C
agaaauugagguauggaca

SEQ ID NO: 55623 - RNA, 17 nt, Artificial Sequence
  Synthetic Oligonucleotide; CD80 exon 2; Set C
gaaauugagguauggac

SEQ ID NO: 55624 - RNA, 38 nt, Artificial Sequence
  Synthetic Oligonucleotide; CD80 exon 2; Set B
aagagcugaaagaaauugagguauggacacuuggaugg

SEQ ID NO: 55625 - RNA, 22 nt, Artificial Sequence
  Synthetic Oligonucleotide; CD80 exon 2; Set C
aaagaaauugagguauggacac

SEQ ID NO: 55626 - RNA, 20 nt, Artificial Sequence
  Synthetic Oligonucleotide; CD80 exon 2; Set C
aagaaauugagguauggaca

SEQ ID NO: 55627 - RNA, 18 nt, Artificial Sequence
  Synthetic Oligonucleotide; CD80 exon 2; Set C
agaaauugagguauggac

SEQ ID NO: 55628 - RNA, 23 nt, Artificial Sequence
  Synthetic Oligonucleotide; CD80 exon 2; Set C
gaaagaaauugagguauggacac

SEQ ID NO: 55629 - RNA, 21 nt, Artificial Sequence
  Synthetic Oligonucleotide; CD80 exon 2; Set C
aaagaaauugagguauggaca

SEQ ID NO: 55630 - RNA, 19 nt, Artificial Sequence
  Synthetic Oligonucleotide; CD80 exon 2; Set C
aagaaauugagguauggac

SEQ ID NO: 55631 - RNA, 38 nt, Artificial Sequence
  Synthetic Oligonucleotide; CD80 exon 2; Set B
caagagcugaaagaaauugagguauggacacuuggaug

SEQ ID NO: 55632 - RNA, 36 nt, Artificial Sequence
  Synthetic Oligonucleotide; CD80 exon 2; Set B
aagagcugaaagaaauugagguauggacacuuggau

SEQ ID NO: 55633 - RNA, 34 nt, Artificial Sequence
  Synthetic Oligonucleotide; CD80 exon 2; Set B
agagcugaaagaaauugagguauggacacuugga

SEQ ID NO: 55634 - RNA, 24 nt, Artificial Sequence
  Synthetic Oligonucleotide; CD80 exon 2; Set C
ugaaagaaauugagguauggacac

SEQ ID NO: 55635 - RNA, 22 nt, Artificial Sequence
  Synthetic Oligonucleotide; CD80 exon 2; Set C
gaaagaaauugagguauggaca

SEQ ID NO: 55636 - RNA, 20 nt, Artificial Sequence
  Synthetic Oligonucleotide; CD80 exon 2; Set C
aaagaaauugagguauggac

SEQ ID NO: 55637 - RNA, 39 nt, Artificial Sequence
  Synthetic Oligonucleotide; CD80 exon 2; Set B
ccaagagcugaaagaaauugagguauggacacuuggaug

SEQ ID NO: 55638 - RNA, 37 nt, Artificial Sequence
  Synthetic Oligonucleotide; CD80 exon 2; Set B
caagagcugaaagaaauugagguauggacacuuggau

SEQ ID NO: 55639 - RNA, 33 nt, Artificial Sequence
  Synthetic Oligonucleotide; CD80 exon 2; Set B
agagcugaaagaaauugagguauggacacuugg

SEQ ID NO: 55640 - RNA, 35 nt, Artificial Sequence
  Synthetic Oligonucleotide; CD80 exon 2; Set B
aagagcugaaagaaauugagguauggacacuugga

SEQ ID NO: 55641 - RNA, 23 nt, Artificial Sequence
  Synthetic Oligonucleotide; CD80 exon 2; Set C
ugaaagaaauugagguauggaca

SEQ ID NO: 55642 - RNA, 21 nt, Artificial Sequence
  Synthetic Oligonucleotide; CD80 exon 2; Set C
gaaagaaauugagguauggac

SEQ ID NO: 55643 - RNA, 40 nt, Artificial Sequence
  Synthetic Oligonucleotide; CD80 exon 2; Set C
accaagagcugaaagaaauugagguauggacacuuggaug

SEQ ID NO: 55644 - RNA, 34 nt, Artificial Sequence
  Synthetic Oligonucleotide; CD80 exon 2; Set B
aagagcugaaagaaauugagguauggacacuugg

SEQ ID NO: 55645 - RNA, 36 nt, Artificial Sequence
  Synthetic Oligonucleotide; CD80 exon 2; Set B
caagagcugaaagaaauugagguauggacacuugga

SEQ ID NO: 55646 - RNA, 32 nt, Artificial Sequence
  Synthetic Oligonucleotide; CD80 exon 2; Set B
agagcugaaagaaauugagguauggacacuug

SEQ ID NO: 55647 - RNA, 22 nt, Artificial Sequence
  Synthetic Oligonucleotide; CD80 exon 2; Set C
ugaaagaaauugagguauggac

SEQ ID NO: 55648 - RNA, 35 nt, Artificial Sequence
  Synthetic Oligonucleotide; CD80 exon 2; Set B
caagagcugaaagaaauugagguauggacacuugg

SEQ ID NO: 55649 - RNA, 33 nt, Artificial Sequence
  Synthetic Oligonucleotide; CD80 exon 2; Set B
aagagcugaaagaaauugagguauggacacuug

SEQ ID NO: 55650 - RNA, 31 nt, Artificial Sequence
  Synthetic Oligonucleotide; CD80 exon 2; Set B
agagcugaaagaaauugagguauggacacuu

SEQ ID NO: 55651 - RNA, 34 nt, Artificial Sequence
  Synthetic Oligonucleotide; CD80 exon 2; Set B
caagagcugaaagaaauugagguauggacacuug

SEQ ID NO: 55652 - RNA, 32 nt, Artificial Sequence
  Synthetic Oligonucleotide; CD80 exon 2; Set B
aagagcugaaagaaauugagguauggacacuu

SEQ ID NO: 55653 - RNA, 33 nt, Artificial Sequence
  Synthetic Oligonucleotide; CD80 exon 2; Set B
caagagcugaaagaaauugagguauggacacuu

SEQ ID NO: 55654 - RNA, 29 nt, Artificial Sequence
  Synthetic Oligonucleotide; CD80 exon 2; Set B
agagcugaaagaaauugagguauggacac

SEQ ID NO: 55655 - RNA, 32 nt, Artificial Sequence
  Synthetic Oligonucleotide; CD80 exon 2; Set B
caagagcugaaagaaauugagguauggacacu

SEQ ID NO: 55656 - RNA, 28 nt, Artificial Sequence
  Synthetic Oligonucleotide; CD80 exon 2; Set B
agagcugaaagaaauugagguauggaca

SEQ ID NO: 55657 - RNA, 27 nt, Artificial Sequence
  Synthetic Oligonucleotide; CD80 exon 2; Set C
agagcugaaagaaauugagguauggac

SEQ ID NO: 55658 - RNA, 35 nt, Artificial Sequence
  Synthetic Oligonucleotide; CD80 exon 2; Set B
caccaagagcugaaagaaauugagguauggacacu

SEQ ID NO: 55659 - RNA, 35 nt, Artificial Sequence
  Synthetic Oligonucleotide; CD80 exon 2; Set C
gcaccaagagcugaaagaaauugagguauggacac

SEQ ID NO: 55660 - RNA, 34 nt, Artificial Sequence
  Synthetic Oligonucleotide; CD80 exon 2; Set B
gcaccaagagcugaaagaaauugagguauggaca

SEQ ID NO: 55661 - RNA, 33 nt, Artificial Sequence
  Synthetic Oligonucleotide; CD80 exon 2; Set B
gcaccaagagcugaaagaaauugagguauggac

SEQ ID NO: 55662 - RNA, 35 nt, Artificial Sequence
  Synthetic Oligonucleotide; CD80 exon 2; Set C
ccagcaccaagagcugaaagaaauugagguaugga

SEQ ID NO: 55663 - RNA, 28 nt, Artificial Sequence
  Synthetic Oligonucleotide; CD80 exon 2; Set B
ccagcaccaagagcugaaagaaauugag

SEQ ID NO: 55664 - RNA, 27 nt, Artificial Sequence
  Synthetic Oligonucleotide; CD80 exon 2; Set B
ccagcaccaagagcugaaagaaauuga

SEQ ID NO: 55665 - RNA, 40 nt, Artificial Sequence
  Synthetic Oligonucleotide; CD80 exon 2; Set C
agaccagccagcaccaagagcugaaagaaauugagguaug

SEQ ID NO: 55666 - RNA, 39 nt, Artificial Sequence
  Synthetic Oligonucleotide; CD80 exon 2; Set C
agaccagccagcaccaagagcugaaagaaauugagguau

SEQ ID NO: 55667 - RNA, 40 nt, Artificial Sequence
  Synthetic Oligonucleotide; CD80 exon 2; Set C
aagaccagccagcaccaagagcugaaagaaauugagguau

SEQ ID NO: 55668 - RNA, 23 nt, Artificial Sequence
  Synthetic Oligonucleotide; CD80 exon 2; Set C
ccagcaccaagagcugaaagaaa

SEQ ID NO: 55669 - RNA, 22 nt, Artificial Sequence
  Synthetic Oligonucleotide; CD80 exon 2; Set C
ccagcaccaagagcugaaagaa

SEQ ID NO: 55670 - RNA, 21 nt, Artificial Sequence
  Synthetic Oligonucleotide; CD80 exon 2; Set B
ccagcaccaagagcugaaaga

SEQ ID NO: 55671 - RNA, 20 nt, Artificial Sequence
  Synthetic Oligonucleotide; CD80 exon 2; Set C
ccagcaccaagagcugaaag

SEQ ID NO: 55672 - RNA, 19 nt, Artificial Sequence
  Synthetic Oligonucleotide; CD80 exon 2; Set B
agaccagccagcaccaaga

SEQ ID NO: 55673 - RNA, 22 nt, Artificial Sequence
  Synthetic Oligonucleotide; CD80 exon 2; Set B
gaaagaccagccagcaccaaga

SEQ ID NO: 55674 - RNA, 21 nt, Artificial Sequence
  Synthetic Oligonucleotide; CD80 exon 2; Set B
agaaagaccagccagcaccaa

SEQ ID NO: 55675 - RNA, 20 nt, Artificial Sequence
  Synthetic Oligonucleotide; CD80 exon 2; Set B
agaaagaccagccagcacca

SEQ ID NO: 55676 - RNA, 19 nt, Artificial Sequence
  Synthetic Oligonucleotide; CD80 exon 2; Set B
agaaagaccagccagcacc

SEQ ID NO: 55677 - RNA, 18 nt, Artificial Sequence
  Synthetic Oligonucleotide; CD80 exon 2; Set C
agaaagaccagccagcac

SEQ ID NO: 55678 - RNA, 40 nt, Artificial Sequence
  Synthetic Oligonucleotide; CD80 exon 2; Set C
ugaacagaagugagaaagaccagccagcaccaagagcuga

SEQ ID NO: 55679 - RNA, 17 nt, Artificial Sequence
  Synthetic Oligonucleotide; CD80 exon 2; Set C
gagaaagaccagccagc

SEQ ID NO: 55680 - RNA, 18 nt, Artificial Sequence
  Synthetic Oligonucleotide; CD80 exon 2; Set C
ugagaaagaccagccagc

SEQ ID NO: 55681 - RNA, 17 nt, Artificial Sequence
  Synthetic Oligonucleotide; CD80 exon 2; Set C
ugagaaagaccagccag

SEQ ID NO: 55682 - RNA, 35 nt, Artificial Sequence
  Synthetic Oligonucleotide; CD80 exon 2; Set C
ugaacagaagugagaaagaccagccagcaccaaga

SEQ ID NO: 55683 - RNA, 15 nt, Artificial Sequence
  Synthetic Oligonucleotide; CD80 exon 2; Set C
ugagaaagaccagcc

SEQ ID NO: 55684 - RNA, 36 nt, Artificial Sequence
  Synthetic Oligonucleotide; CD80 exon 2; Set C
cugaacagaagugagaaagaccagccagcaccaaga

SEQ ID NO: 55685 - RNA, 34 nt, Artificial Sequence
  Synthetic Oligonucleotide; CD80 exon 2; Set C
ugaacagaagugagaaagaccagccagcaccaag

SEQ ID NO: 55686 - RNA, 37 nt, Artificial Sequence
  Synthetic Oligonucleotide; CD80 exon 2; Set C
ccugaacagaagugagaaagaccagccagcaccaaga

SEQ ID NO: 55687 - RNA, 35 nt, Artificial Sequence
  Synthetic Oligonucleotide; CD80 exon 2; Set C
cugaacagaagugagaaagaccagccagcaccaag

SEQ ID NO: 55688 - RNA, 33 nt, Artificial Sequence
  Synthetic Oligonucleotide; CD80 exon 2; Set C
ugaacagaagugagaaagaccagccagcaccaa

SEQ ID NO: 55689 - RNA, 36 nt, Artificial Sequence
  Synthetic Oligonucleotide; CD80 exon 2; Set C
ccugaacagaagugagaaagaccagccagcaccaag

SEQ ID NO: 55690 - RNA, 34 nt, Artificial Sequence
  Synthetic Oligonucleotide; CD80 exon 2; Set C
cugaacagaagugagaaagaccagccagcaccaa

SEQ ID NO: 55691 - RNA, 35 nt, Artificial Sequence
  Synthetic Oligonucleotide; CD80 exon 2; Set C
ccugaacagaagugagaaagaccagccagcaccaa

SEQ ID NO: 55692 - RNA, 29 nt, Artificial Sequence
  Synthetic Oligonucleotide; CD80 exon 2; Set B
ugaacagaagugagaaagaccagccagca

SEQ ID NO: 55693 - RNA, 30 nt, Artificial Sequence
  Synthetic Oligonucleotide; CD80 exon 2; Set B
cugaacagaagugagaaagaccagccagca

SEQ ID NO: 55694 - RNA, 31 nt, Artificial Sequence
  Synthetic Oligonucleotide; CD80 exon 2; Set C
ccugaacagaagugagaaagaccagccagca

SEQ ID NO: 55695 - RNA, 31 nt, Artificial Sequence
  Synthetic Oligonucleotide; CD80 exon 2; Set C
accugaacagaagugagaaagaccagccagc

SEQ ID NO: 55696 - RNA, 32 nt, Artificial Sequence
  Synthetic Oligonucleotide; CD80 exon 2; Set C
uaccugaacagaagugagaaagaccagccagc

SEQ ID NO: 55697 - RNA, 31 nt, Artificial Sequence
  Synthetic Oligonucleotide; CD80 exon 2; Set B
uaccugaacagaagugagaaagaccagccag

SEQ ID NO: 55698 - RNA, 28 nt, Artificial Sequence
  Synthetic Oligonucleotide; CD80 exon 2; Set B
accugaacagaagugagaaagaccagcc

SEQ ID NO: 55699 - RNA, 32 nt, Artificial Sequence
  Synthetic Oligonucleotide; CD80 exon 2; Set B
uuaccugaacagaagugagaaagaccagccag

SEQ ID NO: 55700 - RNA, 27 nt, Artificial Sequence
  Synthetic Oligonucleotide; CD80 exon 2; Set B
accugaacagaagugagaaagaccagc

SEQ ID NO: 55701 - RNA, 29 nt, Artificial Sequence
  Synthetic Oligonucleotide; CD80 exon 2; Set B
uaccugaacagaagugagaaagaccagcc

SEQ ID NO: 55702 - RNA, 30 nt, Artificial Sequence
  Synthetic Oligonucleotide; CD80 exon 2; Set B
uuaccugaacagaagugagaaagaccagcc

SEQ ID NO: 55703 - RNA, 39 nt, Artificial Sequence
  Synthetic Oligonucleotide; CD80 exon 2; Set C
guugcuuaccugaacagaagugagaaagaccagccagca

SEQ ID NO: 55704 - RNA, 38 nt, Artificial Sequence
  Synthetic Oligonucleotide; CD80 exon 2; Set C
aguugcuuaccugaacagaagugagaaagaccagccag

SEQ ID NO: 55705 - RNA, 39 nt, Artificial Sequence
  Synthetic Oligonucleotide; CD80 exon 2; Set C
aaguugcuuaccugaacagaagugagaaagaccagccag

SEQ ID NO: 55706 - RNA, 37 nt, Artificial Sequence
  Synthetic Oligonucleotide; CD80 exon 2; Set C
aguugcuuaccugaacagaagugagaaagaccagcca

SEQ ID NO: 55707 - RNA, 40 nt, Artificial Sequence
  Synthetic Oligonucleotide; CD80 exon 2; Set C
aaaguugcuuaccugaacagaagugagaaagaccagccag

SEQ ID NO: 55708 - RNA, 37 nt, Artificial Sequence
  Synthetic Oligonucleotide; CD80 exon 2; Set C
aaguugcuuaccugaacagaagugagaaagaccagcc

SEQ ID NO: 55709 - RNA, 38 nt, Artificial Sequence
  Synthetic Oligonucleotide; CD80 exon 2; Set C
aaaguugcuuaccugaacagaagugagaaagaccagcc

SEQ ID NO: 55710 - RNA, 18 nt, Artificial Sequence
  Synthetic Oligonucleotide; CD80 exon 2; Set C
accugaacagaagugaga

SEQ ID NO: 55711 - RNA, 39 nt, Artificial Sequence
  Synthetic Oligonucleotide; CD80 exon 2; Set C
gaaaguugcuuaccugaacagaagugagaaagaccagcc

SEQ ID NO: 55712 - RNA, 19 nt, Artificial Sequence
  Synthetic Oligonucleotide; CD80 exon 2; Set C
uaccugaacagaagugaga

SEQ ID NO: 55713 - RNA, 20 nt, Artificial Sequence
  Synthetic Oligonucleotide; CD80 exon 2; Set C
uuaccugaacagaagugaga

SEQ ID NO: 55714 - RNA, 27 nt, Artificial Sequence
  Synthetic Oligonucleotide; CD80 exon 2; Set B
aaguugcuuaccugaacagaagugaga

SEQ ID NO: 55715 - RNA, 28 nt, Artificial Sequence
  Synthetic Oligonucleotide; CD80 exon 2; Set B
aaaguugcuuaccugaacagaagugaga

SEQ ID NO: 55716 - RNA, 29 nt, Artificial Sequence
  Synthetic Oligonucleotide; CD80 exon 2; Set B
gaaaguugcuuaccugaacagaagugaga

SEQ ID NO: 55717 - RNA, 15 nt, Artificial Sequence
  Synthetic Oligonucleotide; CD80 exon 2; Set C
aaguugcuuaccuga

SEQ ID NO: 55718 - RNA, 40 nt, Artificial Sequence
  Synthetic Oligonucleotide; CD80 exon 2; Set C
guuaaguuccugaaaguugcuuaccugaacagaagugaga

SEQ ID NO: 55719 - RNA, 16 nt, Artificial Sequence
  Synthetic Oligonucleotide; CD80 exon 2; Set C
aaaguugcuuaccuga

SEQ ID NO: 55720 - RNA, 17 nt, Artificial Sequence
  Synthetic Oligonucleotide; CD80 exon 2; Set C
gaaaguugcuuaccuga

SEQ ID NO: 55721 - RNA, 15 nt, Artificial Sequence
  Synthetic Oligonucleotide; CD80 exon 2; Set C
aaaguugcuuaccug

SEQ ID NO: 55722 - RNA, 16 nt, Artificial Sequence
  Synthetic Oligonucleotide; CD80 exon 2; Set C
gaaaguugcuuaccug

SEQ ID NO: 55723 - RNA, 15 nt, Artificial Sequence
  Synthetic Oligonucleotide; CD80 exon 2; Set C
gaaaguugcuuaccu

SEQ ID NO: 55724 - RNA, 22 nt, Artificial Sequence
  Synthetic Oligonucleotide; CD80 exon 2; Set C
uuccugaaaguugcuuaccuga

SEQ ID NO: 55725 - RNA, 23 nt, Artificial Sequence
  Synthetic Oligonucleotide; CD80 exon 2; Set B
guuccugaaaguugcuuaccuga

SEQ ID NO: 55726 - RNA, 21 nt, Artificial Sequence
  Synthetic Oligonucleotide; CD80 exon 2; Set C
uuccugaaaguugcuuaccug

SEQ ID NO: 55727 - RNA, 24 nt, Artificial Sequence
  Synthetic Oligonucleotide; CD80 exon 2; Set B
aguuccugaaaguugcuuaccuga

SEQ ID NO: 55728 - RNA, 22 nt, Artificial Sequence
  Synthetic Oligonucleotide; CD80 exon 2; Set C
guuccugaaaguugcuuaccug

SEQ ID NO: 55729 - RNA, 20 nt, Artificial Sequence
  Synthetic Oligonucleotide; CD80 exon 2; Set C
uuccugaaaguugcuuaccu

SEQ ID NO: 55730 - RNA, 23 nt, Artificial Sequence
  Synthetic Oligonucleotide; CD80 exon 2; Set C
aguuccugaaaguugcuuaccug

SEQ ID NO: 55731 - RNA, 21 nt, Artificial Sequence
  Synthetic Oligonucleotide; CD80 exon 2; Set C
guuccugaaaguugcuuaccu

SEQ ID NO: 55732 - RNA, 24 nt, Artificial Sequence
  Synthetic Oligonucleotide; CD80 exon 2; Set C
aaguuccugaaaguugcuuaccug

SEQ ID NO: 55733 - RNA, 22 nt, Artificial Sequence
  Synthetic Oligonucleotide; CD80 exon 2; Set C
aguuccugaaaguugcuuaccu

SEQ ID NO: 55734 - RNA, 23 nt, Artificial Sequence
  Synthetic Oligonucleotide; CD80 exon 2; Set C
aaguuccugaaaguugcuuaccu

SEQ ID NO: 55735 - RNA, 28 nt, Artificial Sequence
  Synthetic Oligonucleotide; CD80 exon 2; Set B
guuaaguuccugaaaguugcuuaccuga

SEQ ID NO: 55736 - RNA, 29 nt, Artificial Sequence
  Synthetic Oligonucleotide; CD80 exon 2; Set B
aguuaaguuccugaaaguugcuuaccuga

SEQ ID NO: 55737 - RNA, 27 nt, Artificial Sequence
  Synthetic Oligonucleotide; CD80 exon 2; Set B
guuaaguuccugaaaguugcuuaccug

SEQ ID NO: 55738 - RNA, 28 nt, Artificial Sequence
  Synthetic Oligonucleotide; CD80 exon 2; Set B
aguuaaguuccugaaaguugcuuaccug

SEQ ID NO: 55739 - RNA, 26 nt, Artificial Sequence
  Synthetic Oligonucleotide; CD80 exon 2; Set C
guuaaguuccugaaaguugcuuaccu

SEQ ID NO: 55740 - RNA, 27 nt, Artificial Sequence
  Synthetic Oligonucleotide; CD80 exon 2; Set C
aguuaaguuccugaaaguugcuuaccu

SEQ ID NO: 55741 - RNA, 35 nt, Artificial Sequence
  Synthetic Oligonucleotide; CD80 exon 2; Set B
ugacucaguuaaguuccugaaaguugcuuaccuga

SEQ ID NO: 55742 - RNA, 15 nt, Artificial Sequence
  Synthetic Oligonucleotide; CD80 exon 2; Set C
aaguuccugaaaguu

SEQ ID NO: 55743 - RNA, 36 nt, Artificial Sequence
  Synthetic Oligonucleotide; CD80 exon 2; Set B
uugacucaguuaaguuccugaaaguugcuuaccuga

SEQ ID NO: 55744 - RNA, 34 nt, Artificial Sequence
  Synthetic Oligonucleotide; CD80 exon 2; Set B
ugacucaguuaaguuccugaaaguugcuuaccug

SEQ ID NO: 55745 - RNA, 16 nt, Artificial Sequence
  Synthetic Oligonucleotide; CD80 exon 2; Set C
uaaguuccugaaaguu

SEQ ID NO: 55746 - RNA, 37 nt, Artificial Sequence
  Synthetic Oligonucleotide; CD80 exon 2; Set C
guugacucaguuaaguuccugaaaguugcuuaccuga

SEQ ID NO: 55747 - RNA, 35 nt, Artificial Sequence
  Synthetic Oligonucleotide; CD80 exon 2; Set B
uugacucaguuaaguuccugaaaguugcuuaccug

SEQ ID NO: 55748 - RNA, 33 nt, Artificial Sequence
  Synthetic Oligonucleotide; CD80 exon 2; Set B
ugacucaguuaaguuccugaaaguugcuuaccu

SEQ ID NO: 55749 - RNA, 17 nt, Artificial Sequence
  Synthetic Oligonucleotide; CD80 exon 2; Set C
uuaaguuccugaaaguu

SEQ ID NO: 55750 - RNA, 36 nt, Artificial Sequence
  Synthetic Oligonucleotide; CD80 exon 2; Set B
guugacucaguuaaguuccugaaaguugcuuaccug

SEQ ID NO: 55751 - RNA, 34 nt, Artificial Sequence
  Synthetic Oligonucleotide; CD80 exon 2; Set B
uugacucaguuaaguuccugaaaguugcuuaccu

SEQ ID NO: 55752 - RNA, 18 nt, Artificial Sequence
  Synthetic Oligonucleotide; CD80 exon 2; Set C
guuaaguuccugaaaguu

SEQ ID NO: 55753 - RNA, 35 nt, Artificial Sequence
  Synthetic Oligonucleotide; CD80 exon 2; Set B
guugacucaguuaaguuccugaaaguugcuuaccu

SEQ ID NO: 55754 - RNA, 38 nt, Artificial Sequence
  Synthetic Oligonucleotide; CD80 exon 2; Set C
agcaguugacucaguuaaguuccugaaaguugcuuacc

SEQ ID NO: 55755 - RNA, 37 nt, Artificial Sequence
  Synthetic Oligonucleotide; CD80 exon 2; Set B
agcaguugacucaguuaaguuccugaaaguugcuuac

SEQ ID NO: 55756 - RNA, 39 nt, Artificial Sequence
  Synthetic Oligonucleotide; CD80 exon 2; Set C
uagcaguugacucaguuaaguuccugaaaguugcuuacc

SEQ ID NO: 55757 - RNA, 25 nt, Artificial Sequence
  Synthetic Oligonucleotide; CD80 exon 2; Set C
ugacucaguuaaguuccugaaaguu

SEQ ID NO: 55758 - RNA, 36 nt, Artificial Sequence
  Synthetic Oligonucleotide; CD80 exon 2; Set B
agcaguugacucaguuaaguuccugaaaguugcuua

SEQ ID NO: 55759 - RNA, 38 nt, Artificial Sequence
  Synthetic Oligonucleotide; CD80 exon 2; Set C
uagcaguugacucaguuaaguuccugaaaguugcuuac

SEQ ID NO: 55760 - RNA, 40 nt, Artificial Sequence
  Synthetic Oligonucleotide; CD80 exon 2; Set C
guagcaguugacucaguuaaguuccugaaaguugcuuacc

SEQ ID NO: 55761 - RNA, 26 nt, Artificial Sequence
  Synthetic Oligonucleotide; CD80 exon 2; Set C
uugacucaguuaaguuccugaaaguu

SEQ ID NO: 55762 - RNA, 37 nt, Artificial Sequence
  Synthetic Oligonucleotide; CD80 exon 2; Set B
uagcaguugacucaguuaaguuccugaaaguugcuua

SEQ ID NO: 55763 - RNA, 39 nt, Artificial Sequence
  Synthetic Oligonucleotide; CD80 exon 2; Set C
guagcaguugacucaguuaaguuccugaaaguugcuuac

SEQ ID NO: 55764 - RNA, 27 nt, Artificial Sequence
  Synthetic Oligonucleotide; CD80 exon 2; Set C
guugacucaguuaaguuccugaaaguu

SEQ ID NO: 55765 - RNA, 38 nt, Artificial Sequence
  Synthetic Oligonucleotide; CD80 exon 2; Set C
guagcaguugacucaguuaaguuccugaaaguugcuua

SEQ ID NO: 55766 - RNA, 40 nt, Artificial Sequence
  Synthetic Oligonucleotide; CD80 exon 2; Set C
cuguagcaguugacucaguuaaguuccugaaaguugcuua

SEQ ID NO: 55767 - RNA, 29 nt, Artificial Sequence
  Synthetic Oligonucleotide; CD80 exon 2; Set B
gcaguugacucaguuaaguuccugaaagu

SEQ ID NO: 55768 - RNA, 29 nt, Artificial Sequence
  Synthetic Oligonucleotide; CD80 exon 2; Set B
agcaguugacucaguuaaguuccugaaag

SEQ ID NO: 55769 - RNA, 30 nt, Artificial Sequence
  Synthetic Oligonucleotide; CD80 exon 2; Set B
uagcaguugacucaguuaaguuccugaaag

SEQ ID NO: 55770 - RNA, 28 nt, Artificial Sequence
  Synthetic Oligonucleotide; CD80 exon 2; Set B
agcaguugacucaguuaaguuccugaaa

SEQ ID NO: 55771 - RNA, 31 nt, Artificial Sequence
  Synthetic Oligonucleotide; CD80 exon 2; Set B
guagcaguugacucaguuaaguuccugaaag

SEQ ID NO: 55772 - RNA, 29 nt, Artificial Sequence
  Synthetic Oligonucleotide; CD80 exon 2; Set B
uagcaguugacucaguuaaguuccugaaa

SEQ ID NO: 55773 - RNA, 27 nt, Artificial Sequence
  Synthetic Oligonucleotide; CD80 exon 2; Set B
agcaguugacucaguuaaguuccugaa

SEQ ID NO: 55774 - RNA, 30 nt, Artificial Sequence
  Synthetic Oligonucleotide; CD80 exon 2; Set B
guagcaguugacucaguuaaguuccugaaa

SEQ ID NO: 55775 - RNA, 28 nt, Artificial Sequence
  Synthetic Oligonucleotide; CD80 exon 2; Set B
uagcaguugacucaguuaaguuccugaa

SEQ ID NO: 55776 - RNA, 33 nt, Artificial Sequence
  Synthetic Oligonucleotide; CD80 exon 2; Set B
cuguagcaguugacucaguuaaguuccugaaag

SEQ ID NO: 55777 - RNA, 29 nt, Artificial Sequence
  Synthetic Oligonucleotide; CD80 exon 2; Set B
guagcaguugacucaguuaaguuccugaa

SEQ ID NO: 55778 - RNA, 32 nt, Artificial Sequence
  Synthetic Oligonucleotide; CD80 exon 2; Set B
cuguagcaguugacucaguuaaguuccugaaa

SEQ ID NO: 55779 - RNA, 21 nt, Artificial Sequence
  Synthetic Oligonucleotide; CD80 exon 2; Set C
gcaguugacucaguuaaguuc

SEQ ID NO: 55780 - RNA, 31 nt, Artificial Sequence
  Synthetic Oligonucleotide; CD80 exon 2; Set B
cuguagcaguugacucaguuaaguuccugaa

SEQ ID NO: 55781 - RNA, 20 nt, Artificial Sequence
  Synthetic Oligonucleotide; CD80 exon 2; Set C
gcaguugacucaguuaaguu

SEQ ID NO: 55782 - RNA, 19 nt, Artificial Sequence
  Synthetic Oligonucleotide; CD80 exon 2; Set C
gcaguugacucaguuaagu

SEQ ID NO: 55783 - RNA, 18 nt, Artificial Sequence
  Synthetic Oligonucleotide; CD80 exon 2; Set C
gcaguugacucaguuaag

SEQ ID NO: 55784 - RNA, 17 nt, Artificial Sequence
  Synthetic Oligonucleotide; CD80 exon 2; Set C
gcaguugacucaguuaa

SEQ ID NO: 55785 - RNA, 16 nt, Artificial Sequence
  Synthetic Oligonucleotide; CD80 exon 2; Set C
gcaguugacucaguua

SEQ ID NO: 55786 - RNA, 40 nt, Artificial Sequence
  Synthetic Oligonucleotide; CD80 exon 2; Set C
cuuaacccuguagcaguugacucaguuaaguuccugaaag

SEQ ID NO: 55787 - RNA, 17 nt, Artificial Sequence
  Synthetic Oligonucleotide; CD80 exon 2; Set C
agcaguugacucaguua

SEQ ID NO: 55788 - RNA, 39 nt, Artificial Sequence
  Synthetic Oligonucleotide; CD80 exon 2; Set C
cuuaacccuguagcaguugacucaguuaaguuccugaaa

SEQ ID NO: 55789 - RNA, 38 nt, Artificial Sequence
  Synthetic Oligonucleotide; CD80 exon 2; Set C
cuuaacccuguagcaguugacucaguuaaguuccugaa

SEQ ID NO: 55790 - RNA, 17 nt, Artificial Sequence
  Synthetic Oligonucleotide; CD80 exon 2; Set C
uagcaguugacucaguu

SEQ ID NO: 55791 - RNA, 18 nt, Artificial Sequence
  Synthetic Oligonucleotide; CD80 exon 2; Set C
guagcaguugacucaguu

SEQ ID NO: 55792 - RNA, 19 nt, Artificial Sequence
  Synthetic Oligonucleotide; CD80 exon 2; Set C
uguagcaguugacucaguu

SEQ ID NO: 55793 - RNA, 17 nt, Artificial Sequence
  Synthetic Oligonucleotide; CD80 exon 2; Set C
guagcaguugacucagu

SEQ ID NO: 55794 - RNA, 20 nt, Artificial Sequence
  Synthetic Oligonucleotide; CD80 exon 2; Set C
cuguagcaguugacucaguu

SEQ ID NO: 55795 - RNA, 18 nt, Artificial Sequence
  Synthetic Oligonucleotide; CD80 exon 2; Set C
uguagcaguugacucagu

SEQ ID NO: 55796 - RNA, 19 nt, Artificial Sequence
  Synthetic Oligonucleotide; CD80 exon 2; Set C
cuguagcaguugacucagu

SEQ ID NO: 55797 - RNA, 24 nt, Artificial Sequence
  Synthetic Oligonucleotide; CD80 exon 2; Set B
uaacccuguagcaguugacucagu

SEQ ID NO: 55798 - RNA, 27 nt, Artificial Sequence
  Synthetic Oligonucleotide; CD80 exon 2; Set B
cuuaacccuguagcaguugacucaguu

SEQ ID NO: 55799 - RNA, 25 nt, Artificial Sequence
  Synthetic Oligonucleotide; CD80 exon 2; Set B
uuaacccuguagcaguugacucagu

SEQ ID NO: 55800 - RNA, 26 nt, Artificial Sequence
  Synthetic Oligonucleotide; CD80 exon 2; Set B
cuuaacccuguagcaguugacucagu

SEQ ID NO: 55801 - RNA, 15 nt, Artificial Sequence
  Synthetic Oligonucleotide; CD80 exon 2; Set C
cccuguagcaguuga

SEQ ID NO: 55802 - RNA, 16 nt, Artificial Sequence
  Synthetic Oligonucleotide; CD80 exon 2; Set C
acccuguagcaguuga

SEQ ID NO: 55803 - RNA, 17 nt, Artificial Sequence
  Synthetic Oligonucleotide; CD80 exon 2; Set C
aacccuguagcaguuga

SEQ ID NO: 55804 - RNA, 15 nt, Artificial Sequence
  Synthetic Oligonucleotide; CD80 exon 2; Set C
acccuguagcaguug

SEQ ID NO: 55805 - RNA, 16 nt, Artificial Sequence
  Synthetic Oligonucleotide; CD80 exon 2; Set C
aacccuguagcaguug

SEQ ID NO: 55806 - RNA, 15 nt, Artificial Sequence
  Synthetic Oligonucleotide; CD80 exon 2; Set C
aacccuguagcaguu

SEQ ID NO: 55807 - RNA, 21 nt, Artificial Sequence
  Synthetic Oligonucleotide; CD80 exon 2; Set C
ucuuaacccuguagcaguuga

SEQ ID NO: 55808 - RNA, 22 nt, Artificial Sequence
  Synthetic Oligonucleotide; CD80 exon 2; Set B
cucuuaacccuguagcaguuga

SEQ ID NO: 55809 - RNA, 20 nt, Artificial Sequence
  Synthetic Oligonucleotide; CD80 exon 2; Set C
ucuuaacccuguagcaguug

SEQ ID NO: 55810 - RNA, 19 nt, Artificial Sequence
  Synthetic Oligonucleotide; CD80 exon 2; Set C
ucuuaacccuguagcaguu

SEQ ID NO: 55811 - RNA, 21 nt, Artificial Sequence
  Synthetic Oligonucleotide; CD80 exon 2; Set C
cucuuaacccuguagcaguug

SEQ ID NO: 55812 - RNA, 20 nt, Artificial Sequence
  Synthetic Oligonucleotide; CD80 exon 2; Set C
cucuuaacccuguagcaguu

SEQ ID NO: 55813 - RNA, 15 nt, Artificial Sequence
  Synthetic Oligonucleotide; CD80 exon 5; Set C
agaaugacacaaaaa

SEQ ID NO: 55814 - RNA, 16 nt, Artificial Sequence
  Synthetic Oligonucleotide; CD80 exon 5; Set C
uagaaugacacaaaaa

SEQ ID NO: 55815 - RNA, 15 nt, Artificial Sequence
  Synthetic Oligonucleotide; CD80 exon 5; Set C
uagaaugacacaaaa

SEQ ID NO: 55816 - RNA, 17 nt, Artificial Sequence
  Synthetic Oligonucleotide; CD80 exon 5; Set C
uuagaaugacacaaaaa

SEQ ID NO: 55817 - RNA, 16 nt, Artificial Sequence
  Synthetic Oligonucleotide; CD80 exon 5; Set C
uuagaaugacacaaaa

SEQ ID NO: 55818 - RNA, 18 nt, Artificial Sequence
  Synthetic Oligonucleotide; CD80 exon 5; Set C
auuagaaugacacaaaaa

SEQ ID NO: 55819 - RNA, 17 nt, Artificial Sequence
  Synthetic Oligonucleotide; CD80 exon 5; Set C
auuagaaugacacaaaa

SEQ ID NO: 55820 - RNA, 15 nt, Artificial Sequence
  Synthetic Oligonucleotide; CD80 exon 5; Set C
uuagaaugacacaaa

SEQ ID NO: 55821 - RNA, 19 nt, Artificial Sequence
  Synthetic Oligonucleotide; CD80 exon 5; Set C
gauuagaaugacacaaaaa

SEQ ID NO: 55822 - RNA, 16 nt, Artificial Sequence
  Synthetic Oligonucleotide; CD80 exon 5; Set C
auuagaaugacacaaa

SEQ ID NO: 55823 - RNA, 18 nt, Artificial Sequence
  Synthetic Oligonucleotide; CD80 exon 5; Set C
gauuagaaugacacaaaa

SEQ ID NO: 55824 - RNA, 20 nt, Artificial Sequence
  Synthetic Oligonucleotide; CD80 exon 5; Set C
agauuagaaugacacaaaaa

SEQ ID NO: 55825 - RNA, 19 nt, Artificial Sequence
  Synthetic Oligonucleotide; CD80 exon 5; Set C
agauuagaaugacacaaaa

SEQ ID NO: 55826 - RNA, 17 nt, Artificial Sequence
  Synthetic Oligonucleotide; CD80 exon 5; Set C
gauuagaaugacacaaa

SEQ ID NO: 55827 - RNA, 15 nt, Artificial Sequence
  Synthetic Oligonucleotide; CD80 exon 5; Set C
auuagaaugacacaa

SEQ ID NO: 55828 - RNA, 21 nt, Artificial Sequence
  Synthetic Oligonucleotide; CD80 exon 5; Set C
cagauuagaaugacacaaaaa

SEQ ID NO: 55829 - RNA, 20 nt, Artificial Sequence
  Synthetic Oligonucleotide; CD80 exon 5; Set C
cagauuagaaugacacaaaa

SEQ ID NO: 55830 - RNA, 18 nt, Artificial Sequence
  Synthetic Oligonucleotide; CD80 exon 5; Set C
agauuagaaugacacaaa

SEQ ID NO: 55831 - RNA, 16 nt, Artificial Sequence
  Synthetic Oligonucleotide; CD80 exon 5; Set C
gauuagaaugacacaa

SEQ ID NO: 55832 - RNA, 19 nt, Artificial Sequence
  Synthetic Oligonucleotide; CD80 exon 5; Set C
cagauuagaaugacacaaa

SEQ ID NO: 55833 - RNA, 17 nt, Artificial Sequence
  Synthetic Oligonucleotide; CD80 exon 5; Set C
agauuagaaugacacaa

SEQ ID NO: 55834 - RNA, 15 nt, Artificial Sequence
  Synthetic Oligonucleotide; CD80 exon 5; Set C
gauuagaaugacaca

SEQ ID NO: 55835 - RNA, 18 nt, Artificial Sequence
  Synthetic Oligonucleotide; CD80 exon 5; Set C
cagauuagaaugacacaa

SEQ ID NO: 55836 - RNA, 16 nt, Artificial Sequence
  Synthetic Oligonucleotide; CD80 exon 5; Set C
agauuagaaugacaca

SEQ ID NO: 55837 - RNA, 17 nt, Artificial Sequence
  Synthetic Oligonucleotide; CD80 exon 5; Set C
cagauuagaaugacaca

SEQ ID NO: 55838 - RNA, 15 nt, Artificial Sequence
  Synthetic Oligonucleotide; CD80 exon 5; Set C
acaucaagugauuac

SEQ ID NO: 55839 - RNA, 16 nt, Artificial Sequence
  Synthetic Oligonucleotide; CD80 exon 5; Set C
gacaucaagugauuac

SEQ ID NO: 55840 - RNA, 15 nt, Artificial Sequence
  Synthetic Oligonucleotide; CD80 exon 5; Set C
gacaucaagugauua

SEQ ID NO: 55841 - RNA, 17 nt, Artificial Sequence
  Synthetic Oligonucleotide; CD80 exon 5; Set C
agacaucaagugauuac

SEQ ID NO: 55842 - RNA, 16 nt, Artificial Sequence
  Synthetic Oligonucleotide; CD80 exon 5; Set C
agacaucaagugauua

SEQ ID NO: 55843 - RNA, 15 nt, Artificial Sequence
  Synthetic Oligonucleotide; CD80 exon 5; Set C
agacaucaagugauu

SEQ ID NO: 55844 - RNA, 21 nt, Artificial Sequence
  Synthetic Oligonucleotide; CD80 exon 5; Set C
aauggagacaucaagugauua

SEQ ID NO: 55845 - RNA, 23 nt, Artificial Sequence
  Synthetic Oligonucleotide; CD80 exon 5; Set C
gaauggagacaucaagugauuac

SEQ ID NO: 55846 - RNA, 22 nt, Artificial Sequence
  Synthetic Oligonucleotide; CD80 exon 5; Set C
gaauggagacaucaagugauua

SEQ ID NO: 55847 - RNA, 36 nt, Artificial Sequence
  Synthetic Oligonucleotide; CD80 exon 5; Set A
aaaacaccagauugaauggagacaucaagugauuac

SEQ ID NO: 55848 - RNA, 35 nt, Artificial Sequence
  Synthetic Oligonucleotide; CD80 exon 5; Set A
aaaacaccagauugaauggagacaucaagugauua

SEQ ID NO: 55849 - RNA, 34 nt, Artificial Sequence
  Synthetic Oligonucleotide; CD80 exon 5; Set A
aaaacaccagauugaauggagacaucaagugauu

SEQ ID NO: 55850 - RNA, 24 nt, Artificial Sequence
  Synthetic Oligonucleotide; CD80 exon 5; Set C
aaaacaccagauugaauggagaca

SEQ ID NO: 55851 - RNA, 23 nt, Artificial Sequence
  Synthetic Oligonucleotide; CD80 exon 5; Set C
aaaacaccagauugaauggagac

SEQ ID NO: 55852 - RNA, 22 nt, Artificial Sequence
  Synthetic Oligonucleotide; CD80 exon 5; Set C
aaaacaccagauugaauggaga

SEQ ID NO: 55853 - RNA, 38 nt, Artificial Sequence
  Synthetic Oligonucleotide; CD80 exon 5; Set A
uuuucuuuuuucucuaaaacaccagauugaauggagac

SEQ ID NO: 55854 - RNA, 15 nt, Artificial Sequence
  Synthetic Oligonucleotide; CD80 exon 5; Set C
ucuuuuuucucuaaa

SEQ ID NO: 55855 - RNA, 16 nt, Artificial Sequence
  Synthetic Oligonucleotide; CD80 exon 5; Set C
uucuuuuuucucuaaa

SEQ ID NO: 55856 - RNA, 17 nt, Artificial Sequence
  Synthetic Oligonucleotide; CD80 exon 5; Set C
uuucuuuuuucucuaaa

SEQ ID NO: 55857 - RNA, 18 nt, Artificial Sequence
  Synthetic Oligonucleotide; CD80 exon 5; Set C
uuuucuuuuuucucuaaa

SEQ ID NO: 55858 - RNA, 24 nt, Artificial Sequence
  Synthetic Oligonucleotide; CD80 exon 5; Set C
guugguuuuucuuuuuucucuaaa

SEQ ID NO: 55859 - RNA, 25 nt, Artificial Sequence
  Synthetic Oligonucleotide; CD80 exon 5; Set C
aguugguuuuucuuuuuucucuaaa

SEQ ID NO: 55860 - RNA, 26 nt, Artificial Sequence
  Synthetic Oligonucleotide; CD80 exon 5; Set C
uaguugguuuuucuuuuuucucuaaa

SEQ ID NO: 55861 - RNA, 30 nt, Artificial Sequence
  Synthetic Oligonucleotide; CD80 exon 5; Set C
aggauaguugguuuuucuuuuuucucuaaa

SEQ ID NO: 55862 - RNA, 31 nt, Artificial Sequence
  Synthetic Oligonucleotide; CD80 exon 5; Set C
caggauaguugguuuuucuuuuuucucuaaa

SEQ ID NO: 55863 - RNA, 17 nt, Artificial Sequence
  Synthetic Oligonucleotide; CD80 exon 5; Set C
guugguuuuucuuuuuu

SEQ ID NO: 55864 - RNA, 32 nt, Artificial Sequence
  Synthetic Oligonucleotide; CD80 exon 5; Set A
acaggauaguugguuuuucuuuuuucucuaaa

SEQ ID NO: 55865 - RNA, 16 nt, Artificial Sequence
  Synthetic Oligonucleotide; CD80 exon 5; Set C
guugguuuuucuuuuu

SEQ ID NO: 55866 - RNA, 33 nt, Artificial Sequence
  Synthetic Oligonucleotide; CD80 exon 5; Set A
gacaggauaguugguuuuucuuuuuucucuaaa

SEQ ID NO: 55867 - RNA, 17 nt, Artificial Sequence
  Synthetic Oligonucleotide; CD80 exon 5; Set C
aguugguuuuucuuuuu

SEQ ID NO: 55868 - RNA, 15 nt, Artificial Sequence
  Synthetic Oligonucleotide; CD80 exon 5; Set C
guugguuuuucuuuu

SEQ ID NO: 55869 - RNA, 34 nt, Artificial Sequence
  Synthetic Oligonucleotide; CD80 exon 5; Set A
agacaggauaguugguuuuucuuuuuucucuaaa

SEQ ID NO: 55870 - RNA, 35 nt, Artificial Sequence
  Synthetic Oligonucleotide; CD80 exon 5; Set A
aagacaggauaguugguuuuucuuuuuucucuaaa

SEQ ID NO: 55871 - RNA, 36 nt, Artificial Sequence
  Synthetic Oligonucleotide; CD80 exon 5; Set A
aaagacaggauaguugguuuuucuuuuuucucuaaa

SEQ ID NO: 55872 - RNA, 37 nt, Artificial Sequence
  Synthetic Oligonucleotide; CD80 exon 5; Set A
uaaagacaggauaguugguuuuucuuuuuucucuaaa

SEQ ID NO: 55873 - RNA, 38 nt, Artificial Sequence
  Synthetic Oligonucleotide; CD80 exon 5; Set A
uuaaagacaggauaguugguuuuucuuuuuucucuaaa

SEQ ID NO: 55874 - RNA, 36 nt, Artificial Sequence
  Synthetic Oligonucleotide; CD80 exon 5; Set A
uaaagacaggauaguugguuuuucuuuuuucucuaa

SEQ ID NO: 55875 - RNA, 25 nt, Artificial Sequence
  Synthetic Oligonucleotide; CD80 exon 5; Set C
gacaggauaguugguuuuucuuuuu

SEQ ID NO: 55876 - RNA, 26 nt, Artificial Sequence
  Synthetic Oligonucleotide; CD80 exon 5; Set C
agacaggauaguugguuuuucuuuuu

SEQ ID NO: 55877 - RNA, 28 nt, Artificial Sequence
  Synthetic Oligonucleotide; CD80 exon 5; Set C
aagacaggauaguugguuuuucuuuuuu

SEQ ID NO: 55878 - RNA, 27 nt, Artificial Sequence
  Synthetic Oligonucleotide; CD80 exon 5; Set C
aagacaggauaguugguuuuucuuuuu

SEQ ID NO: 55879 - RNA, 29 nt, Artificial Sequence
  Synthetic Oligonucleotide; CD80 exon 5; Set C
aaagacaggauaguugguuuuucuuuuuu

SEQ ID NO: 55880 - RNA, 31 nt, Artificial Sequence
  Synthetic Oligonucleotide; CD80 exon 5; Set C
uaaagacaggauaguugguuuuucuuuuuuc

SEQ ID NO: 55881 - RNA, 28 nt, Artificial Sequence
  Synthetic Oligonucleotide; CD80 exon 5; Set C
aaagacaggauaguugguuuuucuuuuu

SEQ ID NO: 55882 - RNA, 30 nt, Artificial Sequence
  Synthetic Oligonucleotide; CD80 exon 5; Set C
uaaagacaggauaguugguuuuucuuuuuu

SEQ ID NO: 55883 - RNA, 29 nt, Artificial Sequence
  Synthetic Oligonucleotide; CD80 exon 5; Set C
uaaagacaggauaguugguuuuucuuuuu

SEQ ID NO: 55884 - RNA, 27 nt, Artificial Sequence
  Synthetic Oligonucleotide; CD80 exon 5; Set C
aaagacaggauaguugguuuuucuuuu

SEQ ID NO: 55885 - RNA, 28 nt, Artificial Sequence
  Synthetic Oligonucleotide; CD80 exon 5; Set C
uaaagacaggauaguugguuuuucuuuu

SEQ ID NO: 55886 - RNA, 26 nt, Artificial Sequence
  Synthetic Oligonucleotide; CD80 exon 5; Set C
aaagacaggauaguugguuuuucuuu

SEQ ID NO: 55887 - RNA, 27 nt, Artificial Sequence
  Synthetic Oligonucleotide; CD80 exon 5; Set C
uaaagacaggauaguugguuuuucuuu

SEQ ID NO: 55888 - RNA, 26 nt, Artificial Sequence
  Synthetic Oligonucleotide; CD80 exon 5; Set C
uaaagacaggauaguugguuuuucuu

SEQ ID NO: 55889 - RNA, 21 nt, Artificial Sequence
  Synthetic Oligonucleotide; CD80 exon 5; Set C
aagacaggauaguugguuuuu

SEQ ID NO: 55890 - RNA, 25 nt, Artificial Sequence
  Synthetic Oligonucleotide; CD80 exon 5; Set C
uaaagacaggauaguugguuuuucu

SEQ ID NO: 55891 - RNA, 20 nt, Artificial Sequence
  Synthetic Oligonucleotide; CD80 exon 5; Set C
aagacaggauaguugguuuu

SEQ ID NO: 55892 - RNA, 22 nt, Artificial Sequence
  Synthetic Oligonucleotide; CD80 exon 5; Set C
aaagacaggauaguugguuuuu

SEQ ID NO: 55893 - RNA, 24 nt, Artificial Sequence
  Synthetic Oligonucleotide; CD80 exon 5; Set C
uaaagacaggauaguugguuuuuc

SEQ ID NO: 55894 - RNA, 21 nt, Artificial Sequence
  Synthetic Oligonucleotide; CD80 exon 5; Set C
aaagacaggauaguugguuuu

SEQ ID NO: 55895 - RNA, 23 nt, Artificial Sequence
  Synthetic Oligonucleotide; CD80 exon 5; Set C
uaaagacaggauaguugguuuuu

SEQ ID NO: 55896 - RNA, 22 nt, Artificial Sequence
  Synthetic Oligonucleotide; CD80 exon 5; Set C
uaaagacaggauaguugguuuu

SEQ ID NO: 55897 - RNA, 15 nt, Artificial Sequence
  Synthetic Oligonucleotide; CD80 exon 5; Set C
aaagacaggauaguu

SEQ ID NO: 55898 - RNA, 16 nt, Artificial Sequence
  Synthetic Oligonucleotide; CD80 exon 5; Set C
uaaagacaggauaguu

SEQ ID NO: 55899 - RNA, 17 nt, Artificial Sequence
  Synthetic Oligonucleotide; CD80 exon 5; Set C
uuaaagacaggauaguu

SEQ ID NO: 55900 - RNA, 15 nt, Artificial Sequence
  Synthetic Oligonucleotide; CD80 exon 5; Set C
uaaagacaggauagu

SEQ ID NO: 55901 - RNA, 15 nt, Artificial Sequence
  Synthetic Oligonucleotide; CD80 exon 5; Set C
uugcuguuauccugg

SEQ ID NO: 55902 - RNA, 16 nt, Artificial Sequence
  Synthetic Oligonucleotide; CD80 exon 5; Set C
auugcuguuauccugg

SEQ ID NO: 55903 - RNA, 15 nt, Artificial Sequence
  Synthetic Oligonucleotide; CD80 exon 5; Set C
auugcuguuauccug

SEQ ID NO: 55904 - RNA, 17 nt, Artificial Sequence
  Synthetic Oligonucleotide; CD80 exon 5; Set C
cauugcuguuauccugg

SEQ ID NO: 55905 - RNA, 16 nt, Artificial Sequence
  Synthetic Oligonucleotide; CD80 exon 5; Set C
cauugcuguuauccug

SEQ ID NO: 55906 - RNA, 40 nt, Artificial Sequence
  Synthetic Oligonucleotide; CD80 exon 5; Set A
gaaugacacaaaaaauaacaagccauugcuguuauccugg

SEQ ID NO: 55907 - RNA, 39 nt, Artificial Sequence
  Synthetic Oligonucleotide; CD80 exon 5; Set A
gaaugacacaaaaaauaacaagccauugcuguuauccug

SEQ ID NO: 55908 - RNA, 40 nt, Artificial Sequence
  Synthetic Oligonucleotide; CD80 exon 5; Set A
agaaugacacaaaaaauaacaagccauugcuguuauccug

SEQ ID NO: 55909 - RNA, 27 nt, Artificial Sequence
  Synthetic Oligonucleotide; CD80 exon 5; Set C
aaugacacaaaaaauaacaagccauug

SEQ ID NO: 55910 - RNA, 37 nt, Artificial Sequence
  Synthetic Oligonucleotide; CD80 exon 5; Set A
auuagaaugacacaaaaaauaacaagccauugcuguu

SEQ ID NO: 55911 - RNA, 26 nt, Artificial Sequence
  Synthetic Oligonucleotide; CD80 exon 5; Set C
aaugacacaaaaaauaacaagccauu

SEQ ID NO: 55912 - RNA, 28 nt, Artificial Sequence
  Synthetic Oligonucleotide; CD80 exon 5; Set C
gaaugacacaaaaaauaacaagccauug

SEQ ID NO: 55913 - RNA, 38 nt, Artificial Sequence
  Synthetic Oligonucleotide; CD80 exon 5; Set A
gauuagaaugacacaaaaaauaacaagccauugcuguu

SEQ ID NO: 55914 - RNA, 27 nt, Artificial Sequence
  Synthetic Oligonucleotide; CD80 exon 5; Set C
gaaugacacaaaaaauaacaagccauu

SEQ ID NO: 55915 - RNA, 29 nt, Artificial Sequence
  Synthetic Oligonucleotide; CD80 exon 5; Set C
agaaugacacaaaaaauaacaagccauug

SEQ ID NO: 55916 - RNA, 25 nt, Artificial Sequence
  Synthetic Oligonucleotide; CD80 exon 5; Set C
aaugacacaaaaaauaacaagccau

SEQ ID NO: 55917 - RNA, 39 nt, Artificial Sequence
  Synthetic Oligonucleotide; CD80 exon 5; Set A
agauuagaaugacacaaaaaauaacaagccauugcuguu

SEQ ID NO: 55918 - RNA, 28 nt, Artificial Sequence
  Synthetic Oligonucleotide; CD80 exon 5; Set C
agaaugacacaaaaaauaacaagccauu

SEQ ID NO: 55919 - RNA, 30 nt, Artificial Sequence
  Synthetic Oligonucleotide; CD80 exon 5; Set C
uagaaugacacaaaaaauaacaagccauug

SEQ ID NO: 55920 - RNA, 26 nt, Artificial Sequence
  Synthetic Oligonucleotide; CD80 exon 5; Set C
gaaugacacaaaaaauaacaagccau

SEQ ID NO: 55921 - RNA, 40 nt, Artificial Sequence
  Synthetic Oligonucleotide; CD80 exon 5; Set A
cagauuagaaugacacaaaaaauaacaagccauugcuguu

SEQ ID NO: 55922 - RNA, 29 nt, Artificial Sequence
  Synthetic Oligonucleotide; CD80 exon 5; Set C
uagaaugacacaaaaaauaacaagccauu

SEQ ID NO: 55923 - RNA, 31 nt, Artificial Sequence
  Synthetic Oligonucleotide; CD80 exon 5; Set C
uuagaaugacacaaaaaauaacaagccauug

SEQ ID NO: 55924 - RNA, 27 nt, Artificial Sequence
  Synthetic Oligonucleotide; CD80 exon 5; Set C
agaaugacacaaaaaauaacaagccau

SEQ ID NO: 55925 - RNA, 30 nt, Artificial Sequence
  Synthetic Oligonucleotide; CD80 exon 5; Set C
uuagaaugacacaaaaaauaacaagccauu

SEQ ID NO: 55926 - RNA, 32 nt, Artificial Sequence
  Synthetic Oligonucleotide; CD80 exon 5; Set C
auuagaaugacacaaaaaauaacaagccauug

SEQ ID NO: 55927 - RNA, 28 nt, Artificial Sequence
  Synthetic Oligonucleotide; CD80 exon 5; Set C
uagaaugacacaaaaaauaacaagccau

SEQ ID NO: 55928 - RNA, 31 nt, Artificial Sequence
  Synthetic Oligonucleotide; CD80 exon 5; Set C
auuagaaugacacaaaaaauaacaagccauu

SEQ ID NO: 55929 - RNA, 33 nt, Artificial Sequence
  Synthetic Oligonucleotide; CD80 exon 5; Set C
gauuagaaugacacaaaaaauaacaagccauug

SEQ ID NO: 55930 - RNA, 29 nt, Artificial Sequence
  Synthetic Oligonucleotide; CD80 exon 5; Set C
uuagaaugacacaaaaaauaacaagccau

SEQ ID NO: 55931 - RNA, 32 nt, Artificial Sequence
  Synthetic Oligonucleotide; CD80 exon 5; Set C
gauuagaaugacacaaaaaauaacaagccauu

SEQ ID NO: 55932 - RNA, 34 nt, Artificial Sequence
  Synthetic Oligonucleotide; CD80 exon 5; Set C
agauuagaaugacacaaaaaauaacaagccauug

SEQ ID NO: 55933 - RNA, 30 nt, Artificial Sequence
  Synthetic Oligonucleotide; CD80 exon 5; Set C
auuagaaugacacaaaaaauaacaagccau

SEQ ID NO: 55934 - RNA, 33 nt, Artificial Sequence
  Synthetic Oligonucleotide; CD80 exon 5; Set C
agauuagaaugacacaaaaaauaacaagccauu

SEQ ID NO: 55935 - RNA, 35 nt, Artificial Sequence
  Synthetic Oligonucleotide; CD80 exon 5; Set C
cagauuagaaugacacaaaaaauaacaagccauug

SEQ ID NO: 55936 - RNA, 31 nt, Artificial Sequence
  Synthetic Oligonucleotide; CD80 exon 5; Set C
gauuagaaugacacaaaaaauaacaagccau

SEQ ID NO: 55937 - RNA, 34 nt, Artificial Sequence
  Synthetic Oligonucleotide; CD80 exon 5; Set C
cagauuagaaugacacaaaaaauaacaagccauu

SEQ ID NO: 55938 - RNA, 32 nt, Artificial Sequence
  Synthetic Oligonucleotide; CD80 exon 5; Set C
agauuagaaugacacaaaaaauaacaagccau

SEQ ID NO: 55939 - RNA, 33 nt, Artificial Sequence
  Synthetic Oligonucleotide; CD80 exon 5; Set C
cagauuagaaugacacaaaaaauaacaagccau

SEQ ID NO: 55940 - RNA, 15 nt, Artificial Sequence
  Synthetic Oligonucleotide; CD80 exon 5; Set C
aaugacacaaaaaau

SEQ ID NO: 55941 - RNA, 16 nt, Artificial Sequence
  Synthetic Oligonucleotide; CD80 exon 5; Set C
gaaugacacaaaaaau

SEQ ID NO: 55942 - RNA, 15 nt, Artificial Sequence
  Synthetic Oligonucleotide; CD80 exon 5; Set C
gaaugacacaaaaaa

SEQ ID NO: 55943 - RNA, 17 nt, Artificial Sequence
  Synthetic Oligonucleotide; CD80 exon 5; Set C
agaaugacacaaaaaau

SEQ ID NO: 55944 - RNA, 16 nt, Artificial Sequence
  Synthetic Oligonucleotide; CD80 exon 5; Set C
agaaugacacaaaaaa

SEQ ID NO: 55945 - RNA, 18 nt, Artificial Sequence
  Synthetic Oligonucleotide; CD80 exon 5; Set C
uagaaugacacaaaaaau

SEQ ID NO: 55946 - RNA, 17 nt, Artificial Sequence
  Synthetic Oligonucleotide; CD80 exon 5; Set C
uagaaugacacaaaaaa

SEQ ID NO: 55947 - RNA, 19 nt, Artificial Sequence
  Synthetic Oligonucleotide; CD80 exon 5; Set C
uuagaaugacacaaaaaau

SEQ ID NO: 55948 - RNA, 18 nt, Artificial Sequence
  Synthetic Oligonucleotide; CD80 exon 5; Set C
uuagaaugacacaaaaaa

SEQ ID NO: 55949 - RNA, 20 nt, Artificial Sequence
  Synthetic Oligonucleotide; CD80 exon 5; Set C
auuagaaugacacaaaaaau

SEQ ID NO: 55950 - RNA, 19 nt, Artificial Sequence
  Synthetic Oligonucleotide; CD80 exon 5; Set C
auuagaaugacacaaaaaa

SEQ ID NO: 55951 - RNA, 21 nt, Artificial Sequence
  Synthetic Oligonucleotide; CD80 exon 5; Set C
gauuagaaugacacaaaaaau

SEQ ID NO: 55952 - RNA, 20 nt, Artificial Sequence
  Synthetic Oligonucleotide; CD80 exon 5; Set C
gauuagaaugacacaaaaaa

SEQ ID NO: 55953 - RNA, 22 nt, Artificial Sequence
  Synthetic Oligonucleotide; CD80 exon 5; Set C
agauuagaaugacacaaaaaau

SEQ ID NO: 55954 - RNA, 21 nt, Artificial Sequence
  Synthetic Oligonucleotide; CD80 exon 5; Set C
agauuagaaugacacaaaaaa

SEQ ID NO: 55955 - RNA, 23 nt, Artificial Sequence
  Synthetic Oligonucleotide; CD80 exon 5; Set C
cagauuagaaugacacaaaaaau

SEQ ID NO: 55956 - RNA, 22 nt, Artificial Sequence
  Synthetic Oligonucleotide; CD80 exon 5; Set C
cagauuagaaugacacaaaaaa

SEQ ID NO: 55957 - RNA, 15 nt, Artificial Sequence
  Synthetic Oligonucleotide; CD80 exon 5; Set C
agauuagaaugacac

SEQ ID NO: 55958 - RNA, 16 nt, Artificial Sequence
  Synthetic Oligonucleotide; CD80 exon 5; Set C
cagauuagaaugacac

SEQ ID NO: 55959 - RNA, 30 nt, Artificial Sequence
  Synthetic Oligonucleotide; CD80 exon 5; Set C
gaccucuacagauuagaaugacacaaaaaa

SEQ ID NO: 55960 - RNA, 29 nt, Artificial Sequence
  Synthetic Oligonucleotide; CD80 exon 5; Set C
gaccucuacagauuagaaugacacaaaaa

SEQ ID NO: 55961 - RNA, 31 nt, Artificial Sequence
  Synthetic Oligonucleotide; CD80 exon 5; Set C
ugaccucuacagauuagaaugacacaaaaaa

SEQ ID NO: 55962 - RNA, 28 nt, Artificial Sequence
  Synthetic Oligonucleotide; CD80 exon 5; Set C
gaccucuacagauuagaaugacacaaaa

SEQ ID NO: 55963 - RNA, 30 nt, Artificial Sequence
  Synthetic Oligonucleotide; CD80 exon 5; Set C
ugaccucuacagauuagaaugacacaaaaa

SEQ ID NO: 55964 - RNA, 32 nt, Artificial Sequence
  Synthetic Oligonucleotide; CD80 exon 5; Set C
uugaccucuacagauuagaaugacacaaaaaa

SEQ ID NO: 55965 - RNA, 29 nt, Artificial Sequence
  Synthetic Oligonucleotide; CD80 exon 5; Set C
ugaccucuacagauuagaaugacacaaaa

SEQ ID NO: 55966 - RNA, 27 nt, Artificial Sequence
  Synthetic Oligonucleotide; CD80 exon 5; Set C
gaccucuacagauuagaaugacacaaa

SEQ ID NO: 55967 - RNA, 31 nt, Artificial Sequence
  Synthetic Oligonucleotide; CD80 exon 5; Set C
uugaccucuacagauuagaaugacacaaaaa

SEQ ID NO: 55968 - RNA, 30 nt, Artificial Sequence
  Synthetic Oligonucleotide; CD80 exon 5; Set A
uugaccucuacagauuagaaugacacaaaa

SEQ ID NO: 55969 - RNA, 28 nt, Artificial Sequence
  Synthetic Oligonucleotide; CD80 exon 5; Set A
ugaccucuacagauuagaaugacacaaa

SEQ ID NO: 55970 - RNA, 26 nt, Artificial Sequence
  Synthetic Oligonucleotide; CD80 exon 5; Set A
gaccucuacagauuagaaugacacaa

SEQ ID NO: 55971 - RNA, 29 nt, Artificial Sequence
  Synthetic Oligonucleotide; CD80 exon 5; Set A
uugaccucuacagauuagaaugacacaaa

SEQ ID NO: 55972 - RNA, 27 nt, Artificial Sequence
  Synthetic Oligonucleotide; CD80 exon 5; Set A
ugaccucuacagauuagaaugacacaa

SEQ ID NO: 55973 - RNA, 25 nt, Artificial Sequence
  Synthetic Oligonucleotide; CD80 exon 5; Set A
gaccucuacagauuagaaugacaca

SEQ ID NO: 55974 - RNA, 28 nt, Artificial Sequence
  Synthetic Oligonucleotide; CD80 exon 5; Set A
uugaccucuacagauuagaaugacacaa

SEQ ID NO: 55975 - RNA, 26 nt, Artificial Sequence
  Synthetic Oligonucleotide; CD80 exon 5; Set A
ugaccucuacagauuagaaugacaca

SEQ ID NO: 55976 - RNA, 24 nt, Artificial Sequence
  Synthetic Oligonucleotide; CD80 exon 5; Set C
gaccucuacagauuagaaugacac

SEQ ID NO: 55977 - RNA, 27 nt, Artificial Sequence
  Synthetic Oligonucleotide; CD80 exon 5; Set A
uugaccucuacagauuagaaugacaca

SEQ ID NO: 55978 - RNA, 25 nt, Artificial Sequence
  Synthetic Oligonucleotide; CD80 exon 5; Set C
ugaccucuacagauuagaaugacac

SEQ ID NO: 55979 - RNA, 26 nt, Artificial Sequence
  Synthetic Oligonucleotide; CD80 exon 5; Set A
uugaccucuacagauuagaaugacac

SEQ ID NO: 55980 - RNA, 20 nt, Artificial Sequence
  Synthetic Oligonucleotide; CD80 exon 5; Set C
gaccucuacagauuagaaug

SEQ ID NO: 55981 - RNA, 19 nt, Artificial Sequence
  Synthetic Oligonucleotide; CD80 exon 5; Set C
gaccucuacagauuagaau

SEQ ID NO: 55982 - RNA, 39 nt, Artificial Sequence
  Synthetic Oligonucleotide; CD80 exon 5; Set A
uaccagaguugaccucuacagauuagaaugacacaaaaa

SEQ ID NO: 55983 - RNA, 21 nt, Artificial Sequence
  Synthetic Oligonucleotide; CD80 exon 5; Set C
ugaccucuacagauuagaaug

SEQ ID NO: 55984 - RNA, 20 nt, Artificial Sequence
  Synthetic Oligonucleotide; CD80 exon 5; Set C
ugaccucuacagauuagaau

SEQ ID NO: 55985 - RNA, 18 nt, Artificial Sequence
  Synthetic Oligonucleotide; CD80 exon 5; Set C
gaccucuacagauuagaa

SEQ ID NO: 55986 - RNA, 38 nt, Artificial Sequence
  Synthetic Oligonucleotide; CD80 exon 5; Set A
uaccagaguugaccucuacagauuagaaugacacaaaa

SEQ ID NO: 55987 - RNA, 40 nt, Artificial Sequence
  Synthetic Oligonucleotide; CD80 exon 5; Set A
uuaccagaguugaccucuacagauuagaaugacacaaaaa

SEQ ID NO: 55988 - RNA, 22 nt, Artificial Sequence
  Synthetic Oligonucleotide; CD80 exon 5; Set C
uugaccucuacagauuagaaug

SEQ ID NO: 55989 - RNA, 17 nt, Artificial Sequence
  Synthetic Oligonucleotide; CD80 exon 5; Set C
gaccucuacagauuaga

SEQ ID NO: 55990 - RNA, 21 nt, Artificial Sequence
  Synthetic Oligonucleotide; CD80 exon 5; Set C
uugaccucuacagauuagaau

SEQ ID NO: 55991 - RNA, 19 nt, Artificial Sequence
  Synthetic Oligonucleotide; CD80 exon 5; Set C
ugaccucuacagauuagaa

SEQ ID NO: 55992 - RNA, 39 nt, Artificial Sequence
  Synthetic Oligonucleotide; CD80 exon 5; Set A
uuaccagaguugaccucuacagauuagaaugacacaaaa

SEQ ID NO: 55993 - RNA, 37 nt, Artificial Sequence
  Synthetic Oligonucleotide; CD80 exon 5; Set C
uaccagaguugaccucuacagauuagaaugacacaaa

SEQ ID NO: 55994 - RNA, 18 nt, Artificial Sequence
  Synthetic Oligonucleotide; CD80 exon 5; Set C
ugaccucuacagauuaga

SEQ ID NO: 55995 - RNA, 16 nt, Artificial Sequence
  Synthetic Oligonucleotide; CD80 exon 5; Set C
gaccucuacagauuag

SEQ ID NO: 55996 - RNA, 20 nt, Artificial Sequence
  Synthetic Oligonucleotide; CD80 exon 5; Set C
uugaccucuacagauuagaa

SEQ ID NO: 55997 - RNA, 38 nt, Artificial Sequence
  Synthetic Oligonucleotide; CD80 exon 5; Set C
uuaccagaguugaccucuacagauuagaaugacacaaa

SEQ ID NO: 55998 - RNA, 40 nt, Artificial Sequence
  Synthetic Oligonucleotide; CD80 exon 5; Set A
auuaccagaguugaccucuacagauuagaaugacacaaaa

SEQ ID NO: 55999 - RNA, 36 nt, Artificial Sequence
  Synthetic Oligonucleotide; CD80 exon 5; Set C
uaccagaguugaccucuacagauuagaaugacacaa

SEQ ID NO: 56000 - RNA, 19 nt, Artificial Sequence
  Synthetic Oligonucleotide; CD80 exon 5; Set C
uugaccucuacagauuaga

SEQ ID NO: 56001 - RNA, 17 nt, Artificial Sequence
  Synthetic Oligonucleotide; CD80 exon 5; Set C
ugaccucuacagauuag

SEQ ID NO: 56002 - RNA, 15 nt, Artificial Sequence
  Synthetic Oligonucleotide; CD80 exon 5; Set C
gaccucuacagauua

SEQ ID NO: 56003 - RNA, 39 nt, Artificial Sequence
  Synthetic Oligonucleotide; CD80 exon 5; Set C
auuaccagaguugaccucuacagauuagaaugacacaaa

SEQ ID NO: 56004 - RNA, 37 nt, Artificial Sequence
  Synthetic Oligonucleotide; CD80 exon 5; Set C
uuaccagaguugaccucuacagauuagaaugacacaa

SEQ ID NO: 56005 - RNA, 35 nt, Artificial Sequence
  Synthetic Oligonucleotide; CD80 exon 5; Set C
uaccagaguugaccucuacagauuagaaugacaca

SEQ ID NO: 56006 - RNA, 18 nt, Artificial Sequence
  Synthetic Oligonucleotide; CD80 exon 5; Set C
uugaccucuacagauuag

SEQ ID NO: 56007 - RNA, 16 nt, Artificial Sequence
  Synthetic Oligonucleotide; CD80 exon 5; Set C
ugaccucuacagauua

SEQ ID NO: 56008 - RNA, 38 nt, Artificial Sequence
  Synthetic Oligonucleotide; CD80 exon 5; Set C
auuaccagaguugaccucuacagauuagaaugacacaa

SEQ ID NO: 56009 - RNA, 36 nt, Artificial Sequence
  Synthetic Oligonucleotide; CD80 exon 5; Set C
uuaccagaguugaccucuacagauuagaaugacaca

SEQ ID NO: 56010 - RNA, 17 nt, Artificial Sequence
  Synthetic Oligonucleotide; CD80 exon 5; Set C
uugaccucuacagauua

SEQ ID NO: 56011 - RNA, 15 nt, Artificial Sequence
  Synthetic Oligonucleotide; CD80 exon 5; Set C
ugaccucuacagauu

SEQ ID NO: 56012 - RNA, 37 nt, Artificial Sequence
  Synthetic Oligonucleotide; CD80 exon 5; Set C
auuaccagaguugaccucuacagauuagaaugacaca

SEQ ID NO: 56013 - RNA, 35 nt, Artificial Sequence
  Synthetic Oligonucleotide; CD80 exon 5; Set C
uuaccagaguugaccucuacagauuagaaugacac

SEQ ID NO: 56014 - RNA, 16 nt, Artificial Sequence
  Synthetic Oligonucleotide; CD80 exon 5; Set C
uugaccucuacagauu

SEQ ID NO: 56015 - RNA, 15 nt, Artificial Sequence
  Synthetic Oligonucleotide; CD80 exon 5; Set C
uugaccucuacagau

SEQ ID NO: 56016 - RNA, 29 nt, Artificial Sequence
  Synthetic Oligonucleotide; CD80 exon 5; Set A
uaccagaguugaccucuacagauuagaau

SEQ ID NO: 56017 - RNA, 31 nt, Artificial Sequence
  Synthetic Oligonucleotide; CD80 exon 5; Set A
uuaccagaguugaccucuacagauuagaaug

SEQ ID NO: 56018 - RNA, 30 nt, Artificial Sequence
  Synthetic Oligonucleotide; CD80 exon 5; Set A
uuaccagaguugaccucuacagauuagaau

SEQ ID NO: 56019 - RNA, 28 nt, Artificial Sequence
  Synthetic Oligonucleotide; CD80 exon 5; Set A
uaccagaguugaccucuacagauuagaa

SEQ ID NO: 56020 - RNA, 32 nt, Artificial Sequence
  Synthetic Oligonucleotide; CD80 exon 5; Set A
auuaccagaguugaccucuacagauuagaaug

SEQ ID NO: 56021 - RNA, 27 nt, Artificial Sequence
  Synthetic Oligonucleotide; CD80 exon 5; Set A
uaccagaguugaccucuacagauuaga

SEQ ID NO: 56022 - RNA, 31 nt, Artificial Sequence
  Synthetic Oligonucleotide; CD80 exon 5; Set A
auuaccagaguugaccucuacagauuagaau

SEQ ID NO: 56023 - RNA, 29 nt, Artificial Sequence
  Synthetic Oligonucleotide; CD80 exon 5; Set A
uuaccagaguugaccucuacagauuagaa

SEQ ID NO: 56024 - RNA, 28 nt, Artificial Sequence
  Synthetic Oligonucleotide; CD80 exon 5; Set A
uuaccagaguugaccucuacagauuaga

SEQ ID NO: 56025 - RNA, 26 nt, Artificial Sequence
  Synthetic Oligonucleotide; CD80 exon 5; Set A
uaccagaguugaccucuacagauuag

SEQ ID NO: 56026 - RNA, 30 nt, Artificial Sequence
  Synthetic Oligonucleotide; CD80 exon 5; Set A
auuaccagaguugaccucuacagauuagaa

SEQ ID NO: 56027 - RNA, 27 nt, Artificial Sequence
  Synthetic Oligonucleotide; CD80 exon 5; Set A
uuaccagaguugaccucuacagauuag

SEQ ID NO: 56028 - RNA, 29 nt, Artificial Sequence
  Synthetic Oligonucleotide; CD80 exon 5; Set A
auuaccagaguugaccucuacagauuaga

SEQ ID NO: 56029 - RNA, 25 nt, Artificial Sequence
  Synthetic Oligonucleotide; CD80 exon 5; Set A
uaccagaguugaccucuacagauua

SEQ ID NO: 56030 - RNA, 26 nt, Artificial Sequence
  Synthetic Oligonucleotide; CD80 exon 5; Set A
uuaccagaguugaccucuacagauua

SEQ ID NO: 56031 - RNA, 28 nt, Artificial Sequence
  Synthetic Oligonucleotide; CD80 exon 5; Set A
auuaccagaguugaccucuacagauuag

SEQ ID NO: 56032 - RNA, 24 nt, Artificial Sequence
  Synthetic Oligonucleotide; CD80 exon 5; Set A
uaccagaguugaccucuacagauu

SEQ ID NO: 56033 - RNA, 25 nt, Artificial Sequence
  Synthetic Oligonucleotide; CD80 exon 5; Set A
uuaccagaguugaccucuacagauu

SEQ ID NO: 56034 - RNA, 27 nt, Artificial Sequence
  Synthetic Oligonucleotide; CD80 exon 5; Set A
auuaccagaguugaccucuacagauua

SEQ ID NO: 56035 - RNA, 23 nt, Artificial Sequence
  Synthetic Oligonucleotide; CD80 exon 5; Set A
uaccagaguugaccucuacagau

SEQ ID NO: 56036 - RNA, 26 nt, Artificial Sequence
  Synthetic Oligonucleotide; CD80 exon 5; Set A
auuaccagaguugaccucuacagauu

SEQ ID NO: 56037 - RNA, 22 nt, Artificial Sequence
  Synthetic Oligonucleotide; CD80 exon 5; Set A
uaccagaguugaccucuacaga

SEQ ID NO: 56038 - RNA, 24 nt, Artificial Sequence
  Synthetic Oligonucleotide; CD80 exon 5; Set A
uuaccagaguugaccucuacagau

SEQ ID NO: 56039 - RNA, 23 nt, Artificial Sequence
  Synthetic Oligonucleotide; CD80 exon 5; Set A
uuaccagaguugaccucuacaga

SEQ ID NO: 56040 - RNA, 21 nt, Artificial Sequence
  Synthetic Oligonucleotide; CD80 exon 5; Set C
uaccagaguugaccucuacag

SEQ ID NO: 56041 - RNA, 25 nt, Artificial Sequence
  Synthetic Oligonucleotide; CD80 exon 5; Set A
auuaccagaguugaccucuacagau

SEQ ID NO: 56042 - RNA, 22 nt, Artificial Sequence
  Synthetic Oligonucleotide; CD80 exon 5; Set C
uuaccagaguugaccucuacag

SEQ ID NO: 56043 - RNA, 24 nt, Artificial Sequence
  Synthetic Oligonucleotide; CD80 exon 5; Set A
auuaccagaguugaccucuacaga

SEQ ID NO: 56044 - RNA, 23 nt, Artificial Sequence
  Synthetic Oligonucleotide; CD80 exon 5; Set C
auuaccagaguugaccucuacag

SEQ ID NO: 56045 - RNA, 40 nt, Artificial Sequence
  Synthetic Oligonucleotide; CD80 exon 5; Set C
caucaagugauuaccagaguugaccucuacagauuagaau

SEQ ID NO: 56046 - RNA, 39 nt, Artificial Sequence
  Synthetic Oligonucleotide; CD80 exon 5; Set C
caucaagugauuaccagaguugaccucuacagauuagaa

SEQ ID NO: 56047 - RNA, 38 nt, Artificial Sequence
  Synthetic Oligonucleotide; CD80 exon 5; Set C
caucaagugauuaccagaguugaccucuacagauuaga

SEQ ID NO: 56048 - RNA, 40 nt, Artificial Sequence
  Synthetic Oligonucleotide; CD80 exon 5; Set C
acaucaagugauuaccagaguugaccucuacagauuagaa

SEQ ID NO: 56049 - RNA, 39 nt, Artificial Sequence
  Synthetic Oligonucleotide; CD80 exon 5; Set C
acaucaagugauuaccagaguugaccucuacagauuaga

SEQ ID NO: 56050 - RNA, 37 nt, Artificial Sequence
  Synthetic Oligonucleotide; CD80 exon 5; Set A
caucaagugauuaccagaguugaccucuacagauuag

SEQ ID NO: 56051 - RNA, 40 nt, Artificial Sequence
  Synthetic Oligonucleotide; CD80 exon 5; Set C
gacaucaagugauuaccagaguugaccucuacagauuaga

SEQ ID NO: 56052 - RNA, 38 nt, Artificial Sequence
  Synthetic Oligonucleotide; CD80 exon 5; Set C
acaucaagugauuaccagaguugaccucuacagauuag

SEQ ID NO: 56053 - RNA, 36 nt, Artificial Sequence
  Synthetic Oligonucleotide; CD80 exon 5; Set C
caucaagugauuaccagaguugaccucuacagauua

SEQ ID NO: 56054 - RNA, 39 nt, Artificial Sequence
  Synthetic Oligonucleotide; CD80 exon 5; Set C
gacaucaagugauuaccagaguugaccucuacagauuag

SEQ ID NO: 56055 - RNA, 37 nt, Artificial Sequence
  Synthetic Oligonucleotide; CD80 exon 5; Set C
acaucaagugauuaccagaguugaccucuacagauua

SEQ ID NO: 56056 - RNA, 38 nt, Artificial Sequence
  Synthetic Oligonucleotide; CD80 exon 5; Set C
gacaucaagugauuaccagaguugaccucuacagauua

SEQ ID NO: 56057 - RNA, 40 nt, Artificial Sequence
  Synthetic Oligonucleotide; CD80 exon 5; Set C
agacaucaagugauuaccagaguugaccucuacagauuag

SEQ ID NO: 56058 - RNA, 36 nt, Artificial Sequence
  Synthetic Oligonucleotide; CD80 exon 5; Set C
acaucaagugauuaccagaguugaccucuacagauu

SEQ ID NO: 56059 - RNA, 37 nt, Artificial Sequence
  Synthetic Oligonucleotide; CD80 exon 5; Set C
gacaucaagugauuaccagaguugaccucuacagauu

SEQ ID NO: 56060 - RNA, 39 nt, Artificial Sequence
  Synthetic Oligonucleotide; CD80 exon 5; Set C
agacaucaagugauuaccagaguugaccucuacagauua

SEQ ID NO: 56061 - RNA, 35 nt, Artificial Sequence
  Synthetic Oligonucleotide; CD80 exon 5; Set C
acaucaagugauuaccagaguugaccucuacagau

SEQ ID NO: 56062 - RNA, 15 nt, Artificial Sequence
  Synthetic Oligonucleotide; CD80 exon 5; Set C
auuaccagaguugac

SEQ ID NO: 56063 - RNA, 38 nt, Artificial Sequence
  Synthetic Oligonucleotide; CD80 exon 5; Set C
agacaucaagugauuaccagaguugaccucuacagauu

SEQ ID NO: 56064 - RNA, 34 nt, Artificial Sequence
  Synthetic Oligonucleotide; CD80 exon 5; Set C
acaucaagugauuaccagaguugaccucuacaga

SEQ ID NO: 56065 - RNA, 40 nt, Artificial Sequence
  Synthetic Oligonucleotide; CD80 exon 5; Set C
gagacaucaagugauuaccagaguugaccucuacagauua

SEQ ID NO: 56066 - RNA, 36 nt, Artificial Sequence
  Synthetic Oligonucleotide; CD80 exon 5; Set C
gacaucaagugauuaccagaguugaccucuacagau

SEQ ID NO: 56067 - RNA, 35 nt, Artificial Sequence
  Synthetic Oligonucleotide; CD80 exon 5; Set C
gacaucaagugauuaccagaguugaccucuacaga

SEQ ID NO: 56068 - RNA, 33 nt, Artificial Sequence
  Synthetic Oligonucleotide; CD80 exon 5; Set A
acaucaagugauuaccagaguugaccucuacag

SEQ ID NO: 56069 - RNA, 37 nt, Artificial Sequence
  Synthetic Oligonucleotide; CD80 exon 5; Set C
agacaucaagugauuaccagaguugaccucuacagau

SEQ ID NO: 56070 - RNA, 34 nt, Artificial Sequence
  Synthetic Oligonucleotide; CD80 exon 5; Set C
gacaucaagugauuaccagaguugaccucuacag

SEQ ID NO: 56071 - RNA, 36 nt, Artificial Sequence
  Synthetic Oligonucleotide; CD80 exon 5; Set C
agacaucaagugauuaccagaguugaccucuacaga

SEQ ID NO: 56072 - RNA, 35 nt, Artificial Sequence
  Synthetic Oligonucleotide; CD80 exon 5; Set C
agacaucaagugauuaccagaguugaccucuacag

SEQ ID NO: 56073 - RNA, 40 nt, Artificial Sequence
  Synthetic Oligonucleotide; CD80 exon 5; Set C
aauggagacaucaagugauuaccagaguugaccucuacag

SEQ ID NO: 56074 - RNA, 24 nt, Artificial Sequence
  Synthetic Oligonucleotide; CD80 exon 5; Set C
caucaagugauuaccagaguugac

SEQ ID NO: 56075 - RNA, 23 nt, Artificial Sequence
  Synthetic Oligonucleotide; CD80 exon 5; Set C
caucaagugauuaccagaguuga

SEQ ID NO: 56076 - RNA, 25 nt, Artificial Sequence
  Synthetic Oligonucleotide; CD80 exon 5; Set C
acaucaagugauuaccagaguugac

SEQ ID NO: 56077 - RNA, 24 nt, Artificial Sequence
  Synthetic Oligonucleotide; CD80 exon 5; Set C
acaucaagugauuaccagaguuga

SEQ ID NO: 56078 - RNA, 22 nt, Artificial Sequence
  Synthetic Oligonucleotide; CD80 exon 5; Set C
caucaagugauuaccagaguug

SEQ ID NO: 56079 - RNA, 26 nt, Artificial Sequence
  Synthetic Oligonucleotide; CD80 exon 5; Set A
gacaucaagugauuaccagaguugac

SEQ ID NO: 56080 - RNA, 25 nt, Artificial Sequence
  Synthetic Oligonucleotide; CD80 exon 5; Set A
gacaucaagugauuaccagaguuga

SEQ ID NO: 56081 - RNA, 23 nt, Artificial Sequence
  Synthetic Oligonucleotide; CD80 exon 5; Set C
acaucaagugauuaccagaguug

SEQ ID NO: 56082 - RNA, 27 nt, Artificial Sequence
  Synthetic Oligonucleotide; CD80 exon 5; Set A
agacaucaagugauuaccagaguugac

SEQ ID NO: 56083 - RNA, 24 nt, Artificial Sequence
  Synthetic Oligonucleotide; CD80 exon 5; Set C
gacaucaagugauuaccagaguug

SEQ ID NO: 56084 - RNA, 26 nt, Artificial Sequence
  Synthetic Oligonucleotide; CD80 exon 5; Set A
agacaucaagugauuaccagaguuga

SEQ ID NO: 56085 - RNA, 28 nt, Artificial Sequence
  Synthetic Oligonucleotide; CD80 exon 5; Set A
gagacaucaagugauuaccagaguugac

SEQ ID NO: 56086 - RNA, 25 nt, Artificial Sequence
  Synthetic Oligonucleotide; CD80 exon 5; Set C
agacaucaagugauuaccagaguug

SEQ ID NO: 56087 - RNA, 27 nt, Artificial Sequence
  Synthetic Oligonucleotide; CD80 exon 5; Set A
gagacaucaagugauuaccagaguuga

SEQ ID NO: 56088 - RNA, 26 nt, Artificial Sequence
  Synthetic Oligonucleotide; CD80 exon 5; Set A
gagacaucaagugauuaccagaguug

SEQ ID NO: 56089 - RNA, 32 nt, Artificial Sequence
  Synthetic Oligonucleotide; CD80 exon 5; Set A
aauggagacaucaagugauuaccagaguugac

SEQ ID NO: 56090 - RNA, 31 nt, Artificial Sequence
  Synthetic Oligonucleotide; CD80 exon 5; Set A
aauggagacaucaagugauuaccagaguuga

SEQ ID NO: 56091 - RNA, 33 nt, Artificial Sequence
  Synthetic Oligonucleotide; CD80 exon 5; Set A
gaauggagacaucaagugauuaccagaguugac

SEQ ID NO: 56092 - RNA, 32 nt, Artificial Sequence
  Synthetic Oligonucleotide; CD80 exon 5; Set A
gaauggagacaucaagugauuaccagaguuga

SEQ ID NO: 56093 - RNA, 30 nt, Artificial Sequence
  Synthetic Oligonucleotide; CD80 exon 5; Set A
aauggagacaucaagugauuaccagaguug

SEQ ID NO: 56094 - RNA, 34 nt, Artificial Sequence
  Synthetic Oligonucleotide; CD80 exon 5; Set A
ugaauggagacaucaagugauuaccagaguugac

SEQ ID NO: 56095 - RNA, 31 nt, Artificial Sequence
  Synthetic Oligonucleotide; CD80 exon 5; Set A
gaauggagacaucaagugauuaccagaguug

SEQ ID NO: 56096 - RNA, 33 nt, Artificial Sequence
  Synthetic Oligonucleotide; CD80 exon 5; Set A
ugaauggagacaucaagugauuaccagaguuga

SEQ ID NO: 56097 - RNA, 35 nt, Artificial Sequence
  Synthetic Oligonucleotide; CD80 exon 5; Set A
uugaauggagacaucaagugauuaccagaguugac

SEQ ID NO: 56098 - RNA, 32 nt, Artificial Sequence
  Synthetic Oligonucleotide; CD80 exon 5; Set A
ugaauggagacaucaagugauuaccagaguug

SEQ ID NO: 56099 - RNA, 34 nt, Artificial Sequence
  Synthetic Oligonucleotide; CD80 exon 5; Set A
uugaauggagacaucaagugauuaccagaguuga

SEQ ID NO: 56100 - RNA, 36 nt, Artificial Sequence
  Synthetic Oligonucleotide; CD80 exon 5; Set A
auugaauggagacaucaagugauuaccagaguugac

SEQ ID NO: 56101 - RNA, 33 nt, Artificial Sequence
  Synthetic Oligonucleotide; CD80 exon 5; Set A
uugaauggagacaucaagugauuaccagaguug

SEQ ID NO: 56102 - RNA, 35 nt, Artificial Sequence
  Synthetic Oligonucleotide; CD80 exon 5; Set A
auugaauggagacaucaagugauuaccagaguuga

SEQ ID NO: 56103 - RNA, 37 nt, Artificial Sequence
  Synthetic Oligonucleotide; CD80 exon 5; Set A
gauugaauggagacaucaagugauuaccagaguugac

SEQ ID NO: 56104 - RNA, 36 nt, Artificial Sequence
  Synthetic Oligonucleotide; CD80 exon 5; Set A
gauugaauggagacaucaagugauuaccagaguuga

SEQ ID NO: 56105 - RNA, 18 nt, Artificial Sequence
  Synthetic Oligonucleotide; CD80 exon 5; Set C
gagacaucaagugauuac

SEQ ID NO: 56106 - RNA, 35 nt, Artificial Sequence
  Synthetic Oligonucleotide; CD80 exon 5; Set A
gauugaauggagacaucaagugauuaccagaguug

SEQ ID NO: 56107 - RNA, 17 nt, Artificial Sequence
  Synthetic Oligonucleotide; CD80 exon 5; Set C
gagacaucaagugauua

SEQ ID NO: 56108 - RNA, 16 nt, Artificial Sequence
  Synthetic Oligonucleotide; CD80 exon 5; Set C
gagacaucaagugauu

SEQ ID NO: 56109 - RNA, 22 nt, Artificial Sequence
  Synthetic Oligonucleotide; CD80 exon 5; Set C
aauggagacaucaagugauuac

SEQ ID NO: 56110 - RNA, 20 nt, Artificial Sequence
  Synthetic Oligonucleotide; CD80 exon 5; Set C
aauggagacaucaagugauu

SEQ ID NO: 56111 - RNA, 24 nt, Artificial Sequence
  Synthetic Oligonucleotide; CD80 exon 5; Set C
ugaauggagacaucaagugauuac

SEQ ID NO: 56112 - RNA, 23 nt, Artificial Sequence
  Synthetic Oligonucleotide; CD80 exon 5; Set C
ugaauggagacaucaagugauua

SEQ ID NO: 56113 - RNA, 21 nt, Artificial Sequence
  Synthetic Oligonucleotide; CD80 exon 5; Set C
gaauggagacaucaagugauu

SEQ ID NO: 56114 - RNA, 25 nt, Artificial Sequence
  Synthetic Oligonucleotide; CD80 exon 5; Set C
uugaauggagacaucaagugauuac

SEQ ID NO: 56115 - RNA, 19 nt, Artificial Sequence
  Synthetic Oligonucleotide; CD80 exon 5; Set C
aauggagacaucaagugau

SEQ ID NO: 56116 - RNA, 24 nt, Artificial Sequence
  Synthetic Oligonucleotide; CD80 exon 5; Set C
uugaauggagacaucaagugauua

SEQ ID NO: 56117 - RNA, 22 nt, Artificial Sequence
  Synthetic Oligonucleotide; CD80 exon 5; Set C
ugaauggagacaucaagugauu

SEQ ID NO: 56118 - RNA, 26 nt, Artificial Sequence
  Synthetic Oligonucleotide; CD80 exon 5; Set C
auugaauggagacaucaagugauuac

SEQ ID NO: 56119 - RNA, 20 nt, Artificial Sequence
  Synthetic Oligonucleotide; CD80 exon 5; Set C
gaauggagacaucaagugau

SEQ ID NO: 56120 - RNA, 25 nt, Artificial Sequence
  Synthetic Oligonucleotide; CD80 exon 5; Set C
auugaauggagacaucaagugauua

SEQ ID NO: 56121 - RNA, 27 nt, Artificial Sequence
  Synthetic Oligonucleotide; CD80 exon 5; Set C
gauugaauggagacaucaagugauuac

SEQ ID NO: 56122 - RNA, 23 nt, Artificial Sequence
  Synthetic Oligonucleotide; CD80 exon 5; Set C
uugaauggagacaucaagugauu

SEQ ID NO: 56123 - RNA, 26 nt, Artificial Sequence
  Synthetic Oligonucleotide; CD80 exon 5; Set C
gauugaauggagacaucaagugauua

SEQ ID NO: 56124 - RNA, 24 nt, Artificial Sequence
  Synthetic Oligonucleotide; CD80 exon 5; Set C
auugaauggagacaucaagugauu

SEQ ID NO: 56125 - RNA, 25 nt, Artificial Sequence
  Synthetic Oligonucleotide; CD80 exon 5; Set C
gauugaauggagacaucaagugauu

SEQ ID NO: 56126 - RNA, 15 nt, Artificial Sequence
  Synthetic Oligonucleotide; CD80 exon 5; Set C
aauggagacaucaag

SEQ ID NO: 56127 - RNA, 16 nt, Artificial Sequence
  Synthetic Oligonucleotide; CD80 exon 5; Set C
gaauggagacaucaag

SEQ ID NO: 56128 - RNA, 20 nt, Artificial Sequence
  Synthetic Oligonucleotide; CD80 exon 5; Set C
gauugaauggagacaucaag

SEQ ID NO: 56129 - RNA, 35 nt, Artificial Sequence
  Synthetic Oligonucleotide; CD80 exon 5; Set A
aaacaccagauugaauggagacaucaagugauuac

SEQ ID NO: 56130 - RNA, 34 nt, Artificial Sequence
  Synthetic Oligonucleotide; CD80 exon 5; Set A
aaacaccagauugaauggagacaucaagugauua

SEQ ID NO: 56131 - RNA, 37 nt, Artificial Sequence
  Synthetic Oligonucleotide; CD80 exon 5; Set A
uaaaacaccagauugaauggagacaucaagugauuac

SEQ ID NO: 56132 - RNA, 33 nt, Artificial Sequence
  Synthetic Oligonucleotide; CD80 exon 5; Set A
aaacaccagauugaauggagacaucaagugauu

SEQ ID NO: 56133 - RNA, 36 nt, Artificial Sequence
  Synthetic Oligonucleotide; CD80 exon 5; Set A
uaaaacaccagauugaauggagacaucaagugauua

SEQ ID NO: 56134 - RNA, 38 nt, Artificial Sequence
  Synthetic Oligonucleotide; CD80 exon 5; Set A
cuaaaacaccagauugaauggagacaucaagugauuac

SEQ ID NO: 56135 - RNA, 16 nt, Artificial Sequence
  Synthetic Oligonucleotide; CD80 exon 5; Set C
gauugaauggagacau

SEQ ID NO: 56136 - RNA, 37 nt, Artificial Sequence
  Synthetic Oligonucleotide; CD80 exon 5; Set A
cuaaaacaccagauugaauggagacaucaagugauua

SEQ ID NO: 56137 - RNA, 35 nt, Artificial Sequence
  Synthetic Oligonucleotide; CD80 exon 5; Set A
uaaaacaccagauugaauggagacaucaagugauu

SEQ ID NO: 56138 - RNA, 39 nt, Artificial Sequence
  Synthetic Oligonucleotide; CD80 exon 5; Set A
ucuaaaacaccagauugaauggagacaucaagugauuac

SEQ ID NO: 56139 - RNA, 15 nt, Artificial Sequence
  Synthetic Oligonucleotide; CD80 exon 5; Set C
gauugaauggagaca

SEQ ID NO: 56140 - RNA, 33 nt, Artificial Sequence
  Synthetic Oligonucleotide; CD80 exon 5; Set A
aaaacaccagauugaauggagacaucaagugau

SEQ ID NO: 56141 - RNA, 38 nt, Artificial Sequence
  Synthetic Oligonucleotide; CD80 exon 5; Set A
ucuaaaacaccagauugaauggagacaucaagugauua

SEQ ID NO: 56142 - RNA, 40 nt, Artificial Sequence
  Synthetic Oligonucleotide; CD80 exon 5; Set A
cucuaaaacaccagauugaauggagacaucaagugauuac

SEQ ID NO: 56143 - RNA, 36 nt, Artificial Sequence
  Synthetic Oligonucleotide; CD80 exon 5; Set A
cuaaaacaccagauugaauggagacaucaagugauu

SEQ ID NO: 56144 - RNA, 39 nt, Artificial Sequence
  Synthetic Oligonucleotide; CD80 exon 5; Set A
cucuaaaacaccagauugaauggagacaucaagugauua

SEQ ID NO: 56145 - RNA, 37 nt, Artificial Sequence
  Synthetic Oligonucleotide; CD80 exon 5; Set A
ucuaaaacaccagauugaauggagacaucaagugauu

SEQ ID NO: 56146 - RNA, 40 nt, Artificial Sequence
  Synthetic Oligonucleotide; CD80 exon 5; Set A
ucucuaaaacaccagauugaauggagacaucaagugauua

SEQ ID NO: 56147 - RNA, 38 nt, Artificial Sequence
  Synthetic Oligonucleotide; CD80 exon 5; Set A
cucuaaaacaccagauugaauggagacaucaagugauu

SEQ ID NO: 56148 - RNA, 39 nt, Artificial Sequence
  Synthetic Oligonucleotide; CD80 exon 5; Set A
ucucuaaaacaccagauugaauggagacaucaagugauu

SEQ ID NO: 56149 - RNA, 29 nt, Artificial Sequence
  Synthetic Oligonucleotide; CD80 exon 5; Set C
aaaacaccagauugaauggagacaucaag

SEQ ID NO: 56150 - RNA, 40 nt, Artificial Sequence
  Synthetic Oligonucleotide; CD80 exon 5; Set A
uucucuaaaacaccagauugaauggagacaucaagugauu

SEQ ID NO: 56151 - RNA, 30 nt, Artificial Sequence
  Synthetic Oligonucleotide; CD80 exon 5; Set C
uaaaacaccagauugaauggagacaucaag

SEQ ID NO: 56152 - RNA, 40 nt, Artificial Sequence
  Synthetic Oligonucleotide; CD80 exon 5; Set A
uuucucuaaaacaccagauugaauggagacaucaagugau

SEQ ID NO: 56153 - RNA, 26 nt, Artificial Sequence
  Synthetic Oligonucleotide; CD80 exon 5; Set C
aaaacaccagauugaauggagacauc

SEQ ID NO: 56154 - RNA, 23 nt, Artificial Sequence
  Synthetic Oligonucleotide; CD80 exon 5; Set C
aaacaccagauugaauggagaca

SEQ ID NO: 56155 - RNA, 25 nt, Artificial Sequence
  Synthetic Oligonucleotide; CD80 exon 5; Set C
aaaacaccagauugaauggagacau

SEQ ID NO: 56156 - RNA, 22 nt, Artificial Sequence
  Synthetic Oligonucleotide; CD80 exon 5; Set C
aaacaccagauugaauggagac

SEQ ID NO: 56157 - RNA, 26 nt, Artificial Sequence
  Synthetic Oligonucleotide; CD80 exon 5; Set C
uaaaacaccagauugaauggagacau

SEQ ID NO: 56158 - RNA, 21 nt, Artificial Sequence
  Synthetic Oligonucleotide; CD80 exon 5; Set C
aaacaccagauugaauggaga

SEQ ID NO: 56159 - RNA, 25 nt, Artificial Sequence
  Synthetic Oligonucleotide; CD80 exon 5; Set C
uaaaacaccagauugaauggagaca

SEQ ID NO: 56160 - RNA, 27 nt, Artificial Sequence
  Synthetic Oligonucleotide; CD80 exon 5; Set C
cuaaaacaccagauugaauggagacau

SEQ ID NO: 56161 - RNA, 35 nt, Artificial Sequence
  Synthetic Oligonucleotide; CD80 exon 5; Set A
uucucuaaaacaccagauugaauggagacaucaag

SEQ ID NO: 56162 - RNA, 24 nt, Artificial Sequence
  Synthetic Oligonucleotide; CD80 exon 5; Set C
uaaaacaccagauugaauggagac

SEQ ID NO: 56163 - RNA, 26 nt, Artificial Sequence
  Synthetic Oligonucleotide; CD80 exon 5; Set C
cuaaaacaccagauugaauggagaca

SEQ ID NO: 56164 - RNA, 28 nt, Artificial Sequence
  Synthetic Oligonucleotide; CD80 exon 5; Set C
ucuaaaacaccagauugaauggagacau

SEQ ID NO: 56165 - RNA, 36 nt, Artificial Sequence
  Synthetic Oligonucleotide; CD80 exon 5; Set A
uuucucuaaaacaccagauugaauggagacaucaag

SEQ ID NO: 56166 - RNA, 25 nt, Artificial Sequence
  Synthetic Oligonucleotide; CD80 exon 5; Set C
cuaaaacaccagauugaauggagac

SEQ ID NO: 56167 - RNA, 23 nt, Artificial Sequence
  Synthetic Oligonucleotide; CD80 exon 5; Set C
uaaaacaccagauugaauggaga

SEQ ID NO: 56168 - RNA, 27 nt, Artificial Sequence
  Synthetic Oligonucleotide; CD80 exon 5; Set C
ucuaaaacaccagauugaauggagaca

SEQ ID NO: 56169 - RNA, 29 nt, Artificial Sequence
  Synthetic Oligonucleotide; CD80 exon 5; Set A
cucuaaaacaccagauugaauggagacau

SEQ ID NO: 56170 - RNA, 21 nt, Artificial Sequence
  Synthetic Oligonucleotide; CD80 exon 5; Set C
aaaacaccagauugaauggag

SEQ ID NO: 56171 - RNA, 37 nt, Artificial Sequence
  Synthetic Oligonucleotide; CD80 exon 5; Set A
uuuucucuaaaacaccagauugaauggagacaucaag

SEQ ID NO: 56172 - RNA, 26 nt, Artificial Sequence
  Synthetic Oligonucleotide; CD80 exon 5; Set C
ucuaaaacaccagauugaauggagac

SEQ ID NO: 56173 - RNA, 24 nt, Artificial Sequence
  Synthetic Oligonucleotide; CD80 exon 5; Set C
cuaaaacaccagauugaauggaga

SEQ ID NO: 56174 - RNA, 28 nt, Artificial Sequence
  Synthetic Oligonucleotide; CD80 exon 5; Set A
cucuaaaacaccagauugaauggagaca

SEQ ID NO: 56175 - RNA, 30 nt, Artificial Sequence
  Synthetic Oligonucleotide; CD80 exon 5; Set A
ucucuaaaacaccagauugaauggagacau

SEQ ID NO: 56176 - RNA, 38 nt, Artificial Sequence
  Synthetic Oligonucleotide; CD80 exon 5; Set A
uuuuucucuaaaacaccagauugaauggagacaucaag

SEQ ID NO: 56177 - RNA, 27 nt, Artificial Sequence
  Synthetic Oligonucleotide; CD80 exon 5; Set C
cucuaaaacaccagauugaauggagac

SEQ ID NO: 56178 - RNA, 25 nt, Artificial Sequence
  Synthetic Oligonucleotide; CD80 exon 5; Set C
ucuaaaacaccagauugaauggaga

SEQ ID NO: 56179 - RNA, 29 nt, Artificial Sequence
  Synthetic Oligonucleotide; CD80 exon 5; Set A
ucucuaaaacaccagauugaauggagaca

SEQ ID NO: 56180 - RNA, 31 nt, Artificial Sequence
  Synthetic Oligonucleotide; CD80 exon 5; Set A
uucucuaaaacaccagauugaauggagacau

SEQ ID NO: 56181 - RNA, 39 nt, Artificial Sequence
  Synthetic Oligonucleotide; CD80 exon 5; Set A
uuuuuucucuaaaacaccagauugaauggagacaucaag

SEQ ID NO: 56182 - RNA, 28 nt, Artificial Sequence
  Synthetic Oligonucleotide; CD80 exon 5; Set C
ucucuaaaacaccagauugaauggagac

SEQ ID NO: 56183 - RNA, 26 nt, Artificial Sequence
  Synthetic Oligonucleotide; CD80 exon 5; Set C
cucuaaaacaccagauugaauggaga

SEQ ID NO: 56184 - RNA, 30 nt, Artificial Sequence
  Synthetic Oligonucleotide; CD80 exon 5; Set A
uucucuaaaacaccagauugaauggagaca

SEQ ID NO: 56185 - RNA, 32 nt, Artificial Sequence
  Synthetic Oligonucleotide; CD80 exon 5; Set A
uuucucuaaaacaccagauugaauggagacau

SEQ ID NO: 56186 - RNA, 40 nt, Artificial Sequence
  Synthetic Oligonucleotide; CD80 exon 5; Set A
cuuuuuucucuaaaacaccagauugaauggagacaucaag

SEQ ID NO: 56187 - RNA, 29 nt, Artificial Sequence
  Synthetic Oligonucleotide; CD80 exon 5; Set A
uucucuaaaacaccagauugaauggagac

SEQ ID NO: 56188 - RNA, 27 nt, Artificial Sequence
  Synthetic Oligonucleotide; CD80 exon 5; Set C
ucucuaaaacaccagauugaauggaga

SEQ ID NO: 56189 - RNA, 31 nt, Artificial Sequence
  Synthetic Oligonucleotide; CD80 exon 5; Set A
uuucucuaaaacaccagauugaauggagaca

SEQ ID NO: 56190 - RNA, 17 nt, Artificial Sequence
  Synthetic Oligonucleotide; CD80 exon 5; Set C
aaaacaccagauugaau

SEQ ID NO: 56191 - RNA, 33 nt, Artificial Sequence
  Synthetic Oligonucleotide; CD80 exon 5; Set A
uuuucucuaaaacaccagauugaauggagacau

SEQ ID NO: 56192 - RNA, 30 nt, Artificial Sequence
  Synthetic Oligonucleotide; CD80 exon 5; Set A
uuucucuaaaacaccagauugaauggagac

SEQ ID NO: 56193 - RNA, 28 nt, Artificial Sequence
  Synthetic Oligonucleotide; CD80 exon 5; Set C
uucucuaaaacaccagauugaauggaga

SEQ ID NO: 56194 - RNA, 32 nt, Artificial Sequence
  Synthetic Oligonucleotide; CD80 exon 5; Set A
uuuucucuaaaacaccagauugaauggagaca

SEQ ID NO: 56195 - RNA, 16 nt, Artificial Sequence
  Synthetic Oligonucleotide; CD80 exon 5; Set C
aaaacaccagauugaa

SEQ ID NO: 56196 - RNA, 18 nt, Artificial Sequence
  Synthetic Oligonucleotide; CD80 exon 5; Set C
uaaaacaccagauugaau

SEQ ID NO: 56197 - RNA, 34 nt, Artificial Sequence
  Synthetic Oligonucleotide; CD80 exon 5; Set A
uuuuucucuaaaacaccagauugaauggagacau

SEQ ID NO: 56198 - RNA, 31 nt, Artificial Sequence
  Synthetic Oligonucleotide; CD80 exon 5; Set A
uuuucucuaaaacaccagauugaauggagac

SEQ ID NO: 56199 - RNA, 29 nt, Artificial Sequence
  Synthetic Oligonucleotide; CD80 exon 5; Set C
uuucucuaaaacaccagauugaauggaga

SEQ ID NO: 56200 - RNA, 33 nt, Artificial Sequence
  Synthetic Oligonucleotide; CD80 exon 5; Set A
uuuuucucuaaaacaccagauugaauggagaca

SEQ ID NO: 56201 - RNA, 17 nt, Artificial Sequence
  Synthetic Oligonucleotide; CD80 exon 5; Set C
uaaaacaccagauugaa

SEQ ID NO: 56202 - RNA, 19 nt, Artificial Sequence
  Synthetic Oligonucleotide; CD80 exon 5; Set C
cuaaaacaccagauugaau

SEQ ID NO: 56203 - RNA, 15 nt, Artificial Sequence
  Synthetic Oligonucleotide; CD80 exon 5; Set C
aaaacaccagauuga

SEQ ID NO: 56204 - RNA, 35 nt, Artificial Sequence
  Synthetic Oligonucleotide; CD80 exon 5; Set A
uuuuuucucuaaaacaccagauugaauggagacau

SEQ ID NO: 56205 - RNA, 27 nt, Artificial Sequence
  Synthetic Oligonucleotide; CD80 exon 5; Set C
uucucuaaaacaccagauugaauggag

SEQ ID NO: 56206 - RNA, 32 nt, Artificial Sequence
  Synthetic Oligonucleotide; CD80 exon 5; Set A
uuuuucucuaaaacaccagauugaauggagac

SEQ ID NO: 56207 - RNA, 30 nt, Artificial Sequence
  Synthetic Oligonucleotide; CD80 exon 5; Set C
uuuucucuaaaacaccagauugaauggaga

SEQ ID NO: 56208 - RNA, 34 nt, Artificial Sequence
  Synthetic Oligonucleotide; CD80 exon 5; Set A
uuuuuucucuaaaacaccagauugaauggagaca

SEQ ID NO: 56209 - RNA, 18 nt, Artificial Sequence
  Synthetic Oligonucleotide; CD80 exon 5; Set C
cuaaaacaccagauugaa

SEQ ID NO: 56210 - RNA, 20 nt, Artificial Sequence
  Synthetic Oligonucleotide; CD80 exon 5; Set C
ucuaaaacaccagauugaau

SEQ ID NO: 56211 - RNA, 16 nt, Artificial Sequence
  Synthetic Oligonucleotide; CD80 exon 5; Set C
uaaaacaccagauuga

SEQ ID NO: 56212 - RNA, 36 nt, Artificial Sequence
  Synthetic Oligonucleotide; CD80 exon 5; Set A
cuuuuuucucuaaaacaccagauugaauggagacau

SEQ ID NO: 56213 - RNA, 28 nt, Artificial Sequence
  Synthetic Oligonucleotide; CD80 exon 5; Set C
uuucucuaaaacaccagauugaauggag

SEQ ID NO: 56214 - RNA, 33 nt, Artificial Sequence
  Synthetic Oligonucleotide; CD80 exon 5; Set A
uuuuuucucuaaaacaccagauugaauggagac

SEQ ID NO: 56215 - RNA, 31 nt, Artificial Sequence
  Synthetic Oligonucleotide; CD80 exon 5; Set C
uuuuucucuaaaacaccagauugaauggaga

SEQ ID NO: 56216 - RNA, 35 nt, Artificial Sequence
  Synthetic Oligonucleotide; CD80 exon 5; Set A
cuuuuuucucuaaaacaccagauugaauggagaca

SEQ ID NO: 56217 - RNA, 19 nt, Artificial Sequence
  Synthetic Oligonucleotide; CD80 exon 5; Set C
ucuaaaacaccagauugaa

SEQ ID NO: 56218 - RNA, 21 nt, Artificial Sequence
  Synthetic Oligonucleotide; CD80 exon 5; Set C
cucuaaaacaccagauugaau

SEQ ID NO: 56219 - RNA, 17 nt, Artificial Sequence
  Synthetic Oligonucleotide; CD80 exon 5; Set C
cuaaaacaccagauuga

SEQ ID NO: 56220 - RNA, 37 nt, Artificial Sequence
  Synthetic Oligonucleotide; CD80 exon 5; Set A
ucuuuuuucucuaaaacaccagauugaauggagacau

SEQ ID NO: 56221 - RNA, 29 nt, Artificial Sequence
  Synthetic Oligonucleotide; CD80 exon 5; Set C
uuuucucuaaaacaccagauugaauggag

SEQ ID NO: 56222 - RNA, 34 nt, Artificial Sequence
  Synthetic Oligonucleotide; CD80 exon 5; Set A
cuuuuuucucuaaaacaccagauugaauggagac

SEQ ID NO: 56223 - RNA, 32 nt, Artificial Sequence
  Synthetic Oligonucleotide; CD80 exon 5; Set A
uuuuuucucuaaaacaccagauugaauggaga

SEQ ID NO: 56224 - RNA, 36 nt, Artificial Sequence
  Synthetic Oligonucleotide; CD80 exon 5; Set A
ucuuuuuucucuaaaacaccagauugaauggagaca

SEQ ID NO: 56225 - RNA, 20 nt, Artificial Sequence
  Synthetic Oligonucleotide; CD80 exon 5; Set C
cucuaaaacaccagauugaa

SEQ ID NO: 56226 - RNA, 22 nt, Artificial Sequence
  Synthetic Oligonucleotide; CD80 exon 5; Set C
ucucuaaaacaccagauugaau

SEQ ID NO: 56227 - RNA, 18 nt, Artificial Sequence
  Synthetic Oligonucleotide; CD80 exon 5; Set C
ucuaaaacaccagauuga

SEQ ID NO: 56228 - RNA, 38 nt, Artificial Sequence
  Synthetic Oligonucleotide; CD80 exon 5; Set A
uucuuuuuucucuaaaacaccagauugaauggagacau

SEQ ID NO: 56229 - RNA, 30 nt, Artificial Sequence
  Synthetic Oligonucleotide; CD80 exon 5; Set C
uuuuucucuaaaacaccagauugaauggag

SEQ ID NO: 56230 - RNA, 40 nt, Artificial Sequence
  Synthetic Oligonucleotide; CD80 exon 5; Set A
uuucuuuuuucucuaaaacaccagauugaauggagacauc

SEQ ID NO: 56231 - RNA, 35 nt, Artificial Sequence
  Synthetic Oligonucleotide; CD80 exon 5; Set A
ucuuuuuucucuaaaacaccagauugaauggagac

SEQ ID NO: 56232 - RNA, 33 nt, Artificial Sequence
  Synthetic Oligonucleotide; CD80 exon 5; Set A
cuuuuuucucuaaaacaccagauugaauggaga

SEQ ID NO: 56233 - RNA, 37 nt, Artificial Sequence
  Synthetic Oligonucleotide; CD80 exon 5; Set A
uucuuuuuucucuaaaacaccagauugaauggagaca

SEQ ID NO: 56234 - RNA, 21 nt, Artificial Sequence
  Synthetic Oligonucleotide; CD80 exon 5; Set C
ucucuaaaacaccagauugaa

SEQ ID NO: 56235 - RNA, 23 nt, Artificial Sequence
  Synthetic Oligonucleotide; CD80 exon 5; Set C
uucucuaaaacaccagauugaau

SEQ ID NO: 56236 - RNA, 19 nt, Artificial Sequence
  Synthetic Oligonucleotide; CD80 exon 5; Set C
cucuaaaacaccagauuga

SEQ ID NO: 56237 - RNA, 39 nt, Artificial Sequence
  Synthetic Oligonucleotide; CD80 exon 5; Set A
uuucuuuuuucucuaaaacaccagauugaauggagacau

SEQ ID NO: 56238 - RNA, 31 nt, Artificial Sequence
  Synthetic Oligonucleotide; CD80 exon 5; Set C
uuuuuucucuaaaacaccagauugaauggag

SEQ ID NO: 56239 - RNA, 36 nt, Artificial Sequence
  Synthetic Oligonucleotide; CD80 exon 5; Set A
uucuuuuuucucuaaaacaccagauugaauggagac

SEQ ID NO: 56240 - RNA, 34 nt, Artificial Sequence
  Synthetic Oligonucleotide; CD80 exon 5; Set A
ucuuuuuucucuaaaacaccagauugaauggaga

SEQ ID NO: 56241 - RNA, 38 nt, Artificial Sequence
  Synthetic Oligonucleotide; CD80 exon 5; Set A
uuucuuuuuucucuaaaacaccagauugaauggagaca

SEQ ID NO: 56242 - RNA, 22 nt, Artificial Sequence
  Synthetic Oligonucleotide; CD80 exon 5; Set C
uucucuaaaacaccagauugaa

SEQ ID NO: 56243 - RNA, 24 nt, Artificial Sequence
  Synthetic Oligonucleotide; CD80 exon 5; Set C
uuucucuaaaacaccagauugaau

SEQ ID NO: 56244 - RNA, 20 nt, Artificial Sequence
  Synthetic Oligonucleotide; CD80 exon 5; Set C
ucucuaaaacaccagauuga

SEQ ID NO: 56245 - RNA, 40 nt, Artificial Sequence
  Synthetic Oligonucleotide; CD80 exon 5; Set A
uuuucuuuuuucucuaaaacaccagauugaauggagacau

SEQ ID NO: 56246 - RNA, 32 nt, Artificial Sequence
  Synthetic Oligonucleotide; CD80 exon 5; Set C
cuuuuuucucuaaaacaccagauugaauggag

SEQ ID NO: 56247 - RNA, 37 nt, Artificial Sequence
  Synthetic Oligonucleotide; CD80 exon 5; Set A
uuucuuuuuucucuaaaacaccagauugaauggagac

SEQ ID NO: 56248 - RNA, 35 nt, Artificial Sequence
  Synthetic Oligonucleotide; CD80 exon 5; Set A
uucuuuuuucucuaaaacaccagauugaauggaga

SEQ ID NO: 56249 - RNA, 39 nt, Artificial Sequence
  Synthetic Oligonucleotide; CD80 exon 5; Set A
uuuucuuuuuucucuaaaacaccagauugaauggagaca

SEQ ID NO: 56250 - RNA, 23 nt, Artificial Sequence
  Synthetic Oligonucleotide; CD80 exon 5; Set C
uuucucuaaaacaccagauugaa

SEQ ID NO: 56251 - RNA, 25 nt, Artificial Sequence
  Synthetic Oligonucleotide; CD80 exon 5; Set C
uuuucucuaaaacaccagauugaau

SEQ ID NO: 56252 - RNA, 15 nt, Artificial Sequence
  Synthetic Oligonucleotide; CD80 exon 5; Set C
ucuaaaacaccagau

SEQ ID NO: 56253 - RNA, 21 nt, Artificial Sequence
  Synthetic Oligonucleotide; CD80 exon 5; Set C
uucucuaaaacaccagauuga

SEQ ID NO: 56254 - RNA, 33 nt, Artificial Sequence
  Synthetic Oligonucleotide; CD80 exon 5; Set A
ucuuuuuucucuaaaacaccagauugaauggag

SEQ ID NO: 56255 - RNA, 36 nt, Artificial Sequence
  Synthetic Oligonucleotide; CD80 exon 5; Set A
uuucuuuuuucucuaaaacaccagauugaauggaga

SEQ ID NO: 56256 - RNA, 40 nt, Artificial Sequence
  Synthetic Oligonucleotide; CD80 exon 5; Set A
uuuuucuuuuuucucuaaaacaccagauugaauggagaca

SEQ ID NO: 56257 - RNA, 24 nt, Artificial Sequence
  Synthetic Oligonucleotide; CD80 exon 5; Set C
uuuucucuaaaacaccagauugaa

SEQ ID NO: 56258 - RNA, 26 nt, Artificial Sequence
  Synthetic Oligonucleotide; CD80 exon 5; Set C
uuuuucucuaaaacaccagauugaau

SEQ ID NO: 56259 - RNA, 16 nt, Artificial Sequence
  Synthetic Oligonucleotide; CD80 exon 5; Set C
cucuaaaacaccagau

SEQ ID NO: 56260 - RNA, 22 nt, Artificial Sequence
  Synthetic Oligonucleotide; CD80 exon 5; Set C
uuucucuaaaacaccagauuga

SEQ ID NO: 56261 - RNA, 34 nt, Artificial Sequence
  Synthetic Oligonucleotide; CD80 exon 5; Set A
uucuuuuuucucuaaaacaccagauugaauggag

SEQ ID NO: 56262 - RNA, 39 nt, Artificial Sequence
  Synthetic Oligonucleotide; CD80 exon 5; Set A
uuuuucuuuuuucucuaaaacaccagauugaauggagac

SEQ ID NO: 56263 - RNA, 37 nt, Artificial Sequence
  Synthetic Oligonucleotide; CD80 exon 5; Set A
uuuucuuuuuucucuaaaacaccagauugaauggaga

SEQ ID NO: 56264 - RNA, 25 nt, Artificial Sequence
  Synthetic Oligonucleotide; CD80 exon 5; Set C
uuuuucucuaaaacaccagauugaa

SEQ ID NO: 56265 - RNA, 27 nt, Artificial Sequence
  Synthetic Oligonucleotide; CD80 exon 5; Set C
uuuuuucucuaaaacaccagauugaau

SEQ ID NO: 56266 - RNA, 17 nt, Artificial Sequence
  Synthetic Oligonucleotide; CD80 exon 5; Set C
ucucuaaaacaccagau

SEQ ID NO: 56267 - RNA, 23 nt, Artificial Sequence
  Synthetic Oligonucleotide; CD80 exon 5; Set C
uuuucucuaaaacaccagauuga

SEQ ID NO: 56268 - RNA, 35 nt, Artificial Sequence
  Synthetic Oligonucleotide; CD80 exon 5; Set A
uuucuuuuuucucuaaaacaccagauugaauggag

SEQ ID NO: 56269 - RNA, 38 nt, Artificial Sequence
  Synthetic Oligonucleotide; CD80 exon 5; Set A
uuuuucuuuuuucucuaaaacaccagauugaauggaga

SEQ ID NO: 56270 - RNA, 26 nt, Artificial Sequence
  Synthetic Oligonucleotide; CD80 exon 5; Set C
uuuuuucucuaaaacaccagauugaa

SEQ ID NO: 56271 - RNA, 28 nt, Artificial Sequence
  Synthetic Oligonucleotide; CD80 exon 5; Set C
cuuuuuucucuaaaacaccagauugaau

SEQ ID NO: 56272 - RNA, 18 nt, Artificial Sequence
  Synthetic Oligonucleotide; CD80 exon 5; Set C
uucucuaaaacaccagau

SEQ ID NO: 56273 - RNA, 24 nt, Artificial Sequence
  Synthetic Oligonucleotide; CD80 exon 5; Set C
uuuuucucuaaaacaccagauuga

SEQ ID NO: 56274 - RNA, 36 nt, Artificial Sequence
  Synthetic Oligonucleotide; CD80 exon 5; Set A
uuuucuuuuuucucuaaaacaccagauugaauggag

SEQ ID NO: 56275 - RNA, 22 nt, Artificial Sequence
  Synthetic Oligonucleotide; CD80 exon 5; Set C
uuuucucuaaaacaccagauug

SEQ ID NO: 56276 - RNA, 27 nt, Artificial Sequence
  Synthetic Oligonucleotide; CD80 exon 5; Set C
cuuuuuucucuaaaacaccagauugaa

SEQ ID NO: 56277 - RNA, 29 nt, Artificial Sequence
  Synthetic Oligonucleotide; CD80 exon 5; Set C
ucuuuuuucucuaaaacaccagauugaau

SEQ ID NO: 56278 - RNA, 19 nt, Artificial Sequence
  Synthetic Oligonucleotide; CD80 exon 5; Set C
uuucucuaaaacaccagau

SEQ ID NO: 56279 - RNA, 25 nt, Artificial Sequence
  Synthetic Oligonucleotide; CD80 exon 5; Set C
uuuuuucucuaaaacaccagauuga

SEQ ID NO: 56280 - RNA, 23 nt, Artificial Sequence
  Synthetic Oligonucleotide; CD80 exon 5; Set C
uuuuucucuaaaacaccagauug

SEQ ID NO: 56281 - RNA, 28 nt, Artificial Sequence
  Synthetic Oligonucleotide; CD80 exon 5; Set C
ucuuuuuucucuaaaacaccagauugaa

SEQ ID NO: 56282 - RNA, 30 nt, Artificial Sequence
  Synthetic Oligonucleotide; CD80 exon 5; Set C
uucuuuuuucucuaaaacaccagauugaau

SEQ ID NO: 56283 - RNA, 20 nt, Artificial Sequence
  Synthetic Oligonucleotide; CD80 exon 5; Set C
uuuucucuaaaacaccagau

SEQ ID NO: 56284 - RNA, 26 nt, Artificial Sequence
  Synthetic Oligonucleotide; CD80 exon 5; Set C
cuuuuuucucuaaaacaccagauuga

SEQ ID NO: 56285 - RNA, 24 nt, Artificial Sequence
  Synthetic Oligonucleotide; CD80 exon 5; Set C
uuuuuucucuaaaacaccagauug

SEQ ID NO: 56286 - RNA, 29 nt, Artificial Sequence
  Synthetic Oligonucleotide; CD80 exon 5; Set C
uucuuuuuucucuaaaacaccagauugaa

SEQ ID NO: 56287 - RNA, 31 nt, Artificial Sequence
  Synthetic Oligonucleotide; CD80 exon 5; Set C
uuucuuuuuucucuaaaacaccagauugaau

SEQ ID NO: 56288 - RNA, 21 nt, Artificial Sequence
  Synthetic Oligonucleotide; CD80 exon 5; Set C
uuuuucucuaaaacaccagau

SEQ ID NO: 56289 - RNA, 27 nt, Artificial Sequence
  Synthetic Oligonucleotide; CD80 exon 5; Set C
ucuuuuuucucuaaaacaccagauuga

SEQ ID NO: 56290 - RNA, 25 nt, Artificial Sequence
  Synthetic Oligonucleotide; CD80 exon 5; Set C
cuuuuuucucuaaaacaccagauug

SEQ ID NO: 56291 - RNA, 30 nt, Artificial Sequence
  Synthetic Oligonucleotide; CD80 exon 5; Set C
uuucuuuuuucucuaaaacaccagauugaa

SEQ ID NO: 56292 - RNA, 32 nt, Artificial Sequence
  Synthetic Oligonucleotide; CD80 exon 5; Set C
uuuucuuuuuucucuaaaacaccagauugaau

SEQ ID NO: 56293 - RNA, 22 nt, Artificial Sequence
  Synthetic Oligonucleotide; CD80 exon 5; Set C
uuuuuucucuaaaacaccagau

SEQ ID NO: 56294 - RNA, 28 nt, Artificial Sequence
  Synthetic Oligonucleotide; CD80 exon 5; Set C
uucuuuuuucucuaaaacaccagauuga

SEQ ID NO: 56295 - RNA, 26 nt, Artificial Sequence
  Synthetic Oligonucleotide; CD80 exon 5; Set C
ucuuuuuucucuaaaacaccagauug

SEQ ID NO: 56296 - RNA, 31 nt, Artificial Sequence
  Synthetic Oligonucleotide; CD80 exon 5; Set C
uuuucuuuuuucucuaaaacaccagauugaa

SEQ ID NO: 56297 - RNA, 23 nt, Artificial Sequence
  Synthetic Oligonucleotide; CD80 exon 5; Set C
cuuuuuucucuaaaacaccagau

SEQ ID NO: 56298 - RNA, 29 nt, Artificial Sequence
  Synthetic Oligonucleotide; CD80 exon 5; Set C
uuucuuuuuucucuaaaacaccagauuga

SEQ ID NO: 56299 - RNA, 27 nt, Artificial Sequence
  Synthetic Oligonucleotide; CD80 exon 5; Set C
uucuuuuuucucuaaaacaccagauug

SEQ ID NO: 56300 - RNA, 24 nt, Artificial Sequence
  Synthetic Oligonucleotide; CD80 exon 5; Set C
ucuuuuuucucuaaaacaccagau

SEQ ID NO: 56301 - RNA, 30 nt, Artificial Sequence
  Synthetic Oligonucleotide; CD80 exon 5; Set C
uuuucuuuuuucucuaaaacaccagauuga

SEQ ID NO: 56302 - RNA, 28 nt, Artificial Sequence
  Synthetic Oligonucleotide; CD80 exon 5; Set C
uuucuuuuuucucuaaaacaccagauug

SEQ ID NO: 56303 - RNA, 25 nt, Artificial Sequence
  Synthetic Oligonucleotide; CD80 exon 5; Set C
uucuuuuuucucuaaaacaccagau

SEQ ID NO: 56304 - RNA, 29 nt, Artificial Sequence
  Synthetic Oligonucleotide; CD80 exon 5; Set C
uuuucuuuuuucucuaaaacaccagauug

SEQ ID NO: 56305 - RNA, 26 nt, Artificial Sequence
  Synthetic Oligonucleotide; CD80 exon 5; Set C
uuucuuuuuucucuaaaacaccagau

SEQ ID NO: 56306 - RNA, 28 nt, Artificial Sequence
  Synthetic Oligonucleotide; CD80 exon 5; Set C
uuuucuuuuuucucuaaaacaccagauu

SEQ ID NO: 56307 - RNA, 37 nt, Artificial Sequence
  Synthetic Oligonucleotide; CD80 exon 5; Set A
uugguuuuucuuuuuucucuaaaacaccagauugaau

SEQ ID NO: 56308 - RNA, 27 nt, Artificial Sequence
  Synthetic Oligonucleotide; CD80 exon 5; Set C
uuuucuuuuuucucuaaaacaccagau

SEQ ID NO: 56309 - RNA, 36 nt, Artificial Sequence
  Synthetic Oligonucleotide; CD80 exon 5; Set A
uugguuuuucuuuuuucucuaaaacaccagauugaa

SEQ ID NO: 56310 - RNA, 38 nt, Artificial Sequence
  Synthetic Oligonucleotide; CD80 exon 5; Set A
guugguuuuucuuuuuucucuaaaacaccagauugaau

SEQ ID NO: 56311 - RNA, 37 nt, Artificial Sequence
  Synthetic Oligonucleotide; CD80 exon 5; Set A
guugguuuuucuuuuuucucuaaaacaccagauugaa

SEQ ID NO: 56312 - RNA, 39 nt, Artificial Sequence
  Synthetic Oligonucleotide; CD80 exon 5; Set A
aguugguuuuucuuuuuucucuaaaacaccagauugaau

SEQ ID NO: 56313 - RNA, 38 nt, Artificial Sequence
  Synthetic Oligonucleotide; CD80 exon 5; Set A
aguugguuuuucuuuuuucucuaaaacaccagauugaa

SEQ ID NO: 56314 - RNA, 40 nt, Artificial Sequence
  Synthetic Oligonucleotide; CD80 exon 5; Set A
uaguugguuuuucuuuuuucucuaaaacaccagauugaau

SEQ ID NO: 56315 - RNA, 36 nt, Artificial Sequence
  Synthetic Oligonucleotide; CD80 exon 5; Set A
guugguuuuucuuuuuucucuaaaacaccagauuga

SEQ ID NO: 56316 - RNA, 39 nt, Artificial Sequence
  Synthetic Oligonucleotide; CD80 exon 5; Set A
uaguugguuuuucuuuuuucucuaaaacaccagauugaa

SEQ ID NO: 56317 - RNA, 37 nt, Artificial Sequence
  Synthetic Oligonucleotide; CD80 exon 5; Set A
aguugguuuuucuuuuuucucuaaaacaccagauuga

SEQ ID NO: 56318 - RNA, 35 nt, Artificial Sequence
  Synthetic Oligonucleotide; CD80 exon 5; Set A
guugguuuuucuuuuuucucuaaaacaccagauug

SEQ ID NO: 56319 - RNA, 15 nt, Artificial Sequence
  Synthetic Oligonucleotide; CD80 exon 5; Set C
cuuuuuucucuaaaa

SEQ ID NO: 56320 - RNA, 32 nt, Artificial Sequence
  Synthetic Oligonucleotide; CD80 exon 5; Set C
uugguuuuucuuuuuucucuaaaacaccagau

SEQ ID NO: 56321 - RNA, 38 nt, Artificial Sequence
  Synthetic Oligonucleotide; CD80 exon 5; Set A
uaguugguuuuucuuuuuucucuaaaacaccagauuga

SEQ ID NO: 56322 - RNA, 36 nt, Artificial Sequence
  Synthetic Oligonucleotide; CD80 exon 5; Set A
aguugguuuuucuuuuuucucuaaaacaccagauug

SEQ ID NO: 56323 - RNA, 34 nt, Artificial Sequence
  Synthetic Oligonucleotide; CD80 exon 5; Set A
guugguuuuucuuuuuucucuaaaacaccagauu

SEQ ID NO: 56324 - RNA, 16 nt, Artificial Sequence
  Synthetic Oligonucleotide; CD80 exon 5; Set C
ucuuuuuucucuaaaa

SEQ ID NO: 56325 - RNA, 33 nt, Artificial Sequence
  Synthetic Oligonucleotide; CD80 exon 5; Set A
guugguuuuucuuuuuucucuaaaacaccagau

SEQ ID NO: 56326 - RNA, 37 nt, Artificial Sequence
  Synthetic Oligonucleotide; CD80 exon 5; Set A
uaguugguuuuucuuuuuucucuaaaacaccagauug

SEQ ID NO: 56327 - RNA, 35 nt, Artificial Sequence
  Synthetic Oligonucleotide; CD80 exon 5; Set A
aguugguuuuucuuuuuucucuaaaacaccagauu

SEQ ID NO: 56328 - RNA, 17 nt, Artificial Sequence
  Synthetic Oligonucleotide; CD80 exon 5; Set C
uucuuuuuucucuaaaa

SEQ ID NO: 56329 - RNA, 34 nt, Artificial Sequence
  Synthetic Oligonucleotide; CD80 exon 5; Set A
aguugguuuuucuuuuuucucuaaaacaccagau

SEQ ID NO: 56330 - RNA, 18 nt, Artificial Sequence
  Synthetic Oligonucleotide; CD80 exon 5; Set C
uuucuuuuuucucuaaaa

SEQ ID NO: 56331 - RNA, 15 nt, Artificial Sequence
  Synthetic Oligonucleotide; CD80 exon 5; Set C
uucuuuuuucucuaa

SEQ ID NO: 56332 - RNA, 35 nt, Artificial Sequence
  Synthetic Oligonucleotide; CD80 exon 5; Set A
uaguugguuuuucuuuuuucucuaaaacaccagau

SEQ ID NO: 56333 - RNA, 19 nt, Artificial Sequence
  Synthetic Oligonucleotide; CD80 exon 5; Set C
uuuucuuuuuucucuaaaa

SEQ ID NO: 56334 - RNA, 16 nt, Artificial Sequence
  Synthetic Oligonucleotide; CD80 exon 5; Set C
uuucuuuuuucucuaa

SEQ ID NO: 56335 - RNA, 19 nt, Artificial Sequence
  Synthetic Oligonucleotide; CD80 exon 5; Set C
uuuuucuuuuuucucuaaa

SEQ ID NO: 56336 - RNA, 17 nt, Artificial Sequence
  Synthetic Oligonucleotide; CD80 exon 5; Set C
uuuucuuuuuucucuaa

SEQ ID NO: 56337 - RNA, 15 nt, Artificial Sequence
  Synthetic Oligonucleotide; CD80 exon 5; Set C
uuucuuuuuucucua

SEQ ID NO: 56338 - RNA, 20 nt, Artificial Sequence
  Synthetic Oligonucleotide; CD80 exon 5; Set C
guuuuucuuuuuucucuaaa

SEQ ID NO: 56339 - RNA, 18 nt, Artificial Sequence
  Synthetic Oligonucleotide; CD80 exon 5; Set C
uuuuucuuuuuucucuaa

SEQ ID NO: 56340 - RNA, 16 nt, Artificial Sequence
  Synthetic Oligonucleotide; CD80 exon 5; Set C
uuuucuuuuuucucua

SEQ ID NO: 56341 - RNA, 15 nt, Artificial Sequence
  Synthetic Oligonucleotide; CD80 exon 5; Set C
uuuucuuuuuucucu

SEQ ID NO: 56342 - RNA, 39 nt, Artificial Sequence
  Synthetic Oligonucleotide; CD80 exon 5; Set A
aggauaguugguuuuucuuuuuucucuaaaacaccagau

SEQ ID NO: 56343 - RNA, 22 nt, Artificial Sequence
  Synthetic Oligonucleotide; CD80 exon 5; Set C
ugguuuuucuuuuuucucuaaa

SEQ ID NO: 56344 - RNA, 40 nt, Artificial Sequence
  Synthetic Oligonucleotide; CD80 exon 5; Set A
caggauaguugguuuuucuuuuuucucuaaaacaccagau

SEQ ID NO: 56345 - RNA, 23 nt, Artificial Sequence
  Synthetic Oligonucleotide; CD80 exon 5; Set C
uugguuuuucuuuuuucucuaaa

SEQ ID NO: 56346 - RNA, 25 nt, Artificial Sequence
  Synthetic Oligonucleotide; CD80 exon 5; Set C
guugguuuuucuuuuuucucuaaaa

SEQ ID NO: 56347 - RNA, 22 nt, Artificial Sequence
  Synthetic Oligonucleotide; CD80 exon 5; Set C
uugguuuuucuuuuuucucuaa

SEQ ID NO: 56348 - RNA, 26 nt, Artificial Sequence
  Synthetic Oligonucleotide; CD80 exon 5; Set C
aguugguuuuucuuuuuucucuaaaa

SEQ ID NO: 56349 - RNA, 23 nt, Artificial Sequence
  Synthetic Oligonucleotide; CD80 exon 5; Set C
guugguuuuucuuuuuucucuaa

SEQ ID NO: 56350 - RNA, 21 nt, Artificial Sequence
  Synthetic Oligonucleotide; CD80 exon 5; Set C
uugguuuuucuuuuuucucua

SEQ ID NO: 56351 - RNA, 27 nt, Artificial Sequence
  Synthetic Oligonucleotide; CD80 exon 5; Set C
uaguugguuuuucuuuuuucucuaaaa

SEQ ID NO: 56352 - RNA, 24 nt, Artificial Sequence
  Synthetic Oligonucleotide; CD80 exon 5; Set C
aguugguuuuucuuuuuucucuaa

SEQ ID NO: 56353 - RNA, 20 nt, Artificial Sequence
  Synthetic Oligonucleotide; CD80 exon 5; Set C
uugguuuuucuuuuuucucu

SEQ ID NO: 56354 - RNA, 22 nt, Artificial Sequence
  Synthetic Oligonucleotide; CD80 exon 5; Set C
guugguuuuucuuuuuucucua

SEQ ID NO: 56355 - RNA, 25 nt, Artificial Sequence
  Synthetic Oligonucleotide; CD80 exon 5; Set C
uaguugguuuuucuuuuuucucuaa

SEQ ID NO: 56356 - RNA, 21 nt, Artificial Sequence
  Synthetic Oligonucleotide; CD80 exon 5; Set C
guugguuuuucuuuuuucucu

SEQ ID NO: 56357 - RNA, 19 nt, Artificial Sequence
  Synthetic Oligonucleotide; CD80 exon 5; Set C
uugguuuuucuuuuuucuc

SEQ ID NO: 56358 - RNA, 23 nt, Artificial Sequence
  Synthetic Oligonucleotide; CD80 exon 5; Set C
aguugguuuuucuuuuuucucua

SEQ ID NO: 56359 - RNA, 18 nt, Artificial Sequence
  Synthetic Oligonucleotide; CD80 exon 5; Set C
uugguuuuucuuuuuucu

SEQ ID NO: 56360 - RNA, 20 nt, Artificial Sequence
  Synthetic Oligonucleotide; CD80 exon 5; Set C
guugguuuuucuuuuuucuc

SEQ ID NO: 56361 - RNA, 22 nt, Artificial Sequence
  Synthetic Oligonucleotide; CD80 exon 5; Set C
aguugguuuuucuuuuuucucu

SEQ ID NO: 56362 - RNA, 24 nt, Artificial Sequence
  Synthetic Oligonucleotide; CD80 exon 5; Set C
uaguugguuuuucuuuuuucucua

SEQ ID NO: 56363 - RNA, 17 nt, Artificial Sequence
  Synthetic Oligonucleotide; CD80 exon 5; Set C
uugguuuuucuuuuuuc

SEQ ID NO: 56364 - RNA, 19 nt, Artificial Sequence
  Synthetic Oligonucleotide; CD80 exon 5; Set C
guugguuuuucuuuuuucu

SEQ ID NO: 56365 - RNA, 21 nt, Artificial Sequence
  Synthetic Oligonucleotide; CD80 exon 5; Set C
aguugguuuuucuuuuuucuc

SEQ ID NO: 56366 - RNA, 23 nt, Artificial Sequence
  Synthetic Oligonucleotide; CD80 exon 5; Set C
uaguugguuuuucuuuuuucucu

SEQ ID NO: 56367 - RNA, 31 nt, Artificial Sequence
  Synthetic Oligonucleotide; CD80 exon 5; Set C
aggauaguugguuuuucuuuuuucucuaaaa

SEQ ID NO: 56368 - RNA, 16 nt, Artificial Sequence
  Synthetic Oligonucleotide; CD80 exon 5; Set C
uugguuuuucuuuuuu

SEQ ID NO: 56369 - RNA, 18 nt, Artificial Sequence
  Synthetic Oligonucleotide; CD80 exon 5; Set C
guugguuuuucuuuuuuc

SEQ ID NO: 56370 - RNA, 20 nt, Artificial Sequence
  Synthetic Oligonucleotide; CD80 exon 5; Set C
aguugguuuuucuuuuuucu

SEQ ID NO: 56371 - RNA, 22 nt, Artificial Sequence
  Synthetic Oligonucleotide; CD80 exon 5; Set C
uaguugguuuuucuuuuuucuc

SEQ ID NO: 56372 - RNA, 32 nt, Artificial Sequence
  Synthetic Oligonucleotide; CD80 exon 5; Set C
caggauaguugguuuuucuuuuuucucuaaaa

SEQ ID NO: 56373 - RNA, 15 nt, Artificial Sequence
  Synthetic Oligonucleotide; CD80 exon 5; Set C
uugguuuuucuuuuu

SEQ ID NO: 56374 - RNA, 29 nt, Artificial Sequence
  Synthetic Oligonucleotide; CD80 exon 5; Set C
aggauaguugguuuuucuuuuuucucuaa

SEQ ID NO: 56375 - RNA, 19 nt, Artificial Sequence
  Synthetic Oligonucleotide; CD80 exon 5; Set C
aguugguuuuucuuuuuuc

SEQ ID NO: 56376 - RNA, 21 nt, Artificial Sequence
  Synthetic Oligonucleotide; CD80 exon 5; Set C
uaguugguuuuucuuuuuucu

SEQ ID NO: 56377 - RNA, 33 nt, Artificial Sequence
  Synthetic Oligonucleotide; CD80 exon 5; Set C
acaggauaguugguuuuucuuuuuucucuaaaa

SEQ ID NO: 56378 - RNA, 18 nt, Artificial Sequence
  Synthetic Oligonucleotide; CD80 exon 5; Set C
aguugguuuuucuuuuuu

SEQ ID NO: 56379 - RNA, 30 nt, Artificial Sequence
  Synthetic Oligonucleotide; CD80 exon 5; Set C
caggauaguugguuuuucuuuuuucucuaa

SEQ ID NO: 56380 - RNA, 20 nt, Artificial Sequence
  Synthetic Oligonucleotide; CD80 exon 5; Set C
uaguugguuuuucuuuuuuc

SEQ ID NO: 56381 - RNA, 28 nt, Artificial Sequence
  Synthetic Oligonucleotide; CD80 exon 5; Set C
aggauaguugguuuuucuuuuuucucua

SEQ ID NO: 56382 - RNA, 34 nt, Artificial Sequence
  Synthetic Oligonucleotide; CD80 exon 5; Set A
gacaggauaguugguuuuucuuuuuucucuaaaa

SEQ ID NO: 56383 - RNA, 19 nt, Artificial Sequence
  Synthetic Oligonucleotide; CD80 exon 5; Set C
uaguugguuuuucuuuuuu

SEQ ID NO: 56384 - RNA, 31 nt, Artificial Sequence
  Synthetic Oligonucleotide; CD80 exon 5; Set A
acaggauaguugguuuuucuuuuuucucuaa

SEQ ID NO: 56385 - RNA, 27 nt, Artificial Sequence
  Synthetic Oligonucleotide; CD80 exon 5; Set C
aggauaguugguuuuucuuuuuucucu

SEQ ID NO: 56386 - RNA, 29 nt, Artificial Sequence
  Synthetic Oligonucleotide; CD80 exon 5; Set A
caggauaguugguuuuucuuuuuucucua

SEQ ID NO: 56387 - RNA, 35 nt, Artificial Sequence
  Synthetic Oligonucleotide; CD80 exon 5; Set A
agacaggauaguugguuuuucuuuuuucucuaaaa

SEQ ID NO: 56388 - RNA, 18 nt, Artificial Sequence
  Synthetic Oligonucleotide; CD80 exon 5; Set C
uaguugguuuuucuuuuu

SEQ ID NO: 56389 - RNA, 16 nt, Artificial Sequence
  Synthetic Oligonucleotide; CD80 exon 5; Set C
aguugguuuuucuuuu

SEQ ID NO: 56390 - RNA, 32 nt, Artificial Sequence
  Synthetic Oligonucleotide; CD80 exon 5; Set A
gacaggauaguugguuuuucuuuuuucucuaa

SEQ ID NO: 56391 - RNA, 26 nt, Artificial Sequence
  Synthetic Oligonucleotide; CD80 exon 5; Set C
aggauaguugguuuuucuuuuuucuc

SEQ ID NO: 56392 - RNA, 28 nt, Artificial Sequence
  Synthetic Oligonucleotide; CD80 exon 5; Set C
caggauaguugguuuuucuuuuuucucu

SEQ ID NO: 56393 - RNA, 30 nt, Artificial Sequence
  Synthetic Oligonucleotide; CD80 exon 5; Set A
acaggauaguugguuuuucuuuuuucucua

SEQ ID NO: 56394 - RNA, 36 nt, Artificial Sequence
  Synthetic Oligonucleotide; CD80 exon 5; Set A
aagacaggauaguugguuuuucuuuuuucucuaaaa

SEQ ID NO: 56395 - RNA, 15 nt, Artificial Sequence
  Synthetic Oligonucleotide; CD80 exon 5; Set C
aguugguuuuucuuu

SEQ ID NO: 56396 - RNA, 17 nt, Artificial Sequence
  Synthetic Oligonucleotide; CD80 exon 5; Set C
uaguugguuuuucuuuu

SEQ ID NO: 56397 - RNA, 33 nt, Artificial Sequence
  Synthetic Oligonucleotide; CD80 exon 5; Set A
agacaggauaguugguuuuucuuuuuucucuaa

SEQ ID NO: 56398 - RNA, 25 nt, Artificial Sequence
  Synthetic Oligonucleotide; CD80 exon 5; Set C
aggauaguugguuuuucuuuuuucu

SEQ ID NO: 56399 - RNA, 29 nt, Artificial Sequence
  Synthetic Oligonucleotide; CD80 exon 5; Set A
acaggauaguugguuuuucuuuuuucucu

SEQ ID NO: 56400 - RNA, 27 nt, Artificial Sequence
  Synthetic Oligonucleotide; CD80 exon 5; Set C
caggauaguugguuuuucuuuuuucuc

SEQ ID NO: 56401 - RNA, 31 nt, Artificial Sequence
  Synthetic Oligonucleotide; CD80 exon 5; Set A
gacaggauaguugguuuuucuuuuuucucua

SEQ ID NO: 56402 - RNA, 37 nt, Artificial Sequence
  Synthetic Oligonucleotide; CD80 exon 5; Set A
aaagacaggauaguugguuuuucuuuuuucucuaaaa

SEQ ID NO: 56403 - RNA, 16 nt, Artificial Sequence
  Synthetic Oligonucleotide; CD80 exon 5; Set C
uaguugguuuuucuuu

SEQ ID NO: 56404 - RNA, 34 nt, Artificial Sequence
  Synthetic Oligonucleotide; CD80 exon 5; Set A
aagacaggauaguugguuuuucuuuuuucucuaa

SEQ ID NO: 56405 - RNA, 24 nt, Artificial Sequence
  Synthetic Oligonucleotide; CD80 exon 5; Set C
aggauaguugguuuuucuuuuuuc

SEQ ID NO: 56406 - RNA, 26 nt, Artificial Sequence
  Synthetic Oligonucleotide; CD80 exon 5; Set C
caggauaguugguuuuucuuuuuucu

SEQ ID NO: 56407 - RNA, 30 nt, Artificial Sequence
  Synthetic Oligonucleotide; CD80 exon 5; Set A
gacaggauaguugguuuuucuuuuuucucu

SEQ ID NO: 56408 - RNA, 28 nt, Artificial Sequence
  Synthetic Oligonucleotide; CD80 exon 5; Set C
acaggauaguugguuuuucuuuuuucuc

SEQ ID NO: 56409 - RNA, 32 nt, Artificial Sequence
  Synthetic Oligonucleotide; CD80 exon 5; Set A
agacaggauaguugguuuuucuuuuuucucua

SEQ ID NO: 56410 - RNA, 38 nt, Artificial Sequence
  Synthetic Oligonucleotide; CD80 exon 5; Set A
uaaagacaggauaguugguuuuucuuuuuucucuaaaa

SEQ ID NO: 56411 - RNA, 23 nt, Artificial Sequence
  Synthetic Oligonucleotide; CD80 exon 5; Set C
aggauaguugguuuuucuuuuuu

SEQ ID NO: 56412 - RNA, 15 nt, Artificial Sequence
  Synthetic Oligonucleotide; CD80 exon 5; Set C
uaguugguuuuucuu

SEQ ID NO: 56413 - RNA, 35 nt, Artificial Sequence
  Synthetic Oligonucleotide; CD80 exon 5; Set A
aaagacaggauaguugguuuuucuuuuuucucuaa

SEQ ID NO: 56414 - RNA, 25 nt, Artificial Sequence
  Synthetic Oligonucleotide; CD80 exon 5; Set C
caggauaguugguuuuucuuuuuuc

SEQ ID NO: 56415 - RNA, 27 nt, Artificial Sequence
  Synthetic Oligonucleotide; CD80 exon 5; Set C
acaggauaguugguuuuucuuuuuucu

SEQ ID NO: 56416 - RNA, 29 nt, Artificial Sequence
  Synthetic Oligonucleotide; CD80 exon 5; Set A
gacaggauaguugguuuuucuuuuuucuc

SEQ ID NO: 56417 - RNA, 31 nt, Artificial Sequence
  Synthetic Oligonucleotide; CD80 exon 5; Set A
agacaggauaguugguuuuucuuuuuucucu

SEQ ID NO: 56418 - RNA, 33 nt, Artificial Sequence
  Synthetic Oligonucleotide; CD80 exon 5; Set A
aagacaggauaguugguuuuucuuuuuucucua

SEQ ID NO: 56419 - RNA, 39 nt, Artificial Sequence
  Synthetic Oligonucleotide; CD80 exon 5; Set A
uuaaagacaggauaguugguuuuucuuuuuucucuaaaa

SEQ ID NO: 56420 - RNA, 22 nt, Artificial Sequence
  Synthetic Oligonucleotide; CD80 exon 5; Set C
aggauaguugguuuuucuuuuu

SEQ ID NO: 56421 - RNA, 24 nt, Artificial Sequence
  Synthetic Oligonucleotide; CD80 exon 5; Set C
caggauaguugguuuuucuuuuuu

SEQ ID NO: 56422 - RNA, 26 nt, Artificial Sequence
  Synthetic Oligonucleotide; CD80 exon 5; Set C
acaggauaguugguuuuucuuuuuuc

SEQ ID NO: 56423 - RNA, 28 nt, Artificial Sequence
  Synthetic Oligonucleotide; CD80 exon 5; Set A
gacaggauaguugguuuuucuuuuuucu

SEQ ID NO: 56424 - RNA, 32 nt, Artificial Sequence
  Synthetic Oligonucleotide; CD80 exon 5; Set A
aagacaggauaguugguuuuucuuuuuucucu

SEQ ID NO: 56425 - RNA, 30 nt, Artificial Sequence
  Synthetic Oligonucleotide; CD80 exon 5; Set A
agacaggauaguugguuuuucuuuuuucuc

SEQ ID NO: 56426 - RNA, 34 nt, Artificial Sequence
  Synthetic Oligonucleotide; CD80 exon 5; Set A
aaagacaggauaguugguuuuucuuuuuucucua

SEQ ID NO: 56427 - RNA, 23 nt, Artificial Sequence
  Synthetic Oligonucleotide; CD80 exon 5; Set C
caggauaguugguuuuucuuuuu

SEQ ID NO: 56428 - RNA, 21 nt, Artificial Sequence
  Synthetic Oligonucleotide; CD80 exon 5; Set C
aggauaguugguuuuucuuuu

SEQ ID NO: 56429 - RNA, 25 nt, Artificial Sequence
  Synthetic Oligonucleotide; CD80 exon 5; Set C
acaggauaguugguuuuucuuuuuu

SEQ ID NO: 56430 - RNA, 37 nt, Artificial Sequence
  Synthetic Oligonucleotide; CD80 exon 5; Set A
uuaaagacaggauaguugguuuuucuuuuuucucuaa

SEQ ID NO: 56431 - RNA, 27 nt, Artificial Sequence
  Synthetic Oligonucleotide; CD80 exon 5; Set C
gacaggauaguugguuuuucuuuuuuc

SEQ ID NO: 56432 - RNA, 29 nt, Artificial Sequence
  Synthetic Oligonucleotide; CD80 exon 5; Set A
agacaggauaguugguuuuucuuuuuucu

SEQ ID NO: 56433 - RNA, 33 nt, Artificial Sequence
  Synthetic Oligonucleotide; CD80 exon 5; Set A
aaagacaggauaguugguuuuucuuuuuucucu

SEQ ID NO: 56434 - RNA, 31 nt, Artificial Sequence
  Synthetic Oligonucleotide; CD80 exon 5; Set A
aagacaggauaguugguuuuucuuuuuucuc

SEQ ID NO: 56435 - RNA, 35 nt, Artificial Sequence
  Synthetic Oligonucleotide; CD80 exon 5; Set A
uaaagacaggauaguugguuuuucuuuuuucucua

SEQ ID NO: 56436 - RNA, 24 nt, Artificial Sequence
  Synthetic Oligonucleotide; CD80 exon 5; Set C
acaggauaguugguuuuucuuuuu

SEQ ID NO: 56437 - RNA, 20 nt, Artificial Sequence
  Synthetic Oligonucleotide; CD80 exon 5; Set C
aggauaguugguuuuucuuu

SEQ ID NO: 56438 - RNA, 22 nt, Artificial Sequence
  Synthetic Oligonucleotide; CD80 exon 5; Set C
caggauaguugguuuuucuuuu

SEQ ID NO: 56439 - RNA, 26 nt, Artificial Sequence
  Synthetic Oligonucleotide; CD80 exon 5; Set C
gacaggauaguugguuuuucuuuuuu

SEQ ID NO: 56440 - RNA, 28 nt, Artificial Sequence
  Synthetic Oligonucleotide; CD80 exon 5; Set C
agacaggauaguugguuuuucuuuuuuc

SEQ ID NO: 56441 - RNA, 30 nt, Artificial Sequence
  Synthetic Oligonucleotide; CD80 exon 5; Set C
aagacaggauaguugguuuuucuuuuuucu

SEQ ID NO: 56442 - RNA, 34 nt, Artificial Sequence
  Synthetic Oligonucleotide; CD80 exon 5; Set A
uaaagacaggauaguugguuuuucuuuuuucucu

SEQ ID NO: 56443 - RNA, 32 nt, Artificial Sequence
  Synthetic Oligonucleotide; CD80 exon 5; Set A
aaagacaggauaguugguuuuucuuuuuucuc

SEQ ID NO: 56444 - RNA, 36 nt, Artificial Sequence
  Synthetic Oligonucleotide; CD80 exon 5; Set A
uuaaagacaggauaguugguuuuucuuuuuucucua

SEQ ID NO: 56445 - RNA, 23 nt, Artificial Sequence
  Synthetic Oligonucleotide; CD80 exon 5; Set C
acaggauaguugguuuuucuuuu

SEQ ID NO: 56446 - RNA, 21 nt, Artificial Sequence
  Synthetic Oligonucleotide; CD80 exon 5; Set C
caggauaguugguuuuucuuu

SEQ ID NO: 56447 - RNA, 27 nt, Artificial Sequence
  Synthetic Oligonucleotide; CD80 exon 5; Set C
agacaggauaguugguuuuucuuuuuu

SEQ ID NO: 56448 - RNA, 19 nt, Artificial Sequence
  Synthetic Oligonucleotide; CD80 exon 5; Set C
aggauaguugguuuuucuu

SEQ ID NO: 56449 - RNA, 29 nt, Artificial Sequence
  Synthetic Oligonucleotide; CD80 exon 5; Set C
aagacaggauaguugguuuuucuuuuuuc

SEQ ID NO: 56450 - RNA, 31 nt, Artificial Sequence
  Synthetic Oligonucleotide; CD80 exon 5; Set C
aaagacaggauaguugguuuuucuuuuuucu

SEQ ID NO: 56451 - RNA, 33 nt, Artificial Sequence
  Synthetic Oligonucleotide; CD80 exon 5; Set A
uaaagacaggauaguugguuuuucuuuuuucuc

SEQ ID NO: 56452 - RNA, 35 nt, Artificial Sequence
  Synthetic Oligonucleotide; CD80 exon 5; Set A
uuaaagacaggauaguugguuuuucuuuuuucucu

SEQ ID NO: 56453 - RNA, 24 nt, Artificial Sequence
  Synthetic Oligonucleotide; CD80 exon 5; Set C
gacaggauaguugguuuuucuuuu

SEQ ID NO: 56454 - RNA, 22 nt, Artificial Sequence
  Synthetic Oligonucleotide; CD80 exon 5; Set C
acaggauaguugguuuuucuuu

SEQ ID NO: 56455 - RNA, 18 nt, Artificial Sequence
  Synthetic Oligonucleotide; CD80 exon 5; Set C
aggauaguugguuuuucu

SEQ ID NO: 56456 - RNA, 20 nt, Artificial Sequence
  Synthetic Oligonucleotide; CD80 exon 5; Set C
caggauaguugguuuuucuu

SEQ ID NO: 56457 - RNA, 30 nt, Artificial Sequence
  Synthetic Oligonucleotide; CD80 exon 5; Set C
aaagacaggauaguugguuuuucuuuuuuc

SEQ ID NO: 56458 - RNA, 32 nt, Artificial Sequence
  Synthetic Oligonucleotide; CD80 exon 5; Set C
uaaagacaggauaguugguuuuucuuuuuucu

SEQ ID NO: 56459 - RNA, 34 nt, Artificial Sequence
  Synthetic Oligonucleotide; CD80 exon 5; Set A
uuaaagacaggauaguugguuuuucuuuuuucuc

SEQ ID NO: 56460 - RNA, 23 nt, Artificial Sequence
  Synthetic Oligonucleotide; CD80 exon 5; Set C
gacaggauaguugguuuuucuuu

SEQ ID NO: 56461 - RNA, 25 nt, Artificial Sequence
  Synthetic Oligonucleotide; CD80 exon 5; Set C
agacaggauaguugguuuuucuuuu

SEQ ID NO: 56462 - RNA, 21 nt, Artificial Sequence
  Synthetic Oligonucleotide; CD80 exon 5; Set C
acaggauaguugguuuuucuu

SEQ ID NO: 56463 - RNA, 17 nt, Artificial Sequence
  Synthetic Oligonucleotide; CD80 exon 5; Set C
aggauaguugguuuuuc

SEQ ID NO: 56464 - RNA, 19 nt, Artificial Sequence
  Synthetic Oligonucleotide; CD80 exon 5; Set C
caggauaguugguuuuucu

SEQ ID NO: 56465 - RNA, 33 nt, Artificial Sequence
  Synthetic Oligonucleotide; CD80 exon 5; Set C
uuaaagacaggauaguugguuuuucuuuuuucu

SEQ ID NO: 56466 - RNA, 16 nt, Artificial Sequence
  Synthetic Oligonucleotide; CD80 exon 5; Set C
aggauaguugguuuuu

SEQ ID NO: 56467 - RNA, 26 nt, Artificial Sequence
  Synthetic Oligonucleotide; CD80 exon 5; Set C
aagacaggauaguugguuuuucuuuu

SEQ ID NO: 56468 - RNA, 24 nt, Artificial Sequence
  Synthetic Oligonucleotide; CD80 exon 5; Set C
agacaggauaguugguuuuucuuu

SEQ ID NO: 56469 - RNA, 22 nt, Artificial Sequence
  Synthetic Oligonucleotide; CD80 exon 5; Set C
gacaggauaguugguuuuucuu

SEQ ID NO: 56470 - RNA, 20 nt, Artificial Sequence
  Synthetic Oligonucleotide; CD80 exon 5; Set C
acaggauaguugguuuuucu

SEQ ID NO: 56471 - RNA, 18 nt, Artificial Sequence
  Synthetic Oligonucleotide; CD80 exon 5; Set C
caggauaguugguuuuuc

SEQ ID NO: 56472 - RNA, 32 nt, Artificial Sequence
  Synthetic Oligonucleotide; CD80 exon 5; Set C
uuaaagacaggauaguugguuuuucuuuuuuc

SEQ ID NO: 56473 - RNA, 15 nt, Artificial Sequence
  Synthetic Oligonucleotide; CD80 exon 5; Set C
aggauaguugguuuu

SEQ ID NO: 56474 - RNA, 17 nt, Artificial Sequence
  Synthetic Oligonucleotide; CD80 exon 5; Set C
caggauaguugguuuuu

SEQ ID NO: 56475 - RNA, 25 nt, Artificial Sequence
  Synthetic Oligonucleotide; CD80 exon 5; Set C
aagacaggauaguugguuuuucuuu

SEQ ID NO: 56476 - RNA, 31 nt, Artificial Sequence
  Synthetic Oligonucleotide; CD80 exon 5; Set C
uuaaagacaggauaguugguuuuucuuuuuu

SEQ ID NO: 56477 - RNA, 21 nt, Artificial Sequence
  Synthetic Oligonucleotide; CD80 exon 5; Set C
gacaggauaguugguuuuucu

SEQ ID NO: 56478 - RNA, 23 nt, Artificial Sequence
  Synthetic Oligonucleotide; CD80 exon 5; Set C
agacaggauaguugguuuuucuu

SEQ ID NO: 56479 - RNA, 19 nt, Artificial Sequence
  Synthetic Oligonucleotide; CD80 exon 5; Set C
acaggauaguugguuuuuc

SEQ ID NO: 56480 - RNA, 30 nt, Artificial Sequence
  Synthetic Oligonucleotide; CD80 exon 5; Set C
uuaaagacaggauaguugguuuuucuuuuu

SEQ ID NO: 56481 - RNA, 16 nt, Artificial Sequence
  Synthetic Oligonucleotide; CD80 exon 5; Set C
caggauaguugguuuu

SEQ ID NO: 56482 - RNA, 18 nt, Artificial Sequence
  Synthetic Oligonucleotide; CD80 exon 5; Set C
acaggauaguugguuuuu

SEQ ID NO: 56483 - RNA, 24 nt, Artificial Sequence
  Synthetic Oligonucleotide; CD80 exon 5; Set C
aagacaggauaguugguuuuucuu

SEQ ID NO: 56484 - RNA, 20 nt, Artificial Sequence
  Synthetic Oligonucleotide; CD80 exon 5; Set C
gacaggauaguugguuuuuc

SEQ ID NO: 56485 - RNA, 22 nt, Artificial Sequence
  Synthetic Oligonucleotide; CD80 exon 5; Set C
agacaggauaguugguuuuucu

SEQ ID NO: 56486 - RNA, 17 nt, Artificial Sequence
  Synthetic Oligonucleotide; CD80 exon 5; Set C
acaggauaguugguuuu

SEQ ID NO: 56487 - RNA, 19 nt, Artificial Sequence
  Synthetic Oligonucleotide; CD80 exon 5; Set C
gacaggauaguugguuuuu

SEQ ID NO: 56488 - RNA, 29 nt, Artificial Sequence
  Synthetic Oligonucleotide; CD80 exon 5; Set C
uuaaagacaggauaguugguuuuucuuuu

SEQ ID NO: 56489 - RNA, 25 nt, Artificial Sequence
  Synthetic Oligonucleotide; CD80 exon 5; Set C
aaagacaggauaguugguuuuucuu

SEQ ID NO: 56490 - RNA, 23 nt, Artificial Sequence
  Synthetic Oligonucleotide; CD80 exon 5; Set C
aagacaggauaguugguuuuucu

SEQ ID NO: 56491 - RNA, 21 nt, Artificial Sequence
  Synthetic Oligonucleotide; CD80 exon 5; Set C
agacaggauaguugguuuuuc

SEQ ID NO: 56492 - RNA, 18 nt, Artificial Sequence
  Synthetic Oligonucleotide; CD80 exon 5; Set C
gacaggauaguugguuuu

SEQ ID NO: 56493 - RNA, 20 nt, Artificial Sequence
  Synthetic Oligonucleotide; CD80 exon 5; Set C
agacaggauaguugguuuuu

SEQ ID NO: 56494 - RNA, 28 nt, Artificial Sequence
  Synthetic Oligonucleotide; CD80 exon 5; Set C
uuaaagacaggauaguugguuuuucuuu

SEQ ID NO: 56495 - RNA, 24 nt, Artificial Sequence
  Synthetic Oligonucleotide; CD80 exon 5; Set C
aaagacaggauaguugguuuuucu

SEQ ID NO: 56496 - RNA, 22 nt, Artificial Sequence
  Synthetic Oligonucleotide; CD80 exon 5; Set C
aagacaggauaguugguuuuuc

SEQ ID NO: 56497 - RNA, 19 nt, Artificial Sequence
  Synthetic Oligonucleotide; CD80 exon 5; Set C
agacaggauaguugguuuu

SEQ ID NO: 56498 - RNA, 23 nt, Artificial Sequence
  Synthetic Oligonucleotide; CD80 exon 5; Set C
aaagacaggauaguugguuuuuc

SEQ ID NO: 56499 - RNA, 27 nt, Artificial Sequence
  Synthetic Oligonucleotide; CD80 exon 5; Set C
uuaaagacaggauaguugguuuuucuu

SEQ ID NO: 56500 - RNA, 17 nt, Artificial Sequence
  Synthetic Oligonucleotide; CD80 exon 5; Set C
gacaggauaguugguuu

SEQ ID NO: 56501 - RNA, 26 nt, Artificial Sequence
  Synthetic Oligonucleotide; CD80 exon 5; Set C
uuaaagacaggauaguugguuuuucu

SEQ ID NO: 56502 - RNA, 18 nt, Artificial Sequence
  Synthetic Oligonucleotide; CD80 exon 5; Set C
agacaggauaguugguuu

SEQ ID NO: 56503 - RNA, 25 nt, Artificial Sequence
  Synthetic Oligonucleotide; CD80 exon 5; Set C
uuaaagacaggauaguugguuuuuc

SEQ ID NO: 56504 - RNA, 19 nt, Artificial Sequence
  Synthetic Oligonucleotide; CD80 exon 5; Set C
aagacaggauaguugguuu

SEQ ID NO: 56505 - RNA, 24 nt, Artificial Sequence
  Synthetic Oligonucleotide; CD80 exon 5; Set C
uuaaagacaggauaguugguuuuu

SEQ ID NO: 56506 - RNA, 20 nt, Artificial Sequence
  Synthetic Oligonucleotide; CD80 exon 5; Set C
aaagacaggauaguugguuu

SEQ ID NO: 56507 - RNA, 23 nt, Artificial Sequence
  Synthetic Oligonucleotide; CD80 exon 5; Set C
uuaaagacaggauaguugguuuu

SEQ ID NO: 56508 - RNA, 21 nt, Artificial Sequence
  Synthetic Oligonucleotide; CD80 exon 5; Set C
uaaagacaggauaguugguuu

SEQ ID NO: 56509 - RNA, 22 nt, Artificial Sequence
  Synthetic Oligonucleotide; CD80 exon 5; Set C
uuaaagacaggauaguugguuu

SEQ ID NO: 56510 - RNA, 20 nt, Artificial Sequence
  Synthetic Oligonucleotide; CD80 exon 5; Set C
uaaagacaggauaguugguu

SEQ ID NO: 56511 - RNA, 15 nt, Artificial Sequence
  Synthetic Oligonucleotide; CD80 exon 5; Set C
aagacaggauaguug

SEQ ID NO: 56512 - RNA, 16 nt, Artificial Sequence
  Synthetic Oligonucleotide; CD80 exon 5; Set C
aaagacaggauaguug

SEQ ID NO: 56513 - RNA, 17 nt, Artificial Sequence
  Synthetic Oligonucleotide; CD80 exon 5; Set C
uaaagacaggauaguug

SEQ ID NO: 56514 - RNA, 18 nt, Artificial Sequence
  Synthetic Oligonucleotide; CD80 exon 5; Set C
uuaaagacaggauaguug

SEQ ID NO: 56515 - RNA, 16 nt, Artificial Sequence
  Synthetic Oligonucleotide; CD80 exon 5; Set C
uuaaagacaggauagu

SEQ ID NO: 56516 - RNA, 15 nt, Artificial Sequence
  Synthetic Oligonucleotide; CD80 exon 5; Set C
uuaaagacaggauag

SEQ ID NO: 56517 - RNA, 35 nt, Artificial Sequence
  Synthetic Oligonucleotide; CD80 exon 5; Set A
ucauaguguaccuaccacuuaaagacaggauaguu

SEQ ID NO: 56518 - RNA, 36 nt, Artificial Sequence
  Synthetic Oligonucleotide; CD80 exon 5; Set A
aucauaguguaccuaccacuuaaagacaggauaguu

SEQ ID NO: 56519 - RNA, 34 nt, Artificial Sequence
  Synthetic Oligonucleotide; CD80 exon 5; Set A
ucauaguguaccuaccacuuaaagacaggauagu

SEQ ID NO: 56520 - RNA, 37 nt, Artificial Sequence
  Synthetic Oligonucleotide; CD80 exon 5; Set A
aaucauaguguaccuaccacuuaaagacaggauaguu

SEQ ID NO: 56521 - RNA, 35 nt, Artificial Sequence
  Synthetic Oligonucleotide; CD80 exon 5; Set A
aucauaguguaccuaccacuuaaagacaggauagu

SEQ ID NO: 56522 - RNA, 38 nt, Artificial Sequence
  Synthetic Oligonucleotide; CD80 exon 5; Set A
uaaucauaguguaccuaccacuuaaagacaggauaguu

SEQ ID NO: 56523 - RNA, 36 nt, Artificial Sequence
  Synthetic Oligonucleotide; CD80 exon 5; Set A
aaucauaguguaccuaccacuuaaagacaggauagu

SEQ ID NO: 56524 - RNA, 34 nt, Artificial Sequence
  Synthetic Oligonucleotide; CD80 exon 5; Set A
aucauaguguaccuaccacuuaaagacaggauag

SEQ ID NO: 56525 - RNA, 39 nt, Artificial Sequence
  Synthetic Oligonucleotide; CD80 exon 5; Set A
uuaaucauaguguaccuaccacuuaaagacaggauaguu

SEQ ID NO: 56526 - RNA, 37 nt, Artificial Sequence
  Synthetic Oligonucleotide; CD80 exon 5; Set A
uaaucauaguguaccuaccacuuaaagacaggauagu

SEQ ID NO: 56527 - RNA, 35 nt, Artificial Sequence
  Synthetic Oligonucleotide; CD80 exon 5; Set A
aaucauaguguaccuaccacuuaaagacaggauag

SEQ ID NO: 56528 - RNA, 38 nt, Artificial Sequence
  Synthetic Oligonucleotide; CD80 exon 5; Set A
uuaaucauaguguaccuaccacuuaaagacaggauagu

SEQ ID NO: 56529 - RNA, 36 nt, Artificial Sequence
  Synthetic Oligonucleotide; CD80 exon 5; Set A
uaaucauaguguaccuaccacuuaaagacaggauag

SEQ ID NO: 56530 - RNA, 29 nt, Artificial Sequence
  Synthetic Oligonucleotide; CD80 exon 5; Set A
ucauaguguaccuaccacuuaaagacagg

SEQ ID NO: 56531 - RNA, 37 nt, Artificial Sequence
  Synthetic Oligonucleotide; CD80 exon 5; Set A
uuaaucauaguguaccuaccacuuaaagacaggauag

SEQ ID NO: 56532 - RNA, 30 nt, Artificial Sequence
  Synthetic Oligonucleotide; CD80 exon 5; Set A
aucauaguguaccuaccacuuaaagacagg

SEQ ID NO: 56533 - RNA, 31 nt, Artificial Sequence
  Synthetic Oligonucleotide; CD80 exon 5; Set A
aaucauaguguaccuaccacuuaaagacagg

SEQ ID NO: 56534 - RNA, 29 nt, Artificial Sequence
  Synthetic Oligonucleotide; CD80 exon 5; Set A
aucauaguguaccuaccacuuaaagacag

SEQ ID NO: 56535 - RNA, 26 nt, Artificial Sequence
  Synthetic Oligonucleotide; CD80 exon 5; Set B
ucauaguguaccuaccacuuaaagac

SEQ ID NO: 56536 - RNA, 28 nt, Artificial Sequence
  Synthetic Oligonucleotide; CD80 exon 5; Set B
aucauaguguaccuaccacuuaaagaca

SEQ ID NO: 56537 - RNA, 32 nt, Artificial Sequence
  Synthetic Oligonucleotide; CD80 exon 5; Set A
uaaucauaguguaccuaccacuuaaagacagg

SEQ ID NO: 56538 - RNA, 30 nt, Artificial Sequence
  Synthetic Oligonucleotide; CD80 exon 5; Set A
aaucauaguguaccuaccacuuaaagacag

SEQ ID NO: 56539 - RNA, 27 nt, Artificial Sequence
  Synthetic Oligonucleotide; CD80 exon 5; Set B
aucauaguguaccuaccacuuaaagac

SEQ ID NO: 56540 - RNA, 25 nt, Artificial Sequence
  Synthetic Oligonucleotide; CD80 exon 5; Set C
ucauaguguaccuaccacuuaaaga

SEQ ID NO: 56541 - RNA, 29 nt, Artificial Sequence
  Synthetic Oligonucleotide; CD80 exon 5; Set B
aaucauaguguaccuaccacuuaaagaca

SEQ ID NO: 56542 - RNA, 33 nt, Artificial Sequence
  Synthetic Oligonucleotide; CD80 exon 5; Set A
uuaaucauaguguaccuaccacuuaaagacagg

SEQ ID NO: 56543 - RNA, 31 nt, Artificial Sequence
  Synthetic Oligonucleotide; CD80 exon 5; Set A
uaaucauaguguaccuaccacuuaaagacag

SEQ ID NO: 56544 - RNA, 24 nt, Artificial Sequence
  Synthetic Oligonucleotide; CD80 exon 5; Set C
ucauaguguaccuaccacuuaaag

SEQ ID NO: 56545 - RNA, 28 nt, Artificial Sequence
  Synthetic Oligonucleotide; CD80 exon 5; Set C
aaucauaguguaccuaccacuuaaagac

SEQ ID NO: 56546 - RNA, 26 nt, Artificial Sequence
  Synthetic Oligonucleotide; CD80 exon 5; Set C
aucauaguguaccuaccacuuaaaga

SEQ ID NO: 56547 - RNA, 30 nt, Artificial Sequence
  Synthetic Oligonucleotide; CD80 exon 5; Set B
uaaucauaguguaccuaccacuuaaagaca

SEQ ID NO: 56548 - RNA, 32 nt, Artificial Sequence
  Synthetic Oligonucleotide; CD80 exon 5; Set A
uuaaucauaguguaccuaccacuuaaagacag

SEQ ID NO: 56549 - RNA, 25 nt, Artificial Sequence
  Synthetic Oligonucleotide; CD80 exon 5; Set C
aucauaguguaccuaccacuuaaag

SEQ ID NO: 56550 - RNA, 29 nt, Artificial Sequence
  Synthetic Oligonucleotide; CD80 exon 5; Set B
uaaucauaguguaccuaccacuuaaagac

SEQ ID NO: 56551 - RNA, 27 nt, Artificial Sequence
  Synthetic Oligonucleotide; CD80 exon 5; Set C
aaucauaguguaccuaccacuuaaaga

SEQ ID NO: 56552 - RNA, 31 nt, Artificial Sequence
  Synthetic Oligonucleotide; CD80 exon 5; Set B
uuaaucauaguguaccuaccacuuaaagaca

SEQ ID NO: 56553 - RNA, 24 nt, Artificial Sequence
  Synthetic Oligonucleotide; CD80 exon 5; Set C
aucauaguguaccuaccacuuaaa

SEQ ID NO: 56554 - RNA, 26 nt, Artificial Sequence
  Synthetic Oligonucleotide; CD80 exon 5; Set C
aaucauaguguaccuaccacuuaaag

SEQ ID NO: 56555 - RNA, 30 nt, Artificial Sequence
  Synthetic Oligonucleotide; CD80 exon 5; Set B
uuaaucauaguguaccuaccacuuaaagac

SEQ ID NO: 56556 - RNA, 28 nt, Artificial Sequence
  Synthetic Oligonucleotide; CD80 exon 5; Set C
uaaucauaguguaccuaccacuuaaaga

SEQ ID NO: 56557 - RNA, 23 nt, Artificial Sequence
  Synthetic Oligonucleotide; CD80 exon 5; Set C
aucauaguguaccuaccacuuaa

SEQ ID NO: 56558 - RNA, 25 nt, Artificial Sequence
  Synthetic Oligonucleotide; CD80 exon 5; Set C
aaucauaguguaccuaccacuuaaa

SEQ ID NO: 56559 - RNA, 27 nt, Artificial Sequence
  Synthetic Oligonucleotide; CD80 exon 5; Set C
uaaucauaguguaccuaccacuuaaag

SEQ ID NO: 56560 - RNA, 29 nt, Artificial Sequence
  Synthetic Oligonucleotide; CD80 exon 5; Set C
uuaaucauaguguaccuaccacuuaaaga

SEQ ID NO: 56561 - RNA, 24 nt, Artificial Sequence
  Synthetic Oligonucleotide; CD80 exon 5; Set C
aaucauaguguaccuaccacuuaa

SEQ ID NO: 56562 - RNA, 26 nt, Artificial Sequence
  Synthetic Oligonucleotide; CD80 exon 5; Set C
uaaucauaguguaccuaccacuuaaa

SEQ ID NO: 56563 - RNA, 28 nt, Artificial Sequence
  Synthetic Oligonucleotide; CD80 exon 5; Set C
uuaaucauaguguaccuaccacuuaaag

SEQ ID NO: 56564 - RNA, 25 nt, Artificial Sequence
  Synthetic Oligonucleotide; CD80 exon 5; Set C
uaaucauaguguaccuaccacuuaa

SEQ ID NO: 56565 - RNA, 27 nt, Artificial Sequence
  Synthetic Oligonucleotide; CD80 exon 5; Set C
uuaaucauaguguaccuaccacuuaaa

SEQ ID NO: 56566 - RNA, 26 nt, Artificial Sequence
  Synthetic Oligonucleotide; CD80 exon 5; Set C
uuaaucauaguguaccuaccacuuaa

SEQ ID NO: 56567 - RNA, 24 nt, Artificial Sequence
  Synthetic Oligonucleotide; CD80 exon 5; Set C
uaaucauaguguaccuaccacuua

SEQ ID NO: 56568 - RNA, 25 nt, Artificial Sequence
  Synthetic Oligonucleotide; CD80 exon 5; Set C
uuaaucauaguguaccuaccacuua

SEQ ID NO: 56569 - RNA, 15 nt, Artificial Sequence
  Synthetic Oligonucleotide; CD80 exon 5; Set C
aacaccuauuuaauc

SEQ ID NO: 56570 - RNA, 15 nt, Artificial Sequence
  Synthetic Oligonucleotide; CD80 exon 5; Set C
cauugcuguuauccu

SEQ ID NO: 56571 - RNA, 29 nt, Artificial Sequence
  Synthetic Oligonucleotide; CD80 exon 5; Set A
aaaauaacaagccauugcuguuauccugg

SEQ ID NO: 56572 - RNA, 28 nt, Artificial Sequence
  Synthetic Oligonucleotide; CD80 exon 5; Set C
aaaauaacaagccauugcuguuauccug

SEQ ID NO: 56573 - RNA, 30 nt, Artificial Sequence
  Synthetic Oligonucleotide; CD80 exon 5; Set C
aaaaauaacaagccauugcuguuauccugg

SEQ ID NO: 56574 - RNA, 29 nt, Artificial Sequence
  Synthetic Oligonucleotide; CD80 exon 5; Set C
aaaaauaacaagccauugcuguuauccug

SEQ ID NO: 56575 - RNA, 31 nt, Artificial Sequence
  Synthetic Oligonucleotide; CD80 exon 5; Set C
aaaaaauaacaagccauugcuguuauccugg

SEQ ID NO: 56576 - RNA, 30 nt, Artificial Sequence
  Synthetic Oligonucleotide; CD80 exon 5; Set C
aaaaaauaacaagccauugcuguuauccug

SEQ ID NO: 56577 - RNA, 32 nt, Artificial Sequence
  Synthetic Oligonucleotide; CD80 exon 5; Set A
caaaaaauaacaagccauugcuguuauccugg

SEQ ID NO: 56578 - RNA, 31 nt, Artificial Sequence
  Synthetic Oligonucleotide; CD80 exon 5; Set C
caaaaaauaacaagccauugcuguuauccug

SEQ ID NO: 56579 - RNA, 33 nt, Artificial Sequence
  Synthetic Oligonucleotide; CD80 exon 5; Set A
acaaaaaauaacaagccauugcuguuauccugg

SEQ ID NO: 56580 - RNA, 32 nt, Artificial Sequence
  Synthetic Oligonucleotide; CD80 exon 5; Set C
acaaaaaauaacaagccauugcuguuauccug

SEQ ID NO: 56581 - RNA, 34 nt, Artificial Sequence
  Synthetic Oligonucleotide; CD80 exon 5; Set A
cacaaaaaauaacaagccauugcuguuauccugg

SEQ ID NO: 56582 - RNA, 30 nt, Artificial Sequence
  Synthetic Oligonucleotide; CD80 exon 5; Set C
caaaaaauaacaagccauugcuguuauccu

SEQ ID NO: 56583 - RNA, 33 nt, Artificial Sequence
  Synthetic Oligonucleotide; CD80 exon 5; Set A
cacaaaaaauaacaagccauugcuguuauccug

SEQ ID NO: 56584 - RNA, 22 nt, Artificial Sequence
  Synthetic Oligonucleotide; CD80 exon 5; Set C
aaaauaacaagccauugcuguu

SEQ ID NO: 56585 - RNA, 23 nt, Artificial Sequence
  Synthetic Oligonucleotide; CD80 exon 5; Set C
aaaaauaacaagccauugcuguu

SEQ ID NO: 56586 - RNA, 38 nt, Artificial Sequence
  Synthetic Oligonucleotide; CD80 exon 5; Set A
augacacaaaaaauaacaagccauugcuguuauccugg

SEQ ID NO: 56587 - RNA, 24 nt, Artificial Sequence
  Synthetic Oligonucleotide; CD80 exon 5; Set C
aaaaaauaacaagccauugcuguu

SEQ ID NO: 56588 - RNA, 37 nt, Artificial Sequence
  Synthetic Oligonucleotide; CD80 exon 5; Set A
augacacaaaaaauaacaagccauugcuguuauccug

SEQ ID NO: 56589 - RNA, 39 nt, Artificial Sequence
  Synthetic Oligonucleotide; CD80 exon 5; Set A
aaugacacaaaaaauaacaagccauugcuguuauccugg

SEQ ID NO: 56590 - RNA, 25 nt, Artificial Sequence
  Synthetic Oligonucleotide; CD80 exon 5; Set C
caaaaaauaacaagccauugcuguu

SEQ ID NO: 56591 - RNA, 38 nt, Artificial Sequence
  Synthetic Oligonucleotide; CD80 exon 5; Set A
aaugacacaaaaaauaacaagccauugcuguuauccug

SEQ ID NO: 56592 - RNA, 26 nt, Artificial Sequence
  Synthetic Oligonucleotide; CD80 exon 5; Set C
acaaaaaauaacaagccauugcuguu

SEQ ID NO: 56593 - RNA, 17 nt, Artificial Sequence
  Synthetic Oligonucleotide; CD80 exon 5; Set C
aaaauaacaagccauug

SEQ ID NO: 56594 - RNA, 27 nt, Artificial Sequence
  Synthetic Oligonucleotide; CD80 exon 5; Set C
cacaaaaaauaacaagccauugcuguu

SEQ ID NO: 56595 - RNA, 37 nt, Artificial Sequence
  Synthetic Oligonucleotide; CD80 exon 5; Set A
aaugacacaaaaaauaacaagccauugcuguuauccu

SEQ ID NO: 56596 - RNA, 16 nt, Artificial Sequence
  Synthetic Oligonucleotide; CD80 exon 5; Set C
aaaauaacaagccauu

SEQ ID NO: 56597 - RNA, 18 nt, Artificial Sequence
  Synthetic Oligonucleotide; CD80 exon 5; Set C
aaaaauaacaagccauug

SEQ ID NO: 56598 - RNA, 38 nt, Artificial Sequence
  Synthetic Oligonucleotide; CD80 exon 5; Set A
gaaugacacaaaaaauaacaagccauugcuguuauccu

SEQ ID NO: 56599 - RNA, 36 nt, Artificial Sequence
  Synthetic Oligonucleotide; CD80 exon 5; Set A
aaugacacaaaaaauaacaagccauugcuguuaucc

SEQ ID NO: 56600 - RNA, 17 nt, Artificial Sequence
  Synthetic Oligonucleotide; CD80 exon 5; Set C
aaaaauaacaagccauu

SEQ ID NO: 56601 - RNA, 19 nt, Artificial Sequence
  Synthetic Oligonucleotide; CD80 exon 5; Set C
aaaaaauaacaagccauug

SEQ ID NO: 56602 - RNA, 39 nt, Artificial Sequence
  Synthetic Oligonucleotide; CD80 exon 5; Set A
agaaugacacaaaaaauaacaagccauugcuguuauccu

SEQ ID NO: 56603 - RNA, 37 nt, Artificial Sequence
  Synthetic Oligonucleotide; CD80 exon 5; Set A
gaaugacacaaaaaauaacaagccauugcuguuaucc

SEQ ID NO: 56604 - RNA, 18 nt, Artificial Sequence
  Synthetic Oligonucleotide; CD80 exon 5; Set C
aaaaaauaacaagccauu

SEQ ID NO: 56605 - RNA, 20 nt, Artificial Sequence
  Synthetic Oligonucleotide; CD80 exon 5; Set C
caaaaaauaacaagccauug

SEQ ID NO: 56606 - RNA, 16 nt, Artificial Sequence
  Synthetic Oligonucleotide; CD80 exon 5; Set C
aaaaauaacaagccau

SEQ ID NO: 56607 - RNA, 40 nt, Artificial Sequence
  Synthetic Oligonucleotide; CD80 exon 5; Set A
uagaaugacacaaaaaauaacaagccauugcuguuauccu

SEQ ID NO: 56608 - RNA, 34 nt, Artificial Sequence
  Synthetic Oligonucleotide; CD80 exon 5; Set C
aaugacacaaaaaauaacaagccauugcuguuau

SEQ ID NO: 56609 - RNA, 38 nt, Artificial Sequence
  Synthetic Oligonucleotide; CD80 exon 5; Set A
agaaugacacaaaaaauaacaagccauugcuguuaucc

SEQ ID NO: 56610 - RNA, 19 nt, Artificial Sequence
  Synthetic Oligonucleotide; CD80 exon 5; Set C
caaaaaauaacaagccauu

SEQ ID NO: 56611 - RNA, 21 nt, Artificial Sequence
  Synthetic Oligonucleotide; CD80 exon 5; Set C
acaaaaaauaacaagccauug

SEQ ID NO: 56612 - RNA, 17 nt, Artificial Sequence
  Synthetic Oligonucleotide; CD80 exon 5; Set C
aaaaaauaacaagccau

SEQ ID NO: 56613 - RNA, 31 nt, Artificial Sequence
  Synthetic Oligonucleotide; CD80 exon 5; Set C
augacacaaaaaauaacaagccauugcuguu

SEQ ID NO: 56614 - RNA, 33 nt, Artificial Sequence
  Synthetic Oligonucleotide; CD80 exon 5; Set C
aaugacacaaaaaauaacaagccauugcuguua

SEQ ID NO: 56615 - RNA, 35 nt, Artificial Sequence
  Synthetic Oligonucleotide; CD80 exon 5; Set A
gaaugacacaaaaaauaacaagccauugcuguuau

SEQ ID NO: 56616 - RNA, 39 nt, Artificial Sequence
  Synthetic Oligonucleotide; CD80 exon 5; Set A
uagaaugacacaaaaaauaacaagccauugcuguuaucc

SEQ ID NO: 56617 - RNA, 20 nt, Artificial Sequence
  Synthetic Oligonucleotide; CD80 exon 5; Set C
acaaaaaauaacaagccauu

SEQ ID NO: 56618 - RNA, 22 nt, Artificial Sequence
  Synthetic Oligonucleotide; CD80 exon 5; Set C
cacaaaaaauaacaagccauug

SEQ ID NO: 56619 - RNA, 18 nt, Artificial Sequence
  Synthetic Oligonucleotide; CD80 exon 5; Set C
caaaaaauaacaagccau

SEQ ID NO: 56620 - RNA, 32 nt, Artificial Sequence
  Synthetic Oligonucleotide; CD80 exon 5; Set C
aaugacacaaaaaauaacaagccauugcuguu

SEQ ID NO: 56621 - RNA, 34 nt, Artificial Sequence
  Synthetic Oligonucleotide; CD80 exon 5; Set A
gaaugacacaaaaaauaacaagccauugcuguua

SEQ ID NO: 56622 - RNA, 36 nt, Artificial Sequence
  Synthetic Oligonucleotide; CD80 exon 5; Set A
agaaugacacaaaaaauaacaagccauugcuguuau

SEQ ID NO: 56623 - RNA, 40 nt, Artificial Sequence
  Synthetic Oligonucleotide; CD80 exon 5; Set A
uuagaaugacacaaaaaauaacaagccauugcuguuaucc

SEQ ID NO: 56624 - RNA, 21 nt, Artificial Sequence
  Synthetic Oligonucleotide; CD80 exon 5; Set C
cacaaaaaauaacaagccauu

SEQ ID NO: 56625 - RNA, 19 nt, Artificial Sequence
  Synthetic Oligonucleotide; CD80 exon 5; Set C
acaaaaaauaacaagccau

SEQ ID NO: 56626 - RNA, 33 nt, Artificial Sequence
  Synthetic Oligonucleotide; CD80 exon 5; Set A
gaaugacacaaaaaauaacaagccauugcuguu

SEQ ID NO: 56627 - RNA, 31 nt, Artificial Sequence
  Synthetic Oligonucleotide; CD80 exon 5; Set C
aaugacacaaaaaauaacaagccauugcugu

SEQ ID NO: 56628 - RNA, 35 nt, Artificial Sequence
  Synthetic Oligonucleotide; CD80 exon 5; Set A
agaaugacacaaaaaauaacaagccauugcuguua

SEQ ID NO: 56629 - RNA, 37 nt, Artificial Sequence
  Synthetic Oligonucleotide; CD80 exon 5; Set A
uagaaugacacaaaaaauaacaagccauugcuguuau

SEQ ID NO: 56630 - RNA, 20 nt, Artificial Sequence
  Synthetic Oligonucleotide; CD80 exon 5; Set C
cacaaaaaauaacaagccau

SEQ ID NO: 56631 - RNA, 34 nt, Artificial Sequence
  Synthetic Oligonucleotide; CD80 exon 5; Set A
agaaugacacaaaaaauaacaagccauugcuguu

SEQ ID NO: 56632 - RNA, 32 nt, Artificial Sequence
  Synthetic Oligonucleotide; CD80 exon 5; Set A
gaaugacacaaaaaauaacaagccauugcugu

SEQ ID NO: 56633 - RNA, 36 nt, Artificial Sequence
  Synthetic Oligonucleotide; CD80 exon 5; Set A
uagaaugacacaaaaaauaacaagccauugcuguua

SEQ ID NO: 56634 - RNA, 38 nt, Artificial Sequence
  Synthetic Oligonucleotide; CD80 exon 5; Set A
uuagaaugacacaaaaaauaacaagccauugcuguuau

SEQ ID NO: 56635 - RNA, 35 nt, Artificial Sequence
  Synthetic Oligonucleotide; CD80 exon 5; Set A
uagaaugacacaaaaaauaacaagccauugcuguu

SEQ ID NO: 56636 - RNA, 33 nt, Artificial Sequence
  Synthetic Oligonucleotide; CD80 exon 5; Set A
agaaugacacaaaaaauaacaagccauugcugu

SEQ ID NO: 56637 - RNA, 37 nt, Artificial Sequence
  Synthetic Oligonucleotide; CD80 exon 5; Set A
uuagaaugacacaaaaaauaacaagccauugcuguua

SEQ ID NO: 56638 - RNA, 39 nt, Artificial Sequence
  Synthetic Oligonucleotide; CD80 exon 5; Set A
auuagaaugacacaaaaaauaacaagccauugcuguuau

SEQ ID NO: 56639 - RNA, 26 nt, Artificial Sequence
  Synthetic Oligonucleotide; CD80 exon 5; Set C
augacacaaaaaauaacaagccauug

SEQ ID NO: 56640 - RNA, 36 nt, Artificial Sequence
  Synthetic Oligonucleotide; CD80 exon 5; Set A
uuagaaugacacaaaaaauaacaagccauugcuguu

SEQ ID NO: 56641 - RNA, 34 nt, Artificial Sequence
  Synthetic Oligonucleotide; CD80 exon 5; Set A
uagaaugacacaaaaaauaacaagccauugcugu

SEQ ID NO: 56642 - RNA, 38 nt, Artificial Sequence
  Synthetic Oligonucleotide; CD80 exon 5; Set A
auuagaaugacacaaaaaauaacaagccauugcuguua

SEQ ID NO: 56643 - RNA, 40 nt, Artificial Sequence
  Synthetic Oligonucleotide; CD80 exon 5; Set A
gauuagaaugacacaaaaaauaacaagccauugcuguuau

SEQ ID NO: 56644 - RNA, 25 nt, Artificial Sequence
  Synthetic Oligonucleotide; CD80 exon 5; Set C
augacacaaaaaauaacaagccauu

SEQ ID NO: 56645 - RNA, 35 nt, Artificial Sequence
  Synthetic Oligonucleotide; CD80 exon 5; Set A
uuagaaugacacaaaaaauaacaagccauugcugu

SEQ ID NO: 56646 - RNA, 39 nt, Artificial Sequence
  Synthetic Oligonucleotide; CD80 exon 5; Set A
gauuagaaugacacaaaaaauaacaagccauugcuguua

SEQ ID NO: 56647 - RNA, 24 nt, Artificial Sequence
  Synthetic Oligonucleotide; CD80 exon 5; Set C
augacacaaaaaauaacaagccau

SEQ ID NO: 56648 - RNA, 36 nt, Artificial Sequence
  Synthetic Oligonucleotide; CD80 exon 5; Set A
auuagaaugacacaaaaaauaacaagccauugcugu

SEQ ID NO: 56649 - RNA, 40 nt, Artificial Sequence
  Synthetic Oligonucleotide; CD80 exon 5; Set A
agauuagaaugacacaaaaaauaacaagccauugcuguua

SEQ ID NO: 56650 - RNA, 37 nt, Artificial Sequence
  Synthetic Oligonucleotide; CD80 exon 5; Set A
gauuagaaugacacaaaaaauaacaagccauugcugu

SEQ ID NO: 56651 - RNA, 38 nt, Artificial Sequence
  Synthetic Oligonucleotide; CD80 exon 5; Set A
agauuagaaugacacaaaaaauaacaagccauugcugu

SEQ ID NO: 56652 - RNA, 39 nt, Artificial Sequence
  Synthetic Oligonucleotide; CD80 exon 5; Set A
cagauuagaaugacacaaaaaauaacaagccauugcugu

SEQ ID NO: 56653 - RNA, 16 nt, Artificial Sequence
  Synthetic Oligonucleotide; CD80 exon 5; Set C
aaugacacaaaaaaua

SEQ ID NO: 56654 - RNA, 17 nt, Artificial Sequence
  Synthetic Oligonucleotide; CD80 exon 5; Set C
gaaugacacaaaaaaua

SEQ ID NO: 56655 - RNA, 18 nt, Artificial Sequence
  Synthetic Oligonucleotide; CD80 exon 5; Set C
agaaugacacaaaaaaua

SEQ ID NO: 56656 - RNA, 19 nt, Artificial Sequence
  Synthetic Oligonucleotide; CD80 exon 5; Set C
uagaaugacacaaaaaaua

SEQ ID NO: 56657 - RNA, 20 nt, Artificial Sequence
  Synthetic Oligonucleotide; CD80 exon 5; Set C
uuagaaugacacaaaaaaua

SEQ ID NO: 56658 - RNA, 21 nt, Artificial Sequence
  Synthetic Oligonucleotide; CD80 exon 5; Set C
auuagaaugacacaaaaaaua

SEQ ID NO: 56659 - RNA, 22 nt, Artificial Sequence
  Synthetic Oligonucleotide; CD80 exon 5; Set C
gauuagaaugacacaaaaaaua

SEQ ID NO: 56660 - RNA, 23 nt, Artificial Sequence
  Synthetic Oligonucleotide; CD80 exon 5; Set C
agauuagaaugacacaaaaaaua

SEQ ID NO: 56661 - RNA, 25 nt, Artificial Sequence
  Synthetic Oligonucleotide; CD80 exon 5; Set C
cagauuagaaugacacaaaaaauaa

SEQ ID NO: 56662 - RNA, 24 nt, Artificial Sequence
  Synthetic Oligonucleotide; CD80 exon 5; Set C
cagauuagaaugacacaaaaaaua

SEQ ID NO: 56663 - RNA, 32 nt, Artificial Sequence
  Synthetic Oligonucleotide; CD80 exon 5; Set C
gaccucuacagauuagaaugacacaaaaaaua

SEQ ID NO: 56664 - RNA, 31 nt, Artificial Sequence
  Synthetic Oligonucleotide; CD80 exon 5; Set C
gaccucuacagauuagaaugacacaaaaaau

SEQ ID NO: 56665 - RNA, 33 nt, Artificial Sequence
  Synthetic Oligonucleotide; CD80 exon 5; Set C
ugaccucuacagauuagaaugacacaaaaaaua

SEQ ID NO: 56666 - RNA, 15 nt, Artificial Sequence
  Synthetic Oligonucleotide; CD80 exon 5; Set C
cagauuagaaugaca

SEQ ID NO: 56667 - RNA, 32 nt, Artificial Sequence
  Synthetic Oligonucleotide; CD80 exon 5; Set C
ugaccucuacagauuagaaugacacaaaaaau

SEQ ID NO: 56668 - RNA, 34 nt, Artificial Sequence
  Synthetic Oligonucleotide; CD80 exon 5; Set C
uugaccucuacagauuagaaugacacaaaaaaua

SEQ ID NO: 56669 - RNA, 33 nt, Artificial Sequence
  Synthetic Oligonucleotide; CD80 exon 5; Set C
uugaccucuacagauuagaaugacacaaaaaau

SEQ ID NO: 56670 - RNA, 32 nt, Artificial Sequence
  Synthetic Oligonucleotide; CD80 exon 5; Set A
guugaccucuacagauuagaaugacacaaaaa

SEQ ID NO: 56671 - RNA, 31 nt, Artificial Sequence
  Synthetic Oligonucleotide; CD80 exon 5; Set A
guugaccucuacagauuagaaugacacaaaa

SEQ ID NO: 56672 - RNA, 30 nt, Artificial Sequence
  Synthetic Oligonucleotide; CD80 exon 5; Set A
guugaccucuacagauuagaaugacacaaa

SEQ ID NO: 56673 - RNA, 29 nt, Artificial Sequence
  Synthetic Oligonucleotide; CD80 exon 5; Set A
guugaccucuacagauuagaaugacacaa

SEQ ID NO: 56674 - RNA, 28 nt, Artificial Sequence
  Synthetic Oligonucleotide; CD80 exon 5; Set A
guugaccucuacagauuagaaugacaca

SEQ ID NO: 56675 - RNA, 27 nt, Artificial Sequence
  Synthetic Oligonucleotide; CD80 exon 5; Set A
guugaccucuacagauuagaaugacac

SEQ ID NO: 56676 - RNA, 40 nt, Artificial Sequence
  Synthetic Oligonucleotide; CD80 exon 5; Set A
uaccagaguugaccucuacagauuagaaugacacaaaaaa

SEQ ID NO: 56677 - RNA, 23 nt, Artificial Sequence
  Synthetic Oligonucleotide; CD80 exon 5; Set C
guugaccucuacagauuagaaug

SEQ ID NO: 56678 - RNA, 22 nt, Artificial Sequence
  Synthetic Oligonucleotide; CD80 exon 5; Set C
guugaccucuacagauuagaau

SEQ ID NO: 56679 - RNA, 21 nt, Artificial Sequence
  Synthetic Oligonucleotide; CD80 exon 5; Set C
guugaccucuacagauuagaa

SEQ ID NO: 56680 - RNA, 20 nt, Artificial Sequence
  Synthetic Oligonucleotide; CD80 exon 5; Set C
guugaccucuacagauuaga

SEQ ID NO: 56681 - RNA, 40 nt, Artificial Sequence
  Synthetic Oligonucleotide; CD80 exon 5; Set C
gauuaccagaguugaccucuacagauuagaaugacacaaa

SEQ ID NO: 56682 - RNA, 34 nt, Artificial Sequence
  Synthetic Oligonucleotide; CD80 exon 5; Set C
uaccagaguugaccucuacagauuagaaugacac

SEQ ID NO: 56683 - RNA, 19 nt, Artificial Sequence
  Synthetic Oligonucleotide; CD80 exon 5; Set C
guugaccucuacagauuag

SEQ ID NO: 56684 - RNA, 39 nt, Artificial Sequence
  Synthetic Oligonucleotide; CD80 exon 5; Set C
gauuaccagaguugaccucuacagauuagaaugacacaa

SEQ ID NO: 56685 - RNA, 18 nt, Artificial Sequence
  Synthetic Oligonucleotide; CD80 exon 5; Set C
guugaccucuacagauua

SEQ ID NO: 56686 - RNA, 38 nt, Artificial Sequence
  Synthetic Oligonucleotide; CD80 exon 5; Set C
gauuaccagaguugaccucuacagauuagaaugacaca

SEQ ID NO: 56687 - RNA, 36 nt, Artificial Sequence
  Synthetic Oligonucleotide; CD80 exon 5; Set C
auuaccagaguugaccucuacagauuagaaugacac

SEQ ID NO: 56688 - RNA, 17 nt, Artificial Sequence
  Synthetic Oligonucleotide; CD80 exon 5; Set C
guugaccucuacagauu

SEQ ID NO: 56689 - RNA, 37 nt, Artificial Sequence
  Synthetic Oligonucleotide; CD80 exon 5; Set C
gauuaccagaguugaccucuacagauuagaaugacac

SEQ ID NO: 56690 - RNA, 16 nt, Artificial Sequence
  Synthetic Oligonucleotide; CD80 exon 5; Set C
guugaccucuacagau

SEQ ID NO: 56691 - RNA, 30 nt, Artificial Sequence
  Synthetic Oligonucleotide; CD80 exon 5; Set A
uaccagaguugaccucuacagauuagaaug

SEQ ID NO: 56692 - RNA, 15 nt, Artificial Sequence
  Synthetic Oligonucleotide; CD80 exon 5; Set C
guugaccucuacaga

SEQ ID NO: 56693 - RNA, 33 nt, Artificial Sequence
  Synthetic Oligonucleotide; CD80 exon 5; Set A
gauuaccagaguugaccucuacagauuagaaug

SEQ ID NO: 56694 - RNA, 32 nt, Artificial Sequence
  Synthetic Oligonucleotide; CD80 exon 5; Set A
gauuaccagaguugaccucuacagauuagaau

SEQ ID NO: 56695 - RNA, 31 nt, Artificial Sequence
  Synthetic Oligonucleotide; CD80 exon 5; Set A
gauuaccagaguugaccucuacagauuagaa

SEQ ID NO: 56696 - RNA, 30 nt, Artificial Sequence
  Synthetic Oligonucleotide; CD80 exon 5; Set A
gauuaccagaguugaccucuacagauuaga

SEQ ID NO: 56697 - RNA, 29 nt, Artificial Sequence
  Synthetic Oligonucleotide; CD80 exon 5; Set A
gauuaccagaguugaccucuacagauuag

SEQ ID NO: 56698 - RNA, 35 nt, Artificial Sequence
  Synthetic Oligonucleotide; CD80 exon 5; Set A
agugauuaccagaguugaccucuacagauuagaau

SEQ ID NO: 56699 - RNA, 37 nt, Artificial Sequence
  Synthetic Oligonucleotide; CD80 exon 5; Set A
aagugauuaccagaguugaccucuacagauuagaaug

SEQ ID NO: 56700 - RNA, 28 nt, Artificial Sequence
  Synthetic Oligonucleotide; CD80 exon 5; Set A
gauuaccagaguugaccucuacagauua

SEQ ID NO: 56701 - RNA, 36 nt, Artificial Sequence
  Synthetic Oligonucleotide; CD80 exon 5; Set A
aagugauuaccagaguugaccucuacagauuagaau

SEQ ID NO: 56702 - RNA, 27 nt, Artificial Sequence
  Synthetic Oligonucleotide; CD80 exon 5; Set A
gauuaccagaguugaccucuacagauu

SEQ ID NO: 56703 - RNA, 37 nt, Artificial Sequence
  Synthetic Oligonucleotide; CD80 exon 5; Set A
caagugauuaccagaguugaccucuacagauuagaau

SEQ ID NO: 56704 - RNA, 35 nt, Artificial Sequence
  Synthetic Oligonucleotide; CD80 exon 5; Set A
aagugauuaccagaguugaccucuacagauuagaa

SEQ ID NO: 56705 - RNA, 34 nt, Artificial Sequence
  Synthetic Oligonucleotide; CD80 exon 5; Set A
aagugauuaccagaguugaccucuacagauuaga

SEQ ID NO: 56706 - RNA, 26 nt, Artificial Sequence
  Synthetic Oligonucleotide; CD80 exon 5; Set A
gauuaccagaguugaccucuacagau

SEQ ID NO: 56707 - RNA, 38 nt, Artificial Sequence
  Synthetic Oligonucleotide; CD80 exon 5; Set A
ucaagugauuaccagaguugaccucuacagauuagaau

SEQ ID NO: 56708 - RNA, 36 nt, Artificial Sequence
  Synthetic Oligonucleotide; CD80 exon 5; Set A
caagugauuaccagaguugaccucuacagauuagaa

SEQ ID NO: 56709 - RNA, 40 nt, Artificial Sequence
  Synthetic Oligonucleotide; CD80 exon 5; Set A
aucaagugauuaccagaguugaccucuacagauuagaaug

SEQ ID NO: 56710 - RNA, 33 nt, Artificial Sequence
  Synthetic Oligonucleotide; CD80 exon 5; Set A
aagugauuaccagaguugaccucuacagauuag

SEQ ID NO: 56711 - RNA, 25 nt, Artificial Sequence
  Synthetic Oligonucleotide; CD80 exon 5; Set A
gauuaccagaguugaccucuacaga

SEQ ID NO: 56712 - RNA, 35 nt, Artificial Sequence
  Synthetic Oligonucleotide; CD80 exon 5; Set A
caagugauuaccagaguugaccucuacagauuaga

SEQ ID NO: 56713 - RNA, 39 nt, Artificial Sequence
  Synthetic Oligonucleotide; CD80 exon 5; Set A
aucaagugauuaccagaguugaccucuacagauuagaau

SEQ ID NO: 56714 - RNA, 37 nt, Artificial Sequence
  Synthetic Oligonucleotide; CD80 exon 5; Set A
ucaagugauuaccagaguugaccucuacagauuagaa

SEQ ID NO: 56715 - RNA, 32 nt, Artificial Sequence
  Synthetic Oligonucleotide; CD80 exon 5; Set A
aagugauuaccagaguugaccucuacagauua

SEQ ID NO: 56716 - RNA, 24 nt, Artificial Sequence
  Synthetic Oligonucleotide; CD80 exon 5; Set A
gauuaccagaguugaccucuacag

SEQ ID NO: 56717 - RNA, 36 nt, Artificial Sequence
  Synthetic Oligonucleotide; CD80 exon 5; Set C
ucaagugauuaccagaguugaccucuacagauuaga

SEQ ID NO: 56718 - RNA, 34 nt, Artificial Sequence
  Synthetic Oligonucleotide; CD80 exon 5; Set A
caagugauuaccagaguugaccucuacagauuag

SEQ ID NO: 56719 - RNA, 38 nt, Artificial Sequence
  Synthetic Oligonucleotide; CD80 exon 5; Set A
aucaagugauuaccagaguugaccucuacagauuagaa

SEQ ID NO: 56720 - RNA, 31 nt, Artificial Sequence
  Synthetic Oligonucleotide; CD80 exon 5; Set A
aagugauuaccagaguugaccucuacagauu

SEQ ID NO: 56721 - RNA, 37 nt, Artificial Sequence
  Synthetic Oligonucleotide; CD80 exon 5; Set C
aucaagugauuaccagaguugaccucuacagauuaga

SEQ ID NO: 56722 - RNA, 35 nt, Artificial Sequence
  Synthetic Oligonucleotide; CD80 exon 5; Set A
ucaagugauuaccagaguugaccucuacagauuag

SEQ ID NO: 56723 - RNA, 33 nt, Artificial Sequence
  Synthetic Oligonucleotide; CD80 exon 5; Set A
caagugauuaccagaguugaccucuacagauua

SEQ ID NO: 56724 - RNA, 36 nt, Artificial Sequence
  Synthetic Oligonucleotide; CD80 exon 5; Set A
aucaagugauuaccagaguugaccucuacagauuag

SEQ ID NO: 56725 - RNA, 34 nt, Artificial Sequence
  Synthetic Oligonucleotide; CD80 exon 5; Set A
ucaagugauuaccagaguugaccucuacagauua

SEQ ID NO: 56726 - RNA, 30 nt, Artificial Sequence
  Synthetic Oligonucleotide; CD80 exon 5; Set A
aagugauuaccagaguugaccucuacagau

SEQ ID NO: 56727 - RNA, 29 nt, Artificial Sequence
  Synthetic Oligonucleotide; CD80 exon 5; Set A
aagugauuaccagaguugaccucuacaga

SEQ ID NO: 56728 - RNA, 35 nt, Artificial Sequence
  Synthetic Oligonucleotide; CD80 exon 5; Set A
aucaagugauuaccagaguugaccucuacagauua

SEQ ID NO: 56729 - RNA, 33 nt, Artificial Sequence
  Synthetic Oligonucleotide; CD80 exon 5; Set A
ucaagugauuaccagaguugaccucuacagauu

SEQ ID NO: 56730 - RNA, 28 nt, Artificial Sequence
  Synthetic Oligonucleotide; CD80 exon 5; Set A
aagugauuaccagaguugaccucuacag

SEQ ID NO: 56731 - RNA, 34 nt, Artificial Sequence
  Synthetic Oligonucleotide; CD80 exon 5; Set A
aucaagugauuaccagaguugaccucuacagauu

SEQ ID NO: 56732 - RNA, 35 nt, Artificial Sequence
  Synthetic Oligonucleotide; CD80 exon 5; Set C
caucaagugauuaccagaguugaccucuacagauu

SEQ ID NO: 56733 - RNA, 33 nt, Artificial Sequence
  Synthetic Oligonucleotide; CD80 exon 5; Set A
aucaagugauuaccagaguugaccucuacagau

SEQ ID NO: 56734 - RNA, 32 nt, Artificial Sequence
  Synthetic Oligonucleotide; CD80 exon 5; Set A
aucaagugauuaccagaguugaccucuacaga

SEQ ID NO: 56735 - RNA, 34 nt, Artificial Sequence
  Synthetic Oligonucleotide; CD80 exon 5; Set C
caucaagugauuaccagaguugaccucuacagau

SEQ ID NO: 56736 - RNA, 33 nt, Artificial Sequence
  Synthetic Oligonucleotide; CD80 exon 5; Set C
caucaagugauuaccagaguugaccucuacaga

SEQ ID NO: 56737 - RNA, 31 nt, Artificial Sequence
  Synthetic Oligonucleotide; CD80 exon 5; Set A
aucaagugauuaccagaguugaccucuacag

SEQ ID NO: 56738 - RNA, 32 nt, Artificial Sequence
  Synthetic Oligonucleotide; CD80 exon 5; Set A
caucaagugauuaccagaguugaccucuacag

SEQ ID NO: 56739 - RNA, 16 nt, Artificial Sequence
  Synthetic Oligonucleotide; CD80 exon 5; Set C
gauuaccagaguugac

SEQ ID NO: 56740 - RNA, 39 nt, Artificial Sequence
  Synthetic Oligonucleotide; CD80 exon 5; Set C
gagacaucaagugauuaccagaguugaccucuacagauu

SEQ ID NO: 56741 - RNA, 15 nt, Artificial Sequence
  Synthetic Oligonucleotide; CD80 exon 5; Set C
gauuaccagaguuga

SEQ ID NO: 56742 - RNA, 38 nt, Artificial Sequence
  Synthetic Oligonucleotide; CD80 exon 5; Set C
gagacaucaagugauuaccagaguugaccucuacagau

SEQ ID NO: 56743 - RNA, 37 nt, Artificial Sequence
  Synthetic Oligonucleotide; CD80 exon 5; Set C
gagacaucaagugauuaccagaguugaccucuacaga

SEQ ID NO: 56744 - RNA, 36 nt, Artificial Sequence
  Synthetic Oligonucleotide; CD80 exon 5; Set C
gagacaucaagugauuaccagaguugaccucuacag

SEQ ID NO: 56745 - RNA, 40 nt, Artificial Sequence
  Synthetic Oligonucleotide; CD80 exon 5; Set C
uggagacaucaagugauuaccagaguugaccucuacagau

SEQ ID NO: 56746 - RNA, 20 nt, Artificial Sequence
  Synthetic Oligonucleotide; CD80 exon 5; Set C
aagugauuaccagaguugac

SEQ ID NO: 56747 - RNA, 39 nt, Artificial Sequence
  Synthetic Oligonucleotide; CD80 exon 5; Set C
uggagacaucaagugauuaccagaguugaccucuacaga

SEQ ID NO: 56748 - RNA, 19 nt, Artificial Sequence
  Synthetic Oligonucleotide; CD80 exon 5; Set C
aagugauuaccagaguuga

SEQ ID NO: 56749 - RNA, 21 nt, Artificial Sequence
  Synthetic Oligonucleotide; CD80 exon 5; Set C
caagugauuaccagaguugac

SEQ ID NO: 56750 - RNA, 18 nt, Artificial Sequence
  Synthetic Oligonucleotide; CD80 exon 5; Set C
aagugauuaccagaguug

SEQ ID NO: 56751 - RNA, 20 nt, Artificial Sequence
  Synthetic Oligonucleotide; CD80 exon 5; Set C
caagugauuaccagaguuga

SEQ ID NO: 56752 - RNA, 22 nt, Artificial Sequence
  Synthetic Oligonucleotide; CD80 exon 5; Set C
ucaagugauuaccagaguugac

SEQ ID NO: 56753 - RNA, 21 nt, Artificial Sequence
  Synthetic Oligonucleotide; CD80 exon 5; Set C
ucaagugauuaccagaguuga

SEQ ID NO: 56754 - RNA, 23 nt, Artificial Sequence
  Synthetic Oligonucleotide; CD80 exon 5; Set C
aucaagugauuaccagaguugac

SEQ ID NO: 56755 - RNA, 22 nt, Artificial Sequence
  Synthetic Oligonucleotide; CD80 exon 5; Set C
aucaagugauuaccagaguuga

SEQ ID NO: 56756 - RNA, 20 nt, Artificial Sequence
  Synthetic Oligonucleotide; CD80 exon 5; Set C
ucaagugauuaccagaguug

SEQ ID NO: 56757 - RNA, 21 nt, Artificial Sequence
  Synthetic Oligonucleotide; CD80 exon 5; Set C
aucaagugauuaccagaguug

SEQ ID NO: 56758 - RNA, 22 nt, Artificial Sequence
  Synthetic Oligonucleotide; CD80 exon 5; Set C
acaucaagugauuaccagaguu

SEQ ID NO: 56759 - RNA, 29 nt, Artificial Sequence
  Synthetic Oligonucleotide; CD80 exon 5; Set A
ggagacaucaagugauuaccagaguugac

SEQ ID NO: 56760 - RNA, 23 nt, Artificial Sequence
  Synthetic Oligonucleotide; CD80 exon 5; Set C
gacaucaagugauuaccagaguu

SEQ ID NO: 56761 - RNA, 28 nt, Artificial Sequence
  Synthetic Oligonucleotide; CD80 exon 5; Set A
ggagacaucaagugauuaccagaguuga

SEQ ID NO: 56762 - RNA, 30 nt, Artificial Sequence
  Synthetic Oligonucleotide; CD80 exon 5; Set A
uggagacaucaagugauuaccagaguugac

SEQ ID NO: 56763 - RNA, 24 nt, Artificial Sequence
  Synthetic Oligonucleotide; CD80 exon 5; Set C
agacaucaagugauuaccagaguu

SEQ ID NO: 56764 - RNA, 29 nt, Artificial Sequence
  Synthetic Oligonucleotide; CD80 exon 5; Set A
uggagacaucaagugauuaccagaguuga

SEQ ID NO: 56765 - RNA, 27 nt, Artificial Sequence
  Synthetic Oligonucleotide; CD80 exon 5; Set A
ggagacaucaagugauuaccagaguug

SEQ ID NO: 56766 - RNA, 31 nt, Artificial Sequence
  Synthetic Oligonucleotide; CD80 exon 5; Set A
auggagacaucaagugauuaccagaguugac

SEQ ID NO: 56767 - RNA, 28 nt, Artificial Sequence
  Synthetic Oligonucleotide; CD80 exon 5; Set A
uggagacaucaagugauuaccagaguug

SEQ ID NO: 56768 - RNA, 30 nt, Artificial Sequence
  Synthetic Oligonucleotide; CD80 exon 5; Set A
auggagacaucaagugauuaccagaguuga

SEQ ID NO: 56769 - RNA, 29 nt, Artificial Sequence
  Synthetic Oligonucleotide; CD80 exon 5; Set A
auggagacaucaagugauuaccagaguug

SEQ ID NO: 56770 - RNA, 29 nt, Artificial Sequence
  Synthetic Oligonucleotide; CD80 exon 5; Set A
aauggagacaucaagugauuaccagaguu

SEQ ID NO: 56771 - RNA, 30 nt, Artificial Sequence
  Synthetic Oligonucleotide; CD80 exon 5; Set A
gaauggagacaucaagugauuaccagaguu

SEQ ID NO: 56772 - RNA, 34 nt, Artificial Sequence
  Synthetic Oligonucleotide; CD80 exon 5; Set A
auugaauggagacaucaagugauuaccagaguug

SEQ ID NO: 56773 - RNA, 38 nt, Artificial Sequence
  Synthetic Oligonucleotide; CD80 exon 5; Set A
agauugaauggagacaucaagugauuaccagaguugac

SEQ ID NO: 56774 - RNA, 37 nt, Artificial Sequence
  Synthetic Oligonucleotide; CD80 exon 5; Set A
agauugaauggagacaucaagugauuaccagaguuga

SEQ ID NO: 56775 - RNA, 39 nt, Artificial Sequence
  Synthetic Oligonucleotide; CD80 exon 5; Set C
cagauugaauggagacaucaagugauuaccagaguugac

SEQ ID NO: 56776 - RNA, 19 nt, Artificial Sequence
  Synthetic Oligonucleotide; CD80 exon 5; Set C
ggagacaucaagugauuac

SEQ ID NO: 56777 - RNA, 36 nt, Artificial Sequence
  Synthetic Oligonucleotide; CD80 exon 5; Set A
agauugaauggagacaucaagugauuaccagaguug

SEQ ID NO: 56778 - RNA, 18 nt, Artificial Sequence
  Synthetic Oligonucleotide; CD80 exon 5; Set C
ggagacaucaagugauua

SEQ ID NO: 56779 - RNA, 38 nt, Artificial Sequence
  Synthetic Oligonucleotide; CD80 exon 5; Set C
cagauugaauggagacaucaagugauuaccagaguuga

SEQ ID NO: 56780 - RNA, 20 nt, Artificial Sequence
  Synthetic Oligonucleotide; CD80 exon 5; Set C
uggagacaucaagugauuac

SEQ ID NO: 56781 - RNA, 34 nt, Artificial Sequence
  Synthetic Oligonucleotide; CD80 exon 5; Set A
gauugaauggagacaucaagugauuaccagaguu

SEQ ID NO: 56782 - RNA, 19 nt, Artificial Sequence
  Synthetic Oligonucleotide; CD80 exon 5; Set C
uggagacaucaagugauua

SEQ ID NO: 56783 - RNA, 37 nt, Artificial Sequence
  Synthetic Oligonucleotide; CD80 exon 5; Set A
cagauugaauggagacaucaagugauuaccagaguug

SEQ ID NO: 56784 - RNA, 17 nt, Artificial Sequence
  Synthetic Oligonucleotide; CD80 exon 5; Set C
ggagacaucaagugauu

SEQ ID NO: 56785 - RNA, 21 nt, Artificial Sequence
  Synthetic Oligonucleotide; CD80 exon 5; Set C
auggagacaucaagugauuac

SEQ ID NO: 56786 - RNA, 15 nt, Artificial Sequence
  Synthetic Oligonucleotide; CD80 exon 5; Set C
gagacaucaagugau

SEQ ID NO: 56787 - RNA, 20 nt, Artificial Sequence
  Synthetic Oligonucleotide; CD80 exon 5; Set C
auggagacaucaagugauua

SEQ ID NO: 56788 - RNA, 18 nt, Artificial Sequence
  Synthetic Oligonucleotide; CD80 exon 5; Set C
uggagacaucaagugauu

SEQ ID NO: 56789 - RNA, 19 nt, Artificial Sequence
  Synthetic Oligonucleotide; CD80 exon 5; Set C
auggagacaucaagugauu

SEQ ID NO: 56790 - RNA, 18 nt, Artificial Sequence
  Synthetic Oligonucleotide; CD80 exon 5; Set C
aauggagacaucaaguga

SEQ ID NO: 56791 - RNA, 21 nt, Artificial Sequence
  Synthetic Oligonucleotide; CD80 exon 5; Set C
ugaauggagacaucaagugau

SEQ ID NO: 56792 - RNA, 19 nt, Artificial Sequence
  Synthetic Oligonucleotide; CD80 exon 5; Set C
gaauggagacaucaaguga

SEQ ID NO: 56793 - RNA, 17 nt, Artificial Sequence
  Synthetic Oligonucleotide; CD80 exon 5; Set C
aauggagacaucaagug

SEQ ID NO: 56794 - RNA, 28 nt, Artificial Sequence
  Synthetic Oligonucleotide; CD80 exon 5; Set C
agauugaauggagacaucaagugauuac

SEQ ID NO: 56795 - RNA, 22 nt, Artificial Sequence
  Synthetic Oligonucleotide; CD80 exon 5; Set C
uugaauggagacaucaagugau

SEQ ID NO: 56796 - RNA, 16 nt, Artificial Sequence
  Synthetic Oligonucleotide; CD80 exon 5; Set C
aauggagacaucaagu

SEQ ID NO: 56797 - RNA, 18 nt, Artificial Sequence
  Synthetic Oligonucleotide; CD80 exon 5; Set C
gaauggagacaucaagug

SEQ ID NO: 56798 - RNA, 27 nt, Artificial Sequence
  Synthetic Oligonucleotide; CD80 exon 5; Set C
agauugaauggagacaucaagugauua

SEQ ID NO: 56799 - RNA, 29 nt, Artificial Sequence
  Synthetic Oligonucleotide; CD80 exon 5; Set A
cagauugaauggagacaucaagugauuac

SEQ ID NO: 56800 - RNA, 23 nt, Artificial Sequence
  Synthetic Oligonucleotide; CD80 exon 5; Set C
auugaauggagacaucaagugau

SEQ ID NO: 56801 - RNA, 17 nt, Artificial Sequence
  Synthetic Oligonucleotide; CD80 exon 5; Set C
gaauggagacaucaagu

SEQ ID NO: 56802 - RNA, 28 nt, Artificial Sequence
  Synthetic Oligonucleotide; CD80 exon 5; Set C
cagauugaauggagacaucaagugauua

SEQ ID NO: 56803 - RNA, 26 nt, Artificial Sequence
  Synthetic Oligonucleotide; CD80 exon 5; Set C
agauugaauggagacaucaagugauu

SEQ ID NO: 56804 - RNA, 24 nt, Artificial Sequence
  Synthetic Oligonucleotide; CD80 exon 5; Set C
gauugaauggagacaucaagugau

SEQ ID NO: 56805 - RNA, 27 nt, Artificial Sequence
  Synthetic Oligonucleotide; CD80 exon 5; Set C
cagauugaauggagacaucaagugauu

SEQ ID NO: 56806 - RNA, 17 nt, Artificial Sequence
  Synthetic Oligonucleotide; CD80 exon 5; Set C
ugaauggagacaucaag

SEQ ID NO: 56807 - RNA, 15 nt, Artificial Sequence
  Synthetic Oligonucleotide; CD80 exon 5; Set C
gaauggagacaucaa

SEQ ID NO: 56808 - RNA, 23 nt, Artificial Sequence
  Synthetic Oligonucleotide; CD80 exon 5; Set C
gauugaauggagacaucaaguga

SEQ ID NO: 56809 - RNA, 18 nt, Artificial Sequence
  Synthetic Oligonucleotide; CD80 exon 5; Set C
uugaauggagacaucaag

SEQ ID NO: 56810 - RNA, 16 nt, Artificial Sequence
  Synthetic Oligonucleotide; CD80 exon 5; Set C
ugaauggagacaucaa

SEQ ID NO: 56811 - RNA, 22 nt, Artificial Sequence
  Synthetic Oligonucleotide; CD80 exon 5; Set C
gauugaauggagacaucaagug

SEQ ID NO: 56812 - RNA, 19 nt, Artificial Sequence
  Synthetic Oligonucleotide; CD80 exon 5; Set C
auugaauggagacaucaag

SEQ ID NO: 56813 - RNA, 15 nt, Artificial Sequence
  Synthetic Oligonucleotide; CD80 exon 5; Set C
ugaauggagacauca

SEQ ID NO: 56814 - RNA, 21 nt, Artificial Sequence
  Synthetic Oligonucleotide; CD80 exon 5; Set C
gauugaauggagacaucaagu

SEQ ID NO: 56815 - RNA, 34 nt, Artificial Sequence
  Synthetic Oligonucleotide; CD80 exon 5; Set A
aacaccagauugaauggagacaucaagugauuac

SEQ ID NO: 56816 - RNA, 33 nt, Artificial Sequence
  Synthetic Oligonucleotide; CD80 exon 5; Set A
aacaccagauugaauggagacaucaagugauua

SEQ ID NO: 56817 - RNA, 15 nt, Artificial Sequence
  Synthetic Oligonucleotide; CD80 exon 5; Set C
uugaauggagacauc

SEQ ID NO: 56818 - RNA, 19 nt, Artificial Sequence
  Synthetic Oligonucleotide; CD80 exon 5; Set C
gauugaauggagacaucaa

SEQ ID NO: 56819 - RNA, 32 nt, Artificial Sequence
  Synthetic Oligonucleotide; CD80 exon 5; Set A
aacaccagauugaauggagacaucaagugauu

SEQ ID NO: 56820 - RNA, 16 nt, Artificial Sequence
  Synthetic Oligonucleotide; CD80 exon 5; Set C
auugaauggagacauc

SEQ ID NO: 56821 - RNA, 18 nt, Artificial Sequence
  Synthetic Oligonucleotide; CD80 exon 5; Set C
gauugaauggagacauca

SEQ ID NO: 56822 - RNA, 15 nt, Artificial Sequence
  Synthetic Oligonucleotide; CD80 exon 5; Set C
auugaauggagacau

SEQ ID NO: 56823 - RNA, 17 nt, Artificial Sequence
  Synthetic Oligonucleotide; CD80 exon 5; Set C
gauugaauggagacauc

SEQ ID NO: 56824 - RNA, 32 nt, Artificial Sequence
  Synthetic Oligonucleotide; CD80 exon 5; Set A
aaacaccagauugaauggagacaucaagugau

SEQ ID NO: 56825 - RNA, 16 nt, Artificial Sequence
  Synthetic Oligonucleotide; CD80 exon 5; Set C
agauugaauggagaca

SEQ ID NO: 56826 - RNA, 34 nt, Artificial Sequence
  Synthetic Oligonucleotide; CD80 exon 5; Set A
uaaaacaccagauugaauggagacaucaagugau

SEQ ID NO: 56827 - RNA, 32 nt, Artificial Sequence
  Synthetic Oligonucleotide; CD80 exon 5; Set A
aaaacaccagauugaauggagacaucaaguga

SEQ ID NO: 56828 - RNA, 15 nt, Artificial Sequence
  Synthetic Oligonucleotide; CD80 exon 5; Set C
agauugaauggagac

SEQ ID NO: 56829 - RNA, 17 nt, Artificial Sequence
  Synthetic Oligonucleotide; CD80 exon 5; Set C
cagauugaauggagaca

SEQ ID NO: 56830 - RNA, 35 nt, Artificial Sequence
  Synthetic Oligonucleotide; CD80 exon 5; Set A
cuaaaacaccagauugaauggagacaucaagugau

SEQ ID NO: 56831 - RNA, 33 nt, Artificial Sequence
  Synthetic Oligonucleotide; CD80 exon 5; Set A
uaaaacaccagauugaauggagacaucaaguga

SEQ ID NO: 56832 - RNA, 31 nt, Artificial Sequence
  Synthetic Oligonucleotide; CD80 exon 5; Set A
aaaacaccagauugaauggagacaucaagug

SEQ ID NO: 56833 - RNA, 16 nt, Artificial Sequence
  Synthetic Oligonucleotide; CD80 exon 5; Set C
cagauugaauggagac

SEQ ID NO: 56834 - RNA, 28 nt, Artificial Sequence
  Synthetic Oligonucleotide; CD80 exon 5; Set C
aaacaccagauugaauggagacaucaag

SEQ ID NO: 56835 - RNA, 36 nt, Artificial Sequence
  Synthetic Oligonucleotide; CD80 exon 5; Set A
ucuaaaacaccagauugaauggagacaucaagugau

SEQ ID NO: 56836 - RNA, 30 nt, Artificial Sequence
  Synthetic Oligonucleotide; CD80 exon 5; Set A
aaaacaccagauugaauggagacaucaagu

SEQ ID NO: 56837 - RNA, 34 nt, Artificial Sequence
  Synthetic Oligonucleotide; CD80 exon 5; Set A
cuaaaacaccagauugaauggagacaucaaguga

SEQ ID NO: 56838 - RNA, 32 nt, Artificial Sequence
  Synthetic Oligonucleotide; CD80 exon 5; Set A
uaaaacaccagauugaauggagacaucaagug

SEQ ID NO: 56839 - RNA, 15 nt, Artificial Sequence
  Synthetic Oligonucleotide; CD80 exon 5; Set C
cagauugaauggaga

SEQ ID NO: 56840 - RNA, 37 nt, Artificial Sequence
  Synthetic Oligonucleotide; CD80 exon 5; Set A
cucuaaaacaccagauugaauggagacaucaagugau

SEQ ID NO: 56841 - RNA, 31 nt, Artificial Sequence
  Synthetic Oligonucleotide; CD80 exon 5; Set A
uaaaacaccagauugaauggagacaucaagu

SEQ ID NO: 56842 - RNA, 35 nt, Artificial Sequence
  Synthetic Oligonucleotide; CD80 exon 5; Set A
ucuaaaacaccagauugaauggagacaucaaguga

SEQ ID NO: 56843 - RNA, 38 nt, Artificial Sequence
  Synthetic Oligonucleotide; CD80 exon 5; Set A
ucucuaaaacaccagauugaauggagacaucaagugau

SEQ ID NO: 56844 - RNA, 28 nt, Artificial Sequence
  Synthetic Oligonucleotide; CD80 exon 5; Set C
aaaacaccagauugaauggagacaucaa

SEQ ID NO: 56845 - RNA, 32 nt, Artificial Sequence
  Synthetic Oligonucleotide; CD80 exon 5; Set A
cuaaaacaccagauugaauggagacaucaagu

SEQ ID NO: 56846 - RNA, 36 nt, Artificial Sequence
  Synthetic Oligonucleotide; CD80 exon 5; Set A
cucuaaaacaccagauugaauggagacaucaaguga

SEQ ID NO: 56847 - RNA, 34 nt, Artificial Sequence
  Synthetic Oligonucleotide; CD80 exon 5; Set A
ucuaaaacaccagauugaauggagacaucaagug

SEQ ID NO: 56848 - RNA, 31 nt, Artificial Sequence
  Synthetic Oligonucleotide; CD80 exon 5; Set A
cuaaaacaccagauugaauggagacaucaag

SEQ ID NO: 56849 - RNA, 39 nt, Artificial Sequence
  Synthetic Oligonucleotide; CD80 exon 5; Set A
uucucuaaaacaccagauugaauggagacaucaagugau

SEQ ID NO: 56850 - RNA, 25 nt, Artificial Sequence
  Synthetic Oligonucleotide; CD80 exon 5; Set C
aaacaccagauugaauggagacauc

SEQ ID NO: 56851 - RNA, 27 nt, Artificial Sequence
  Synthetic Oligonucleotide; CD80 exon 5; Set C
aaaacaccagauugaauggagacauca

SEQ ID NO: 56852 - RNA, 29 nt, Artificial Sequence
  Synthetic Oligonucleotide; CD80 exon 5; Set C
uaaaacaccagauugaauggagacaucaa

SEQ ID NO: 56853 - RNA, 33 nt, Artificial Sequence
  Synthetic Oligonucleotide; CD80 exon 5; Set A
ucuaaaacaccagauugaauggagacaucaagu

SEQ ID NO: 56854 - RNA, 37 nt, Artificial Sequence
  Synthetic Oligonucleotide; CD80 exon 5; Set A
ucucuaaaacaccagauugaauggagacaucaaguga

SEQ ID NO: 56855 - RNA, 35 nt, Artificial Sequence
  Synthetic Oligonucleotide; CD80 exon 5; Set A
cucuaaaacaccagauugaauggagacaucaagug

SEQ ID NO: 56856 - RNA, 22 nt, Artificial Sequence
  Synthetic Oligonucleotide; CD80 exon 5; Set C
aacaccagauugaauggagaca

SEQ ID NO: 56857 - RNA, 24 nt, Artificial Sequence
  Synthetic Oligonucleotide; CD80 exon 5; Set C
aaacaccagauugaauggagacau

SEQ ID NO: 56858 - RNA, 32 nt, Artificial Sequence
  Synthetic Oligonucleotide; CD80 exon 5; Set A
ucuaaaacaccagauugaauggagacaucaag

SEQ ID NO: 56859 - RNA, 28 nt, Artificial Sequence
  Synthetic Oligonucleotide; CD80 exon 5; Set C
uaaaacaccagauugaauggagacauca

SEQ ID NO: 56860 - RNA, 30 nt, Artificial Sequence
  Synthetic Oligonucleotide; CD80 exon 5; Set A
cuaaaacaccagauugaauggagacaucaa

SEQ ID NO: 56861 - RNA, 34 nt, Artificial Sequence
  Synthetic Oligonucleotide; CD80 exon 5; Set A
cucuaaaacaccagauugaauggagacaucaagu

SEQ ID NO: 56862 - RNA, 38 nt, Artificial Sequence
  Synthetic Oligonucleotide; CD80 exon 5; Set A
uucucuaaaacaccagauugaauggagacaucaaguga

SEQ ID NO: 56863 - RNA, 36 nt, Artificial Sequence
  Synthetic Oligonucleotide; CD80 exon 5; Set A
ucucuaaaacaccagauugaauggagacaucaagug

SEQ ID NO: 56864 - RNA, 21 nt, Artificial Sequence
  Synthetic Oligonucleotide; CD80 exon 5; Set C
aacaccagauugaauggagac

SEQ ID NO: 56865 - RNA, 33 nt, Artificial Sequence
  Synthetic Oligonucleotide; CD80 exon 5; Set A
cucuaaaacaccagauugaauggagacaucaag

SEQ ID NO: 56866 - RNA, 27 nt, Artificial Sequence
  Synthetic Oligonucleotide; CD80 exon 5; Set C
uaaaacaccagauugaauggagacauc

SEQ ID NO: 56867 - RNA, 29 nt, Artificial Sequence
  Synthetic Oligonucleotide; CD80 exon 5; Set A
cuaaaacaccagauugaauggagacauca

SEQ ID NO: 56868 - RNA, 31 nt, Artificial Sequence
  Synthetic Oligonucleotide; CD80 exon 5; Set A
ucuaaaacaccagauugaauggagacaucaa

SEQ ID NO: 56869 - RNA, 35 nt, Artificial Sequence
  Synthetic Oligonucleotide; CD80 exon 5; Set A
ucucuaaaacaccagauugaauggagacaucaagu

SEQ ID NO: 56870 - RNA, 39 nt, Artificial Sequence
  Synthetic Oligonucleotide; CD80 exon 5; Set A
uuucucuaaaacaccagauugaauggagacaucaaguga

SEQ ID NO: 56871 - RNA, 37 nt, Artificial Sequence
  Synthetic Oligonucleotide; CD80 exon 5; Set A
uucucuaaaacaccagauugaauggagacaucaagug

SEQ ID NO: 56872 - RNA, 20 nt, Artificial Sequence
  Synthetic Oligonucleotide; CD80 exon 5; Set C
aacaccagauugaauggaga

SEQ ID NO: 56873 - RNA, 34 nt, Artificial Sequence
  Synthetic Oligonucleotide; CD80 exon 5; Set A
ucucuaaaacaccagauugaauggagacaucaag

SEQ ID NO: 56874 - RNA, 28 nt, Artificial Sequence
  Synthetic Oligonucleotide; CD80 exon 5; Set C
cuaaaacaccagauugaauggagacauc

SEQ ID NO: 56875 - RNA, 30 nt, Artificial Sequence
  Synthetic Oligonucleotide; CD80 exon 5; Set A
ucuaaaacaccagauugaauggagacauca

SEQ ID NO: 56876 - RNA, 32 nt, Artificial Sequence
  Synthetic Oligonucleotide; CD80 exon 5; Set A
cucuaaaacaccagauugaauggagacaucaa

SEQ ID NO: 56877 - RNA, 36 nt, Artificial Sequence
  Synthetic Oligonucleotide; CD80 exon 5; Set A
uucucuaaaacaccagauugaauggagacaucaagu

SEQ ID NO: 56878 - RNA, 40 nt, Artificial Sequence
  Synthetic Oligonucleotide; CD80 exon 5; Set A
uuuucucuaaaacaccagauugaauggagacaucaaguga

SEQ ID NO: 56879 - RNA, 38 nt, Artificial Sequence
  Synthetic Oligonucleotide; CD80 exon 5; Set A
uuucucuaaaacaccagauugaauggagacaucaagug

SEQ ID NO: 56880 - RNA, 29 nt, Artificial Sequence
  Synthetic Oligonucleotide; CD80 exon 5; Set A
ucuaaaacaccagauugaauggagacauc

SEQ ID NO: 56881 - RNA, 31 nt, Artificial Sequence
  Synthetic Oligonucleotide; CD80 exon 5; Set A
cucuaaaacaccagauugaauggagacauca

SEQ ID NO: 56882 - RNA, 33 nt, Artificial Sequence
  Synthetic Oligonucleotide; CD80 exon 5; Set A
ucucuaaaacaccagauugaauggagacaucaa

SEQ ID NO: 56883 - RNA, 37 nt, Artificial Sequence
  Synthetic Oligonucleotide; CD80 exon 5; Set A
uuucucuaaaacaccagauugaauggagacaucaagu

SEQ ID NO: 56884 - RNA, 39 nt, Artificial Sequence
  Synthetic Oligonucleotide; CD80 exon 5; Set A
uuuucucuaaaacaccagauugaauggagacaucaagug

SEQ ID NO: 56885 - RNA, 20 nt, Artificial Sequence
  Synthetic Oligonucleotide; CD80 exon 5; Set C
aaacaccagauugaauggag

SEQ ID NO: 56886 - RNA, 30 nt, Artificial Sequence
  Synthetic Oligonucleotide; CD80 exon 5; Set A
cucuaaaacaccagauugaauggagacauc

SEQ ID NO: 56887 - RNA, 32 nt, Artificial Sequence
  Synthetic Oligonucleotide; CD80 exon 5; Set A
ucucuaaaacaccagauugaauggagacauca

SEQ ID NO: 56888 - RNA, 34 nt, Artificial Sequence
  Synthetic Oligonucleotide; CD80 exon 5; Set A
uucucuaaaacaccagauugaauggagacaucaa

SEQ ID NO: 56889 - RNA, 38 nt, Artificial Sequence
  Synthetic Oligonucleotide; CD80 exon 5; Set A
uuuucucuaaaacaccagauugaauggagacaucaagu

SEQ ID NO: 56890 - RNA, 40 nt, Artificial Sequence
  Synthetic Oligonucleotide; CD80 exon 5; Set A
uuuuucucuaaaacaccagauugaauggagacaucaagug

SEQ ID NO: 56891 - RNA, 31 nt, Artificial Sequence
  Synthetic Oligonucleotide; CD80 exon 5; Set A
ucucuaaaacaccagauugaauggagacauc

SEQ ID NO: 56892 - RNA, 33 nt, Artificial Sequence
  Synthetic Oligonucleotide; CD80 exon 5; Set A
uucucuaaaacaccagauugaauggagacauca

SEQ ID NO: 56893 - RNA, 35 nt, Artificial Sequence
  Synthetic Oligonucleotide; CD80 exon 5; Set A
uuucucuaaaacaccagauugaauggagacaucaa

SEQ ID NO: 56894 - RNA, 39 nt, Artificial Sequence
  Synthetic Oligonucleotide; CD80 exon 5; Set A
uuuuucucuaaaacaccagauugaauggagacaucaagu

SEQ ID NO: 56895 - RNA, 22 nt, Artificial Sequence
  Synthetic Oligonucleotide; CD80 exon 5; Set C
uaaaacaccagauugaauggag

SEQ ID NO: 56896 - RNA, 32 nt, Artificial Sequence
  Synthetic Oligonucleotide; CD80 exon 5; Set A
uucucuaaaacaccagauugaauggagacauc

SEQ ID NO: 56897 - RNA, 34 nt, Artificial Sequence
  Synthetic Oligonucleotide; CD80 exon 5; Set A
uuucucuaaaacaccagauugaauggagacauca

SEQ ID NO: 56898 - RNA, 36 nt, Artificial Sequence
  Synthetic Oligonucleotide; CD80 exon 5; Set A
uuuucucuaaaacaccagauugaauggagacaucaa

SEQ ID NO: 56899 - RNA, 40 nt, Artificial Sequence
  Synthetic Oligonucleotide; CD80 exon 5; Set A
uuuuuucucuaaaacaccagauugaauggagacaucaagu

SEQ ID NO: 56900 - RNA, 20 nt, Artificial Sequence
  Synthetic Oligonucleotide; CD80 exon 5; Set C
aaaacaccagauugaaugga

SEQ ID NO: 56901 - RNA, 15 nt, Artificial Sequence
  Synthetic Oligonucleotide; CD80 exon 5; Set C
aacaccagauugaau

SEQ ID NO: 56902 - RNA, 23 nt, Artificial Sequence
  Synthetic Oligonucleotide; CD80 exon 5; Set C
cuaaaacaccagauugaauggag

SEQ ID NO: 56903 - RNA, 33 nt, Artificial Sequence
  Synthetic Oligonucleotide; CD80 exon 5; Set A
uuucucuaaaacaccagauugaauggagacauc

SEQ ID NO: 56904 - RNA, 35 nt, Artificial Sequence
  Synthetic Oligonucleotide; CD80 exon 5; Set A
uuuucucuaaaacaccagauugaauggagacauca

SEQ ID NO: 56905 - RNA, 37 nt, Artificial Sequence
  Synthetic Oligonucleotide; CD80 exon 5; Set A
uuuuucucuaaaacaccagauugaauggagacaucaa

SEQ ID NO: 56906 - RNA, 19 nt, Artificial Sequence
  Synthetic Oligonucleotide; CD80 exon 5; Set C
aaaacaccagauugaaugg

SEQ ID NO: 56907 - RNA, 16 nt, Artificial Sequence
  Synthetic Oligonucleotide; CD80 exon 5; Set C
aaacaccagauugaau

SEQ ID NO: 56908 - RNA, 24 nt, Artificial Sequence
  Synthetic Oligonucleotide; CD80 exon 5; Set C
ucuaaaacaccagauugaauggag

SEQ ID NO: 56909 - RNA, 34 nt, Artificial Sequence
  Synthetic Oligonucleotide; CD80 exon 5; Set A
uuuucucuaaaacaccagauugaauggagacauc

SEQ ID NO: 56910 - RNA, 36 nt, Artificial Sequence
  Synthetic Oligonucleotide; CD80 exon 5; Set A
uuuuucucuaaaacaccagauugaauggagacauca

SEQ ID NO: 56911 - RNA, 38 nt, Artificial Sequence
  Synthetic Oligonucleotide; CD80 exon 5; Set A
uuuuuucucuaaaacaccagauugaauggagacaucaa

SEQ ID NO: 56912 - RNA, 20 nt, Artificial Sequence
  Synthetic Oligonucleotide; CD80 exon 5; Set C
uaaaacaccagauugaaugg

SEQ ID NO: 56913 - RNA, 18 nt, Artificial Sequence
  Synthetic Oligonucleotide; CD80 exon 5; Set C
aaaacaccagauugaaug

SEQ ID NO: 56914 - RNA, 15 nt, Artificial Sequence
  Synthetic Oligonucleotide; CD80 exon 5; Set C
aaacaccagauugaa

SEQ ID NO: 56915 - RNA, 25 nt, Artificial Sequence
  Synthetic Oligonucleotide; CD80 exon 5; Set C
cucuaaaacaccagauugaauggag

SEQ ID NO: 56916 - RNA, 35 nt, Artificial Sequence
  Synthetic Oligonucleotide; CD80 exon 5; Set A
uuuuucucuaaaacaccagauugaauggagacauc

SEQ ID NO: 56917 - RNA, 37 nt, Artificial Sequence
  Synthetic Oligonucleotide; CD80 exon 5; Set A
uuuuuucucuaaaacaccagauugaauggagacauca

SEQ ID NO: 56918 - RNA, 39 nt, Artificial Sequence
  Synthetic Oligonucleotide; CD80 exon 5; Set A
cuuuuuucucuaaaacaccagauugaauggagacaucaa

SEQ ID NO: 56919 - RNA, 26 nt, Artificial Sequence
  Synthetic Oligonucleotide; CD80 exon 5; Set C
ucucuaaaacaccagauugaauggag

SEQ ID NO: 56920 - RNA, 36 nt, Artificial Sequence
  Synthetic Oligonucleotide; CD80 exon 5; Set A
uuuuuucucuaaaacaccagauugaauggagacauc

SEQ ID NO: 56921 - RNA, 38 nt, Artificial Sequence
  Synthetic Oligonucleotide; CD80 exon 5; Set A
cuuuuuucucuaaaacaccagauugaauggagacauca

SEQ ID NO: 56922 - RNA, 40 nt, Artificial Sequence
  Synthetic Oligonucleotide; CD80 exon 5; Set A
ucuuuuuucucuaaaacaccagauugaauggagacaucaa

SEQ ID NO: 56923 - RNA, 37 nt, Artificial Sequence
  Synthetic Oligonucleotide; CD80 exon 5; Set A
cuuuuuucucuaaaacaccagauugaauggagacauc

SEQ ID NO: 56924 - RNA, 39 nt, Artificial Sequence
  Synthetic Oligonucleotide; CD80 exon 5; Set A
ucuuuuuucucuaaaacaccagauugaauggagacauca

SEQ ID NO: 56925 - RNA, 38 nt, Artificial Sequence
  Synthetic Oligonucleotide; CD80 exon 5; Set A
ucuuuuuucucuaaaacaccagauugaauggagacauc

SEQ ID NO: 56926 - RNA, 40 nt, Artificial Sequence
  Synthetic Oligonucleotide; CD80 exon 5; Set A
uucuuuuuucucuaaaacaccagauugaauggagacauca

SEQ ID NO: 56927 - RNA, 24 nt, Artificial Sequence
  Synthetic Oligonucleotide; CD80 exon 5; Set C
ucucuaaaacaccagauugaaugg

SEQ ID NO: 56928 - RNA, 15 nt, Artificial Sequence
  Synthetic Oligonucleotide; CD80 exon 5; Set C
uaaaacaccagauug

SEQ ID NO: 56929 - RNA, 39 nt, Artificial Sequence
  Synthetic Oligonucleotide; CD80 exon 5; Set A
uucuuuuuucucuaaaacaccagauugaauggagacauc

SEQ ID NO: 56930 - RNA, 25 nt, Artificial Sequence
  Synthetic Oligonucleotide; CD80 exon 5; Set C
uucucuaaaacaccagauugaaugg

SEQ ID NO: 56931 - RNA, 27 nt, Artificial Sequence
  Synthetic Oligonucleotide; CD80 exon 5; Set C
uuucucuaaaacaccagauugaaugga

SEQ ID NO: 56932 - RNA, 16 nt, Artificial Sequence
  Synthetic Oligonucleotide; CD80 exon 5; Set C
cuaaaacaccagauug

SEQ ID NO: 56933 - RNA, 26 nt, Artificial Sequence
  Synthetic Oligonucleotide; CD80 exon 5; Set C
uuucucuaaaacaccagauugaaugg

SEQ ID NO: 56934 - RNA, 28 nt, Artificial Sequence
  Synthetic Oligonucleotide; CD80 exon 5; Set C
uuuucucuaaaacaccagauugaaugga

SEQ ID NO: 56935 - RNA, 17 nt, Artificial Sequence
  Synthetic Oligonucleotide; CD80 exon 5; Set C
ucuaaaacaccagauug

SEQ ID NO: 56936 - RNA, 15 nt, Artificial Sequence
  Synthetic Oligonucleotide; CD80 exon 5; Set C
cuaaaacaccagauu

SEQ ID NO: 56937 - RNA, 27 nt, Artificial Sequence
  Synthetic Oligonucleotide; CD80 exon 5; Set C
uuuucucuaaaacaccagauugaaugg

SEQ ID NO: 56938 - RNA, 29 nt, Artificial Sequence
  Synthetic Oligonucleotide; CD80 exon 5; Set C
uuuuucucuaaaacaccagauugaaugga

SEQ ID NO: 56939 - RNA, 25 nt, Artificial Sequence
  Synthetic Oligonucleotide; CD80 exon 5; Set C
uuucucuaaaacaccagauugaaug

SEQ ID NO: 56940 - RNA, 18 nt, Artificial Sequence
  Synthetic Oligonucleotide; CD80 exon 5; Set C
cucuaaaacaccagauug

SEQ ID NO: 56941 - RNA, 16 nt, Artificial Sequence
  Synthetic Oligonucleotide; CD80 exon 5; Set C
ucuaaaacaccagauu

SEQ ID NO: 56942 - RNA, 28 nt, Artificial Sequence
  Synthetic Oligonucleotide; CD80 exon 5; Set C
uuuuucucuaaaacaccagauugaaugg

SEQ ID NO: 56943 - RNA, 30 nt, Artificial Sequence
  Synthetic Oligonucleotide; CD80 exon 5; Set C
uuuuuucucuaaaacaccagauugaaugga

SEQ ID NO: 56944 - RNA, 26 nt, Artificial Sequence
  Synthetic Oligonucleotide; CD80 exon 5; Set C
uuuucucuaaaacaccagauugaaug

SEQ ID NO: 56945 - RNA, 19 nt, Artificial Sequence
  Synthetic Oligonucleotide; CD80 exon 5; Set C
ucucuaaaacaccagauug

SEQ ID NO: 56946 - RNA, 17 nt, Artificial Sequence
  Synthetic Oligonucleotide; CD80 exon 5; Set C
cucuaaaacaccagauu

SEQ ID NO: 56947 - RNA, 29 nt, Artificial Sequence
  Synthetic Oligonucleotide; CD80 exon 5; Set C
uuuuuucucuaaaacaccagauugaaugg

SEQ ID NO: 56948 - RNA, 31 nt, Artificial Sequence
  Synthetic Oligonucleotide; CD80 exon 5; Set C
cuuuuuucucuaaaacaccagauugaaugga

SEQ ID NO: 56949 - RNA, 27 nt, Artificial Sequence
  Synthetic Oligonucleotide; CD80 exon 5; Set C
uuuuucucuaaaacaccagauugaaug

SEQ ID NO: 56950 - RNA, 20 nt, Artificial Sequence
  Synthetic Oligonucleotide; CD80 exon 5; Set C
uucucuaaaacaccagauug

SEQ ID NO: 56951 - RNA, 18 nt, Artificial Sequence
  Synthetic Oligonucleotide; CD80 exon 5; Set C
ucucuaaaacaccagauu

SEQ ID NO: 56952 - RNA, 30 nt, Artificial Sequence
  Synthetic Oligonucleotide; CD80 exon 5; Set C
cuuuuuucucuaaaacaccagauugaaugg

SEQ ID NO: 56953 - RNA, 32 nt, Artificial Sequence
  Synthetic Oligonucleotide; CD80 exon 5; Set A
ucuuuuuucucuaaaacaccagauugaaugga

SEQ ID NO: 56954 - RNA, 28 nt, Artificial Sequence
  Synthetic Oligonucleotide; CD80 exon 5; Set C
uuuuuucucuaaaacaccagauugaaug

SEQ ID NO: 56955 - RNA, 21 nt, Artificial Sequence
  Synthetic Oligonucleotide; CD80 exon 5; Set C
uuucucuaaaacaccagauug

SEQ ID NO: 56956 - RNA, 19 nt, Artificial Sequence
  Synthetic Oligonucleotide; CD80 exon 5; Set C
uucucuaaaacaccagauu

SEQ ID NO: 56957 - RNA, 31 nt, Artificial Sequence
  Synthetic Oligonucleotide; CD80 exon 5; Set C
ucuuuuuucucuaaaacaccagauugaaugg

SEQ ID NO: 56958 - RNA, 33 nt, Artificial Sequence
  Synthetic Oligonucleotide; CD80 exon 5; Set A
uucuuuuuucucuaaaacaccagauugaaugga

SEQ ID NO: 56959 - RNA, 29 nt, Artificial Sequence
  Synthetic Oligonucleotide; CD80 exon 5; Set C
cuuuuuucucuaaaacaccagauugaaug

SEQ ID NO: 56960 - RNA, 40 nt, Artificial Sequence
  Synthetic Oligonucleotide; CD80 exon 5; Set A
guuuuucuuuuuucucuaaaacaccagauugaauggagac

SEQ ID NO: 56961 - RNA, 20 nt, Artificial Sequence
  Synthetic Oligonucleotide; CD80 exon 5; Set C
uuucucuaaaacaccagauu

SEQ ID NO: 56962 - RNA, 32 nt, Artificial Sequence
  Synthetic Oligonucleotide; CD80 exon 5; Set C
uucuuuuuucucuaaaacaccagauugaaugg

SEQ ID NO: 56963 - RNA, 34 nt, Artificial Sequence
  Synthetic Oligonucleotide; CD80 exon 5; Set A
uuucuuuuuucucuaaaacaccagauugaaugga

SEQ ID NO: 56964 - RNA, 30 nt, Artificial Sequence
  Synthetic Oligonucleotide; CD80 exon 5; Set C
ucuuuuuucucuaaaacaccagauugaaug

SEQ ID NO: 56965 - RNA, 39 nt, Artificial Sequence
  Synthetic Oligonucleotide; CD80 exon 5; Set A
guuuuucuuuuuucucuaaaacaccagauugaauggaga

SEQ ID NO: 56966 - RNA, 37 nt, Artificial Sequence
  Synthetic Oligonucleotide; CD80 exon 5; Set A
uuuuucuuuuuucucuaaaacaccagauugaauggag

SEQ ID NO: 56967 - RNA, 21 nt, Artificial Sequence
  Synthetic Oligonucleotide; CD80 exon 5; Set C
uuuucucuaaaacaccagauu

SEQ ID NO: 56968 - RNA, 33 nt, Artificial Sequence
  Synthetic Oligonucleotide; CD80 exon 5; Set C
uuucuuuuuucucuaaaacaccagauugaaugg

SEQ ID NO: 56969 - RNA, 35 nt, Artificial Sequence
  Synthetic Oligonucleotide; CD80 exon 5; Set A
uuuucuuuuuucucuaaaacaccagauugaaugga

SEQ ID NO: 56970 - RNA, 31 nt, Artificial Sequence
  Synthetic Oligonucleotide; CD80 exon 5; Set C
uucuuuuuucucuaaaacaccagauugaaug

SEQ ID NO: 56971 - RNA, 40 nt, Artificial Sequence
  Synthetic Oligonucleotide; CD80 exon 5; Set A
gguuuuucuuuuuucucuaaaacaccagauugaauggaga

SEQ ID NO: 56972 - RNA, 38 nt, Artificial Sequence
  Synthetic Oligonucleotide; CD80 exon 5; Set A
guuuuucuuuuuucucuaaaacaccagauugaauggag

SEQ ID NO: 56973 - RNA, 22 nt, Artificial Sequence
  Synthetic Oligonucleotide; CD80 exon 5; Set C
uuuuucucuaaaacaccagauu

SEQ ID NO: 56974 - RNA, 34 nt, Artificial Sequence
  Synthetic Oligonucleotide; CD80 exon 5; Set C
uuuucuuuuuucucuaaaacaccagauugaaugg

SEQ ID NO: 56975 - RNA, 18 nt, Artificial Sequence
  Synthetic Oligonucleotide; CD80 exon 5; Set C
uuucucuaaaacaccaga

SEQ ID NO: 56976 - RNA, 32 nt, Artificial Sequence
  Synthetic Oligonucleotide; CD80 exon 5; Set C
uuucuuuuuucucuaaaacaccagauugaaug

SEQ ID NO: 56977 - RNA, 39 nt, Artificial Sequence
  Synthetic Oligonucleotide; CD80 exon 5; Set A
gguuuuucuuuuuucucuaaaacaccagauugaauggag

SEQ ID NO: 56978 - RNA, 23 nt, Artificial Sequence
  Synthetic Oligonucleotide; CD80 exon 5; Set C
uuuuuucucuaaaacaccagauu

SEQ ID NO: 56979 - RNA, 19 nt, Artificial Sequence
  Synthetic Oligonucleotide; CD80 exon 5; Set C
uuuucucuaaaacaccaga

SEQ ID NO: 56980 - RNA, 33 nt, Artificial Sequence
  Synthetic Oligonucleotide; CD80 exon 5; Set C
uuuucuuuuuucucuaaaacaccagauugaaug

SEQ ID NO: 56981 - RNA, 40 nt, Artificial Sequence
  Synthetic Oligonucleotide; CD80 exon 5; Set A
ugguuuuucuuuuuucucuaaaacaccagauugaauggag

SEQ ID NO: 56982 - RNA, 24 nt, Artificial Sequence
  Synthetic Oligonucleotide; CD80 exon 5; Set C
cuuuuuucucuaaaacaccagauu

SEQ ID NO: 56983 - RNA, 20 nt, Artificial Sequence
  Synthetic Oligonucleotide; CD80 exon 5; Set C
uuuuucucuaaaacaccaga

SEQ ID NO: 56984 - RNA, 18 nt, Artificial Sequence
  Synthetic Oligonucleotide; CD80 exon 5; Set C
uuuucucuaaaacaccag

SEQ ID NO: 56985 - RNA, 33 nt, Artificial Sequence
  Synthetic Oligonucleotide; CD80 exon 5; Set C
uuuuucuuuuuucucuaaaacaccagauugaau

SEQ ID NO: 56986 - RNA, 25 nt, Artificial Sequence
  Synthetic Oligonucleotide; CD80 exon 5; Set C
ucuuuuuucucuaaaacaccagauu

SEQ ID NO: 56987 - RNA, 21 nt, Artificial Sequence
  Synthetic Oligonucleotide; CD80 exon 5; Set C
uuuuuucucuaaaacaccaga

SEQ ID NO: 56988 - RNA, 19 nt, Artificial Sequence
  Synthetic Oligonucleotide; CD80 exon 5; Set C
uuuuucucuaaaacaccag

SEQ ID NO: 56989 - RNA, 32 nt, Artificial Sequence
  Synthetic Oligonucleotide; CD80 exon 5; Set C
uuuuucuuuuuucucuaaaacaccagauugaa

SEQ ID NO: 56990 - RNA, 34 nt, Artificial Sequence
  Synthetic Oligonucleotide; CD80 exon 5; Set C
guuuuucuuuuuucucuaaaacaccagauugaau

SEQ ID NO: 56991 - RNA, 26 nt, Artificial Sequence
  Synthetic Oligonucleotide; CD80 exon 5; Set C
uucuuuuuucucuaaaacaccagauu

SEQ ID NO: 56992 - RNA, 22 nt, Artificial Sequence
  Synthetic Oligonucleotide; CD80 exon 5; Set C
cuuuuuucucuaaaacaccaga

SEQ ID NO: 56993 - RNA, 20 nt, Artificial Sequence
  Synthetic Oligonucleotide; CD80 exon 5; Set C
uuuuuucucuaaaacaccag

SEQ ID NO: 56994 - RNA, 33 nt, Artificial Sequence
  Synthetic Oligonucleotide; CD80 exon 5; Set C
guuuuucuuuuuucucuaaaacaccagauugaa

SEQ ID NO: 56995 - RNA, 35 nt, Artificial Sequence
  Synthetic Oligonucleotide; CD80 exon 5; Set A
gguuuuucuuuuuucucuaaaacaccagauugaau

SEQ ID NO: 56996 - RNA, 31 nt, Artificial Sequence
  Synthetic Oligonucleotide; CD80 exon 5; Set C
uuuuucuuuuuucucuaaaacaccagauuga

SEQ ID NO: 56997 - RNA, 27 nt, Artificial Sequence
  Synthetic Oligonucleotide; CD80 exon 5; Set C
uuucuuuuuucucuaaaacaccagauu

SEQ ID NO: 56998 - RNA, 23 nt, Artificial Sequence
  Synthetic Oligonucleotide; CD80 exon 5; Set C
ucuuuuuucucuaaaacaccaga

SEQ ID NO: 56999 - RNA, 21 nt, Artificial Sequence
  Synthetic Oligonucleotide; CD80 exon 5; Set C
cuuuuuucucuaaaacaccag

SEQ ID NO: 57000 - RNA, 34 nt, Artificial Sequence
  Synthetic Oligonucleotide; CD80 exon 5; Set A
gguuuuucuuuuuucucuaaaacaccagauugaa

SEQ ID NO: 57001 - RNA, 36 nt, Artificial Sequence
  Synthetic Oligonucleotide; CD80 exon 5; Set A
ugguuuuucuuuuuucucuaaaacaccagauugaau

SEQ ID NO: 57002 - RNA, 32 nt, Artificial Sequence
  Synthetic Oligonucleotide; CD80 exon 5; Set C
guuuuucuuuuuucucuaaaacaccagauuga

SEQ ID NO: 57003 - RNA, 30 nt, Artificial Sequence
  Synthetic Oligonucleotide; CD80 exon 5; Set C
uuuuucuuuuuucucuaaaacaccagauug

SEQ ID NO: 57004 - RNA, 40 nt, Artificial Sequence
  Synthetic Oligonucleotide; CD80 exon 5; Set A
guugguuuuucuuuuuucucuaaaacaccagauugaaugg

SEQ ID NO: 57005 - RNA, 24 nt, Artificial Sequence
  Synthetic Oligonucleotide; CD80 exon 5; Set C
uucuuuuuucucuaaaacaccaga

SEQ ID NO: 57006 - RNA, 22 nt, Artificial Sequence
  Synthetic Oligonucleotide; CD80 exon 5; Set C
ucuuuuuucucuaaaacaccag

SEQ ID NO: 57007 - RNA, 35 nt, Artificial Sequence
  Synthetic Oligonucleotide; CD80 exon 5; Set A
ugguuuuucuuuuuucucuaaaacaccagauugaa

SEQ ID NO: 57008 - RNA, 33 nt, Artificial Sequence
  Synthetic Oligonucleotide; CD80 exon 5; Set A
gguuuuucuuuuuucucuaaaacaccagauuga

SEQ ID NO: 57009 - RNA, 31 nt, Artificial Sequence
  Synthetic Oligonucleotide; CD80 exon 5; Set C
guuuuucuuuuuucucuaaaacaccagauug

SEQ ID NO: 57010 - RNA, 29 nt, Artificial Sequence
  Synthetic Oligonucleotide; CD80 exon 5; Set C
uuuuucuuuuuucucuaaaacaccagauu

SEQ ID NO: 57011 - RNA, 25 nt, Artificial Sequence
  Synthetic Oligonucleotide; CD80 exon 5; Set C
uuucuuuuuucucuaaaacaccaga

SEQ ID NO: 57012 - RNA, 23 nt, Artificial Sequence
  Synthetic Oligonucleotide; CD80 exon 5; Set C
uucuuuuuucucuaaaacaccag

SEQ ID NO: 57013 - RNA, 39 nt, Artificial Sequence
  Synthetic Oligonucleotide; CD80 exon 5; Set A
guugguuuuucuuuuuucucuaaaacaccagauugaaug

SEQ ID NO: 57014 - RNA, 28 nt, Artificial Sequence
  Synthetic Oligonucleotide; CD80 exon 5; Set C
uuuuucuuuuuucucuaaaacaccagau

SEQ ID NO: 57015 - RNA, 34 nt, Artificial Sequence
  Synthetic Oligonucleotide; CD80 exon 5; Set A
ugguuuuucuuuuuucucuaaaacaccagauuga

SEQ ID NO: 57016 - RNA, 26 nt, Artificial Sequence
  Synthetic Oligonucleotide; CD80 exon 5; Set C
uuuucuuuuuucucuaaaacaccaga

SEQ ID NO: 57017 - RNA, 24 nt, Artificial Sequence
  Synthetic Oligonucleotide; CD80 exon 5; Set C
uuucuuuuuucucuaaaacaccag

SEQ ID NO: 57018 - RNA, 40 nt, Artificial Sequence
  Synthetic Oligonucleotide; CD80 exon 5; Set A
aguugguuuuucuuuuuucucuaaaacaccagauugaaug

SEQ ID NO: 57019 - RNA, 29 nt, Artificial Sequence
  Synthetic Oligonucleotide; CD80 exon 5; Set C
guuuuucuuuuuucucuaaaacaccagau

SEQ ID NO: 57020 - RNA, 35 nt, Artificial Sequence
  Synthetic Oligonucleotide; CD80 exon 5; Set A
uugguuuuucuuuuuucucuaaaacaccagauuga

SEQ ID NO: 57021 - RNA, 33 nt, Artificial Sequence
  Synthetic Oligonucleotide; CD80 exon 5; Set A
ugguuuuucuuuuuucucuaaaacaccagauug

SEQ ID NO: 57022 - RNA, 15 nt, Artificial Sequence
  Synthetic Oligonucleotide; CD80 exon 5; Set C
uuuuuucucuaaaac

SEQ ID NO: 57023 - RNA, 25 nt, Artificial Sequence
  Synthetic Oligonucleotide; CD80 exon 5; Set C
uuuucuuuuuucucuaaaacaccag

SEQ ID NO: 57024 - RNA, 30 nt, Artificial Sequence
  Synthetic Oligonucleotide; CD80 exon 5; Set C
gguuuuucuuuuuucucuaaaacaccagau

SEQ ID NO: 57025 - RNA, 34 nt, Artificial Sequence
  Synthetic Oligonucleotide; CD80 exon 5; Set A
uugguuuuucuuuuuucucuaaaacaccagauug

SEQ ID NO: 57026 - RNA, 16 nt, Artificial Sequence
  Synthetic Oligonucleotide; CD80 exon 5; Set C
cuuuuuucucuaaaac

SEQ ID NO: 57027 - RNA, 31 nt, Artificial Sequence
  Synthetic Oligonucleotide; CD80 exon 5; Set C
ugguuuuucuuuuuucucuaaaacaccagau

SEQ ID NO: 57028 - RNA, 33 nt, Artificial Sequence
  Synthetic Oligonucleotide; CD80 exon 5; Set A
uugguuuuucuuuuuucucuaaaacaccagauu

SEQ ID NO: 57029 - RNA, 17 nt, Artificial Sequence
  Synthetic Oligonucleotide; CD80 exon 5; Set C
ucuuuuuucucuaaaac

SEQ ID NO: 57030 - RNA, 18 nt, Artificial Sequence
  Synthetic Oligonucleotide; CD80 exon 5; Set C
uucuuuuuucucuaaaac

SEQ ID NO: 57031 - RNA, 19 nt, Artificial Sequence
  Synthetic Oligonucleotide; CD80 exon 5; Set C
uuucuuuuuucucuaaaac

SEQ ID NO: 57032 - RNA, 36 nt, Artificial Sequence
  Synthetic Oligonucleotide; CD80 exon 5; Set A
uaguugguuuuucuuuuuucucuaaaacaccagauu

SEQ ID NO: 57033 - RNA, 20 nt, Artificial Sequence
  Synthetic Oligonucleotide; CD80 exon 5; Set C
uuuucuuuuuucucuaaaac

SEQ ID NO: 57034 - RNA, 32 nt, Artificial Sequence
  Synthetic Oligonucleotide; CD80 exon 5; Set A
guugguuuuucuuuuuucucuaaaacaccaga

SEQ ID NO: 57035 - RNA, 33 nt, Artificial Sequence
  Synthetic Oligonucleotide; CD80 exon 5; Set A
aguugguuuuucuuuuuucucuaaaacaccaga

SEQ ID NO: 57036 - RNA, 31 nt, Artificial Sequence
  Synthetic Oligonucleotide; CD80 exon 5; Set C
guugguuuuucuuuuuucucuaaaacaccag

SEQ ID NO: 57037 - RNA, 20 nt, Artificial Sequence
  Synthetic Oligonucleotide; CD80 exon 5; Set C
uuuuucuuuuuucucuaaaa

SEQ ID NO: 57038 - RNA, 34 nt, Artificial Sequence
  Synthetic Oligonucleotide; CD80 exon 5; Set A
uaguugguuuuucuuuuuucucuaaaacaccaga

SEQ ID NO: 57039 - RNA, 32 nt, Artificial Sequence
  Synthetic Oligonucleotide; CD80 exon 5; Set C
aguugguuuuucuuuuuucucuaaaacaccag

SEQ ID NO: 57040 - RNA, 21 nt, Artificial Sequence
  Synthetic Oligonucleotide; CD80 exon 5; Set C
guuuuucuuuuuucucuaaaa

SEQ ID NO: 57041 - RNA, 33 nt, Artificial Sequence
  Synthetic Oligonucleotide; CD80 exon 5; Set A
uaguugguuuuucuuuuuucucuaaaacaccag

SEQ ID NO: 57042 - RNA, 40 nt, Artificial Sequence
  Synthetic Oligonucleotide; CD80 exon 5; Set A
aggauaguugguuuuucuuuuuucucuaaaacaccagauu

SEQ ID NO: 57043 - RNA, 21 nt, Artificial Sequence
  Synthetic Oligonucleotide; CD80 exon 5; Set C
gguuuuucuuuuuucucuaaa

SEQ ID NO: 57044 - RNA, 19 nt, Artificial Sequence
  Synthetic Oligonucleotide; CD80 exon 5; Set C
guuuuucuuuuuucucuaa

SEQ ID NO: 57045 - RNA, 17 nt, Artificial Sequence
  Synthetic Oligonucleotide; CD80 exon 5; Set C
uuuuucuuuuuucucua

SEQ ID NO: 57046 - RNA, 23 nt, Artificial Sequence
  Synthetic Oligonucleotide; CD80 exon 5; Set C
ugguuuuucuuuuuucucuaaaa

SEQ ID NO: 57047 - RNA, 25 nt, Artificial Sequence
  Synthetic Oligonucleotide; CD80 exon 5; Set C
uugguuuuucuuuuuucucuaaaac

SEQ ID NO: 57048 - RNA, 20 nt, Artificial Sequence
  Synthetic Oligonucleotide; CD80 exon 5; Set C
gguuuuucuuuuuucucuaa

SEQ ID NO: 57049 - RNA, 16 nt, Artificial Sequence
  Synthetic Oligonucleotide; CD80 exon 5; Set C
uuuuucuuuuuucucu

SEQ ID NO: 57050 - RNA, 18 nt, Artificial Sequence
  Synthetic Oligonucleotide; CD80 exon 5; Set C
guuuuucuuuuuucucua

SEQ ID NO: 57051 - RNA, 24 nt, Artificial Sequence
  Synthetic Oligonucleotide; CD80 exon 5; Set C
uugguuuuucuuuuuucucuaaaa

SEQ ID NO: 57052 - RNA, 26 nt, Artificial Sequence
  Synthetic Oligonucleotide; CD80 exon 5; Set C
guugguuuuucuuuuuucucuaaaac

SEQ ID NO: 57053 - RNA, 38 nt, Artificial Sequence
  Synthetic Oligonucleotide; CD80 exon 5; Set A
aggauaguugguuuuucuuuuuucucuaaaacaccaga

SEQ ID NO: 57054 - RNA, 21 nt, Artificial Sequence
  Synthetic Oligonucleotide; CD80 exon 5; Set C
ugguuuuucuuuuuucucuaa

SEQ ID NO: 57055 - RNA, 15 nt, Artificial Sequence
  Synthetic Oligonucleotide; CD80 exon 5; Set C
uuuuucuuuuuucuc

SEQ ID NO: 57056 - RNA, 17 nt, Artificial Sequence
  Synthetic Oligonucleotide; CD80 exon 5; Set C
guuuuucuuuuuucucu

SEQ ID NO: 57057 - RNA, 19 nt, Artificial Sequence
  Synthetic Oligonucleotide; CD80 exon 5; Set C
gguuuuucuuuuuucucua

SEQ ID NO: 57058 - RNA, 27 nt, Artificial Sequence
  Synthetic Oligonucleotide; CD80 exon 5; Set C
aguugguuuuucuuuuuucucuaaaac

SEQ ID NO: 57059 - RNA, 39 nt, Artificial Sequence
  Synthetic Oligonucleotide; CD80 exon 5; Set A
caggauaguugguuuuucuuuuuucucuaaaacaccaga

SEQ ID NO: 57060 - RNA, 37 nt, Artificial Sequence
  Synthetic Oligonucleotide; CD80 exon 5; Set A
aggauaguugguuuuucuuuuuucucuaaaacaccag

SEQ ID NO: 57061 - RNA, 16 nt, Artificial Sequence
  Synthetic Oligonucleotide; CD80 exon 5; Set C
guuuuucuuuuuucuc

SEQ ID NO: 57062 - RNA, 18 nt, Artificial Sequence
  Synthetic Oligonucleotide; CD80 exon 5; Set C
gguuuuucuuuuuucucu

SEQ ID NO: 57063 - RNA, 20 nt, Artificial Sequence
  Synthetic Oligonucleotide; CD80 exon 5; Set C
ugguuuuucuuuuuucucua

SEQ ID NO: 57064 - RNA, 28 nt, Artificial Sequence
  Synthetic Oligonucleotide; CD80 exon 5; Set C
uaguugguuuuucuuuuuucucuaaaac

SEQ ID NO: 57065 - RNA, 40 nt, Artificial Sequence
  Synthetic Oligonucleotide; CD80 exon 5; Set A
acaggauaguugguuuuucuuuuuucucuaaaacaccaga

SEQ ID NO: 57066 - RNA, 38 nt, Artificial Sequence
  Synthetic Oligonucleotide; CD80 exon 5; Set A
caggauaguugguuuuucuuuuuucucuaaaacaccag

SEQ ID NO: 57067 - RNA, 15 nt, Artificial Sequence
  Synthetic Oligonucleotide; CD80 exon 5; Set C
guuuuucuuuuuucu

SEQ ID NO: 57068 - RNA, 19 nt, Artificial Sequence
  Synthetic Oligonucleotide; CD80 exon 5; Set C
ugguuuuucuuuuuucucu

SEQ ID NO: 57069 - RNA, 17 nt, Artificial Sequence
  Synthetic Oligonucleotide; CD80 exon 5; Set C
gguuuuucuuuuuucuc

SEQ ID NO: 57070 - RNA, 39 nt, Artificial Sequence
  Synthetic Oligonucleotide; CD80 exon 5; Set A
acaggauaguugguuuuucuuuuuucucuaaaacaccag

SEQ ID NO: 57071 - RNA, 16 nt, Artificial Sequence
  Synthetic Oligonucleotide; CD80 exon 5; Set C
gguuuuucuuuuuucu

SEQ ID NO: 57072 - RNA, 18 nt, Artificial Sequence
  Synthetic Oligonucleotide; CD80 exon 5; Set C
ugguuuuucuuuuuucuc

SEQ ID NO: 57073 - RNA, 40 nt, Artificial Sequence
  Synthetic Oligonucleotide; CD80 exon 5; Set A
gacaggauaguugguuuuucuuuuuucucuaaaacaccag

SEQ ID NO: 57074 - RNA, 15 nt, Artificial Sequence
  Synthetic Oligonucleotide; CD80 exon 5; Set C
gguuuuucuuuuuuc

SEQ ID NO: 57075 - RNA, 17 nt, Artificial Sequence
  Synthetic Oligonucleotide; CD80 exon 5; Set C
ugguuuuucuuuuuucu

SEQ ID NO: 57076 - RNA, 16 nt, Artificial Sequence
  Synthetic Oligonucleotide; CD80 exon 5; Set C
ugguuuuucuuuuuuc

SEQ ID NO: 57077 - RNA, 32 nt, Artificial Sequence
  Synthetic Oligonucleotide; CD80 exon 5; Set C
aggauaguugguuuuucuuuuuucucuaaaac

SEQ ID NO: 57078 - RNA, 15 nt, Artificial Sequence
  Synthetic Oligonucleotide; CD80 exon 5; Set C
ugguuuuucuuuuuu

SEQ ID NO: 57079 - RNA, 33 nt, Artificial Sequence
  Synthetic Oligonucleotide; CD80 exon 5; Set C
caggauaguugguuuuucuuuuuucucuaaaac

SEQ ID NO: 57080 - RNA, 34 nt, Artificial Sequence
  Synthetic Oligonucleotide; CD80 exon 5; Set A
acaggauaguugguuuuucuuuuuucucuaaaac

SEQ ID NO: 57081 - RNA, 35 nt, Artificial Sequence
  Synthetic Oligonucleotide; CD80 exon 5; Set A
gacaggauaguugguuuuucuuuuuucucuaaaac

SEQ ID NO: 57082 - RNA, 36 nt, Artificial Sequence
  Synthetic Oligonucleotide; CD80 exon 5; Set A
agacaggauaguugguuuuucuuuuuucucuaaaac

SEQ ID NO: 57083 - RNA, 37 nt, Artificial Sequence
  Synthetic Oligonucleotide; CD80 exon 5; Set A
aagacaggauaguugguuuuucuuuuuucucuaaaac

SEQ ID NO: 57084 - RNA, 38 nt, Artificial Sequence
  Synthetic Oligonucleotide; CD80 exon 5; Set A
aaagacaggauaguugguuuuucuuuuuucucuaaaac

SEQ ID NO: 57085 - RNA, 39 nt, Artificial Sequence
  Synthetic Oligonucleotide; CD80 exon 5; Set A
uaaagacaggauaguugguuuuucuuuuuucucuaaaac

SEQ ID NO: 57086 - RNA, 40 nt, Artificial Sequence
  Synthetic Oligonucleotide; CD80 exon 5; Set A
uuaaagacaggauaguugguuuuucuuuuuucucuaaaac

SEQ ID NO: 57087 - RNA, 15 nt, Artificial Sequence
  Synthetic Oligonucleotide; CD80 exon 5; Set C
caggauaguugguuu

SEQ ID NO: 57088 - RNA, 16 nt, Artificial Sequence
  Synthetic Oligonucleotide; CD80 exon 5; Set C
acaggauaguugguuu

SEQ ID NO: 57089 - RNA, 15 nt, Artificial Sequence
  Synthetic Oligonucleotide; CD80 exon 5; Set C
acaggauaguugguu

SEQ ID NO: 57090 - RNA, 16 nt, Artificial Sequence
  Synthetic Oligonucleotide; CD80 exon 5; Set C
gacaggauaguugguu

SEQ ID NO: 57091 - RNA, 17 nt, Artificial Sequence
  Synthetic Oligonucleotide; CD80 exon 5; Set C
agacaggauaguugguu

SEQ ID NO: 57092 - RNA, 15 nt, Artificial Sequence
  Synthetic Oligonucleotide; CD80 exon 5; Set C
gacaggauaguuggu

SEQ ID NO: 57093 - RNA, 18 nt, Artificial Sequence
  Synthetic Oligonucleotide; CD80 exon 5; Set C
aagacaggauaguugguu

SEQ ID NO: 57094 - RNA, 16 nt, Artificial Sequence
  Synthetic Oligonucleotide; CD80 exon 5; Set C
agacaggauaguuggu

SEQ ID NO: 57095 - RNA, 19 nt, Artificial Sequence
  Synthetic Oligonucleotide; CD80 exon 5; Set C
aaagacaggauaguugguu

SEQ ID NO: 57096 - RNA, 15 nt, Artificial Sequence
  Synthetic Oligonucleotide; CD80 exon 5; Set C
agacaggauaguugg

SEQ ID NO: 57097 - RNA, 17 nt, Artificial Sequence
  Synthetic Oligonucleotide; CD80 exon 5; Set C
aagacaggauaguuggu

SEQ ID NO: 57098 - RNA, 16 nt, Artificial Sequence
  Synthetic Oligonucleotide; CD80 exon 5; Set C
aagacaggauaguugg

SEQ ID NO: 57099 - RNA, 18 nt, Artificial Sequence
  Synthetic Oligonucleotide; CD80 exon 5; Set C
aaagacaggauaguuggu

SEQ ID NO: 57100 - RNA, 21 nt, Artificial Sequence
  Synthetic Oligonucleotide; CD80 exon 5; Set C
uuaaagacaggauaguugguu

SEQ ID NO: 57101 - RNA, 17 nt, Artificial Sequence
  Synthetic Oligonucleotide; CD80 exon 5; Set C
aaagacaggauaguugg

SEQ ID NO: 57102 - RNA, 19 nt, Artificial Sequence
  Synthetic Oligonucleotide; CD80 exon 5; Set C
uaaagacaggauaguuggu

SEQ ID NO: 57103 - RNA, 18 nt, Artificial Sequence
  Synthetic Oligonucleotide; CD80 exon 5; Set C
uaaagacaggauaguugg

SEQ ID NO: 57104 - RNA, 20 nt, Artificial Sequence
  Synthetic Oligonucleotide; CD80 exon 5; Set C
uuaaagacaggauaguuggu

SEQ ID NO: 57105 - RNA, 19 nt, Artificial Sequence
  Synthetic Oligonucleotide; CD80 exon 5; Set C
uuaaagacaggauaguugg

SEQ ID NO: 57106 - RNA, 40 nt, Artificial Sequence
  Synthetic Oligonucleotide; CD80 exon 5; Set C
ucauaguguaccuaccacuuaaagacaggauaguugguuu

SEQ ID NO: 57107 - RNA, 39 nt, Artificial Sequence
  Synthetic Oligonucleotide; CD80 exon 5; Set C
ucauaguguaccuaccacuuaaagacaggauaguugguu

SEQ ID NO: 57108 - RNA, 40 nt, Artificial Sequence
  Synthetic Oligonucleotide; CD80 exon 5; Set C
aucauaguguaccuaccacuuaaagacaggauaguugguu

SEQ ID NO: 57109 - RNA, 39 nt, Artificial Sequence
  Synthetic Oligonucleotide; CD80 exon 5; Set C
aucauaguguaccuaccacuuaaagacaggauaguuggu

SEQ ID NO: 57110 - RNA, 36 nt, Artificial Sequence
  Synthetic Oligonucleotide; CD80 exon 5; Set A
ucauaguguaccuaccacuuaaagacaggauaguug

SEQ ID NO: 57111 - RNA, 38 nt, Artificial Sequence
  Synthetic Oligonucleotide; CD80 exon 5; Set C
aucauaguguaccuaccacuuaaagacaggauaguugg

SEQ ID NO: 57112 - RNA, 40 nt, Artificial Sequence
  Synthetic Oligonucleotide; CD80 exon 5; Set C
aaucauaguguaccuaccacuuaaagacaggauaguuggu

SEQ ID NO: 57113 - RNA, 37 nt, Artificial Sequence
  Synthetic Oligonucleotide; CD80 exon 5; Set A
aucauaguguaccuaccacuuaaagacaggauaguug

SEQ ID NO: 57114 - RNA, 39 nt, Artificial Sequence
  Synthetic Oligonucleotide; CD80 exon 5; Set C
aaucauaguguaccuaccacuuaaagacaggauaguugg

SEQ ID NO: 57115 - RNA, 38 nt, Artificial Sequence
  Synthetic Oligonucleotide; CD80 exon 5; Set A
aaucauaguguaccuaccacuuaaagacaggauaguug

SEQ ID NO: 57116 - RNA, 40 nt, Artificial Sequence
  Synthetic Oligonucleotide; CD80 exon 5; Set C
uaaucauaguguaccuaccacuuaaagacaggauaguugg

SEQ ID NO: 57117 - RNA, 33 nt, Artificial Sequence
  Synthetic Oligonucleotide; CD80 exon 5; Set A
ucauaguguaccuaccacuuaaagacaggauag

SEQ ID NO: 57118 - RNA, 39 nt, Artificial Sequence
  Synthetic Oligonucleotide; CD80 exon 5; Set A
uaaucauaguguaccuaccacuuaaagacaggauaguug

SEQ ID NO: 57119 - RNA, 40 nt, Artificial Sequence
  Synthetic Oligonucleotide; CD80 exon 5; Set A
uuaaucauaguguaccuaccacuuaaagacaggauaguug

SEQ ID NO: 57120 - RNA, 28 nt, Artificial Sequence
  Synthetic Oligonucleotide; CD80 exon 5; Set A
ucauaguguaccuaccacuuaaagacag

SEQ ID NO: 57121 - RNA, 27 nt, Artificial Sequence
  Synthetic Oligonucleotide; CD80 exon 5; Set B
ucauaguguaccuaccacuuaaagaca

SEQ ID NO: 57122 - RNA, 23 nt, Artificial Sequence
  Synthetic Oligonucleotide; CD80 exon 5; Set C
ucauaguguaccuaccacuuaaa

SEQ ID NO: 57123 - RNA, 22 nt, Artificial Sequence
  Synthetic Oligonucleotide; CD80 exon 5; Set C
ucauaguguaccuaccacuuaa

SEQ ID NO: 57124 - RNA, 21 nt, Artificial Sequence
  Synthetic Oligonucleotide; CD80 exon 5; Set C
ucauaguguaccuaccacuua

SEQ ID NO: 57125 - RNA, 22 nt, Artificial Sequence
  Synthetic Oligonucleotide; CD80 exon 5; Set C
aucauaguguaccuaccacuua

SEQ ID NO: 57126 - RNA, 23 nt, Artificial Sequence
  Synthetic Oligonucleotide; CD80 exon 5; Set C
aaucauaguguaccuaccacuua

SEQ ID NO: 57127 - RNA, 40 nt, Artificial Sequence
  Synthetic Oligonucleotide; CD80 exon 5; Set C
caccuauuuaaucauaguguaccuaccacuuaaagacagg

SEQ ID NO: 57128 - RNA, 39 nt, Artificial Sequence
  Synthetic Oligonucleotide; CD80 exon 5; Set A
caccuauuuaaucauaguguaccuaccacuuaaagacag

SEQ ID NO: 57129 - RNA, 38 nt, Artificial Sequence
  Synthetic Oligonucleotide; CD80 exon 5; Set B
caccuauuuaaucauaguguaccuaccacuuaaagaca

SEQ ID NO: 57130 - RNA, 40 nt, Artificial Sequence
  Synthetic Oligonucleotide; CD80 exon 5; Set C
acaccuauuuaaucauaguguaccuaccacuuaaagacag

SEQ ID NO: 57131 - RNA, 37 nt, Artificial Sequence
  Synthetic Oligonucleotide; CD80 exon 5; Set B
caccuauuuaaucauaguguaccuaccacuuaaagac

SEQ ID NO: 57132 - RNA, 39 nt, Artificial Sequence
  Synthetic Oligonucleotide; CD80 exon 5; Set C
acaccuauuuaaucauaguguaccuaccacuuaaagaca

SEQ ID NO: 57133 - RNA, 38 nt, Artificial Sequence
  Synthetic Oligonucleotide; CD80 exon 5; Set B
acaccuauuuaaucauaguguaccuaccacuuaaagac

SEQ ID NO: 57134 - RNA, 36 nt, Artificial Sequence
  Synthetic Oligonucleotide; CD80 exon 5; Set B
caccuauuuaaucauaguguaccuaccacuuaaaga

SEQ ID NO: 57135 - RNA, 40 nt, Artificial Sequence
  Synthetic Oligonucleotide; CD80 exon 5; Set B
aacaccuauuuaaucauaguguaccuaccacuuaaagaca

SEQ ID NO: 57136 - RNA, 35 nt, Artificial Sequence
  Synthetic Oligonucleotide; CD80 exon 5; Set B
caccuauuuaaucauaguguaccuaccacuuaaag

SEQ ID NO: 57137 - RNA, 39 nt, Artificial Sequence
  Synthetic Oligonucleotide; CD80 exon 5; Set B
aacaccuauuuaaucauaguguaccuaccacuuaaagac

SEQ ID NO: 57138 - RNA, 37 nt, Artificial Sequence
  Synthetic Oligonucleotide; CD80 exon 5; Set B
acaccuauuuaaucauaguguaccuaccacuuaaaga

SEQ ID NO: 57139 - RNA, 34 nt, Artificial Sequence
  Synthetic Oligonucleotide; CD80 exon 5; Set B
caccuauuuaaucauaguguaccuaccacuuaaa

SEQ ID NO: 57140 - RNA, 36 nt, Artificial Sequence
  Synthetic Oligonucleotide; CD80 exon 5; Set B
acaccuauuuaaucauaguguaccuaccacuuaaag

SEQ ID NO: 57141 - RNA, 38 nt, Artificial Sequence
  Synthetic Oligonucleotide; CD80 exon 5; Set B
aacaccuauuuaaucauaguguaccuaccacuuaaaga

SEQ ID NO: 57142 - RNA, 33 nt, Artificial Sequence
  Synthetic Oligonucleotide; CD80 exon 5; Set B
caccuauuuaaucauaguguaccuaccacuuaa

SEQ ID NO: 57143 - RNA, 35 nt, Artificial Sequence
  Synthetic Oligonucleotide; CD80 exon 5; Set B
acaccuauuuaaucauaguguaccuaccacuuaaa

SEQ ID NO: 57144 - RNA, 37 nt, Artificial Sequence
  Synthetic Oligonucleotide; CD80 exon 5; Set B
aacaccuauuuaaucauaguguaccuaccacuuaaag

SEQ ID NO: 57145 - RNA, 34 nt, Artificial Sequence
  Synthetic Oligonucleotide; CD80 exon 5; Set B
acaccuauuuaaucauaguguaccuaccacuuaa

SEQ ID NO: 57146 - RNA, 36 nt, Artificial Sequence
  Synthetic Oligonucleotide; CD80 exon 5; Set B
aacaccuauuuaaucauaguguaccuaccacuuaaa

SEQ ID NO: 57147 - RNA, 32 nt, Artificial Sequence
  Synthetic Oligonucleotide; CD80 exon 5; Set B
caccuauuuaaucauaguguaccuaccacuua

SEQ ID NO: 57148 - RNA, 35 nt, Artificial Sequence
  Synthetic Oligonucleotide; CD80 exon 5; Set B
aacaccuauuuaaucauaguguaccuaccacuuaa

SEQ ID NO: 57149 - RNA, 33 nt, Artificial Sequence
  Synthetic Oligonucleotide; CD80 exon 5; Set B
acaccuauuuaaucauaguguaccuaccacuua

SEQ ID NO: 57150 - RNA, 34 nt, Artificial Sequence
  Synthetic Oligonucleotide; CD80 exon 5; Set B
aacaccuauuuaaucauaguguaccuaccacuua

SEQ ID NO: 57151 - RNA, 40 nt, Artificial Sequence
  Synthetic Oligonucleotide; CD80 exon 5; Set B
ucugaaacaccuauuuaaucauaguguaccuaccacuuaa

SEQ ID NO: 57152 - RNA, 39 nt, Artificial Sequence
  Synthetic Oligonucleotide; CD80 exon 5; Set C
ucugaaacaccuauuuaaucauaguguaccuaccacuua

SEQ ID NO: 57153 - RNA, 40 nt, Artificial Sequence
  Synthetic Oligonucleotide; CD80 exon 5; Set C
uucugaaacaccuauuuaaucauaguguaccuaccacuua

SEQ ID NO: 57154 - RNA, 15 nt, Artificial Sequence
  Synthetic Oligonucleotide; CD80 exon 5; Set C
acaccuauuuaauca

SEQ ID NO: 57155 - RNA, 16 nt, Artificial Sequence
  Synthetic Oligonucleotide; CD80 exon 5; Set C
aacaccuauuuaauca

SEQ ID NO: 57156 - RNA, 21 nt, Artificial Sequence
  Synthetic Oligonucleotide; CD80 exon 5; Set C
ucugaaacaccuauuuaauca

SEQ ID NO: 57157 - RNA, 20 nt, Artificial Sequence
  Synthetic Oligonucleotide; CD80 exon 5; Set C
ucugaaacaccuauuuaauc

SEQ ID NO: 57158 - RNA, 22 nt, Artificial Sequence
  Synthetic Oligonucleotide; CD80 exon 5; Set C
uucugaaacaccuauuuaauca

SEQ ID NO: 57159 - RNA, 19 nt, Artificial Sequence
  Synthetic Oligonucleotide; CD80 exon 5; Set C
ucugaaacaccuauuuaau

SEQ ID NO: 57160 - RNA, 21 nt, Artificial Sequence
  Synthetic Oligonucleotide; CD80 exon 5; Set C
uucugaaacaccuauuuaauc

SEQ ID NO: 57161 - RNA, 18 nt, Artificial Sequence
  Synthetic Oligonucleotide; CD80 exon 5; Set C
ucugaaacaccuauuuaa

SEQ ID NO: 57162 - RNA, 20 nt, Artificial Sequence
  Synthetic Oligonucleotide; CD80 exon 5; Set C
uucugaaacaccuauuuaau

SEQ ID NO: 57163 - RNA, 17 nt, Artificial Sequence
  Synthetic Oligonucleotide; CD80 exon 5; Set C
ucugaaacaccuauuua

SEQ ID NO: 57164 - RNA, 19 nt, Artificial Sequence
  Synthetic Oligonucleotide; CD80 exon 5; Set C
uucugaaacaccuauuuaa

SEQ ID NO: 57165 - RNA, 18 nt, Artificial Sequence
  Synthetic Oligonucleotide; CD80 exon 5; Set C
uucugaaacaccuauuua

SEQ ID NO: 57166 - RNA, 27 nt, Artificial Sequence
  Synthetic Oligonucleotide; CD80 exon 5; Set A
aauaacaagccauugcuguuauccugg

SEQ ID NO: 57167 - RNA, 26 nt, Artificial Sequence
  Synthetic Oligonucleotide; CD80 exon 5; Set C
aauaacaagccauugcuguuauccug

SEQ ID NO: 57168 - RNA, 28 nt, Artificial Sequence
  Synthetic Oligonucleotide; CD80 exon 5; Set A
aaauaacaagccauugcuguuauccugg

SEQ ID NO: 57169 - RNA, 27 nt, Artificial Sequence
  Synthetic Oligonucleotide; CD80 exon 5; Set C
aaauaacaagccauugcuguuauccug

SEQ ID NO: 57170 - RNA, 25 nt, Artificial Sequence
  Synthetic Oligonucleotide; CD80 exon 5; Set C
aauaacaagccauugcuguuauccu

SEQ ID NO: 57171 - RNA, 26 nt, Artificial Sequence
  Synthetic Oligonucleotide; CD80 exon 5; Set C
aaauaacaagccauugcuguuauccu

SEQ ID NO: 57172 - RNA, 27 nt, Artificial Sequence
  Synthetic Oligonucleotide; CD80 exon 5; Set C
aaaauaacaagccauugcuguuauccu

SEQ ID NO: 57173 - RNA, 28 nt, Artificial Sequence
  Synthetic Oligonucleotide; CD80 exon 5; Set C
aaaaauaacaagccauugcuguuauccu

SEQ ID NO: 57174 - RNA, 26 nt, Artificial Sequence
  Synthetic Oligonucleotide; CD80 exon 5; Set C
aaaauaacaagccauugcuguuaucc

SEQ ID NO: 57175 - RNA, 29 nt, Artificial Sequence
  Synthetic Oligonucleotide; CD80 exon 5; Set C
aaaaaauaacaagccauugcuguuauccu

SEQ ID NO: 57176 - RNA, 23 nt, Artificial Sequence
  Synthetic Oligonucleotide; CD80 exon 5; Set C
aaauaacaagccauugcuguuau

SEQ ID NO: 57177 - RNA, 27 nt, Artificial Sequence
  Synthetic Oligonucleotide; CD80 exon 5; Set C
aaaaauaacaagccauugcuguuaucc

SEQ ID NO: 57178 - RNA, 20 nt, Artificial Sequence
  Synthetic Oligonucleotide; CD80 exon 5; Set C
aauaacaagccauugcuguu

SEQ ID NO: 57179 - RNA, 22 nt, Artificial Sequence
  Synthetic Oligonucleotide; CD80 exon 5; Set C
aaauaacaagccauugcuguua

SEQ ID NO: 57180 - RNA, 24 nt, Artificial Sequence
  Synthetic Oligonucleotide; CD80 exon 5; Set C
aaaauaacaagccauugcuguuau

SEQ ID NO: 57181 - RNA, 28 nt, Artificial Sequence
  Synthetic Oligonucleotide; CD80 exon 5; Set C
aaaaaauaacaagccauugcuguuaucc

SEQ ID NO: 57182 - RNA, 21 nt, Artificial Sequence
  Synthetic Oligonucleotide; CD80 exon 5; Set C
aaauaacaagccauugcuguu

SEQ ID NO: 57183 - RNA, 31 nt, Artificial Sequence
  Synthetic Oligonucleotide; CD80 exon 5; Set C
acaaaaaauaacaagccauugcuguuauccu

SEQ ID NO: 57184 - RNA, 23 nt, Artificial Sequence
  Synthetic Oligonucleotide; CD80 exon 5; Set C
aaaauaacaagccauugcuguua

SEQ ID NO: 57185 - RNA, 25 nt, Artificial Sequence
  Synthetic Oligonucleotide; CD80 exon 5; Set C
aaaaauaacaagccauugcuguuau

SEQ ID NO: 57186 - RNA, 29 nt, Artificial Sequence
  Synthetic Oligonucleotide; CD80 exon 5; Set C
caaaaaauaacaagccauugcuguuaucc

SEQ ID NO: 57187 - RNA, 32 nt, Artificial Sequence
  Synthetic Oligonucleotide; CD80 exon 5; Set A
cacaaaaaauaacaagccauugcuguuauccu

SEQ ID NO: 57188 - RNA, 20 nt, Artificial Sequence
  Synthetic Oligonucleotide; CD80 exon 5; Set C
aaauaacaagccauugcugu

SEQ ID NO: 57189 - RNA, 24 nt, Artificial Sequence
  Synthetic Oligonucleotide; CD80 exon 5; Set C
aaaaauaacaagccauugcuguua

SEQ ID NO: 57190 - RNA, 26 nt, Artificial Sequence
  Synthetic Oligonucleotide; CD80 exon 5; Set C
aaaaaauaacaagccauugcuguuau

SEQ ID NO: 57191 - RNA, 30 nt, Artificial Sequence
  Synthetic Oligonucleotide; CD80 exon 5; Set C
acaaaaaauaacaagccauugcuguuaucc

SEQ ID NO: 57192 - RNA, 21 nt, Artificial Sequence
  Synthetic Oligonucleotide; CD80 exon 5; Set C
aaaauaacaagccauugcugu

SEQ ID NO: 57193 - RNA, 25 nt, Artificial Sequence
  Synthetic Oligonucleotide; CD80 exon 5; Set C
aaaaaauaacaagccauugcuguua

SEQ ID NO: 57194 - RNA, 27 nt, Artificial Sequence
  Synthetic Oligonucleotide; CD80 exon 5; Set C
caaaaaauaacaagccauugcuguuau

SEQ ID NO: 57195 - RNA, 31 nt, Artificial Sequence
  Synthetic Oligonucleotide; CD80 exon 5; Set C
cacaaaaaauaacaagccauugcuguuaucc

SEQ ID NO: 57196 - RNA, 22 nt, Artificial Sequence
  Synthetic Oligonucleotide; CD80 exon 5; Set C
aaaaauaacaagccauugcugu

SEQ ID NO: 57197 - RNA, 26 nt, Artificial Sequence
  Synthetic Oligonucleotide; CD80 exon 5; Set C
caaaaaauaacaagccauugcuguua

SEQ ID NO: 57198 - RNA, 28 nt, Artificial Sequence
  Synthetic Oligonucleotide; CD80 exon 5; Set C
acaaaaaauaacaagccauugcuguuau

SEQ ID NO: 57199 - RNA, 15 nt, Artificial Sequence
  Synthetic Oligonucleotide; CD80 exon 5; Set C
aauaacaagccauug

SEQ ID NO: 57200 - RNA, 23 nt, Artificial Sequence
  Synthetic Oligonucleotide; CD80 exon 5; Set C
aaaaaauaacaagccauugcugu

SEQ ID NO: 57201 - RNA, 27 nt, Artificial Sequence
  Synthetic Oligonucleotide; CD80 exon 5; Set C
acaaaaaauaacaagccauugcuguua

SEQ ID NO: 57202 - RNA, 29 nt, Artificial Sequence
  Synthetic Oligonucleotide; CD80 exon 5; Set C
cacaaaaaauaacaagccauugcuguuau

SEQ ID NO: 57203 - RNA, 16 nt, Artificial Sequence
  Synthetic Oligonucleotide; CD80 exon 5; Set C
aaauaacaagccauug

SEQ ID NO: 57204 - RNA, 36 nt, Artificial Sequence
  Synthetic Oligonucleotide; CD80 exon 5; Set A
augacacaaaaaauaacaagccauugcuguuauccu

SEQ ID NO: 57205 - RNA, 24 nt, Artificial Sequence
  Synthetic Oligonucleotide; CD80 exon 5; Set C
caaaaaauaacaagccauugcugu

SEQ ID NO: 57206 - RNA, 28 nt, Artificial Sequence
  Synthetic Oligonucleotide; CD80 exon 5; Set C
cacaaaaaauaacaagccauugcuguua

SEQ ID NO: 57207 - RNA, 15 nt, Artificial Sequence
  Synthetic Oligonucleotide; CD80 exon 5; Set C
aaauaacaagccauu

SEQ ID NO: 57208 - RNA, 25 nt, Artificial Sequence
  Synthetic Oligonucleotide; CD80 exon 5; Set C
acaaaaaauaacaagccauugcugu

SEQ ID NO: 57209 - RNA, 35 nt, Artificial Sequence
  Synthetic Oligonucleotide; CD80 exon 5; Set A
augacacaaaaaauaacaagccauugcuguuaucc

SEQ ID NO: 57210 - RNA, 26 nt, Artificial Sequence
  Synthetic Oligonucleotide; CD80 exon 5; Set C
cacaaaaaauaacaagccauugcugu

SEQ ID NO: 57211 - RNA, 15 nt, Artificial Sequence
  Synthetic Oligonucleotide; CD80 exon 5; Set C
aaaauaacaagccau

SEQ ID NO: 57212 - RNA, 33 nt, Artificial Sequence
  Synthetic Oligonucleotide; CD80 exon 5; Set C
augacacaaaaaauaacaagccauugcuguuau

SEQ ID NO: 57213 - RNA, 35 nt, Artificial Sequence
  Synthetic Oligonucleotide; CD80 exon 5; Set A
aaugacacaaaaaauaacaagccauugcuguuauc

SEQ ID NO: 57214 - RNA, 32 nt, Artificial Sequence
  Synthetic Oligonucleotide; CD80 exon 5; Set C
augacacaaaaaauaacaagccauugcuguua

SEQ ID NO: 57215 - RNA, 36 nt, Artificial Sequence
  Synthetic Oligonucleotide; CD80 exon 5; Set A
gaaugacacaaaaaauaacaagccauugcuguuauc

SEQ ID NO: 57216 - RNA, 37 nt, Artificial Sequence
  Synthetic Oligonucleotide; CD80 exon 5; Set A
agaaugacacaaaaaauaacaagccauugcuguuauc

SEQ ID NO: 57217 - RNA, 30 nt, Artificial Sequence
  Synthetic Oligonucleotide; CD80 exon 5; Set C
augacacaaaaaauaacaagccauugcugu

SEQ ID NO: 57218 - RNA, 38 nt, Artificial Sequence
  Synthetic Oligonucleotide; CD80 exon 5; Set A
uagaaugacacaaaaaauaacaagccauugcuguuauc

SEQ ID NO: 57219 - RNA, 29 nt, Artificial Sequence
  Synthetic Oligonucleotide; CD80 exon 5; Set C
augacacaaaaaauaacaagccauugcug

SEQ ID NO: 57220 - RNA, 39 nt, Artificial Sequence
  Synthetic Oligonucleotide; CD80 exon 5; Set A
uuagaaugacacaaaaaauaacaagccauugcuguuauc

SEQ ID NO: 57221 - RNA, 22 nt, Artificial Sequence
  Synthetic Oligonucleotide; CD80 exon 5; Set C
acacaaaaaauaacaagccauu

SEQ ID NO: 57222 - RNA, 30 nt, Artificial Sequence
  Synthetic Oligonucleotide; CD80 exon 5; Set C
aaugacacaaaaaauaacaagccauugcug

SEQ ID NO: 57223 - RNA, 40 nt, Artificial Sequence
  Synthetic Oligonucleotide; CD80 exon 5; Set A
auuagaaugacacaaaaaauaacaagccauugcuguuauc

SEQ ID NO: 57224 - RNA, 23 nt, Artificial Sequence
  Synthetic Oligonucleotide; CD80 exon 5; Set C
gacacaaaaaauaacaagccauu

SEQ ID NO: 57225 - RNA, 31 nt, Artificial Sequence
  Synthetic Oligonucleotide; CD80 exon 5; Set C
gaaugacacaaaaaauaacaagccauugcug

SEQ ID NO: 57226 - RNA, 29 nt, Artificial Sequence
  Synthetic Oligonucleotide; CD80 exon 5; Set C
aaugacacaaaaaauaacaagccauugcu

SEQ ID NO: 57227 - RNA, 24 nt, Artificial Sequence
  Synthetic Oligonucleotide; CD80 exon 5; Set C
ugacacaaaaaauaacaagccauu

SEQ ID NO: 57228 - RNA, 28 nt, Artificial Sequence
  Synthetic Oligonucleotide; CD80 exon 5; Set C
aaugacacaaaaaauaacaagccauugc

SEQ ID NO: 57229 - RNA, 32 nt, Artificial Sequence
  Synthetic Oligonucleotide; CD80 exon 5; Set C
agaaugacacaaaaaauaacaagccauugcug

SEQ ID NO: 57230 - RNA, 30 nt, Artificial Sequence
  Synthetic Oligonucleotide; CD80 exon 5; Set C
gaaugacacaaaaaauaacaagccauugcu

SEQ ID NO: 57231 - RNA, 29 nt, Artificial Sequence
  Synthetic Oligonucleotide; CD80 exon 5; Set C
gaaugacacaaaaaauaacaagccauugc

SEQ ID NO: 57232 - RNA, 33 nt, Artificial Sequence
  Synthetic Oligonucleotide; CD80 exon 5; Set C
uagaaugacacaaaaaauaacaagccauugcug

SEQ ID NO: 57233 - RNA, 31 nt, Artificial Sequence
  Synthetic Oligonucleotide; CD80 exon 5; Set C
agaaugacacaaaaaauaacaagccauugcu

SEQ ID NO: 57234 - RNA, 30 nt, Artificial Sequence
  Synthetic Oligonucleotide; CD80 exon 5; Set C
agaaugacacaaaaaauaacaagccauugc

SEQ ID NO: 57235 - RNA, 34 nt, Artificial Sequence
  Synthetic Oligonucleotide; CD80 exon 5; Set C
uuagaaugacacaaaaaauaacaagccauugcug

SEQ ID NO: 57236 - RNA, 32 nt, Artificial Sequence
  Synthetic Oligonucleotide; CD80 exon 5; Set C
uagaaugacacaaaaaauaacaagccauugcu

SEQ ID NO: 57237 - RNA, 31 nt, Artificial Sequence
  Synthetic Oligonucleotide; CD80 exon 5; Set C
uagaaugacacaaaaaauaacaagccauugc

SEQ ID NO: 57238 - RNA, 35 nt, Artificial Sequence
  Synthetic Oligonucleotide; CD80 exon 5; Set C
auuagaaugacacaaaaaauaacaagccauugcug

SEQ ID NO: 57239 - RNA, 33 nt, Artificial Sequence
  Synthetic Oligonucleotide; CD80 exon 5; Set C
uuagaaugacacaaaaaauaacaagccauugcu

SEQ ID NO: 57240 - RNA, 32 nt, Artificial Sequence
  Synthetic Oligonucleotide; CD80 exon 5; Set C
uuagaaugacacaaaaaauaacaagccauugc

SEQ ID NO: 57241 - RNA, 36 nt, Artificial Sequence
  Synthetic Oligonucleotide; CD80 exon 5; Set A
gauuagaaugacacaaaaaauaacaagccauugcug

SEQ ID NO: 57242 - RNA, 34 nt, Artificial Sequence
  Synthetic Oligonucleotide; CD80 exon 5; Set C
auuagaaugacacaaaaaauaacaagccauugcu

SEQ ID NO: 57243 - RNA, 33 nt, Artificial Sequence
  Synthetic Oligonucleotide; CD80 exon 5; Set C
auuagaaugacacaaaaaauaacaagccauugc

SEQ ID NO: 57244 - RNA, 37 nt, Artificial Sequence
  Synthetic Oligonucleotide; CD80 exon 5; Set A
agauuagaaugacacaaaaaauaacaagccauugcug

SEQ ID NO: 57245 - RNA, 35 nt, Artificial Sequence
  Synthetic Oligonucleotide; CD80 exon 5; Set A
gauuagaaugacacaaaaaauaacaagccauugcu

SEQ ID NO: 57246 - RNA, 34 nt, Artificial Sequence
  Synthetic Oligonucleotide; CD80 exon 5; Set C
gauuagaaugacacaaaaaauaacaagccauugc

SEQ ID NO: 57247 - RNA, 38 nt, Artificial Sequence
  Synthetic Oligonucleotide; CD80 exon 5; Set A
cagauuagaaugacacaaaaaauaacaagccauugcug

SEQ ID NO: 57248 - RNA, 36 nt, Artificial Sequence
  Synthetic Oligonucleotide; CD80 exon 5; Set A
agauuagaaugacacaaaaaauaacaagccauugcu

SEQ ID NO: 57249 - RNA, 35 nt, Artificial Sequence
  Synthetic Oligonucleotide; CD80 exon 5; Set C
agauuagaaugacacaaaaaauaacaagccauugc

SEQ ID NO: 57250 - RNA, 37 nt, Artificial Sequence
  Synthetic Oligonucleotide; CD80 exon 5; Set A
cagauuagaaugacacaaaaaauaacaagccauugcu

SEQ ID NO: 57251 - RNA, 36 nt, Artificial Sequence
  Synthetic Oligonucleotide; CD80 exon 5; Set A
cagauuagaaugacacaaaaaauaacaagccauugc

SEQ ID NO: 57252 - RNA, 17 nt, Artificial Sequence
  Synthetic Oligonucleotide; CD80 exon 5; Set C
augacacaaaaaauaac

SEQ ID NO: 57253 - RNA, 16 nt, Artificial Sequence
  Synthetic Oligonucleotide; CD80 exon 5; Set C
augacacaaaaaauaa

SEQ ID NO: 57254 - RNA, 18 nt, Artificial Sequence
  Synthetic Oligonucleotide; CD80 exon 5; Set C
aaugacacaaaaaauaac

SEQ ID NO: 57255 - RNA, 15 nt, Artificial Sequence
  Synthetic Oligonucleotide; CD80 exon 5; Set C
augacacaaaaaaua

SEQ ID NO: 57256 - RNA, 17 nt, Artificial Sequence
  Synthetic Oligonucleotide; CD80 exon 5; Set C
aaugacacaaaaaauaa

SEQ ID NO: 57257 - RNA, 19 nt, Artificial Sequence
  Synthetic Oligonucleotide; CD80 exon 5; Set C
gaaugacacaaaaaauaac

SEQ ID NO: 57258 - RNA, 18 nt, Artificial Sequence
  Synthetic Oligonucleotide; CD80 exon 5; Set C
gaaugacacaaaaaauaa

SEQ ID NO: 57259 - RNA, 20 nt, Artificial Sequence
  Synthetic Oligonucleotide; CD80 exon 5; Set C
agaaugacacaaaaaauaac

SEQ ID NO: 57260 - RNA, 19 nt, Artificial Sequence
  Synthetic Oligonucleotide; CD80 exon 5; Set C
agaaugacacaaaaaauaa

SEQ ID NO: 57261 - RNA, 21 nt, Artificial Sequence
  Synthetic Oligonucleotide; CD80 exon 5; Set C
uagaaugacacaaaaaauaac

SEQ ID NO: 57262 - RNA, 20 nt, Artificial Sequence
  Synthetic Oligonucleotide; CD80 exon 5; Set C
uagaaugacacaaaaaauaa

SEQ ID NO: 57263 - RNA, 22 nt, Artificial Sequence
  Synthetic Oligonucleotide; CD80 exon 5; Set C
uuagaaugacacaaaaaauaac

SEQ ID NO: 57264 - RNA, 21 nt, Artificial Sequence
  Synthetic Oligonucleotide; CD80 exon 5; Set C
uuagaaugacacaaaaaauaa

SEQ ID NO: 57265 - RNA, 23 nt, Artificial Sequence
  Synthetic Oligonucleotide; CD80 exon 5; Set C
auuagaaugacacaaaaaauaac

SEQ ID NO: 57266 - RNA, 22 nt, Artificial Sequence
  Synthetic Oligonucleotide; CD80 exon 5; Set C
auuagaaugacacaaaaaauaa

SEQ ID NO: 57267 - RNA, 24 nt, Artificial Sequence
  Synthetic Oligonucleotide; CD80 exon 5; Set C
gauuagaaugacacaaaaaauaac

SEQ ID NO: 57268 - RNA, 23 nt, Artificial Sequence
  Synthetic Oligonucleotide; CD80 exon 5; Set C
gauuagaaugacacaaaaaauaa

SEQ ID NO: 57269 - RNA, 25 nt, Artificial Sequence
  Synthetic Oligonucleotide; CD80 exon 5; Set C
agauuagaaugacacaaaaaauaac

SEQ ID NO: 57270 - RNA, 24 nt, Artificial Sequence
  Synthetic Oligonucleotide; CD80 exon 5; Set C
agauuagaaugacacaaaaaauaa

SEQ ID NO: 57271 - RNA, 26 nt, Artificial Sequence
  Synthetic Oligonucleotide; CD80 exon 5; Set C
cagauuagaaugacacaaaaaauaac

SEQ ID NO: 57272 - RNA, 34 nt, Artificial Sequence
  Synthetic Oligonucleotide; CD80 exon 5; Set C
gaccucuacagauuagaaugacacaaaaaauaac

SEQ ID NO: 57273 - RNA, 33 nt, Artificial Sequence
  Synthetic Oligonucleotide; CD80 exon 5; Set C
gaccucuacagauuagaaugacacaaaaaauaa

SEQ ID NO: 57274 - RNA, 35 nt, Artificial Sequence
  Synthetic Oligonucleotide; CD80 exon 5; Set C
ugaccucuacagauuagaaugacacaaaaaauaac

SEQ ID NO: 57275 - RNA, 34 nt, Artificial Sequence
  Synthetic Oligonucleotide; CD80 exon 5; Set C
ugaccucuacagauuagaaugacacaaaaaauaa

SEQ ID NO: 57276 - RNA, 36 nt, Artificial Sequence
  Synthetic Oligonucleotide; CD80 exon 5; Set C
uugaccucuacagauuagaaugacacaaaaaauaac

SEQ ID NO: 57277 - RNA, 35 nt, Artificial Sequence
  Synthetic Oligonucleotide; CD80 exon 5; Set C
uugaccucuacagauuagaaugacacaaaaaauaa

SEQ ID NO: 57278 - RNA, 34 nt, Artificial Sequence
  Synthetic Oligonucleotide; CD80 exon 5; Set A
guugaccucuacagauuagaaugacacaaaaaau

SEQ ID NO: 57279 - RNA, 33 nt, Artificial Sequence
  Synthetic Oligonucleotide; CD80 exon 5; Set A
guugaccucuacagauuagaaugacacaaaaaa

SEQ ID NO: 57280 - RNA, 23 nt, Artificial Sequence
  Synthetic Oligonucleotide; CD80 exon 5; Set C
gaccucuacagauuagaaugaca

SEQ ID NO: 57281 - RNA, 24 nt, Artificial Sequence
  Synthetic Oligonucleotide; CD80 exon 5; Set C
ugaccucuacagauuagaaugaca

SEQ ID NO: 57282 - RNA, 22 nt, Artificial Sequence
  Synthetic Oligonucleotide; CD80 exon 5; Set C
gaccucuacagauuagaaugac

SEQ ID NO: 57283 - RNA, 21 nt, Artificial Sequence
  Synthetic Oligonucleotide; CD80 exon 5; Set C
gaccucuacagauuagaauga

SEQ ID NO: 57284 - RNA, 25 nt, Artificial Sequence
  Synthetic Oligonucleotide; CD80 exon 5; Set C
uugaccucuacagauuagaaugaca

SEQ ID NO: 57285 - RNA, 23 nt, Artificial Sequence
  Synthetic Oligonucleotide; CD80 exon 5; Set C
ugaccucuacagauuagaaugac

SEQ ID NO: 57286 - RNA, 22 nt, Artificial Sequence
  Synthetic Oligonucleotide; CD80 exon 5; Set C
ugaccucuacagauuagaauga

SEQ ID NO: 57287 - RNA, 24 nt, Artificial Sequence
  Synthetic Oligonucleotide; CD80 exon 5; Set C
uugaccucuacagauuagaaugac

SEQ ID NO: 57288 - RNA, 23 nt, Artificial Sequence
  Synthetic Oligonucleotide; CD80 exon 5; Set C
uugaccucuacagauuagaauga

SEQ ID NO: 57289 - RNA, 33 nt, Artificial Sequence
  Synthetic Oligonucleotide; CD80 exon 5; Set A
uaccagaguugaccucuacagauuagaaugaca

SEQ ID NO: 57290 - RNA, 40 nt, Artificial Sequence
  Synthetic Oligonucleotide; CD80 exon 5; Set C
ugauuaccagaguugaccucuacagauuagaaugacacaa

SEQ ID NO: 57291 - RNA, 34 nt, Artificial Sequence
  Synthetic Oligonucleotide; CD80 exon 5; Set A
uuaccagaguugaccucuacagauuagaaugaca

SEQ ID NO: 57292 - RNA, 32 nt, Artificial Sequence
  Synthetic Oligonucleotide; CD80 exon 5; Set A
uaccagaguugaccucuacagauuagaaugac

SEQ ID NO: 57293 - RNA, 39 nt, Artificial Sequence
  Synthetic Oligonucleotide; CD80 exon 5; Set C
ugauuaccagaguugaccucuacagauuagaaugacaca

SEQ ID NO: 57294 - RNA, 31 nt, Artificial Sequence
  Synthetic Oligonucleotide; CD80 exon 5; Set A
uaccagaguugaccucuacagauuagaauga

SEQ ID NO: 57295 - RNA, 35 nt, Artificial Sequence
  Synthetic Oligonucleotide; CD80 exon 5; Set A
auuaccagaguugaccucuacagauuagaaugaca

SEQ ID NO: 57296 - RNA, 33 nt, Artificial Sequence
  Synthetic Oligonucleotide; CD80 exon 5; Set A
uuaccagaguugaccucuacagauuagaaugac

SEQ ID NO: 57297 - RNA, 40 nt, Artificial Sequence
  Synthetic Oligonucleotide; CD80 exon 5; Set C
gugauuaccagaguugaccucuacagauuagaaugacaca

SEQ ID NO: 57298 - RNA, 38 nt, Artificial Sequence
  Synthetic Oligonucleotide; CD80 exon 5; Set C
ugauuaccagaguugaccucuacagauuagaaugacac

SEQ ID NO: 57299 - RNA, 32 nt, Artificial Sequence
  Synthetic Oligonucleotide; CD80 exon 5; Set A
uuaccagaguugaccucuacagauuagaauga

SEQ ID NO: 57300 - RNA, 34 nt, Artificial Sequence
  Synthetic Oligonucleotide; CD80 exon 5; Set A
auuaccagaguugaccucuacagauuagaaugac

SEQ ID NO: 57301 - RNA, 39 nt, Artificial Sequence
  Synthetic Oligonucleotide; CD80 exon 5; Set C
gugauuaccagaguugaccucuacagauuagaaugacac

SEQ ID NO: 57302 - RNA, 33 nt, Artificial Sequence
  Synthetic Oligonucleotide; CD80 exon 5; Set A
auuaccagaguugaccucuacagauuagaauga

SEQ ID NO: 57303 - RNA, 40 nt, Artificial Sequence
  Synthetic Oligonucleotide; CD80 exon 5; Set C
agugauuaccagaguugaccucuacagauuagaaugacac

SEQ ID NO: 57304 - RNA, 34 nt, Artificial Sequence
  Synthetic Oligonucleotide; CD80 exon 5; Set A
ugauuaccagaguugaccucuacagauuagaaug

SEQ ID NO: 57305 - RNA, 33 nt, Artificial Sequence
  Synthetic Oligonucleotide; CD80 exon 5; Set A
ugauuaccagaguugaccucuacagauuagaau

SEQ ID NO: 57306 - RNA, 35 nt, Artificial Sequence
  Synthetic Oligonucleotide; CD80 exon 5; Set A
gugauuaccagaguugaccucuacagauuagaaug

SEQ ID NO: 57307 - RNA, 34 nt, Artificial Sequence
  Synthetic Oligonucleotide; CD80 exon 5; Set A
gugauuaccagaguugaccucuacagauuagaau

SEQ ID NO: 57308 - RNA, 32 nt, Artificial Sequence
  Synthetic Oligonucleotide; CD80 exon 5; Set A
ugauuaccagaguugaccucuacagauuagaa

SEQ ID NO: 57309 - RNA, 36 nt, Artificial Sequence
  Synthetic Oligonucleotide; CD80 exon 5; Set A
agugauuaccagaguugaccucuacagauuagaaug

SEQ ID NO: 57310 - RNA, 31 nt, Artificial Sequence
  Synthetic Oligonucleotide; CD80 exon 5; Set A
ugauuaccagaguugaccucuacagauuaga

SEQ ID NO: 57311 - RNA, 33 nt, Artificial Sequence
  Synthetic Oligonucleotide; CD80 exon 5; Set A
gugauuaccagaguugaccucuacagauuagaa

SEQ ID NO: 57312 - RNA, 30 nt, Artificial Sequence
  Synthetic Oligonucleotide; CD80 exon 5; Set A
ugauuaccagaguugaccucuacagauuag

SEQ ID NO: 57313 - RNA, 32 nt, Artificial Sequence
  Synthetic Oligonucleotide; CD80 exon 5; Set A
gugauuaccagaguugaccucuacagauuaga

SEQ ID NO: 57314 - RNA, 34 nt, Artificial Sequence
  Synthetic Oligonucleotide; CD80 exon 5; Set A
agugauuaccagaguugaccucuacagauuagaa

SEQ ID NO: 57315 - RNA, 38 nt, Artificial Sequence
  Synthetic Oligonucleotide; CD80 exon 5; Set A
caagugauuaccagaguugaccucuacagauuagaaug

SEQ ID NO: 57316 - RNA, 33 nt, Artificial Sequence
  Synthetic Oligonucleotide; CD80 exon 5; Set A
agugauuaccagaguugaccucuacagauuaga

SEQ ID NO: 57317 - RNA, 29 nt, Artificial Sequence
  Synthetic Oligonucleotide; CD80 exon 5; Set A
ugauuaccagaguugaccucuacagauua

SEQ ID NO: 57318 - RNA, 31 nt, Artificial Sequence
  Synthetic Oligonucleotide; CD80 exon 5; Set A
gugauuaccagaguugaccucuacagauuag

SEQ ID NO: 57319 - RNA, 39 nt, Artificial Sequence
  Synthetic Oligonucleotide; CD80 exon 5; Set A
ucaagugauuaccagaguugaccucuacagauuagaaug

SEQ ID NO: 57320 - RNA, 32 nt, Artificial Sequence
  Synthetic Oligonucleotide; CD80 exon 5; Set A
agugauuaccagaguugaccucuacagauuag

SEQ ID NO: 57321 - RNA, 28 nt, Artificial Sequence
  Synthetic Oligonucleotide; CD80 exon 5; Set A
ugauuaccagaguugaccucuacagauu

SEQ ID NO: 57322 - RNA, 30 nt, Artificial Sequence
  Synthetic Oligonucleotide; CD80 exon 5; Set A
gugauuaccagaguugaccucuacagauua

SEQ ID NO: 57323 - RNA, 31 nt, Artificial Sequence
  Synthetic Oligonucleotide; CD80 exon 5; Set A
agugauuaccagaguugaccucuacagauua

SEQ ID NO: 57324 - RNA, 29 nt, Artificial Sequence
  Synthetic Oligonucleotide; CD80 exon 5; Set A
gugauuaccagaguugaccucuacagauu

SEQ ID NO: 57325 - RNA, 27 nt, Artificial Sequence
  Synthetic Oligonucleotide; CD80 exon 5; Set A
ugauuaccagaguugaccucuacagau

SEQ ID NO: 57326 - RNA, 30 nt, Artificial Sequence
  Synthetic Oligonucleotide; CD80 exon 5; Set A
agugauuaccagaguugaccucuacagauu

SEQ ID NO: 57327 - RNA, 26 nt, Artificial Sequence
  Synthetic Oligonucleotide; CD80 exon 5; Set A
ugauuaccagaguugaccucuacaga

SEQ ID NO: 57328 - RNA, 28 nt, Artificial Sequence
  Synthetic Oligonucleotide; CD80 exon 5; Set A
gugauuaccagaguugaccucuacagau

SEQ ID NO: 57329 - RNA, 25 nt, Artificial Sequence
  Synthetic Oligonucleotide; CD80 exon 5; Set A
ugauuaccagaguugaccucuacag

SEQ ID NO: 57330 - RNA, 27 nt, Artificial Sequence
  Synthetic Oligonucleotide; CD80 exon 5; Set A
gugauuaccagaguugaccucuacaga

SEQ ID NO: 57331 - RNA, 29 nt, Artificial Sequence
  Synthetic Oligonucleotide; CD80 exon 5; Set A
agugauuaccagaguugaccucuacagau

SEQ ID NO: 57332 - RNA, 32 nt, Artificial Sequence
  Synthetic Oligonucleotide; CD80 exon 5; Set A
caagugauuaccagaguugaccucuacagauu

SEQ ID NO: 57333 - RNA, 28 nt, Artificial Sequence
  Synthetic Oligonucleotide; CD80 exon 5; Set A
agugauuaccagaguugaccucuacaga

SEQ ID NO: 57334 - RNA, 26 nt, Artificial Sequence
  Synthetic Oligonucleotide; CD80 exon 5; Set A
gugauuaccagaguugaccucuacag

SEQ ID NO: 57335 - RNA, 27 nt, Artificial Sequence
  Synthetic Oligonucleotide; CD80 exon 5; Set A
agugauuaccagaguugaccucuacag

SEQ ID NO: 57336 - RNA, 31 nt, Artificial Sequence
  Synthetic Oligonucleotide; CD80 exon 5; Set A
caagugauuaccagaguugaccucuacagau

SEQ ID NO: 57337 - RNA, 30 nt, Artificial Sequence
  Synthetic Oligonucleotide; CD80 exon 5; Set A
caagugauuaccagaguugaccucuacaga

SEQ ID NO: 57338 - RNA, 32 nt, Artificial Sequence
  Synthetic Oligonucleotide; CD80 exon 5; Set A
ucaagugauuaccagaguugaccucuacagau

SEQ ID NO: 57339 - RNA, 31 nt, Artificial Sequence
  Synthetic Oligonucleotide; CD80 exon 5; Set A
ucaagugauuaccagaguugaccucuacaga

SEQ ID NO: 57340 - RNA, 29 nt, Artificial Sequence
  Synthetic Oligonucleotide; CD80 exon 5; Set A
caagugauuaccagaguugaccucuacag

SEQ ID NO: 57341 - RNA, 30 nt, Artificial Sequence
  Synthetic Oligonucleotide; CD80 exon 5; Set A
ucaagugauuaccagaguugaccucuacag

SEQ ID NO: 57342 - RNA, 17 nt, Artificial Sequence
  Synthetic Oligonucleotide; CD80 exon 5; Set C
ugauuaccagaguugac

SEQ ID NO: 57343 - RNA, 40 nt, Artificial Sequence
  Synthetic Oligonucleotide; CD80 exon 5; Set C
ggagacaucaagugauuaccagaguugaccucuacagauu

SEQ ID NO: 57344 - RNA, 16 nt, Artificial Sequence
  Synthetic Oligonucleotide; CD80 exon 5; Set C
ugauuaccagaguuga

SEQ ID NO: 57345 - RNA, 18 nt, Artificial Sequence
  Synthetic Oligonucleotide; CD80 exon 5; Set C
gugauuaccagaguugac

SEQ ID NO: 57346 - RNA, 39 nt, Artificial Sequence
  Synthetic Oligonucleotide; CD80 exon 5; Set C
ggagacaucaagugauuaccagaguugaccucuacagau

SEQ ID NO: 57347 - RNA, 15 nt, Artificial Sequence
  Synthetic Oligonucleotide; CD80 exon 5; Set C
ugauuaccagaguug

SEQ ID NO: 57348 - RNA, 17 nt, Artificial Sequence
  Synthetic Oligonucleotide; CD80 exon 5; Set C
gugauuaccagaguuga

SEQ ID NO: 57349 - RNA, 19 nt, Artificial Sequence
  Synthetic Oligonucleotide; CD80 exon 5; Set C
agugauuaccagaguugac

SEQ ID NO: 57350 - RNA, 38 nt, Artificial Sequence
  Synthetic Oligonucleotide; CD80 exon 5; Set C
ggagacaucaagugauuaccagaguugaccucuacaga

SEQ ID NO: 57351 - RNA, 18 nt, Artificial Sequence
  Synthetic Oligonucleotide; CD80 exon 5; Set C
agugauuaccagaguuga

SEQ ID NO: 57352 - RNA, 16 nt, Artificial Sequence
  Synthetic Oligonucleotide; CD80 exon 5; Set C
gugauuaccagaguug

SEQ ID NO: 57353 - RNA, 37 nt, Artificial Sequence
  Synthetic Oligonucleotide; CD80 exon 5; Set C
ggagacaucaagugauuaccagaguugaccucuacag

SEQ ID NO: 57354 - RNA, 17 nt, Artificial Sequence
  Synthetic Oligonucleotide; CD80 exon 5; Set C
agugauuaccagaguug

SEQ ID NO: 57355 - RNA, 38 nt, Artificial Sequence
  Synthetic Oligonucleotide; CD80 exon 5; Set C
uggagacaucaagugauuaccagaguugaccucuacag

SEQ ID NO: 57356 - RNA, 40 nt, Artificial Sequence
  Synthetic Oligonucleotide; CD80 exon 5; Set C
auggagacaucaagugauuaccagaguugaccucuacaga

SEQ ID NO: 57357 - RNA, 39 nt, Artificial Sequence
  Synthetic Oligonucleotide; CD80 exon 5; Set C
auggagacaucaagugauuaccagaguugaccucuacag

SEQ ID NO: 57358 - RNA, 19 nt, Artificial Sequence
  Synthetic Oligonucleotide; CD80 exon 5; Set C
caagugauuaccagaguug

SEQ ID NO: 57359 - RNA, 17 nt, Artificial Sequence
  Synthetic Oligonucleotide; CD80 exon 5; Set C
aagugauuaccagaguu

SEQ ID NO: 57360 - RNA, 20 nt, Artificial Sequence
  Synthetic Oligonucleotide; CD80 exon 5; Set C
aucaagugauuaccagaguu

SEQ ID NO: 57361 - RNA, 21 nt, Artificial Sequence
  Synthetic Oligonucleotide; CD80 exon 5; Set C
caucaagugauuaccagaguu

SEQ ID NO: 57362 - RNA, 25 nt, Artificial Sequence
  Synthetic Oligonucleotide; CD80 exon 5; Set C
gagacaucaagugauuaccagaguu

SEQ ID NO: 57363 - RNA, 31 nt, Artificial Sequence
  Synthetic Oligonucleotide; CD80 exon 5; Set A
ugaauggagacaucaagugauuaccagaguu

SEQ ID NO: 57364 - RNA, 32 nt, Artificial Sequence
  Synthetic Oligonucleotide; CD80 exon 5; Set A
uugaauggagacaucaagugauuaccagaguu

SEQ ID NO: 57365 - RNA, 33 nt, Artificial Sequence
  Synthetic Oligonucleotide; CD80 exon 5; Set A
auugaauggagacaucaagugauuaccagaguu

SEQ ID NO: 57366 - RNA, 16 nt, Artificial Sequence
  Synthetic Oligonucleotide; CD80 exon 5; Set C
ggagacaucaagugau

SEQ ID NO: 57367 - RNA, 17 nt, Artificial Sequence
  Synthetic Oligonucleotide; CD80 exon 5; Set C
uggagacaucaagugau

SEQ ID NO: 57368 - RNA, 18 nt, Artificial Sequence
  Synthetic Oligonucleotide; CD80 exon 5; Set C
auggagacaucaagugau

SEQ ID NO: 57369 - RNA, 20 nt, Artificial Sequence
  Synthetic Oligonucleotide; CD80 exon 5; Set C
ugaauggagacaucaaguga

SEQ ID NO: 57370 - RNA, 21 nt, Artificial Sequence
  Synthetic Oligonucleotide; CD80 exon 5; Set C
uugaauggagacaucaaguga

SEQ ID NO: 57371 - RNA, 19 nt, Artificial Sequence
  Synthetic Oligonucleotide; CD80 exon 5; Set C
ugaauggagacaucaagug

SEQ ID NO: 57372 - RNA, 18 nt, Artificial Sequence
  Synthetic Oligonucleotide; CD80 exon 5; Set C
ugaauggagacaucaagu

SEQ ID NO: 57373 - RNA, 22 nt, Artificial Sequence
  Synthetic Oligonucleotide; CD80 exon 5; Set C
auugaauggagacaucaaguga

SEQ ID NO: 57374 - RNA, 20 nt, Artificial Sequence
  Synthetic Oligonucleotide; CD80 exon 5; Set C
uugaauggagacaucaagug

SEQ ID NO: 57375 - RNA, 25 nt, Artificial Sequence
  Synthetic Oligonucleotide; CD80 exon 5; Set C
agauugaauggagacaucaagugau

SEQ ID NO: 57376 - RNA, 19 nt, Artificial Sequence
  Synthetic Oligonucleotide; CD80 exon 5; Set C
uugaauggagacaucaagu

SEQ ID NO: 57377 - RNA, 21 nt, Artificial Sequence
  Synthetic Oligonucleotide; CD80 exon 5; Set C
auugaauggagacaucaagug

SEQ ID NO: 57378 - RNA, 26 nt, Artificial Sequence
  Synthetic Oligonucleotide; CD80 exon 5; Set C
cagauugaauggagacaucaagugau

SEQ ID NO: 57379 - RNA, 20 nt, Artificial Sequence
  Synthetic Oligonucleotide; CD80 exon 5; Set C
auugaauggagacaucaagu

SEQ ID NO: 57380 - RNA, 33 nt, Artificial Sequence
  Synthetic Oligonucleotide; CD80 exon 5; Set A
acaccagauugaauggagacaucaagugauuac

SEQ ID NO: 57381 - RNA, 17 nt, Artificial Sequence
  Synthetic Oligonucleotide; CD80 exon 5; Set C
uugaauggagacaucaa

SEQ ID NO: 57382 - RNA, 32 nt, Artificial Sequence
  Synthetic Oligonucleotide; CD80 exon 5; Set A
acaccagauugaauggagacaucaagugauua

SEQ ID NO: 57383 - RNA, 16 nt, Artificial Sequence
  Synthetic Oligonucleotide; CD80 exon 5; Set C
uugaauggagacauca

SEQ ID NO: 57384 - RNA, 18 nt, Artificial Sequence
  Synthetic Oligonucleotide; CD80 exon 5; Set C
auugaauggagacaucaa

SEQ ID NO: 57385 - RNA, 31 nt, Artificial Sequence
  Synthetic Oligonucleotide; CD80 exon 5; Set A
acaccagauugaauggagacaucaagugauu

SEQ ID NO: 57386 - RNA, 21 nt, Artificial Sequence
  Synthetic Oligonucleotide; CD80 exon 5; Set C
agauugaauggagacaucaag

SEQ ID NO: 57387 - RNA, 17 nt, Artificial Sequence
  Synthetic Oligonucleotide; CD80 exon 5; Set C
auugaauggagacauca

SEQ ID NO: 57388 - RNA, 22 nt, Artificial Sequence
  Synthetic Oligonucleotide; CD80 exon 5; Set C
cagauugaauggagacaucaag

SEQ ID NO: 57389 - RNA, 20 nt, Artificial Sequence
  Synthetic Oligonucleotide; CD80 exon 5; Set C
agauugaauggagacaucaa

SEQ ID NO: 57390 - RNA, 31 nt, Artificial Sequence
  Synthetic Oligonucleotide; CD80 exon 5; Set A
aacaccagauugaauggagacaucaagugau

SEQ ID NO: 57391 - RNA, 19 nt, Artificial Sequence
  Synthetic Oligonucleotide; CD80 exon 5; Set C
agauugaauggagacauca

SEQ ID NO: 57392 - RNA, 18 nt, Artificial Sequence
  Synthetic Oligonucleotide; CD80 exon 5; Set C
agauugaauggagacauc

SEQ ID NO: 57393 - RNA, 17 nt, Artificial Sequence
  Synthetic Oligonucleotide; CD80 exon 5; Set C
agauugaauggagacau

SEQ ID NO: 57394 - RNA, 19 nt, Artificial Sequence
  Synthetic Oligonucleotide; CD80 exon 5; Set C
cagauugaauggagacauc

SEQ ID NO: 57395 - RNA, 31 nt, Artificial Sequence
  Synthetic Oligonucleotide; CD80 exon 5; Set A
aaacaccagauugaauggagacaucaaguga

SEQ ID NO: 57396 - RNA, 18 nt, Artificial Sequence
  Synthetic Oligonucleotide; CD80 exon 5; Set C
cagauugaauggagacau

SEQ ID NO: 57397 - RNA, 30 nt, Artificial Sequence
  Synthetic Oligonucleotide; CD80 exon 5; Set A
aaacaccagauugaauggagacaucaagug

SEQ ID NO: 57398 - RNA, 27 nt, Artificial Sequence
  Synthetic Oligonucleotide; CD80 exon 5; Set C
aacaccagauugaauggagacaucaag

SEQ ID NO: 57399 - RNA, 29 nt, Artificial Sequence
  Synthetic Oligonucleotide; CD80 exon 5; Set A
aaacaccagauugaauggagacaucaagu

SEQ ID NO: 57400 - RNA, 26 nt, Artificial Sequence
  Synthetic Oligonucleotide; CD80 exon 5; Set C
aacaccagauugaauggagacaucaa

SEQ ID NO: 57401 - RNA, 25 nt, Artificial Sequence
  Synthetic Oligonucleotide; CD80 exon 5; Set A
aacaccagauugaauggagacauca

SEQ ID NO: 57402 - RNA, 27 nt, Artificial Sequence
  Synthetic Oligonucleotide; CD80 exon 5; Set C
aaacaccagauugaauggagacaucaa

SEQ ID NO: 57403 - RNA, 33 nt, Artificial Sequence
  Synthetic Oligonucleotide; CD80 exon 5; Set A
cuaaaacaccagauugaauggagacaucaagug

SEQ ID NO: 57404 - RNA, 24 nt, Artificial Sequence
  Synthetic Oligonucleotide; CD80 exon 5; Set C
aacaccagauugaauggagacauc

SEQ ID NO: 57405 - RNA, 26 nt, Artificial Sequence
  Synthetic Oligonucleotide; CD80 exon 5; Set C
aaacaccagauugaauggagacauca

SEQ ID NO: 57406 - RNA, 21 nt, Artificial Sequence
  Synthetic Oligonucleotide; CD80 exon 5; Set C
acaccagauugaauggagaca

SEQ ID NO: 57407 - RNA, 23 nt, Artificial Sequence
  Synthetic Oligonucleotide; CD80 exon 5; Set C
aacaccagauugaauggagacau

SEQ ID NO: 57408 - RNA, 20 nt, Artificial Sequence
  Synthetic Oligonucleotide; CD80 exon 5; Set C
acaccagauugaauggagac

SEQ ID NO: 57409 - RNA, 19 nt, Artificial Sequence
  Synthetic Oligonucleotide; CD80 exon 5; Set C
acaccagauugaauggaga

SEQ ID NO: 57410 - RNA, 19 nt, Artificial Sequence
  Synthetic Oligonucleotide; CD80 exon 5; Set C
aacaccagauugaauggag

SEQ ID NO: 57411 - RNA, 19 nt, Artificial Sequence
  Synthetic Oligonucleotide; CD80 exon 5; Set C
aaacaccagauugaaugga

SEQ ID NO: 57412 - RNA, 18 nt, Artificial Sequence
  Synthetic Oligonucleotide; CD80 exon 5; Set C
aaacaccagauugaaugg

SEQ ID NO: 57413 - RNA, 21 nt, Artificial Sequence
  Synthetic Oligonucleotide; CD80 exon 5; Set C
uaaaacaccagauugaaugga

SEQ ID NO: 57414 - RNA, 17 nt, Artificial Sequence
  Synthetic Oligonucleotide; CD80 exon 5; Set C
aaacaccagauugaaug

SEQ ID NO: 57415 - RNA, 22 nt, Artificial Sequence
  Synthetic Oligonucleotide; CD80 exon 5; Set C
cuaaaacaccagauugaaugga

SEQ ID NO: 57416 - RNA, 21 nt, Artificial Sequence
  Synthetic Oligonucleotide; CD80 exon 5; Set C
cuaaaacaccagauugaaugg

SEQ ID NO: 57417 - RNA, 23 nt, Artificial Sequence
  Synthetic Oligonucleotide; CD80 exon 5; Set C
ucuaaaacaccagauugaaugga

SEQ ID NO: 57418 - RNA, 19 nt, Artificial Sequence
  Synthetic Oligonucleotide; CD80 exon 5; Set C
uaaaacaccagauugaaug

SEQ ID NO: 57419 - RNA, 22 nt, Artificial Sequence
  Synthetic Oligonucleotide; CD80 exon 5; Set C
ucuaaaacaccagauugaaugg

SEQ ID NO: 57420 - RNA, 24 nt, Artificial Sequence
  Synthetic Oligonucleotide; CD80 exon 5; Set C
cucuaaaacaccagauugaaugga

SEQ ID NO: 57421 - RNA, 20 nt, Artificial Sequence
  Synthetic Oligonucleotide; CD80 exon 5; Set C
cuaaaacaccagauugaaug

SEQ ID NO: 57422 - RNA, 23 nt, Artificial Sequence
  Synthetic Oligonucleotide; CD80 exon 5; Set C
cucuaaaacaccagauugaaugg

SEQ ID NO: 57423 - RNA, 25 nt, Artificial Sequence
  Synthetic Oligonucleotide; CD80 exon 5; Set C
ucucuaaaacaccagauugaaugga

SEQ ID NO: 57424 - RNA, 21 nt, Artificial Sequence
  Synthetic Oligonucleotide; CD80 exon 5; Set C
ucuaaaacaccagauugaaug

SEQ ID NO: 57425 - RNA, 26 nt, Artificial Sequence
  Synthetic Oligonucleotide; CD80 exon 5; Set C
uucucuaaaacaccagauugaaugga

SEQ ID NO: 57426 - RNA, 22 nt, Artificial Sequence
  Synthetic Oligonucleotide; CD80 exon 5; Set C
cucuaaaacaccagauugaaug

SEQ ID NO: 57427 - RNA, 23 nt, Artificial Sequence
  Synthetic Oligonucleotide; CD80 exon 5; Set C
ucucuaaaacaccagauugaaug

SEQ ID NO: 57428 - RNA, 24 nt, Artificial Sequence
  Synthetic Oligonucleotide; CD80 exon 5; Set C
uucucuaaaacaccagauugaaug

SEQ ID NO: 57429 - RNA, 15 nt, Artificial Sequence
  Synthetic Oligonucleotide; CD80 exon 5; Set C
cucuaaaacaccaga

SEQ ID NO: 57430 - RNA, 16 nt, Artificial Sequence
  Synthetic Oligonucleotide; CD80 exon 5; Set C
ucucuaaaacaccaga

SEQ ID NO: 57431 - RNA, 17 nt, Artificial Sequence
  Synthetic Oligonucleotide; CD80 exon 5; Set C
uucucuaaaacaccaga

SEQ ID NO: 57432 - RNA, 15 nt, Artificial Sequence
  Synthetic Oligonucleotide; CD80 exon 5; Set C
ucucuaaaacaccag

SEQ ID NO: 57433 - RNA, 16 nt, Artificial Sequence
  Synthetic Oligonucleotide; CD80 exon 5; Set C
uucucuaaaacaccag

SEQ ID NO: 57434 - RNA, 36 nt, Artificial Sequence
  Synthetic Oligonucleotide; CD80 exon 5; Set A
uuuuucuuuuuucucuaaaacaccagauugaaugga

SEQ ID NO: 57435 - RNA, 35 nt, Artificial Sequence
  Synthetic Oligonucleotide; CD80 exon 5; Set C
uuuuucuuuuuucucuaaaacaccagauugaaugg

SEQ ID NO: 57436 - RNA, 17 nt, Artificial Sequence
  Synthetic Oligonucleotide; CD80 exon 5; Set C
uuucucuaaaacaccag

SEQ ID NO: 57437 - RNA, 37 nt, Artificial Sequence
  Synthetic Oligonucleotide; CD80 exon 5; Set A
guuuuucuuuuuucucuaaaacaccagauugaaugga

SEQ ID NO: 57438 - RNA, 36 nt, Artificial Sequence
  Synthetic Oligonucleotide; CD80 exon 5; Set A
guuuuucuuuuuucucuaaaacaccagauugaaugg

SEQ ID NO: 57439 - RNA, 38 nt, Artificial Sequence
  Synthetic Oligonucleotide; CD80 exon 5; Set A
gguuuuucuuuuuucucuaaaacaccagauugaaugga

SEQ ID NO: 57440 - RNA, 34 nt, Artificial Sequence
  Synthetic Oligonucleotide; CD80 exon 5; Set C
uuuuucuuuuuucucuaaaacaccagauugaaug

SEQ ID NO: 57441 - RNA, 37 nt, Artificial Sequence
  Synthetic Oligonucleotide; CD80 exon 5; Set A
gguuuuucuuuuuucucuaaaacaccagauugaaugg

SEQ ID NO: 57442 - RNA, 39 nt, Artificial Sequence
  Synthetic Oligonucleotide; CD80 exon 5; Set A
ugguuuuucuuuuuucucuaaaacaccagauugaaugga

SEQ ID NO: 57443 - RNA, 35 nt, Artificial Sequence
  Synthetic Oligonucleotide; CD80 exon 5; Set C
guuuuucuuuuuucucuaaaacaccagauugaaug

SEQ ID NO: 57444 - RNA, 38 nt, Artificial Sequence
  Synthetic Oligonucleotide; CD80 exon 5; Set A
ugguuuuucuuuuuucucuaaaacaccagauugaaugg

SEQ ID NO: 57445 - RNA, 40 nt, Artificial Sequence
  Synthetic Oligonucleotide; CD80 exon 5; Set A
uugguuuuucuuuuuucucuaaaacaccagauugaaugga

SEQ ID NO: 57446 - RNA, 36 nt, Artificial Sequence
  Synthetic Oligonucleotide; CD80 exon 5; Set A
gguuuuucuuuuuucucuaaaacaccagauugaaug

SEQ ID NO: 57447 - RNA, 39 nt, Artificial Sequence
  Synthetic Oligonucleotide; CD80 exon 5; Set A
uugguuuuucuuuuuucucuaaaacaccagauugaaugg

SEQ ID NO: 57448 - RNA, 37 nt, Artificial Sequence
  Synthetic Oligonucleotide; CD80 exon 5; Set A
ugguuuuucuuuuuucucuaaaacaccagauugaaug

SEQ ID NO: 57449 - RNA, 38 nt, Artificial Sequence
  Synthetic Oligonucleotide; CD80 exon 5; Set A
uugguuuuucuuuuuucucuaaaacaccagauugaaug

SEQ ID NO: 57450 - RNA, 15 nt, Artificial Sequence
  Synthetic Oligonucleotide; CD80 exon 5; Set C
uuuuucucuaaaaca

SEQ ID NO: 57451 - RNA, 32 nt, Artificial Sequence
  Synthetic Oligonucleotide; CD80 exon 5; Set C
gguuuuucuuuuuucucuaaaacaccagauug

SEQ ID NO: 57452 - RNA, 30 nt, Artificial Sequence
  Synthetic Oligonucleotide; CD80 exon 5; Set C
guuuuucuuuuuucucuaaaacaccagauu

SEQ ID NO: 57453 - RNA, 16 nt, Artificial Sequence
  Synthetic Oligonucleotide; CD80 exon 5; Set C
uuuuuucucuaaaaca

SEQ ID NO: 57454 - RNA, 31 nt, Artificial Sequence
  Synthetic Oligonucleotide; CD80 exon 5; Set C
gguuuuucuuuuuucucuaaaacaccagauu

SEQ ID NO: 57455 - RNA, 27 nt, Artificial Sequence
  Synthetic Oligonucleotide; CD80 exon 5; Set C
uuuuucuuuuuucucuaaaacaccaga

SEQ ID NO: 57456 - RNA, 17 nt, Artificial Sequence
  Synthetic Oligonucleotide; CD80 exon 5; Set C
cuuuuuucucuaaaaca

SEQ ID NO: 57457 - RNA, 32 nt, Artificial Sequence
  Synthetic Oligonucleotide; CD80 exon 5; Set C
ugguuuuucuuuuuucucuaaaacaccagauu

SEQ ID NO: 57458 - RNA, 28 nt, Artificial Sequence
  Synthetic Oligonucleotide; CD80 exon 5; Set C
guuuuucuuuuuucucuaaaacaccaga

SEQ ID NO: 57459 - RNA, 26 nt, Artificial Sequence
  Synthetic Oligonucleotide; CD80 exon 5; Set C
uuuuucuuuuuucucuaaaacaccag

SEQ ID NO: 57460 - RNA, 18 nt, Artificial Sequence
  Synthetic Oligonucleotide; CD80 exon 5; Set C
ucuuuuuucucuaaaaca

SEQ ID NO: 57461 - RNA, 29 nt, Artificial Sequence
  Synthetic Oligonucleotide; CD80 exon 5; Set C
gguuuuucuuuuuucucuaaaacaccaga

SEQ ID NO: 57462 - RNA, 27 nt, Artificial Sequence
  Synthetic Oligonucleotide; CD80 exon 5; Set C
guuuuucuuuuuucucuaaaacaccag

SEQ ID NO: 57463 - RNA, 19 nt, Artificial Sequence
  Synthetic Oligonucleotide; CD80 exon 5; Set C
uucuuuuuucucuaaaaca

SEQ ID NO: 57464 - RNA, 30 nt, Artificial Sequence
  Synthetic Oligonucleotide; CD80 exon 5; Set C
ugguuuuucuuuuuucucuaaaacaccaga

SEQ ID NO: 57465 - RNA, 20 nt, Artificial Sequence
  Synthetic Oligonucleotide; CD80 exon 5; Set C
uuucuuuuuucucuaaaaca

SEQ ID NO: 57466 - RNA, 31 nt, Artificial Sequence
  Synthetic Oligonucleotide; CD80 exon 5; Set C
uugguuuuucuuuuuucucuaaaacaccaga

SEQ ID NO: 57467 - RNA, 29 nt, Artificial Sequence
  Synthetic Oligonucleotide; CD80 exon 5; Set C
ugguuuuucuuuuuucucuaaaacaccag

SEQ ID NO: 57468 - RNA, 21 nt, Artificial Sequence
  Synthetic Oligonucleotide; CD80 exon 5; Set C
uuuucuuuuuucucuaaaaca

SEQ ID NO: 57469 - RNA, 30 nt, Artificial Sequence
  Synthetic Oligonucleotide; CD80 exon 5; Set C
uugguuuuucuuuuuucucuaaaacaccag

SEQ ID NO: 57470 - RNA, 21 nt, Artificial Sequence
  Synthetic Oligonucleotide; CD80 exon 5; Set C
uuuuucuuuuuucucuaaaac

SEQ ID NO: 57471 - RNA, 22 nt, Artificial Sequence
  Synthetic Oligonucleotide; CD80 exon 5; Set C
guuuuucuuuuuucucuaaaac

SEQ ID NO: 57472 - RNA, 23 nt, Artificial Sequence
  Synthetic Oligonucleotide; CD80 exon 5; Set C
gguuuuucuuuuuucucuaaaac

SEQ ID NO: 57473 - RNA, 22 nt, Artificial Sequence
  Synthetic Oligonucleotide; CD80 exon 5; Set C
gguuuuucuuuuuucucuaaaa

SEQ ID NO: 57474 - RNA, 24 nt, Artificial Sequence
  Synthetic Oligonucleotide; CD80 exon 5; Set C
ugguuuuucuuuuuucucuaaaac

SEQ ID NO: 57475 - RNA, 26 nt, Artificial Sequence
  Synthetic Oligonucleotide; CD80 exon 5; Set C
uugguuuuucuuuuuucucuaaaaca

SEQ ID NO: 57476 - RNA, 27 nt, Artificial Sequence
  Synthetic Oligonucleotide; CD80 exon 5; Set C
guugguuuuucuuuuuucucuaaaaca

SEQ ID NO: 57477 - RNA, 28 nt, Artificial Sequence
  Synthetic Oligonucleotide; CD80 exon 5; Set C
aguugguuuuucuuuuuucucuaaaaca

SEQ ID NO: 57478 - RNA, 29 nt, Artificial Sequence
  Synthetic Oligonucleotide; CD80 exon 5; Set C
uaguugguuuuucuuuuuucucuaaaaca

SEQ ID NO: 57479 - RNA, 33 nt, Artificial Sequence
  Synthetic Oligonucleotide; CD80 exon 5; Set C
aggauaguugguuuuucuuuuuucucuaaaaca

SEQ ID NO: 57480 - RNA, 34 nt, Artificial Sequence
  Synthetic Oligonucleotide; CD80 exon 5; Set A
caggauaguugguuuuucuuuuuucucuaaaaca

SEQ ID NO: 57481 - RNA, 35 nt, Artificial Sequence
  Synthetic Oligonucleotide; CD80 exon 5; Set A
acaggauaguugguuuuucuuuuuucucuaaaaca

SEQ ID NO: 57482 - RNA, 36 nt, Artificial Sequence
  Synthetic Oligonucleotide; CD80 exon 5; Set A
gacaggauaguugguuuuucuuuuuucucuaaaaca

SEQ ID NO: 57483 - RNA, 37 nt, Artificial Sequence
  Synthetic Oligonucleotide; CD80 exon 5; Set A
agacaggauaguugguuuuucuuuuuucucuaaaaca

SEQ ID NO: 57484 - RNA, 38 nt, Artificial Sequence
  Synthetic Oligonucleotide; CD80 exon 5; Set A
aagacaggauaguugguuuuucuuuuuucucuaaaaca

SEQ ID NO: 57485 - RNA, 39 nt, Artificial Sequence
  Synthetic Oligonucleotide; CD80 exon 5; Set A
aaagacaggauaguugguuuuucuuuuuucucuaaaaca

SEQ ID NO: 57486 - RNA, 40 nt, Artificial Sequence
  Synthetic Oligonucleotide; CD80 exon 5; Set A
uaaagacaggauaguugguuuuucuuuuuucucuaaaaca

SEQ ID NO: 57487 - RNA, 40 nt, Artificial Sequence
  Synthetic Oligonucleotide; CD80 exon 5; Set A
ccuaccacuuaaagacaggauaguugguuuuucuuuuuuc

SEQ ID NO: 57488 - RNA, 39 nt, Artificial Sequence
  Synthetic Oligonucleotide; CD80 exon 5; Set A
ccuaccacuuaaagacaggauaguugguuuuucuuuuuu

SEQ ID NO: 57489 - RNA, 38 nt, Artificial Sequence
  Synthetic Oligonucleotide; CD80 exon 5; Set A
ccuaccacuuaaagacaggauaguugguuuuucuuuuu

SEQ ID NO: 57490 - RNA, 37 nt, Artificial Sequence
  Synthetic Oligonucleotide; CD80 exon 5; Set A
ccuaccacuuaaagacaggauaguugguuuuucuuuu

SEQ ID NO: 57491 - RNA, 40 nt, Artificial Sequence
  Synthetic Oligonucleotide; CD80 exon 5; Set C
uaccuaccacuuaaagacaggauaguugguuuuucuuuuu

SEQ ID NO: 57492 - RNA, 36 nt, Artificial Sequence
  Synthetic Oligonucleotide; CD80 exon 5; Set A
ccuaccacuuaaagacaggauaguugguuuuucuuu

SEQ ID NO: 57493 - RNA, 39 nt, Artificial Sequence
  Synthetic Oligonucleotide; CD80 exon 5; Set C
uaccuaccacuuaaagacaggauaguugguuuuucuuuu

SEQ ID NO: 57494 - RNA, 35 nt, Artificial Sequence
  Synthetic Oligonucleotide; CD80 exon 5; Set A
ccuaccacuuaaagacaggauaguugguuuuucuu

SEQ ID NO: 57495 - RNA, 40 nt, Artificial Sequence
  Synthetic Oligonucleotide; CD80 exon 5; Set C
guaccuaccacuuaaagacaggauaguugguuuuucuuuu

SEQ ID NO: 57496 - RNA, 38 nt, Artificial Sequence
  Synthetic Oligonucleotide; CD80 exon 5; Set C
uaccuaccacuuaaagacaggauaguugguuuuucuuu

SEQ ID NO: 57497 - RNA, 34 nt, Artificial Sequence
  Synthetic Oligonucleotide; CD80 exon 5; Set A
ccuaccacuuaaagacaggauaguugguuuuucu

SEQ ID NO: 57498 - RNA, 39 nt, Artificial Sequence
  Synthetic Oligonucleotide; CD80 exon 5; Set C
guaccuaccacuuaaagacaggauaguugguuuuucuuu

SEQ ID NO: 57499 - RNA, 33 nt, Artificial Sequence
  Synthetic Oligonucleotide; CD80 exon 5; Set A
ccuaccacuuaaagacaggauaguugguuuuuc

SEQ ID NO: 57500 - RNA, 37 nt, Artificial Sequence
  Synthetic Oligonucleotide; CD80 exon 5; Set C
uaccuaccacuuaaagacaggauaguugguuuuucuu

SEQ ID NO: 57501 - RNA, 32 nt, Artificial Sequence
  Synthetic Oligonucleotide; CD80 exon 5; Set A
ccuaccacuuaaagacaggauaguugguuuuu

SEQ ID NO: 57502 - RNA, 40 nt, Artificial Sequence
  Synthetic Oligonucleotide; CD80 exon 5; Set C
uguaccuaccacuuaaagacaggauaguugguuuuucuuu

SEQ ID NO: 57503 - RNA, 38 nt, Artificial Sequence
  Synthetic Oligonucleotide; CD80 exon 5; Set C
guaccuaccacuuaaagacaggauaguugguuuuucuu

SEQ ID NO: 57504 - RNA, 36 nt, Artificial Sequence
  Synthetic Oligonucleotide; CD80 exon 5; Set A
uaccuaccacuuaaagacaggauaguugguuuuucu

SEQ ID NO: 57505 - RNA, 31 nt, Artificial Sequence
  Synthetic Oligonucleotide; CD80 exon 5; Set A
ccuaccacuuaaagacaggauaguugguuuu

SEQ ID NO: 57506 - RNA, 39 nt, Artificial Sequence
  Synthetic Oligonucleotide; CD80 exon 5; Set C
uguaccuaccacuuaaagacaggauaguugguuuuucuu

SEQ ID NO: 57507 - RNA, 37 nt, Artificial Sequence
  Synthetic Oligonucleotide; CD80 exon 5; Set C
guaccuaccacuuaaagacaggauaguugguuuuucu

SEQ ID NO: 57508 - RNA, 35 nt, Artificial Sequence
  Synthetic Oligonucleotide; CD80 exon 5; Set A
uaccuaccacuuaaagacaggauaguugguuuuuc

SEQ ID NO: 57509 - RNA, 34 nt, Artificial Sequence
  Synthetic Oligonucleotide; CD80 exon 5; Set A
uaccuaccacuuaaagacaggauaguugguuuuu

SEQ ID NO: 57510 - RNA, 38 nt, Artificial Sequence
  Synthetic Oligonucleotide; CD80 exon 5; Set C
uguaccuaccacuuaaagacaggauaguugguuuuucu

SEQ ID NO: 57511 - RNA, 36 nt, Artificial Sequence
  Synthetic Oligonucleotide; CD80 exon 5; Set C
guaccuaccacuuaaagacaggauaguugguuuuuc

SEQ ID NO: 57512 - RNA, 33 nt, Artificial Sequence
  Synthetic Oligonucleotide; CD80 exon 5; Set A
uaccuaccacuuaaagacaggauaguugguuuu

SEQ ID NO: 57513 - RNA, 35 nt, Artificial Sequence
  Synthetic Oligonucleotide; CD80 exon 5; Set A
guaccuaccacuuaaagacaggauaguugguuuuu

SEQ ID NO: 57514 - RNA, 37 nt, Artificial Sequence
  Synthetic Oligonucleotide; CD80 exon 5; Set C
uguaccuaccacuuaaagacaggauaguugguuuuuc

SEQ ID NO: 57515 - RNA, 34 nt, Artificial Sequence
  Synthetic Oligonucleotide; CD80 exon 5; Set A
guaccuaccacuuaaagacaggauaguugguuuu

SEQ ID NO: 57516 - RNA, 36 nt, Artificial Sequence
  Synthetic Oligonucleotide; CD80 exon 5; Set C
uguaccuaccacuuaaagacaggauaguugguuuuu

SEQ ID NO: 57517 - RNA, 35 nt, Artificial Sequence
  Synthetic Oligonucleotide; CD80 exon 5; Set C
uguaccuaccacuuaaagacaggauaguugguuuu

SEQ ID NO: 57518 - RNA, 25 nt, Artificial Sequence
  Synthetic Oligonucleotide; CD80 exon 5; Set C
ccuaccacuuaaagacaggauaguu

SEQ ID NO: 57519 - RNA, 24 nt, Artificial Sequence
  Synthetic Oligonucleotide; CD80 exon 5; Set C
ccuaccacuuaaagacaggauagu

SEQ ID NO: 57520 - RNA, 27 nt, Artificial Sequence
  Synthetic Oligonucleotide; CD80 exon 5; Set A
uaccuaccacuuaaagacaggauaguu

SEQ ID NO: 57521 - RNA, 28 nt, Artificial Sequence
  Synthetic Oligonucleotide; CD80 exon 5; Set A
guaccuaccacuuaaagacaggauaguu

SEQ ID NO: 57522 - RNA, 40 nt, Artificial Sequence
  Synthetic Oligonucleotide; CD80 exon 5; Set C
cauaguguaccuaccacuuaaagacaggauaguugguuuu

SEQ ID NO: 57523 - RNA, 29 nt, Artificial Sequence
  Synthetic Oligonucleotide; CD80 exon 5; Set A
uguaccuaccacuuaaagacaggauaguu

SEQ ID NO: 57524 - RNA, 27 nt, Artificial Sequence
  Synthetic Oligonucleotide; CD80 exon 5; Set A
guaccuaccacuuaaagacaggauagu

SEQ ID NO: 57525 - RNA, 28 nt, Artificial Sequence
  Synthetic Oligonucleotide; CD80 exon 5; Set A
uguaccuaccacuuaaagacaggauagu

SEQ ID NO: 57526 - RNA, 19 nt, Artificial Sequence
  Synthetic Oligonucleotide; CD80 exon 5; Set C
ccuaccacuuaaagacagg

SEQ ID NO: 57527 - RNA, 27 nt, Artificial Sequence
  Synthetic Oligonucleotide; CD80 exon 5; Set A
uguaccuaccacuuaaagacaggauag

SEQ ID NO: 57528 - RNA, 18 nt, Artificial Sequence
  Synthetic Oligonucleotide; CD80 exon 5; Set C
ccuaccacuuaaagacag

SEQ ID NO: 57529 - RNA, 38 nt, Artificial Sequence
  Synthetic Oligonucleotide; CD80 exon 5; Set C
ucauaguguaccuaccacuuaaagacaggauaguuggu

SEQ ID NO: 57530 - RNA, 37 nt, Artificial Sequence
  Synthetic Oligonucleotide; CD80 exon 5; Set C
ucauaguguaccuaccacuuaaagacaggauaguugg

SEQ ID NO: 57531 - RNA, 16 nt, Artificial Sequence
  Synthetic Oligonucleotide; CD80 exon 5; Set C
ccuaccacuuaaagac

SEQ ID NO: 57532 - RNA, 34 nt, Artificial Sequence
  Synthetic Oligonucleotide; CD80 exon 5; Set A
cauaguguaccuaccacuuaaagacaggauaguu

SEQ ID NO: 57533 - RNA, 22 nt, Artificial Sequence
  Synthetic Oligonucleotide; CD80 exon 5; Set C
guaccuaccacuuaaagacagg

SEQ ID NO: 57534 - RNA, 33 nt, Artificial Sequence
  Synthetic Oligonucleotide; CD80 exon 5; Set A
cauaguguaccuaccacuuaaagacaggauagu

SEQ ID NO: 57535 - RNA, 23 nt, Artificial Sequence
  Synthetic Oligonucleotide; CD80 exon 5; Set C
uguaccuaccacuuaaagacagg

SEQ ID NO: 57536 - RNA, 22 nt, Artificial Sequence
  Synthetic Oligonucleotide; CD80 exon 5; Set C
uguaccuaccacuuaaagacag

SEQ ID NO: 57537 - RNA, 32 nt, Artificial Sequence
  Synthetic Oligonucleotide; CD80 exon 5; Set A
cauaguguaccuaccacuuaaagacaggauag

SEQ ID NO: 57538 - RNA, 19 nt, Artificial Sequence
  Synthetic Oligonucleotide; CD80 exon 5; Set C
guaccuaccacuuaaagac

SEQ ID NO: 57539 - RNA, 21 nt, Artificial Sequence
  Synthetic Oligonucleotide; CD80 exon 5; Set C
uguaccuaccacuuaaagaca

SEQ ID NO: 57540 - RNA, 20 nt, Artificial Sequence
  Synthetic Oligonucleotide; CD80 exon 5; Set C
uguaccuaccacuuaaagac

SEQ ID NO: 57541 - RNA, 19 nt, Artificial Sequence
  Synthetic Oligonucleotide; CD80 exon 5; Set C
uguaccuaccacuuaaaga

SEQ ID NO: 57542 - RNA, 18 nt, Artificial Sequence
  Synthetic Oligonucleotide; CD80 exon 5; Set C
uguaccuaccacuuaaag

SEQ ID NO: 57543 - RNA, 28 nt, Artificial Sequence
  Synthetic Oligonucleotide; CD80 exon 5; Set A
cauaguguaccuaccacuuaaagacagg

SEQ ID NO: 57544 - RNA, 17 nt, Artificial Sequence
  Synthetic Oligonucleotide; CD80 exon 5; Set C
uguaccuaccacuuaaa

SEQ ID NO: 57545 - RNA, 27 nt, Artificial Sequence
  Synthetic Oligonucleotide; CD80 exon 5; Set A
cauaguguaccuaccacuuaaagacag

SEQ ID NO: 57546 - RNA, 16 nt, Artificial Sequence
  Synthetic Oligonucleotide; CD80 exon 5; Set C
uguaccuaccacuuaa

SEQ ID NO: 57547 - RNA, 26 nt, Artificial Sequence
  Synthetic Oligonucleotide; CD80 exon 5; Set B
cauaguguaccuaccacuuaaagaca

SEQ ID NO: 57548 - RNA, 25 nt, Artificial Sequence
  Synthetic Oligonucleotide; CD80 exon 5; Set C
cauaguguaccuaccacuuaaagac

SEQ ID NO: 57549 - RNA, 24 nt, Artificial Sequence
  Synthetic Oligonucleotide; CD80 exon 5; Set C
cauaguguaccuaccacuuaaaga

SEQ ID NO: 57550 - RNA, 23 nt, Artificial Sequence
  Synthetic Oligonucleotide; CD80 exon 5; Set C
cauaguguaccuaccacuuaaag

SEQ ID NO: 57551 - RNA, 22 nt, Artificial Sequence
  Synthetic Oligonucleotide; CD80 exon 5; Set C
cauaguguaccuaccacuuaaa

SEQ ID NO: 57552 - RNA, 21 nt, Artificial Sequence
  Synthetic Oligonucleotide; CD80 exon 5; Set C
cauaguguaccuaccacuuaa

SEQ ID NO: 57553 - RNA, 15 nt, Artificial Sequence
  Synthetic Oligonucleotide; CD80 exon 5; Set C
aaucauaguguaccu

SEQ ID NO: 57554 - RNA, 16 nt, Artificial Sequence
  Synthetic Oligonucleotide; CD80 exon 5; Set C
uaaucauaguguaccu

SEQ ID NO: 57555 - RNA, 17 nt, Artificial Sequence
  Synthetic Oligonucleotide; CD80 exon 5; Set C
uuaaucauaguguaccu

SEQ ID NO: 57556 - RNA, 15 nt, Artificial Sequence
  Synthetic Oligonucleotide; CD80 exon 5; Set C
uuaaucauaguguac

SEQ ID NO: 57557 - RNA, 16 nt, Artificial Sequence
  Synthetic Oligonucleotide; CD80 exon 5; Set C
acaccuauuuaaucau

SEQ ID NO: 57558 - RNA, 17 nt, Artificial Sequence
  Synthetic Oligonucleotide; CD80 exon 5; Set C
aacaccuauuuaaucau

SEQ ID NO: 57559 - RNA, 24 nt, Artificial Sequence
  Synthetic Oligonucleotide; CD80 exon 5; Set A
aacaagccauugcuguuauccugg

SEQ ID NO: 57560 - RNA, 23 nt, Artificial Sequence
  Synthetic Oligonucleotide; CD80 exon 5; Set C
aacaagccauugcuguuauccug

SEQ ID NO: 57561 - RNA, 25 nt, Artificial Sequence
  Synthetic Oligonucleotide; CD80 exon 5; Set A
uaacaagccauugcuguuauccugg

SEQ ID NO: 57562 - RNA, 24 nt, Artificial Sequence
  Synthetic Oligonucleotide; CD80 exon 5; Set C
uaacaagccauugcuguuauccug

SEQ ID NO: 57563 - RNA, 26 nt, Artificial Sequence
  Synthetic Oligonucleotide; CD80 exon 5; Set A
auaacaagccauugcuguuauccugg

SEQ ID NO: 57564 - RNA, 25 nt, Artificial Sequence
  Synthetic Oligonucleotide; CD80 exon 5; Set C
auaacaagccauugcuguuauccug

SEQ ID NO: 57565 - RNA, 24 nt, Artificial Sequence
  Synthetic Oligonucleotide; CD80 exon 5; Set C
auaacaagccauugcuguuauccu

SEQ ID NO: 57566 - RNA, 24 nt, Artificial Sequence
  Synthetic Oligonucleotide; CD80 exon 5; Set C
aauaacaagccauugcuguuaucc

SEQ ID NO: 57567 - RNA, 25 nt, Artificial Sequence
  Synthetic Oligonucleotide; CD80 exon 5; Set C
aaauaacaagccauugcuguuaucc

SEQ ID NO: 57568 - RNA, 22 nt, Artificial Sequence
  Synthetic Oligonucleotide; CD80 exon 5; Set C
aauaacaagccauugcuguuau

SEQ ID NO: 57569 - RNA, 24 nt, Artificial Sequence
  Synthetic Oligonucleotide; CD80 exon 5; Set C
aaauaacaagccauugcuguuauc

SEQ ID NO: 57570 - RNA, 19 nt, Artificial Sequence
  Synthetic Oligonucleotide; CD80 exon 5; Set C
auaacaagccauugcuguu

SEQ ID NO: 57571 - RNA, 21 nt, Artificial Sequence
  Synthetic Oligonucleotide; CD80 exon 5; Set C
aauaacaagccauugcuguua

SEQ ID NO: 57572 - RNA, 25 nt, Artificial Sequence
  Synthetic Oligonucleotide; CD80 exon 5; Set C
aaaauaacaagccauugcuguuauc

SEQ ID NO: 57573 - RNA, 26 nt, Artificial Sequence
  Synthetic Oligonucleotide; CD80 exon 5; Set C
aaaaauaacaagccauugcuguuauc

SEQ ID NO: 57574 - RNA, 35 nt, Artificial Sequence
  Synthetic Oligonucleotide; CD80 exon 5; Set A
acacaaaaaauaacaagccauugcuguuauccugg

SEQ ID NO: 57575 - RNA, 19 nt, Artificial Sequence
  Synthetic Oligonucleotide; CD80 exon 5; Set C
aauaacaagccauugcugu

SEQ ID NO: 57576 - RNA, 27 nt, Artificial Sequence
  Synthetic Oligonucleotide; CD80 exon 5; Set C
aaaaaauaacaagccauugcuguuauc

SEQ ID NO: 57577 - RNA, 34 nt, Artificial Sequence
  Synthetic Oligonucleotide; CD80 exon 5; Set A
acacaaaaaauaacaagccauugcuguuauccug

SEQ ID NO: 57578 - RNA, 36 nt, Artificial Sequence
  Synthetic Oligonucleotide; CD80 exon 5; Set A
gacacaaaaaauaacaagccauugcuguuauccugg

SEQ ID NO: 57579 - RNA, 28 nt, Artificial Sequence
  Synthetic Oligonucleotide; CD80 exon 5; Set C
caaaaaauaacaagccauugcuguuauc

SEQ ID NO: 57580 - RNA, 35 nt, Artificial Sequence
  Synthetic Oligonucleotide; CD80 exon 5; Set A
gacacaaaaaauaacaagccauugcuguuauccug

SEQ ID NO: 57581 - RNA, 37 nt, Artificial Sequence
  Synthetic Oligonucleotide; CD80 exon 5; Set A
ugacacaaaaaauaacaagccauugcuguuauccugg

SEQ ID NO: 57582 - RNA, 33 nt, Artificial Sequence
  Synthetic Oligonucleotide; CD80 exon 5; Set A
acacaaaaaauaacaagccauugcuguuauccu

SEQ ID NO: 57583 - RNA, 19 nt, Artificial Sequence
  Synthetic Oligonucleotide; CD80 exon 5; Set C
aaauaacaagccauugcug

SEQ ID NO: 57584 - RNA, 29 nt, Artificial Sequence
  Synthetic Oligonucleotide; CD80 exon 5; Set C
acaaaaaauaacaagccauugcuguuauc

SEQ ID NO: 57585 - RNA, 36 nt, Artificial Sequence
  Synthetic Oligonucleotide; CD80 exon 5; Set A
ugacacaaaaaauaacaagccauugcuguuauccug

SEQ ID NO: 57586 - RNA, 34 nt, Artificial Sequence
  Synthetic Oligonucleotide; CD80 exon 5; Set A
gacacaaaaaauaacaagccauugcuguuauccu

SEQ ID NO: 57587 - RNA, 20 nt, Artificial Sequence
  Synthetic Oligonucleotide; CD80 exon 5; Set C
aaaauaacaagccauugcug

SEQ ID NO: 57588 - RNA, 18 nt, Artificial Sequence
  Synthetic Oligonucleotide; CD80 exon 5; Set C
aaauaacaagccauugcu

SEQ ID NO: 57589 - RNA, 30 nt, Artificial Sequence
  Synthetic Oligonucleotide; CD80 exon 5; Set C
cacaaaaaauaacaagccauugcuguuauc

SEQ ID NO: 57590 - RNA, 35 nt, Artificial Sequence
  Synthetic Oligonucleotide; CD80 exon 5; Set A
ugacacaaaaaauaacaagccauugcuguuauccu

SEQ ID NO: 57591 - RNA, 17 nt, Artificial Sequence
  Synthetic Oligonucleotide; CD80 exon 5; Set C
aaauaacaagccauugc

SEQ ID NO: 57592 - RNA, 21 nt, Artificial Sequence
  Synthetic Oligonucleotide; CD80 exon 5; Set C
aaaaauaacaagccauugcug

SEQ ID NO: 57593 - RNA, 19 nt, Artificial Sequence
  Synthetic Oligonucleotide; CD80 exon 5; Set C
aaaauaacaagccauugcu

SEQ ID NO: 57594 - RNA, 18 nt, Artificial Sequence
  Synthetic Oligonucleotide; CD80 exon 5; Set C
aaaauaacaagccauugc

SEQ ID NO: 57595 - RNA, 22 nt, Artificial Sequence
  Synthetic Oligonucleotide; CD80 exon 5; Set C
aaaaaauaacaagccauugcug

SEQ ID NO: 57596 - RNA, 20 nt, Artificial Sequence
  Synthetic Oligonucleotide; CD80 exon 5; Set C
aaaaauaacaagccauugcu

SEQ ID NO: 57597 - RNA, 19 nt, Artificial Sequence
  Synthetic Oligonucleotide; CD80 exon 5; Set C
aaaaauaacaagccauugc

SEQ ID NO: 57598 - RNA, 23 nt, Artificial Sequence
  Synthetic Oligonucleotide; CD80 exon 5; Set C
caaaaaauaacaagccauugcug

SEQ ID NO: 57599 - RNA, 21 nt, Artificial Sequence
  Synthetic Oligonucleotide; CD80 exon 5; Set C
aaaaaauaacaagccauugcu

SEQ ID NO: 57600 - RNA, 28 nt, Artificial Sequence
  Synthetic Oligonucleotide; CD80 exon 5; Set C
acacaaaaaauaacaagccauugcuguu

SEQ ID NO: 57601 - RNA, 20 nt, Artificial Sequence
  Synthetic Oligonucleotide; CD80 exon 5; Set C
aaaaaauaacaagccauugc

SEQ ID NO: 57602 - RNA, 24 nt, Artificial Sequence
  Synthetic Oligonucleotide; CD80 exon 5; Set C
acaaaaaauaacaagccauugcug

SEQ ID NO: 57603 - RNA, 22 nt, Artificial Sequence
  Synthetic Oligonucleotide; CD80 exon 5; Set C
caaaaaauaacaagccauugcu

SEQ ID NO: 57604 - RNA, 34 nt, Artificial Sequence
  Synthetic Oligonucleotide; CD80 exon 5; Set A
augacacaaaaaauaacaagccauugcuguuauc

SEQ ID NO: 57605 - RNA, 29 nt, Artificial Sequence
  Synthetic Oligonucleotide; CD80 exon 5; Set C
gacacaaaaaauaacaagccauugcuguu

SEQ ID NO: 57606 - RNA, 21 nt, Artificial Sequence
  Synthetic Oligonucleotide; CD80 exon 5; Set C
caaaaaauaacaagccauugc

SEQ ID NO: 57607 - RNA, 25 nt, Artificial Sequence
  Synthetic Oligonucleotide; CD80 exon 5; Set C
cacaaaaaauaacaagccauugcug

SEQ ID NO: 57608 - RNA, 23 nt, Artificial Sequence
  Synthetic Oligonucleotide; CD80 exon 5; Set C
acaaaaaauaacaagccauugcu

SEQ ID NO: 57609 - RNA, 30 nt, Artificial Sequence
  Synthetic Oligonucleotide; CD80 exon 5; Set C
ugacacaaaaaauaacaagccauugcuguu

SEQ ID NO: 57610 - RNA, 22 nt, Artificial Sequence
  Synthetic Oligonucleotide; CD80 exon 5; Set C
acaaaaaauaacaagccauugc

SEQ ID NO: 57611 - RNA, 24 nt, Artificial Sequence
  Synthetic Oligonucleotide; CD80 exon 5; Set C
cacaaaaaauaacaagccauugcu

SEQ ID NO: 57612 - RNA, 23 nt, Artificial Sequence
  Synthetic Oligonucleotide; CD80 exon 5; Set C
cacaaaaaauaacaagccauugc

SEQ ID NO: 57613 - RNA, 23 nt, Artificial Sequence
  Synthetic Oligonucleotide; CD80 exon 5; Set C
acacaaaaaauaacaagccauug

SEQ ID NO: 57614 - RNA, 24 nt, Artificial Sequence
  Synthetic Oligonucleotide; CD80 exon 5; Set C
gacacaaaaaauaacaagccauug

SEQ ID NO: 57615 - RNA, 28 nt, Artificial Sequence
  Synthetic Oligonucleotide; CD80 exon 5; Set C
augacacaaaaaauaacaagccauugcu

SEQ ID NO: 57616 - RNA, 25 nt, Artificial Sequence
  Synthetic Oligonucleotide; CD80 exon 5; Set C
ugacacaaaaaauaacaagccauug

SEQ ID NO: 57617 - RNA, 21 nt, Artificial Sequence
  Synthetic Oligonucleotide; CD80 exon 5; Set C
acacaaaaaauaacaagccau

SEQ ID NO: 57618 - RNA, 27 nt, Artificial Sequence
  Synthetic Oligonucleotide; CD80 exon 5; Set C
augacacaaaaaauaacaagccauugc

SEQ ID NO: 57619 - RNA, 22 nt, Artificial Sequence
  Synthetic Oligonucleotide; CD80 exon 5; Set C
gacacaaaaaauaacaagccau

SEQ ID NO: 57620 - RNA, 23 nt, Artificial Sequence
  Synthetic Oligonucleotide; CD80 exon 5; Set C
ugacacaaaaaauaacaagccau

SEQ ID NO: 57621 - RNA, 22 nt, Artificial Sequence
  Synthetic Oligonucleotide; CD80 exon 5; Set C
acagauuagaaugacacaaaaa

SEQ ID NO: 57622 - RNA, 21 nt, Artificial Sequence
  Synthetic Oligonucleotide; CD80 exon 5; Set C
acagauuagaaugacacaaaa

SEQ ID NO: 57623 - RNA, 20 nt, Artificial Sequence
  Synthetic Oligonucleotide; CD80 exon 5; Set C
acagauuagaaugacacaaa

SEQ ID NO: 57624 - RNA, 19 nt, Artificial Sequence
  Synthetic Oligonucleotide; CD80 exon 5; Set C
acagauuagaaugacacaa

SEQ ID NO: 57625 - RNA, 18 nt, Artificial Sequence
  Synthetic Oligonucleotide; CD80 exon 5; Set C
acagauuagaaugacaca

SEQ ID NO: 57626 - RNA, 37 nt, Artificial Sequence
  Synthetic Oligonucleotide; CD80 exon 5; Set A
guugaccucuacagauuagaaugacacaaaaaauaac

SEQ ID NO: 57627 - RNA, 36 nt, Artificial Sequence
  Synthetic Oligonucleotide; CD80 exon 5; Set A
guugaccucuacagauuagaaugacacaaaaaauaa

SEQ ID NO: 57628 - RNA, 35 nt, Artificial Sequence
  Synthetic Oligonucleotide; CD80 exon 5; Set A
guugaccucuacagauuagaaugacacaaaaaaua

SEQ ID NO: 57629 - RNA, 26 nt, Artificial Sequence
  Synthetic Oligonucleotide; CD80 exon 5; Set A
guugaccucuacagauuagaaugaca

SEQ ID NO: 57630 - RNA, 25 nt, Artificial Sequence
  Synthetic Oligonucleotide; CD80 exon 5; Set C
guugaccucuacagauuagaaugac

SEQ ID NO: 57631 - RNA, 24 nt, Artificial Sequence
  Synthetic Oligonucleotide; CD80 exon 5; Set C
guugaccucuacagauuagaauga

SEQ ID NO: 57632 - RNA, 36 nt, Artificial Sequence
  Synthetic Oligonucleotide; CD80 exon 5; Set C
gauuaccagaguugaccucuacagauuagaaugaca

SEQ ID NO: 57633 - RNA, 35 nt, Artificial Sequence
  Synthetic Oligonucleotide; CD80 exon 5; Set A
gauuaccagaguugaccucuacagauuagaaugac

SEQ ID NO: 57634 - RNA, 34 nt, Artificial Sequence
  Synthetic Oligonucleotide; CD80 exon 5; Set A
gauuaccagaguugaccucuacagauuagaauga

SEQ ID NO: 57635 - RNA, 40 nt, Artificial Sequence
  Synthetic Oligonucleotide; CD80 exon 5; Set C
aagugauuaccagaguugaccucuacagauuagaaugaca

SEQ ID NO: 57636 - RNA, 39 nt, Artificial Sequence
  Synthetic Oligonucleotide; CD80 exon 5; Set C
aagugauuaccagaguugaccucuacagauuagaaugac

SEQ ID NO: 57637 - RNA, 38 nt, Artificial Sequence
  Synthetic Oligonucleotide; CD80 exon 5; Set A
aagugauuaccagaguugaccucuacagauuagaauga

SEQ ID NO: 57638 - RNA, 15 nt, Artificial Sequence
  Synthetic Oligonucleotide; CD80 exon 5; Set C
gugauuaccagaguu

SEQ ID NO: 57639 - RNA, 16 nt, Artificial Sequence
  Synthetic Oligonucleotide; CD80 exon 5; Set C
agugauuaccagaguu

SEQ ID NO: 57640 - RNA, 18 nt, Artificial Sequence
  Synthetic Oligonucleotide; CD80 exon 5; Set C
caagugauuaccagaguu

SEQ ID NO: 57641 - RNA, 19 nt, Artificial Sequence
  Synthetic Oligonucleotide; CD80 exon 5; Set C
ucaagugauuaccagaguu

SEQ ID NO: 57642 - RNA, 26 nt, Artificial Sequence
  Synthetic Oligonucleotide; CD80 exon 5; Set A
ggagacaucaagugauuaccagaguu

SEQ ID NO: 57643 - RNA, 27 nt, Artificial Sequence
  Synthetic Oligonucleotide; CD80 exon 5; Set A
uggagacaucaagugauuaccagaguu

SEQ ID NO: 57644 - RNA, 28 nt, Artificial Sequence
  Synthetic Oligonucleotide; CD80 exon 5; Set A
auggagacaucaagugauuaccagaguu

SEQ ID NO: 57645 - RNA, 35 nt, Artificial Sequence
  Synthetic Oligonucleotide; CD80 exon 5; Set A
agauugaauggagacaucaagugauuaccagaguu

SEQ ID NO: 57646 - RNA, 36 nt, Artificial Sequence
  Synthetic Oligonucleotide; CD80 exon 5; Set A
cagauugaauggagacaucaagugauuaccagaguu

SEQ ID NO: 57647 - RNA, 15 nt, Artificial Sequence
  Synthetic Oligonucleotide; CD80 exon 5; Set C
ggagacaucaaguga

SEQ ID NO: 57648 - RNA, 16 nt, Artificial Sequence
  Synthetic Oligonucleotide; CD80 exon 5; Set C
uggagacaucaaguga

SEQ ID NO: 57649 - RNA, 17 nt, Artificial Sequence
  Synthetic Oligonucleotide; CD80 exon 5; Set C
auggagacaucaaguga

SEQ ID NO: 57650 - RNA, 15 nt, Artificial Sequence
  Synthetic Oligonucleotide; CD80 exon 5; Set C
uggagacaucaagug

SEQ ID NO: 57651 - RNA, 40 nt, Artificial Sequence
  Synthetic Oligonucleotide; CD80 exon 5; Set C
acaccagauugaauggagacaucaagugauuaccagaguu

SEQ ID NO: 57652 - RNA, 16 nt, Artificial Sequence
  Synthetic Oligonucleotide; CD80 exon 5; Set C
auggagacaucaagug

SEQ ID NO: 57653 - RNA, 15 nt, Artificial Sequence
  Synthetic Oligonucleotide; CD80 exon 5; Set C
auggagacaucaagu

SEQ ID NO: 57654 - RNA, 24 nt, Artificial Sequence
  Synthetic Oligonucleotide; CD80 exon 5; Set C
agauugaauggagacaucaaguga

SEQ ID NO: 57655 - RNA, 25 nt, Artificial Sequence
  Synthetic Oligonucleotide; CD80 exon 5; Set C
cagauugaauggagacaucaaguga

SEQ ID NO: 57656 - RNA, 23 nt, Artificial Sequence
  Synthetic Oligonucleotide; CD80 exon 5; Set C
agauugaauggagacaucaagug

SEQ ID NO: 57657 - RNA, 22 nt, Artificial Sequence
  Synthetic Oligonucleotide; CD80 exon 5; Set C
agauugaauggagacaucaagu

SEQ ID NO: 57658 - RNA, 24 nt, Artificial Sequence
  Synthetic Oligonucleotide; CD80 exon 5; Set C
cagauugaauggagacaucaagug

SEQ ID NO: 57659 - RNA, 23 nt, Artificial Sequence
  Synthetic Oligonucleotide; CD80 exon 5; Set C
cagauugaauggagacaucaagu

SEQ ID NO: 57660 - RNA, 30 nt, Artificial Sequence
  Synthetic Oligonucleotide; CD80 exon 5; Set A
acaccagauugaauggagacaucaagugau

SEQ ID NO: 57661 - RNA, 21 nt, Artificial Sequence
  Synthetic Oligonucleotide; CD80 exon 5; Set C
cagauugaauggagacaucaa

SEQ ID NO: 57662 - RNA, 20 nt, Artificial Sequence
  Synthetic Oligonucleotide; CD80 exon 5; Set C
cagauugaauggagacauca

SEQ ID NO: 57663 - RNA, 30 nt, Artificial Sequence
  Synthetic Oligonucleotide; CD80 exon 5; Set A
aacaccagauugaauggagacaucaaguga

SEQ ID NO: 57664 - RNA, 29 nt, Artificial Sequence
  Synthetic Oligonucleotide; CD80 exon 5; Set A
aacaccagauugaauggagacaucaagug

SEQ ID NO: 57665 - RNA, 26 nt, Artificial Sequence
  Synthetic Oligonucleotide; CD80 exon 5; Set A
acaccagauugaauggagacaucaag

SEQ ID NO: 57666 - RNA, 28 nt, Artificial Sequence
  Synthetic Oligonucleotide; CD80 exon 5; Set A
aacaccagauugaauggagacaucaagu

SEQ ID NO: 57667 - RNA, 25 nt, Artificial Sequence
  Synthetic Oligonucleotide; CD80 exon 5; Set A
acaccagauugaauggagacaucaa

SEQ ID NO: 57668 - RNA, 24 nt, Artificial Sequence
  Synthetic Oligonucleotide; CD80 exon 5; Set A
acaccagauugaauggagacauca

SEQ ID NO: 57669 - RNA, 23 nt, Artificial Sequence
  Synthetic Oligonucleotide; CD80 exon 5; Set C
acaccagauugaauggagacauc

SEQ ID NO: 57670 - RNA, 22 nt, Artificial Sequence
  Synthetic Oligonucleotide; CD80 exon 5; Set C
acaccagauugaauggagacau

SEQ ID NO: 57671 - RNA, 18 nt, Artificial Sequence
  Synthetic Oligonucleotide; CD80 exon 5; Set C
acaccagauugaauggag

SEQ ID NO: 57672 - RNA, 18 nt, Artificial Sequence
  Synthetic Oligonucleotide; CD80 exon 5; Set C
aacaccagauugaaugga

SEQ ID NO: 57673 - RNA, 17 nt, Artificial Sequence
  Synthetic Oligonucleotide; CD80 exon 5; Set C
aacaccagauugaaugg

SEQ ID NO: 57674 - RNA, 16 nt, Artificial Sequence
  Synthetic Oligonucleotide; CD80 exon 5; Set C
aacaccagauugaaug

SEQ ID NO: 57675 - RNA, 28 nt, Artificial Sequence
  Synthetic Oligonucleotide; CD80 exon 5; Set C
gguuuuucuuuuuucucuaaaacaccag

SEQ ID NO: 57676 - RNA, 22 nt, Artificial Sequence
  Synthetic Oligonucleotide; CD80 exon 5; Set C
uuuuucuuuuuucucuaaaaca

SEQ ID NO: 57677 - RNA, 23 nt, Artificial Sequence
  Synthetic Oligonucleotide; CD80 exon 5; Set C
guuuuucuuuuuucucuaaaaca

SEQ ID NO: 57678 - RNA, 24 nt, Artificial Sequence
  Synthetic Oligonucleotide; CD80 exon 5; Set C
gguuuuucuuuuuucucuaaaaca

SEQ ID NO: 57679 - RNA, 25 nt, Artificial Sequence
  Synthetic Oligonucleotide; CD80 exon 5; Set C
ugguuuuucuuuuuucucuaaaaca

SEQ ID NO: 57680 - RNA, 40 nt, Artificial Sequence
  Synthetic Oligonucleotide; CD80 exon 5; Set C
accuaccacuuaaagacaggauaguugguuuuucuuuuuu

SEQ ID NO: 57681 - RNA, 39 nt, Artificial Sequence
  Synthetic Oligonucleotide; CD80 exon 5; Set C
accuaccacuuaaagacaggauaguugguuuuucuuuuu

SEQ ID NO: 57682 - RNA, 38 nt, Artificial Sequence
  Synthetic Oligonucleotide; CD80 exon 5; Set A
accuaccacuuaaagacaggauaguugguuuuucuuuu

SEQ ID NO: 57683 - RNA, 37 nt, Artificial Sequence
  Synthetic Oligonucleotide; CD80 exon 5; Set A
accuaccacuuaaagacaggauaguugguuuuucuuu

SEQ ID NO: 57684 - RNA, 36 nt, Artificial Sequence
  Synthetic Oligonucleotide; CD80 exon 5; Set A
accuaccacuuaaagacaggauaguugguuuuucuu

SEQ ID NO: 57685 - RNA, 35 nt, Artificial Sequence
  Synthetic Oligonucleotide; CD80 exon 5; Set A
accuaccacuuaaagacaggauaguugguuuuucu

SEQ ID NO: 57686 - RNA, 34 nt, Artificial Sequence
  Synthetic Oligonucleotide; CD80 exon 5; Set A
accuaccacuuaaagacaggauaguugguuuuuc

SEQ ID NO: 57687 - RNA, 33 nt, Artificial Sequence
  Synthetic Oligonucleotide; CD80 exon 5; Set A
accuaccacuuaaagacaggauaguugguuuuu

SEQ ID NO: 57688 - RNA, 32 nt, Artificial Sequence
  Synthetic Oligonucleotide; CD80 exon 5; Set A
accuaccacuuaaagacaggauaguugguuuu

SEQ ID NO: 57689 - RNA, 40 nt, Artificial Sequence
  Synthetic Oligonucleotide; CD80 exon 5; Set C
guguaccuaccacuuaaagacaggauaguugguuuuucuu

SEQ ID NO: 57690 - RNA, 30 nt, Artificial Sequence
  Synthetic Oligonucleotide; CD80 exon 5; Set A
ccuaccacuuaaagacaggauaguugguuu

SEQ ID NO: 57691 - RNA, 39 nt, Artificial Sequence
  Synthetic Oligonucleotide; CD80 exon 5; Set C
guguaccuaccacuuaaagacaggauaguugguuuuucu

SEQ ID NO: 57692 - RNA, 29 nt, Artificial Sequence
  Synthetic Oligonucleotide; CD80 exon 5; Set A
ccuaccacuuaaagacaggauaguugguu

SEQ ID NO: 57693 - RNA, 38 nt, Artificial Sequence
  Synthetic Oligonucleotide; CD80 exon 5; Set C
guguaccuaccacuuaaagacaggauaguugguuuuuc

SEQ ID NO: 57694 - RNA, 32 nt, Artificial Sequence
  Synthetic Oligonucleotide; CD80 exon 5; Set A
uaccuaccacuuaaagacaggauaguugguuu

SEQ ID NO: 57695 - RNA, 28 nt, Artificial Sequence
  Synthetic Oligonucleotide; CD80 exon 5; Set A
ccuaccacuuaaagacaggauaguuggu

SEQ ID NO: 57696 - RNA, 37 nt, Artificial Sequence
  Synthetic Oligonucleotide; CD80 exon 5; Set C
guguaccuaccacuuaaagacaggauaguugguuuuu

SEQ ID NO: 57697 - RNA, 33 nt, Artificial Sequence
  Synthetic Oligonucleotide; CD80 exon 5; Set A
guaccuaccacuuaaagacaggauaguugguuu

SEQ ID NO: 57698 - RNA, 27 nt, Artificial Sequence
  Synthetic Oligonucleotide; CD80 exon 5; Set A
ccuaccacuuaaagacaggauaguugg

SEQ ID NO: 57699 - RNA, 36 nt, Artificial Sequence
  Synthetic Oligonucleotide; CD80 exon 5; Set C
guguaccuaccacuuaaagacaggauaguugguuuu

SEQ ID NO: 57700 - RNA, 26 nt, Artificial Sequence
  Synthetic Oligonucleotide; CD80 exon 5; Set A
ccuaccacuuaaagacaggauaguug

SEQ ID NO: 57701 - RNA, 34 nt, Artificial Sequence
  Synthetic Oligonucleotide; CD80 exon 5; Set A
uguaccuaccacuuaaagacaggauaguugguuu

SEQ ID NO: 57702 - RNA, 32 nt, Artificial Sequence
  Synthetic Oligonucleotide; CD80 exon 5; Set A
guaccuaccacuuaaagacaggauaguugguu

SEQ ID NO: 57703 - RNA, 35 nt, Artificial Sequence
  Synthetic Oligonucleotide; CD80 exon 5; Set C
guguaccuaccacuuaaagacaggauaguugguuu

SEQ ID NO: 57704 - RNA, 33 nt, Artificial Sequence
  Synthetic Oligonucleotide; CD80 exon 5; Set A
uguaccuaccacuuaaagacaggauaguugguu

SEQ ID NO: 57705 - RNA, 26 nt, Artificial Sequence
  Synthetic Oligonucleotide; CD80 exon 5; Set A
accuaccacuuaaagacaggauaguu

SEQ ID NO: 57706 - RNA, 28 nt, Artificial Sequence
  Synthetic Oligonucleotide; CD80 exon 5; Set A
uaccuaccacuuaaagacaggauaguug

SEQ ID NO: 57707 - RNA, 32 nt, Artificial Sequence
  Synthetic Oligonucleotide; CD80 exon 5; Set A
uguaccuaccacuuaaagacaggauaguuggu

SEQ ID NO: 57708 - RNA, 25 nt, Artificial Sequence
  Synthetic Oligonucleotide; CD80 exon 5; Set A
accuaccacuuaaagacaggauagu

SEQ ID NO: 57709 - RNA, 23 nt, Artificial Sequence
  Synthetic Oligonucleotide; CD80 exon 5; Set C
ccuaccacuuaaagacaggauag

SEQ ID NO: 57710 - RNA, 29 nt, Artificial Sequence
  Synthetic Oligonucleotide; CD80 exon 5; Set A
guaccuaccacuuaaagacaggauaguug

SEQ ID NO: 57711 - RNA, 31 nt, Artificial Sequence
  Synthetic Oligonucleotide; CD80 exon 5; Set A
uguaccuaccacuuaaagacaggauaguugg

SEQ ID NO: 57712 - RNA, 26 nt, Artificial Sequence
  Synthetic Oligonucleotide; CD80 exon 5; Set A
uaccuaccacuuaaagacaggauagu

SEQ ID NO: 57713 - RNA, 24 nt, Artificial Sequence
  Synthetic Oligonucleotide; CD80 exon 5; Set C
accuaccacuuaaagacaggauag

SEQ ID NO: 57714 - RNA, 30 nt, Artificial Sequence
  Synthetic Oligonucleotide; CD80 exon 5; Set A
uguaccuaccacuuaaagacaggauaguug

SEQ ID NO: 57715 - RNA, 25 nt, Artificial Sequence
  Synthetic Oligonucleotide; CD80 exon 5; Set C
uaccuaccacuuaaagacaggauag

SEQ ID NO: 57716 - RNA, 31 nt, Artificial Sequence
  Synthetic Oligonucleotide; CD80 exon 5; Set A
guguaccuaccacuuaaagacaggauaguug

SEQ ID NO: 57717 - RNA, 39 nt, Artificial Sequence
  Synthetic Oligonucleotide; CD80 exon 5; Set C
cauaguguaccuaccacuuaaagacaggauaguugguuu

SEQ ID NO: 57718 - RNA, 30 nt, Artificial Sequence
  Synthetic Oligonucleotide; CD80 exon 5; Set A
guguaccuaccacuuaaagacaggauaguu

SEQ ID NO: 57719 - RNA, 26 nt, Artificial Sequence
  Synthetic Oligonucleotide; CD80 exon 5; Set A
guaccuaccacuuaaagacaggauag

SEQ ID NO: 57720 - RNA, 38 nt, Artificial Sequence
  Synthetic Oligonucleotide; CD80 exon 5; Set C
cauaguguaccuaccacuuaaagacaggauaguugguu

SEQ ID NO: 57721 - RNA, 29 nt, Artificial Sequence
  Synthetic Oligonucleotide; CD80 exon 5; Set A
guguaccuaccacuuaaagacaggauagu

SEQ ID NO: 57722 - RNA, 37 nt, Artificial Sequence
  Synthetic Oligonucleotide; CD80 exon 5; Set C
cauaguguaccuaccacuuaaagacaggauaguuggu

SEQ ID NO: 57723 - RNA, 20 nt, Artificial Sequence
  Synthetic Oligonucleotide; CD80 exon 5; Set C
accuaccacuuaaagacagg

SEQ ID NO: 57724 - RNA, 28 nt, Artificial Sequence
  Synthetic Oligonucleotide; CD80 exon 5; Set A
guguaccuaccacuuaaagacaggauag

SEQ ID NO: 57725 - RNA, 36 nt, Artificial Sequence
  Synthetic Oligonucleotide; CD80 exon 5; Set C
cauaguguaccuaccacuuaaagacaggauaguugg

SEQ ID NO: 57726 - RNA, 17 nt, Artificial Sequence
  Synthetic Oligonucleotide; CD80 exon 5; Set C
ccuaccacuuaaagaca

SEQ ID NO: 57727 - RNA, 21 nt, Artificial Sequence
  Synthetic Oligonucleotide; CD80 exon 5; Set C
uaccuaccacuuaaagacagg

SEQ ID NO: 57728 - RNA, 19 nt, Artificial Sequence
  Synthetic Oligonucleotide; CD80 exon 5; Set C
accuaccacuuaaagacag

SEQ ID NO: 57729 - RNA, 35 nt, Artificial Sequence
  Synthetic Oligonucleotide; CD80 exon 5; Set A
cauaguguaccuaccacuuaaagacaggauaguug

SEQ ID NO: 57730 - RNA, 18 nt, Artificial Sequence
  Synthetic Oligonucleotide; CD80 exon 5; Set C
accuaccacuuaaagaca

SEQ ID NO: 57731 - RNA, 20 nt, Artificial Sequence
  Synthetic Oligonucleotide; CD80 exon 5; Set C
uaccuaccacuuaaagacag

SEQ ID NO: 57732 - RNA, 17 nt, Artificial Sequence
  Synthetic Oligonucleotide; CD80 exon 5; Set C
accuaccacuuaaagac

SEQ ID NO: 57733 - RNA, 15 nt, Artificial Sequence
  Synthetic Oligonucleotide; CD80 exon 5; Set C
ccuaccacuuaaaga

SEQ ID NO: 57734 - RNA, 19 nt, Artificial Sequence
  Synthetic Oligonucleotide; CD80 exon 5; Set C
uaccuaccacuuaaagaca

SEQ ID NO: 57735 - RNA, 21 nt, Artificial Sequence
  Synthetic Oligonucleotide; CD80 exon 5; Set C
guaccuaccacuuaaagacag

SEQ ID NO: 57736 - RNA, 18 nt, Artificial Sequence
  Synthetic Oligonucleotide; CD80 exon 5; Set C
uaccuaccacuuaaagac

SEQ ID NO: 57737 - RNA, 16 nt, Artificial Sequence
  Synthetic Oligonucleotide; CD80 exon 5; Set C
accuaccacuuaaaga

SEQ ID NO: 57738 - RNA, 20 nt, Artificial Sequence
  Synthetic Oligonucleotide; CD80 exon 5; Set C
guaccuaccacuuaaagaca

SEQ ID NO: 57739 - RNA, 24 nt, Artificial Sequence
  Synthetic Oligonucleotide; CD80 exon 5; Set A
guguaccuaccacuuaaagacagg

SEQ ID NO: 57740 - RNA, 15 nt, Artificial Sequence
  Synthetic Oligonucleotide; CD80 exon 5; Set C
accuaccacuuaaag

SEQ ID NO: 57741 - RNA, 17 nt, Artificial Sequence
  Synthetic Oligonucleotide; CD80 exon 5; Set C
uaccuaccacuuaaaga

SEQ ID NO: 57742 - RNA, 23 nt, Artificial Sequence
  Synthetic Oligonucleotide; CD80 exon 5; Set C
guguaccuaccacuuaaagacag

SEQ ID NO: 57743 - RNA, 16 nt, Artificial Sequence
  Synthetic Oligonucleotide; CD80 exon 5; Set C
uaccuaccacuuaaag

SEQ ID NO: 57744 - RNA, 18 nt, Artificial Sequence
  Synthetic Oligonucleotide; CD80 exon 5; Set C
guaccuaccacuuaaaga

SEQ ID NO: 57745 - RNA, 22 nt, Artificial Sequence
  Synthetic Oligonucleotide; CD80 exon 5; Set C
guguaccuaccacuuaaagaca

SEQ ID NO: 57746 - RNA, 15 nt, Artificial Sequence
  Synthetic Oligonucleotide; CD80 exon 5; Set C
uaccuaccacuuaaa

SEQ ID NO: 57747 - RNA, 17 nt, Artificial Sequence
  Synthetic Oligonucleotide; CD80 exon 5; Set C
guaccuaccacuuaaag

SEQ ID NO: 57748 - RNA, 21 nt, Artificial Sequence
  Synthetic Oligonucleotide; CD80 exon 5; Set C
guguaccuaccacuuaaagac

SEQ ID NO: 57749 - RNA, 16 nt, Artificial Sequence
  Synthetic Oligonucleotide; CD80 exon 5; Set C
guaccuaccacuuaaa

SEQ ID NO: 57750 - RNA, 20 nt, Artificial Sequence
  Synthetic Oligonucleotide; CD80 exon 5; Set C
guguaccuaccacuuaaaga

SEQ ID NO: 57751 - RNA, 40 nt, Artificial Sequence
  Synthetic Oligonucleotide; CD80 exon 5; Set A
uuuaaucauaguguaccuaccacuuaaagacaggauaguu

SEQ ID NO: 57752 - RNA, 15 nt, Artificial Sequence
  Synthetic Oligonucleotide; CD80 exon 5; Set C
guaccuaccacuuaa

SEQ ID NO: 57753 - RNA, 19 nt, Artificial Sequence
  Synthetic Oligonucleotide; CD80 exon 5; Set C
guguaccuaccacuuaaag

SEQ ID NO: 57754 - RNA, 39 nt, Artificial Sequence
  Synthetic Oligonucleotide; CD80 exon 5; Set A
uuuaaucauaguguaccuaccacuuaaagacaggauagu

SEQ ID NO: 57755 - RNA, 18 nt, Artificial Sequence
  Synthetic Oligonucleotide; CD80 exon 5; Set C
guguaccuaccacuuaaa

SEQ ID NO: 57756 - RNA, 38 nt, Artificial Sequence
  Synthetic Oligonucleotide; CD80 exon 5; Set A
uuuaaucauaguguaccuaccacuuaaagacaggauag

SEQ ID NO: 57757 - RNA, 17 nt, Artificial Sequence
  Synthetic Oligonucleotide; CD80 exon 5; Set C
guguaccuaccacuuaa

SEQ ID NO: 57758 - RNA, 15 nt, Artificial Sequence
  Synthetic Oligonucleotide; CD80 exon 5; Set C
uguaccuaccacuua

SEQ ID NO: 57759 - RNA, 16 nt, Artificial Sequence
  Synthetic Oligonucleotide; CD80 exon 5; Set C
guguaccuaccacuua

SEQ ID NO: 57760 - RNA, 34 nt, Artificial Sequence
  Synthetic Oligonucleotide; CD80 exon 5; Set A
uuuaaucauaguguaccuaccacuuaaagacagg

SEQ ID NO: 57761 - RNA, 33 nt, Artificial Sequence
  Synthetic Oligonucleotide; CD80 exon 5; Set A
uuuaaucauaguguaccuaccacuuaaagacag

SEQ ID NO: 57762 - RNA, 20 nt, Artificial Sequence
  Synthetic Oligonucleotide; CD80 exon 5; Set C
cauaguguaccuaccacuua

SEQ ID NO: 57763 - RNA, 32 nt, Artificial Sequence
  Synthetic Oligonucleotide; CD80 exon 5; Set B
uuuaaucauaguguaccuaccacuuaaagaca

SEQ ID NO: 57764 - RNA, 31 nt, Artificial Sequence
  Synthetic Oligonucleotide; CD80 exon 5; Set B
uuuaaucauaguguaccuaccacuuaaagac

SEQ ID NO: 57765 - RNA, 30 nt, Artificial Sequence
  Synthetic Oligonucleotide; CD80 exon 5; Set C
uuuaaucauaguguaccuaccacuuaaaga

SEQ ID NO: 57766 - RNA, 29 nt, Artificial Sequence
  Synthetic Oligonucleotide; CD80 exon 5; Set C
uuuaaucauaguguaccuaccacuuaaag

SEQ ID NO: 57767 - RNA, 28 nt, Artificial Sequence
  Synthetic Oligonucleotide; CD80 exon 5; Set C
uuuaaucauaguguaccuaccacuuaaa

SEQ ID NO: 57768 - RNA, 27 nt, Artificial Sequence
  Synthetic Oligonucleotide; CD80 exon 5; Set C
uuuaaucauaguguaccuaccacuuaa

SEQ ID NO: 57769 - RNA, 15 nt, Artificial Sequence
  Synthetic Oligonucleotide; CD80 exon 5; Set C
uaaucauaguguacc

SEQ ID NO: 57770 - RNA, 16 nt, Artificial Sequence
  Synthetic Oligonucleotide; CD80 exon 5; Set C
uuaaucauaguguacc

SEQ ID NO: 57771 - RNA, 40 nt, Artificial Sequence
  Synthetic Oligonucleotide; CD80 exon 5; Set B
cugaaacaccuauuuaaucauaguguaccuaccacuuaaa

SEQ ID NO: 57772 - RNA, 39 nt, Artificial Sequence
  Synthetic Oligonucleotide; CD80 exon 5; Set B
cugaaacaccuauuuaaucauaguguaccuaccacuuaa

SEQ ID NO: 57773 - RNA, 38 nt, Artificial Sequence
  Synthetic Oligonucleotide; CD80 exon 5; Set B
cugaaacaccuauuuaaucauaguguaccuaccacuua

SEQ ID NO: 57774 - RNA, 24 nt, Artificial Sequence
  Synthetic Oligonucleotide; CD80 exon 5; Set C
caccuauuuaaucauaguguaccu

SEQ ID NO: 57775 - RNA, 25 nt, Artificial Sequence
  Synthetic Oligonucleotide; CD80 exon 5; Set C
acaccuauuuaaucauaguguaccu

SEQ ID NO: 57776 - RNA, 26 nt, Artificial Sequence
  Synthetic Oligonucleotide; CD80 exon 5; Set C
aacaccuauuuaaucauaguguaccu

SEQ ID NO: 57777 - RNA, 22 nt, Artificial Sequence
  Synthetic Oligonucleotide; CD80 exon 5; Set C
caccuauuuaaucauaguguac

SEQ ID NO: 57778 - RNA, 21 nt, Artificial Sequence
  Synthetic Oligonucleotide; CD80 exon 5; Set C
caccuauuuaaucauagugua

SEQ ID NO: 57779 - RNA, 23 nt, Artificial Sequence
  Synthetic Oligonucleotide; CD80 exon 5; Set C
acaccuauuuaaucauaguguac

SEQ ID NO: 57780 - RNA, 20 nt, Artificial Sequence
  Synthetic Oligonucleotide; CD80 exon 5; Set C
caccuauuuaaucauagugu

SEQ ID NO: 57781 - RNA, 22 nt, Artificial Sequence
  Synthetic Oligonucleotide; CD80 exon 5; Set C
acaccuauuuaaucauagugua

SEQ ID NO: 57782 - RNA, 24 nt, Artificial Sequence
  Synthetic Oligonucleotide; CD80 exon 5; Set C
aacaccuauuuaaucauaguguac

SEQ ID NO: 57783 - RNA, 21 nt, Artificial Sequence
  Synthetic Oligonucleotide; CD80 exon 5; Set C
acaccuauuuaaucauagugu

SEQ ID NO: 57784 - RNA, 23 nt, Artificial Sequence
  Synthetic Oligonucleotide; CD80 exon 5; Set C
aacaccuauuuaaucauagugua

SEQ ID NO: 57785 - RNA, 19 nt, Artificial Sequence
  Synthetic Oligonucleotide; CD80 exon 5; Set C
caccuauuuaaucauagug

SEQ ID NO: 57786 - RNA, 22 nt, Artificial Sequence
  Synthetic Oligonucleotide; CD80 exon 5; Set C
aacaccuauuuaaucauagugu

SEQ ID NO: 57787 - RNA, 20 nt, Artificial Sequence
  Synthetic Oligonucleotide; CD80 exon 5; Set C
acaccuauuuaaucauagug

SEQ ID NO: 57788 - RNA, 31 nt, Artificial Sequence
  Synthetic Oligonucleotide; CD80 exon 5; Set B
ucugaaacaccuauuuaaucauaguguaccu

SEQ ID NO: 57789 - RNA, 21 nt, Artificial Sequence
  Synthetic Oligonucleotide; CD80 exon 5; Set C
aacaccuauuuaaucauagug

SEQ ID NO: 57790 - RNA, 32 nt, Artificial Sequence
  Synthetic Oligonucleotide; CD80 exon 5; Set B
uucugaaacaccuauuuaaucauaguguaccu

SEQ ID NO: 57791 - RNA, 15 nt, Artificial Sequence
  Synthetic Oligonucleotide; CD80 exon 5; Set C
caccuauuuaaucau

SEQ ID NO: 57792 - RNA, 29 nt, Artificial Sequence
  Synthetic Oligonucleotide; CD80 exon 5; Set C
ucugaaacaccuauuuaaucauaguguac

SEQ ID NO: 57793 - RNA, 28 nt, Artificial Sequence
  Synthetic Oligonucleotide; CD80 exon 5; Set C
ucugaaacaccuauuuaaucauagugua

SEQ ID NO: 57794 - RNA, 30 nt, Artificial Sequence
  Synthetic Oligonucleotide; CD80 exon 5; Set C
uucugaaacaccuauuuaaucauaguguac

SEQ ID NO: 57795 - RNA, 27 nt, Artificial Sequence
  Synthetic Oligonucleotide; CD80 exon 5; Set C
ucugaaacaccuauuuaaucauagugu

SEQ ID NO: 57796 - RNA, 29 nt, Artificial Sequence
  Synthetic Oligonucleotide; CD80 exon 5; Set C
uucugaaacaccuauuuaaucauagugua

SEQ ID NO: 57797 - RNA, 28 nt, Artificial Sequence
  Synthetic Oligonucleotide; CD80 exon 5; Set C
uucugaaacaccuauuuaaucauagugu

SEQ ID NO: 57798 - RNA, 26 nt, Artificial Sequence
  Synthetic Oligonucleotide; CD80 exon 5; Set C
ucugaaacaccuauuuaaucauagug

SEQ ID NO: 57799 - RNA, 27 nt, Artificial Sequence
  Synthetic Oligonucleotide; CD80 exon 5; Set C
uucugaaacaccuauuuaaucauagug

SEQ ID NO: 57800 - RNA, 16 nt, Artificial Sequence
  Synthetic Oligonucleotide; CD80 exon 5; Set C
aaacaccuauuuaauc

SEQ ID NO: 57801 - RNA, 20 nt, Artificial Sequence
  Synthetic Oligonucleotide; CD80 exon 5; Set C
cugaaacaccuauuuaauca

SEQ ID NO: 57802 - RNA, 22 nt, Artificial Sequence
  Synthetic Oligonucleotide; CD80 exon 5; Set C
ucugaaacaccuauuuaaucau

SEQ ID NO: 57803 - RNA, 19 nt, Artificial Sequence
  Synthetic Oligonucleotide; CD80 exon 5; Set C
cugaaacaccuauuuaauc

SEQ ID NO: 57804 - RNA, 23 nt, Artificial Sequence
  Synthetic Oligonucleotide; CD80 exon 5; Set C
uucugaaacaccuauuuaaucau

SEQ ID NO: 57805 - RNA, 18 nt, Artificial Sequence
  Synthetic Oligonucleotide; CD80 exon 5; Set C
cugaaacaccuauuuaau

SEQ ID NO: 57806 - RNA, 17 nt, Artificial Sequence
  Synthetic Oligonucleotide; CD80 exon 5; Set C
cugaaacaccuauuuaa

SEQ ID NO: 57807 - RNA, 16 nt, Artificial Sequence
  Synthetic Oligonucleotide; CD80 exon 5; Set C
cugaaacaccuauuua

SEQ ID NO: 57808 - RNA, 21 nt, Artificial Sequence
  Synthetic Oligonucleotide; CD80 exon 6; Set C
augucagcuguaauguauuuc

SEQ ID NO: 57809 - RNA, 22 nt, Artificial Sequence
  Synthetic Oligonucleotide; CD80 exon 6; Set C
aaugucagcuguaauguauuuc

SEQ ID NO: 57810 - RNA, 23 nt, Artificial Sequence
  Synthetic Oligonucleotide; CD80 exon 6; Set C
uaaugucagcuguaauguauuuc

SEQ ID NO: 57811 - RNA, 21 nt, Artificial Sequence
  Synthetic Oligonucleotide; CD80 exon 6; Set C
aaugucagcuguaauguauuu

SEQ ID NO: 57812 - RNA, 22 nt, Artificial Sequence
  Synthetic Oligonucleotide; CD80 exon 6; Set C
uaaugucagcuguaauguauuu

SEQ ID NO: 57813 - RNA, 24 nt, Artificial Sequence
  Synthetic Oligonucleotide; CD80 exon 6; Set C
auaaugucagcuguaauguauuuc

SEQ ID NO: 57814 - RNA, 21 nt, Artificial Sequence
  Synthetic Oligonucleotide; CD80 exon 6; Set C
uaaugucagcuguaauguauu

SEQ ID NO: 57815 - RNA, 23 nt, Artificial Sequence
  Synthetic Oligonucleotide; CD80 exon 6; Set C
auaaugucagcuguaauguauuu

SEQ ID NO: 57816 - RNA, 22 nt, Artificial Sequence
  Synthetic Oligonucleotide; CD80 exon 6; Set C
auaaugucagcuguaauguauu

SEQ ID NO: 57817 - RNA, 21 nt, Artificial Sequence
  Synthetic Oligonucleotide; CD80 exon 6; Set C
auaaugucagcuguaauguau

SEQ ID NO: 57818 - RNA, 28 nt, Artificial Sequence
  Synthetic Oligonucleotide; CD80 exon 6; Set C
aagaauaaugucagcuguaauguauuuc

SEQ ID NO: 57819 - RNA, 29 nt, Artificial Sequence
  Synthetic Oligonucleotide; CD80 exon 6; Set C
aaagaauaaugucagcuguaauguauuuc

SEQ ID NO: 57820 - RNA, 28 nt, Artificial Sequence
  Synthetic Oligonucleotide; CD80 exon 6; Set C
aaagaauaaugucagcuguaauguauuu

SEQ ID NO: 57821 - RNA, 30 nt, Artificial Sequence
  Synthetic Oligonucleotide; CD80 exon 6; Set C
aaaagaauaaugucagcuguaauguauuuc

SEQ ID NO: 57822 - RNA, 27 nt, Artificial Sequence
  Synthetic Oligonucleotide; CD80 exon 6; Set C
aaagaauaaugucagcuguaauguauu

SEQ ID NO: 57823 - RNA, 29 nt, Artificial Sequence
  Synthetic Oligonucleotide; CD80 exon 6; Set C
aaaagaauaaugucagcuguaauguauuu

SEQ ID NO: 57824 - RNA, 26 nt, Artificial Sequence
  Synthetic Oligonucleotide; CD80 exon 6; Set C
aaagaauaaugucagcuguaauguau

SEQ ID NO: 57825 - RNA, 28 nt, Artificial Sequence
  Synthetic Oligonucleotide; CD80 exon 6; Set C
aaaagaauaaugucagcuguaauguauu

SEQ ID NO: 57826 - RNA, 25 nt, Artificial Sequence
  Synthetic Oligonucleotide; CD80 exon 6; Set C
aaagaauaaugucagcuguaaugua

SEQ ID NO: 57827 - RNA, 27 nt, Artificial Sequence
  Synthetic Oligonucleotide; CD80 exon 6; Set C
aaaagaauaaugucagcuguaauguau

SEQ ID NO: 57828 - RNA, 26 nt, Artificial Sequence
  Synthetic Oligonucleotide; CD80 exon 6; Set C
aaaagaauaaugucagcuguaaugua

SEQ ID NO: 57829 - RNA, 24 nt, Artificial Sequence
  Synthetic Oligonucleotide; CD80 exon 6; Set C
aaagaauaaugucagcuguaaugu

SEQ ID NO: 57830 - RNA, 25 nt, Artificial Sequence
  Synthetic Oligonucleotide; CD80 exon 6; Set C
aaaagaauaaugucagcuguaaugu

SEQ ID NO: 57831 - RNA, 35 nt, Artificial Sequence
  Synthetic Oligonucleotide; CD80 exon 6; Set A
gagggaaaagaauaaugucagcuguaauguauuuc

SEQ ID NO: 57832 - RNA, 34 nt, Artificial Sequence
  Synthetic Oligonucleotide; CD80 exon 6; Set A
gagggaaaagaauaaugucagcuguaauguauuu

SEQ ID NO: 57833 - RNA, 36 nt, Artificial Sequence
  Synthetic Oligonucleotide; CD80 exon 6; Set A
ggagggaaaagaauaaugucagcuguaauguauuuc

SEQ ID NO: 57834 - RNA, 33 nt, Artificial Sequence
  Synthetic Oligonucleotide; CD80 exon 6; Set C
gagggaaaagaauaaugucagcuguaauguauu

SEQ ID NO: 57835 - RNA, 37 nt, Artificial Sequence
  Synthetic Oligonucleotide; CD80 exon 6; Set A
uggagggaaaagaauaaugucagcuguaauguauuuc

SEQ ID NO: 57836 - RNA, 35 nt, Artificial Sequence
  Synthetic Oligonucleotide; CD80 exon 6; Set A
ggagggaaaagaauaaugucagcuguaauguauuu

SEQ ID NO: 57837 - RNA, 32 nt, Artificial Sequence
  Synthetic Oligonucleotide; CD80 exon 6; Set C
gagggaaaagaauaaugucagcuguaauguau

SEQ ID NO: 57838 - RNA, 34 nt, Artificial Sequence
  Synthetic Oligonucleotide; CD80 exon 6; Set A
ggagggaaaagaauaaugucagcuguaauguauu

SEQ ID NO: 57839 - RNA, 38 nt, Artificial Sequence
  Synthetic Oligonucleotide; CD80 exon 6; Set A
auggagggaaaagaauaaugucagcuguaauguauuuc

SEQ ID NO: 57840 - RNA, 36 nt, Artificial Sequence
  Synthetic Oligonucleotide; CD80 exon 6; Set A
uggagggaaaagaauaaugucagcuguaauguauuu

SEQ ID NO: 57841 - RNA, 35 nt, Artificial Sequence
  Synthetic Oligonucleotide; CD80 exon 6; Set A
uggagggaaaagaauaaugucagcuguaauguauu

SEQ ID NO: 57842 - RNA, 31 nt, Artificial Sequence
  Synthetic Oligonucleotide; CD80 exon 6; Set C
gagggaaaagaauaaugucagcuguaaugua

SEQ ID NO: 57843 - RNA, 33 nt, Artificial Sequence
  Synthetic Oligonucleotide; CD80 exon 6; Set A
ggagggaaaagaauaaugucagcuguaauguau

SEQ ID NO: 57844 - RNA, 39 nt, Artificial Sequence
  Synthetic Oligonucleotide; CD80 exon 6; Set A
uauggagggaaaagaauaaugucagcuguaauguauuuc

SEQ ID NO: 57845 - RNA, 37 nt, Artificial Sequence
  Synthetic Oligonucleotide; CD80 exon 6; Set A
auggagggaaaagaauaaugucagcuguaauguauuu

SEQ ID NO: 57846 - RNA, 36 nt, Artificial Sequence
  Synthetic Oligonucleotide; CD80 exon 6; Set A
auggagggaaaagaauaaugucagcuguaauguauu

SEQ ID NO: 57847 - RNA, 34 nt, Artificial Sequence
  Synthetic Oligonucleotide; CD80 exon 6; Set A
uggagggaaaagaauaaugucagcuguaauguau

SEQ ID NO: 57848 - RNA, 32 nt, Artificial Sequence
  Synthetic Oligonucleotide; CD80 exon 6; Set A
ggagggaaaagaauaaugucagcuguaaugua

SEQ ID NO: 57849 - RNA, 38 nt, Artificial Sequence
  Synthetic Oligonucleotide; CD80 exon 6; Set A
uauggagggaaaagaauaaugucagcuguaauguauuu

SEQ ID NO: 57850 - RNA, 37 nt, Artificial Sequence
  Synthetic Oligonucleotide; CD80 exon 6; Set A
uauggagggaaaagaauaaugucagcuguaauguauu

SEQ ID NO: 57851 - RNA, 35 nt, Artificial Sequence
  Synthetic Oligonucleotide; CD80 exon 6; Set A
auggagggaaaagaauaaugucagcuguaauguau

SEQ ID NO: 57852 - RNA, 33 nt, Artificial Sequence
  Synthetic Oligonucleotide; CD80 exon 6; Set A
uggagggaaaagaauaaugucagcuguaaugua

SEQ ID NO: 57853 - RNA, 36 nt, Artificial Sequence
  Synthetic Oligonucleotide; CD80 exon 6; Set A
uauggagggaaaagaauaaugucagcuguaauguau

SEQ ID NO: 57854 - RNA, 34 nt, Artificial Sequence
  Synthetic Oligonucleotide; CD80 exon 6; Set A
auggagggaaaagaauaaugucagcuguaaugua

SEQ ID NO: 57855 - RNA, 32 nt, Artificial Sequence
  Synthetic Oligonucleotide; CD80 exon 6; Set A
uggagggaaaagaauaaugucagcuguaaugu

SEQ ID NO: 57856 - RNA, 35 nt, Artificial Sequence
  Synthetic Oligonucleotide; CD80 exon 6; Set A
uauggagggaaaagaauaaugucagcuguaaugua

SEQ ID NO: 57857 - RNA, 33 nt, Artificial Sequence
  Synthetic Oligonucleotide; CD80 exon 6; Set A
auggagggaaaagaauaaugucagcuguaaugu

SEQ ID NO: 57858 - RNA, 34 nt, Artificial Sequence
  Synthetic Oligonucleotide; CD80 exon 6; Set A
uauggagggaaaagaauaaugucagcuguaaugu

SEQ ID NO: 57859 - RNA, 15 nt, Artificial Sequence
  Synthetic Oligonucleotide; CD80 exon 6; Set C
ggaaaagaauaaugu

SEQ ID NO: 57860 - RNA, 16 nt, Artificial Sequence
  Synthetic Oligonucleotide; CD80 exon 6; Set C
gggaaaagaauaaugu

SEQ ID NO: 57861 - RNA, 15 nt, Artificial Sequence
  Synthetic Oligonucleotide; CD80 exon 6; Set C
gggaaaagaauaaug

SEQ ID NO: 57862 - RNA, 17 nt, Artificial Sequence
  Synthetic Oligonucleotide; CD80 exon 6; Set C
agggaaaagaauaaugu

SEQ ID NO: 57863 - RNA, 16 nt, Artificial Sequence
  Synthetic Oligonucleotide; CD80 exon 6; Set C
agggaaaagaauaaug

SEQ ID NO: 57864 - RNA, 18 nt, Artificial Sequence
  Synthetic Oligonucleotide; CD80 exon 6; Set C
gagggaaaagaauaaugu

SEQ ID NO: 57865 - RNA, 15 nt, Artificial Sequence
  Synthetic Oligonucleotide; CD80 exon 6; Set C
agggaaaagaauaau

SEQ ID NO: 57866 - RNA, 17 nt, Artificial Sequence
  Synthetic Oligonucleotide; CD80 exon 6; Set C
gagggaaaagaauaaug

SEQ ID NO: 57867 - RNA, 19 nt, Artificial Sequence
  Synthetic Oligonucleotide; CD80 exon 6; Set C
ggagggaaaagaauaaugu

SEQ ID NO: 57868 - RNA, 16 nt, Artificial Sequence
  Synthetic Oligonucleotide; CD80 exon 6; Set C
gagggaaaagaauaau

SEQ ID NO: 57869 - RNA, 18 nt, Artificial Sequence
  Synthetic Oligonucleotide; CD80 exon 6; Set C
ggagggaaaagaauaaug

SEQ ID NO: 57870 - RNA, 20 nt, Artificial Sequence
  Synthetic Oligonucleotide; CD80 exon 6; Set C
uggagggaaaagaauaaugu

SEQ ID NO: 57871 - RNA, 15 nt, Artificial Sequence
  Synthetic Oligonucleotide; CD80 exon 6; Set C
gagggaaaagaauaa

SEQ ID NO: 57872 - RNA, 17 nt, Artificial Sequence
  Synthetic Oligonucleotide; CD80 exon 6; Set C
ggagggaaaagaauaau

SEQ ID NO: 57873 - RNA, 19 nt, Artificial Sequence
  Synthetic Oligonucleotide; CD80 exon 6; Set C
uggagggaaaagaauaaug

SEQ ID NO: 57874 - RNA, 21 nt, Artificial Sequence
  Synthetic Oligonucleotide; CD80 exon 6; Set C
auggagggaaaagaauaaugu

SEQ ID NO: 57875 - RNA, 18 nt, Artificial Sequence
  Synthetic Oligonucleotide; CD80 exon 6; Set C
uggagggaaaagaauaau

SEQ ID NO: 57876 - RNA, 16 nt, Artificial Sequence
  Synthetic Oligonucleotide; CD80 exon 6; Set C
ggagggaaaagaauaa

SEQ ID NO: 57877 - RNA, 20 nt, Artificial Sequence
  Synthetic Oligonucleotide; CD80 exon 6; Set C
auggagggaaaagaauaaug

SEQ ID NO: 57878 - RNA, 22 nt, Artificial Sequence
  Synthetic Oligonucleotide; CD80 exon 6; Set C
uauggagggaaaagaauaaugu

SEQ ID NO: 57879 - RNA, 19 nt, Artificial Sequence
  Synthetic Oligonucleotide; CD80 exon 6; Set C
auggagggaaaagaauaau

SEQ ID NO: 57880 - RNA, 17 nt, Artificial Sequence
  Synthetic Oligonucleotide; CD80 exon 6; Set C
uggagggaaaagaauaa

SEQ ID NO: 57881 - RNA, 21 nt, Artificial Sequence
  Synthetic Oligonucleotide; CD80 exon 6; Set C
uauggagggaaaagaauaaug

SEQ ID NO: 57882 - RNA, 15 nt, Artificial Sequence
  Synthetic Oligonucleotide; CD80 exon 6; Set C
ggagggaaaagaaua

SEQ ID NO: 57883 - RNA, 20 nt, Artificial Sequence
  Synthetic Oligonucleotide; CD80 exon 6; Set C
uauggagggaaaagaauaau

SEQ ID NO: 57884 - RNA, 18 nt, Artificial Sequence
  Synthetic Oligonucleotide; CD80 exon 6; Set C
auggagggaaaagaauaa

SEQ ID NO: 57885 - RNA, 16 nt, Artificial Sequence
  Synthetic Oligonucleotide; CD80 exon 6; Set C
uggagggaaaagaaua

SEQ ID NO: 57886 - RNA, 19 nt, Artificial Sequence
  Synthetic Oligonucleotide; CD80 exon 6; Set C
uauggagggaaaagaauaa

SEQ ID NO: 57887 - RNA, 17 nt, Artificial Sequence
  Synthetic Oligonucleotide; CD80 exon 6; Set C
auggagggaaaagaaua

SEQ ID NO: 57888 - RNA, 15 nt, Artificial Sequence
  Synthetic Oligonucleotide; CD80 exon 6; Set C
uggagggaaaagaau

SEQ ID NO: 57889 - RNA, 18 nt, Artificial Sequence
  Synthetic Oligonucleotide; CD80 exon 6; Set C
uauggagggaaaagaaua

SEQ ID NO: 57890 - RNA, 16 nt, Artificial Sequence
  Synthetic Oligonucleotide; CD80 exon 6; Set C
auggagggaaaagaau

SEQ ID NO: 57891 - RNA, 17 nt, Artificial Sequence
  Synthetic Oligonucleotide; CD80 exon 6; Set C
uauggagggaaaagaau

SEQ ID NO: 57892 - RNA, 27 nt, Artificial Sequence
  Synthetic Oligonucleotide; CD80 exon 6; Set C
uuggcuauggagggaaaagaauaaugu

SEQ ID NO: 57893 - RNA, 15 nt, Artificial Sequence
  Synthetic Oligonucleotide; CD80 exon 6; Set C
auggagggaaaagaa

SEQ ID NO: 57894 - RNA, 26 nt, Artificial Sequence
  Synthetic Oligonucleotide; CD80 exon 6; Set C
uuggcuauggagggaaaagaauaaug

SEQ ID NO: 57895 - RNA, 16 nt, Artificial Sequence
  Synthetic Oligonucleotide; CD80 exon 6; Set C
uauggagggaaaagaa

SEQ ID NO: 57896 - RNA, 25 nt, Artificial Sequence
  Synthetic Oligonucleotide; CD80 exon 6; Set C
uuggcuauggagggaaaagaauaau

SEQ ID NO: 57897 - RNA, 15 nt, Artificial Sequence
  Synthetic Oligonucleotide; CD80 exon 6; Set C
uauggagggaaaaga

SEQ ID NO: 57898 - RNA, 24 nt, Artificial Sequence
  Synthetic Oligonucleotide; CD80 exon 6; Set C
uuggcuauggagggaaaagaauaa

SEQ ID NO: 57899 - RNA, 23 nt, Artificial Sequence
  Synthetic Oligonucleotide; CD80 exon 6; Set C
uuggcuauggagggaaaagaaua

SEQ ID NO: 57900 - RNA, 22 nt, Artificial Sequence
  Synthetic Oligonucleotide; CD80 exon 6; Set C
uuggcuauggagggaaaagaau

SEQ ID NO: 57901 - RNA, 18 nt, Artificial Sequence
  Synthetic Oligonucleotide; CD80 exon 6; Set C
uuggcuauggagggaaaa

SEQ ID NO: 57902 - RNA, 17 nt, Artificial Sequence
  Synthetic Oligonucleotide; CD80 exon 6; Set C
uuggcuauggagggaaa

SEQ ID NO: 57903 - RNA, 21 nt, Artificial Sequence
  Synthetic Oligonucleotide; CD80 exon 6; Set C
ugucagcuguaauguauuucc

SEQ ID NO: 57904 - RNA, 20 nt, Artificial Sequence
  Synthetic Oligonucleotide; CD80 exon 6; Set C
ugucagcuguaauguauuuc

SEQ ID NO: 57905 - RNA, 22 nt, Artificial Sequence
  Synthetic Oligonucleotide; CD80 exon 6; Set C
augucagcuguaauguauuucc

SEQ ID NO: 57906 - RNA, 19 nt, Artificial Sequence
  Synthetic Oligonucleotide; CD80 exon 6; Set C
ugucagcuguaauguauuu

SEQ ID NO: 57907 - RNA, 23 nt, Artificial Sequence
  Synthetic Oligonucleotide; CD80 exon 6; Set C
aaugucagcuguaauguauuucc

SEQ ID NO: 57908 - RNA, 18 nt, Artificial Sequence
  Synthetic Oligonucleotide; CD80 exon 6; Set C
ugucagcuguaauguauu

SEQ ID NO: 57909 - RNA, 20 nt, Artificial Sequence
  Synthetic Oligonucleotide; CD80 exon 6; Set C
augucagcuguaauguauuu

SEQ ID NO: 57910 - RNA, 24 nt, Artificial Sequence
  Synthetic Oligonucleotide; CD80 exon 6; Set C
uaaugucagcuguaauguauuucc

SEQ ID NO: 57911 - RNA, 19 nt, Artificial Sequence
  Synthetic Oligonucleotide; CD80 exon 6; Set C
augucagcuguaauguauu

SEQ ID NO: 57912 - RNA, 17 nt, Artificial Sequence
  Synthetic Oligonucleotide; CD80 exon 6; Set C
ugucagcuguaauguau

SEQ ID NO: 57913 - RNA, 25 nt, Artificial Sequence
  Synthetic Oligonucleotide; CD80 exon 6; Set C
auaaugucagcuguaauguauuucc

SEQ ID NO: 57914 - RNA, 20 nt, Artificial Sequence
  Synthetic Oligonucleotide; CD80 exon 6; Set C
aaugucagcuguaauguauu

SEQ ID NO: 57915 - RNA, 18 nt, Artificial Sequence
  Synthetic Oligonucleotide; CD80 exon 6; Set C
augucagcuguaauguau

SEQ ID NO: 57916 - RNA, 16 nt, Artificial Sequence
  Synthetic Oligonucleotide; CD80 exon 6; Set C
ugucagcuguaaugua

SEQ ID NO: 57917 - RNA, 26 nt, Artificial Sequence
  Synthetic Oligonucleotide; CD80 exon 6; Set C
aauaaugucagcuguaauguauuucc

SEQ ID NO: 57918 - RNA, 19 nt, Artificial Sequence
  Synthetic Oligonucleotide; CD80 exon 6; Set C
aaugucagcuguaauguau

SEQ ID NO: 57919 - RNA, 17 nt, Artificial Sequence
  Synthetic Oligonucleotide; CD80 exon 6; Set C
augucagcuguaaugua

SEQ ID NO: 57920 - RNA, 15 nt, Artificial Sequence
  Synthetic Oligonucleotide; CD80 exon 6; Set C
ugucagcuguaaugu

SEQ ID NO: 57921 - RNA, 25 nt, Artificial Sequence
  Synthetic Oligonucleotide; CD80 exon 6; Set C
aauaaugucagcuguaauguauuuc

SEQ ID NO: 57922 - RNA, 27 nt, Artificial Sequence
  Synthetic Oligonucleotide; CD80 exon 6; Set C
gaauaaugucagcuguaauguauuucc

SEQ ID NO: 57923 - RNA, 20 nt, Artificial Sequence
  Synthetic Oligonucleotide; CD80 exon 6; Set C
uaaugucagcuguaauguau

SEQ ID NO: 57924 - RNA, 18 nt, Artificial Sequence
  Synthetic Oligonucleotide; CD80 exon 6; Set C
aaugucagcuguaaugua

SEQ ID NO: 57925 - RNA, 16 nt, Artificial Sequence
  Synthetic Oligonucleotide; CD80 exon 6; Set C
augucagcuguaaugu

SEQ ID NO: 57926 - RNA, 24 nt, Artificial Sequence
  Synthetic Oligonucleotide; CD80 exon 6; Set C
aauaaugucagcuguaauguauuu

SEQ ID NO: 57927 - RNA, 26 nt, Artificial Sequence
  Synthetic Oligonucleotide; CD80 exon 6; Set C
gaauaaugucagcuguaauguauuuc

SEQ ID NO: 57928 - RNA, 28 nt, Artificial Sequence
  Synthetic Oligonucleotide; CD80 exon 6; Set C
agaauaaugucagcuguaauguauuucc

SEQ ID NO: 57929 - RNA, 19 nt, Artificial Sequence
  Synthetic Oligonucleotide; CD80 exon 6; Set C
uaaugucagcuguaaugua

SEQ ID NO: 57930 - RNA, 23 nt, Artificial Sequence
  Synthetic Oligonucleotide; CD80 exon 6; Set C
aauaaugucagcuguaauguauu

SEQ ID NO: 57931 - RNA, 17 nt, Artificial Sequence
  Synthetic Oligonucleotide; CD80 exon 6; Set C
aaugucagcuguaaugu

SEQ ID NO: 57932 - RNA, 25 nt, Artificial Sequence
  Synthetic Oligonucleotide; CD80 exon 6; Set C
gaauaaugucagcuguaauguauuu

SEQ ID NO: 57933 - RNA, 27 nt, Artificial Sequence
  Synthetic Oligonucleotide; CD80 exon 6; Set C
agaauaaugucagcuguaauguauuuc

SEQ ID NO: 57934 - RNA, 15 nt, Artificial Sequence
  Synthetic Oligonucleotide; CD80 exon 6; Set C
augucagcuguaaug

SEQ ID NO: 57935 - RNA, 29 nt, Artificial Sequence
  Synthetic Oligonucleotide; CD80 exon 6; Set C
aagaauaaugucagcuguaauguauuucc

SEQ ID NO: 57936 - RNA, 20 nt, Artificial Sequence
  Synthetic Oligonucleotide; CD80 exon 6; Set C
auaaugucagcuguaaugua

SEQ ID NO: 57937 - RNA, 22 nt, Artificial Sequence
  Synthetic Oligonucleotide; CD80 exon 6; Set C
aauaaugucagcuguaauguau

SEQ ID NO: 57938 - RNA, 24 nt, Artificial Sequence
  Synthetic Oligonucleotide; CD80 exon 6; Set C
gaauaaugucagcuguaauguauu

SEQ ID NO: 57939 - RNA, 18 nt, Artificial Sequence
  Synthetic Oligonucleotide; CD80 exon 6; Set C
uaaugucagcuguaaugu

SEQ ID NO: 57940 - RNA, 26 nt, Artificial Sequence
  Synthetic Oligonucleotide; CD80 exon 6; Set C
agaauaaugucagcuguaauguauuu

SEQ ID NO: 57941 - RNA, 16 nt, Artificial Sequence
  Synthetic Oligonucleotide; CD80 exon 6; Set C
aaugucagcuguaaug

SEQ ID NO: 57942 - RNA, 30 nt, Artificial Sequence
  Synthetic Oligonucleotide; CD80 exon 6; Set C
aaagaauaaugucagcuguaauguauuucc

SEQ ID NO: 57943 - RNA, 21 nt, Artificial Sequence
  Synthetic Oligonucleotide; CD80 exon 6; Set C
aauaaugucagcuguaaugua

SEQ ID NO: 57944 - RNA, 23 nt, Artificial Sequence
  Synthetic Oligonucleotide; CD80 exon 6; Set C
gaauaaugucagcuguaauguau

SEQ ID NO: 57945 - RNA, 25 nt, Artificial Sequence
  Synthetic Oligonucleotide; CD80 exon 6; Set C
agaauaaugucagcuguaauguauu

SEQ ID NO: 57946 - RNA, 19 nt, Artificial Sequence
  Synthetic Oligonucleotide; CD80 exon 6; Set C
auaaugucagcuguaaugu

SEQ ID NO: 57947 - RNA, 27 nt, Artificial Sequence
  Synthetic Oligonucleotide; CD80 exon 6; Set C
aagaauaaugucagcuguaauguauuu

SEQ ID NO: 57948 - RNA, 17 nt, Artificial Sequence
  Synthetic Oligonucleotide; CD80 exon 6; Set C
uaaugucagcuguaaug

SEQ ID NO: 57949 - RNA, 15 nt, Artificial Sequence
  Synthetic Oligonucleotide; CD80 exon 6; Set C
aaugucagcuguaau

SEQ ID NO: 57950 - RNA, 31 nt, Artificial Sequence
  Synthetic Oligonucleotide; CD80 exon 6; Set C
aaaagaauaaugucagcuguaauguauuucc

SEQ ID NO: 57951 - RNA, 26 nt, Artificial Sequence
  Synthetic Oligonucleotide; CD80 exon 6; Set C
aagaauaaugucagcuguaauguauu

SEQ ID NO: 57952 - RNA, 22 nt, Artificial Sequence
  Synthetic Oligonucleotide; CD80 exon 6; Set C
gaauaaugucagcuguaaugua

SEQ ID NO: 57953 - RNA, 24 nt, Artificial Sequence
  Synthetic Oligonucleotide; CD80 exon 6; Set C
agaauaaugucagcuguaauguau

SEQ ID NO: 57954 - RNA, 20 nt, Artificial Sequence
  Synthetic Oligonucleotide; CD80 exon 6; Set C
aauaaugucagcuguaaugu

SEQ ID NO: 57955 - RNA, 16 nt, Artificial Sequence
  Synthetic Oligonucleotide; CD80 exon 6; Set C
uaaugucagcuguaau

SEQ ID NO: 57956 - RNA, 18 nt, Artificial Sequence
  Synthetic Oligonucleotide; CD80 exon 6; Set C
auaaugucagcuguaaug

SEQ ID NO: 57957 - RNA, 32 nt, Artificial Sequence
  Synthetic Oligonucleotide; CD80 exon 6; Set C
gaaaagaauaaugucagcuguaauguauuucc

SEQ ID NO: 57958 - RNA, 25 nt, Artificial Sequence
  Synthetic Oligonucleotide; CD80 exon 6; Set C
aagaauaaugucagcuguaauguau

SEQ ID NO: 57959 - RNA, 23 nt, Artificial Sequence
  Synthetic Oligonucleotide; CD80 exon 6; Set C
agaauaaugucagcuguaaugua

SEQ ID NO: 57960 - RNA, 21 nt, Artificial Sequence
  Synthetic Oligonucleotide; CD80 exon 6; Set C
gaauaaugucagcuguaaugu

SEQ ID NO: 57961 - RNA, 31 nt, Artificial Sequence
  Synthetic Oligonucleotide; CD80 exon 6; Set C
gaaaagaauaaugucagcuguaauguauuuc

SEQ ID NO: 57962 - RNA, 15 nt, Artificial Sequence
  Synthetic Oligonucleotide; CD80 exon 6; Set C
uaaugucagcuguaa

SEQ ID NO: 57963 - RNA, 17 nt, Artificial Sequence
  Synthetic Oligonucleotide; CD80 exon 6; Set C
auaaugucagcuguaau

SEQ ID NO: 57964 - RNA, 19 nt, Artificial Sequence
  Synthetic Oligonucleotide; CD80 exon 6; Set C
aauaaugucagcuguaaug

SEQ ID NO: 57965 - RNA, 33 nt, Artificial Sequence
  Synthetic Oligonucleotide; CD80 exon 6; Set C
ggaaaagaauaaugucagcuguaauguauuucc

SEQ ID NO: 57966 - RNA, 24 nt, Artificial Sequence
  Synthetic Oligonucleotide; CD80 exon 6; Set C
aagaauaaugucagcuguaaugua

SEQ ID NO: 57967 - RNA, 22 nt, Artificial Sequence
  Synthetic Oligonucleotide; CD80 exon 6; Set C
agaauaaugucagcuguaaugu

SEQ ID NO: 57968 - RNA, 30 nt, Artificial Sequence
  Synthetic Oligonucleotide; CD80 exon 6; Set C
gaaaagaauaaugucagcuguaauguauuu

SEQ ID NO: 57969 - RNA, 32 nt, Artificial Sequence
  Synthetic Oligonucleotide; CD80 exon 6; Set C
ggaaaagaauaaugucagcuguaauguauuuc

SEQ ID NO: 57970 - RNA, 16 nt, Artificial Sequence
  Synthetic Oligonucleotide; CD80 exon 6; Set C
auaaugucagcuguaa

SEQ ID NO: 57971 - RNA, 18 nt, Artificial Sequence
  Synthetic Oligonucleotide; CD80 exon 6; Set C
aauaaugucagcuguaau

SEQ ID NO: 57972 - RNA, 20 nt, Artificial Sequence
  Synthetic Oligonucleotide; CD80 exon 6; Set C
gaauaaugucagcuguaaug

SEQ ID NO: 57973 - RNA, 34 nt, Artificial Sequence
  Synthetic Oligonucleotide; CD80 exon 6; Set A
gggaaaagaauaaugucagcuguaauguauuucc

SEQ ID NO: 57974 - RNA, 29 nt, Artificial Sequence
  Synthetic Oligonucleotide; CD80 exon 6; Set C
gaaaagaauaaugucagcuguaauguauu

SEQ ID NO: 57975 - RNA, 23 nt, Artificial Sequence
  Synthetic Oligonucleotide; CD80 exon 6; Set C
aagaauaaugucagcuguaaugu

SEQ ID NO: 57976 - RNA, 33 nt, Artificial Sequence
  Synthetic Oligonucleotide; CD80 exon 6; Set C
gggaaaagaauaaugucagcuguaauguauuuc

SEQ ID NO: 57977 - RNA, 31 nt, Artificial Sequence
  Synthetic Oligonucleotide; CD80 exon 6; Set C
ggaaaagaauaaugucagcuguaauguauuu

SEQ ID NO: 57978 - RNA, 17 nt, Artificial Sequence
  Synthetic Oligonucleotide; CD80 exon 6; Set C
aauaaugucagcuguaa

SEQ ID NO: 57979 - RNA, 19 nt, Artificial Sequence
  Synthetic Oligonucleotide; CD80 exon 6; Set C
gaauaaugucagcuguaau

SEQ ID NO: 57980 - RNA, 21 nt, Artificial Sequence
  Synthetic Oligonucleotide; CD80 exon 6; Set C
agaauaaugucagcuguaaug

SEQ ID NO: 57981 - RNA, 35 nt, Artificial Sequence
  Synthetic Oligonucleotide; CD80 exon 6; Set A
agggaaaagaauaaugucagcuguaauguauuucc

SEQ ID NO: 57982 - RNA, 28 nt, Artificial Sequence
  Synthetic Oligonucleotide; CD80 exon 6; Set C
gaaaagaauaaugucagcuguaauguau

SEQ ID NO: 57983 - RNA, 30 nt, Artificial Sequence
  Synthetic Oligonucleotide; CD80 exon 6; Set C
ggaaaagaauaaugucagcuguaauguauu

SEQ ID NO: 57984 - RNA, 34 nt, Artificial Sequence
  Synthetic Oligonucleotide; CD80 exon 6; Set C
agggaaaagaauaaugucagcuguaauguauuuc

SEQ ID NO: 57985 - RNA, 32 nt, Artificial Sequence
  Synthetic Oligonucleotide; CD80 exon 6; Set C
gggaaaagaauaaugucagcuguaauguauuu

SEQ ID NO: 57986 - RNA, 22 nt, Artificial Sequence
  Synthetic Oligonucleotide; CD80 exon 6; Set C
aagaauaaugucagcuguaaug

SEQ ID NO: 57987 - RNA, 18 nt, Artificial Sequence
  Synthetic Oligonucleotide; CD80 exon 6; Set C
gaauaaugucagcuguaa

SEQ ID NO: 57988 - RNA, 20 nt, Artificial Sequence
  Synthetic Oligonucleotide; CD80 exon 6; Set C
agaauaaugucagcuguaau

SEQ ID NO: 57989 - RNA, 36 nt, Artificial Sequence
  Synthetic Oligonucleotide; CD80 exon 6; Set A
gagggaaaagaauaaugucagcuguaauguauuucc

SEQ ID NO: 57990 - RNA, 27 nt, Artificial Sequence
  Synthetic Oligonucleotide; CD80 exon 6; Set C
gaaaagaauaaugucagcuguaaugua

SEQ ID NO: 57991 - RNA, 31 nt, Artificial Sequence
  Synthetic Oligonucleotide; CD80 exon 6; Set C
gggaaaagaauaaugucagcuguaauguauu

SEQ ID NO: 57992 - RNA, 29 nt, Artificial Sequence
  Synthetic Oligonucleotide; CD80 exon 6; Set C
ggaaaagaauaaugucagcuguaauguau

SEQ ID NO: 57993 - RNA, 33 nt, Artificial Sequence
  Synthetic Oligonucleotide; CD80 exon 6; Set C
agggaaaagaauaaugucagcuguaauguauuu

SEQ ID NO: 57994 - RNA, 23 nt, Artificial Sequence
  Synthetic Oligonucleotide; CD80 exon 6; Set C
aaagaauaaugucagcuguaaug

SEQ ID NO: 57995 - RNA, 21 nt, Artificial Sequence
  Synthetic Oligonucleotide; CD80 exon 6; Set C
aagaauaaugucagcuguaau

SEQ ID NO: 57996 - RNA, 19 nt, Artificial Sequence
  Synthetic Oligonucleotide; CD80 exon 6; Set C
agaauaaugucagcuguaa

SEQ ID NO: 57997 - RNA, 37 nt, Artificial Sequence
  Synthetic Oligonucleotide; CD80 exon 6; Set A
ggagggaaaagaauaaugucagcuguaauguauuucc

SEQ ID NO: 57998 - RNA, 32 nt, Artificial Sequence
  Synthetic Oligonucleotide; CD80 exon 6; Set C
agggaaaagaauaaugucagcuguaauguauu

SEQ ID NO: 57999 - RNA, 30 nt, Artificial Sequence
  Synthetic Oligonucleotide; CD80 exon 6; Set C
gggaaaagaauaaugucagcuguaauguau

SEQ ID NO: 58000 - RNA, 28 nt, Artificial Sequence
  Synthetic Oligonucleotide; CD80 exon 6; Set C
ggaaaagaauaaugucagcuguaaugua

SEQ ID NO: 58001 - RNA, 26 nt, Artificial Sequence
  Synthetic Oligonucleotide; CD80 exon 6; Set C
gaaaagaauaaugucagcuguaaugu

SEQ ID NO: 58002 - RNA, 22 nt, Artificial Sequence
  Synthetic Oligonucleotide; CD80 exon 6; Set C
aaagaauaaugucagcuguaau

SEQ ID NO: 58003 - RNA, 24 nt, Artificial Sequence
  Synthetic Oligonucleotide; CD80 exon 6; Set C
aaaagaauaaugucagcuguaaug

SEQ ID NO: 58004 - RNA, 20 nt, Artificial Sequence
  Synthetic Oligonucleotide; CD80 exon 6; Set C
aagaauaaugucagcuguaa

SEQ ID NO: 58005 - RNA, 38 nt, Artificial Sequence
  Synthetic Oligonucleotide; CD80 exon 6; Set A
uggagggaaaagaauaaugucagcuguaauguauuucc

SEQ ID NO: 58006 - RNA, 31 nt, Artificial Sequence
  Synthetic Oligonucleotide; CD80 exon 6; Set C
agggaaaagaauaaugucagcuguaauguau

SEQ ID NO: 58007 - RNA, 29 nt, Artificial Sequence
  Synthetic Oligonucleotide; CD80 exon 6; Set C
gggaaaagaauaaugucagcuguaaugua

SEQ ID NO: 58008 - RNA, 27 nt, Artificial Sequence
  Synthetic Oligonucleotide; CD80 exon 6; Set C
ggaaaagaauaaugucagcuguaaugu

SEQ ID NO: 58009 - RNA, 21 nt, Artificial Sequence
  Synthetic Oligonucleotide; CD80 exon 6; Set C
aaagaauaaugucagcuguaa

SEQ ID NO: 58010 - RNA, 23 nt, Artificial Sequence
  Synthetic Oligonucleotide; CD80 exon 6; Set C
aaaagaauaaugucagcuguaau

SEQ ID NO: 58011 - RNA, 25 nt, Artificial Sequence
  Synthetic Oligonucleotide; CD80 exon 6; Set C
gaaaagaauaaugucagcuguaaug

SEQ ID NO: 58012 - RNA, 39 nt, Artificial Sequence
  Synthetic Oligonucleotide; CD80 exon 6; Set A
auggagggaaaagaauaaugucagcuguaauguauuucc

SEQ ID NO: 58013 - RNA, 19 nt, Artificial Sequence
  Synthetic Oligonucleotide; CD80 exon 6; Set C
aagaauaaugucagcugua

SEQ ID NO: 58014 - RNA, 30 nt, Artificial Sequence
  Synthetic Oligonucleotide; CD80 exon 6; Set C
agggaaaagaauaaugucagcuguaaugua

SEQ ID NO: 58015 - RNA, 28 nt, Artificial Sequence
  Synthetic Oligonucleotide; CD80 exon 6; Set C
gggaaaagaauaaugucagcuguaaugu

SEQ ID NO: 58016 - RNA, 22 nt, Artificial Sequence
  Synthetic Oligonucleotide; CD80 exon 6; Set C
aaaagaauaaugucagcuguaa

SEQ ID NO: 58017 - RNA, 24 nt, Artificial Sequence
  Synthetic Oligonucleotide; CD80 exon 6; Set C
gaaaagaauaaugucagcuguaau

SEQ ID NO: 58018 - RNA, 26 nt, Artificial Sequence
  Synthetic Oligonucleotide; CD80 exon 6; Set C
ggaaaagaauaaugucagcuguaaug

SEQ ID NO: 58019 - RNA, 40 nt, Artificial Sequence
  Synthetic Oligonucleotide; CD80 exon 6; Set A
uauggagggaaaagaauaaugucagcuguaauguauuucc

SEQ ID NO: 58020 - RNA, 20 nt, Artificial Sequence
  Synthetic Oligonucleotide; CD80 exon 6; Set C
aaagaauaaugucagcugua

SEQ ID NO: 58021 - RNA, 29 nt, Artificial Sequence
  Synthetic Oligonucleotide; CD80 exon 6; Set C
agggaaaagaauaaugucagcuguaaugu

SEQ ID NO: 58022 - RNA, 23 nt, Artificial Sequence
  Synthetic Oligonucleotide; CD80 exon 6; Set C
gaaaagaauaaugucagcuguaa

SEQ ID NO: 58023 - RNA, 27 nt, Artificial Sequence
  Synthetic Oligonucleotide; CD80 exon 6; Set C
gggaaaagaauaaugucagcuguaaug

SEQ ID NO: 58024 - RNA, 25 nt, Artificial Sequence
  Synthetic Oligonucleotide; CD80 exon 6; Set C
ggaaaagaauaaugucagcuguaau

SEQ ID NO: 58025 - RNA, 19 nt, Artificial Sequence
  Synthetic Oligonucleotide; CD80 exon 6; Set C
aaagaauaaugucagcugu

SEQ ID NO: 58026 - RNA, 21 nt, Artificial Sequence
  Synthetic Oligonucleotide; CD80 exon 6; Set C
aaaagaauaaugucagcugua

SEQ ID NO: 58027 - RNA, 30 nt, Artificial Sequence
  Synthetic Oligonucleotide; CD80 exon 6; Set C
gagggaaaagaauaaugucagcuguaaugu

SEQ ID NO: 58028 - RNA, 28 nt, Artificial Sequence
  Synthetic Oligonucleotide; CD80 exon 6; Set C
agggaaaagaauaaugucagcuguaaug

SEQ ID NO: 58029 - RNA, 26 nt, Artificial Sequence
  Synthetic Oligonucleotide; CD80 exon 6; Set C
gggaaaagaauaaugucagcuguaau

SEQ ID NO: 58030 - RNA, 24 nt, Artificial Sequence
  Synthetic Oligonucleotide; CD80 exon 6; Set C
ggaaaagaauaaugucagcuguaa

SEQ ID NO: 58031 - RNA, 20 nt, Artificial Sequence
  Synthetic Oligonucleotide; CD80 exon 6; Set C
aaaagaauaaugucagcugu

SEQ ID NO: 58032 - RNA, 22 nt, Artificial Sequence
  Synthetic Oligonucleotide; CD80 exon 6; Set C
gaaaagaauaaugucagcugua

SEQ ID NO: 58033 - RNA, 31 nt, Artificial Sequence
  Synthetic Oligonucleotide; CD80 exon 6; Set A
ggagggaaaagaauaaugucagcuguaaugu

SEQ ID NO: 58034 - RNA, 29 nt, Artificial Sequence
  Synthetic Oligonucleotide; CD80 exon 6; Set C
gagggaaaagaauaaugucagcuguaaug

SEQ ID NO: 58035 - RNA, 27 nt, Artificial Sequence
  Synthetic Oligonucleotide; CD80 exon 6; Set C
agggaaaagaauaaugucagcuguaau

SEQ ID NO: 58036 - RNA, 25 nt, Artificial Sequence
  Synthetic Oligonucleotide; CD80 exon 6; Set C
gggaaaagaauaaugucagcuguaa

SEQ ID NO: 58037 - RNA, 21 nt, Artificial Sequence
  Synthetic Oligonucleotide; CD80 exon 6; Set C
gaaaagaauaaugucagcugu

SEQ ID NO: 58038 - RNA, 28 nt, Artificial Sequence
  Synthetic Oligonucleotide; CD80 exon 6; Set C
gagggaaaagaauaaugucagcuguaau

SEQ ID NO: 58039 - RNA, 30 nt, Artificial Sequence
  Synthetic Oligonucleotide; CD80 exon 6; Set C
ggagggaaaagaauaaugucagcuguaaug

SEQ ID NO: 58040 - RNA, 26 nt, Artificial Sequence
  Synthetic Oligonucleotide; CD80 exon 6; Set C
agggaaaagaauaaugucagcuguaa

SEQ ID NO: 58041 - RNA, 31 nt, Artificial Sequence
  Synthetic Oligonucleotide; CD80 exon 6; Set C
uggagggaaaagaauaaugucagcuguaaug

SEQ ID NO: 58042 - RNA, 27 nt, Artificial Sequence
  Synthetic Oligonucleotide; CD80 exon 6; Set C
gagggaaaagaauaaugucagcuguaa

SEQ ID NO: 58043 - RNA, 29 nt, Artificial Sequence
  Synthetic Oligonucleotide; CD80 exon 6; Set C
ggagggaaaagaauaaugucagcuguaau

SEQ ID NO: 58044 - RNA, 25 nt, Artificial Sequence
  Synthetic Oligonucleotide; CD80 exon 6; Set C
agggaaaagaauaaugucagcugua

SEQ ID NO: 58045 - RNA, 32 nt, Artificial Sequence
  Synthetic Oligonucleotide; CD80 exon 6; Set C
auggagggaaaagaauaaugucagcuguaaug

SEQ ID NO: 58046 - RNA, 30 nt, Artificial Sequence
  Synthetic Oligonucleotide; CD80 exon 6; Set C
uggagggaaaagaauaaugucagcuguaau

SEQ ID NO: 58047 - RNA, 28 nt, Artificial Sequence
  Synthetic Oligonucleotide; CD80 exon 6; Set C
ggagggaaaagaauaaugucagcuguaa

SEQ ID NO: 58048 - RNA, 24 nt, Artificial Sequence
  Synthetic Oligonucleotide; CD80 exon 6; Set C
agggaaaagaauaaugucagcugu

SEQ ID NO: 58049 - RNA, 26 nt, Artificial Sequence
  Synthetic Oligonucleotide; CD80 exon 6; Set C
gagggaaaagaauaaugucagcugua

SEQ ID NO: 58050 - RNA, 33 nt, Artificial Sequence
  Synthetic Oligonucleotide; CD80 exon 6; Set A
uauggagggaaaagaauaaugucagcuguaaug

SEQ ID NO: 58051 - RNA, 31 nt, Artificial Sequence
  Synthetic Oligonucleotide; CD80 exon 6; Set C
auggagggaaaagaauaaugucagcuguaau

SEQ ID NO: 58052 - RNA, 29 nt, Artificial Sequence
  Synthetic Oligonucleotide; CD80 exon 6; Set C
uggagggaaaagaauaaugucagcuguaa

SEQ ID NO: 58053 - RNA, 25 nt, Artificial Sequence
  Synthetic Oligonucleotide; CD80 exon 6; Set C
gagggaaaagaauaaugucagcugu

SEQ ID NO: 58054 - RNA, 27 nt, Artificial Sequence
  Synthetic Oligonucleotide; CD80 exon 6; Set C
ggagggaaaagaauaaugucagcugua

SEQ ID NO: 58055 - RNA, 32 nt, Artificial Sequence
  Synthetic Oligonucleotide; CD80 exon 6; Set C
uauggagggaaaagaauaaugucagcuguaau

SEQ ID NO: 58056 - RNA, 30 nt, Artificial Sequence
  Synthetic Oligonucleotide; CD80 exon 6; Set C
auggagggaaaagaauaaugucagcuguaa

SEQ ID NO: 58057 - RNA, 26 nt, Artificial Sequence
  Synthetic Oligonucleotide; CD80 exon 6; Set C
ggagggaaaagaauaaugucagcugu

SEQ ID NO: 58058 - RNA, 28 nt, Artificial Sequence
  Synthetic Oligonucleotide; CD80 exon 6; Set C
uggagggaaaagaauaaugucagcugua

SEQ ID NO: 58059 - RNA, 31 nt, Artificial Sequence
  Synthetic Oligonucleotide; CD80 exon 6; Set C
uauggagggaaaagaauaaugucagcuguaa

SEQ ID NO: 58060 - RNA, 27 nt, Artificial Sequence
  Synthetic Oligonucleotide; CD80 exon 6; Set C
uggagggaaaagaauaaugucagcugu

SEQ ID NO: 58061 - RNA, 29 nt, Artificial Sequence
  Synthetic Oligonucleotide; CD80 exon 6; Set C
auggagggaaaagaauaaugucagcugua

SEQ ID NO: 58062 - RNA, 40 nt, Artificial Sequence
  Synthetic Oligonucleotide; CD80 exon 6; Set A
uuggcuauggagggaaaagaauaaugucagcuguaaugua

SEQ ID NO: 58063 - RNA, 28 nt, Artificial Sequence
  Synthetic Oligonucleotide; CD80 exon 6; Set C
auggagggaaaagaauaaugucagcugu

SEQ ID NO: 58064 - RNA, 30 nt, Artificial Sequence
  Synthetic Oligonucleotide; CD80 exon 6; Set A
uauggagggaaaagaauaaugucagcugua

SEQ ID NO: 58065 - RNA, 39 nt, Artificial Sequence
  Synthetic Oligonucleotide; CD80 exon 6; Set A
uuggcuauggagggaaaagaauaaugucagcuguaaugu

SEQ ID NO: 58066 - RNA, 29 nt, Artificial Sequence
  Synthetic Oligonucleotide; CD80 exon 6; Set C
uauggagggaaaagaauaaugucagcugu

SEQ ID NO: 58067 - RNA, 38 nt, Artificial Sequence
  Synthetic Oligonucleotide; CD80 exon 6; Set A
uuggcuauggagggaaaagaauaaugucagcuguaaug

SEQ ID NO: 58068 - RNA, 37 nt, Artificial Sequence
  Synthetic Oligonucleotide; CD80 exon 6; Set A
uuggcuauggagggaaaagaauaaugucagcuguaau

SEQ ID NO: 58069 - RNA, 36 nt, Artificial Sequence
  Synthetic Oligonucleotide; CD80 exon 6; Set A
uuggcuauggagggaaaagaauaaugucagcuguaa

SEQ ID NO: 58070 - RNA, 35 nt, Artificial Sequence
  Synthetic Oligonucleotide; CD80 exon 6; Set A
uuggcuauggagggaaaagaauaaugucagcugua

SEQ ID NO: 58071 - RNA, 34 nt, Artificial Sequence
  Synthetic Oligonucleotide; CD80 exon 6; Set A
uuggcuauggagggaaaagaauaaugucagcugu

SEQ ID NO: 58072 - RNA, 25 nt, Artificial Sequence
  Synthetic Oligonucleotide; CD80 exon 6; Set C
uggcuauggagggaaaagaauaaug

SEQ ID NO: 58073 - RNA, 24 nt, Artificial Sequence
  Synthetic Oligonucleotide; CD80 exon 6; Set C
uggcuauggagggaaaagaauaau

SEQ ID NO: 58074 - RNA, 23 nt, Artificial Sequence
  Synthetic Oligonucleotide; CD80 exon 6; Set C
uggcuauggagggaaaagaauaa

SEQ ID NO: 58075 - RNA, 22 nt, Artificial Sequence
  Synthetic Oligonucleotide; CD80 exon 6; Set C
uggcuauggagggaaaagaaua

SEQ ID NO: 58076 - RNA, 32 nt, Artificial Sequence
  Synthetic Oligonucleotide; CD80 exon 6; Set A
cuugcuuggcuauggagggaaaagaauaaugu

SEQ ID NO: 58077 - RNA, 31 nt, Artificial Sequence
  Synthetic Oligonucleotide; CD80 exon 6; Set A
cuugcuuggcuauggagggaaaagaauaaug

SEQ ID NO: 58078 - RNA, 33 nt, Artificial Sequence
  Synthetic Oligonucleotide; CD80 exon 6; Set A
ucuugcuuggcuauggagggaaaagaauaaugu

SEQ ID NO: 58079 - RNA, 21 nt, Artificial Sequence
  Synthetic Oligonucleotide; CD80 exon 6; Set C
uuggcuauggagggaaaagaa

SEQ ID NO: 58080 - RNA, 30 nt, Artificial Sequence
  Synthetic Oligonucleotide; CD80 exon 6; Set A
cuugcuuggcuauggagggaaaagaauaau

SEQ ID NO: 58081 - RNA, 32 nt, Artificial Sequence
  Synthetic Oligonucleotide; CD80 exon 6; Set A
ucuugcuuggcuauggagggaaaagaauaaug

SEQ ID NO: 58082 - RNA, 20 nt, Artificial Sequence
  Synthetic Oligonucleotide; CD80 exon 6; Set C
uuggcuauggagggaaaaga

SEQ ID NO: 58083 - RNA, 29 nt, Artificial Sequence
  Synthetic Oligonucleotide; CD80 exon 6; Set A
cuugcuuggcuauggagggaaaagaauaa

SEQ ID NO: 58084 - RNA, 31 nt, Artificial Sequence
  Synthetic Oligonucleotide; CD80 exon 6; Set A
ucuugcuuggcuauggagggaaaagaauaau

SEQ ID NO: 58085 - RNA, 19 nt, Artificial Sequence
  Synthetic Oligonucleotide; CD80 exon 6; Set C
uuggcuauggagggaaaag

SEQ ID NO: 58086 - RNA, 30 nt, Artificial Sequence
  Synthetic Oligonucleotide; CD80 exon 6; Set A
ucuugcuuggcuauggagggaaaagaauaa

SEQ ID NO: 58087 - RNA, 28 nt, Artificial Sequence
  Synthetic Oligonucleotide; CD80 exon 6; Set A
cuugcuuggcuauggagggaaaagaaua

SEQ ID NO: 58088 - RNA, 29 nt, Artificial Sequence
  Synthetic Oligonucleotide; CD80 exon 6; Set A
ucuugcuuggcuauggagggaaaagaaua

SEQ ID NO: 58089 - RNA, 27 nt, Artificial Sequence
  Synthetic Oligonucleotide; CD80 exon 6; Set A
cuugcuuggcuauggagggaaaagaau

SEQ ID NO: 58090 - RNA, 28 nt, Artificial Sequence
  Synthetic Oligonucleotide; CD80 exon 6; Set A
ucuugcuuggcuauggagggaaaagaau

SEQ ID NO: 58091 - RNA, 38 nt, Artificial Sequence
  Synthetic Oligonucleotide; CD80 exon 6; Set A
aaugcucuugcuuggcuauggagggaaaagaauaaugu

SEQ ID NO: 58092 - RNA, 26 nt, Artificial Sequence
  Synthetic Oligonucleotide; CD80 exon 6; Set A
cuugcuuggcuauggagggaaaagaa

SEQ ID NO: 58093 - RNA, 16 nt, Artificial Sequence
  Synthetic Oligonucleotide; CD80 exon 6; Set C
uuggcuauggagggaa

SEQ ID NO: 58094 - RNA, 37 nt, Artificial Sequence
  Synthetic Oligonucleotide; CD80 exon 6; Set A
aaugcucuugcuuggcuauggagggaaaagaauaaug

SEQ ID NO: 58095 - RNA, 39 nt, Artificial Sequence
  Synthetic Oligonucleotide; CD80 exon 6; Set A
aaaugcucuugcuuggcuauggagggaaaagaauaaugu

SEQ ID NO: 58096 - RNA, 27 nt, Artificial Sequence
  Synthetic Oligonucleotide; CD80 exon 6; Set A
ucuugcuuggcuauggagggaaaagaa

SEQ ID NO: 58097 - RNA, 25 nt, Artificial Sequence
  Synthetic Oligonucleotide; CD80 exon 6; Set A
cuugcuuggcuauggagggaaaaga

SEQ ID NO: 58098 - RNA, 15 nt, Artificial Sequence
  Synthetic Oligonucleotide; CD80 exon 6; Set C
uuggcuauggaggga

SEQ ID NO: 58099 - RNA, 36 nt, Artificial Sequence
  Synthetic Oligonucleotide; CD80 exon 6; Set A
aaugcucuugcuuggcuauggagggaaaagaauaau

SEQ ID NO: 58100 - RNA, 38 nt, Artificial Sequence
  Synthetic Oligonucleotide; CD80 exon 6; Set A
aaaugcucuugcuuggcuauggagggaaaagaauaaug

SEQ ID NO: 58101 - RNA, 24 nt, Artificial Sequence
  Synthetic Oligonucleotide; CD80 exon 6; Set A
cuugcuuggcuauggagggaaaag

SEQ ID NO: 58102 - RNA, 40 nt, Artificial Sequence
  Synthetic Oligonucleotide; CD80 exon 6; Set A
aaaaugcucuugcuuggcuauggagggaaaagaauaaugu

SEQ ID NO: 58103 - RNA, 26 nt, Artificial Sequence
  Synthetic Oligonucleotide; CD80 exon 6; Set A
ucuugcuuggcuauggagggaaaaga

SEQ ID NO: 58104 - RNA, 37 nt, Artificial Sequence
  Synthetic Oligonucleotide; CD80 exon 6; Set A
aaaugcucuugcuuggcuauggagggaaaagaauaau

SEQ ID NO: 58105 - RNA, 35 nt, Artificial Sequence
  Synthetic Oligonucleotide; CD80 exon 6; Set A
aaugcucuugcuuggcuauggagggaaaagaauaa

SEQ ID NO: 58106 - RNA, 39 nt, Artificial Sequence
  Synthetic Oligonucleotide; CD80 exon 6; Set A
aaaaugcucuugcuuggcuauggagggaaaagaauaaug

SEQ ID NO: 58107 - RNA, 23 nt, Artificial Sequence
  Synthetic Oligonucleotide; CD80 exon 6; Set A
cuugcuuggcuauggagggaaaa

SEQ ID NO: 58108 - RNA, 25 nt, Artificial Sequence
  Synthetic Oligonucleotide; CD80 exon 6; Set A
ucuugcuuggcuauggagggaaaag

SEQ ID NO: 58109 - RNA, 38 nt, Artificial Sequence
  Synthetic Oligonucleotide; CD80 exon 6; Set A
aaaaugcucuugcuuggcuauggagggaaaagaauaau

SEQ ID NO: 58110 - RNA, 36 nt, Artificial Sequence
  Synthetic Oligonucleotide; CD80 exon 6; Set A
aaaugcucuugcuuggcuauggagggaaaagaauaa

SEQ ID NO: 58111 - RNA, 40 nt, Artificial Sequence
  Synthetic Oligonucleotide; CD80 exon 6; Set A
gaaaaugcucuugcuuggcuauggagggaaaagaauaaug

SEQ ID NO: 58112 - RNA, 34 nt, Artificial Sequence
  Synthetic Oligonucleotide; CD80 exon 6; Set A
aaugcucuugcuuggcuauggagggaaaagaaua

SEQ ID NO: 58113 - RNA, 24 nt, Artificial Sequence
  Synthetic Oligonucleotide; CD80 exon 6; Set A
ucuugcuuggcuauggagggaaaa

SEQ ID NO: 58114 - RNA, 22 nt, Artificial Sequence
  Synthetic Oligonucleotide; CD80 exon 6; Set A
cuugcuuggcuauggagggaaa

SEQ ID NO: 58115 - RNA, 39 nt, Artificial Sequence
  Synthetic Oligonucleotide; CD80 exon 6; Set A
gaaaaugcucuugcuuggcuauggagggaaaagaauaau

SEQ ID NO: 58116 - RNA, 37 nt, Artificial Sequence
  Synthetic Oligonucleotide; CD80 exon 6; Set A
aaaaugcucuugcuuggcuauggagggaaaagaauaa

SEQ ID NO: 58117 - RNA, 35 nt, Artificial Sequence
  Synthetic Oligonucleotide; CD80 exon 6; Set A
aaaugcucuugcuuggcuauggagggaaaagaaua

SEQ ID NO: 58118 - RNA, 23 nt, Artificial Sequence
  Synthetic Oligonucleotide; CD80 exon 6; Set A
ucuugcuuggcuauggagggaaa

SEQ ID NO: 58119 - RNA, 33 nt, Artificial Sequence
  Synthetic Oligonucleotide; CD80 exon 6; Set A
aaugcucuugcuuggcuauggagggaaaagaau

SEQ ID NO: 58120 - RNA, 21 nt, Artificial Sequence
  Synthetic Oligonucleotide; CD80 exon 6; Set A
cuugcuuggcuauggagggaa

SEQ ID NO: 58121 - RNA, 38 nt, Artificial Sequence
  Synthetic Oligonucleotide; CD80 exon 6; Set A
gaaaaugcucuugcuuggcuauggagggaaaagaauaa

SEQ ID NO: 58122 - RNA, 40 nt, Artificial Sequence
  Synthetic Oligonucleotide; CD80 exon 6; Set A
ggaaaaugcucuugcuuggcuauggagggaaaagaauaau

SEQ ID NO: 58123 - RNA, 36 nt, Artificial Sequence
  Synthetic Oligonucleotide; CD80 exon 6; Set A
aaaaugcucuugcuuggcuauggagggaaaagaaua

SEQ ID NO: 58124 - RNA, 34 nt, Artificial Sequence
  Synthetic Oligonucleotide; CD80 exon 6; Set A
aaaugcucuugcuuggcuauggagggaaaagaau

SEQ ID NO: 58125 - RNA, 32 nt, Artificial Sequence
  Synthetic Oligonucleotide; CD80 exon 6; Set A
aaugcucuugcuuggcuauggagggaaaagaa

SEQ ID NO: 58126 - RNA, 22 nt, Artificial Sequence
  Synthetic Oligonucleotide; CD80 exon 6; Set A
ucuugcuuggcuauggagggaa

SEQ ID NO: 58127 - RNA, 20 nt, Artificial Sequence
  Synthetic Oligonucleotide; CD80 exon 6; Set A
cuugcuuggcuauggaggga

SEQ ID NO: 58128 - RNA, 39 nt, Artificial Sequence
  Synthetic Oligonucleotide; CD80 exon 6; Set A
ggaaaaugcucuugcuuggcuauggagggaaaagaauaa

SEQ ID NO: 58129 - RNA, 37 nt, Artificial Sequence
  Synthetic Oligonucleotide; CD80 exon 6; Set A
gaaaaugcucuugcuuggcuauggagggaaaagaaua

SEQ ID NO: 58130 - RNA, 35 nt, Artificial Sequence
  Synthetic Oligonucleotide; CD80 exon 6; Set A
aaaaugcucuugcuuggcuauggagggaaaagaau

SEQ ID NO: 58131 - RNA, 33 nt, Artificial Sequence
  Synthetic Oligonucleotide; CD80 exon 6; Set A
aaaugcucuugcuuggcuauggagggaaaagaa

SEQ ID NO: 58132 - RNA, 31 nt, Artificial Sequence
  Synthetic Oligonucleotide; CD80 exon 6; Set A
aaugcucuugcuuggcuauggagggaaaaga

SEQ ID NO: 58133 - RNA, 40 nt, Artificial Sequence
  Synthetic Oligonucleotide; CD80 exon 6; Set A
aggaaaaugcucuugcuuggcuauggagggaaaagaauaa

SEQ ID NO: 58134 - RNA, 38 nt, Artificial Sequence
  Synthetic Oligonucleotide; CD80 exon 6; Set A
ggaaaaugcucuugcuuggcuauggagggaaaagaaua

SEQ ID NO: 58135 - RNA, 30 nt, Artificial Sequence
  Synthetic Oligonucleotide; CD80 exon 6; Set A
aaugcucuugcuuggcuauggagggaaaag

SEQ ID NO: 58136 - RNA, 36 nt, Artificial Sequence
  Synthetic Oligonucleotide; CD80 exon 6; Set A
gaaaaugcucuugcuuggcuauggagggaaaagaau

SEQ ID NO: 58137 - RNA, 34 nt, Artificial Sequence
  Synthetic Oligonucleotide; CD80 exon 6; Set A
aaaaugcucuugcuuggcuauggagggaaaagaa

SEQ ID NO: 58138 - RNA, 32 nt, Artificial Sequence
  Synthetic Oligonucleotide; CD80 exon 6; Set A
aaaugcucuugcuuggcuauggagggaaaaga

SEQ ID NO: 58139 - RNA, 18 nt, Artificial Sequence
  Synthetic Oligonucleotide; CD80 exon 6; Set C
cuugcuuggcuauggagg

SEQ ID NO: 58140 - RNA, 39 nt, Artificial Sequence
  Synthetic Oligonucleotide; CD80 exon 6; Set A
aggaaaaugcucuugcuuggcuauggagggaaaagaaua

SEQ ID NO: 58141 - RNA, 29 nt, Artificial Sequence
  Synthetic Oligonucleotide; CD80 exon 6; Set A
aaugcucuugcuuggcuauggagggaaaa

SEQ ID NO: 58142 - RNA, 31 nt, Artificial Sequence
  Synthetic Oligonucleotide; CD80 exon 6; Set A
aaaugcucuugcuuggcuauggagggaaaag

SEQ ID NO: 58143 - RNA, 35 nt, Artificial Sequence
  Synthetic Oligonucleotide; CD80 exon 6; Set A
gaaaaugcucuugcuuggcuauggagggaaaagaa

SEQ ID NO: 58144 - RNA, 17 nt, Artificial Sequence
  Synthetic Oligonucleotide; CD80 exon 6; Set C
cuugcuuggcuauggag

SEQ ID NO: 58145 - RNA, 33 nt, Artificial Sequence
  Synthetic Oligonucleotide; CD80 exon 6; Set A
aaaaugcucuugcuuggcuauggagggaaaaga

SEQ ID NO: 58146 - RNA, 19 nt, Artificial Sequence
  Synthetic Oligonucleotide; CD80 exon 6; Set C
ucuugcuuggcuauggagg

SEQ ID NO: 58147 - RNA, 30 nt, Artificial Sequence
  Synthetic Oligonucleotide; CD80 exon 6; Set A
aaaugcucuugcuuggcuauggagggaaaa

SEQ ID NO: 58148 - RNA, 28 nt, Artificial Sequence
  Synthetic Oligonucleotide; CD80 exon 6; Set A
aaugcucuugcuuggcuauggagggaaa

SEQ ID NO: 58149 - RNA, 32 nt, Artificial Sequence
  Synthetic Oligonucleotide; CD80 exon 6; Set A
aaaaugcucuugcuuggcuauggagggaaaag

SEQ ID NO: 58150 - RNA, 18 nt, Artificial Sequence
  Synthetic Oligonucleotide; CD80 exon 6; Set C
ucuugcuuggcuauggag

SEQ ID NO: 58151 - RNA, 16 nt, Artificial Sequence
  Synthetic Oligonucleotide; CD80 exon 6; Set C
cuugcuuggcuaugga

SEQ ID NO: 58152 - RNA, 34 nt, Artificial Sequence
  Synthetic Oligonucleotide; CD80 exon 6; Set A
gaaaaugcucuugcuuggcuauggagggaaaaga

SEQ ID NO: 58153 - RNA, 31 nt, Artificial Sequence
  Synthetic Oligonucleotide; CD80 exon 6; Set A
aaaaugcucuugcuuggcuauggagggaaaa

SEQ ID NO: 58154 - RNA, 29 nt, Artificial Sequence
  Synthetic Oligonucleotide; CD80 exon 6; Set A
aaaugcucuugcuuggcuauggagggaaa

SEQ ID NO: 58155 - RNA, 33 nt, Artificial Sequence
  Synthetic Oligonucleotide; CD80 exon 6; Set A
gaaaaugcucuugcuuggcuauggagggaaaag

SEQ ID NO: 58156 - RNA, 15 nt, Artificial Sequence
  Synthetic Oligonucleotide; CD80 exon 6; Set C
cuugcuuggcuaugg

SEQ ID NO: 58157 - RNA, 17 nt, Artificial Sequence
  Synthetic Oligonucleotide; CD80 exon 6; Set C
ucuugcuuggcuaugga

SEQ ID NO: 58158 - RNA, 32 nt, Artificial Sequence
  Synthetic Oligonucleotide; CD80 exon 6; Set A
gaaaaugcucuugcuuggcuauggagggaaaa

SEQ ID NO: 58159 - RNA, 30 nt, Artificial Sequence
  Synthetic Oligonucleotide; CD80 exon 6; Set A
aaaaugcucuugcuuggcuauggagggaaa

SEQ ID NO: 58160 - RNA, 16 nt, Artificial Sequence
  Synthetic Oligonucleotide; CD80 exon 6; Set C
ucuugcuuggcuaugg

SEQ ID NO: 58161 - RNA, 28 nt, Artificial Sequence
  Synthetic Oligonucleotide; CD80 exon 6; Set A
aaaugcucuugcuuggcuauggagggaa

SEQ ID NO: 58162 - RNA, 31 nt, Artificial Sequence
  Synthetic Oligonucleotide; CD80 exon 6; Set A
gaaaaugcucuugcuuggcuauggagggaaa

SEQ ID NO: 58163 - RNA, 15 nt, Artificial Sequence
  Synthetic Oligonucleotide; CD80 exon 6; Set C
ucuugcuuggcuaug

SEQ ID NO: 58164 - RNA, 29 nt, Artificial Sequence
  Synthetic Oligonucleotide; CD80 exon 6; Set A
aaaaugcucuugcuuggcuauggagggaa

SEQ ID NO: 58165 - RNA, 30 nt, Artificial Sequence
  Synthetic Oligonucleotide; CD80 exon 6; Set A
gaaaaugcucuugcuuggcuauggagggaa

SEQ ID NO: 58166 - RNA, 24 nt, Artificial Sequence
  Synthetic Oligonucleotide; CD80 exon 6; Set A
aaaugcucuugcuuggcuauggag

SEQ ID NO: 58167 - RNA, 40 nt, Artificial Sequence
  Synthetic Oligonucleotide; CD80 exon 6; Set C
uaucaggaaaaugcucuugcuuggcuauggagggaaaaga

SEQ ID NO: 58168 - RNA, 26 nt, Artificial Sequence
  Synthetic Oligonucleotide; CD80 exon 6; Set A
aaaaugcucuugcuuggcuauggagg

SEQ ID NO: 58169 - RNA, 39 nt, Artificial Sequence
  Synthetic Oligonucleotide; CD80 exon 6; Set C
uaucaggaaaaugcucuugcuuggcuauggagggaaaag

SEQ ID NO: 58170 - RNA, 25 nt, Artificial Sequence
  Synthetic Oligonucleotide; CD80 exon 6; Set A
aaaaugcucuugcuuggcuauggag

SEQ ID NO: 58171 - RNA, 27 nt, Artificial Sequence
  Synthetic Oligonucleotide; CD80 exon 6; Set A
gaaaaugcucuugcuuggcuauggagg

SEQ ID NO: 58172 - RNA, 38 nt, Artificial Sequence
  Synthetic Oligonucleotide; CD80 exon 6; Set C
uaucaggaaaaugcucuugcuuggcuauggagggaaaa

SEQ ID NO: 58173 - RNA, 40 nt, Artificial Sequence
  Synthetic Oligonucleotide; CD80 exon 6; Set C
uuaucaggaaaaugcucuugcuuggcuauggagggaaaag

SEQ ID NO: 58174 - RNA, 26 nt, Artificial Sequence
  Synthetic Oligonucleotide; CD80 exon 6; Set A
gaaaaugcucuugcuuggcuauggag

SEQ ID NO: 58175 - RNA, 24 nt, Artificial Sequence
  Synthetic Oligonucleotide; CD80 exon 6; Set A
aaaaugcucuugcuuggcuaugga

SEQ ID NO: 58176 - RNA, 39 nt, Artificial Sequence
  Synthetic Oligonucleotide; CD80 exon 6; Set C
uuaucaggaaaaugcucuugcuuggcuauggagggaaaa

SEQ ID NO: 58177 - RNA, 37 nt, Artificial Sequence
  Synthetic Oligonucleotide; CD80 exon 6; Set C
uaucaggaaaaugcucuugcuuggcuauggagggaaa

SEQ ID NO: 58178 - RNA, 25 nt, Artificial Sequence
  Synthetic Oligonucleotide; CD80 exon 6; Set A
gaaaaugcucuugcuuggcuaugga

SEQ ID NO: 58179 - RNA, 38 nt, Artificial Sequence
  Synthetic Oligonucleotide; CD80 exon 6; Set C
uuaucaggaaaaugcucuugcuuggcuauggagggaaa

SEQ ID NO: 58180 - RNA, 24 nt, Artificial Sequence
  Synthetic Oligonucleotide; CD80 exon 6; Set A
gaaaaugcucuugcuuggcuaugg

SEQ ID NO: 58181 - RNA, 36 nt, Artificial Sequence
  Synthetic Oligonucleotide; CD80 exon 6; Set C
uaucaggaaaaugcucuugcuuggcuauggagggaa

SEQ ID NO: 58182 - RNA, 23 nt, Artificial Sequence
  Synthetic Oligonucleotide; CD80 exon 6; Set C
gaaaaugcucuugcuuggcuaug

SEQ ID NO: 58183 - RNA, 37 nt, Artificial Sequence
  Synthetic Oligonucleotide; CD80 exon 6; Set C
uuaucaggaaaaugcucuugcuuggcuauggagggaa

SEQ ID NO: 58184 - RNA, 35 nt, Artificial Sequence
  Synthetic Oligonucleotide; CD80 exon 6; Set C
uaucaggaaaaugcucuugcuuggcuauggaggga

SEQ ID NO: 58185 - RNA, 34 nt, Artificial Sequence
  Synthetic Oligonucleotide; CD80 exon 6; Set C
uaucaggaaaaugcucuugcuuggcuauggaggg

SEQ ID NO: 58186 - RNA, 36 nt, Artificial Sequence
  Synthetic Oligonucleotide; CD80 exon 6; Set C
uuaucaggaaaaugcucuugcuuggcuauggaggga

SEQ ID NO: 58187 - RNA, 33 nt, Artificial Sequence
  Synthetic Oligonucleotide; CD80 exon 6; Set A
uaucaggaaaaugcucuugcuuggcuauggagg

SEQ ID NO: 58188 - RNA, 35 nt, Artificial Sequence
  Synthetic Oligonucleotide; CD80 exon 6; Set C
uuaucaggaaaaugcucuugcuuggcuauggaggg

SEQ ID NO: 58189 - RNA, 32 nt, Artificial Sequence
  Synthetic Oligonucleotide; CD80 exon 6; Set A
uaucaggaaaaugcucuugcuuggcuauggag

SEQ ID NO: 58190 - RNA, 34 nt, Artificial Sequence
  Synthetic Oligonucleotide; CD80 exon 6; Set A
uuaucaggaaaaugcucuugcuuggcuauggagg

SEQ ID NO: 58191 - RNA, 33 nt, Artificial Sequence
  Synthetic Oligonucleotide; CD80 exon 6; Set A
uuaucaggaaaaugcucuugcuuggcuauggag

SEQ ID NO: 58192 - RNA, 31 nt, Artificial Sequence
  Synthetic Oligonucleotide; CD80 exon 6; Set A
uaucaggaaaaugcucuugcuuggcuaugga

SEQ ID NO: 58193 - RNA, 30 nt, Artificial Sequence
  Synthetic Oligonucleotide; CD80 exon 6; Set A
uaucaggaaaaugcucuugcuuggcuaugg

SEQ ID NO: 58194 - RNA, 32 nt, Artificial Sequence
  Synthetic Oligonucleotide; CD80 exon 6; Set A
uuaucaggaaaaugcucuugcuuggcuaugga

SEQ ID NO: 58195 - RNA, 29 nt, Artificial Sequence
  Synthetic Oligonucleotide; CD80 exon 6; Set A
uaucaggaaaaugcucuugcuuggcuaug

SEQ ID NO: 58196 - RNA, 31 nt, Artificial Sequence
  Synthetic Oligonucleotide; CD80 exon 6; Set A
uuaucaggaaaaugcucuugcuuggcuaugg

SEQ ID NO: 58197 - RNA, 30 nt, Artificial Sequence
  Synthetic Oligonucleotide; CD80 exon 6; Set A
uuaucaggaaaaugcucuugcuuggcuaug

SEQ ID NO: 58198 - RNA, 28 nt, Artificial Sequence
  Synthetic Oligonucleotide; CD80 exon 6; Set A
uaucaggaaaaugcucuugcuuggcuau

SEQ ID NO: 58199 - RNA, 29 nt, Artificial Sequence
  Synthetic Oligonucleotide; CD80 exon 6; Set A
uuaucaggaaaaugcucuugcuuggcuau

SEQ ID NO: 58200 - RNA, 23 nt, Artificial Sequence
  Synthetic Oligonucleotide; CD80 exon 6; Set C
uaucaggaaaaugcucuugcuug

SEQ ID NO: 58201 - RNA, 24 nt, Artificial Sequence
  Synthetic Oligonucleotide; CD80 exon 6; Set C
uuaucaggaaaaugcucuugcuug

SEQ ID NO: 58202 - RNA, 18 nt, Artificial Sequence
  Synthetic Oligonucleotide; CD80 exon 6; Set C
uaucaggaaaaugcucuu

SEQ ID NO: 58203 - RNA, 19 nt, Artificial Sequence
  Synthetic Oligonucleotide; CD80 exon 6; Set C
uuaucaggaaaaugcucuu

SEQ ID NO: 58204 - RNA, 17 nt, Artificial Sequence
  Synthetic Oligonucleotide; CD80 exon 6; Set C
uaucaggaaaaugcucu

SEQ ID NO: 58205 - RNA, 18 nt, Artificial Sequence
  Synthetic Oligonucleotide; CD80 exon 6; Set C
uuaucaggaaaaugcucu

SEQ ID NO: 58206 - RNA, 17 nt, Artificial Sequence
  Synthetic Oligonucleotide; CD80 exon 6; Set C
uuuacugagauuaaggu

SEQ ID NO: 58207 - RNA, 16 nt, Artificial Sequence
  Synthetic Oligonucleotide; CD80 exon 6; Set C
uuuacugagauuaagg

SEQ ID NO: 58208 - RNA, 15 nt, Artificial Sequence
  Synthetic Oligonucleotide; CD80 exon 6; Set C
uuuacugagauuaag

SEQ ID NO: 58209 - RNA, 20 nt, Artificial Sequence
  Synthetic Oligonucleotide; CD80 exon 6; Set C
uuccauuuacugagauuaag

SEQ ID NO: 58210 - RNA, 21 nt, Artificial Sequence
  Synthetic Oligonucleotide; CD80 exon 6; Set C
auuccauuuacugagauuaag

SEQ ID NO: 58211 - RNA, 22 nt, Artificial Sequence
  Synthetic Oligonucleotide; CD80 exon 6; Set C
aauuccauuuacugagauuaag

SEQ ID NO: 58212 - RNA, 23 nt, Artificial Sequence
  Synthetic Oligonucleotide; CD80 exon 6; Set C
aaauuccauuuacugagauuaag

SEQ ID NO: 58213 - RNA, 24 nt, Artificial Sequence
  Synthetic Oligonucleotide; CD80 exon 6; Set C
aaaauuccauuuacugagauuaag

SEQ ID NO: 58214 - RNA, 25 nt, Artificial Sequence
  Synthetic Oligonucleotide; CD80 exon 6; Set C
aaaaauuccauuuacugagauuaag

SEQ ID NO: 58215 - RNA, 15 nt, Artificial Sequence
  Synthetic Oligonucleotide; CD80 exon 6; Set C
aaaaauuccauuuac

SEQ ID NO: 58216 - RNA, 35 nt, Artificial Sequence
  Synthetic Oligonucleotide; CD80 exon 6; Set A
aguaggucaggcagcauaucacaaaaauuccauuu

SEQ ID NO: 58217 - RNA, 19 nt, Artificial Sequence
  Synthetic Oligonucleotide; CD80 exon 6; Set C
aguuugaucuuccagaauu

SEQ ID NO: 58218 - RNA, 16 nt, Artificial Sequence
  Synthetic Oligonucleotide; CD80 exon 6; Set C
guauuuccuacugccu

SEQ ID NO: 58219 - RNA, 17 nt, Artificial Sequence
  Synthetic Oligonucleotide; CD80 exon 6; Set C
uguauuuccuacugccu

SEQ ID NO: 58220 - RNA, 15 nt, Artificial Sequence
  Synthetic Oligonucleotide; CD80 exon 6; Set C
uguauuuccuacugc

SEQ ID NO: 58221 - RNA, 19 nt, Artificial Sequence
  Synthetic Oligonucleotide; CD80 exon 6; Set C
aauguauuuccuacugccu

SEQ ID NO: 58222 - RNA, 16 nt, Artificial Sequence
  Synthetic Oligonucleotide; CD80 exon 6; Set C
auguauuuccuacugc

SEQ ID NO: 58223 - RNA, 20 nt, Artificial Sequence
  Synthetic Oligonucleotide; CD80 exon 6; Set C
uaauguauuuccuacugccu

SEQ ID NO: 58224 - RNA, 17 nt, Artificial Sequence
  Synthetic Oligonucleotide; CD80 exon 6; Set C
aauguauuuccuacugc

SEQ ID NO: 58225 - RNA, 18 nt, Artificial Sequence
  Synthetic Oligonucleotide; CD80 exon 6; Set C
uaauguauuuccuacugc

SEQ ID NO: 58226 - RNA, 19 nt, Artificial Sequence
  Synthetic Oligonucleotide; CD80 exon 6; Set C
guaauguauuuccuacugc

SEQ ID NO: 58227 - RNA, 20 nt, Artificial Sequence
  Synthetic Oligonucleotide; CD80 exon 6; Set C
uguaauguauuuccuacugc

SEQ ID NO: 58228 - RNA, 27 nt, Artificial Sequence
  Synthetic Oligonucleotide; CD80 exon 6; Set A
ugucagcuguaauguauuuccuacugc

SEQ ID NO: 58229 - RNA, 28 nt, Artificial Sequence
  Synthetic Oligonucleotide; CD80 exon 6; Set A
augucagcuguaauguauuuccuacugc

SEQ ID NO: 58230 - RNA, 29 nt, Artificial Sequence
  Synthetic Oligonucleotide; CD80 exon 6; Set A
aaugucagcuguaauguauuuccuacugc

SEQ ID NO: 58231 - RNA, 30 nt, Artificial Sequence
  Synthetic Oligonucleotide; CD80 exon 6; Set A
uaaugucagcuguaauguauuuccuacugc

SEQ ID NO: 58232 - RNA, 31 nt, Artificial Sequence
  Synthetic Oligonucleotide; CD80 exon 6; Set A
auaaugucagcuguaauguauuuccuacugc

SEQ ID NO: 58233 - RNA, 32 nt, Artificial Sequence
  Synthetic Oligonucleotide; CD80 exon 6; Set A
aauaaugucagcuguaauguauuuccuacugc

SEQ ID NO: 58234 - RNA, 19 nt, Artificial Sequence
  Synthetic Oligonucleotide; CD80 exon 6; Set C
gucagcuguaauguauuuc

SEQ ID NO: 58235 - RNA, 33 nt, Artificial Sequence
  Synthetic Oligonucleotide; CD80 exon 6; Set A
gaauaaugucagcuguaauguauuuccuacugc

SEQ ID NO: 58236 - RNA, 18 nt, Artificial Sequence
  Synthetic Oligonucleotide; CD80 exon 6; Set C
gucagcuguaauguauuu

SEQ ID NO: 58237 - RNA, 34 nt, Artificial Sequence
  Synthetic Oligonucleotide; CD80 exon 6; Set A
agaauaaugucagcuguaauguauuuccuacugc

SEQ ID NO: 58238 - RNA, 38 nt, Artificial Sequence
  Synthetic Oligonucleotide; CD80 exon 6; Set A
aaagaauaaugucagcuguaauguauuuccuacugccu

SEQ ID NO: 58239 - RNA, 35 nt, Artificial Sequence
  Synthetic Oligonucleotide; CD80 exon 6; Set A
aagaauaaugucagcuguaauguauuuccuacugc

SEQ ID NO: 58240 - RNA, 39 nt, Artificial Sequence
  Synthetic Oligonucleotide; CD80 exon 6; Set A
aaaagaauaaugucagcuguaauguauuuccuacugccu

SEQ ID NO: 58241 - RNA, 36 nt, Artificial Sequence
  Synthetic Oligonucleotide; CD80 exon 6; Set A
aaagaauaaugucagcuguaauguauuuccuacugc

SEQ ID NO: 58242 - RNA, 37 nt, Artificial Sequence
  Synthetic Oligonucleotide; CD80 exon 6; Set A
aaaagaauaaugucagcuguaauguauuuccuacugc

SEQ ID NO: 58243 - RNA, 38 nt, Artificial Sequence
  Synthetic Oligonucleotide; CD80 exon 6; Set A
gaaaagaauaaugucagcuguaauguauuuccuacugc

SEQ ID NO: 58244 - RNA, 39 nt, Artificial Sequence
  Synthetic Oligonucleotide; CD80 exon 6; Set A
ggaaaagaauaaugucagcuguaauguauuuccuacugc

SEQ ID NO: 58245 - RNA, 40 nt, Artificial Sequence
  Synthetic Oligonucleotide; CD80 exon 6; Set A
gggaaaagaauaaugucagcuguaauguauuuccuacugc

SEQ ID NO: 58246 - RNA, 15 nt, Artificial Sequence
  Synthetic Oligonucleotide; CD80 exon 6; Set C
auaaugucagcugua

SEQ ID NO: 58247 - RNA, 16 nt, Artificial Sequence
  Synthetic Oligonucleotide; CD80 exon 6; Set C
aauaaugucagcugua

SEQ ID NO: 58248 - RNA, 15 nt, Artificial Sequence
  Synthetic Oligonucleotide; CD80 exon 6; Set C
aauaaugucagcugu

SEQ ID NO: 58249 - RNA, 17 nt, Artificial Sequence
  Synthetic Oligonucleotide; CD80 exon 6; Set C
gaauaaugucagcugua

SEQ ID NO: 58250 - RNA, 16 nt, Artificial Sequence
  Synthetic Oligonucleotide; CD80 exon 6; Set C
gaauaaugucagcugu

SEQ ID NO: 58251 - RNA, 18 nt, Artificial Sequence
  Synthetic Oligonucleotide; CD80 exon 6; Set C
agaauaaugucagcugua

SEQ ID NO: 58252 - RNA, 17 nt, Artificial Sequence
  Synthetic Oligonucleotide; CD80 exon 6; Set C
agaauaaugucagcugu

SEQ ID NO: 58253 - RNA, 18 nt, Artificial Sequence
  Synthetic Oligonucleotide; CD80 exon 6; Set C
aagaauaaugucagcugu

SEQ ID NO: 58254 - RNA, 23 nt, Artificial Sequence
  Synthetic Oligonucleotide; CD80 exon 6; Set C
ggaaaagaauaaugucagcugua

SEQ ID NO: 58255 - RNA, 22 nt, Artificial Sequence
  Synthetic Oligonucleotide; CD80 exon 6; Set C
ggaaaagaauaaugucagcugu

SEQ ID NO: 58256 - RNA, 24 nt, Artificial Sequence
  Synthetic Oligonucleotide; CD80 exon 6; Set C
gggaaaagaauaaugucagcugua

SEQ ID NO: 58257 - RNA, 23 nt, Artificial Sequence
  Synthetic Oligonucleotide; CD80 exon 6; Set C
gggaaaagaauaaugucagcugu

SEQ ID NO: 58258 - RNA, 40 nt, Artificial Sequence
  Synthetic Oligonucleotide; CD80 exon 6; Set A
uggcuauggagggaaaagaauaaugucagcuguaauguau

SEQ ID NO: 58259 - RNA, 39 nt, Artificial Sequence
  Synthetic Oligonucleotide; CD80 exon 6; Set A
uggcuauggagggaaaagaauaaugucagcuguaaugua

SEQ ID NO: 58260 - RNA, 15 nt, Artificial Sequence
  Synthetic Oligonucleotide; CD80 exon 6; Set C
gaaaagaauaauguc

SEQ ID NO: 58261 - RNA, 38 nt, Artificial Sequence
  Synthetic Oligonucleotide; CD80 exon 6; Set A
uggcuauggagggaaaagaauaaugucagcuguaaugu

SEQ ID NO: 58262 - RNA, 16 nt, Artificial Sequence
  Synthetic Oligonucleotide; CD80 exon 6; Set C
ggaaaagaauaauguc

SEQ ID NO: 58263 - RNA, 37 nt, Artificial Sequence
  Synthetic Oligonucleotide; CD80 exon 6; Set A
uggcuauggagggaaaagaauaaugucagcuguaaug

SEQ ID NO: 58264 - RNA, 17 nt, Artificial Sequence
  Synthetic Oligonucleotide; CD80 exon 6; Set C
gggaaaagaauaauguc

SEQ ID NO: 58265 - RNA, 36 nt, Artificial Sequence
  Synthetic Oligonucleotide; CD80 exon 6; Set A
uggcuauggagggaaaagaauaaugucagcuguaau

SEQ ID NO: 58266 - RNA, 18 nt, Artificial Sequence
  Synthetic Oligonucleotide; CD80 exon 6; Set C
agggaaaagaauaauguc

SEQ ID NO: 58267 - RNA, 35 nt, Artificial Sequence
  Synthetic Oligonucleotide; CD80 exon 6; Set A
uggcuauggagggaaaagaauaaugucagcuguaa

SEQ ID NO: 58268 - RNA, 19 nt, Artificial Sequence
  Synthetic Oligonucleotide; CD80 exon 6; Set C
gagggaaaagaauaauguc

SEQ ID NO: 58269 - RNA, 20 nt, Artificial Sequence
  Synthetic Oligonucleotide; CD80 exon 6; Set C
ggagggaaaagaauaauguc

SEQ ID NO: 58270 - RNA, 21 nt, Artificial Sequence
  Synthetic Oligonucleotide; CD80 exon 6; Set C
uggagggaaaagaauaauguc

SEQ ID NO: 58271 - RNA, 22 nt, Artificial Sequence
  Synthetic Oligonucleotide; CD80 exon 6; Set C
auggagggaaaagaauaauguc

SEQ ID NO: 58272 - RNA, 23 nt, Artificial Sequence
  Synthetic Oligonucleotide; CD80 exon 6; Set C
uauggagggaaaagaauaauguc

SEQ ID NO: 58273 - RNA, 22 nt, Artificial Sequence
  Synthetic Oligonucleotide; CD80 exon 6; Set C
cuauggagggaaaagaauaaug

SEQ ID NO: 58274 - RNA, 40 nt, Artificial Sequence
  Synthetic Oligonucleotide; CD80 exon 6; Set C
cuugcuuggcuauggagggaaaagaauaaugucagcugua

SEQ ID NO: 58275 - RNA, 21 nt, Artificial Sequence
  Synthetic Oligonucleotide; CD80 exon 6; Set C
cuauggagggaaaagaauaau

SEQ ID NO: 58276 - RNA, 23 nt, Artificial Sequence
  Synthetic Oligonucleotide; CD80 exon 6; Set C
gcuauggagggaaaagaauaaug

SEQ ID NO: 58277 - RNA, 25 nt, Artificial Sequence
  Synthetic Oligonucleotide; CD80 exon 6; Set C
ggcuauggagggaaaagaauaaugu

SEQ ID NO: 58278 - RNA, 39 nt, Artificial Sequence
  Synthetic Oligonucleotide; CD80 exon 6; Set C
cuugcuuggcuauggagggaaaagaauaaugucagcugu

SEQ ID NO: 58279 - RNA, 20 nt, Artificial Sequence
  Synthetic Oligonucleotide; CD80 exon 6; Set C
cuauggagggaaaagaauaa

SEQ ID NO: 58280 - RNA, 22 nt, Artificial Sequence
  Synthetic Oligonucleotide; CD80 exon 6; Set C
gcuauggagggaaaagaauaau

SEQ ID NO: 58281 - RNA, 24 nt, Artificial Sequence
  Synthetic Oligonucleotide; CD80 exon 6; Set C
ggcuauggagggaaaagaauaaug

SEQ ID NO: 58282 - RNA, 26 nt, Artificial Sequence
  Synthetic Oligonucleotide; CD80 exon 6; Set C
uggcuauggagggaaaagaauaaugu

SEQ ID NO: 58283 - RNA, 40 nt, Artificial Sequence
  Synthetic Oligonucleotide; CD80 exon 6; Set C
ucuugcuuggcuauggagggaaaagaauaaugucagcugu

SEQ ID NO: 58284 - RNA, 28 nt, Artificial Sequence
  Synthetic Oligonucleotide; CD80 exon 6; Set C
uuggcuauggagggaaaagaauaauguc

SEQ ID NO: 58285 - RNA, 23 nt, Artificial Sequence
  Synthetic Oligonucleotide; CD80 exon 6; Set C
ggcuauggagggaaaagaauaau

SEQ ID NO: 58286 - RNA, 21 nt, Artificial Sequence
  Synthetic Oligonucleotide; CD80 exon 6; Set C
gcuauggagggaaaagaauaa

SEQ ID NO: 58287 - RNA, 19 nt, Artificial Sequence
  Synthetic Oligonucleotide; CD80 exon 6; Set C
cuauggagggaaaagaaua

SEQ ID NO: 58288 - RNA, 22 nt, Artificial Sequence
  Synthetic Oligonucleotide; CD80 exon 6; Set C
ggcuauggagggaaaagaauaa

SEQ ID NO: 58289 - RNA, 20 nt, Artificial Sequence
  Synthetic Oligonucleotide; CD80 exon 6; Set C
gcuauggagggaaaagaaua

SEQ ID NO: 58290 - RNA, 21 nt, Artificial Sequence
  Synthetic Oligonucleotide; CD80 exon 6; Set C
ggcuauggagggaaaagaaua

SEQ ID NO: 58291 - RNA, 20 nt, Artificial Sequence
  Synthetic Oligonucleotide; CD80 exon 6; Set C
ggcuauggagggaaaagaau

SEQ ID NO: 58292 - RNA, 21 nt, Artificial Sequence
  Synthetic Oligonucleotide; CD80 exon 6; Set C
uggcuauggagggaaaagaau

SEQ ID NO: 58293 - RNA, 20 nt, Artificial Sequence
  Synthetic Oligonucleotide; CD80 exon 6; Set C
uggcuauggagggaaaagaa

SEQ ID NO: 58294 - RNA, 15 nt, Artificial Sequence
  Synthetic Oligonucleotide; CD80 exon 6; Set C
gcuauggagggaaaa

SEQ ID NO: 58295 - RNA, 17 nt, Artificial Sequence
  Synthetic Oligonucleotide; CD80 exon 6; Set C
ggcuauggagggaaaag

SEQ ID NO: 58296 - RNA, 19 nt, Artificial Sequence
  Synthetic Oligonucleotide; CD80 exon 6; Set C
uggcuauggagggaaaaga

SEQ ID NO: 58297 - RNA, 16 nt, Artificial Sequence
  Synthetic Oligonucleotide; CD80 exon 6; Set C
ggcuauggagggaaaa

SEQ ID NO: 58298 - RNA, 18 nt, Artificial Sequence
  Synthetic Oligonucleotide; CD80 exon 6; Set C
uggcuauggagggaaaag

SEQ ID NO: 58299 - RNA, 17 nt, Artificial Sequence
  Synthetic Oligonucleotide; CD80 exon 6; Set C
uggcuauggagggaaaa

SEQ ID NO: 58300 - RNA, 15 nt, Artificial Sequence
  Synthetic Oligonucleotide; CD80 exon 6; Set C
ggcuauggagggaaa

SEQ ID NO: 58301 - RNA, 16 nt, Artificial Sequence
  Synthetic Oligonucleotide; CD80 exon 6; Set C
uggcuauggagggaaa

SEQ ID NO: 58302 - RNA, 15 nt, Artificial Sequence
  Synthetic Oligonucleotide; CD80 exon 6; Set C
uggcuauggagggaa

SEQ ID NO: 58303 - RNA, 19 nt, Artificial Sequence
  Synthetic Oligonucleotide; CD80 exon 6; Set A
cuugcuuggcuauggaggg

SEQ ID NO: 58304 - RNA, 21 nt, Artificial Sequence
  Synthetic Oligonucleotide; CD80 exon 6; Set A
ucuugcuuggcuauggaggga

SEQ ID NO: 58305 - RNA, 20 nt, Artificial Sequence
  Synthetic Oligonucleotide; CD80 exon 6; Set A
ucuugcuuggcuauggaggg

SEQ ID NO: 58306 - RNA, 37 nt, Artificial Sequence
  Synthetic Oligonucleotide; CD80 exon 6; Set A
ggaaaaugcucuugcuuggcuauggagggaaaagaau

SEQ ID NO: 58307 - RNA, 40 nt, Artificial Sequence
  Synthetic Oligonucleotide; CD80 exon 6; Set C
caggaaaaugcucuugcuuggcuauggagggaaaagaaua

SEQ ID NO: 58308 - RNA, 38 nt, Artificial Sequence
  Synthetic Oligonucleotide; CD80 exon 6; Set A
aggaaaaugcucuugcuuggcuauggagggaaaagaau

SEQ ID NO: 58309 - RNA, 36 nt, Artificial Sequence
  Synthetic Oligonucleotide; CD80 exon 6; Set A
ggaaaaugcucuugcuuggcuauggagggaaaagaa

SEQ ID NO: 58310 - RNA, 39 nt, Artificial Sequence
  Synthetic Oligonucleotide; CD80 exon 6; Set C
caggaaaaugcucuugcuuggcuauggagggaaaagaau

SEQ ID NO: 58311 - RNA, 37 nt, Artificial Sequence
  Synthetic Oligonucleotide; CD80 exon 6; Set A
aggaaaaugcucuugcuuggcuauggagggaaaagaa

SEQ ID NO: 58312 - RNA, 35 nt, Artificial Sequence
  Synthetic Oligonucleotide; CD80 exon 6; Set C
ggaaaaugcucuugcuuggcuauggagggaaaaga

SEQ ID NO: 58313 - RNA, 27 nt, Artificial Sequence
  Synthetic Oligonucleotide; CD80 exon 6; Set A
aaugcucuugcuuggcuauggagggaa

SEQ ID NO: 58314 - RNA, 34 nt, Artificial Sequence
  Synthetic Oligonucleotide; CD80 exon 6; Set A
ggaaaaugcucuugcuuggcuauggagggaaaag

SEQ ID NO: 58315 - RNA, 40 nt, Artificial Sequence
  Synthetic Oligonucleotide; CD80 exon 6; Set C
ucaggaaaaugcucuugcuuggcuauggagggaaaagaau

SEQ ID NO: 58316 - RNA, 38 nt, Artificial Sequence
  Synthetic Oligonucleotide; CD80 exon 6; Set C
caggaaaaugcucuugcuuggcuauggagggaaaagaa

SEQ ID NO: 58317 - RNA, 36 nt, Artificial Sequence
  Synthetic Oligonucleotide; CD80 exon 6; Set C
aggaaaaugcucuugcuuggcuauggagggaaaaga

SEQ ID NO: 58318 - RNA, 26 nt, Artificial Sequence
  Synthetic Oligonucleotide; CD80 exon 6; Set A
aaugcucuugcuuggcuauggaggga

SEQ ID NO: 58319 - RNA, 33 nt, Artificial Sequence
  Synthetic Oligonucleotide; CD80 exon 6; Set A
ggaaaaugcucuugcuuggcuauggagggaaaa

SEQ ID NO: 58320 - RNA, 35 nt, Artificial Sequence
  Synthetic Oligonucleotide; CD80 exon 6; Set A
aggaaaaugcucuugcuuggcuauggagggaaaag

SEQ ID NO: 58321 - RNA, 39 nt, Artificial Sequence
  Synthetic Oligonucleotide; CD80 exon 6; Set C
ucaggaaaaugcucuugcuuggcuauggagggaaaagaa

SEQ ID NO: 58322 - RNA, 37 nt, Artificial Sequence
  Synthetic Oligonucleotide; CD80 exon 6; Set C
caggaaaaugcucuugcuuggcuauggagggaaaaga

SEQ ID NO: 58323 - RNA, 25 nt, Artificial Sequence
  Synthetic Oligonucleotide; CD80 exon 6; Set A
aaugcucuugcuuggcuauggaggg

SEQ ID NO: 58324 - RNA, 27 nt, Artificial Sequence
  Synthetic Oligonucleotide; CD80 exon 6; Set A
aaaugcucuugcuuggcuauggaggga

SEQ ID NO: 58325 - RNA, 34 nt, Artificial Sequence
  Synthetic Oligonucleotide; CD80 exon 6; Set A
aggaaaaugcucuugcuuggcuauggagggaaaa

SEQ ID NO: 58326 - RNA, 32 nt, Artificial Sequence
  Synthetic Oligonucleotide; CD80 exon 6; Set A
ggaaaaugcucuugcuuggcuauggagggaaa

SEQ ID NO: 58327 - RNA, 36 nt, Artificial Sequence
  Synthetic Oligonucleotide; CD80 exon 6; Set A
caggaaaaugcucuugcuuggcuauggagggaaaag

SEQ ID NO: 58328 - RNA, 40 nt, Artificial Sequence
  Synthetic Oligonucleotide; CD80 exon 6; Set C
aucaggaaaaugcucuugcuuggcuauggagggaaaagaa

SEQ ID NO: 58329 - RNA, 38 nt, Artificial Sequence
  Synthetic Oligonucleotide; CD80 exon 6; Set C
ucaggaaaaugcucuugcuuggcuauggagggaaaaga

SEQ ID NO: 58330 - RNA, 24 nt, Artificial Sequence
  Synthetic Oligonucleotide; CD80 exon 6; Set A
aaugcucuugcuuggcuauggagg

SEQ ID NO: 58331 - RNA, 26 nt, Artificial Sequence
  Synthetic Oligonucleotide; CD80 exon 6; Set A
aaaugcucuugcuuggcuauggaggg

SEQ ID NO: 58332 - RNA, 28 nt, Artificial Sequence
  Synthetic Oligonucleotide; CD80 exon 6; Set A
aaaaugcucuugcuuggcuauggaggga

SEQ ID NO: 58333 - RNA, 35 nt, Artificial Sequence
  Synthetic Oligonucleotide; CD80 exon 6; Set C
caggaaaaugcucuugcuuggcuauggagggaaaa

SEQ ID NO: 58334 - RNA, 33 nt, Artificial Sequence
  Synthetic Oligonucleotide; CD80 exon 6; Set A
aggaaaaugcucuugcuuggcuauggagggaaa

SEQ ID NO: 58335 - RNA, 37 nt, Artificial Sequence
  Synthetic Oligonucleotide; CD80 exon 6; Set C
ucaggaaaaugcucuugcuuggcuauggagggaaaag

SEQ ID NO: 58336 - RNA, 23 nt, Artificial Sequence
  Synthetic Oligonucleotide; CD80 exon 6; Set A
aaugcucuugcuuggcuauggag

SEQ ID NO: 58337 - RNA, 39 nt, Artificial Sequence
  Synthetic Oligonucleotide; CD80 exon 6; Set C
aucaggaaaaugcucuugcuuggcuauggagggaaaaga

SEQ ID NO: 58338 - RNA, 31 nt, Artificial Sequence
  Synthetic Oligonucleotide; CD80 exon 6; Set C
ggaaaaugcucuugcuuggcuauggagggaa

SEQ ID NO: 58339 - RNA, 25 nt, Artificial Sequence
  Synthetic Oligonucleotide; CD80 exon 6; Set A
aaaugcucuugcuuggcuauggagg

SEQ ID NO: 58340 - RNA, 27 nt, Artificial Sequence
  Synthetic Oligonucleotide; CD80 exon 6; Set A
aaaaugcucuugcuuggcuauggaggg

SEQ ID NO: 58341 - RNA, 29 nt, Artificial Sequence
  Synthetic Oligonucleotide; CD80 exon 6; Set A
gaaaaugcucuugcuuggcuauggaggga

SEQ ID NO: 58342 - RNA, 36 nt, Artificial Sequence
  Synthetic Oligonucleotide; CD80 exon 6; Set C
ucaggaaaaugcucuugcuuggcuauggagggaaaa

SEQ ID NO: 58343 - RNA, 34 nt, Artificial Sequence
  Synthetic Oligonucleotide; CD80 exon 6; Set C
caggaaaaugcucuugcuuggcuauggagggaaa

SEQ ID NO: 58344 - RNA, 38 nt, Artificial Sequence
  Synthetic Oligonucleotide; CD80 exon 6; Set C
aucaggaaaaugcucuugcuuggcuauggagggaaaag

SEQ ID NO: 58345 - RNA, 22 nt, Artificial Sequence
  Synthetic Oligonucleotide; CD80 exon 6; Set A
aaugcucuugcuuggcuaugga

SEQ ID NO: 58346 - RNA, 32 nt, Artificial Sequence
  Synthetic Oligonucleotide; CD80 exon 6; Set C
aggaaaaugcucuugcuuggcuauggagggaa

SEQ ID NO: 58347 - RNA, 28 nt, Artificial Sequence
  Synthetic Oligonucleotide; CD80 exon 6; Set A
gaaaaugcucuugcuuggcuauggaggg

SEQ ID NO: 58348 - RNA, 30 nt, Artificial Sequence
  Synthetic Oligonucleotide; CD80 exon 6; Set C
ggaaaaugcucuugcuuggcuauggaggga

SEQ ID NO: 58349 - RNA, 37 nt, Artificial Sequence
  Synthetic Oligonucleotide; CD80 exon 6; Set C
aucaggaaaaugcucuugcuuggcuauggagggaaaa

SEQ ID NO: 58350 - RNA, 35 nt, Artificial Sequence
  Synthetic Oligonucleotide; CD80 exon 6; Set C
ucaggaaaaugcucuugcuuggcuauggagggaaa

SEQ ID NO: 58351 - RNA, 21 nt, Artificial Sequence
  Synthetic Oligonucleotide; CD80 exon 6; Set C
aaugcucuugcuuggcuaugg

SEQ ID NO: 58352 - RNA, 23 nt, Artificial Sequence
  Synthetic Oligonucleotide; CD80 exon 6; Set A
aaaugcucuugcuuggcuaugga

SEQ ID NO: 58353 - RNA, 29 nt, Artificial Sequence
  Synthetic Oligonucleotide; CD80 exon 6; Set A
ggaaaaugcucuugcuuggcuauggaggg

SEQ ID NO: 58354 - RNA, 31 nt, Artificial Sequence
  Synthetic Oligonucleotide; CD80 exon 6; Set C
aggaaaaugcucuugcuuggcuauggaggga

SEQ ID NO: 58355 - RNA, 36 nt, Artificial Sequence
  Synthetic Oligonucleotide; CD80 exon 6; Set C
aucaggaaaaugcucuugcuuggcuauggagggaaa

SEQ ID NO: 58356 - RNA, 20 nt, Artificial Sequence
  Synthetic Oligonucleotide; CD80 exon 6; Set C
aaugcucuugcuuggcuaug

SEQ ID NO: 58357 - RNA, 22 nt, Artificial Sequence
  Synthetic Oligonucleotide; CD80 exon 6; Set C
aaaugcucuugcuuggcuaugg

SEQ ID NO: 58358 - RNA, 28 nt, Artificial Sequence
  Synthetic Oligonucleotide; CD80 exon 6; Set A
ggaaaaugcucuugcuuggcuauggagg

SEQ ID NO: 58359 - RNA, 30 nt, Artificial Sequence
  Synthetic Oligonucleotide; CD80 exon 6; Set A
aggaaaaugcucuugcuuggcuauggaggg

SEQ ID NO: 58360 - RNA, 21 nt, Artificial Sequence
  Synthetic Oligonucleotide; CD80 exon 6; Set C
aaaugcucuugcuuggcuaug

SEQ ID NO: 58361 - RNA, 19 nt, Artificial Sequence
  Synthetic Oligonucleotide; CD80 exon 6; Set C
aaugcucuugcuuggcuau

SEQ ID NO: 58362 - RNA, 23 nt, Artificial Sequence
  Synthetic Oligonucleotide; CD80 exon 6; Set C
aaaaugcucuugcuuggcuaugg

SEQ ID NO: 58363 - RNA, 27 nt, Artificial Sequence
  Synthetic Oligonucleotide; CD80 exon 6; Set A
ggaaaaugcucuugcuuggcuauggag

SEQ ID NO: 58364 - RNA, 35 nt, Artificial Sequence
  Synthetic Oligonucleotide; CD80 exon 6; Set C
aucaggaaaaugcucuugcuuggcuauggagggaa

SEQ ID NO: 58365 - RNA, 29 nt, Artificial Sequence
  Synthetic Oligonucleotide; CD80 exon 6; Set A
aggaaaaugcucuugcuuggcuauggagg

SEQ ID NO: 58366 - RNA, 40 nt, Artificial Sequence
  Synthetic Oligonucleotide; CD80 exon 6; Set C
guuaucaggaaaaugcucuugcuuggcuauggagggaaaa

SEQ ID NO: 58367 - RNA, 22 nt, Artificial Sequence
  Synthetic Oligonucleotide; CD80 exon 6; Set C
aaaaugcucuugcuuggcuaug

SEQ ID NO: 58368 - RNA, 20 nt, Artificial Sequence
  Synthetic Oligonucleotide; CD80 exon 6; Set C
aaaugcucuugcuuggcuau

SEQ ID NO: 58369 - RNA, 28 nt, Artificial Sequence
  Synthetic Oligonucleotide; CD80 exon 6; Set A
aggaaaaugcucuugcuuggcuauggag

SEQ ID NO: 58370 - RNA, 26 nt, Artificial Sequence
  Synthetic Oligonucleotide; CD80 exon 6; Set A
ggaaaaugcucuugcuuggcuaugga

SEQ ID NO: 58371 - RNA, 39 nt, Artificial Sequence
  Synthetic Oligonucleotide; CD80 exon 6; Set C
guuaucaggaaaaugcucuugcuuggcuauggagggaaa

SEQ ID NO: 58372 - RNA, 21 nt, Artificial Sequence
  Synthetic Oligonucleotide; CD80 exon 6; Set C
aaaaugcucuugcuuggcuau

SEQ ID NO: 58373 - RNA, 25 nt, Artificial Sequence
  Synthetic Oligonucleotide; CD80 exon 6; Set A
ggaaaaugcucuugcuuggcuaugg

SEQ ID NO: 58374 - RNA, 27 nt, Artificial Sequence
  Synthetic Oligonucleotide; CD80 exon 6; Set A
aggaaaaugcucuugcuuggcuaugga

SEQ ID NO: 58375 - RNA, 40 nt, Artificial Sequence
  Synthetic Oligonucleotide; CD80 exon 6; Set C
gguuaucaggaaaaugcucuugcuuggcuauggagggaaa

SEQ ID NO: 58376 - RNA, 22 nt, Artificial Sequence
  Synthetic Oligonucleotide; CD80 exon 6; Set C
gaaaaugcucuugcuuggcuau

SEQ ID NO: 58377 - RNA, 24 nt, Artificial Sequence
  Synthetic Oligonucleotide; CD80 exon 6; Set A
ggaaaaugcucuugcuuggcuaug

SEQ ID NO: 58378 - RNA, 26 nt, Artificial Sequence
  Synthetic Oligonucleotide; CD80 exon 6; Set A
aggaaaaugcucuugcuuggcuaugg

SEQ ID NO: 58379 - RNA, 38 nt, Artificial Sequence
  Synthetic Oligonucleotide; CD80 exon 6; Set C
guuaucaggaaaaugcucuugcuuggcuauggagggaa

SEQ ID NO: 58380 - RNA, 23 nt, Artificial Sequence
  Synthetic Oligonucleotide; CD80 exon 6; Set C
ggaaaaugcucuugcuuggcuau

SEQ ID NO: 58381 - RNA, 25 nt, Artificial Sequence
  Synthetic Oligonucleotide; CD80 exon 6; Set A
aggaaaaugcucuugcuuggcuaug

SEQ ID NO: 58382 - RNA, 39 nt, Artificial Sequence
  Synthetic Oligonucleotide; CD80 exon 6; Set C
gguuaucaggaaaaugcucuugcuuggcuauggagggaa

SEQ ID NO: 58383 - RNA, 24 nt, Artificial Sequence
  Synthetic Oligonucleotide; CD80 exon 6; Set A
aggaaaaugcucuugcuuggcuau

SEQ ID NO: 58384 - RNA, 35 nt, Artificial Sequence
  Synthetic Oligonucleotide; CD80 exon 6; Set C
guuaucaggaaaaugcucuugcuuggcuauggagg

SEQ ID NO: 58385 - RNA, 15 nt, Artificial Sequence
  Synthetic Oligonucleotide; CD80 exon 6; Set C
aaaugcucuugcuug

SEQ ID NO: 58386 - RNA, 34 nt, Artificial Sequence
  Synthetic Oligonucleotide; CD80 exon 6; Set A
guuaucaggaaaaugcucuugcuuggcuauggag

SEQ ID NO: 58387 - RNA, 36 nt, Artificial Sequence
  Synthetic Oligonucleotide; CD80 exon 6; Set C
gguuaucaggaaaaugcucuugcuuggcuauggagg

SEQ ID NO: 58388 - RNA, 16 nt, Artificial Sequence
  Synthetic Oligonucleotide; CD80 exon 6; Set C
aaaaugcucuugcuug

SEQ ID NO: 58389 - RNA, 35 nt, Artificial Sequence
  Synthetic Oligonucleotide; CD80 exon 6; Set C
gguuaucaggaaaaugcucuugcuuggcuauggag

SEQ ID NO: 58390 - RNA, 33 nt, Artificial Sequence
  Synthetic Oligonucleotide; CD80 exon 6; Set A
guuaucaggaaaaugcucuugcuuggcuaugga

SEQ ID NO: 58391 - RNA, 17 nt, Artificial Sequence
  Synthetic Oligonucleotide; CD80 exon 6; Set C
gaaaaugcucuugcuug

SEQ ID NO: 58392 - RNA, 32 nt, Artificial Sequence
  Synthetic Oligonucleotide; CD80 exon 6; Set A
guuaucaggaaaaugcucuugcuuggcuaugg

SEQ ID NO: 58393 - RNA, 34 nt, Artificial Sequence
  Synthetic Oligonucleotide; CD80 exon 6; Set C
gguuaucaggaaaaugcucuugcuuggcuaugga

SEQ ID NO: 58394 - RNA, 18 nt, Artificial Sequence
  Synthetic Oligonucleotide; CD80 exon 6; Set C
ggaaaaugcucuugcuug

SEQ ID NO: 58395 - RNA, 31 nt, Artificial Sequence
  Synthetic Oligonucleotide; CD80 exon 6; Set A
guuaucaggaaaaugcucuugcuuggcuaug

SEQ ID NO: 58396 - RNA, 33 nt, Artificial Sequence
  Synthetic Oligonucleotide; CD80 exon 6; Set C
gguuaucaggaaaaugcucuugcuuggcuaugg

SEQ ID NO: 58397 - RNA, 19 nt, Artificial Sequence
  Synthetic Oligonucleotide; CD80 exon 6; Set C
aggaaaaugcucuugcuug

SEQ ID NO: 58398 - RNA, 30 nt, Artificial Sequence
  Synthetic Oligonucleotide; CD80 exon 6; Set A
guuaucaggaaaaugcucuugcuuggcuau

SEQ ID NO: 58399 - RNA, 32 nt, Artificial Sequence
  Synthetic Oligonucleotide; CD80 exon 6; Set A
gguuaucaggaaaaugcucuugcuuggcuaug

SEQ ID NO: 58400 - RNA, 31 nt, Artificial Sequence
  Synthetic Oligonucleotide; CD80 exon 6; Set A
gguuaucaggaaaaugcucuugcuuggcuau

SEQ ID NO: 58401 - RNA, 40 nt, Artificial Sequence
  Synthetic Oligonucleotide; CD80 exon 6; Set C
augggagcagguuaucaggaaaaugcucuugcuuggcuau

SEQ ID NO: 58402 - RNA, 15 nt, Artificial Sequence
  Synthetic Oligonucleotide; CD80 exon 6; Set C
gguuaucaggaaaau

SEQ ID NO: 58403 - RNA, 24 nt, Artificial Sequence
  Synthetic Oligonucleotide; CD80 exon 6; Set C
augggagcagguuaucaggaaaau

SEQ ID NO: 58404 - RNA, 23 nt, Artificial Sequence
  Synthetic Oligonucleotide; CD80 exon 6; Set C
augggagcagguuaucaggaaaa

SEQ ID NO: 58405 - RNA, 25 nt, Artificial Sequence
  Synthetic Oligonucleotide; CD80 exon 6; Set A
gaugggagcagguuaucaggaaaau

SEQ ID NO: 58406 - RNA, 24 nt, Artificial Sequence
  Synthetic Oligonucleotide; CD80 exon 6; Set A
gaugggagcagguuaucaggaaaa

SEQ ID NO: 58407 - RNA, 22 nt, Artificial Sequence
  Synthetic Oligonucleotide; CD80 exon 6; Set C
augggagcagguuaucaggaaa

SEQ ID NO: 58408 - RNA, 23 nt, Artificial Sequence
  Synthetic Oligonucleotide; CD80 exon 6; Set A
gaugggagcagguuaucaggaaa

SEQ ID NO: 58409 - RNA, 21 nt, Artificial Sequence
  Synthetic Oligonucleotide; CD80 exon 6; Set C
augggagcagguuaucaggaa

SEQ ID NO: 58410 - RNA, 22 nt, Artificial Sequence
  Synthetic Oligonucleotide; CD80 exon 6; Set A
gaugggagcagguuaucaggaa

SEQ ID NO: 58411 - RNA, 37 nt, Artificial Sequence
  Synthetic Oligonucleotide; CD80 exon 6; Set C
gguaauggcccaggaugggagcagguuaucaggaaaa

SEQ ID NO: 58412 - RNA, 38 nt, Artificial Sequence
  Synthetic Oligonucleotide; CD80 exon 6; Set C
agguaauggcccaggaugggagcagguuaucaggaaaa

SEQ ID NO: 58413 - RNA, 40 nt, Artificial Sequence
  Synthetic Oligonucleotide; CD80 exon 6; Set C
aagguaauggcccaggaugggagcagguuaucaggaaaau

SEQ ID NO: 58414 - RNA, 39 nt, Artificial Sequence
  Synthetic Oligonucleotide; CD80 exon 6; Set C
aagguaauggcccaggaugggagcagguuaucaggaaaa

SEQ ID NO: 58415 - RNA, 38 nt, Artificial Sequence
  Synthetic Oligonucleotide; CD80 exon 6; Set C
aagguaauggcccaggaugggagcagguuaucaggaaa

SEQ ID NO: 58416 - RNA, 40 nt, Artificial Sequence
  Synthetic Oligonucleotide; CD80 exon 6; Set C
uaagguaauggcccaggaugggagcagguuaucaggaaaa

SEQ ID NO: 58417 - RNA, 37 nt, Artificial Sequence
  Synthetic Oligonucleotide; CD80 exon 6; Set C
aagguaauggcccaggaugggagcagguuaucaggaa

SEQ ID NO: 58418 - RNA, 39 nt, Artificial Sequence
  Synthetic Oligonucleotide; CD80 exon 6; Set C
uaagguaauggcccaggaugggagcagguuaucaggaaa

SEQ ID NO: 58419 - RNA, 40 nt, Artificial Sequence
  Synthetic Oligonucleotide; CD80 exon 6; Set C
uuaagguaauggcccaggaugggagcagguuaucaggaaa

SEQ ID NO: 58420 - RNA, 38 nt, Artificial Sequence
  Synthetic Oligonucleotide; CD80 exon 6; Set C
uaagguaauggcccaggaugggagcagguuaucaggaa

SEQ ID NO: 58421 - RNA, 36 nt, Artificial Sequence
  Synthetic Oligonucleotide; CD80 exon 6; Set C
aagguaauggcccaggaugggagcagguuaucagga

SEQ ID NO: 58422 - RNA, 39 nt, Artificial Sequence
  Synthetic Oligonucleotide; CD80 exon 6; Set C
uuaagguaauggcccaggaugggagcagguuaucaggaa

SEQ ID NO: 58423 - RNA, 35 nt, Artificial Sequence
  Synthetic Oligonucleotide; CD80 exon 6; Set C
aagguaauggcccaggaugggagcagguuaucagg

SEQ ID NO: 58424 - RNA, 31 nt, Artificial Sequence
  Synthetic Oligonucleotide; CD80 exon 6; Set C
aagguaauggcccaggaugggagcagguuau

SEQ ID NO: 58425 - RNA, 30 nt, Artificial Sequence
  Synthetic Oligonucleotide; CD80 exon 6; Set C
aagguaauggcccaggaugggagcagguua

SEQ ID NO: 58426 - RNA, 32 nt, Artificial Sequence
  Synthetic Oligonucleotide; CD80 exon 6; Set C
uaagguaauggcccaggaugggagcagguuau

SEQ ID NO: 58427 - RNA, 33 nt, Artificial Sequence
  Synthetic Oligonucleotide; CD80 exon 6; Set C
uuaagguaauggcccaggaugggagcagguuau

SEQ ID NO: 58428 - RNA, 31 nt, Artificial Sequence
  Synthetic Oligonucleotide; CD80 exon 6; Set C
uaagguaauggcccaggaugggagcagguua

SEQ ID NO: 58429 - RNA, 32 nt, Artificial Sequence
  Synthetic Oligonucleotide; CD80 exon 6; Set C
uuaagguaauggcccaggaugggagcagguua

SEQ ID NO: 58430 - RNA, 40 nt, Artificial Sequence
  Synthetic Oligonucleotide; CD80 exon 6; Set C
uacugagauuaagguaauggcccaggaugggagcagguua

SEQ ID NO: 58431 - RNA, 20 nt, Artificial Sequence
  Synthetic Oligonucleotide; CD80 exon 6; Set C
aagguaauggcccaggaugg

SEQ ID NO: 58432 - RNA, 19 nt, Artificial Sequence
  Synthetic Oligonucleotide; CD80 exon 6; Set C
aagguaauggcccaggaug

SEQ ID NO: 58433 - RNA, 18 nt, Artificial Sequence
  Synthetic Oligonucleotide; CD80 exon 6; Set C
aagguaauggcccaggau

SEQ ID NO: 58434 - RNA, 20 nt, Artificial Sequence
  Synthetic Oligonucleotide; CD80 exon 6; Set C
uaagguaauggcccaggaug

SEQ ID NO: 58435 - RNA, 19 nt, Artificial Sequence
  Synthetic Oligonucleotide; CD80 exon 6; Set C
uaagguaauggcccaggau

SEQ ID NO: 58436 - RNA, 21 nt, Artificial Sequence
  Synthetic Oligonucleotide; CD80 exon 6; Set C
uuaagguaauggcccaggaug

SEQ ID NO: 58437 - RNA, 17 nt, Artificial Sequence
  Synthetic Oligonucleotide; CD80 exon 6; Set C
aagguaauggcccagga

SEQ ID NO: 58438 - RNA, 20 nt, Artificial Sequence
  Synthetic Oligonucleotide; CD80 exon 6; Set C
uuaagguaauggcccaggau

SEQ ID NO: 58439 - RNA, 30 nt, Artificial Sequence
  Synthetic Oligonucleotide; CD80 exon 6; Set A
uacugagauuaagguaauggcccaggaugg

SEQ ID NO: 58440 - RNA, 29 nt, Artificial Sequence
  Synthetic Oligonucleotide; CD80 exon 6; Set A
uacugagauuaagguaauggcccaggaug

SEQ ID NO: 58441 - RNA, 31 nt, Artificial Sequence
  Synthetic Oligonucleotide; CD80 exon 6; Set A
uuacugagauuaagguaauggcccaggaugg

SEQ ID NO: 58442 - RNA, 28 nt, Artificial Sequence
  Synthetic Oligonucleotide; CD80 exon 6; Set A
uacugagauuaagguaauggcccaggau

SEQ ID NO: 58443 - RNA, 30 nt, Artificial Sequence
  Synthetic Oligonucleotide; CD80 exon 6; Set A
uuacugagauuaagguaauggcccaggaug

SEQ ID NO: 58444 - RNA, 32 nt, Artificial Sequence
  Synthetic Oligonucleotide; CD80 exon 6; Set A
uuuacugagauuaagguaauggcccaggaugg

SEQ ID NO: 58445 - RNA, 29 nt, Artificial Sequence
  Synthetic Oligonucleotide; CD80 exon 6; Set A
uuacugagauuaagguaauggcccaggau

SEQ ID NO: 58446 - RNA, 31 nt, Artificial Sequence
  Synthetic Oligonucleotide; CD80 exon 6; Set A
uuuacugagauuaagguaauggcccaggaug

SEQ ID NO: 58447 - RNA, 30 nt, Artificial Sequence
  Synthetic Oligonucleotide; CD80 exon 6; Set A
uuuacugagauuaagguaauggcccaggau

SEQ ID NO: 58448 - RNA, 28 nt, Artificial Sequence
  Synthetic Oligonucleotide; CD80 exon 6; Set A
uuacugagauuaagguaauggcccagga

SEQ ID NO: 58449 - RNA, 29 nt, Artificial Sequence
  Synthetic Oligonucleotide; CD80 exon 6; Set A
uuuacugagauuaagguaauggcccagga

SEQ ID NO: 58450 - RNA, 37 nt, Artificial Sequence
  Synthetic Oligonucleotide; CD80 exon 6; Set C
uuccauuuacugagauuaagguaauggcccaggaugg

SEQ ID NO: 58451 - RNA, 36 nt, Artificial Sequence
  Synthetic Oligonucleotide; CD80 exon 6; Set C
uuccauuuacugagauuaagguaauggcccaggaug

SEQ ID NO: 58452 - RNA, 38 nt, Artificial Sequence
  Synthetic Oligonucleotide; CD80 exon 6; Set C
auuccauuuacugagauuaagguaauggcccaggaugg

SEQ ID NO: 58453 - RNA, 35 nt, Artificial Sequence
  Synthetic Oligonucleotide; CD80 exon 6; Set C
uuccauuuacugagauuaagguaauggcccaggau

SEQ ID NO: 58454 - RNA, 37 nt, Artificial Sequence
  Synthetic Oligonucleotide; CD80 exon 6; Set C
auuccauuuacugagauuaagguaauggcccaggaug

SEQ ID NO: 58455 - RNA, 39 nt, Artificial Sequence
  Synthetic Oligonucleotide; CD80 exon 6; Set C
aauuccauuuacugagauuaagguaauggcccaggaugg

SEQ ID NO: 58456 - RNA, 36 nt, Artificial Sequence
  Synthetic Oligonucleotide; CD80 exon 6; Set C
auuccauuuacugagauuaagguaauggcccaggau

SEQ ID NO: 58457 - RNA, 38 nt, Artificial Sequence
  Synthetic Oligonucleotide; CD80 exon 6; Set A
aauuccauuuacugagauuaagguaauggcccaggaug

SEQ ID NO: 58458 - RNA, 40 nt, Artificial Sequence
  Synthetic Oligonucleotide; CD80 exon 6; Set C
aaauuccauuuacugagauuaagguaauggcccaggaugg

SEQ ID NO: 58459 - RNA, 37 nt, Artificial Sequence
  Synthetic Oligonucleotide; CD80 exon 6; Set A
aauuccauuuacugagauuaagguaauggcccaggau

SEQ ID NO: 58460 - RNA, 39 nt, Artificial Sequence
  Synthetic Oligonucleotide; CD80 exon 6; Set A
aaauuccauuuacugagauuaagguaauggcccaggaug

SEQ ID NO: 58461 - RNA, 38 nt, Artificial Sequence
  Synthetic Oligonucleotide; CD80 exon 6; Set A
aaauuccauuuacugagauuaagguaauggcccaggau

SEQ ID NO: 58462 - RNA, 40 nt, Artificial Sequence
  Synthetic Oligonucleotide; CD80 exon 6; Set A
aaaauuccauuuacugagauuaagguaauggcccaggaug

SEQ ID NO: 58463 - RNA, 36 nt, Artificial Sequence
  Synthetic Oligonucleotide; CD80 exon 6; Set C
aauuccauuuacugagauuaagguaauggcccagga

SEQ ID NO: 58464 - RNA, 39 nt, Artificial Sequence
  Synthetic Oligonucleotide; CD80 exon 6; Set A
aaaauuccauuuacugagauuaagguaauggcccaggau

SEQ ID NO: 58465 - RNA, 37 nt, Artificial Sequence
  Synthetic Oligonucleotide; CD80 exon 6; Set A
aaauuccauuuacugagauuaagguaauggcccagga

SEQ ID NO: 58466 - RNA, 19 nt, Artificial Sequence
  Synthetic Oligonucleotide; CD80 exon 6; Set C
uuacugagauuaagguaau

SEQ ID NO: 58467 - RNA, 40 nt, Artificial Sequence
  Synthetic Oligonucleotide; CD80 exon 6; Set A
aaaaauuccauuuacugagauuaagguaauggcccaggau

SEQ ID NO: 58468 - RNA, 38 nt, Artificial Sequence
  Synthetic Oligonucleotide; CD80 exon 6; Set A
aaaauuccauuuacugagauuaagguaauggcccagga

SEQ ID NO: 58469 - RNA, 16 nt, Artificial Sequence
  Synthetic Oligonucleotide; CD80 exon 6; Set C
uacugagauuaaggua

SEQ ID NO: 58470 - RNA, 20 nt, Artificial Sequence
  Synthetic Oligonucleotide; CD80 exon 6; Set C
uuuacugagauuaagguaau

SEQ ID NO: 58471 - RNA, 15 nt, Artificial Sequence
  Synthetic Oligonucleotide; CD80 exon 6; Set C
uacugagauuaaggu

SEQ ID NO: 58472 - RNA, 39 nt, Artificial Sequence
  Synthetic Oligonucleotide; CD80 exon 6; Set A
aaaaauuccauuuacugagauuaagguaauggcccagga

SEQ ID NO: 58473 - RNA, 17 nt, Artificial Sequence
  Synthetic Oligonucleotide; CD80 exon 6; Set C
uuacugagauuaaggua

SEQ ID NO: 58474 - RNA, 19 nt, Artificial Sequence
  Synthetic Oligonucleotide; CD80 exon 6; Set C
uuuacugagauuaagguaa

SEQ ID NO: 58475 - RNA, 16 nt, Artificial Sequence
  Synthetic Oligonucleotide; CD80 exon 6; Set C
uuacugagauuaaggu

SEQ ID NO: 58476 - RNA, 18 nt, Artificial Sequence
  Synthetic Oligonucleotide; CD80 exon 6; Set C
uuuacugagauuaaggua

SEQ ID NO: 58477 - RNA, 15 nt, Artificial Sequence
  Synthetic Oligonucleotide; CD80 exon 6; Set C
uuacugagauuaagg

SEQ ID NO: 58478 - RNA, 23 nt, Artificial Sequence
  Synthetic Oligonucleotide; CD80 exon 6; Set C
uuccauuuacugagauuaaggua

SEQ ID NO: 58479 - RNA, 22 nt, Artificial Sequence
  Synthetic Oligonucleotide; CD80 exon 6; Set C
uuccauuuacugagauuaaggu

SEQ ID NO: 58480 - RNA, 24 nt, Artificial Sequence
  Synthetic Oligonucleotide; CD80 exon 6; Set C
auuccauuuacugagauuaaggua

SEQ ID NO: 58481 - RNA, 23 nt, Artificial Sequence
  Synthetic Oligonucleotide; CD80 exon 6; Set C
auuccauuuacugagauuaaggu

SEQ ID NO: 58482 - RNA, 21 nt, Artificial Sequence
  Synthetic Oligonucleotide; CD80 exon 6; Set C
uuccauuuacugagauuaagg

SEQ ID NO: 58483 - RNA, 25 nt, Artificial Sequence
  Synthetic Oligonucleotide; CD80 exon 6; Set C
aauuccauuuacugagauuaaggua

SEQ ID NO: 58484 - RNA, 24 nt, Artificial Sequence
  Synthetic Oligonucleotide; CD80 exon 6; Set C
aauuccauuuacugagauuaaggu

SEQ ID NO: 58485 - RNA, 22 nt, Artificial Sequence
  Synthetic Oligonucleotide; CD80 exon 6; Set C
auuccauuuacugagauuaagg

SEQ ID NO: 58486 - RNA, 26 nt, Artificial Sequence
  Synthetic Oligonucleotide; CD80 exon 6; Set C
aaauuccauuuacugagauuaaggua

SEQ ID NO: 58487 - RNA, 19 nt, Artificial Sequence
  Synthetic Oligonucleotide; CD80 exon 6; Set C
uuccauuuacugagauuaa

SEQ ID NO: 58488 - RNA, 25 nt, Artificial Sequence
  Synthetic Oligonucleotide; CD80 exon 6; Set C
aaauuccauuuacugagauuaaggu

SEQ ID NO: 58489 - RNA, 23 nt, Artificial Sequence
  Synthetic Oligonucleotide; CD80 exon 6; Set C
aauuccauuuacugagauuaagg

SEQ ID NO: 58490 - RNA, 27 nt, Artificial Sequence
  Synthetic Oligonucleotide; CD80 exon 6; Set C
aaaauuccauuuacugagauuaaggua

SEQ ID NO: 58491 - RNA, 18 nt, Artificial Sequence
  Synthetic Oligonucleotide; CD80 exon 6; Set C
uuccauuuacugagauua

SEQ ID NO: 58492 - RNA, 20 nt, Artificial Sequence
  Synthetic Oligonucleotide; CD80 exon 6; Set C
auuccauuuacugagauuaa

SEQ ID NO: 58493 - RNA, 26 nt, Artificial Sequence
  Synthetic Oligonucleotide; CD80 exon 6; Set C
aaaauuccauuuacugagauuaaggu

SEQ ID NO: 58494 - RNA, 24 nt, Artificial Sequence
  Synthetic Oligonucleotide; CD80 exon 6; Set C
aaauuccauuuacugagauuaagg

SEQ ID NO: 58495 - RNA, 28 nt, Artificial Sequence
  Synthetic Oligonucleotide; CD80 exon 6; Set C
aaaaauuccauuuacugagauuaaggua

SEQ ID NO: 58496 - RNA, 19 nt, Artificial Sequence
  Synthetic Oligonucleotide; CD80 exon 6; Set C
auuccauuuacugagauua

SEQ ID NO: 58497 - RNA, 21 nt, Artificial Sequence
  Synthetic Oligonucleotide; CD80 exon 6; Set C
aauuccauuuacugagauuaa

SEQ ID NO: 58498 - RNA, 27 nt, Artificial Sequence
  Synthetic Oligonucleotide; CD80 exon 6; Set C
aaaaauuccauuuacugagauuaaggu

SEQ ID NO: 58499 - RNA, 25 nt, Artificial Sequence
  Synthetic Oligonucleotide; CD80 exon 6; Set C
aaaauuccauuuacugagauuaagg

SEQ ID NO: 58500 - RNA, 20 nt, Artificial Sequence
  Synthetic Oligonucleotide; CD80 exon 6; Set C
aauuccauuuacugagauua

SEQ ID NO: 58501 - RNA, 22 nt, Artificial Sequence
  Synthetic Oligonucleotide; CD80 exon 6; Set C
aaauuccauuuacugagauuaa

SEQ ID NO: 58502 - RNA, 26 nt, Artificial Sequence
  Synthetic Oligonucleotide; CD80 exon 6; Set C
aaaaauuccauuuacugagauuaagg

SEQ ID NO: 58503 - RNA, 21 nt, Artificial Sequence
  Synthetic Oligonucleotide; CD80 exon 6; Set C
aaauuccauuuacugagauua

SEQ ID NO: 58504 - RNA, 23 nt, Artificial Sequence
  Synthetic Oligonucleotide; CD80 exon 6; Set C
aaaauuccauuuacugagauuaa

SEQ ID NO: 58505 - RNA, 22 nt, Artificial Sequence
  Synthetic Oligonucleotide; CD80 exon 6; Set C
aaaauuccauuuacugagauua

SEQ ID NO: 58506 - RNA, 24 nt, Artificial Sequence
  Synthetic Oligonucleotide; CD80 exon 6; Set C
aaaaauuccauuuacugagauuaa

SEQ ID NO: 58507 - RNA, 23 nt, Artificial Sequence
  Synthetic Oligonucleotide; CD80 exon 6; Set C
aaaaauuccauuuacugagauua

SEQ ID NO: 58508 - RNA, 32 nt, Artificial Sequence
  Synthetic Oligonucleotide; CD80 exon 6; Set C
auaucacaaaaauuccauuuacugagauuaag

SEQ ID NO: 58509 - RNA, 39 nt, Artificial Sequence
  Synthetic Oligonucleotide; CD80 exon 6; Set A
aggcagcauaucacaaaaauuccauuuacugagauuaag

SEQ ID NO: 58510 - RNA, 40 nt, Artificial Sequence
  Synthetic Oligonucleotide; CD80 exon 6; Set A
caggcagcauaucacaaaaauuccauuuacugagauuaag

SEQ ID NO: 58511 - RNA, 22 nt, Artificial Sequence
  Synthetic Oligonucleotide; CD80 exon 6; Set C
auaucacaaaaauuccauuuac

SEQ ID NO: 58512 - RNA, 40 nt, Artificial Sequence
  Synthetic Oligonucleotide; CD80 exon 6; Set A
ucaggcagcauaucacaaaaauuccauuuacugagauuaa

SEQ ID NO: 58513 - RNA, 21 nt, Artificial Sequence
  Synthetic Oligonucleotide; CD80 exon 6; Set C
auaucacaaaaauuccauuua

SEQ ID NO: 58514 - RNA, 39 nt, Artificial Sequence
  Synthetic Oligonucleotide; CD80 exon 6; Set A
ucaggcagcauaucacaaaaauuccauuuacugagauua

SEQ ID NO: 58515 - RNA, 20 nt, Artificial Sequence
  Synthetic Oligonucleotide; CD80 exon 6; Set C
auaucacaaaaauuccauuu

SEQ ID NO: 58516 - RNA, 29 nt, Artificial Sequence
  Synthetic Oligonucleotide; CD80 exon 6; Set C
aggcagcauaucacaaaaauuccauuuac

SEQ ID NO: 58517 - RNA, 15 nt, Artificial Sequence
  Synthetic Oligonucleotide; CD80 exon 6; Set C
auaucacaaaaauuc

SEQ ID NO: 58518 - RNA, 28 nt, Artificial Sequence
  Synthetic Oligonucleotide; CD80 exon 6; Set C
aggcagcauaucacaaaaauuccauuua

SEQ ID NO: 58519 - RNA, 30 nt, Artificial Sequence
  Synthetic Oligonucleotide; CD80 exon 6; Set A
caggcagcauaucacaaaaauuccauuuac

SEQ ID NO: 58520 - RNA, 27 nt, Artificial Sequence
  Synthetic Oligonucleotide; CD80 exon 6; Set C
aggcagcauaucacaaaaauuccauuu

SEQ ID NO: 58521 - RNA, 29 nt, Artificial Sequence
  Synthetic Oligonucleotide; CD80 exon 6; Set A
caggcagcauaucacaaaaauuccauuua

SEQ ID NO: 58522 - RNA, 31 nt, Artificial Sequence
  Synthetic Oligonucleotide; CD80 exon 6; Set A
ucaggcagcauaucacaaaaauuccauuuac

SEQ ID NO: 58523 - RNA, 28 nt, Artificial Sequence
  Synthetic Oligonucleotide; CD80 exon 6; Set A
caggcagcauaucacaaaaauuccauuu

SEQ ID NO: 58524 - RNA, 30 nt, Artificial Sequence
  Synthetic Oligonucleotide; CD80 exon 6; Set A
ucaggcagcauaucacaaaaauuccauuua

SEQ ID NO: 58525 - RNA, 29 nt, Artificial Sequence
  Synthetic Oligonucleotide; CD80 exon 6; Set A
ucaggcagcauaucacaaaaauuccauuu

SEQ ID NO: 58526 - RNA, 31 nt, Artificial Sequence
  Synthetic Oligonucleotide; CD80 exon 6; Set A
gucaggcagcauaucacaaaaauuccauuua

SEQ ID NO: 58527 - RNA, 30 nt, Artificial Sequence
  Synthetic Oligonucleotide; CD80 exon 6; Set A
gucaggcagcauaucacaaaaauuccauuu

SEQ ID NO: 58528 - RNA, 32 nt, Artificial Sequence
  Synthetic Oligonucleotide; CD80 exon 6; Set A
ggucaggcagcauaucacaaaaauuccauuua

SEQ ID NO: 58529 - RNA, 31 nt, Artificial Sequence
  Synthetic Oligonucleotide; CD80 exon 6; Set A
ggucaggcagcauaucacaaaaauuccauuu

SEQ ID NO: 58530 - RNA, 33 nt, Artificial Sequence
  Synthetic Oligonucleotide; CD80 exon 6; Set A
aggucaggcagcauaucacaaaaauuccauuua

SEQ ID NO: 58531 - RNA, 32 nt, Artificial Sequence
  Synthetic Oligonucleotide; CD80 exon 6; Set A
aggucaggcagcauaucacaaaaauuccauuu

SEQ ID NO: 58532 - RNA, 34 nt, Artificial Sequence
  Synthetic Oligonucleotide; CD80 exon 6; Set A
uaggucaggcagcauaucacaaaaauuccauuua

SEQ ID NO: 58533 - RNA, 36 nt, Artificial Sequence
  Synthetic Oligonucleotide; CD80 exon 6; Set A
guaggucaggcagcauaucacaaaaauuccauuuac

SEQ ID NO: 58534 - RNA, 22 nt, Artificial Sequence
  Synthetic Oligonucleotide; CD80 exon 6; Set C
aggcagcauaucacaaaaauuc

SEQ ID NO: 58535 - RNA, 33 nt, Artificial Sequence
  Synthetic Oligonucleotide; CD80 exon 6; Set A
uaggucaggcagcauaucacaaaaauuccauuu

SEQ ID NO: 58536 - RNA, 35 nt, Artificial Sequence
  Synthetic Oligonucleotide; CD80 exon 6; Set A
guaggucaggcagcauaucacaaaaauuccauuua

SEQ ID NO: 58537 - RNA, 21 nt, Artificial Sequence
  Synthetic Oligonucleotide; CD80 exon 6; Set C
aggcagcauaucacaaaaauu

SEQ ID NO: 58538 - RNA, 37 nt, Artificial Sequence
  Synthetic Oligonucleotide; CD80 exon 6; Set A
aguaggucaggcagcauaucacaaaaauuccauuuac

SEQ ID NO: 58539 - RNA, 23 nt, Artificial Sequence
  Synthetic Oligonucleotide; CD80 exon 6; Set C
caggcagcauaucacaaaaauuc

SEQ ID NO: 58540 - RNA, 34 nt, Artificial Sequence
  Synthetic Oligonucleotide; CD80 exon 6; Set A
guaggucaggcagcauaucacaaaaauuccauuu

SEQ ID NO: 58541 - RNA, 36 nt, Artificial Sequence
  Synthetic Oligonucleotide; CD80 exon 6; Set A
aguaggucaggcagcauaucacaaaaauuccauuua

SEQ ID NO: 58542 - RNA, 20 nt, Artificial Sequence
  Synthetic Oligonucleotide; CD80 exon 6; Set C
aggcagcauaucacaaaaau

SEQ ID NO: 58543 - RNA, 22 nt, Artificial Sequence
  Synthetic Oligonucleotide; CD80 exon 6; Set C
caggcagcauaucacaaaaauu

SEQ ID NO: 58544 - RNA, 24 nt, Artificial Sequence
  Synthetic Oligonucleotide; CD80 exon 6; Set C
ucaggcagcauaucacaaaaauuc

SEQ ID NO: 58545 - RNA, 21 nt, Artificial Sequence
  Synthetic Oligonucleotide; CD80 exon 6; Set C
caggcagcauaucacaaaaau

SEQ ID NO: 58546 - RNA, 19 nt, Artificial Sequence
  Synthetic Oligonucleotide; CD80 exon 6; Set C
aggcagcauaucacaaaaa

SEQ ID NO: 58547 - RNA, 23 nt, Artificial Sequence
  Synthetic Oligonucleotide; CD80 exon 6; Set C
ucaggcagcauaucacaaaaauu

SEQ ID NO: 58548 - RNA, 36 nt, Artificial Sequence
  Synthetic Oligonucleotide; CD80 exon 6; Set A
caguaggucaggcagcauaucacaaaaauuccauuu

SEQ ID NO: 58549 - RNA, 18 nt, Artificial Sequence
  Synthetic Oligonucleotide; CD80 exon 6; Set C
aggcagcauaucacaaaa

SEQ ID NO: 58550 - RNA, 22 nt, Artificial Sequence
  Synthetic Oligonucleotide; CD80 exon 6; Set C
ucaggcagcauaucacaaaaau

SEQ ID NO: 58551 - RNA, 20 nt, Artificial Sequence
  Synthetic Oligonucleotide; CD80 exon 6; Set C
caggcagcauaucacaaaaa

SEQ ID NO: 58552 - RNA, 17 nt, Artificial Sequence
  Synthetic Oligonucleotide; CD80 exon 6; Set C
aggcagcauaucacaaa

SEQ ID NO: 58553 - RNA, 19 nt, Artificial Sequence
  Synthetic Oligonucleotide; CD80 exon 6; Set C
caggcagcauaucacaaaa

SEQ ID NO: 58554 - RNA, 21 nt, Artificial Sequence
  Synthetic Oligonucleotide; CD80 exon 6; Set C
ucaggcagcauaucacaaaaa

SEQ ID NO: 58555 - RNA, 18 nt, Artificial Sequence
  Synthetic Oligonucleotide; CD80 exon 6; Set C
caggcagcauaucacaaa

SEQ ID NO: 58556 - RNA, 20 nt, Artificial Sequence
  Synthetic Oligonucleotide; CD80 exon 6; Set C
ucaggcagcauaucacaaaa

SEQ ID NO: 58557 - RNA, 26 nt, Artificial Sequence
  Synthetic Oligonucleotide; CD80 exon 6; Set C
aggucaggcagcauaucacaaaaauu

SEQ ID NO: 58558 - RNA, 19 nt, Artificial Sequence
  Synthetic Oligonucleotide; CD80 exon 6; Set C
ucaggcagcauaucacaaa

SEQ ID NO: 58559 - RNA, 25 nt, Artificial Sequence
  Synthetic Oligonucleotide; CD80 exon 6; Set C
aggucaggcagcauaucacaaaaau

SEQ ID NO: 58560 - RNA, 27 nt, Artificial Sequence
  Synthetic Oligonucleotide; CD80 exon 6; Set A
uaggucaggcagcauaucacaaaaauu

SEQ ID NO: 58561 - RNA, 29 nt, Artificial Sequence
  Synthetic Oligonucleotide; CD80 exon 6; Set A
guaggucaggcagcauaucacaaaaauuc

SEQ ID NO: 58562 - RNA, 26 nt, Artificial Sequence
  Synthetic Oligonucleotide; CD80 exon 6; Set C
uaggucaggcagcauaucacaaaaau

SEQ ID NO: 58563 - RNA, 28 nt, Artificial Sequence
  Synthetic Oligonucleotide; CD80 exon 6; Set A
guaggucaggcagcauaucacaaaaauu

SEQ ID NO: 58564 - RNA, 30 nt, Artificial Sequence
  Synthetic Oligonucleotide; CD80 exon 6; Set A
aguaggucaggcagcauaucacaaaaauuc

SEQ ID NO: 58565 - RNA, 27 nt, Artificial Sequence
  Synthetic Oligonucleotide; CD80 exon 6; Set A
guaggucaggcagcauaucacaaaaau

SEQ ID NO: 58566 - RNA, 29 nt, Artificial Sequence
  Synthetic Oligonucleotide; CD80 exon 6; Set A
aguaggucaggcagcauaucacaaaaauu

SEQ ID NO: 58567 - RNA, 28 nt, Artificial Sequence
  Synthetic Oligonucleotide; CD80 exon 6; Set A
aguaggucaggcagcauaucacaaaaau

SEQ ID NO: 58568 - RNA, 26 nt, Artificial Sequence
  Synthetic Oligonucleotide; CD80 exon 6; Set A
guaggucaggcagcauaucacaaaaa

SEQ ID NO: 58569 - RNA, 25 nt, Artificial Sequence
  Synthetic Oligonucleotide; CD80 exon 6; Set A
guaggucaggcagcauaucacaaaa

SEQ ID NO: 58570 - RNA, 27 nt, Artificial Sequence
  Synthetic Oligonucleotide; CD80 exon 6; Set A
aguaggucaggcagcauaucacaaaaa

SEQ ID NO: 58571 - RNA, 24 nt, Artificial Sequence
  Synthetic Oligonucleotide; CD80 exon 6; Set A
guaggucaggcagcauaucacaaa

SEQ ID NO: 58572 - RNA, 26 nt, Artificial Sequence
  Synthetic Oligonucleotide; CD80 exon 6; Set A
aguaggucaggcagcauaucacaaaa

SEQ ID NO: 58573 - RNA, 25 nt, Artificial Sequence
  Synthetic Oligonucleotide; CD80 exon 6; Set A
aguaggucaggcagcauaucacaaa

SEQ ID NO: 58574 - RNA, 40 nt, Artificial Sequence
  Synthetic Oligonucleotide; CD80 exon 6; Set C
uaguacuuacaguaggucaggcagcauaucacaaaaauuc

SEQ ID NO: 58575 - RNA, 37 nt, Artificial Sequence
  Synthetic Oligonucleotide; CD80 exon 6; Set A
aguacuuacaguaggucaggcagcauaucacaaaaau

SEQ ID NO: 58576 - RNA, 39 nt, Artificial Sequence
  Synthetic Oligonucleotide; CD80 exon 6; Set C
uaguacuuacaguaggucaggcagcauaucacaaaaauu

SEQ ID NO: 58577 - RNA, 17 nt, Artificial Sequence
  Synthetic Oligonucleotide; CD80 exon 6; Set C
guaggucaggcagcaua

SEQ ID NO: 58578 - RNA, 19 nt, Artificial Sequence
  Synthetic Oligonucleotide; CD80 exon 6; Set C
aguaggucaggcagcauau

SEQ ID NO: 58579 - RNA, 38 nt, Artificial Sequence
  Synthetic Oligonucleotide; CD80 exon 6; Set C
uaguacuuacaguaggucaggcagcauaucacaaaaau

SEQ ID NO: 58580 - RNA, 40 nt, Artificial Sequence
  Synthetic Oligonucleotide; CD80 exon 6; Set C
auaguacuuacaguaggucaggcagcauaucacaaaaauu

SEQ ID NO: 58581 - RNA, 18 nt, Artificial Sequence
  Synthetic Oligonucleotide; CD80 exon 6; Set C
aguaggucaggcagcaua

SEQ ID NO: 58582 - RNA, 39 nt, Artificial Sequence
  Synthetic Oligonucleotide; CD80 exon 6; Set A
auaguacuuacaguaggucaggcagcauaucacaaaaau

SEQ ID NO: 58583 - RNA, 37 nt, Artificial Sequence
  Synthetic Oligonucleotide; CD80 exon 6; Set C
uaguacuuacaguaggucaggcagcauaucacaaaaa

SEQ ID NO: 58584 - RNA, 36 nt, Artificial Sequence
  Synthetic Oligonucleotide; CD80 exon 6; Set C
uaguacuuacaguaggucaggcagcauaucacaaaa

SEQ ID NO: 58585 - RNA, 40 nt, Artificial Sequence
  Synthetic Oligonucleotide; CD80 exon 6; Set C
gauaguacuuacaguaggucaggcagcauaucacaaaaau

SEQ ID NO: 58586 - RNA, 38 nt, Artificial Sequence
  Synthetic Oligonucleotide; CD80 exon 6; Set C
auaguacuuacaguaggucaggcagcauaucacaaaaa

SEQ ID NO: 58587 - RNA, 35 nt, Artificial Sequence
  Synthetic Oligonucleotide; CD80 exon 6; Set C
uaguacuuacaguaggucaggcagcauaucacaaa

SEQ ID NO: 58588 - RNA, 37 nt, Artificial Sequence
  Synthetic Oligonucleotide; CD80 exon 6; Set C
auaguacuuacaguaggucaggcagcauaucacaaaa

SEQ ID NO: 58589 - RNA, 39 nt, Artificial Sequence
  Synthetic Oligonucleotide; CD80 exon 6; Set C
gauaguacuuacaguaggucaggcagcauaucacaaaaa

SEQ ID NO: 58590 - RNA, 36 nt, Artificial Sequence
  Synthetic Oligonucleotide; CD80 exon 6; Set C
auaguacuuacaguaggucaggcagcauaucacaaa

SEQ ID NO: 58591 - RNA, 38 nt, Artificial Sequence
  Synthetic Oligonucleotide; CD80 exon 6; Set C
gauaguacuuacaguaggucaggcagcauaucacaaaa

SEQ ID NO: 58592 - RNA, 40 nt, Artificial Sequence
  Synthetic Oligonucleotide; CD80 exon 6; Set C
ugauaguacuuacaguaggucaggcagcauaucacaaaaa

SEQ ID NO: 58593 - RNA, 37 nt, Artificial Sequence
  Synthetic Oligonucleotide; CD80 exon 6; Set C
gauaguacuuacaguaggucaggcagcauaucacaaa

SEQ ID NO: 58594 - RNA, 39 nt, Artificial Sequence
  Synthetic Oligonucleotide; CD80 exon 6; Set C
ugauaguacuuacaguaggucaggcagcauaucacaaaa

SEQ ID NO: 58595 - RNA, 38 nt, Artificial Sequence
  Synthetic Oligonucleotide; CD80 exon 6; Set C
ugauaguacuuacaguaggucaggcagcauaucacaaa

SEQ ID NO: 58596 - RNA, 40 nt, Artificial Sequence
  Synthetic Oligonucleotide; CD80 exon 6; Set C
augauaguacuuacaguaggucaggcagcauaucacaaaa

SEQ ID NO: 58597 - RNA, 39 nt, Artificial Sequence
  Synthetic Oligonucleotide; CD80 exon 6; Set C
augauaguacuuacaguaggucaggcagcauaucacaaa

SEQ ID NO: 58598 - RNA, 40 nt, Artificial Sequence
  Synthetic Oligonucleotide; CD80 exon 6; Set C
uaugauaguacuuacaguaggucaggcagcauaucacaaa

SEQ ID NO: 58599 - RNA, 28 nt, Artificial Sequence
  Synthetic Oligonucleotide; CD80 exon 6; Set A
uaguacuuacaguaggucaggcagcaua

SEQ ID NO: 58600 - RNA, 29 nt, Artificial Sequence
  Synthetic Oligonucleotide; CD80 exon 6; Set A
auaguacuuacaguaggucaggcagcaua

SEQ ID NO: 58601 - RNA, 30 nt, Artificial Sequence
  Synthetic Oligonucleotide; CD80 exon 6; Set C
gauaguacuuacaguaggucaggcagcaua

SEQ ID NO: 58602 - RNA, 31 nt, Artificial Sequence
  Synthetic Oligonucleotide; CD80 exon 6; Set C
ugauaguacuuacaguaggucaggcagcaua

SEQ ID NO: 58603 - RNA, 32 nt, Artificial Sequence
  Synthetic Oligonucleotide; CD80 exon 6; Set C
augauaguacuuacaguaggucaggcagcaua

SEQ ID NO: 58604 - RNA, 33 nt, Artificial Sequence
  Synthetic Oligonucleotide; CD80 exon 6; Set C
uaugauaguacuuacaguaggucaggcagcaua

SEQ ID NO: 58605 - RNA, 34 nt, Artificial Sequence
  Synthetic Oligonucleotide; CD80 exon 6; Set C
guaugauaguacuuacaguaggucaggcagcaua

SEQ ID NO: 58606 - RNA, 35 nt, Artificial Sequence
  Synthetic Oligonucleotide; CD80 exon 6; Set C
gguaugauaguacuuacaguaggucaggcagcaua

SEQ ID NO: 58607 - RNA, 21 nt, Artificial Sequence
  Synthetic Oligonucleotide; CD80 exon 6; Set C
uaguacuuacaguaggucagg

SEQ ID NO: 58608 - RNA, 22 nt, Artificial Sequence
  Synthetic Oligonucleotide; CD80 exon 6; Set C
auaguacuuacaguaggucagg

SEQ ID NO: 58609 - RNA, 20 nt, Artificial Sequence
  Synthetic Oligonucleotide; CD80 exon 6; Set C
uaguacuuacaguaggucag

SEQ ID NO: 58610 - RNA, 19 nt, Artificial Sequence
  Synthetic Oligonucleotide; CD80 exon 6; Set C
uaguacuuacaguagguca

SEQ ID NO: 58611 - RNA, 23 nt, Artificial Sequence
  Synthetic Oligonucleotide; CD80 exon 6; Set C
gauaguacuuacaguaggucagg

SEQ ID NO: 58612 - RNA, 21 nt, Artificial Sequence
  Synthetic Oligonucleotide; CD80 exon 6; Set C
auaguacuuacaguaggucag

SEQ ID NO: 58613 - RNA, 20 nt, Artificial Sequence
  Synthetic Oligonucleotide; CD80 exon 6; Set C
auaguacuuacaguagguca

SEQ ID NO: 58614 - RNA, 24 nt, Artificial Sequence
  Synthetic Oligonucleotide; CD80 exon 6; Set C
ugauaguacuuacaguaggucagg

SEQ ID NO: 58615 - RNA, 22 nt, Artificial Sequence
  Synthetic Oligonucleotide; CD80 exon 6; Set C
gauaguacuuacaguaggucag

SEQ ID NO: 58616 - RNA, 21 nt, Artificial Sequence
  Synthetic Oligonucleotide; CD80 exon 6; Set C
gauaguacuuacaguagguca

SEQ ID NO: 58617 - RNA, 25 nt, Artificial Sequence
  Synthetic Oligonucleotide; CD80 exon 6; Set C
augauaguacuuacaguaggucagg

SEQ ID NO: 58618 - RNA, 23 nt, Artificial Sequence
  Synthetic Oligonucleotide; CD80 exon 6; Set C
ugauaguacuuacaguaggucag

SEQ ID NO: 58619 - RNA, 22 nt, Artificial Sequence
  Synthetic Oligonucleotide; CD80 exon 6; Set C
ugauaguacuuacaguagguca

SEQ ID NO: 58620 - RNA, 26 nt, Artificial Sequence
  Synthetic Oligonucleotide; CD80 exon 6; Set B
uaugauaguacuuacaguaggucagg

SEQ ID NO: 58621 - RNA, 24 nt, Artificial Sequence
  Synthetic Oligonucleotide; CD80 exon 6; Set C
augauaguacuuacaguaggucag

SEQ ID NO: 58622 - RNA, 23 nt, Artificial Sequence
  Synthetic Oligonucleotide; CD80 exon 6; Set C
augauaguacuuacaguagguca

SEQ ID NO: 58623 - RNA, 27 nt, Artificial Sequence
  Synthetic Oligonucleotide; CD80 exon 6; Set B
guaugauaguacuuacaguaggucagg

SEQ ID NO: 58624 - RNA, 25 nt, Artificial Sequence
  Synthetic Oligonucleotide; CD80 exon 6; Set C
uaugauaguacuuacaguaggucag

SEQ ID NO: 58625 - RNA, 24 nt, Artificial Sequence
  Synthetic Oligonucleotide; CD80 exon 6; Set C
uaugauaguacuuacaguagguca

SEQ ID NO: 58626 - RNA, 28 nt, Artificial Sequence
  Synthetic Oligonucleotide; CD80 exon 6; Set B
gguaugauaguacuuacaguaggucagg

SEQ ID NO: 58627 - RNA, 26 nt, Artificial Sequence
  Synthetic Oligonucleotide; CD80 exon 6; Set C
guaugauaguacuuacaguaggucag

SEQ ID NO: 58628 - RNA, 15 nt, Artificial Sequence
  Synthetic Oligonucleotide; CD80 exon 6; Set C
auaguacuuacagua

SEQ ID NO: 58629 - RNA, 25 nt, Artificial Sequence
  Synthetic Oligonucleotide; CD80 exon 6; Set C
guaugauaguacuuacaguagguca

SEQ ID NO: 58630 - RNA, 27 nt, Artificial Sequence
  Synthetic Oligonucleotide; CD80 exon 6; Set B
gguaugauaguacuuacaguaggucag

SEQ ID NO: 58631 - RNA, 16 nt, Artificial Sequence
  Synthetic Oligonucleotide; CD80 exon 6; Set C
gauaguacuuacagua

SEQ ID NO: 58632 - RNA, 26 nt, Artificial Sequence
  Synthetic Oligonucleotide; CD80 exon 6; Set B
gguaugauaguacuuacaguagguca

SEQ ID NO: 58633 - RNA, 15 nt, Artificial Sequence
  Synthetic Oligonucleotide; CD80 exon 6; Set C
gauaguacuuacagu

SEQ ID NO: 58634 - RNA, 17 nt, Artificial Sequence
  Synthetic Oligonucleotide; CD80 exon 6; Set C
ugauaguacuuacagua

SEQ ID NO: 58635 - RNA, 16 nt, Artificial Sequence
  Synthetic Oligonucleotide; CD80 exon 6; Set C
ugauaguacuuacagu

SEQ ID NO: 58636 - RNA, 18 nt, Artificial Sequence
  Synthetic Oligonucleotide; CD80 exon 6; Set C
augauaguacuuacagua

SEQ ID NO: 58637 - RNA, 17 nt, Artificial Sequence
  Synthetic Oligonucleotide; CD80 exon 6; Set C
augauaguacuuacagu

SEQ ID NO: 58638 - RNA, 19 nt, Artificial Sequence
  Synthetic Oligonucleotide; CD80 exon 6; Set C
uaugauaguacuuacagua

SEQ ID NO: 58639 - RNA, 18 nt, Artificial Sequence
  Synthetic Oligonucleotide; CD80 exon 6; Set C
uaugauaguacuuacagu

SEQ ID NO: 58640 - RNA, 20 nt, Artificial Sequence
  Synthetic Oligonucleotide; CD80 exon 6; Set C
guaugauaguacuuacagua

SEQ ID NO: 58641 - RNA, 19 nt, Artificial Sequence
  Synthetic Oligonucleotide; CD80 exon 6; Set C
guaugauaguacuuacagu

SEQ ID NO: 58642 - RNA, 21 nt, Artificial Sequence
  Synthetic Oligonucleotide; CD80 exon 6; Set C
gguaugauaguacuuacagua

SEQ ID NO: 58643 - RNA, 20 nt, Artificial Sequence
  Synthetic Oligonucleotide; CD80 exon 6; Set C
gguaugauaguacuuacagu

SEQ ID NO: 58644 - RNA, 34 nt, Artificial Sequence
  Synthetic Oligonucleotide; CD80 exon 6; Set B
agaucaggaugaugguaugauaguacuuacagua

SEQ ID NO: 58645 - RNA, 33 nt, Artificial Sequence
  Synthetic Oligonucleotide; CD80 exon 6; Set B
agaucaggaugaugguaugauaguacuuacagu

SEQ ID NO: 58646 - RNA, 35 nt, Artificial Sequence
  Synthetic Oligonucleotide; CD80 exon 6; Set B
gagaucaggaugaugguaugauaguacuuacagua

SEQ ID NO: 58647 - RNA, 34 nt, Artificial Sequence
  Synthetic Oligonucleotide; CD80 exon 6; Set B
gagaucaggaugaugguaugauaguacuuacagu

SEQ ID NO: 58648 - RNA, 36 nt, Artificial Sequence
  Synthetic Oligonucleotide; CD80 exon 6; Set B
ugagaucaggaugaugguaugauaguacuuacagua

SEQ ID NO: 58649 - RNA, 35 nt, Artificial Sequence
  Synthetic Oligonucleotide; CD80 exon 6; Set B
ugagaucaggaugaugguaugauaguacuuacagu

SEQ ID NO: 58650 - RNA, 37 nt, Artificial Sequence
  Synthetic Oligonucleotide; CD80 exon 6; Set B
uugagaucaggaugaugguaugauaguacuuacagua

SEQ ID NO: 58651 - RNA, 36 nt, Artificial Sequence
  Synthetic Oligonucleotide; CD80 exon 6; Set B
uugagaucaggaugaugguaugauaguacuuacagu

SEQ ID NO: 58652 - RNA, 38 nt, Artificial Sequence
  Synthetic Oligonucleotide; CD80 exon 6; Set B
auugagaucaggaugaugguaugauaguacuuacagua

SEQ ID NO: 58653 - RNA, 37 nt, Artificial Sequence
  Synthetic Oligonucleotide; CD80 exon 6; Set B
auugagaucaggaugaugguaugauaguacuuacagu

SEQ ID NO: 58654 - RNA, 40 nt, Artificial Sequence
  Synthetic Oligonucleotide; CD80 exon 6; Set B
uugaucuuccagaauugagaucaggaugaugguaugauag

SEQ ID NO: 58655 - RNA, 39 nt, Artificial Sequence
  Synthetic Oligonucleotide; CD80 exon 6; Set B
uugaucuuccagaauugagaucaggaugaugguaugaua

SEQ ID NO: 58656 - RNA, 40 nt, Artificial Sequence
  Synthetic Oligonucleotide; CD80 exon 6; Set B
uuugaucuuccagaauugagaucaggaugaugguaugaua

SEQ ID NO: 58657 - RNA, 38 nt, Artificial Sequence
  Synthetic Oligonucleotide; CD80 exon 6; Set B
uugaucuuccagaauugagaucaggaugaugguaugau

SEQ ID NO: 58658 - RNA, 39 nt, Artificial Sequence
  Synthetic Oligonucleotide; CD80 exon 6; Set B
uuugaucuuccagaauugagaucaggaugaugguaugau

SEQ ID NO: 58659 - RNA, 38 nt, Artificial Sequence
  Synthetic Oligonucleotide; CD80 exon 6; Set B
uuugaucuuccagaauugagaucaggaugaugguauga

SEQ ID NO: 58660 - RNA, 40 nt, Artificial Sequence
  Synthetic Oligonucleotide; CD80 exon 6; Set C
guuugaucuuccagaauugagaucaggaugaugguaugau

SEQ ID NO: 58661 - RNA, 39 nt, Artificial Sequence
  Synthetic Oligonucleotide; CD80 exon 6; Set C
guuugaucuuccagaauugagaucaggaugaugguauga

SEQ ID NO: 58662 - RNA, 37 nt, Artificial Sequence
  Synthetic Oligonucleotide; CD80 exon 6; Set B
uuugaucuuccagaauugagaucaggaugaugguaug

SEQ ID NO: 58663 - RNA, 36 nt, Artificial Sequence
  Synthetic Oligonucleotide; CD80 exon 6; Set B
uuugaucuuccagaauugagaucaggaugaugguau

SEQ ID NO: 58664 - RNA, 40 nt, Artificial Sequence
  Synthetic Oligonucleotide; CD80 exon 6; Set C
aguuugaucuuccagaauugagaucaggaugaugguauga

SEQ ID NO: 58665 - RNA, 38 nt, Artificial Sequence
  Synthetic Oligonucleotide; CD80 exon 6; Set B
guuugaucuuccagaauugagaucaggaugaugguaug

SEQ ID NO: 58666 - RNA, 35 nt, Artificial Sequence
  Synthetic Oligonucleotide; CD80 exon 6; Set B
uuugaucuuccagaauugagaucaggaugauggua

SEQ ID NO: 58667 - RNA, 37 nt, Artificial Sequence
  Synthetic Oligonucleotide; CD80 exon 6; Set B
guuugaucuuccagaauugagaucaggaugaugguau

SEQ ID NO: 58668 - RNA, 39 nt, Artificial Sequence
  Synthetic Oligonucleotide; CD80 exon 6; Set B
aguuugaucuuccagaauugagaucaggaugaugguaug

SEQ ID NO: 58669 - RNA, 36 nt, Artificial Sequence
  Synthetic Oligonucleotide; CD80 exon 6; Set B
guuugaucuuccagaauugagaucaggaugauggua

SEQ ID NO: 58670 - RNA, 34 nt, Artificial Sequence
  Synthetic Oligonucleotide; CD80 exon 6; Set B
uuugaucuuccagaauugagaucaggaugauggu

SEQ ID NO: 58671 - RNA, 38 nt, Artificial Sequence
  Synthetic Oligonucleotide; CD80 exon 6; Set B
aguuugaucuuccagaauugagaucaggaugaugguau

SEQ ID NO: 58672 - RNA, 37 nt, Artificial Sequence
  Synthetic Oligonucleotide; CD80 exon 6; Set B
aguuugaucuuccagaauugagaucaggaugauggua

SEQ ID NO: 58673 - RNA, 35 nt, Artificial Sequence
  Synthetic Oligonucleotide; CD80 exon 6; Set B
guuugaucuuccagaauugagaucaggaugauggu

SEQ ID NO: 58674 - RNA, 36 nt, Artificial Sequence
  Synthetic Oligonucleotide; CD80 exon 6; Set B
aguuugaucuuccagaauugagaucaggaugauggu

SEQ ID NO: 58675 - RNA, 20 nt, Artificial Sequence
  Synthetic Oligonucleotide; CD80 exon 6; Set C
uugaucuuccagaauugaga

SEQ ID NO: 58676 - RNA, 19 nt, Artificial Sequence
  Synthetic Oligonucleotide; CD80 exon 6; Set C
uugaucuuccagaauugag

SEQ ID NO: 58677 - RNA, 21 nt, Artificial Sequence
  Synthetic Oligonucleotide; CD80 exon 6; Set C
uuugaucuuccagaauugaga

SEQ ID NO: 58678 - RNA, 18 nt, Artificial Sequence
  Synthetic Oligonucleotide; CD80 exon 6; Set C
uugaucuuccagaauuga

SEQ ID NO: 58679 - RNA, 20 nt, Artificial Sequence
  Synthetic Oligonucleotide; CD80 exon 6; Set C
uuugaucuuccagaauugag

SEQ ID NO: 58680 - RNA, 22 nt, Artificial Sequence
  Synthetic Oligonucleotide; CD80 exon 6; Set C
guuugaucuuccagaauugaga

SEQ ID NO: 58681 - RNA, 17 nt, Artificial Sequence
  Synthetic Oligonucleotide; CD80 exon 6; Set C
uugaucuuccagaauug

SEQ ID NO: 58682 - RNA, 19 nt, Artificial Sequence
  Synthetic Oligonucleotide; CD80 exon 6; Set C
uuugaucuuccagaauuga

SEQ ID NO: 58683 - RNA, 21 nt, Artificial Sequence
  Synthetic Oligonucleotide; CD80 exon 6; Set C
guuugaucuuccagaauugag

SEQ ID NO: 58684 - RNA, 23 nt, Artificial Sequence
  Synthetic Oligonucleotide; CD80 exon 6; Set C
aguuugaucuuccagaauugaga

SEQ ID NO: 58685 - RNA, 16 nt, Artificial Sequence
  Synthetic Oligonucleotide; CD80 exon 6; Set C
uugaucuuccagaauu

SEQ ID NO: 58686 - RNA, 18 nt, Artificial Sequence
  Synthetic Oligonucleotide; CD80 exon 6; Set C
uuugaucuuccagaauug

SEQ ID NO: 58687 - RNA, 20 nt, Artificial Sequence
  Synthetic Oligonucleotide; CD80 exon 6; Set C
guuugaucuuccagaauuga

SEQ ID NO: 58688 - RNA, 22 nt, Artificial Sequence
  Synthetic Oligonucleotide; CD80 exon 6; Set C
aguuugaucuuccagaauugag

SEQ ID NO: 58689 - RNA, 17 nt, Artificial Sequence
  Synthetic Oligonucleotide; CD80 exon 6; Set C
uuugaucuuccagaauu

SEQ ID NO: 58690 - RNA, 19 nt, Artificial Sequence
  Synthetic Oligonucleotide; CD80 exon 6; Set C
guuugaucuuccagaauug

SEQ ID NO: 58691 - RNA, 21 nt, Artificial Sequence
  Synthetic Oligonucleotide; CD80 exon 6; Set C
aguuugaucuuccagaauuga

SEQ ID NO: 58692 - RNA, 18 nt, Artificial Sequence
  Synthetic Oligonucleotide; CD80 exon 6; Set C
guuugaucuuccagaauu

SEQ ID NO: 58693 - RNA, 20 nt, Artificial Sequence
  Synthetic Oligonucleotide; CD80 exon 6; Set C
aguuugaucuuccagaauug

SEQ ID NO: 58694 - RNA, 15 nt, Artificial Sequence
  Synthetic Oligonucleotide; CD80 exon 6; Set C
uauuuccuacugccu

SEQ ID NO: 58695 - RNA, 15 nt, Artificial Sequence
  Synthetic Oligonucleotide; CD80 exon 6; Set C
guauuuccuacugcc

SEQ ID NO: 58696 - RNA, 18 nt, Artificial Sequence
  Synthetic Oligonucleotide; CD80 exon 6; Set C
auguauuuccuacugccu

SEQ ID NO: 58697 - RNA, 16 nt, Artificial Sequence
  Synthetic Oligonucleotide; CD80 exon 6; Set C
uguauuuccuacugcc

SEQ ID NO: 58698 - RNA, 17 nt, Artificial Sequence
  Synthetic Oligonucleotide; CD80 exon 6; Set C
auguauuuccuacugcc

SEQ ID NO: 58699 - RNA, 18 nt, Artificial Sequence
  Synthetic Oligonucleotide; CD80 exon 6; Set C
aauguauuuccuacugcc

SEQ ID NO: 58700 - RNA, 21 nt, Artificial Sequence
  Synthetic Oligonucleotide; CD80 exon 6; Set C
guaauguauuuccuacugccu

SEQ ID NO: 58701 - RNA, 19 nt, Artificial Sequence
  Synthetic Oligonucleotide; CD80 exon 6; Set C
uaauguauuuccuacugcc

SEQ ID NO: 58702 - RNA, 15 nt, Artificial Sequence
  Synthetic Oligonucleotide; CD80 exon 6; Set C
auguauuuccuacug

SEQ ID NO: 58703 - RNA, 22 nt, Artificial Sequence
  Synthetic Oligonucleotide; CD80 exon 6; Set C
uguaauguauuuccuacugccu

SEQ ID NO: 58704 - RNA, 16 nt, Artificial Sequence
  Synthetic Oligonucleotide; CD80 exon 6; Set C
aauguauuuccuacug

SEQ ID NO: 58705 - RNA, 17 nt, Artificial Sequence
  Synthetic Oligonucleotide; CD80 exon 6; Set C
uaauguauuuccuacug

SEQ ID NO: 58706 - RNA, 29 nt, Artificial Sequence
  Synthetic Oligonucleotide; CD80 exon 6; Set A
ugucagcuguaauguauuuccuacugccu

SEQ ID NO: 58707 - RNA, 30 nt, Artificial Sequence
  Synthetic Oligonucleotide; CD80 exon 6; Set A
augucagcuguaauguauuuccuacugccu

SEQ ID NO: 58708 - RNA, 31 nt, Artificial Sequence
  Synthetic Oligonucleotide; CD80 exon 6; Set A
aaugucagcuguaauguauuuccuacugccu

SEQ ID NO: 58709 - RNA, 29 nt, Artificial Sequence
  Synthetic Oligonucleotide; CD80 exon 6; Set A
augucagcuguaauguauuuccuacugcc

SEQ ID NO: 58710 - RNA, 32 nt, Artificial Sequence
  Synthetic Oligonucleotide; CD80 exon 6; Set A
uaaugucagcuguaauguauuuccuacugccu

SEQ ID NO: 58711 - RNA, 30 nt, Artificial Sequence
  Synthetic Oligonucleotide; CD80 exon 6; Set A
aaugucagcuguaauguauuuccuacugcc

SEQ ID NO: 58712 - RNA, 33 nt, Artificial Sequence
  Synthetic Oligonucleotide; CD80 exon 6; Set A
auaaugucagcuguaauguauuuccuacugccu

SEQ ID NO: 58713 - RNA, 31 nt, Artificial Sequence
  Synthetic Oligonucleotide; CD80 exon 6; Set A
uaaugucagcuguaauguauuuccuacugcc

SEQ ID NO: 58714 - RNA, 34 nt, Artificial Sequence
  Synthetic Oligonucleotide; CD80 exon 6; Set A
aauaaugucagcuguaauguauuuccuacugccu

SEQ ID NO: 58715 - RNA, 32 nt, Artificial Sequence
  Synthetic Oligonucleotide; CD80 exon 6; Set A
auaaugucagcuguaauguauuuccuacugcc

SEQ ID NO: 58716 - RNA, 35 nt, Artificial Sequence
  Synthetic Oligonucleotide; CD80 exon 6; Set A
gaauaaugucagcuguaauguauuuccuacugccu

SEQ ID NO: 58717 - RNA, 33 nt, Artificial Sequence
  Synthetic Oligonucleotide; CD80 exon 6; Set A
aauaaugucagcuguaauguauuuccuacugcc

SEQ ID NO: 58718 - RNA, 29 nt, Artificial Sequence
  Synthetic Oligonucleotide; CD80 exon 6; Set A
uaaugucagcuguaauguauuuccuacug

SEQ ID NO: 58719 - RNA, 20 nt, Artificial Sequence
  Synthetic Oligonucleotide; CD80 exon 6; Set C
gucagcuguaauguauuucc

SEQ ID NO: 58720 - RNA, 36 nt, Artificial Sequence
  Synthetic Oligonucleotide; CD80 exon 6; Set A
agaauaaugucagcuguaauguauuuccuacugccu

SEQ ID NO: 58721 - RNA, 34 nt, Artificial Sequence
  Synthetic Oligonucleotide; CD80 exon 6; Set A
gaauaaugucagcuguaauguauuuccuacugcc

SEQ ID NO: 58722 - RNA, 30 nt, Artificial Sequence
  Synthetic Oligonucleotide; CD80 exon 6; Set A
auaaugucagcuguaauguauuuccuacug

SEQ ID NO: 58723 - RNA, 37 nt, Artificial Sequence
  Synthetic Oligonucleotide; CD80 exon 6; Set A
aagaauaaugucagcuguaauguauuuccuacugccu

SEQ ID NO: 58724 - RNA, 35 nt, Artificial Sequence
  Synthetic Oligonucleotide; CD80 exon 6; Set A
agaauaaugucagcuguaauguauuuccuacugcc

SEQ ID NO: 58725 - RNA, 36 nt, Artificial Sequence
  Synthetic Oligonucleotide; CD80 exon 6; Set A
aagaauaaugucagcuguaauguauuuccuacugcc

SEQ ID NO: 58726 - RNA, 17 nt, Artificial Sequence
  Synthetic Oligonucleotide; CD80 exon 6; Set C
gucagcuguaauguauu

SEQ ID NO: 58727 - RNA, 37 nt, Artificial Sequence
  Synthetic Oligonucleotide; CD80 exon 6; Set A
aaagaauaaugucagcuguaauguauuuccuacugcc

SEQ ID NO: 58728 - RNA, 16 nt, Artificial Sequence
  Synthetic Oligonucleotide; CD80 exon 6; Set C
gucagcuguaauguau

SEQ ID NO: 58729 - RNA, 40 nt, Artificial Sequence
  Synthetic Oligonucleotide; CD80 exon 6; Set A
gaaaagaauaaugucagcuguaauguauuuccuacugccu

SEQ ID NO: 58730 - RNA, 38 nt, Artificial Sequence
  Synthetic Oligonucleotide; CD80 exon 6; Set A
aaaagaauaaugucagcuguaauguauuuccuacugcc

SEQ ID NO: 58731 - RNA, 15 nt, Artificial Sequence
  Synthetic Oligonucleotide; CD80 exon 6; Set C
gucagcuguaaugua

SEQ ID NO: 58732 - RNA, 39 nt, Artificial Sequence
  Synthetic Oligonucleotide; CD80 exon 6; Set A
gaaaagaauaaugucagcuguaauguauuuccuacugcc

SEQ ID NO: 58733 - RNA, 35 nt, Artificial Sequence
  Synthetic Oligonucleotide; CD80 exon 6; Set A
aaagaauaaugucagcuguaauguauuuccuacug

SEQ ID NO: 58734 - RNA, 36 nt, Artificial Sequence
  Synthetic Oligonucleotide; CD80 exon 6; Set C
aaaagaauaaugucagcuguaauguauuuccuacug

SEQ ID NO: 58735 - RNA, 40 nt, Artificial Sequence
  Synthetic Oligonucleotide; CD80 exon 6; Set A
cuauggagggaaaagaauaaugucagcuguaauguauuuc

SEQ ID NO: 58736 - RNA, 39 nt, Artificial Sequence
  Synthetic Oligonucleotide; CD80 exon 6; Set A
cuauggagggaaaagaauaaugucagcuguaauguauuu

SEQ ID NO: 58737 - RNA, 38 nt, Artificial Sequence
  Synthetic Oligonucleotide; CD80 exon 6; Set A
cuauggagggaaaagaauaaugucagcuguaauguauu

SEQ ID NO: 58738 - RNA, 40 nt, Artificial Sequence
  Synthetic Oligonucleotide; CD80 exon 6; Set A
gcuauggagggaaaagaauaaugucagcuguaauguauuu

SEQ ID NO: 58739 - RNA, 37 nt, Artificial Sequence
  Synthetic Oligonucleotide; CD80 exon 6; Set A
cuauggagggaaaagaauaaugucagcuguaauguau

SEQ ID NO: 58740 - RNA, 39 nt, Artificial Sequence
  Synthetic Oligonucleotide; CD80 exon 6; Set A
gcuauggagggaaaagaauaaugucagcuguaauguauu

SEQ ID NO: 58741 - RNA, 40 nt, Artificial Sequence
  Synthetic Oligonucleotide; CD80 exon 6; Set A
ggcuauggagggaaaagaauaaugucagcuguaauguauu

SEQ ID NO: 58742 - RNA, 36 nt, Artificial Sequence
  Synthetic Oligonucleotide; CD80 exon 6; Set A
cuauggagggaaaagaauaaugucagcuguaaugua

SEQ ID NO: 58743 - RNA, 38 nt, Artificial Sequence
  Synthetic Oligonucleotide; CD80 exon 6; Set A
gcuauggagggaaaagaauaaugucagcuguaauguau

SEQ ID NO: 58744 - RNA, 39 nt, Artificial Sequence
  Synthetic Oligonucleotide; CD80 exon 6; Set A
ggcuauggagggaaaagaauaaugucagcuguaauguau

SEQ ID NO: 58745 - RNA, 37 nt, Artificial Sequence
  Synthetic Oligonucleotide; CD80 exon 6; Set A
gcuauggagggaaaagaauaaugucagcuguaaugua

SEQ ID NO: 58746 - RNA, 35 nt, Artificial Sequence
  Synthetic Oligonucleotide; CD80 exon 6; Set A
cuauggagggaaaagaauaaugucagcuguaaugu

SEQ ID NO: 58747 - RNA, 15 nt, Artificial Sequence
  Synthetic Oligonucleotide; CD80 exon 6; Set C
aaaagaauaauguca

SEQ ID NO: 58748 - RNA, 38 nt, Artificial Sequence
  Synthetic Oligonucleotide; CD80 exon 6; Set A
ggcuauggagggaaaagaauaaugucagcuguaaugua

SEQ ID NO: 58749 - RNA, 36 nt, Artificial Sequence
  Synthetic Oligonucleotide; CD80 exon 6; Set A
gcuauggagggaaaagaauaaugucagcuguaaugu

SEQ ID NO: 58750 - RNA, 34 nt, Artificial Sequence
  Synthetic Oligonucleotide; CD80 exon 6; Set A
cuauggagggaaaagaauaaugucagcuguaaug

SEQ ID NO: 58751 - RNA, 16 nt, Artificial Sequence
  Synthetic Oligonucleotide; CD80 exon 6; Set C
gaaaagaauaauguca

SEQ ID NO: 58752 - RNA, 37 nt, Artificial Sequence
  Synthetic Oligonucleotide; CD80 exon 6; Set A
ggcuauggagggaaaagaauaaugucagcuguaaugu

SEQ ID NO: 58753 - RNA, 33 nt, Artificial Sequence
  Synthetic Oligonucleotide; CD80 exon 6; Set A
cuauggagggaaaagaauaaugucagcuguaau

SEQ ID NO: 58754 - RNA, 35 nt, Artificial Sequence
  Synthetic Oligonucleotide; CD80 exon 6; Set A
gcuauggagggaaaagaauaaugucagcuguaaug

SEQ ID NO: 58755 - RNA, 36 nt, Artificial Sequence
  Synthetic Oligonucleotide; CD80 exon 6; Set A
ggcuauggagggaaaagaauaaugucagcuguaaug

SEQ ID NO: 58756 - RNA, 32 nt, Artificial Sequence
  Synthetic Oligonucleotide; CD80 exon 6; Set A
cuauggagggaaaagaauaaugucagcuguaa

SEQ ID NO: 58757 - RNA, 34 nt, Artificial Sequence
  Synthetic Oligonucleotide; CD80 exon 6; Set A
gcuauggagggaaaagaauaaugucagcuguaau

SEQ ID NO: 58758 - RNA, 35 nt, Artificial Sequence
  Synthetic Oligonucleotide; CD80 exon 6; Set A
ggcuauggagggaaaagaauaaugucagcuguaau

SEQ ID NO: 58759 - RNA, 33 nt, Artificial Sequence
  Synthetic Oligonucleotide; CD80 exon 6; Set A
gcuauggagggaaaagaauaaugucagcuguaa

SEQ ID NO: 58760 - RNA, 31 nt, Artificial Sequence
  Synthetic Oligonucleotide; CD80 exon 6; Set A
cuauggagggaaaagaauaaugucagcugua

SEQ ID NO: 58761 - RNA, 19 nt, Artificial Sequence
  Synthetic Oligonucleotide; CD80 exon 6; Set C
agggaaaagaauaauguca

SEQ ID NO: 58762 - RNA, 34 nt, Artificial Sequence
  Synthetic Oligonucleotide; CD80 exon 6; Set A
ggcuauggagggaaaagaauaaugucagcuguaa

SEQ ID NO: 58763 - RNA, 30 nt, Artificial Sequence
  Synthetic Oligonucleotide; CD80 exon 6; Set A
cuauggagggaaaagaauaaugucagcugu

SEQ ID NO: 58764 - RNA, 32 nt, Artificial Sequence
  Synthetic Oligonucleotide; CD80 exon 6; Set A
gcuauggagggaaaagaauaaugucagcugua

SEQ ID NO: 58765 - RNA, 20 nt, Artificial Sequence
  Synthetic Oligonucleotide; CD80 exon 6; Set C
gagggaaaagaauaauguca

SEQ ID NO: 58766 - RNA, 33 nt, Artificial Sequence
  Synthetic Oligonucleotide; CD80 exon 6; Set A
ggcuauggagggaaaagaauaaugucagcugua

SEQ ID NO: 58767 - RNA, 21 nt, Artificial Sequence
  Synthetic Oligonucleotide; CD80 exon 6; Set C
ggagggaaaagaauaauguca

SEQ ID NO: 58768 - RNA, 32 nt, Artificial Sequence
  Synthetic Oligonucleotide; CD80 exon 6; Set A
ggcuauggagggaaaagaauaaugucagcugu

SEQ ID NO: 58769 - RNA, 34 nt, Artificial Sequence
  Synthetic Oligonucleotide; CD80 exon 6; Set A
uggcuauggagggaaaagaauaaugucagcugua

SEQ ID NO: 58770 - RNA, 22 nt, Artificial Sequence
  Synthetic Oligonucleotide; CD80 exon 6; Set C
uggagggaaaagaauaauguca

SEQ ID NO: 58771 - RNA, 33 nt, Artificial Sequence
  Synthetic Oligonucleotide; CD80 exon 6; Set A
uggcuauggagggaaaagaauaaugucagcugu

SEQ ID NO: 58772 - RNA, 23 nt, Artificial Sequence
  Synthetic Oligonucleotide; CD80 exon 6; Set C
auggagggaaaagaauaauguca

SEQ ID NO: 58773 - RNA, 24 nt, Artificial Sequence
  Synthetic Oligonucleotide; CD80 exon 6; Set C
uauggagggaaaagaauaauguca

SEQ ID NO: 58774 - RNA, 23 nt, Artificial Sequence
  Synthetic Oligonucleotide; CD80 exon 6; Set C
cuauggagggaaaagaauaaugu

SEQ ID NO: 58775 - RNA, 24 nt, Artificial Sequence
  Synthetic Oligonucleotide; CD80 exon 6; Set C
gcuauggagggaaaagaauaaugu

SEQ ID NO: 58776 - RNA, 27 nt, Artificial Sequence
  Synthetic Oligonucleotide; CD80 exon 6; Set C
uggcuauggagggaaaagaauaauguc

SEQ ID NO: 58777 - RNA, 29 nt, Artificial Sequence
  Synthetic Oligonucleotide; CD80 exon 6; Set A
uuggcuauggagggaaaagaauaauguca

SEQ ID NO: 58778 - RNA, 18 nt, Artificial Sequence
  Synthetic Oligonucleotide; CD80 exon 6; Set C
cuauggagggaaaagaau

SEQ ID NO: 58779 - RNA, 19 nt, Artificial Sequence
  Synthetic Oligonucleotide; CD80 exon 6; Set C
gcuauggagggaaaagaau

SEQ ID NO: 58780 - RNA, 17 nt, Artificial Sequence
  Synthetic Oligonucleotide; CD80 exon 6; Set C
cuauggagggaaaagaa

SEQ ID NO: 58781 - RNA, 18 nt, Artificial Sequence
  Synthetic Oligonucleotide; CD80 exon 6; Set C
gcuauggagggaaaagaa

SEQ ID NO: 58782 - RNA, 16 nt, Artificial Sequence
  Synthetic Oligonucleotide; CD80 exon 6; Set C
cuauggagggaaaaga

SEQ ID NO: 58783 - RNA, 15 nt, Artificial Sequence
  Synthetic Oligonucleotide; CD80 exon 6; Set C
cuauggagggaaaag

SEQ ID NO: 58784 - RNA, 31 nt, Artificial Sequence
  Synthetic Oligonucleotide; CD80 exon 6; Set A
uugcuuggcuauggagggaaaagaauaaugu

SEQ ID NO: 58785 - RNA, 19 nt, Artificial Sequence
  Synthetic Oligonucleotide; CD80 exon 6; Set C
ggcuauggagggaaaagaa

SEQ ID NO: 58786 - RNA, 17 nt, Artificial Sequence
  Synthetic Oligonucleotide; CD80 exon 6; Set C
gcuauggagggaaaaga

SEQ ID NO: 58787 - RNA, 33 nt, Artificial Sequence
  Synthetic Oligonucleotide; CD80 exon 6; Set A
cuugcuuggcuauggagggaaaagaauaauguc

SEQ ID NO: 58788 - RNA, 30 nt, Artificial Sequence
  Synthetic Oligonucleotide; CD80 exon 6; Set A
uugcuuggcuauggagggaaaagaauaaug

SEQ ID NO: 58789 - RNA, 16 nt, Artificial Sequence
  Synthetic Oligonucleotide; CD80 exon 6; Set C
gcuauggagggaaaag

SEQ ID NO: 58790 - RNA, 18 nt, Artificial Sequence
  Synthetic Oligonucleotide; CD80 exon 6; Set C
ggcuauggagggaaaaga

SEQ ID NO: 58791 - RNA, 34 nt, Artificial Sequence
  Synthetic Oligonucleotide; CD80 exon 6; Set A
ucuugcuuggcuauggagggaaaagaauaauguc

SEQ ID NO: 58792 - RNA, 29 nt, Artificial Sequence
  Synthetic Oligonucleotide; CD80 exon 6; Set A
uugcuuggcuauggagggaaaagaauaau

SEQ ID NO: 58793 - RNA, 28 nt, Artificial Sequence
  Synthetic Oligonucleotide; CD80 exon 6; Set A
uugcuuggcuauggagggaaaagaauaa

SEQ ID NO: 58794 - RNA, 27 nt, Artificial Sequence
  Synthetic Oligonucleotide; CD80 exon 6; Set A
uugcuuggcuauggagggaaaagaaua

SEQ ID NO: 58795 - RNA, 26 nt, Artificial Sequence
  Synthetic Oligonucleotide; CD80 exon 6; Set A
uugcuuggcuauggagggaaaagaau

SEQ ID NO: 58796 - RNA, 25 nt, Artificial Sequence
  Synthetic Oligonucleotide; CD80 exon 6; Set A
uugcuuggcuauggagggaaaagaa

SEQ ID NO: 58797 - RNA, 39 nt, Artificial Sequence
  Synthetic Oligonucleotide; CD80 exon 6; Set A
aaugcucuugcuuggcuauggagggaaaagaauaauguc

SEQ ID NO: 58798 - RNA, 24 nt, Artificial Sequence
  Synthetic Oligonucleotide; CD80 exon 6; Set A
uugcuuggcuauggagggaaaaga

SEQ ID NO: 58799 - RNA, 40 nt, Artificial Sequence
  Synthetic Oligonucleotide; CD80 exon 6; Set A
aaaugcucuugcuuggcuauggagggaaaagaauaauguc

SEQ ID NO: 58800 - RNA, 23 nt, Artificial Sequence
  Synthetic Oligonucleotide; CD80 exon 6; Set C
uugcuuggcuauggagggaaaag

SEQ ID NO: 58801 - RNA, 22 nt, Artificial Sequence
  Synthetic Oligonucleotide; CD80 exon 6; Set C
uugcuuggcuauggagggaaaa

SEQ ID NO: 58802 - RNA, 21 nt, Artificial Sequence
  Synthetic Oligonucleotide; CD80 exon 6; Set A
uugcuuggcuauggagggaaa

SEQ ID NO: 58803 - RNA, 33 nt, Artificial Sequence
  Synthetic Oligonucleotide; CD80 exon 6; Set C
caggaaaaugcucuugcuuggcuauggagggaa

SEQ ID NO: 58804 - RNA, 34 nt, Artificial Sequence
  Synthetic Oligonucleotide; CD80 exon 6; Set C
ucaggaaaaugcucuugcuuggcuauggagggaa

SEQ ID NO: 58805 - RNA, 32 nt, Artificial Sequence
  Synthetic Oligonucleotide; CD80 exon 6; Set C
caggaaaaugcucuugcuuggcuauggaggga

SEQ ID NO: 58806 - RNA, 31 nt, Artificial Sequence
  Synthetic Oligonucleotide; CD80 exon 6; Set C
caggaaaaugcucuugcuuggcuauggaggg

SEQ ID NO: 58807 - RNA, 33 nt, Artificial Sequence
  Synthetic Oligonucleotide; CD80 exon 6; Set C
ucaggaaaaugcucuugcuuggcuauggaggga

SEQ ID NO: 58808 - RNA, 30 nt, Artificial Sequence
  Synthetic Oligonucleotide; CD80 exon 6; Set A
caggaaaaugcucuugcuuggcuauggagg

SEQ ID NO: 58809 - RNA, 32 nt, Artificial Sequence
  Synthetic Oligonucleotide; CD80 exon 6; Set C
ucaggaaaaugcucuugcuuggcuauggaggg

SEQ ID NO: 58810 - RNA, 34 nt, Artificial Sequence
  Synthetic Oligonucleotide; CD80 exon 6; Set C
aucaggaaaaugcucuugcuuggcuauggaggga

SEQ ID NO: 58811 - RNA, 29 nt, Artificial Sequence
  Synthetic Oligonucleotide; CD80 exon 6; Set A
caggaaaaugcucuugcuuggcuauggag

SEQ ID NO: 58812 - RNA, 31 nt, Artificial Sequence
  Synthetic Oligonucleotide; CD80 exon 6; Set A
ucaggaaaaugcucuugcuuggcuauggagg

SEQ ID NO: 58813 - RNA, 33 nt, Artificial Sequence
  Synthetic Oligonucleotide; CD80 exon 6; Set C
aucaggaaaaugcucuugcuuggcuauggaggg

SEQ ID NO: 58814 - RNA, 30 nt, Artificial Sequence
  Synthetic Oligonucleotide; CD80 exon 6; Set A
ucaggaaaaugcucuugcuuggcuauggag

SEQ ID NO: 58815 - RNA, 28 nt, Artificial Sequence
  Synthetic Oligonucleotide; CD80 exon 6; Set A
caggaaaaugcucuugcuuggcuaugga

SEQ ID NO: 58816 - RNA, 32 nt, Artificial Sequence
  Synthetic Oligonucleotide; CD80 exon 6; Set A
aucaggaaaaugcucuugcuuggcuauggagg

SEQ ID NO: 58817 - RNA, 31 nt, Artificial Sequence
  Synthetic Oligonucleotide; CD80 exon 6; Set A
aucaggaaaaugcucuugcuuggcuauggag

SEQ ID NO: 58818 - RNA, 27 nt, Artificial Sequence
  Synthetic Oligonucleotide; CD80 exon 6; Set A
caggaaaaugcucuugcuuggcuaugg

SEQ ID NO: 58819 - RNA, 29 nt, Artificial Sequence
  Synthetic Oligonucleotide; CD80 exon 6; Set A
ucaggaaaaugcucuugcuuggcuaugga

SEQ ID NO: 58820 - RNA, 37 nt, Artificial Sequence
  Synthetic Oligonucleotide; CD80 exon 6; Set C
guuaucaggaaaaugcucuugcuuggcuauggaggga

SEQ ID NO: 58821 - RNA, 26 nt, Artificial Sequence
  Synthetic Oligonucleotide; CD80 exon 6; Set A
caggaaaaugcucuugcuuggcuaug

SEQ ID NO: 58822 - RNA, 28 nt, Artificial Sequence
  Synthetic Oligonucleotide; CD80 exon 6; Set A
ucaggaaaaugcucuugcuuggcuaugg

SEQ ID NO: 58823 - RNA, 30 nt, Artificial Sequence
  Synthetic Oligonucleotide; CD80 exon 6; Set A
aucaggaaaaugcucuugcuuggcuaugga

SEQ ID NO: 58824 - RNA, 36 nt, Artificial Sequence
  Synthetic Oligonucleotide; CD80 exon 6; Set C
guuaucaggaaaaugcucuugcuuggcuauggaggg

SEQ ID NO: 58825 - RNA, 38 nt, Artificial Sequence
  Synthetic Oligonucleotide; CD80 exon 6; Set C
gguuaucaggaaaaugcucuugcuuggcuauggaggga

SEQ ID NO: 58826 - RNA, 16 nt, Artificial Sequence
  Synthetic Oligonucleotide; CD80 exon 6; Set C
aaaugcucuugcuugg

SEQ ID NO: 58827 - RNA, 27 nt, Artificial Sequence
  Synthetic Oligonucleotide; CD80 exon 6; Set A
ucaggaaaaugcucuugcuuggcuaug

SEQ ID NO: 58828 - RNA, 25 nt, Artificial Sequence
  Synthetic Oligonucleotide; CD80 exon 6; Set A
caggaaaaugcucuugcuuggcuau

SEQ ID NO: 58829 - RNA, 29 nt, Artificial Sequence
  Synthetic Oligonucleotide; CD80 exon 6; Set A
aucaggaaaaugcucuugcuuggcuaugg

SEQ ID NO: 58830 - RNA, 37 nt, Artificial Sequence
  Synthetic Oligonucleotide; CD80 exon 6; Set C
gguuaucaggaaaaugcucuugcuuggcuauggaggg

SEQ ID NO: 58831 - RNA, 17 nt, Artificial Sequence
  Synthetic Oligonucleotide; CD80 exon 6; Set C
aaaaugcucuugcuugg

SEQ ID NO: 58832 - RNA, 28 nt, Artificial Sequence
  Synthetic Oligonucleotide; CD80 exon 6; Set A
aucaggaaaaugcucuugcuuggcuaug

SEQ ID NO: 58833 - RNA, 26 nt, Artificial Sequence
  Synthetic Oligonucleotide; CD80 exon 6; Set A
ucaggaaaaugcucuugcuuggcuau

SEQ ID NO: 58834 - RNA, 18 nt, Artificial Sequence
  Synthetic Oligonucleotide; CD80 exon 6; Set C
gaaaaugcucuugcuugg

SEQ ID NO: 58835 - RNA, 27 nt, Artificial Sequence
  Synthetic Oligonucleotide; CD80 exon 6; Set A
aucaggaaaaugcucuugcuuggcuau

SEQ ID NO: 58836 - RNA, 27 nt, Artificial Sequence
  Synthetic Oligonucleotide; CD80 exon 6; Set A
uaucaggaaaaugcucuugcuuggcua

SEQ ID NO: 58837 - RNA, 20 nt, Artificial Sequence
  Synthetic Oligonucleotide; CD80 exon 6; Set C
caggaaaaugcucuugcuug

SEQ ID NO: 58838 - RNA, 28 nt, Artificial Sequence
  Synthetic Oligonucleotide; CD80 exon 6; Set A
uuaucaggaaaaugcucuugcuuggcua

SEQ ID NO: 58839 - RNA, 26 nt, Artificial Sequence
  Synthetic Oligonucleotide; CD80 exon 6; Set A
uaucaggaaaaugcucuugcuuggcu

SEQ ID NO: 58840 - RNA, 21 nt, Artificial Sequence
  Synthetic Oligonucleotide; CD80 exon 6; Set C
ucaggaaaaugcucuugcuug

SEQ ID NO: 58841 - RNA, 25 nt, Artificial Sequence
  Synthetic Oligonucleotide; CD80 exon 6; Set A
uaucaggaaaaugcucuugcuuggc

SEQ ID NO: 58842 - RNA, 27 nt, Artificial Sequence
  Synthetic Oligonucleotide; CD80 exon 6; Set A
uuaucaggaaaaugcucuugcuuggcu

SEQ ID NO: 58843 - RNA, 22 nt, Artificial Sequence
  Synthetic Oligonucleotide; CD80 exon 6; Set C
aucaggaaaaugcucuugcuug

SEQ ID NO: 58844 - RNA, 24 nt, Artificial Sequence
  Synthetic Oligonucleotide; CD80 exon 6; Set C
uaucaggaaaaugcucuugcuugg

SEQ ID NO: 58845 - RNA, 26 nt, Artificial Sequence
  Synthetic Oligonucleotide; CD80 exon 6; Set A
uuaucaggaaaaugcucuugcuuggc

SEQ ID NO: 58846 - RNA, 25 nt, Artificial Sequence
  Synthetic Oligonucleotide; CD80 exon 6; Set C
uuaucaggaaaaugcucuugcuugg

SEQ ID NO: 58847 - RNA, 25 nt, Artificial Sequence
  Synthetic Oligonucleotide; CD80 exon 6; Set C
guuaucaggaaaaugcucuugcuug

SEQ ID NO: 58848 - RNA, 15 nt, Artificial Sequence
  Synthetic Oligonucleotide; CD80 exon 6; Set C
caggaaaaugcucuu

SEQ ID NO: 58849 - RNA, 26 nt, Artificial Sequence
  Synthetic Oligonucleotide; CD80 exon 6; Set A
gguuaucaggaaaaugcucuugcuug

SEQ ID NO: 58850 - RNA, 16 nt, Artificial Sequence
  Synthetic Oligonucleotide; CD80 exon 6; Set C
ucaggaaaaugcucuu

SEQ ID NO: 58851 - RNA, 17 nt, Artificial Sequence
  Synthetic Oligonucleotide; CD80 exon 6; Set C
aucaggaaaaugcucuu

SEQ ID NO: 58852 - RNA, 15 nt, Artificial Sequence
  Synthetic Oligonucleotide; CD80 exon 6; Set C
ucaggaaaaugcucu

SEQ ID NO: 58853 - RNA, 40 nt, Artificial Sequence
  Synthetic Oligonucleotide; CD80 exon 6; Set C
ugggagcagguuaucaggaaaaugcucuugcuuggcuaug

SEQ ID NO: 58854 - RNA, 16 nt, Artificial Sequence
  Synthetic Oligonucleotide; CD80 exon 6; Set C
aucaggaaaaugcucu

SEQ ID NO: 58855 - RNA, 39 nt, Artificial Sequence
  Synthetic Oligonucleotide; CD80 exon 6; Set C
ugggagcagguuaucaggaaaaugcucuugcuuggcuau

SEQ ID NO: 58856 - RNA, 20 nt, Artificial Sequence
  Synthetic Oligonucleotide; CD80 exon 6; Set C
guuaucaggaaaaugcucuu

SEQ ID NO: 58857 - RNA, 21 nt, Artificial Sequence
  Synthetic Oligonucleotide; CD80 exon 6; Set C
gguuaucaggaaaaugcucuu

SEQ ID NO: 58858 - RNA, 19 nt, Artificial Sequence
  Synthetic Oligonucleotide; CD80 exon 6; Set C
guuaucaggaaaaugcucu

SEQ ID NO: 58859 - RNA, 20 nt, Artificial Sequence
  Synthetic Oligonucleotide; CD80 exon 6; Set C
gguuaucaggaaaaugcucu

SEQ ID NO: 58860 - RNA, 34 nt, Artificial Sequence
  Synthetic Oligonucleotide; CD80 exon 6; Set C
ugggagcagguuaucaggaaaaugcucuugcuug

SEQ ID NO: 58861 - RNA, 35 nt, Artificial Sequence
  Synthetic Oligonucleotide; CD80 exon 6; Set C
augggagcagguuaucaggaaaaugcucuugcuug

SEQ ID NO: 58862 - RNA, 36 nt, Artificial Sequence
  Synthetic Oligonucleotide; CD80 exon 6; Set C
gaugggagcagguuaucaggaaaaugcucuugcuug

SEQ ID NO: 58863 - RNA, 37 nt, Artificial Sequence
  Synthetic Oligonucleotide; CD80 exon 6; Set C
ggaugggagcagguuaucaggaaaaugcucuugcuug

SEQ ID NO: 58864 - RNA, 38 nt, Artificial Sequence
  Synthetic Oligonucleotide; CD80 exon 6; Set C
aggaugggagcagguuaucaggaaaaugcucuugcuug

SEQ ID NO: 58865 - RNA, 29 nt, Artificial Sequence
  Synthetic Oligonucleotide; CD80 exon 6; Set A
ugggagcagguuaucaggaaaaugcucuu

SEQ ID NO: 58866 - RNA, 30 nt, Artificial Sequence
  Synthetic Oligonucleotide; CD80 exon 6; Set A
augggagcagguuaucaggaaaaugcucuu

SEQ ID NO: 58867 - RNA, 28 nt, Artificial Sequence
  Synthetic Oligonucleotide; CD80 exon 6; Set A
ugggagcagguuaucaggaaaaugcucu

SEQ ID NO: 58868 - RNA, 31 nt, Artificial Sequence
  Synthetic Oligonucleotide; CD80 exon 6; Set A
gaugggagcagguuaucaggaaaaugcucuu

SEQ ID NO: 58869 - RNA, 29 nt, Artificial Sequence
  Synthetic Oligonucleotide; CD80 exon 6; Set A
augggagcagguuaucaggaaaaugcucu

SEQ ID NO: 58870 - RNA, 32 nt, Artificial Sequence
  Synthetic Oligonucleotide; CD80 exon 6; Set C
ggaugggagcagguuaucaggaaaaugcucuu

SEQ ID NO: 58871 - RNA, 30 nt, Artificial Sequence
  Synthetic Oligonucleotide; CD80 exon 6; Set A
gaugggagcagguuaucaggaaaaugcucu

SEQ ID NO: 58872 - RNA, 31 nt, Artificial Sequence
  Synthetic Oligonucleotide; CD80 exon 6; Set C
ggaugggagcagguuaucaggaaaaugcucu

SEQ ID NO: 58873 - RNA, 23 nt, Artificial Sequence
  Synthetic Oligonucleotide; CD80 exon 6; Set C
ugggagcagguuaucaggaaaau

SEQ ID NO: 58874 - RNA, 22 nt, Artificial Sequence
  Synthetic Oligonucleotide; CD80 exon 6; Set C
ugggagcagguuaucaggaaaa

SEQ ID NO: 58875 - RNA, 21 nt, Artificial Sequence
  Synthetic Oligonucleotide; CD80 exon 6; Set C
ugggagcagguuaucaggaaa

SEQ ID NO: 58876 - RNA, 20 nt, Artificial Sequence
  Synthetic Oligonucleotide; CD80 exon 6; Set C
ugggagcagguuaucaggaa

SEQ ID NO: 58877 - RNA, 26 nt, Artificial Sequence
  Synthetic Oligonucleotide; CD80 exon 6; Set A
ggaugggagcagguuaucaggaaaau

SEQ ID NO: 58878 - RNA, 25 nt, Artificial Sequence
  Synthetic Oligonucleotide; CD80 exon 6; Set A
ggaugggagcagguuaucaggaaaa

SEQ ID NO: 58879 - RNA, 27 nt, Artificial Sequence
  Synthetic Oligonucleotide; CD80 exon 6; Set A
aggaugggagcagguuaucaggaaaau

SEQ ID NO: 58880 - RNA, 19 nt, Artificial Sequence
  Synthetic Oligonucleotide; CD80 exon 6; Set A
ugggagcagguuaucagga

SEQ ID NO: 58881 - RNA, 24 nt, Artificial Sequence
  Synthetic Oligonucleotide; CD80 exon 6; Set A
ggaugggagcagguuaucaggaaa

SEQ ID NO: 58882 - RNA, 26 nt, Artificial Sequence
  Synthetic Oligonucleotide; CD80 exon 6; Set A
aggaugggagcagguuaucaggaaaa

SEQ ID NO: 58883 - RNA, 20 nt, Artificial Sequence
  Synthetic Oligonucleotide; CD80 exon 6; Set A
augggagcagguuaucagga

SEQ ID NO: 58884 - RNA, 23 nt, Artificial Sequence
  Synthetic Oligonucleotide; CD80 exon 6; Set A
ggaugggagcagguuaucaggaa

SEQ ID NO: 58885 - RNA, 25 nt, Artificial Sequence
  Synthetic Oligonucleotide; CD80 exon 6; Set A
aggaugggagcagguuaucaggaaa

SEQ ID NO: 58886 - RNA, 21 nt, Artificial Sequence
  Synthetic Oligonucleotide; CD80 exon 6; Set A
gaugggagcagguuaucagga

SEQ ID NO: 58887 - RNA, 19 nt, Artificial Sequence
  Synthetic Oligonucleotide; CD80 exon 6; Set C
augggagcagguuaucagg

SEQ ID NO: 58888 - RNA, 24 nt, Artificial Sequence
  Synthetic Oligonucleotide; CD80 exon 6; Set A
aggaugggagcagguuaucaggaa

SEQ ID NO: 58889 - RNA, 22 nt, Artificial Sequence
  Synthetic Oligonucleotide; CD80 exon 6; Set A
ggaugggagcagguuaucagga

SEQ ID NO: 58890 - RNA, 20 nt, Artificial Sequence
  Synthetic Oligonucleotide; CD80 exon 6; Set A
gaugggagcagguuaucagg

SEQ ID NO: 58891 - RNA, 21 nt, Artificial Sequence
  Synthetic Oligonucleotide; CD80 exon 6; Set A
ggaugggagcagguuaucagg

SEQ ID NO: 58892 - RNA, 15 nt, Artificial Sequence
  Synthetic Oligonucleotide; CD80 exon 6; Set C
augggagcagguuau

SEQ ID NO: 58893 - RNA, 16 nt, Artificial Sequence
  Synthetic Oligonucleotide; CD80 exon 6; Set C
gaugggagcagguuau

SEQ ID NO: 58894 - RNA, 15 nt, Artificial Sequence
  Synthetic Oligonucleotide; CD80 exon 6; Set C
gaugggagcagguua

SEQ ID NO: 58895 - RNA, 17 nt, Artificial Sequence
  Synthetic Oligonucleotide; CD80 exon 6; Set C
ggaugggagcagguuau

SEQ ID NO: 58896 - RNA, 16 nt, Artificial Sequence
  Synthetic Oligonucleotide; CD80 exon 6; Set C
ggaugggagcagguua

SEQ ID NO: 58897 - RNA, 18 nt, Artificial Sequence
  Synthetic Oligonucleotide; CD80 exon 6; Set C
aggaugggagcagguuau

SEQ ID NO: 58898 - RNA, 34 nt, Artificial Sequence
  Synthetic Oligonucleotide; CD80 exon 6; Set C
aauggcccaggaugggagcagguuaucaggaaaa

SEQ ID NO: 58899 - RNA, 17 nt, Artificial Sequence
  Synthetic Oligonucleotide; CD80 exon 6; Set C
aggaugggagcagguua

SEQ ID NO: 58900 - RNA, 33 nt, Artificial Sequence
  Synthetic Oligonucleotide; CD80 exon 6; Set C
aauggcccaggaugggagcagguuaucaggaaa

SEQ ID NO: 58901 - RNA, 35 nt, Artificial Sequence
  Synthetic Oligonucleotide; CD80 exon 6; Set C
uaauggcccaggaugggagcagguuaucaggaaaa

SEQ ID NO: 58902 - RNA, 37 nt, Artificial Sequence
  Synthetic Oligonucleotide; CD80 exon 6; Set C
guaauggcccaggaugggagcagguuaucaggaaaau

SEQ ID NO: 58903 - RNA, 36 nt, Artificial Sequence
  Synthetic Oligonucleotide; CD80 exon 6; Set C
guaauggcccaggaugggagcagguuaucaggaaaa

SEQ ID NO: 58904 - RNA, 34 nt, Artificial Sequence
  Synthetic Oligonucleotide; CD80 exon 6; Set C
uaauggcccaggaugggagcagguuaucaggaaa

SEQ ID NO: 58905 - RNA, 38 nt, Artificial Sequence
  Synthetic Oligonucleotide; CD80 exon 6; Set C
gguaauggcccaggaugggagcagguuaucaggaaaau

SEQ ID NO: 58906 - RNA, 35 nt, Artificial Sequence
  Synthetic Oligonucleotide; CD80 exon 6; Set C
guaauggcccaggaugggagcagguuaucaggaaa

SEQ ID NO: 58907 - RNA, 39 nt, Artificial Sequence
  Synthetic Oligonucleotide; CD80 exon 6; Set C
agguaauggcccaggaugggagcagguuaucaggaaaau

SEQ ID NO: 58908 - RNA, 36 nt, Artificial Sequence
  Synthetic Oligonucleotide; CD80 exon 6; Set C
gguaauggcccaggaugggagcagguuaucaggaaa

SEQ ID NO: 58909 - RNA, 34 nt, Artificial Sequence
  Synthetic Oligonucleotide; CD80 exon 6; Set C
guaauggcccaggaugggagcagguuaucaggaa

SEQ ID NO: 58910 - RNA, 35 nt, Artificial Sequence
  Synthetic Oligonucleotide; CD80 exon 6; Set C
gguaauggcccaggaugggagcagguuaucaggaa

SEQ ID NO: 58911 - RNA, 37 nt, Artificial Sequence
  Synthetic Oligonucleotide; CD80 exon 6; Set C
agguaauggcccaggaugggagcagguuaucaggaaa

SEQ ID NO: 58912 - RNA, 36 nt, Artificial Sequence
  Synthetic Oligonucleotide; CD80 exon 6; Set C
agguaauggcccaggaugggagcagguuaucaggaa

SEQ ID NO: 58913 - RNA, 34 nt, Artificial Sequence
  Synthetic Oligonucleotide; CD80 exon 6; Set C
gguaauggcccaggaugggagcagguuaucagga

SEQ ID NO: 58914 - RNA, 35 nt, Artificial Sequence
  Synthetic Oligonucleotide; CD80 exon 6; Set C
agguaauggcccaggaugggagcagguuaucagga

SEQ ID NO: 58915 - RNA, 33 nt, Artificial Sequence
  Synthetic Oligonucleotide; CD80 exon 6; Set C
gguaauggcccaggaugggagcagguuaucagg

SEQ ID NO: 58916 - RNA, 34 nt, Artificial Sequence
  Synthetic Oligonucleotide; CD80 exon 6; Set C
agguaauggcccaggaugggagcagguuaucagg

SEQ ID NO: 58917 - RNA, 37 nt, Artificial Sequence
  Synthetic Oligonucleotide; CD80 exon 6; Set C
uaagguaauggcccaggaugggagcagguuaucagga

SEQ ID NO: 58918 - RNA, 28 nt, Artificial Sequence
  Synthetic Oligonucleotide; CD80 exon 6; Set C
guaauggcccaggaugggagcagguuau

SEQ ID NO: 58919 - RNA, 40 nt, Artificial Sequence
  Synthetic Oligonucleotide; CD80 exon 6; Set C
auuaagguaauggcccaggaugggagcagguuaucaggaa

SEQ ID NO: 58920 - RNA, 38 nt, Artificial Sequence
  Synthetic Oligonucleotide; CD80 exon 6; Set C
uuaagguaauggcccaggaugggagcagguuaucagga

SEQ ID NO: 58921 - RNA, 36 nt, Artificial Sequence
  Synthetic Oligonucleotide; CD80 exon 6; Set C
uaagguaauggcccaggaugggagcagguuaucagg

SEQ ID NO: 58922 - RNA, 34 nt, Artificial Sequence
  Synthetic Oligonucleotide; CD80 exon 6; Set C
aagguaauggcccaggaugggagcagguuaucag

SEQ ID NO: 58923 - RNA, 29 nt, Artificial Sequence
  Synthetic Oligonucleotide; CD80 exon 6; Set C
gguaauggcccaggaugggagcagguuau

SEQ ID NO: 58924 - RNA, 27 nt, Artificial Sequence
  Synthetic Oligonucleotide; CD80 exon 6; Set C
guaauggcccaggaugggagcagguua

SEQ ID NO: 58925 - RNA, 37 nt, Artificial Sequence
  Synthetic Oligonucleotide; CD80 exon 6; Set C
uuaagguaauggcccaggaugggagcagguuaucagg

SEQ ID NO: 58926 - RNA, 33 nt, Artificial Sequence
  Synthetic Oligonucleotide; CD80 exon 6; Set C
aagguaauggcccaggaugggagcagguuauca

SEQ ID NO: 58927 - RNA, 28 nt, Artificial Sequence
  Synthetic Oligonucleotide; CD80 exon 6; Set C
gguaauggcccaggaugggagcagguua

SEQ ID NO: 58928 - RNA, 30 nt, Artificial Sequence
  Synthetic Oligonucleotide; CD80 exon 6; Set C
agguaauggcccaggaugggagcagguuau

SEQ ID NO: 58929 - RNA, 32 nt, Artificial Sequence
  Synthetic Oligonucleotide; CD80 exon 6; Set C
aagguaauggcccaggaugggagcagguuauc

SEQ ID NO: 58930 - RNA, 29 nt, Artificial Sequence
  Synthetic Oligonucleotide; CD80 exon 6; Set C
agguaauggcccaggaugggagcagguua

SEQ ID NO: 58931 - RNA, 29 nt, Artificial Sequence
  Synthetic Oligonucleotide; CD80 exon 6; Set C
aagguaauggcccaggaugggagcagguu

SEQ ID NO: 58932 - RNA, 34 nt, Artificial Sequence
  Synthetic Oligonucleotide; CD80 exon 6; Set C
auuaagguaauggcccaggaugggagcagguuau

SEQ ID NO: 58933 - RNA, 28 nt, Artificial Sequence
  Synthetic Oligonucleotide; CD80 exon 6; Set C
aagguaauggcccaggaugggagcaggu

SEQ ID NO: 58934 - RNA, 35 nt, Artificial Sequence
  Synthetic Oligonucleotide; CD80 exon 6; Set C
gauuaagguaauggcccaggaugggagcagguuau

SEQ ID NO: 58935 - RNA, 33 nt, Artificial Sequence
  Synthetic Oligonucleotide; CD80 exon 6; Set C
auuaagguaauggcccaggaugggagcagguua

SEQ ID NO: 58936 - RNA, 34 nt, Artificial Sequence
  Synthetic Oligonucleotide; CD80 exon 6; Set C
gauuaagguaauggcccaggaugggagcagguua

SEQ ID NO: 58937 - RNA, 17 nt, Artificial Sequence
  Synthetic Oligonucleotide; CD80 exon 6; Set C
guaauggcccaggaugg

SEQ ID NO: 58938 - RNA, 16 nt, Artificial Sequence
  Synthetic Oligonucleotide; CD80 exon 6; Set C
guaauggcccaggaug

SEQ ID NO: 58939 - RNA, 18 nt, Artificial Sequence
  Synthetic Oligonucleotide; CD80 exon 6; Set C
gguaauggcccaggaugg

SEQ ID NO: 58940 - RNA, 15 nt, Artificial Sequence
  Synthetic Oligonucleotide; CD80 exon 6; Set C
guaauggcccaggau

SEQ ID NO: 58941 - RNA, 17 nt, Artificial Sequence
  Synthetic Oligonucleotide; CD80 exon 6; Set C
gguaauggcccaggaug

SEQ ID NO: 58942 - RNA, 19 nt, Artificial Sequence
  Synthetic Oligonucleotide; CD80 exon 6; Set A
agguaauggcccaggaugg

SEQ ID NO: 58943 - RNA, 16 nt, Artificial Sequence
  Synthetic Oligonucleotide; CD80 exon 6; Set C
gguaauggcccaggau

SEQ ID NO: 58944 - RNA, 18 nt, Artificial Sequence
  Synthetic Oligonucleotide; CD80 exon 6; Set C
agguaauggcccaggaug

SEQ ID NO: 58945 - RNA, 17 nt, Artificial Sequence
  Synthetic Oligonucleotide; CD80 exon 6; Set C
agguaauggcccaggau

SEQ ID NO: 58946 - RNA, 21 nt, Artificial Sequence
  Synthetic Oligonucleotide; CD80 exon 6; Set A
uaagguaauggcccaggaugg

SEQ ID NO: 58947 - RNA, 15 nt, Artificial Sequence
  Synthetic Oligonucleotide; CD80 exon 6; Set C
gguaauggcccagga

SEQ ID NO: 58948 - RNA, 39 nt, Artificial Sequence
  Synthetic Oligonucleotide; CD80 exon 6; Set C
uacugagauuaagguaauggcccaggaugggagcagguu

SEQ ID NO: 58949 - RNA, 22 nt, Artificial Sequence
  Synthetic Oligonucleotide; CD80 exon 6; Set A
uuaagguaauggcccaggaugg

SEQ ID NO: 58950 - RNA, 16 nt, Artificial Sequence
  Synthetic Oligonucleotide; CD80 exon 6; Set C
agguaauggcccagga

SEQ ID NO: 58951 - RNA, 40 nt, Artificial Sequence
  Synthetic Oligonucleotide; CD80 exon 6; Set C
uuacugagauuaagguaauggcccaggaugggagcagguu

SEQ ID NO: 58952 - RNA, 39 nt, Artificial Sequence
  Synthetic Oligonucleotide; CD80 exon 6; Set C
uuacugagauuaagguaauggcccaggaugggagcaggu

SEQ ID NO: 58953 - RNA, 22 nt, Artificial Sequence
  Synthetic Oligonucleotide; CD80 exon 6; Set C
auuaagguaauggcccaggaug

SEQ ID NO: 58954 - RNA, 18 nt, Artificial Sequence
  Synthetic Oligonucleotide; CD80 exon 6; Set C
uaagguaauggcccagga

SEQ ID NO: 58955 - RNA, 40 nt, Artificial Sequence
  Synthetic Oligonucleotide; CD80 exon 6; Set C
uuuacugagauuaagguaauggcccaggaugggagcaggu

SEQ ID NO: 58956 - RNA, 16 nt, Artificial Sequence
  Synthetic Oligonucleotide; CD80 exon 6; Set C
aagguaauggcccagg

SEQ ID NO: 58957 - RNA, 21 nt, Artificial Sequence
  Synthetic Oligonucleotide; CD80 exon 6; Set C
auuaagguaauggcccaggau

SEQ ID NO: 58958 - RNA, 23 nt, Artificial Sequence
  Synthetic Oligonucleotide; CD80 exon 6; Set C
gauuaagguaauggcccaggaug

SEQ ID NO: 58959 - RNA, 19 nt, Artificial Sequence
  Synthetic Oligonucleotide; CD80 exon 6; Set C
uuaagguaauggcccagga

SEQ ID NO: 58960 - RNA, 17 nt, Artificial Sequence
  Synthetic Oligonucleotide; CD80 exon 6; Set C
uaagguaauggcccagg

SEQ ID NO: 58961 - RNA, 22 nt, Artificial Sequence
  Synthetic Oligonucleotide; CD80 exon 6; Set C
gauuaagguaauggcccaggau

SEQ ID NO: 58962 - RNA, 18 nt, Artificial Sequence
  Synthetic Oligonucleotide; CD80 exon 6; Set C
uuaagguaauggcccagg

SEQ ID NO: 58963 - RNA, 27 nt, Artificial Sequence
  Synthetic Oligonucleotide; CD80 exon 6; Set A
uacugagauuaagguaauggcccagga

SEQ ID NO: 58964 - RNA, 26 nt, Artificial Sequence
  Synthetic Oligonucleotide; CD80 exon 6; Set A
uacugagauuaagguaauggcccagg

SEQ ID NO: 58965 - RNA, 27 nt, Artificial Sequence
  Synthetic Oligonucleotide; CD80 exon 6; Set A
uuacugagauuaagguaauggcccagg

SEQ ID NO: 58966 - RNA, 28 nt, Artificial Sequence
  Synthetic Oligonucleotide; CD80 exon 6; Set A
uuuacugagauuaagguaauggcccagg

SEQ ID NO: 58967 - RNA, 34 nt, Artificial Sequence
  Synthetic Oligonucleotide; CD80 exon 6; Set C
uuccauuuacugagauuaagguaauggcccagga

SEQ ID NO: 58968 - RNA, 35 nt, Artificial Sequence
  Synthetic Oligonucleotide; CD80 exon 6; Set C
auuccauuuacugagauuaagguaauggcccagga

SEQ ID NO: 58969 - RNA, 33 nt, Artificial Sequence
  Synthetic Oligonucleotide; CD80 exon 6; Set A
uuccauuuacugagauuaagguaauggcccagg

SEQ ID NO: 58970 - RNA, 19 nt, Artificial Sequence
  Synthetic Oligonucleotide; CD80 exon 6; Set C
uacugagauuaagguaaug

SEQ ID NO: 58971 - RNA, 34 nt, Artificial Sequence
  Synthetic Oligonucleotide; CD80 exon 6; Set A
auuccauuuacugagauuaagguaauggcccagg

SEQ ID NO: 58972 - RNA, 18 nt, Artificial Sequence
  Synthetic Oligonucleotide; CD80 exon 6; Set C
uacugagauuaagguaau

SEQ ID NO: 58973 - RNA, 20 nt, Artificial Sequence
  Synthetic Oligonucleotide; CD80 exon 6; Set C
uuacugagauuaagguaaug

SEQ ID NO: 58974 - RNA, 35 nt, Artificial Sequence
  Synthetic Oligonucleotide; CD80 exon 6; Set A
aauuccauuuacugagauuaagguaauggcccagg

SEQ ID NO: 58975 - RNA, 17 nt, Artificial Sequence
  Synthetic Oligonucleotide; CD80 exon 6; Set C
uacugagauuaagguaa

SEQ ID NO: 58976 - RNA, 21 nt, Artificial Sequence
  Synthetic Oligonucleotide; CD80 exon 6; Set C
uuuacugagauuaagguaaug

SEQ ID NO: 58977 - RNA, 36 nt, Artificial Sequence
  Synthetic Oligonucleotide; CD80 exon 6; Set A
aaauuccauuuacugagauuaagguaauggcccagg

SEQ ID NO: 58978 - RNA, 18 nt, Artificial Sequence
  Synthetic Oligonucleotide; CD80 exon 6; Set C
uuacugagauuaagguaa

SEQ ID NO: 58979 - RNA, 37 nt, Artificial Sequence
  Synthetic Oligonucleotide; CD80 exon 6; Set A
aaaauuccauuuacugagauuaagguaauggcccagg

SEQ ID NO: 58980 - RNA, 38 nt, Artificial Sequence
  Synthetic Oligonucleotide; CD80 exon 6; Set A
aaaaauuccauuuacugagauuaagguaauggcccagg

SEQ ID NO: 58981 - RNA, 26 nt, Artificial Sequence
  Synthetic Oligonucleotide; CD80 exon 6; Set C
uuccauuuacugagauuaagguaaug

SEQ ID NO: 58982 - RNA, 25 nt, Artificial Sequence
  Synthetic Oligonucleotide; CD80 exon 6; Set C
uuccauuuacugagauuaagguaau

SEQ ID NO: 58983 - RNA, 27 nt, Artificial Sequence
  Synthetic Oligonucleotide; CD80 exon 6; Set C
auuccauuuacugagauuaagguaaug

SEQ ID NO: 58984 - RNA, 26 nt, Artificial Sequence
  Synthetic Oligonucleotide; CD80 exon 6; Set C
auuccauuuacugagauuaagguaau

SEQ ID NO: 58985 - RNA, 24 nt, Artificial Sequence
  Synthetic Oligonucleotide; CD80 exon 6; Set C
uuccauuuacugagauuaagguaa

SEQ ID NO: 58986 - RNA, 28 nt, Artificial Sequence
  Synthetic Oligonucleotide; CD80 exon 6; Set C
aauuccauuuacugagauuaagguaaug

SEQ ID NO: 58987 - RNA, 27 nt, Artificial Sequence
  Synthetic Oligonucleotide; CD80 exon 6; Set C
aauuccauuuacugagauuaagguaau

SEQ ID NO: 58988 - RNA, 25 nt, Artificial Sequence
  Synthetic Oligonucleotide; CD80 exon 6; Set C
auuccauuuacugagauuaagguaa

SEQ ID NO: 58989 - RNA, 29 nt, Artificial Sequence
  Synthetic Oligonucleotide; CD80 exon 6; Set C
aaauuccauuuacugagauuaagguaaug

SEQ ID NO: 58990 - RNA, 28 nt, Artificial Sequence
  Synthetic Oligonucleotide; CD80 exon 6; Set C
aaauuccauuuacugagauuaagguaau

SEQ ID NO: 58991 - RNA, 26 nt, Artificial Sequence
  Synthetic Oligonucleotide; CD80 exon 6; Set C
aauuccauuuacugagauuaagguaa

SEQ ID NO: 58992 - RNA, 30 nt, Artificial Sequence
  Synthetic Oligonucleotide; CD80 exon 6; Set C
aaaauuccauuuacugagauuaagguaaug

SEQ ID NO: 58993 - RNA, 29 nt, Artificial Sequence
  Synthetic Oligonucleotide; CD80 exon 6; Set C
aaaauuccauuuacugagauuaagguaau

SEQ ID NO: 58994 - RNA, 27 nt, Artificial Sequence
  Synthetic Oligonucleotide; CD80 exon 6; Set C
aaauuccauuuacugagauuaagguaa

SEQ ID NO: 58995 - RNA, 31 nt, Artificial Sequence
  Synthetic Oligonucleotide; CD80 exon 6; Set C
aaaaauuccauuuacugagauuaagguaaug

SEQ ID NO: 58996 - RNA, 30 nt, Artificial Sequence
  Synthetic Oligonucleotide; CD80 exon 6; Set C
aaaaauuccauuuacugagauuaagguaau

SEQ ID NO: 58997 - RNA, 28 nt, Artificial Sequence
  Synthetic Oligonucleotide; CD80 exon 6; Set C
aaaauuccauuuacugagauuaagguaa

SEQ ID NO: 58998 - RNA, 29 nt, Artificial Sequence
  Synthetic Oligonucleotide; CD80 exon 6; Set C
aaaaauuccauuuacugagauuaagguaa

SEQ ID NO: 58999 - RNA, 17 nt, Artificial Sequence
  Synthetic Oligonucleotide; CD80 exon 6; Set C
uuccauuuacugagauu

SEQ ID NO: 59000 - RNA, 16 nt, Artificial Sequence
  Synthetic Oligonucleotide; CD80 exon 6; Set C
uuccauuuacugagau

SEQ ID NO: 59001 - RNA, 18 nt, Artificial Sequence
  Synthetic Oligonucleotide; CD80 exon 6; Set C
auuccauuuacugagauu

SEQ ID NO: 59002 - RNA, 17 nt, Artificial Sequence
  Synthetic Oligonucleotide; CD80 exon 6; Set C
auuccauuuacugagau

SEQ ID NO: 59003 - RNA, 19 nt, Artificial Sequence
  Synthetic Oligonucleotide; CD80 exon 6; Set C
aauuccauuuacugagauu

SEQ ID NO: 59004 - RNA, 18 nt, Artificial Sequence
  Synthetic Oligonucleotide; CD80 exon 6; Set C
aauuccauuuacugagau

SEQ ID NO: 59005 - RNA, 20 nt, Artificial Sequence
  Synthetic Oligonucleotide; CD80 exon 6; Set C
aaauuccauuuacugagauu

SEQ ID NO: 59006 - RNA, 37 nt, Artificial Sequence
  Synthetic Oligonucleotide; CD80 exon 6; Set C
auaucacaaaaauuccauuuacugagauuaagguaau

SEQ ID NO: 59007 - RNA, 19 nt, Artificial Sequence
  Synthetic Oligonucleotide; CD80 exon 6; Set C
aaauuccauuuacugagau

SEQ ID NO: 59008 - RNA, 21 nt, Artificial Sequence
  Synthetic Oligonucleotide; CD80 exon 6; Set C
aaaauuccauuuacugagauu

SEQ ID NO: 59009 - RNA, 36 nt, Artificial Sequence
  Synthetic Oligonucleotide; CD80 exon 6; Set C
auaucacaaaaauuccauuuacugagauuaagguaa

SEQ ID NO: 59010 - RNA, 20 nt, Artificial Sequence
  Synthetic Oligonucleotide; CD80 exon 6; Set C
aaaauuccauuuacugagau

SEQ ID NO: 59011 - RNA, 22 nt, Artificial Sequence
  Synthetic Oligonucleotide; CD80 exon 6; Set C
aaaaauuccauuuacugagauu

SEQ ID NO: 59012 - RNA, 33 nt, Artificial Sequence
  Synthetic Oligonucleotide; CD80 exon 6; Set C
uaucacaaaaauuccauuuacugagauuaaggu

SEQ ID NO: 59013 - RNA, 35 nt, Artificial Sequence
  Synthetic Oligonucleotide; CD80 exon 6; Set C
auaucacaaaaauuccauuuacugagauuaaggua

SEQ ID NO: 59014 - RNA, 21 nt, Artificial Sequence
  Synthetic Oligonucleotide; CD80 exon 6; Set C
aaaaauuccauuuacugagau

SEQ ID NO: 59015 - RNA, 19 nt, Artificial Sequence
  Synthetic Oligonucleotide; CD80 exon 6; Set C
aaaauuccauuuacugaga

SEQ ID NO: 59016 - RNA, 34 nt, Artificial Sequence
  Synthetic Oligonucleotide; CD80 exon 6; Set C
auaucacaaaaauuccauuuacugagauuaaggu

SEQ ID NO: 59017 - RNA, 32 nt, Artificial Sequence
  Synthetic Oligonucleotide; CD80 exon 6; Set C
uaucacaaaaauuccauuuacugagauuaagg

SEQ ID NO: 59018 - RNA, 20 nt, Artificial Sequence
  Synthetic Oligonucleotide; CD80 exon 6; Set C
aaaaauuccauuuacugaga

SEQ ID NO: 59019 - RNA, 31 nt, Artificial Sequence
  Synthetic Oligonucleotide; CD80 exon 6; Set C
uaucacaaaaauuccauuuacugagauuaag

SEQ ID NO: 59020 - RNA, 35 nt, Artificial Sequence
  Synthetic Oligonucleotide; CD80 exon 6; Set C
cauaucacaaaaauuccauuuacugagauuaaggu

SEQ ID NO: 59021 - RNA, 33 nt, Artificial Sequence
  Synthetic Oligonucleotide; CD80 exon 6; Set C
auaucacaaaaauuccauuuacugagauuaagg

SEQ ID NO: 59022 - RNA, 30 nt, Artificial Sequence
  Synthetic Oligonucleotide; CD80 exon 6; Set C
uaucacaaaaauuccauuuacugagauuaa

SEQ ID NO: 59023 - RNA, 36 nt, Artificial Sequence
  Synthetic Oligonucleotide; CD80 exon 6; Set A
gcauaucacaaaaauuccauuuacugagauuaaggu

SEQ ID NO: 59024 - RNA, 33 nt, Artificial Sequence
  Synthetic Oligonucleotide; CD80 exon 6; Set C
cauaucacaaaaauuccauuuacugagauuaag

SEQ ID NO: 59025 - RNA, 29 nt, Artificial Sequence
  Synthetic Oligonucleotide; CD80 exon 6; Set C
uaucacaaaaauuccauuuacugagauua

SEQ ID NO: 59026 - RNA, 31 nt, Artificial Sequence
  Synthetic Oligonucleotide; CD80 exon 6; Set C
auaucacaaaaauuccauuuacugagauuaa

SEQ ID NO: 59027 - RNA, 34 nt, Artificial Sequence
  Synthetic Oligonucleotide; CD80 exon 6; Set C
gcauaucacaaaaauuccauuuacugagauuaag

SEQ ID NO: 59028 - RNA, 30 nt, Artificial Sequence
  Synthetic Oligonucleotide; CD80 exon 6; Set C
auaucacaaaaauuccauuuacugagauua

SEQ ID NO: 59029 - RNA, 32 nt, Artificial Sequence
  Synthetic Oligonucleotide; CD80 exon 6; Set C
cauaucacaaaaauuccauuuacugagauuaa

SEQ ID NO: 59030 - RNA, 31 nt, Artificial Sequence
  Synthetic Oligonucleotide; CD80 exon 6; Set C
cauaucacaaaaauuccauuuacugagauua

SEQ ID NO: 59031 - RNA, 33 nt, Artificial Sequence
  Synthetic Oligonucleotide; CD80 exon 6; Set C
gcauaucacaaaaauuccauuuacugagauuaa

SEQ ID NO: 59032 - RNA, 32 nt, Artificial Sequence
  Synthetic Oligonucleotide; CD80 exon 6; Set C
gcauaucacaaaaauuccauuuacugagauua

SEQ ID NO: 59033 - RNA, 38 nt, Artificial Sequence
  Synthetic Oligonucleotide; CD80 exon 6; Set A
ggcagcauaucacaaaaauuccauuuacugagauuaag

SEQ ID NO: 59034 - RNA, 40 nt, Artificial Sequence
  Synthetic Oligonucleotide; CD80 exon 6; Set A
aggcagcauaucacaaaaauuccauuuacugagauuaagg

SEQ ID NO: 59035 - RNA, 38 nt, Artificial Sequence
  Synthetic Oligonucleotide; CD80 exon 6; Set A
aggcagcauaucacaaaaauuccauuuacugagauuaa

SEQ ID NO: 59036 - RNA, 21 nt, Artificial Sequence
  Synthetic Oligonucleotide; CD80 exon 6; Set C
uaucacaaaaauuccauuuac

SEQ ID NO: 59037 - RNA, 37 nt, Artificial Sequence
  Synthetic Oligonucleotide; CD80 exon 6; Set A
aggcagcauaucacaaaaauuccauuuacugagauua

SEQ ID NO: 59038 - RNA, 39 nt, Artificial Sequence
  Synthetic Oligonucleotide; CD80 exon 6; Set A
caggcagcauaucacaaaaauuccauuuacugagauuaa

SEQ ID NO: 59039 - RNA, 20 nt, Artificial Sequence
  Synthetic Oligonucleotide; CD80 exon 6; Set C
uaucacaaaaauuccauuua

SEQ ID NO: 59040 - RNA, 38 nt, Artificial Sequence
  Synthetic Oligonucleotide; CD80 exon 6; Set A
caggcagcauaucacaaaaauuccauuuacugagauua

SEQ ID NO: 59041 - RNA, 19 nt, Artificial Sequence
  Synthetic Oligonucleotide; CD80 exon 6; Set C
uaucacaaaaauuccauuu

SEQ ID NO: 59042 - RNA, 23 nt, Artificial Sequence
  Synthetic Oligonucleotide; CD80 exon 6; Set C
cauaucacaaaaauuccauuuac

SEQ ID NO: 59043 - RNA, 22 nt, Artificial Sequence
  Synthetic Oligonucleotide; CD80 exon 6; Set C
cauaucacaaaaauuccauuua

SEQ ID NO: 59044 - RNA, 24 nt, Artificial Sequence
  Synthetic Oligonucleotide; CD80 exon 6; Set C
gcauaucacaaaaauuccauuuac

SEQ ID NO: 59045 - RNA, 40 nt, Artificial Sequence
  Synthetic Oligonucleotide; CD80 exon 6; Set C
gucaggcagcauaucacaaaaauuccauuuacugagauua

SEQ ID NO: 59046 - RNA, 21 nt, Artificial Sequence
  Synthetic Oligonucleotide; CD80 exon 6; Set C
cauaucacaaaaauuccauuu

SEQ ID NO: 59047 - RNA, 23 nt, Artificial Sequence
  Synthetic Oligonucleotide; CD80 exon 6; Set C
gcauaucacaaaaauuccauuua

SEQ ID NO: 59048 - RNA, 22 nt, Artificial Sequence
  Synthetic Oligonucleotide; CD80 exon 6; Set C
gcauaucacaaaaauuccauuu

SEQ ID NO: 59049 - RNA, 28 nt, Artificial Sequence
  Synthetic Oligonucleotide; CD80 exon 6; Set C
ggcagcauaucacaaaaauuccauuuac

SEQ ID NO: 59050 - RNA, 27 nt, Artificial Sequence
  Synthetic Oligonucleotide; CD80 exon 6; Set C
ggcagcauaucacaaaaauuccauuua

SEQ ID NO: 59051 - RNA, 26 nt, Artificial Sequence
  Synthetic Oligonucleotide; CD80 exon 6; Set C
ggcagcauaucacaaaaauuccauuu

SEQ ID NO: 59052 - RNA, 16 nt, Artificial Sequence
  Synthetic Oligonucleotide; CD80 exon 6; Set C
cauaucacaaaaauuc

SEQ ID NO: 59053 - RNA, 15 nt, Artificial Sequence
  Synthetic Oligonucleotide; CD80 exon 6; Set C
cauaucacaaaaauu

SEQ ID NO: 59054 - RNA, 17 nt, Artificial Sequence
  Synthetic Oligonucleotide; CD80 exon 6; Set C
gcauaucacaaaaauuc

SEQ ID NO: 59055 - RNA, 16 nt, Artificial Sequence
  Synthetic Oligonucleotide; CD80 exon 6; Set C
gcauaucacaaaaauu

SEQ ID NO: 59056 - RNA, 32 nt, Artificial Sequence
  Synthetic Oligonucleotide; CD80 exon 6; Set A
gucaggcagcauaucacaaaaauuccauuuac

SEQ ID NO: 59057 - RNA, 15 nt, Artificial Sequence
  Synthetic Oligonucleotide; CD80 exon 6; Set C
gcauaucacaaaaau

SEQ ID NO: 59058 - RNA, 33 nt, Artificial Sequence
  Synthetic Oligonucleotide; CD80 exon 6; Set A
ggucaggcagcauaucacaaaaauuccauuuac

SEQ ID NO: 59059 - RNA, 34 nt, Artificial Sequence
  Synthetic Oligonucleotide; CD80 exon 6; Set A
aggucaggcagcauaucacaaaaauuccauuuac

SEQ ID NO: 59060 - RNA, 35 nt, Artificial Sequence
  Synthetic Oligonucleotide; CD80 exon 6; Set A
uaggucaggcagcauaucacaaaaauuccauuuac

SEQ ID NO: 59061 - RNA, 21 nt, Artificial Sequence
  Synthetic Oligonucleotide; CD80 exon 6; Set C
ggcagcauaucacaaaaauuc

SEQ ID NO: 59062 - RNA, 20 nt, Artificial Sequence
  Synthetic Oligonucleotide; CD80 exon 6; Set C
ggcagcauaucacaaaaauu

SEQ ID NO: 59063 - RNA, 19 nt, Artificial Sequence
  Synthetic Oligonucleotide; CD80 exon 6; Set C
ggcagcauaucacaaaaau

SEQ ID NO: 59064 - RNA, 18 nt, Artificial Sequence
  Synthetic Oligonucleotide; CD80 exon 6; Set C
ggcagcauaucacaaaaa

SEQ ID NO: 59065 - RNA, 38 nt, Artificial Sequence
  Synthetic Oligonucleotide; CD80 exon 6; Set C
caguaggucaggcagcauaucacaaaaauuccauuuac

SEQ ID NO: 59066 - RNA, 37 nt, Artificial Sequence
  Synthetic Oligonucleotide; CD80 exon 6; Set A
caguaggucaggcagcauaucacaaaaauuccauuua

SEQ ID NO: 59067 - RNA, 17 nt, Artificial Sequence
  Synthetic Oligonucleotide; CD80 exon 6; Set C
ggcagcauaucacaaaa

SEQ ID NO: 59068 - RNA, 39 nt, Artificial Sequence
  Synthetic Oligonucleotide; CD80 exon 6; Set C
acaguaggucaggcagcauaucacaaaaauuccauuuac

SEQ ID NO: 59069 - RNA, 25 nt, Artificial Sequence
  Synthetic Oligonucleotide; CD80 exon 6; Set C
gucaggcagcauaucacaaaaauuc

SEQ ID NO: 59070 - RNA, 38 nt, Artificial Sequence
  Synthetic Oligonucleotide; CD80 exon 6; Set C
acaguaggucaggcagcauaucacaaaaauuccauuua

SEQ ID NO: 59071 - RNA, 16 nt, Artificial Sequence
  Synthetic Oligonucleotide; CD80 exon 6; Set C
ggcagcauaucacaaa

SEQ ID NO: 59072 - RNA, 24 nt, Artificial Sequence
  Synthetic Oligonucleotide; CD80 exon 6; Set C
gucaggcagcauaucacaaaaauu

SEQ ID NO: 59073 - RNA, 40 nt, Artificial Sequence
  Synthetic Oligonucleotide; CD80 exon 6; Set C
uacaguaggucaggcagcauaucacaaaaauuccauuuac

SEQ ID NO: 59074 - RNA, 26 nt, Artificial Sequence
  Synthetic Oligonucleotide; CD80 exon 6; Set A
ggucaggcagcauaucacaaaaauuc

SEQ ID NO: 59075 - RNA, 37 nt, Artificial Sequence
  Synthetic Oligonucleotide; CD80 exon 6; Set C
acaguaggucaggcagcauaucacaaaaauuccauuu

SEQ ID NO: 59076 - RNA, 39 nt, Artificial Sequence
  Synthetic Oligonucleotide; CD80 exon 6; Set C
uacaguaggucaggcagcauaucacaaaaauuccauuua

SEQ ID NO: 59077 - RNA, 23 nt, Artificial Sequence
  Synthetic Oligonucleotide; CD80 exon 6; Set C
gucaggcagcauaucacaaaaau

SEQ ID NO: 59078 - RNA, 25 nt, Artificial Sequence
  Synthetic Oligonucleotide; CD80 exon 6; Set C
ggucaggcagcauaucacaaaaauu

SEQ ID NO: 59079 - RNA, 27 nt, Artificial Sequence
  Synthetic Oligonucleotide; CD80 exon 6; Set A
aggucaggcagcauaucacaaaaauuc

SEQ ID NO: 59080 - RNA, 38 nt, Artificial Sequence
  Synthetic Oligonucleotide; CD80 exon 6; Set C
uacaguaggucaggcagcauaucacaaaaauuccauuu

SEQ ID NO: 59081 - RNA, 40 nt, Artificial Sequence
  Synthetic Oligonucleotide; CD80 exon 6; Set C
uuacaguaggucaggcagcauaucacaaaaauuccauuua

SEQ ID NO: 59082 - RNA, 24 nt, Artificial Sequence
  Synthetic Oligonucleotide; CD80 exon 6; Set C
ggucaggcagcauaucacaaaaau

SEQ ID NO: 59083 - RNA, 22 nt, Artificial Sequence
  Synthetic Oligonucleotide; CD80 exon 6; Set C
gucaggcagcauaucacaaaaa

SEQ ID NO: 59084 - RNA, 28 nt, Artificial Sequence
  Synthetic Oligonucleotide; CD80 exon 6; Set A
uaggucaggcagcauaucacaaaaauuc

SEQ ID NO: 59085 - RNA, 39 nt, Artificial Sequence
  Synthetic Oligonucleotide; CD80 exon 6; Set C
uuacaguaggucaggcagcauaucacaaaaauuccauuu

SEQ ID NO: 59086 - RNA, 21 nt, Artificial Sequence
  Synthetic Oligonucleotide; CD80 exon 6; Set C
gucaggcagcauaucacaaaa

SEQ ID NO: 59087 - RNA, 23 nt, Artificial Sequence
  Synthetic Oligonucleotide; CD80 exon 6; Set C
ggucaggcagcauaucacaaaaa

SEQ ID NO: 59088 - RNA, 40 nt, Artificial Sequence
  Synthetic Oligonucleotide; CD80 exon 6; Set C
cuuacaguaggucaggcagcauaucacaaaaauuccauuu

SEQ ID NO: 59089 - RNA, 20 nt, Artificial Sequence
  Synthetic Oligonucleotide; CD80 exon 6; Set C
gucaggcagcauaucacaaa

SEQ ID NO: 59090 - RNA, 22 nt, Artificial Sequence
  Synthetic Oligonucleotide; CD80 exon 6; Set C
ggucaggcagcauaucacaaaa

SEQ ID NO: 59091 - RNA, 24 nt, Artificial Sequence
  Synthetic Oligonucleotide; CD80 exon 6; Set C
aggucaggcagcauaucacaaaaa

SEQ ID NO: 59092 - RNA, 21 nt, Artificial Sequence
  Synthetic Oligonucleotide; CD80 exon 6; Set A
ggucaggcagcauaucacaaa

SEQ ID NO: 59093 - RNA, 23 nt, Artificial Sequence
  Synthetic Oligonucleotide; CD80 exon 6; Set C
aggucaggcagcauaucacaaaa

SEQ ID NO: 59094 - RNA, 25 nt, Artificial Sequence
  Synthetic Oligonucleotide; CD80 exon 6; Set C
uaggucaggcagcauaucacaaaaa

SEQ ID NO: 59095 - RNA, 31 nt, Artificial Sequence
  Synthetic Oligonucleotide; CD80 exon 6; Set A
caguaggucaggcagcauaucacaaaaauuc

SEQ ID NO: 59096 - RNA, 22 nt, Artificial Sequence
  Synthetic Oligonucleotide; CD80 exon 6; Set A
aggucaggcagcauaucacaaa

SEQ ID NO: 59097 - RNA, 24 nt, Artificial Sequence
  Synthetic Oligonucleotide; CD80 exon 6; Set A
uaggucaggcagcauaucacaaaa

SEQ ID NO: 59098 - RNA, 30 nt, Artificial Sequence
  Synthetic Oligonucleotide; CD80 exon 6; Set A
caguaggucaggcagcauaucacaaaaauu

SEQ ID NO: 59099 - RNA, 32 nt, Artificial Sequence
  Synthetic Oligonucleotide; CD80 exon 6; Set A
acaguaggucaggcagcauaucacaaaaauuc

SEQ ID NO: 59100 - RNA, 23 nt, Artificial Sequence
  Synthetic Oligonucleotide; CD80 exon 6; Set A
uaggucaggcagcauaucacaaa

SEQ ID NO: 59101 - RNA, 29 nt, Artificial Sequence
  Synthetic Oligonucleotide; CD80 exon 6; Set A
caguaggucaggcagcauaucacaaaaau

SEQ ID NO: 59102 - RNA, 31 nt, Artificial Sequence
  Synthetic Oligonucleotide; CD80 exon 6; Set A
acaguaggucaggcagcauaucacaaaaauu

SEQ ID NO: 59103 - RNA, 33 nt, Artificial Sequence
  Synthetic Oligonucleotide; CD80 exon 6; Set A
uacaguaggucaggcagcauaucacaaaaauuc

SEQ ID NO: 59104 - RNA, 30 nt, Artificial Sequence
  Synthetic Oligonucleotide; CD80 exon 6; Set A
acaguaggucaggcagcauaucacaaaaau

SEQ ID NO: 59105 - RNA, 28 nt, Artificial Sequence
  Synthetic Oligonucleotide; CD80 exon 6; Set A
caguaggucaggcagcauaucacaaaaa

SEQ ID NO: 59106 - RNA, 32 nt, Artificial Sequence
  Synthetic Oligonucleotide; CD80 exon 6; Set A
uacaguaggucaggcagcauaucacaaaaauu

SEQ ID NO: 59107 - RNA, 34 nt, Artificial Sequence
  Synthetic Oligonucleotide; CD80 exon 6; Set A
uuacaguaggucaggcagcauaucacaaaaauuc

SEQ ID NO: 59108 - RNA, 27 nt, Artificial Sequence
  Synthetic Oligonucleotide; CD80 exon 6; Set A
caguaggucaggcagcauaucacaaaa

SEQ ID NO: 59109 - RNA, 31 nt, Artificial Sequence
  Synthetic Oligonucleotide; CD80 exon 6; Set A
uacaguaggucaggcagcauaucacaaaaau

SEQ ID NO: 59110 - RNA, 29 nt, Artificial Sequence
  Synthetic Oligonucleotide; CD80 exon 6; Set A
acaguaggucaggcagcauaucacaaaaa

SEQ ID NO: 59111 - RNA, 33 nt, Artificial Sequence
  Synthetic Oligonucleotide; CD80 exon 6; Set A
uuacaguaggucaggcagcauaucacaaaaauu

SEQ ID NO: 59112 - RNA, 35 nt, Artificial Sequence
  Synthetic Oligonucleotide; CD80 exon 6; Set A
cuuacaguaggucaggcagcauaucacaaaaauuc

SEQ ID NO: 59113 - RNA, 26 nt, Artificial Sequence
  Synthetic Oligonucleotide; CD80 exon 6; Set A
caguaggucaggcagcauaucacaaa

SEQ ID NO: 59114 - RNA, 28 nt, Artificial Sequence
  Synthetic Oligonucleotide; CD80 exon 6; Set A
acaguaggucaggcagcauaucacaaaa

SEQ ID NO: 59115 - RNA, 32 nt, Artificial Sequence
  Synthetic Oligonucleotide; CD80 exon 6; Set A
uuacaguaggucaggcagcauaucacaaaaau

SEQ ID NO: 59116 - RNA, 30 nt, Artificial Sequence
  Synthetic Oligonucleotide; CD80 exon 6; Set A
uacaguaggucaggcagcauaucacaaaaa

SEQ ID NO: 59117 - RNA, 34 nt, Artificial Sequence
  Synthetic Oligonucleotide; CD80 exon 6; Set A
cuuacaguaggucaggcagcauaucacaaaaauu

SEQ ID NO: 59118 - RNA, 36 nt, Artificial Sequence
  Synthetic Oligonucleotide; CD80 exon 6; Set A
acuuacaguaggucaggcagcauaucacaaaaauuc

SEQ ID NO: 59119 - RNA, 27 nt, Artificial Sequence
  Synthetic Oligonucleotide; CD80 exon 6; Set A
acaguaggucaggcagcauaucacaaa

SEQ ID NO: 59120 - RNA, 29 nt, Artificial Sequence
  Synthetic Oligonucleotide; CD80 exon 6; Set A
uacaguaggucaggcagcauaucacaaaa

SEQ ID NO: 59121 - RNA, 33 nt, Artificial Sequence
  Synthetic Oligonucleotide; CD80 exon 6; Set A
cuuacaguaggucaggcagcauaucacaaaaau

SEQ ID NO: 59122 - RNA, 31 nt, Artificial Sequence
  Synthetic Oligonucleotide; CD80 exon 6; Set A
uuacaguaggucaggcagcauaucacaaaaa

SEQ ID NO: 59123 - RNA, 35 nt, Artificial Sequence
  Synthetic Oligonucleotide; CD80 exon 6; Set A
acuuacaguaggucaggcagcauaucacaaaaauu

SEQ ID NO: 59124 - RNA, 37 nt, Artificial Sequence
  Synthetic Oligonucleotide; CD80 exon 6; Set A
uacuuacaguaggucaggcagcauaucacaaaaauuc

SEQ ID NO: 59125 - RNA, 15 nt, Artificial Sequence
  Synthetic Oligonucleotide; CD80 exon 6; Set C
ggucaggcagcauau

SEQ ID NO: 59126 - RNA, 28 nt, Artificial Sequence
  Synthetic Oligonucleotide; CD80 exon 6; Set A
uacaguaggucaggcagcauaucacaaa

SEQ ID NO: 59127 - RNA, 30 nt, Artificial Sequence
  Synthetic Oligonucleotide; CD80 exon 6; Set A
uuacaguaggucaggcagcauaucacaaaa

SEQ ID NO: 59128 - RNA, 34 nt, Artificial Sequence
  Synthetic Oligonucleotide; CD80 exon 6; Set A
acuuacaguaggucaggcagcauaucacaaaaau

SEQ ID NO: 59129 - RNA, 32 nt, Artificial Sequence
  Synthetic Oligonucleotide; CD80 exon 6; Set A
cuuacaguaggucaggcagcauaucacaaaaa

SEQ ID NO: 59130 - RNA, 36 nt, Artificial Sequence
  Synthetic Oligonucleotide; CD80 exon 6; Set A
uacuuacaguaggucaggcagcauaucacaaaaauu

SEQ ID NO: 59131 - RNA, 38 nt, Artificial Sequence
  Synthetic Oligonucleotide; CD80 exon 6; Set C
guacuuacaguaggucaggcagcauaucacaaaaauuc

SEQ ID NO: 59132 - RNA, 16 nt, Artificial Sequence
  Synthetic Oligonucleotide; CD80 exon 6; Set C
aggucaggcagcauau

SEQ ID NO: 59133 - RNA, 29 nt, Artificial Sequence
  Synthetic Oligonucleotide; CD80 exon 6; Set A
uuacaguaggucaggcagcauaucacaaa

SEQ ID NO: 59134 - RNA, 31 nt, Artificial Sequence
  Synthetic Oligonucleotide; CD80 exon 6; Set A
cuuacaguaggucaggcagcauaucacaaaa

SEQ ID NO: 59135 - RNA, 35 nt, Artificial Sequence
  Synthetic Oligonucleotide; CD80 exon 6; Set A
uacuuacaguaggucaggcagcauaucacaaaaau

SEQ ID NO: 59136 - RNA, 33 nt, Artificial Sequence
  Synthetic Oligonucleotide; CD80 exon 6; Set A
acuuacaguaggucaggcagcauaucacaaaaa

SEQ ID NO: 59137 - RNA, 37 nt, Artificial Sequence
  Synthetic Oligonucleotide; CD80 exon 6; Set C
guacuuacaguaggucaggcagcauaucacaaaaauu

SEQ ID NO: 59138 - RNA, 39 nt, Artificial Sequence
  Synthetic Oligonucleotide; CD80 exon 6; Set C
aguacuuacaguaggucaggcagcauaucacaaaaauuc

SEQ ID NO: 59139 - RNA, 15 nt, Artificial Sequence
  Synthetic Oligonucleotide; CD80 exon 6; Set C
aggucaggcagcaua

SEQ ID NO: 59140 - RNA, 17 nt, Artificial Sequence
  Synthetic Oligonucleotide; CD80 exon 6; Set C
uaggucaggcagcauau

SEQ ID NO: 59141 - RNA, 30 nt, Artificial Sequence
  Synthetic Oligonucleotide; CD80 exon 6; Set A
cuuacaguaggucaggcagcauaucacaaa

SEQ ID NO: 59142 - RNA, 32 nt, Artificial Sequence
  Synthetic Oligonucleotide; CD80 exon 6; Set A
acuuacaguaggucaggcagcauaucacaaaa

SEQ ID NO: 59143 - RNA, 36 nt, Artificial Sequence
  Synthetic Oligonucleotide; CD80 exon 6; Set C
guacuuacaguaggucaggcagcauaucacaaaaau

SEQ ID NO: 59144 - RNA, 34 nt, Artificial Sequence
  Synthetic Oligonucleotide; CD80 exon 6; Set A
uacuuacaguaggucaggcagcauaucacaaaaa

SEQ ID NO: 59145 - RNA, 38 nt, Artificial Sequence
  Synthetic Oligonucleotide; CD80 exon 6; Set C
aguacuuacaguaggucaggcagcauaucacaaaaauu

SEQ ID NO: 59146 - RNA, 16 nt, Artificial Sequence
  Synthetic Oligonucleotide; CD80 exon 6; Set C
uaggucaggcagcaua

SEQ ID NO: 59147 - RNA, 18 nt, Artificial Sequence
  Synthetic Oligonucleotide; CD80 exon 6; Set C
guaggucaggcagcauau

SEQ ID NO: 59148 - RNA, 31 nt, Artificial Sequence
  Synthetic Oligonucleotide; CD80 exon 6; Set C
acuuacaguaggucaggcagcauaucacaaa

SEQ ID NO: 59149 - RNA, 33 nt, Artificial Sequence
  Synthetic Oligonucleotide; CD80 exon 6; Set A
uacuuacaguaggucaggcagcauaucacaaaa

SEQ ID NO: 59150 - RNA, 35 nt, Artificial Sequence
  Synthetic Oligonucleotide; CD80 exon 6; Set C
guacuuacaguaggucaggcagcauaucacaaaaa

SEQ ID NO: 59151 - RNA, 15 nt, Artificial Sequence
  Synthetic Oligonucleotide; CD80 exon 6; Set C
uaggucaggcagcau

SEQ ID NO: 59152 - RNA, 32 nt, Artificial Sequence
  Synthetic Oligonucleotide; CD80 exon 6; Set C
uacuuacaguaggucaggcagcauaucacaaa

SEQ ID NO: 59153 - RNA, 34 nt, Artificial Sequence
  Synthetic Oligonucleotide; CD80 exon 6; Set C
guacuuacaguaggucaggcagcauaucacaaaa

SEQ ID NO: 59154 - RNA, 36 nt, Artificial Sequence
  Synthetic Oligonucleotide; CD80 exon 6; Set C
aguacuuacaguaggucaggcagcauaucacaaaaa

SEQ ID NO: 59155 - RNA, 20 nt, Artificial Sequence
  Synthetic Oligonucleotide; CD80 exon 6; Set A
caguaggucaggcagcauau

SEQ ID NO: 59156 - RNA, 16 nt, Artificial Sequence
  Synthetic Oligonucleotide; CD80 exon 6; Set C
guaggucaggcagcau

SEQ ID NO: 59157 - RNA, 33 nt, Artificial Sequence
  Synthetic Oligonucleotide; CD80 exon 6; Set C
guacuuacaguaggucaggcagcauaucacaaa

SEQ ID NO: 59158 - RNA, 35 nt, Artificial Sequence
  Synthetic Oligonucleotide; CD80 exon 6; Set C
aguacuuacaguaggucaggcagcauaucacaaaa

SEQ ID NO: 59159 - RNA, 19 nt, Artificial Sequence
  Synthetic Oligonucleotide; CD80 exon 6; Set A
caguaggucaggcagcaua

SEQ ID NO: 59160 - RNA, 17 nt, Artificial Sequence
  Synthetic Oligonucleotide; CD80 exon 6; Set C
aguaggucaggcagcau

SEQ ID NO: 59161 - RNA, 15 nt, Artificial Sequence
  Synthetic Oligonucleotide; CD80 exon 6; Set C
guaggucaggcagca

SEQ ID NO: 59162 - RNA, 34 nt, Artificial Sequence
  Synthetic Oligonucleotide; CD80 exon 6; Set C
aguacuuacaguaggucaggcagcauaucacaaa

SEQ ID NO: 59163 - RNA, 20 nt, Artificial Sequence
  Synthetic Oligonucleotide; CD80 exon 6; Set A
acaguaggucaggcagcaua

SEQ ID NO: 59164 - RNA, 16 nt, Artificial Sequence
  Synthetic Oligonucleotide; CD80 exon 6; Set C
aguaggucaggcagca

SEQ ID NO: 59165 - RNA, 21 nt, Artificial Sequence
  Synthetic Oligonucleotide; CD80 exon 6; Set A
uacaguaggucaggcagcaua

SEQ ID NO: 59166 - RNA, 22 nt, Artificial Sequence
  Synthetic Oligonucleotide; CD80 exon 6; Set A
uuacaguaggucaggcagcaua

SEQ ID NO: 59167 - RNA, 25 nt, Artificial Sequence
  Synthetic Oligonucleotide; CD80 exon 6; Set A
uacuuacaguaggucaggcagcaua

SEQ ID NO: 59168 - RNA, 27 nt, Artificial Sequence
  Synthetic Oligonucleotide; CD80 exon 6; Set A
guacuuacaguaggucaggcagcauau

SEQ ID NO: 59169 - RNA, 26 nt, Artificial Sequence
  Synthetic Oligonucleotide; CD80 exon 6; Set A
guacuuacaguaggucaggcagcaua

SEQ ID NO: 59170 - RNA, 28 nt, Artificial Sequence
  Synthetic Oligonucleotide; CD80 exon 6; Set A
aguacuuacaguaggucaggcagcauau

SEQ ID NO: 59171 - RNA, 27 nt, Artificial Sequence
  Synthetic Oligonucleotide; CD80 exon 6; Set A
aguacuuacaguaggucaggcagcaua

SEQ ID NO: 59172 - RNA, 29 nt, Artificial Sequence
  Synthetic Oligonucleotide; CD80 exon 6; Set A
uaguacuuacaguaggucaggcagcauau

SEQ ID NO: 59173 - RNA, 30 nt, Artificial Sequence
  Synthetic Oligonucleotide; CD80 exon 6; Set A
auaguacuuacaguaggucaggcagcauau

SEQ ID NO: 59174 - RNA, 15 nt, Artificial Sequence
  Synthetic Oligonucleotide; CD80 exon 6; Set C
uuacaguaggucagg

SEQ ID NO: 59175 - RNA, 31 nt, Artificial Sequence
  Synthetic Oligonucleotide; CD80 exon 6; Set C
gauaguacuuacaguaggucaggcagcauau

SEQ ID NO: 59176 - RNA, 27 nt, Artificial Sequence
  Synthetic Oligonucleotide; CD80 exon 6; Set A
uaguacuuacaguaggucaggcagcau

SEQ ID NO: 59177 - RNA, 32 nt, Artificial Sequence
  Synthetic Oligonucleotide; CD80 exon 6; Set C
ugauaguacuuacaguaggucaggcagcauau

SEQ ID NO: 59178 - RNA, 28 nt, Artificial Sequence
  Synthetic Oligonucleotide; CD80 exon 6; Set A
auaguacuuacaguaggucaggcagcau

SEQ ID NO: 59179 - RNA, 26 nt, Artificial Sequence
  Synthetic Oligonucleotide; CD80 exon 6; Set B
uaguacuuacaguaggucaggcagca

SEQ ID NO: 59180 - RNA, 33 nt, Artificial Sequence
  Synthetic Oligonucleotide; CD80 exon 6; Set C
augauaguacuuacaguaggucaggcagcauau

SEQ ID NO: 59181 - RNA, 29 nt, Artificial Sequence
  Synthetic Oligonucleotide; CD80 exon 6; Set C
gauaguacuuacaguaggucaggcagcau

SEQ ID NO: 59182 - RNA, 27 nt, Artificial Sequence
  Synthetic Oligonucleotide; CD80 exon 6; Set B
auaguacuuacaguaggucaggcagca

SEQ ID NO: 59183 - RNA, 18 nt, Artificial Sequence
  Synthetic Oligonucleotide; CD80 exon 6; Set C
uacuuacaguaggucagg

SEQ ID NO: 59184 - RNA, 34 nt, Artificial Sequence
  Synthetic Oligonucleotide; CD80 exon 6; Set C
uaugauaguacuuacaguaggucaggcagcauau

SEQ ID NO: 59185 - RNA, 30 nt, Artificial Sequence
  Synthetic Oligonucleotide; CD80 exon 6; Set C
ugauaguacuuacaguaggucaggcagcau

SEQ ID NO: 59186 - RNA, 28 nt, Artificial Sequence
  Synthetic Oligonucleotide; CD80 exon 6; Set C
gauaguacuuacaguaggucaggcagca

SEQ ID NO: 59187 - RNA, 15 nt, Artificial Sequence
  Synthetic Oligonucleotide; CD80 exon 6; Set C
acuuacaguagguca

SEQ ID NO: 59188 - RNA, 19 nt, Artificial Sequence
  Synthetic Oligonucleotide; CD80 exon 6; Set C
guacuuacaguaggucagg

SEQ ID NO: 59189 - RNA, 17 nt, Artificial Sequence
  Synthetic Oligonucleotide; CD80 exon 6; Set C
uacuuacaguaggucag

SEQ ID NO: 59190 - RNA, 35 nt, Artificial Sequence
  Synthetic Oligonucleotide; CD80 exon 6; Set C
guaugauaguacuuacaguaggucaggcagcauau

SEQ ID NO: 59191 - RNA, 31 nt, Artificial Sequence
  Synthetic Oligonucleotide; CD80 exon 6; Set C
augauaguacuuacaguaggucaggcagcau

SEQ ID NO: 59192 - RNA, 29 nt, Artificial Sequence
  Synthetic Oligonucleotide; CD80 exon 6; Set C
ugauaguacuuacaguaggucaggcagca

SEQ ID NO: 59193 - RNA, 16 nt, Artificial Sequence
  Synthetic Oligonucleotide; CD80 exon 6; Set C
uacuuacaguagguca

SEQ ID NO: 59194 - RNA, 20 nt, Artificial Sequence
  Synthetic Oligonucleotide; CD80 exon 6; Set C
aguacuuacaguaggucagg

SEQ ID NO: 59195 - RNA, 18 nt, Artificial Sequence
  Synthetic Oligonucleotide; CD80 exon 6; Set C
guacuuacaguaggucag

SEQ ID NO: 59196 - RNA, 36 nt, Artificial Sequence
  Synthetic Oligonucleotide; CD80 exon 6; Set C
gguaugauaguacuuacaguaggucaggcagcauau

SEQ ID NO: 59197 - RNA, 32 nt, Artificial Sequence
  Synthetic Oligonucleotide; CD80 exon 6; Set C
uaugauaguacuuacaguaggucaggcagcau

SEQ ID NO: 59198 - RNA, 30 nt, Artificial Sequence
  Synthetic Oligonucleotide; CD80 exon 6; Set C
augauaguacuuacaguaggucaggcagca

SEQ ID NO: 59199 - RNA, 22 nt, Artificial Sequence
  Synthetic Oligonucleotide; CD80 exon 6; Set B
uaguacuuacaguaggucaggc

SEQ ID NO: 59200 - RNA, 17 nt, Artificial Sequence
  Synthetic Oligonucleotide; CD80 exon 6; Set C
guacuuacaguagguca

SEQ ID NO: 59201 - RNA, 19 nt, Artificial Sequence
  Synthetic Oligonucleotide; CD80 exon 6; Set C
aguacuuacaguaggucag

SEQ ID NO: 59202 - RNA, 15 nt, Artificial Sequence
  Synthetic Oligonucleotide; CD80 exon 6; Set C
uacuuacaguagguc

SEQ ID NO: 59203 - RNA, 33 nt, Artificial Sequence
  Synthetic Oligonucleotide; CD80 exon 6; Set C
guaugauaguacuuacaguaggucaggcagcau

SEQ ID NO: 59204 - RNA, 31 nt, Artificial Sequence
  Synthetic Oligonucleotide; CD80 exon 6; Set C
uaugauaguacuuacaguaggucaggcagca

SEQ ID NO: 59205 - RNA, 23 nt, Artificial Sequence
  Synthetic Oligonucleotide; CD80 exon 6; Set B
auaguacuuacaguaggucaggc

SEQ ID NO: 59206 - RNA, 18 nt, Artificial Sequence
  Synthetic Oligonucleotide; CD80 exon 6; Set C
aguacuuacaguagguca

SEQ ID NO: 59207 - RNA, 36 nt, Artificial Sequence
  Synthetic Oligonucleotide; CD80 exon 6; Set C
ugguaugauaguacuuacaguaggucaggcagcaua

SEQ ID NO: 59208 - RNA, 16 nt, Artificial Sequence
  Synthetic Oligonucleotide; CD80 exon 6; Set C
guacuuacaguagguc

SEQ ID NO: 59209 - RNA, 34 nt, Artificial Sequence
  Synthetic Oligonucleotide; CD80 exon 6; Set C
gguaugauaguacuuacaguaggucaggcagcau

SEQ ID NO: 59210 - RNA, 32 nt, Artificial Sequence
  Synthetic Oligonucleotide; CD80 exon 6; Set C
guaugauaguacuuacaguaggucaggcagca

SEQ ID NO: 59211 - RNA, 24 nt, Artificial Sequence
  Synthetic Oligonucleotide; CD80 exon 6; Set B
gauaguacuuacaguaggucaggc

SEQ ID NO: 59212 - RNA, 37 nt, Artificial Sequence
  Synthetic Oligonucleotide; CD80 exon 6; Set C
augguaugauaguacuuacaguaggucaggcagcaua

SEQ ID NO: 59213 - RNA, 15 nt, Artificial Sequence
  Synthetic Oligonucleotide; CD80 exon 6; Set C
guacuuacaguaggu

SEQ ID NO: 59214 - RNA, 17 nt, Artificial Sequence
  Synthetic Oligonucleotide; CD80 exon 6; Set C
aguacuuacaguagguc

SEQ ID NO: 59215 - RNA, 33 nt, Artificial Sequence
  Synthetic Oligonucleotide; CD80 exon 6; Set C
gguaugauaguacuuacaguaggucaggcagca

SEQ ID NO: 59216 - RNA, 25 nt, Artificial Sequence
  Synthetic Oligonucleotide; CD80 exon 6; Set B
ugauaguacuuacaguaggucaggc

SEQ ID NO: 59217 - RNA, 16 nt, Artificial Sequence
  Synthetic Oligonucleotide; CD80 exon 6; Set C
aguacuuacaguaggu

SEQ ID NO: 59218 - RNA, 18 nt, Artificial Sequence
  Synthetic Oligonucleotide; CD80 exon 6; Set C
uaguacuuacaguagguc

SEQ ID NO: 59219 - RNA, 26 nt, Artificial Sequence
  Synthetic Oligonucleotide; CD80 exon 6; Set B
augauaguacuuacaguaggucaggc

SEQ ID NO: 59220 - RNA, 15 nt, Artificial Sequence
  Synthetic Oligonucleotide; CD80 exon 6; Set C
aguacuuacaguagg

SEQ ID NO: 59221 - RNA, 17 nt, Artificial Sequence
  Synthetic Oligonucleotide; CD80 exon 6; Set C
uaguacuuacaguaggu

SEQ ID NO: 59222 - RNA, 19 nt, Artificial Sequence
  Synthetic Oligonucleotide; CD80 exon 6; Set C
auaguacuuacaguagguc

SEQ ID NO: 59223 - RNA, 27 nt, Artificial Sequence
  Synthetic Oligonucleotide; CD80 exon 6; Set B
uaugauaguacuuacaguaggucaggc

SEQ ID NO: 59224 - RNA, 16 nt, Artificial Sequence
  Synthetic Oligonucleotide; CD80 exon 6; Set C
uaguacuuacaguagg

SEQ ID NO: 59225 - RNA, 18 nt, Artificial Sequence
  Synthetic Oligonucleotide; CD80 exon 6; Set C
auaguacuuacaguaggu

SEQ ID NO: 59226 - RNA, 20 nt, Artificial Sequence
  Synthetic Oligonucleotide; CD80 exon 6; Set C
gauaguacuuacaguagguc

SEQ ID NO: 59227 - RNA, 28 nt, Artificial Sequence
  Synthetic Oligonucleotide; CD80 exon 6; Set B
guaugauaguacuuacaguaggucaggc

SEQ ID NO: 59228 - RNA, 17 nt, Artificial Sequence
  Synthetic Oligonucleotide; CD80 exon 6; Set C
auaguacuuacaguagg

SEQ ID NO: 59229 - RNA, 15 nt, Artificial Sequence
  Synthetic Oligonucleotide; CD80 exon 6; Set C
uaguacuuacaguag

SEQ ID NO: 59230 - RNA, 19 nt, Artificial Sequence
  Synthetic Oligonucleotide; CD80 exon 6; Set C
gauaguacuuacaguaggu

SEQ ID NO: 59231 - RNA, 21 nt, Artificial Sequence
  Synthetic Oligonucleotide; CD80 exon 6; Set C
ugauaguacuuacaguagguc

SEQ ID NO: 59232 - RNA, 29 nt, Artificial Sequence
  Synthetic Oligonucleotide; CD80 exon 6; Set B
gguaugauaguacuuacaguaggucaggc

SEQ ID NO: 59233 - RNA, 16 nt, Artificial Sequence
  Synthetic Oligonucleotide; CD80 exon 6; Set C
auaguacuuacaguag

SEQ ID NO: 59234 - RNA, 18 nt, Artificial Sequence
  Synthetic Oligonucleotide; CD80 exon 6; Set C
gauaguacuuacaguagg

SEQ ID NO: 59235 - RNA, 20 nt, Artificial Sequence
  Synthetic Oligonucleotide; CD80 exon 6; Set C
ugauaguacuuacaguaggu

SEQ ID NO: 59236 - RNA, 22 nt, Artificial Sequence
  Synthetic Oligonucleotide; CD80 exon 6; Set C
augauaguacuuacaguagguc

SEQ ID NO: 59237 - RNA, 29 nt, Artificial Sequence
  Synthetic Oligonucleotide; CD80 exon 6; Set B
ugguaugauaguacuuacaguaggucagg

SEQ ID NO: 59238 - RNA, 17 nt, Artificial Sequence
  Synthetic Oligonucleotide; CD80 exon 6; Set C
gauaguacuuacaguag

SEQ ID NO: 59239 - RNA, 19 nt, Artificial Sequence
  Synthetic Oligonucleotide; CD80 exon 6; Set C
ugauaguacuuacaguagg

SEQ ID NO: 59240 - RNA, 21 nt, Artificial Sequence
  Synthetic Oligonucleotide; CD80 exon 6; Set C
augauaguacuuacaguaggu

SEQ ID NO: 59241 - RNA, 23 nt, Artificial Sequence
  Synthetic Oligonucleotide; CD80 exon 6; Set C
uaugauaguacuuacaguagguc

SEQ ID NO: 59242 - RNA, 30 nt, Artificial Sequence
  Synthetic Oligonucleotide; CD80 exon 6; Set B
augguaugauaguacuuacaguaggucagg

SEQ ID NO: 59243 - RNA, 28 nt, Artificial Sequence
  Synthetic Oligonucleotide; CD80 exon 6; Set B
ugguaugauaguacuuacaguaggucag

SEQ ID NO: 59244 - RNA, 18 nt, Artificial Sequence
  Synthetic Oligonucleotide; CD80 exon 6; Set C
ugauaguacuuacaguag

SEQ ID NO: 59245 - RNA, 20 nt, Artificial Sequence
  Synthetic Oligonucleotide; CD80 exon 6; Set C
augauaguacuuacaguagg

SEQ ID NO: 59246 - RNA, 22 nt, Artificial Sequence
  Synthetic Oligonucleotide; CD80 exon 6; Set C
uaugauaguacuuacaguaggu

SEQ ID NO: 59247 - RNA, 24 nt, Artificial Sequence
  Synthetic Oligonucleotide; CD80 exon 6; Set C
guaugauaguacuuacaguagguc

SEQ ID NO: 59248 - RNA, 27 nt, Artificial Sequence
  Synthetic Oligonucleotide; CD80 exon 6; Set B
ugguaugauaguacuuacaguagguca

SEQ ID NO: 59249 - RNA, 29 nt, Artificial Sequence
  Synthetic Oligonucleotide; CD80 exon 6; Set B
augguaugauaguacuuacaguaggucag

SEQ ID NO: 59250 - RNA, 21 nt, Artificial Sequence
  Synthetic Oligonucleotide; CD80 exon 6; Set C
uaugauaguacuuacaguagg

SEQ ID NO: 59251 - RNA, 19 nt, Artificial Sequence
  Synthetic Oligonucleotide; CD80 exon 6; Set C
augauaguacuuacaguag

SEQ ID NO: 59252 - RNA, 23 nt, Artificial Sequence
  Synthetic Oligonucleotide; CD80 exon 6; Set C
guaugauaguacuuacaguaggu

SEQ ID NO: 59253 - RNA, 25 nt, Artificial Sequence
  Synthetic Oligonucleotide; CD80 exon 6; Set B
gguaugauaguacuuacaguagguc

SEQ ID NO: 59254 - RNA, 28 nt, Artificial Sequence
  Synthetic Oligonucleotide; CD80 exon 6; Set B
augguaugauaguacuuacaguagguca

SEQ ID NO: 59255 - RNA, 22 nt, Artificial Sequence
  Synthetic Oligonucleotide; CD80 exon 6; Set C
guaugauaguacuuacaguagg

SEQ ID NO: 59256 - RNA, 20 nt, Artificial Sequence
  Synthetic Oligonucleotide; CD80 exon 6; Set C
uaugauaguacuuacaguag

SEQ ID NO: 59257 - RNA, 24 nt, Artificial Sequence
  Synthetic Oligonucleotide; CD80 exon 6; Set C
gguaugauaguacuuacaguaggu

SEQ ID NO: 59258 - RNA, 21 nt, Artificial Sequence
  Synthetic Oligonucleotide; CD80 exon 6; Set C
guaugauaguacuuacaguag

SEQ ID NO: 59259 - RNA, 23 nt, Artificial Sequence
  Synthetic Oligonucleotide; CD80 exon 6; Set C
gguaugauaguacuuacaguagg

SEQ ID NO: 59260 - RNA, 27 nt, Artificial Sequence
  Synthetic Oligonucleotide; CD80 exon 6; Set B
augguaugauaguacuuacaguagguc

SEQ ID NO: 59261 - RNA, 15 nt, Artificial Sequence
  Synthetic Oligonucleotide; CD80 exon 6; Set C
ugauaguacuuacag

SEQ ID NO: 59262 - RNA, 22 nt, Artificial Sequence
  Synthetic Oligonucleotide; CD80 exon 6; Set C
gguaugauaguacuuacaguag

SEQ ID NO: 59263 - RNA, 26 nt, Artificial Sequence
  Synthetic Oligonucleotide; CD80 exon 6; Set B
augguaugauaguacuuacaguaggu

SEQ ID NO: 59264 - RNA, 16 nt, Artificial Sequence
  Synthetic Oligonucleotide; CD80 exon 6; Set C
augauaguacuuacag

SEQ ID NO: 59265 - RNA, 17 nt, Artificial Sequence
  Synthetic Oligonucleotide; CD80 exon 6; Set C
uaugauaguacuuacag

SEQ ID NO: 59266 - RNA, 15 nt, Artificial Sequence
  Synthetic Oligonucleotide; CD80 exon 6; Set C
augauaguacuuaca

SEQ ID NO: 59267 - RNA, 22 nt, Artificial Sequence
  Synthetic Oligonucleotide; CD80 exon 6; Set C
ugguaugauaguacuuacagua

SEQ ID NO: 59268 - RNA, 24 nt, Artificial Sequence
  Synthetic Oligonucleotide; CD80 exon 6; Set C
augguaugauaguacuuacaguag

SEQ ID NO: 59269 - RNA, 18 nt, Artificial Sequence
  Synthetic Oligonucleotide; CD80 exon 6; Set C
guaugauaguacuuacag

SEQ ID NO: 59270 - RNA, 16 nt, Artificial Sequence
  Synthetic Oligonucleotide; CD80 exon 6; Set C
uaugauaguacuuaca

SEQ ID NO: 59271 - RNA, 21 nt, Artificial Sequence
  Synthetic Oligonucleotide; CD80 exon 6; Set C
ugguaugauaguacuuacagu

SEQ ID NO: 59272 - RNA, 23 nt, Artificial Sequence
  Synthetic Oligonucleotide; CD80 exon 6; Set C
augguaugauaguacuuacagua

SEQ ID NO: 59273 - RNA, 19 nt, Artificial Sequence
  Synthetic Oligonucleotide; CD80 exon 6; Set C
gguaugauaguacuuacag

SEQ ID NO: 59274 - RNA, 17 nt, Artificial Sequence
  Synthetic Oligonucleotide; CD80 exon 6; Set C
guaugauaguacuuaca

SEQ ID NO: 59275 - RNA, 15 nt, Artificial Sequence
  Synthetic Oligonucleotide; CD80 exon 6; Set C
uaugauaguacuuac

SEQ ID NO: 59276 - RNA, 22 nt, Artificial Sequence
  Synthetic Oligonucleotide; CD80 exon 6; Set C
augguaugauaguacuuacagu

SEQ ID NO: 59277 - RNA, 16 nt, Artificial Sequence
  Synthetic Oligonucleotide; CD80 exon 6; Set C
guaugauaguacuuac

SEQ ID NO: 59278 - RNA, 18 nt, Artificial Sequence
  Synthetic Oligonucleotide; CD80 exon 6; Set C
gguaugauaguacuuaca

SEQ ID NO: 59279 - RNA, 17 nt, Artificial Sequence
  Synthetic Oligonucleotide; CD80 exon 6; Set C
gguaugauaguacuuac

SEQ ID NO: 59280 - RNA, 15 nt, Artificial Sequence
  Synthetic Oligonucleotide; CD80 exon 6; Set C
guaugauaguacuua

SEQ ID NO: 59281 - RNA, 16 nt, Artificial Sequence
  Synthetic Oligonucleotide; CD80 exon 6; Set C
gguaugauaguacuua

SEQ ID NO: 59282 - RNA, 40 nt, Artificial Sequence
  Synthetic Oligonucleotide; CD80 exon 6; Set C
agaucaggaugaugguaugauaguacuuacaguaggucag

SEQ ID NO: 59283 - RNA, 39 nt, Artificial Sequence
  Synthetic Oligonucleotide; CD80 exon 6; Set C
agaucaggaugaugguaugauaguacuuacaguagguca

SEQ ID NO: 59284 - RNA, 40 nt, Artificial Sequence
  Synthetic Oligonucleotide; CD80 exon 6; Set C
gagaucaggaugaugguaugauaguacuuacaguagguca

SEQ ID NO: 59285 - RNA, 38 nt, Artificial Sequence
  Synthetic Oligonucleotide; CD80 exon 6; Set C
agaucaggaugaugguaugauaguacuuacaguagguc

SEQ ID NO: 59286 - RNA, 37 nt, Artificial Sequence
  Synthetic Oligonucleotide; CD80 exon 6; Set C
agaucaggaugaugguaugauaguacuuacaguaggu

SEQ ID NO: 59287 - RNA, 39 nt, Artificial Sequence
  Synthetic Oligonucleotide; CD80 exon 6; Set C
gagaucaggaugaugguaugauaguacuuacaguagguc

SEQ ID NO: 59288 - RNA, 36 nt, Artificial Sequence
  Synthetic Oligonucleotide; CD80 exon 6; Set B
agaucaggaugaugguaugauaguacuuacaguagg

SEQ ID NO: 59289 - RNA, 38 nt, Artificial Sequence
  Synthetic Oligonucleotide; CD80 exon 6; Set C
gagaucaggaugaugguaugauaguacuuacaguaggu

SEQ ID NO: 59290 - RNA, 40 nt, Artificial Sequence
  Synthetic Oligonucleotide; CD80 exon 6; Set C
ugagaucaggaugaugguaugauaguacuuacaguagguc

SEQ ID NO: 59291 - RNA, 37 nt, Artificial Sequence
  Synthetic Oligonucleotide; CD80 exon 6; Set C
gagaucaggaugaugguaugauaguacuuacaguagg

SEQ ID NO: 59292 - RNA, 35 nt, Artificial Sequence
  Synthetic Oligonucleotide; CD80 exon 6; Set B
agaucaggaugaugguaugauaguacuuacaguag

SEQ ID NO: 59293 - RNA, 39 nt, Artificial Sequence
  Synthetic Oligonucleotide; CD80 exon 6; Set C
ugagaucaggaugaugguaugauaguacuuacaguaggu

SEQ ID NO: 59294 - RNA, 38 nt, Artificial Sequence
  Synthetic Oligonucleotide; CD80 exon 6; Set C
ugagaucaggaugaugguaugauaguacuuacaguagg

SEQ ID NO: 59295 - RNA, 36 nt, Artificial Sequence
  Synthetic Oligonucleotide; CD80 exon 6; Set B
gagaucaggaugaugguaugauaguacuuacaguag

SEQ ID NO: 59296 - RNA, 40 nt, Artificial Sequence
  Synthetic Oligonucleotide; CD80 exon 6; Set C
uugagaucaggaugaugguaugauaguacuuacaguaggu

SEQ ID NO: 59297 - RNA, 39 nt, Artificial Sequence
  Synthetic Oligonucleotide; CD80 exon 6; Set C
uugagaucaggaugaugguaugauaguacuuacaguagg

SEQ ID NO: 59298 - RNA, 37 nt, Artificial Sequence
  Synthetic Oligonucleotide; CD80 exon 6; Set B
ugagaucaggaugaugguaugauaguacuuacaguag

SEQ ID NO: 59299 - RNA, 40 nt, Artificial Sequence
  Synthetic Oligonucleotide; CD80 exon 6; Set C
auugagaucaggaugaugguaugauaguacuuacaguagg

SEQ ID NO: 59300 - RNA, 38 nt, Artificial Sequence
  Synthetic Oligonucleotide; CD80 exon 6; Set B
uugagaucaggaugaugguaugauaguacuuacaguag

SEQ ID NO: 59301 - RNA, 32 nt, Artificial Sequence
  Synthetic Oligonucleotide; CD80 exon 6; Set B
agaucaggaugaugguaugauaguacuuacag

SEQ ID NO: 59302 - RNA, 39 nt, Artificial Sequence
  Synthetic Oligonucleotide; CD80 exon 6; Set B
auugagaucaggaugaugguaugauaguacuuacaguag

SEQ ID NO: 59303 - RNA, 33 nt, Artificial Sequence
  Synthetic Oligonucleotide; CD80 exon 6; Set B
gagaucaggaugaugguaugauaguacuuacag

SEQ ID NO: 59304 - RNA, 34 nt, Artificial Sequence
  Synthetic Oligonucleotide; CD80 exon 6; Set B
ugagaucaggaugaugguaugauaguacuuacag

SEQ ID NO: 59305 - RNA, 35 nt, Artificial Sequence
  Synthetic Oligonucleotide; CD80 exon 6; Set B
uugagaucaggaugaugguaugauaguacuuacag

SEQ ID NO: 59306 - RNA, 33 nt, Artificial Sequence
  Synthetic Oligonucleotide; CD80 exon 6; Set B
ugagaucaggaugaugguaugauaguacuuaca

SEQ ID NO: 59307 - RNA, 36 nt, Artificial Sequence
  Synthetic Oligonucleotide; CD80 exon 6; Set B
auugagaucaggaugaugguaugauaguacuuacag

SEQ ID NO: 59308 - RNA, 34 nt, Artificial Sequence
  Synthetic Oligonucleotide; CD80 exon 6; Set B
uugagaucaggaugaugguaugauaguacuuaca

SEQ ID NO: 59309 - RNA, 35 nt, Artificial Sequence
  Synthetic Oligonucleotide; CD80 exon 6; Set B
auugagaucaggaugaugguaugauaguacuuaca

SEQ ID NO: 59310 - RNA, 33 nt, Artificial Sequence
  Synthetic Oligonucleotide; CD80 exon 6; Set B
uugagaucaggaugaugguaugauaguacuuac

SEQ ID NO: 59311 - RNA, 34 nt, Artificial Sequence
  Synthetic Oligonucleotide; CD80 exon 6; Set B
auugagaucaggaugaugguaugauaguacuuac

SEQ ID NO: 59312 - RNA, 33 nt, Artificial Sequence
  Synthetic Oligonucleotide; CD80 exon 6; Set B
auugagaucaggaugaugguaugauaguacuua

SEQ ID NO: 59313 - RNA, 28 nt, Artificial Sequence
  Synthetic Oligonucleotide; CD80 exon 6; Set B
ugagaucaggaugaugguaugauaguac

SEQ ID NO: 59314 - RNA, 23 nt, Artificial Sequence
  Synthetic Oligonucleotide; CD80 exon 6; Set C
agaucaggaugaugguaugauag

SEQ ID NO: 59315 - RNA, 25 nt, Artificial Sequence
  Synthetic Oligonucleotide; CD80 exon 6; Set C
gagaucaggaugaugguaugauagu

SEQ ID NO: 59316 - RNA, 29 nt, Artificial Sequence
  Synthetic Oligonucleotide; CD80 exon 6; Set B
uugagaucaggaugaugguaugauaguac

SEQ ID NO: 59317 - RNA, 27 nt, Artificial Sequence
  Synthetic Oligonucleotide; CD80 exon 6; Set B
ugagaucaggaugaugguaugauagua

SEQ ID NO: 59318 - RNA, 22 nt, Artificial Sequence
  Synthetic Oligonucleotide; CD80 exon 6; Set C
agaucaggaugaugguaugaua

SEQ ID NO: 59319 - RNA, 24 nt, Artificial Sequence
  Synthetic Oligonucleotide; CD80 exon 6; Set C
gagaucaggaugaugguaugauag

SEQ ID NO: 59320 - RNA, 26 nt, Artificial Sequence
  Synthetic Oligonucleotide; CD80 exon 6; Set B
ugagaucaggaugaugguaugauagu

SEQ ID NO: 59321 - RNA, 30 nt, Artificial Sequence
  Synthetic Oligonucleotide; CD80 exon 6; Set B
auugagaucaggaugaugguaugauaguac

SEQ ID NO: 59322 - RNA, 28 nt, Artificial Sequence
  Synthetic Oligonucleotide; CD80 exon 6; Set B
uugagaucaggaugaugguaugauagua

SEQ ID NO: 59323 - RNA, 23 nt, Artificial Sequence
  Synthetic Oligonucleotide; CD80 exon 6; Set C
gagaucaggaugaugguaugaua

SEQ ID NO: 59324 - RNA, 21 nt, Artificial Sequence
  Synthetic Oligonucleotide; CD80 exon 6; Set C
agaucaggaugaugguaugau

SEQ ID NO: 59325 - RNA, 25 nt, Artificial Sequence
  Synthetic Oligonucleotide; CD80 exon 6; Set C
ugagaucaggaugaugguaugauag

SEQ ID NO: 59326 - RNA, 27 nt, Artificial Sequence
  Synthetic Oligonucleotide; CD80 exon 6; Set B
uugagaucaggaugaugguaugauagu

SEQ ID NO: 59327 - RNA, 29 nt, Artificial Sequence
  Synthetic Oligonucleotide; CD80 exon 6; Set B
auugagaucaggaugaugguaugauagua

SEQ ID NO: 59328 - RNA, 24 nt, Artificial Sequence
  Synthetic Oligonucleotide; CD80 exon 6; Set C
ugagaucaggaugaugguaugaua

SEQ ID NO: 59329 - RNA, 22 nt, Artificial Sequence
  Synthetic Oligonucleotide; CD80 exon 6; Set C
gagaucaggaugaugguaugau

SEQ ID NO: 59330 - RNA, 20 nt, Artificial Sequence
  Synthetic Oligonucleotide; CD80 exon 6; Set C
agaucaggaugaugguauga

SEQ ID NO: 59331 - RNA, 26 nt, Artificial Sequence
  Synthetic Oligonucleotide; CD80 exon 6; Set C
uugagaucaggaugaugguaugauag

SEQ ID NO: 59332 - RNA, 28 nt, Artificial Sequence
  Synthetic Oligonucleotide; CD80 exon 6; Set B
auugagaucaggaugaugguaugauagu

SEQ ID NO: 59333 - RNA, 25 nt, Artificial Sequence
  Synthetic Oligonucleotide; CD80 exon 6; Set C
uugagaucaggaugaugguaugaua

SEQ ID NO: 59334 - RNA, 23 nt, Artificial Sequence
  Synthetic Oligonucleotide; CD80 exon 6; Set C
ugagaucaggaugaugguaugau

SEQ ID NO: 59335 - RNA, 21 nt, Artificial Sequence
  Synthetic Oligonucleotide; CD80 exon 6; Set C
gagaucaggaugaugguauga

SEQ ID NO: 59336 - RNA, 19 nt, Artificial Sequence
  Synthetic Oligonucleotide; CD80 exon 6; Set C
agaucaggaugaugguaug

SEQ ID NO: 59337 - RNA, 27 nt, Artificial Sequence
  Synthetic Oligonucleotide; CD80 exon 6; Set C
auugagaucaggaugaugguaugauag

SEQ ID NO: 59338 - RNA, 18 nt, Artificial Sequence
  Synthetic Oligonucleotide; CD80 exon 6; Set C
agaucaggaugaugguau

SEQ ID NO: 59339 - RNA, 26 nt, Artificial Sequence
  Synthetic Oligonucleotide; CD80 exon 6; Set C
auugagaucaggaugaugguaugaua

SEQ ID NO: 59340 - RNA, 24 nt, Artificial Sequence
  Synthetic Oligonucleotide; CD80 exon 6; Set C
uugagaucaggaugaugguaugau

SEQ ID NO: 59341 - RNA, 22 nt, Artificial Sequence
  Synthetic Oligonucleotide; CD80 exon 6; Set C
ugagaucaggaugaugguauga

SEQ ID NO: 59342 - RNA, 20 nt, Artificial Sequence
  Synthetic Oligonucleotide; CD80 exon 6; Set C
gagaucaggaugaugguaug

SEQ ID NO: 59343 - RNA, 17 nt, Artificial Sequence
  Synthetic Oligonucleotide; CD80 exon 6; Set C
agaucaggaugauggua

SEQ ID NO: 59344 - RNA, 19 nt, Artificial Sequence
  Synthetic Oligonucleotide; CD80 exon 6; Set C
gagaucaggaugaugguau

SEQ ID NO: 59345 - RNA, 25 nt, Artificial Sequence
  Synthetic Oligonucleotide; CD80 exon 6; Set C
auugagaucaggaugaugguaugau

SEQ ID NO: 59346 - RNA, 23 nt, Artificial Sequence
  Synthetic Oligonucleotide; CD80 exon 6; Set C
uugagaucaggaugaugguauga

SEQ ID NO: 59347 - RNA, 21 nt, Artificial Sequence
  Synthetic Oligonucleotide; CD80 exon 6; Set C
ugagaucaggaugaugguaug

SEQ ID NO: 59348 - RNA, 18 nt, Artificial Sequence
  Synthetic Oligonucleotide; CD80 exon 6; Set C
gagaucaggaugauggua

SEQ ID NO: 59349 - RNA, 20 nt, Artificial Sequence
  Synthetic Oligonucleotide; CD80 exon 6; Set C
ugagaucaggaugaugguau

SEQ ID NO: 59350 - RNA, 24 nt, Artificial Sequence
  Synthetic Oligonucleotide; CD80 exon 6; Set C
auugagaucaggaugaugguauga

SEQ ID NO: 59351 - RNA, 22 nt, Artificial Sequence
  Synthetic Oligonucleotide; CD80 exon 6; Set C
uugagaucaggaugaugguaug

SEQ ID NO: 59352 - RNA, 19 nt, Artificial Sequence
  Synthetic Oligonucleotide; CD80 exon 6; Set C
ugagaucaggaugauggua

SEQ ID NO: 59353 - RNA, 17 nt, Artificial Sequence
  Synthetic Oligonucleotide; CD80 exon 6; Set C
gagaucaggaugauggu

SEQ ID NO: 59354 - RNA, 21 nt, Artificial Sequence
  Synthetic Oligonucleotide; CD80 exon 6; Set C
uugagaucaggaugaugguau

SEQ ID NO: 59355 - RNA, 23 nt, Artificial Sequence
  Synthetic Oligonucleotide; CD80 exon 6; Set C
auugagaucaggaugaugguaug

SEQ ID NO: 59356 - RNA, 20 nt, Artificial Sequence
  Synthetic Oligonucleotide; CD80 exon 6; Set C
uugagaucaggaugauggua

SEQ ID NO: 59357 - RNA, 18 nt, Artificial Sequence
  Synthetic Oligonucleotide; CD80 exon 6; Set C
ugagaucaggaugauggu

SEQ ID NO: 59358 - RNA, 22 nt, Artificial Sequence
  Synthetic Oligonucleotide; CD80 exon 6; Set C
auugagaucaggaugaugguau

SEQ ID NO: 59359 - RNA, 21 nt, Artificial Sequence
  Synthetic Oligonucleotide; CD80 exon 6; Set C
auugagaucaggaugauggua

SEQ ID NO: 59360 - RNA, 19 nt, Artificial Sequence
  Synthetic Oligonucleotide; CD80 exon 6; Set C
uugagaucaggaugauggu

SEQ ID NO: 59361 - RNA, 20 nt, Artificial Sequence
  Synthetic Oligonucleotide; CD80 exon 6; Set C
auugagaucaggaugauggu

SEQ ID NO: 59362 - RNA, 18 nt, Artificial Sequence
  Synthetic Oligonucleotide; CD80 exon 6; Set C
auugagaucaggaugaug

SEQ ID NO: 59363 - RNA, 37 nt, Artificial Sequence
  Synthetic Oligonucleotide; CD80 exon 6; Set B
uugaucuuccagaauugagaucaggaugaugguauga

SEQ ID NO: 59364 - RNA, 36 nt, Artificial Sequence
  Synthetic Oligonucleotide; CD80 exon 6; Set B
uugaucuuccagaauugagaucaggaugaugguaug

SEQ ID NO: 59365 - RNA, 35 nt, Artificial Sequence
  Synthetic Oligonucleotide; CD80 exon 6; Set B
uugaucuuccagaauugagaucaggaugaugguau

SEQ ID NO: 59366 - RNA, 34 nt, Artificial Sequence
  Synthetic Oligonucleotide; CD80 exon 6; Set B
uugaucuuccagaauugagaucaggaugauggua

SEQ ID NO: 59367 - RNA, 33 nt, Artificial Sequence
  Synthetic Oligonucleotide; CD80 exon 6; Set B
uugaucuuccagaauugagaucaggaugauggu

SEQ ID NO: 59368 - RNA, 31 nt, Artificial Sequence
  Synthetic Oligonucleotide; CD80 exon 6; Set B
uugaucuuccagaauugagaucaggaugaug

SEQ ID NO: 59369 - RNA, 33 nt, Artificial Sequence
  Synthetic Oligonucleotide; CD80 exon 6; Set B
uuugaucuuccagaauugagaucaggaugaugg

SEQ ID NO: 59370 - RNA, 32 nt, Artificial Sequence
  Synthetic Oligonucleotide; CD80 exon 6; Set B
uuugaucuuccagaauugagaucaggaugaug

SEQ ID NO: 59371 - RNA, 34 nt, Artificial Sequence
  Synthetic Oligonucleotide; CD80 exon 6; Set B
guuugaucuuccagaauugagaucaggaugaugg

SEQ ID NO: 59372 - RNA, 33 nt, Artificial Sequence
  Synthetic Oligonucleotide; CD80 exon 6; Set B
guuugaucuuccagaauugagaucaggaugaug

SEQ ID NO: 59373 - RNA, 35 nt, Artificial Sequence
  Synthetic Oligonucleotide; CD80 exon 6; Set B
aguuugaucuuccagaauugagaucaggaugaugg

SEQ ID NO: 59374 - RNA, 34 nt, Artificial Sequence
  Synthetic Oligonucleotide; CD80 exon 6; Set B
aguuugaucuuccagaauugagaucaggaugaug

SEQ ID NO: 59375 - RNA, 19 nt, Artificial Sequence
  Synthetic Oligonucleotide; CD80 exon 6; Set C
ugaucuuccagaauugaga

SEQ ID NO: 59376 - RNA, 18 nt, Artificial Sequence
  Synthetic Oligonucleotide; CD80 exon 6; Set C
ugaucuuccagaauugag

SEQ ID NO: 59377 - RNA, 17 nt, Artificial Sequence
  Synthetic Oligonucleotide; CD80 exon 6; Set C
ugaucuuccagaauuga

SEQ ID NO: 59378 - RNA, 16 nt, Artificial Sequence
  Synthetic Oligonucleotide; CD80 exon 6; Set C
ugaucuuccagaauug

SEQ ID NO: 59379 - RNA, 15 nt, Artificial Sequence
  Synthetic Oligonucleotide; CD80 exon 6; Set C
ugaucuuccagaauu

SEQ ID NO: 59380 - RNA, 20 nt, Artificial Sequence
  Synthetic Oligonucleotide; CD80 exon 6; Set C
guaauguauuuccuacugcc

SEQ ID NO: 59381 - RNA, 21 nt, Artificial Sequence
  Synthetic Oligonucleotide; CD80 exon 6; Set C
uguaauguauuuccuacugcc

SEQ ID NO: 59382 - RNA, 18 nt, Artificial Sequence
  Synthetic Oligonucleotide; CD80 exon 6; Set C
guaauguauuuccuacug

SEQ ID NO: 59383 - RNA, 19 nt, Artificial Sequence
  Synthetic Oligonucleotide; CD80 exon 6; Set C
uguaauguauuuccuacug

SEQ ID NO: 59384 - RNA, 26 nt, Artificial Sequence
  Synthetic Oligonucleotide; CD80 exon 6; Set A
gucagcuguaauguauuuccuacugc

SEQ ID NO: 59385 - RNA, 28 nt, Artificial Sequence
  Synthetic Oligonucleotide; CD80 exon 6; Set A
ugucagcuguaauguauuuccuacugcc

SEQ ID NO: 59386 - RNA, 26 nt, Artificial Sequence
  Synthetic Oligonucleotide; CD80 exon 6; Set A
ugucagcuguaauguauuuccuacug

SEQ ID NO: 59387 - RNA, 27 nt, Artificial Sequence
  Synthetic Oligonucleotide; CD80 exon 6; Set A
augucagcuguaauguauuuccuacug

SEQ ID NO: 59388 - RNA, 28 nt, Artificial Sequence
  Synthetic Oligonucleotide; CD80 exon 6; Set C
aaugucagcuguaauguauuuccuacug

SEQ ID NO: 59389 - RNA, 19 nt, Artificial Sequence
  Synthetic Oligonucleotide; CD80 exon 6; Set C
ucagcuguaauguauuucc

SEQ ID NO: 59390 - RNA, 18 nt, Artificial Sequence
  Synthetic Oligonucleotide; CD80 exon 6; Set C
ucagcuguaauguauuuc

SEQ ID NO: 59391 - RNA, 17 nt, Artificial Sequence
  Synthetic Oligonucleotide; CD80 exon 6; Set C
ucagcuguaauguauuu

SEQ ID NO: 59392 - RNA, 31 nt, Artificial Sequence
  Synthetic Oligonucleotide; CD80 exon 6; Set C
aauaaugucagcuguaauguauuuccuacug

SEQ ID NO: 59393 - RNA, 16 nt, Artificial Sequence
  Synthetic Oligonucleotide; CD80 exon 6; Set C
ucagcuguaauguauu

SEQ ID NO: 59394 - RNA, 32 nt, Artificial Sequence
  Synthetic Oligonucleotide; CD80 exon 6; Set A
gaauaaugucagcuguaauguauuuccuacug

SEQ ID NO: 59395 - RNA, 15 nt, Artificial Sequence
  Synthetic Oligonucleotide; CD80 exon 6; Set C
ucagcuguaauguau

SEQ ID NO: 59396 - RNA, 33 nt, Artificial Sequence
  Synthetic Oligonucleotide; CD80 exon 6; Set A
agaauaaugucagcuguaauguauuuccuacug

SEQ ID NO: 59397 - RNA, 34 nt, Artificial Sequence
  Synthetic Oligonucleotide; CD80 exon 6; Set A
aagaauaaugucagcuguaauguauuuccuacug

SEQ ID NO: 59398 - RNA, 40 nt, Artificial Sequence
  Synthetic Oligonucleotide; CD80 exon 6; Set A
ggaaaagaauaaugucagcuguaauguauuuccuacugcc

SEQ ID NO: 59399 - RNA, 37 nt, Artificial Sequence
  Synthetic Oligonucleotide; CD80 exon 6; Set A
gaaaagaauaaugucagcuguaauguauuuccuacug

SEQ ID NO: 59400 - RNA, 38 nt, Artificial Sequence
  Synthetic Oligonucleotide; CD80 exon 6; Set A
ggaaaagaauaaugucagcuguaauguauuuccuacug

SEQ ID NO: 59401 - RNA, 39 nt, Artificial Sequence
  Synthetic Oligonucleotide; CD80 exon 6; Set A
gggaaaagaauaaugucagcuguaauguauuuccuacug

SEQ ID NO: 59402 - RNA, 40 nt, Artificial Sequence
  Synthetic Oligonucleotide; CD80 exon 6; Set A
agggaaaagaauaaugucagcuguaauguauuuccuacug

SEQ ID NO: 59403 - RNA, 17 nt, Artificial Sequence
  Synthetic Oligonucleotide; CD80 exon 6; Set C
ggaaaagaauaauguca

SEQ ID NO: 59404 - RNA, 18 nt, Artificial Sequence
  Synthetic Oligonucleotide; CD80 exon 6; Set C
gggaaaagaauaauguca

SEQ ID NO: 59405 - RNA, 31 nt, Artificial Sequence
  Synthetic Oligonucleotide; CD80 exon 6; Set A
gcuauggagggaaaagaauaaugucagcugu

SEQ ID NO: 59406 - RNA, 40 nt, Artificial Sequence
  Synthetic Oligonucleotide; CD80 exon 6; Set C
uugcuuggcuauggagggaaaagaauaaugucagcuguaa

SEQ ID NO: 59407 - RNA, 24 nt, Artificial Sequence
  Synthetic Oligonucleotide; CD80 exon 6; Set C
cuauggagggaaaagaauaauguc

SEQ ID NO: 59408 - RNA, 39 nt, Artificial Sequence
  Synthetic Oligonucleotide; CD80 exon 6; Set C
uugcuuggcuauggagggaaaagaauaaugucagcugua

SEQ ID NO: 59409 - RNA, 25 nt, Artificial Sequence
  Synthetic Oligonucleotide; CD80 exon 6; Set C
gcuauggagggaaaagaauaauguc

SEQ ID NO: 59410 - RNA, 38 nt, Artificial Sequence
  Synthetic Oligonucleotide; CD80 exon 6; Set C
uugcuuggcuauggagggaaaagaauaaugucagcugu

SEQ ID NO: 59411 - RNA, 26 nt, Artificial Sequence
  Synthetic Oligonucleotide; CD80 exon 6; Set C
ggcuauggagggaaaagaauaauguc

SEQ ID NO: 59412 - RNA, 34 nt, Artificial Sequence
  Synthetic Oligonucleotide; CD80 exon 6; Set A
cuugcuuggcuauggagggaaaagaauaauguca

SEQ ID NO: 59413 - RNA, 35 nt, Artificial Sequence
  Synthetic Oligonucleotide; CD80 exon 6; Set A
ucuugcuuggcuauggagggaaaagaauaauguca

SEQ ID NO: 59414 - RNA, 40 nt, Artificial Sequence
  Synthetic Oligonucleotide; CD80 exon 6; Set C
aaugcucuugcuuggcuauggagggaaaagaauaauguca

SEQ ID NO: 59415 - RNA, 20 nt, Artificial Sequence
  Synthetic Oligonucleotide; CD80 exon 6; Set A
uugcuuggcuauggagggaa

SEQ ID NO: 59416 - RNA, 19 nt, Artificial Sequence
  Synthetic Oligonucleotide; CD80 exon 6; Set A
uugcuuggcuauggaggga

SEQ ID NO: 59417 - RNA, 18 nt, Artificial Sequence
  Synthetic Oligonucleotide; CD80 exon 6; Set C
uugcuuggcuauggaggg

SEQ ID NO: 59418 - RNA, 17 nt, Artificial Sequence
  Synthetic Oligonucleotide; CD80 exon 6; Set C
uugcuuggcuauggagg

SEQ ID NO: 59419 - RNA, 16 nt, Artificial Sequence
  Synthetic Oligonucleotide; CD80 exon 6; Set C
uugcuuggcuauggag

SEQ ID NO: 59420 - RNA, 15 nt, Artificial Sequence
  Synthetic Oligonucleotide; CD80 exon 6; Set C
uugcuuggcuaugga

SEQ ID NO: 59421 - RNA, 18 nt, Artificial Sequence
  Synthetic Oligonucleotide; CD80 exon 6; Set C
aaugcucuugcuuggcua

SEQ ID NO: 59422 - RNA, 19 nt, Artificial Sequence
  Synthetic Oligonucleotide; CD80 exon 6; Set C
aaaugcucuugcuuggcua

SEQ ID NO: 59423 - RNA, 17 nt, Artificial Sequence
  Synthetic Oligonucleotide; CD80 exon 6; Set C
aaugcucuugcuuggcu

SEQ ID NO: 59424 - RNA, 16 nt, Artificial Sequence
  Synthetic Oligonucleotide; CD80 exon 6; Set C
aaugcucuugcuuggc

SEQ ID NO: 59425 - RNA, 20 nt, Artificial Sequence
  Synthetic Oligonucleotide; CD80 exon 6; Set C
aaaaugcucuugcuuggcua

SEQ ID NO: 59426 - RNA, 18 nt, Artificial Sequence
  Synthetic Oligonucleotide; CD80 exon 6; Set C
aaaugcucuugcuuggcu

SEQ ID NO: 59427 - RNA, 15 nt, Artificial Sequence
  Synthetic Oligonucleotide; CD80 exon 6; Set C
aaugcucuugcuugg

SEQ ID NO: 59428 - RNA, 17 nt, Artificial Sequence
  Synthetic Oligonucleotide; CD80 exon 6; Set C
aaaugcucuugcuuggc

SEQ ID NO: 59429 - RNA, 21 nt, Artificial Sequence
  Synthetic Oligonucleotide; CD80 exon 6; Set C
gaaaaugcucuugcuuggcua

SEQ ID NO: 59430 - RNA, 19 nt, Artificial Sequence
  Synthetic Oligonucleotide; CD80 exon 6; Set C
aaaaugcucuugcuuggcu

SEQ ID NO: 59431 - RNA, 18 nt, Artificial Sequence
  Synthetic Oligonucleotide; CD80 exon 6; Set C
aaaaugcucuugcuuggc

SEQ ID NO: 59432 - RNA, 22 nt, Artificial Sequence
  Synthetic Oligonucleotide; CD80 exon 6; Set C
ggaaaaugcucuugcuuggcua

SEQ ID NO: 59433 - RNA, 20 nt, Artificial Sequence
  Synthetic Oligonucleotide; CD80 exon 6; Set C
gaaaaugcucuugcuuggcu

SEQ ID NO: 59434 - RNA, 19 nt, Artificial Sequence
  Synthetic Oligonucleotide; CD80 exon 6; Set C
gaaaaugcucuugcuuggc

SEQ ID NO: 59435 - RNA, 23 nt, Artificial Sequence
  Synthetic Oligonucleotide; CD80 exon 6; Set A
aggaaaaugcucuugcuuggcua

SEQ ID NO: 59436 - RNA, 20 nt, Artificial Sequence
  Synthetic Oligonucleotide; CD80 exon 6; Set C
ggaaaaugcucuugcuuggc

SEQ ID NO: 59437 - RNA, 22 nt, Artificial Sequence
  Synthetic Oligonucleotide; CD80 exon 6; Set C
aggaaaaugcucuugcuuggcu

SEQ ID NO: 59438 - RNA, 19 nt, Artificial Sequence
  Synthetic Oligonucleotide; CD80 exon 6; Set C
ggaaaaugcucuugcuugg

SEQ ID NO: 59439 - RNA, 21 nt, Artificial Sequence
  Synthetic Oligonucleotide; CD80 exon 6; Set C
aggaaaaugcucuugcuuggc

SEQ ID NO: 59440 - RNA, 20 nt, Artificial Sequence
  Synthetic Oligonucleotide; CD80 exon 6; Set C
aggaaaaugcucuugcuugg

SEQ ID NO: 59441 - RNA, 21 nt, Artificial Sequence
  Synthetic Oligonucleotide; CD80 exon 6; Set C
caggaaaaugcucuugcuugg

SEQ ID NO: 59442 - RNA, 22 nt, Artificial Sequence
  Synthetic Oligonucleotide; CD80 exon 6; Set C
ucaggaaaaugcucuugcuugg

SEQ ID NO: 59443 - RNA, 23 nt, Artificial Sequence
  Synthetic Oligonucleotide; CD80 exon 6; Set C
aucaggaaaaugcucuugcuugg

SEQ ID NO: 59444 - RNA, 26 nt, Artificial Sequence
  Synthetic Oligonucleotide; CD80 exon 6; Set A
guuaucaggaaaaugcucuugcuugg

SEQ ID NO: 59445 - RNA, 27 nt, Artificial Sequence
  Synthetic Oligonucleotide; CD80 exon 6; Set A
gguuaucaggaaaaugcucuugcuugg

SEQ ID NO: 59446 - RNA, 19 nt, Artificial Sequence
  Synthetic Oligonucleotide; CD80 exon 6; Set C
uaucaggaaaaugcucuug

SEQ ID NO: 59447 - RNA, 20 nt, Artificial Sequence
  Synthetic Oligonucleotide; CD80 exon 6; Set C
uuaucaggaaaaugcucuug

SEQ ID NO: 59448 - RNA, 35 nt, Artificial Sequence
  Synthetic Oligonucleotide; CD80 exon 6; Set C
ugggagcagguuaucaggaaaaugcucuugcuugg

SEQ ID NO: 59449 - RNA, 36 nt, Artificial Sequence
  Synthetic Oligonucleotide; CD80 exon 6; Set C
augggagcagguuaucaggaaaaugcucuugcuugg

SEQ ID NO: 59450 - RNA, 37 nt, Artificial Sequence
  Synthetic Oligonucleotide; CD80 exon 6; Set C
gaugggagcagguuaucaggaaaaugcucuugcuugg

SEQ ID NO: 59451 - RNA, 38 nt, Artificial Sequence
  Synthetic Oligonucleotide; CD80 exon 6; Set C
ggaugggagcagguuaucaggaaaaugcucuugcuugg

SEQ ID NO: 59452 - RNA, 33 nt, Artificial Sequence
  Synthetic Oligonucleotide; CD80 exon 6; Set C
aggaugggagcagguuaucaggaaaaugcucuu

SEQ ID NO: 59453 - RNA, 32 nt, Artificial Sequence
  Synthetic Oligonucleotide; CD80 exon 6; Set C
aggaugggagcagguuaucaggaaaaugcucu

SEQ ID NO: 59454 - RNA, 40 nt, Artificial Sequence
  Synthetic Oligonucleotide; CD80 exon 6; Set C
auggcccaggaugggagcagguuaucaggaaaaugcucuu

SEQ ID NO: 59455 - RNA, 18 nt, Artificial Sequence
  Synthetic Oligonucleotide; CD80 exon 6; Set C
ugggagcagguuaucagg

SEQ ID NO: 59456 - RNA, 27 nt, Artificial Sequence
  Synthetic Oligonucleotide; CD80 exon 6; Set A
caggaugggagcagguuaucaggaaaa

SEQ ID NO: 59457 - RNA, 39 nt, Artificial Sequence
  Synthetic Oligonucleotide; CD80 exon 6; Set C
auggcccaggaugggagcagguuaucaggaaaaugcucu

SEQ ID NO: 59458 - RNA, 17 nt, Artificial Sequence
  Synthetic Oligonucleotide; CD80 exon 6; Set C
ugggagcagguuaucag

SEQ ID NO: 59459 - RNA, 40 nt, Artificial Sequence
  Synthetic Oligonucleotide; CD80 exon 6; Set C
aauggcccaggaugggagcagguuaucaggaaaaugcucu

SEQ ID NO: 59460 - RNA, 18 nt, Artificial Sequence
  Synthetic Oligonucleotide; CD80 exon 6; Set C
augggagcagguuaucag

SEQ ID NO: 59461 - RNA, 16 nt, Artificial Sequence
  Synthetic Oligonucleotide; CD80 exon 6; Set C
ugggagcagguuauca

SEQ ID NO: 59462 - RNA, 23 nt, Artificial Sequence
  Synthetic Oligonucleotide; CD80 exon 6; Set A
aggaugggagcagguuaucagga

SEQ ID NO: 59463 - RNA, 19 nt, Artificial Sequence
  Synthetic Oligonucleotide; CD80 exon 6; Set C
gaugggagcagguuaucag

SEQ ID NO: 59464 - RNA, 17 nt, Artificial Sequence
  Synthetic Oligonucleotide; CD80 exon 6; Set C
augggagcagguuauca

SEQ ID NO: 59465 - RNA, 22 nt, Artificial Sequence
  Synthetic Oligonucleotide; CD80 exon 6; Set A
aggaugggagcagguuaucagg

SEQ ID NO: 59466 - RNA, 16 nt, Artificial Sequence
  Synthetic Oligonucleotide; CD80 exon 6; Set C
augggagcagguuauc

SEQ ID NO: 59467 - RNA, 18 nt, Artificial Sequence
  Synthetic Oligonucleotide; CD80 exon 6; Set C
gaugggagcagguuauca

SEQ ID NO: 59468 - RNA, 20 nt, Artificial Sequence
  Synthetic Oligonucleotide; CD80 exon 6; Set A
ggaugggagcagguuaucag

SEQ ID NO: 59469 - RNA, 17 nt, Artificial Sequence
  Synthetic Oligonucleotide; CD80 exon 6; Set C
gaugggagcagguuauc

SEQ ID NO: 59470 - RNA, 19 nt, Artificial Sequence
  Synthetic Oligonucleotide; CD80 exon 6; Set A
ggaugggagcagguuauca

SEQ ID NO: 59471 - RNA, 34 nt, Artificial Sequence
  Synthetic Oligonucleotide; CD80 exon 6; Set C
auggcccaggaugggagcagguuaucaggaaaau

SEQ ID NO: 59472 - RNA, 18 nt, Artificial Sequence
  Synthetic Oligonucleotide; CD80 exon 6; Set C
ggaugggagcagguuauc

SEQ ID NO: 59473 - RNA, 33 nt, Artificial Sequence
  Synthetic Oligonucleotide; CD80 exon 6; Set C
auggcccaggaugggagcagguuaucaggaaaa

SEQ ID NO: 59474 - RNA, 35 nt, Artificial Sequence
  Synthetic Oligonucleotide; CD80 exon 6; Set C
aauggcccaggaugggagcagguuaucaggaaaau

SEQ ID NO: 59475 - RNA, 32 nt, Artificial Sequence
  Synthetic Oligonucleotide; CD80 exon 6; Set C
auggcccaggaugggagcagguuaucaggaaa

SEQ ID NO: 59476 - RNA, 36 nt, Artificial Sequence
  Synthetic Oligonucleotide; CD80 exon 6; Set C
uaauggcccaggaugggagcagguuaucaggaaaau

SEQ ID NO: 59477 - RNA, 31 nt, Artificial Sequence
  Synthetic Oligonucleotide; CD80 exon 6; Set C
auggcccaggaugggagcagguuaucaggaa

SEQ ID NO: 59478 - RNA, 32 nt, Artificial Sequence
  Synthetic Oligonucleotide; CD80 exon 6; Set C
aauggcccaggaugggagcagguuaucaggaa

SEQ ID NO: 59479 - RNA, 33 nt, Artificial Sequence
  Synthetic Oligonucleotide; CD80 exon 6; Set C
uaauggcccaggaugggagcagguuaucaggaa

SEQ ID NO: 59480 - RNA, 31 nt, Artificial Sequence
  Synthetic Oligonucleotide; CD80 exon 6; Set C
aauggcccaggaugggagcagguuaucagga

SEQ ID NO: 59481 - RNA, 32 nt, Artificial Sequence
  Synthetic Oligonucleotide; CD80 exon 6; Set C
uaauggcccaggaugggagcagguuaucagga

SEQ ID NO: 59482 - RNA, 30 nt, Artificial Sequence
  Synthetic Oligonucleotide; CD80 exon 6; Set C
aauggcccaggaugggagcagguuaucagg

SEQ ID NO: 59483 - RNA, 33 nt, Artificial Sequence
  Synthetic Oligonucleotide; CD80 exon 6; Set C
guaauggcccaggaugggagcagguuaucagga

SEQ ID NO: 59484 - RNA, 31 nt, Artificial Sequence
  Synthetic Oligonucleotide; CD80 exon 6; Set C
uaauggcccaggaugggagcagguuaucagg

SEQ ID NO: 59485 - RNA, 32 nt, Artificial Sequence
  Synthetic Oligonucleotide; CD80 exon 6; Set C
guaauggcccaggaugggagcagguuaucagg

SEQ ID NO: 59486 - RNA, 25 nt, Artificial Sequence
  Synthetic Oligonucleotide; CD80 exon 6; Set C
auggcccaggaugggagcagguuau

SEQ ID NO: 59487 - RNA, 31 nt, Artificial Sequence
  Synthetic Oligonucleotide; CD80 exon 6; Set C
guaauggcccaggaugggagcagguuaucag

SEQ ID NO: 59488 - RNA, 26 nt, Artificial Sequence
  Synthetic Oligonucleotide; CD80 exon 6; Set C
aauggcccaggaugggagcagguuau

SEQ ID NO: 59489 - RNA, 24 nt, Artificial Sequence
  Synthetic Oligonucleotide; CD80 exon 6; Set C
auggcccaggaugggagcagguua

SEQ ID NO: 59490 - RNA, 32 nt, Artificial Sequence
  Synthetic Oligonucleotide; CD80 exon 6; Set C
gguaauggcccaggaugggagcagguuaucag

SEQ ID NO: 59491 - RNA, 30 nt, Artificial Sequence
  Synthetic Oligonucleotide; CD80 exon 6; Set C
guaauggcccaggaugggagcagguuauca

SEQ ID NO: 59492 - RNA, 25 nt, Artificial Sequence
  Synthetic Oligonucleotide; CD80 exon 6; Set C
aauggcccaggaugggagcagguua

SEQ ID NO: 59493 - RNA, 27 nt, Artificial Sequence
  Synthetic Oligonucleotide; CD80 exon 6; Set C
uaauggcccaggaugggagcagguuau

SEQ ID NO: 59494 - RNA, 29 nt, Artificial Sequence
  Synthetic Oligonucleotide; CD80 exon 6; Set C
guaauggcccaggaugggagcagguuauc

SEQ ID NO: 59495 - RNA, 31 nt, Artificial Sequence
  Synthetic Oligonucleotide; CD80 exon 6; Set C
gguaauggcccaggaugggagcagguuauca

SEQ ID NO: 59496 - RNA, 33 nt, Artificial Sequence
  Synthetic Oligonucleotide; CD80 exon 6; Set C
agguaauggcccaggaugggagcagguuaucag

SEQ ID NO: 59497 - RNA, 26 nt, Artificial Sequence
  Synthetic Oligonucleotide; CD80 exon 6; Set C
uaauggcccaggaugggagcagguua

SEQ ID NO: 59498 - RNA, 30 nt, Artificial Sequence
  Synthetic Oligonucleotide; CD80 exon 6; Set C
gguaauggcccaggaugggagcagguuauc

SEQ ID NO: 59499 - RNA, 32 nt, Artificial Sequence
  Synthetic Oligonucleotide; CD80 exon 6; Set C
agguaauggcccaggaugggagcagguuauca

SEQ ID NO: 59500 - RNA, 39 nt, Artificial Sequence
  Synthetic Oligonucleotide; CD80 exon 6; Set C
auuaagguaauggcccaggaugggagcagguuaucagga

SEQ ID NO: 59501 - RNA, 31 nt, Artificial Sequence
  Synthetic Oligonucleotide; CD80 exon 6; Set C
agguaauggcccaggaugggagcagguuauc

SEQ ID NO: 59502 - RNA, 35 nt, Artificial Sequence
  Synthetic Oligonucleotide; CD80 exon 6; Set C
uaagguaauggcccaggaugggagcagguuaucag

SEQ ID NO: 59503 - RNA, 40 nt, Artificial Sequence
  Synthetic Oligonucleotide; CD80 exon 6; Set C
gauuaagguaauggcccaggaugggagcagguuaucagga

SEQ ID NO: 59504 - RNA, 38 nt, Artificial Sequence
  Synthetic Oligonucleotide; CD80 exon 6; Set C
auuaagguaauggcccaggaugggagcagguuaucagg

SEQ ID NO: 59505 - RNA, 36 nt, Artificial Sequence
  Synthetic Oligonucleotide; CD80 exon 6; Set C
uuaagguaauggcccaggaugggagcagguuaucag

SEQ ID NO: 59506 - RNA, 34 nt, Artificial Sequence
  Synthetic Oligonucleotide; CD80 exon 6; Set C
uaagguaauggcccaggaugggagcagguuauca

SEQ ID NO: 59507 - RNA, 39 nt, Artificial Sequence
  Synthetic Oligonucleotide; CD80 exon 6; Set C
gauuaagguaauggcccaggaugggagcagguuaucagg

SEQ ID NO: 59508 - RNA, 27 nt, Artificial Sequence
  Synthetic Oligonucleotide; CD80 exon 6; Set C
gguaauggcccaggaugggagcagguu

SEQ ID NO: 59509 - RNA, 33 nt, Artificial Sequence
  Synthetic Oligonucleotide; CD80 exon 6; Set C
uaagguaauggcccaggaugggagcagguuauc

SEQ ID NO: 59510 - RNA, 35 nt, Artificial Sequence
  Synthetic Oligonucleotide; CD80 exon 6; Set C
uuaagguaauggcccaggaugggagcagguuauca

SEQ ID NO: 59511 - RNA, 40 nt, Artificial Sequence
  Synthetic Oligonucleotide; CD80 exon 6; Set C
agauuaagguaauggcccaggaugggagcagguuaucagg

SEQ ID NO: 59512 - RNA, 28 nt, Artificial Sequence
  Synthetic Oligonucleotide; CD80 exon 6; Set C
agguaauggcccaggaugggagcagguu

SEQ ID NO: 59513 - RNA, 26 nt, Artificial Sequence
  Synthetic Oligonucleotide; CD80 exon 6; Set C
gguaauggcccaggaugggagcaggu

SEQ ID NO: 59514 - RNA, 34 nt, Artificial Sequence
  Synthetic Oligonucleotide; CD80 exon 6; Set C
uuaagguaauggcccaggaugggagcagguuauc

SEQ ID NO: 59515 - RNA, 27 nt, Artificial Sequence
  Synthetic Oligonucleotide; CD80 exon 6; Set C
agguaauggcccaggaugggagcaggu

SEQ ID NO: 59516 - RNA, 30 nt, Artificial Sequence
  Synthetic Oligonucleotide; CD80 exon 6; Set C
uaagguaauggcccaggaugggagcagguu

SEQ ID NO: 59517 - RNA, 31 nt, Artificial Sequence
  Synthetic Oligonucleotide; CD80 exon 6; Set C
uuaagguaauggcccaggaugggagcagguu

SEQ ID NO: 59518 - RNA, 29 nt, Artificial Sequence
  Synthetic Oligonucleotide; CD80 exon 6; Set C
uaagguaauggcccaggaugggagcaggu

SEQ ID NO: 59519 - RNA, 36 nt, Artificial Sequence
  Synthetic Oligonucleotide; CD80 exon 6; Set C
agauuaagguaauggcccaggaugggagcagguuau

SEQ ID NO: 59520 - RNA, 30 nt, Artificial Sequence
  Synthetic Oligonucleotide; CD80 exon 6; Set C
uuaagguaauggcccaggaugggagcaggu

SEQ ID NO: 59521 - RNA, 35 nt, Artificial Sequence
  Synthetic Oligonucleotide; CD80 exon 6; Set C
agauuaagguaauggcccaggaugggagcagguua

SEQ ID NO: 59522 - RNA, 15 nt, Artificial Sequence
  Synthetic Oligonucleotide; CD80 exon 6; Set C
aauggcccaggaugg

SEQ ID NO: 59523 - RNA, 16 nt, Artificial Sequence
  Synthetic Oligonucleotide; CD80 exon 6; Set C
uaauggcccaggaugg

SEQ ID NO: 59524 - RNA, 15 nt, Artificial Sequence
  Synthetic Oligonucleotide; CD80 exon 6; Set C
uaauggcccaggaug

SEQ ID NO: 59525 - RNA, 38 nt, Artificial Sequence
  Synthetic Oligonucleotide; CD80 exon 6; Set C
uacugagauuaagguaauggcccaggaugggagcaggu

SEQ ID NO: 59526 - RNA, 23 nt, Artificial Sequence
  Synthetic Oligonucleotide; CD80 exon 6; Set A
auuaagguaauggcccaggaugg

SEQ ID NO: 59527 - RNA, 15 nt, Artificial Sequence
  Synthetic Oligonucleotide; CD80 exon 6; Set C
agguaauggcccagg

SEQ ID NO: 59528 - RNA, 24 nt, Artificial Sequence
  Synthetic Oligonucleotide; CD80 exon 6; Set A
gauuaagguaauggcccaggaugg

SEQ ID NO: 59529 - RNA, 25 nt, Artificial Sequence
  Synthetic Oligonucleotide; CD80 exon 6; Set A
agauuaagguaauggcccaggaugg

SEQ ID NO: 59530 - RNA, 15 nt, Artificial Sequence
  Synthetic Oligonucleotide; CD80 exon 6; Set C
aagguaauggcccag

SEQ ID NO: 59531 - RNA, 24 nt, Artificial Sequence
  Synthetic Oligonucleotide; CD80 exon 6; Set A
agauuaagguaauggcccaggaug

SEQ ID NO: 59532 - RNA, 20 nt, Artificial Sequence
  Synthetic Oligonucleotide; CD80 exon 6; Set C
auuaagguaauggcccagga

SEQ ID NO: 59533 - RNA, 23 nt, Artificial Sequence
  Synthetic Oligonucleotide; CD80 exon 6; Set C
agauuaagguaauggcccaggau

SEQ ID NO: 59534 - RNA, 21 nt, Artificial Sequence
  Synthetic Oligonucleotide; CD80 exon 6; Set C
gauuaagguaauggcccagga

SEQ ID NO: 59535 - RNA, 19 nt, Artificial Sequence
  Synthetic Oligonucleotide; CD80 exon 6; Set C
auuaagguaauggcccagg

SEQ ID NO: 59536 - RNA, 22 nt, Artificial Sequence
  Synthetic Oligonucleotide; CD80 exon 6; Set C
agauuaagguaauggcccagga

SEQ ID NO: 59537 - RNA, 20 nt, Artificial Sequence
  Synthetic Oligonucleotide; CD80 exon 6; Set C
gauuaagguaauggcccagg

SEQ ID NO: 59538 - RNA, 26 nt, Artificial Sequence
  Synthetic Oligonucleotide; CD80 exon 6; Set A
uuacugagauuaagguaauggcccag

SEQ ID NO: 59539 - RNA, 27 nt, Artificial Sequence
  Synthetic Oligonucleotide; CD80 exon 6; Set A
uuuacugagauuaagguaauggcccag

SEQ ID NO: 59540 - RNA, 20 nt, Artificial Sequence
  Synthetic Oligonucleotide; CD80 exon 6; Set C
uacugagauuaagguaaugg

SEQ ID NO: 59541 - RNA, 21 nt, Artificial Sequence
  Synthetic Oligonucleotide; CD80 exon 6; Set C
uuacugagauuaagguaaugg

SEQ ID NO: 59542 - RNA, 22 nt, Artificial Sequence
  Synthetic Oligonucleotide; CD80 exon 6; Set C
uuuacugagauuaagguaaugg

SEQ ID NO: 59543 - RNA, 34 nt, Artificial Sequence
  Synthetic Oligonucleotide; CD80 exon 6; Set A
aauuccauuuacugagauuaagguaauggcccag

SEQ ID NO: 59544 - RNA, 35 nt, Artificial Sequence
  Synthetic Oligonucleotide; CD80 exon 6; Set A
aaauuccauuuacugagauuaagguaauggcccag

SEQ ID NO: 59545 - RNA, 36 nt, Artificial Sequence
  Synthetic Oligonucleotide; CD80 exon 6; Set A
aaaauuccauuuacugagauuaagguaauggcccag

SEQ ID NO: 59546 - RNA, 37 nt, Artificial Sequence
  Synthetic Oligonucleotide; CD80 exon 6; Set A
aaaaauuccauuuacugagauuaagguaauggcccag

SEQ ID NO: 59547 - RNA, 27 nt, Artificial Sequence
  Synthetic Oligonucleotide; CD80 exon 6; Set C
uuccauuuacugagauuaagguaaugg

SEQ ID NO: 59548 - RNA, 28 nt, Artificial Sequence
  Synthetic Oligonucleotide; CD80 exon 6; Set C
auuccauuuacugagauuaagguaaugg

SEQ ID NO: 59549 - RNA, 29 nt, Artificial Sequence
  Synthetic Oligonucleotide; CD80 exon 6; Set C
aauuccauuuacugagauuaagguaaugg

SEQ ID NO: 59550 - RNA, 16 nt, Artificial Sequence
  Synthetic Oligonucleotide; CD80 exon 6; Set C
auuuacugagauuaag

SEQ ID NO: 59551 - RNA, 30 nt, Artificial Sequence
  Synthetic Oligonucleotide; CD80 exon 6; Set C
aaauuccauuuacugagauuaagguaaugg

SEQ ID NO: 59552 - RNA, 31 nt, Artificial Sequence
  Synthetic Oligonucleotide; CD80 exon 6; Set C
aaaauuccauuuacugagauuaagguaaugg

SEQ ID NO: 59553 - RNA, 32 nt, Artificial Sequence
  Synthetic Oligonucleotide; CD80 exon 6; Set C
aaaaauuccauuuacugagauuaagguaaugg

SEQ ID NO: 59554 - RNA, 37 nt, Artificial Sequence
  Synthetic Oligonucleotide; CD80 exon 6; Set C
uaucacaaaaauuccauuuacugagauuaagguaaug

SEQ ID NO: 59555 - RNA, 15 nt, Artificial Sequence
  Synthetic Oligonucleotide; CD80 exon 6; Set C
uuccauuuacugaga

SEQ ID NO: 59556 - RNA, 36 nt, Artificial Sequence
  Synthetic Oligonucleotide; CD80 exon 6; Set C
uaucacaaaaauuccauuuacugagauuaagguaau

SEQ ID NO: 59557 - RNA, 38 nt, Artificial Sequence
  Synthetic Oligonucleotide; CD80 exon 6; Set C
auaucacaaaaauuccauuuacugagauuaagguaaug

SEQ ID NO: 59558 - RNA, 16 nt, Artificial Sequence
  Synthetic Oligonucleotide; CD80 exon 6; Set C
auuccauuuacugaga

SEQ ID NO: 59559 - RNA, 35 nt, Artificial Sequence
  Synthetic Oligonucleotide; CD80 exon 6; Set C
uaucacaaaaauuccauuuacugagauuaagguaa

SEQ ID NO: 59560 - RNA, 17 nt, Artificial Sequence
  Synthetic Oligonucleotide; CD80 exon 6; Set C
aauuccauuuacugaga

SEQ ID NO: 59561 - RNA, 34 nt, Artificial Sequence
  Synthetic Oligonucleotide; CD80 exon 6; Set C
uaucacaaaaauuccauuuacugagauuaaggua

SEQ ID NO: 59562 - RNA, 38 nt, Artificial Sequence
  Synthetic Oligonucleotide; CD80 exon 6; Set C
cauaucacaaaaauuccauuuacugagauuaagguaau

SEQ ID NO: 59563 - RNA, 18 nt, Artificial Sequence
  Synthetic Oligonucleotide; CD80 exon 6; Set C
aaauuccauuuacugaga

SEQ ID NO: 59564 - RNA, 39 nt, Artificial Sequence
  Synthetic Oligonucleotide; CD80 exon 6; Set A
gcauaucacaaaaauuccauuuacugagauuaagguaau

SEQ ID NO: 59565 - RNA, 37 nt, Artificial Sequence
  Synthetic Oligonucleotide; CD80 exon 6; Set C
cauaucacaaaaauuccauuuacugagauuaagguaa

SEQ ID NO: 59566 - RNA, 36 nt, Artificial Sequence
  Synthetic Oligonucleotide; CD80 exon 6; Set A
cauaucacaaaaauuccauuuacugagauuaaggua

SEQ ID NO: 59567 - RNA, 38 nt, Artificial Sequence
  Synthetic Oligonucleotide; CD80 exon 6; Set A
gcauaucacaaaaauuccauuuacugagauuaagguaa

SEQ ID NO: 59568 - RNA, 37 nt, Artificial Sequence
  Synthetic Oligonucleotide; CD80 exon 6; Set A
gcauaucacaaaaauuccauuuacugagauuaaggua

SEQ ID NO: 59569 - RNA, 34 nt, Artificial Sequence
  Synthetic Oligonucleotide; CD80 exon 6; Set C
cauaucacaaaaauuccauuuacugagauuaagg

SEQ ID NO: 59570 - RNA, 35 nt, Artificial Sequence
  Synthetic Oligonucleotide; CD80 exon 6; Set A
gcauaucacaaaaauuccauuuacugagauuaagg

SEQ ID NO: 59571 - RNA, 28 nt, Artificial Sequence
  Synthetic Oligonucleotide; CD80 exon 6; Set C
uaucacaaaaauuccauuuacugagauu

SEQ ID NO: 59572 - RNA, 27 nt, Artificial Sequence
  Synthetic Oligonucleotide; CD80 exon 6; Set C
uaucacaaaaauuccauuuacugagau

SEQ ID NO: 59573 - RNA, 29 nt, Artificial Sequence
  Synthetic Oligonucleotide; CD80 exon 6; Set C
auaucacaaaaauuccauuuacugagauu

SEQ ID NO: 59574 - RNA, 40 nt, Artificial Sequence
  Synthetic Oligonucleotide; CD80 exon 6; Set A
ggcagcauaucacaaaaauuccauuuacugagauuaaggu

SEQ ID NO: 59575 - RNA, 28 nt, Artificial Sequence
  Synthetic Oligonucleotide; CD80 exon 6; Set C
auaucacaaaaauuccauuuacugagau

SEQ ID NO: 59576 - RNA, 39 nt, Artificial Sequence
  Synthetic Oligonucleotide; CD80 exon 6; Set A
ggcagcauaucacaaaaauuccauuuacugagauuaagg

SEQ ID NO: 59577 - RNA, 27 nt, Artificial Sequence
  Synthetic Oligonucleotide; CD80 exon 6; Set C
auaucacaaaaauuccauuuacugaga

SEQ ID NO: 59578 - RNA, 37 nt, Artificial Sequence
  Synthetic Oligonucleotide; CD80 exon 6; Set A
ggcagcauaucacaaaaauuccauuuacugagauuaa

SEQ ID NO: 59579 - RNA, 36 nt, Artificial Sequence
  Synthetic Oligonucleotide; CD80 exon 6; Set A
ggcagcauaucacaaaaauuccauuuacugagauua

SEQ ID NO: 59580 - RNA, 36 nt, Artificial Sequence
  Synthetic Oligonucleotide; CD80 exon 6; Set A
aggcagcauaucacaaaaauuccauuuacugagauu

SEQ ID NO: 59581 - RNA, 35 nt, Artificial Sequence
  Synthetic Oligonucleotide; CD80 exon 6; Set A
aggcagcauaucacaaaaauuccauuuacugagau

SEQ ID NO: 59582 - RNA, 37 nt, Artificial Sequence
  Synthetic Oligonucleotide; CD80 exon 6; Set A
caggcagcauaucacaaaaauuccauuuacugagauu

SEQ ID NO: 59583 - RNA, 36 nt, Artificial Sequence
  Synthetic Oligonucleotide; CD80 exon 6; Set A
caggcagcauaucacaaaaauuccauuuacugagau

SEQ ID NO: 59584 - RNA, 38 nt, Artificial Sequence
  Synthetic Oligonucleotide; CD80 exon 6; Set A
ucaggcagcauaucacaaaaauuccauuuacugagauu

SEQ ID NO: 59585 - RNA, 34 nt, Artificial Sequence
  Synthetic Oligonucleotide; CD80 exon 6; Set A
aggcagcauaucacaaaaauuccauuuacugaga

SEQ ID NO: 59586 - RNA, 37 nt, Artificial Sequence
  Synthetic Oligonucleotide; CD80 exon 6; Set A
ucaggcagcauaucacaaaaauuccauuuacugagau

SEQ ID NO: 59587 - RNA, 39 nt, Artificial Sequence
  Synthetic Oligonucleotide; CD80 exon 6; Set A
gucaggcagcauaucacaaaaauuccauuuacugagauu

SEQ ID NO: 59588 - RNA, 35 nt, Artificial Sequence
  Synthetic Oligonucleotide; CD80 exon 6; Set A
caggcagcauaucacaaaaauuccauuuacugaga

SEQ ID NO: 59589 - RNA, 38 nt, Artificial Sequence
  Synthetic Oligonucleotide; CD80 exon 6; Set A
gucaggcagcauaucacaaaaauuccauuuacugagau

SEQ ID NO: 59590 - RNA, 40 nt, Artificial Sequence
  Synthetic Oligonucleotide; CD80 exon 6; Set C
ggucaggcagcauaucacaaaaauuccauuuacugagauu

SEQ ID NO: 59591 - RNA, 36 nt, Artificial Sequence
  Synthetic Oligonucleotide; CD80 exon 6; Set A
ucaggcagcauaucacaaaaauuccauuuacugaga

SEQ ID NO: 59592 - RNA, 39 nt, Artificial Sequence
  Synthetic Oligonucleotide; CD80 exon 6; Set C
ggucaggcagcauaucacaaaaauuccauuuacugagau

SEQ ID NO: 59593 - RNA, 40 nt, Artificial Sequence
  Synthetic Oligonucleotide; CD80 exon 6; Set C
aggucaggcagcauaucacaaaaauuccauuuacugagau

SEQ ID NO: 59594 - RNA, 21 nt, Artificial Sequence
  Synthetic Oligonucleotide; CD80 exon 6; Set A
acaguaggucaggcagcauau

SEQ ID NO: 59595 - RNA, 22 nt, Artificial Sequence
  Synthetic Oligonucleotide; CD80 exon 6; Set A
uacaguaggucaggcagcauau

SEQ ID NO: 59596 - RNA, 18 nt, Artificial Sequence
  Synthetic Oligonucleotide; CD80 exon 6; Set C
caguaggucaggcagcau

SEQ ID NO: 59597 - RNA, 23 nt, Artificial Sequence
  Synthetic Oligonucleotide; CD80 exon 6; Set A
uuacaguaggucaggcagcauau

SEQ ID NO: 59598 - RNA, 19 nt, Artificial Sequence
  Synthetic Oligonucleotide; CD80 exon 6; Set A
acaguaggucaggcagcau

SEQ ID NO: 59599 - RNA, 17 nt, Artificial Sequence
  Synthetic Oligonucleotide; CD80 exon 6; Set C
caguaggucaggcagca

SEQ ID NO: 59600 - RNA, 24 nt, Artificial Sequence
  Synthetic Oligonucleotide; CD80 exon 6; Set A
cuuacaguaggucaggcagcauau

SEQ ID NO: 59601 - RNA, 20 nt, Artificial Sequence
  Synthetic Oligonucleotide; CD80 exon 6; Set A
uacaguaggucaggcagcau

SEQ ID NO: 59602 - RNA, 18 nt, Artificial Sequence
  Synthetic Oligonucleotide; CD80 exon 6; Set B
acaguaggucaggcagca

SEQ ID NO: 59603 - RNA, 23 nt, Artificial Sequence
  Synthetic Oligonucleotide; CD80 exon 6; Set A
cuuacaguaggucaggcagcaua

SEQ ID NO: 59604 - RNA, 25 nt, Artificial Sequence
  Synthetic Oligonucleotide; CD80 exon 6; Set A
acuuacaguaggucaggcagcauau

SEQ ID NO: 59605 - RNA, 21 nt, Artificial Sequence
  Synthetic Oligonucleotide; CD80 exon 6; Set A
uuacaguaggucaggcagcau

SEQ ID NO: 59606 - RNA, 19 nt, Artificial Sequence
  Synthetic Oligonucleotide; CD80 exon 6; Set B
uacaguaggucaggcagca

SEQ ID NO: 59607 - RNA, 24 nt, Artificial Sequence
  Synthetic Oligonucleotide; CD80 exon 6; Set A
acuuacaguaggucaggcagcaua

SEQ ID NO: 59608 - RNA, 26 nt, Artificial Sequence
  Synthetic Oligonucleotide; CD80 exon 6; Set A
uacuuacaguaggucaggcagcauau

SEQ ID NO: 59609 - RNA, 22 nt, Artificial Sequence
  Synthetic Oligonucleotide; CD80 exon 6; Set A
cuuacaguaggucaggcagcau

SEQ ID NO: 59610 - RNA, 20 nt, Artificial Sequence
  Synthetic Oligonucleotide; CD80 exon 6; Set B
uuacaguaggucaggcagca

SEQ ID NO: 59611 - RNA, 23 nt, Artificial Sequence
  Synthetic Oligonucleotide; CD80 exon 6; Set A
acuuacaguaggucaggcagcau

SEQ ID NO: 59612 - RNA, 21 nt, Artificial Sequence
  Synthetic Oligonucleotide; CD80 exon 6; Set B
cuuacaguaggucaggcagca

SEQ ID NO: 59613 - RNA, 24 nt, Artificial Sequence
  Synthetic Oligonucleotide; CD80 exon 6; Set A
uacuuacaguaggucaggcagcau

SEQ ID NO: 59614 - RNA, 22 nt, Artificial Sequence
  Synthetic Oligonucleotide; CD80 exon 6; Set B
acuuacaguaggucaggcagca

SEQ ID NO: 59615 - RNA, 25 nt, Artificial Sequence
  Synthetic Oligonucleotide; CD80 exon 6; Set A
guacuuacaguaggucaggcagcau

SEQ ID NO: 59616 - RNA, 23 nt, Artificial Sequence
  Synthetic Oligonucleotide; CD80 exon 6; Set B
uacuuacaguaggucaggcagca

SEQ ID NO: 59617 - RNA, 15 nt, Artificial Sequence
  Synthetic Oligonucleotide; CD80 exon 6; Set C
uacaguaggucaggc

SEQ ID NO: 59618 - RNA, 26 nt, Artificial Sequence
  Synthetic Oligonucleotide; CD80 exon 6; Set A
aguacuuacaguaggucaggcagcau

SEQ ID NO: 59619 - RNA, 24 nt, Artificial Sequence
  Synthetic Oligonucleotide; CD80 exon 6; Set B
guacuuacaguaggucaggcagca

SEQ ID NO: 59620 - RNA, 16 nt, Artificial Sequence
  Synthetic Oligonucleotide; CD80 exon 6; Set C
uuacaguaggucaggc

SEQ ID NO: 59621 - RNA, 25 nt, Artificial Sequence
  Synthetic Oligonucleotide; CD80 exon 6; Set B
aguacuuacaguaggucaggcagca

SEQ ID NO: 59622 - RNA, 17 nt, Artificial Sequence
  Synthetic Oligonucleotide; CD80 exon 6; Set C
cuuacaguaggucaggc

SEQ ID NO: 59623 - RNA, 16 nt, Artificial Sequence
  Synthetic Oligonucleotide; CD80 exon 6; Set C
cuuacaguaggucagg

SEQ ID NO: 59624 - RNA, 18 nt, Artificial Sequence
  Synthetic Oligonucleotide; CD80 exon 6; Set C
acuuacaguaggucaggc

SEQ ID NO: 59625 - RNA, 17 nt, Artificial Sequence
  Synthetic Oligonucleotide; CD80 exon 6; Set C
acuuacaguaggucagg

SEQ ID NO: 59626 - RNA, 15 nt, Artificial Sequence
  Synthetic Oligonucleotide; CD80 exon 6; Set C
cuuacaguaggucag

SEQ ID NO: 59627 - RNA, 19 nt, Artificial Sequence
  Synthetic Oligonucleotide; CD80 exon 6; Set C
uacuuacaguaggucaggc

SEQ ID NO: 59628 - RNA, 16 nt, Artificial Sequence
  Synthetic Oligonucleotide; CD80 exon 6; Set C
acuuacaguaggucag

SEQ ID NO: 59629 - RNA, 20 nt, Artificial Sequence
  Synthetic Oligonucleotide; CD80 exon 6; Set C
guacuuacaguaggucaggc

SEQ ID NO: 59630 - RNA, 21 nt, Artificial Sequence
  Synthetic Oligonucleotide; CD80 exon 6; Set C
aguacuuacaguaggucaggc

SEQ ID NO: 59631 - RNA, 37 nt, Artificial Sequence
  Synthetic Oligonucleotide; CD80 exon 6; Set C
ugguaugauaguacuuacaguaggucaggcagcauau

SEQ ID NO: 59632 - RNA, 38 nt, Artificial Sequence
  Synthetic Oligonucleotide; CD80 exon 6; Set C
augguaugauaguacuuacaguaggucaggcagcauau

SEQ ID NO: 59633 - RNA, 35 nt, Artificial Sequence
  Synthetic Oligonucleotide; CD80 exon 6; Set C
ugguaugauaguacuuacaguaggucaggcagcau

SEQ ID NO: 59634 - RNA, 38 nt, Artificial Sequence
  Synthetic Oligonucleotide; CD80 exon 6; Set C
gaugguaugauaguacuuacaguaggucaggcagcaua

SEQ ID NO: 59635 - RNA, 36 nt, Artificial Sequence
  Synthetic Oligonucleotide; CD80 exon 6; Set C
augguaugauaguacuuacaguaggucaggcagcau

SEQ ID NO: 59636 - RNA, 34 nt, Artificial Sequence
  Synthetic Oligonucleotide; CD80 exon 6; Set C
ugguaugauaguacuuacaguaggucaggcagca

SEQ ID NO: 59637 - RNA, 39 nt, Artificial Sequence
  Synthetic Oligonucleotide; CD80 exon 6; Set C
ugaugguaugauaguacuuacaguaggucaggcagcaua

SEQ ID NO: 59638 - RNA, 35 nt, Artificial Sequence
  Synthetic Oligonucleotide; CD80 exon 6; Set C
augguaugauaguacuuacaguaggucaggcagca

SEQ ID NO: 59639 - RNA, 40 nt, Artificial Sequence
  Synthetic Oligonucleotide; CD80 exon 6; Set C
augaugguaugauaguacuuacaguaggucaggcagcaua

SEQ ID NO: 59640 - RNA, 30 nt, Artificial Sequence
  Synthetic Oligonucleotide; CD80 exon 6; Set B
ugguaugauaguacuuacaguaggucaggc

SEQ ID NO: 59641 - RNA, 31 nt, Artificial Sequence
  Synthetic Oligonucleotide; CD80 exon 6; Set B
augguaugauaguacuuacaguaggucaggc

SEQ ID NO: 59642 - RNA, 31 nt, Artificial Sequence
  Synthetic Oligonucleotide; CD80 exon 6; Set B
gaugguaugauaguacuuacaguaggucagg

SEQ ID NO: 59643 - RNA, 32 nt, Artificial Sequence
  Synthetic Oligonucleotide; CD80 exon 6; Set B
ugaugguaugauaguacuuacaguaggucagg

SEQ ID NO: 59644 - RNA, 30 nt, Artificial Sequence
  Synthetic Oligonucleotide; CD80 exon 6; Set B
gaugguaugauaguacuuacaguaggucag

SEQ ID NO: 59645 - RNA, 26 nt, Artificial Sequence
  Synthetic Oligonucleotide; CD80 exon 6; Set B
ugguaugauaguacuuacaguagguc

SEQ ID NO: 59646 - RNA, 29 nt, Artificial Sequence
  Synthetic Oligonucleotide; CD80 exon 6; Set B
gaugguaugauaguacuuacaguagguca

SEQ ID NO: 59647 - RNA, 33 nt, Artificial Sequence
  Synthetic Oligonucleotide; CD80 exon 6; Set B
augaugguaugauaguacuuacaguaggucagg

SEQ ID NO: 59648 - RNA, 31 nt, Artificial Sequence
  Synthetic Oligonucleotide; CD80 exon 6; Set B
ugaugguaugauaguacuuacaguaggucag

SEQ ID NO: 59649 - RNA, 25 nt, Artificial Sequence
  Synthetic Oligonucleotide; CD80 exon 6; Set B
ugguaugauaguacuuacaguaggu

SEQ ID NO: 59650 - RNA, 30 nt, Artificial Sequence
  Synthetic Oligonucleotide; CD80 exon 6; Set B
ugaugguaugauaguacuuacaguagguca

SEQ ID NO: 59651 - RNA, 32 nt, Artificial Sequence
  Synthetic Oligonucleotide; CD80 exon 6; Set B
augaugguaugauaguacuuacaguaggucag

SEQ ID NO: 59652 - RNA, 24 nt, Artificial Sequence
  Synthetic Oligonucleotide; CD80 exon 6; Set C
ugguaugauaguacuuacaguagg

SEQ ID NO: 59653 - RNA, 31 nt, Artificial Sequence
  Synthetic Oligonucleotide; CD80 exon 6; Set B
augaugguaugauaguacuuacaguagguca

SEQ ID NO: 59654 - RNA, 25 nt, Artificial Sequence
  Synthetic Oligonucleotide; CD80 exon 6; Set C
augguaugauaguacuuacaguagg

SEQ ID NO: 59655 - RNA, 23 nt, Artificial Sequence
  Synthetic Oligonucleotide; CD80 exon 6; Set C
ugguaugauaguacuuacaguag

SEQ ID NO: 59656 - RNA, 30 nt, Artificial Sequence
  Synthetic Oligonucleotide; CD80 exon 6; Set B
augaugguaugauaguacuuacaguagguc

SEQ ID NO: 59657 - RNA, 29 nt, Artificial Sequence
  Synthetic Oligonucleotide; CD80 exon 6; Set B
augaugguaugauaguacuuacaguaggu

SEQ ID NO: 59658 - RNA, 24 nt, Artificial Sequence
  Synthetic Oligonucleotide; CD80 exon 6; Set C
gaugguaugauaguacuuacagua

SEQ ID NO: 59659 - RNA, 28 nt, Artificial Sequence
  Synthetic Oligonucleotide; CD80 exon 6; Set B
augaugguaugauaguacuuacaguagg

SEQ ID NO: 59660 - RNA, 20 nt, Artificial Sequence
  Synthetic Oligonucleotide; CD80 exon 6; Set C
ugguaugauaguacuuacag

SEQ ID NO: 59661 - RNA, 23 nt, Artificial Sequence
  Synthetic Oligonucleotide; CD80 exon 6; Set C
gaugguaugauaguacuuacagu

SEQ ID NO: 59662 - RNA, 25 nt, Artificial Sequence
  Synthetic Oligonucleotide; CD80 exon 6; Set C
ugaugguaugauaguacuuacagua

SEQ ID NO: 59663 - RNA, 27 nt, Artificial Sequence
  Synthetic Oligonucleotide; CD80 exon 6; Set C
augaugguaugauaguacuuacaguag

SEQ ID NO: 59664 - RNA, 21 nt, Artificial Sequence
  Synthetic Oligonucleotide; CD80 exon 6; Set C
augguaugauaguacuuacag

SEQ ID NO: 59665 - RNA, 19 nt, Artificial Sequence
  Synthetic Oligonucleotide; CD80 exon 6; Set C
ugguaugauaguacuuaca

SEQ ID NO: 59666 - RNA, 24 nt, Artificial Sequence
  Synthetic Oligonucleotide; CD80 exon 6; Set C
ugaugguaugauaguacuuacagu

SEQ ID NO: 59667 - RNA, 26 nt, Artificial Sequence
  Synthetic Oligonucleotide; CD80 exon 6; Set C
augaugguaugauaguacuuacagua

SEQ ID NO: 59668 - RNA, 20 nt, Artificial Sequence
  Synthetic Oligonucleotide; CD80 exon 6; Set C
augguaugauaguacuuaca

SEQ ID NO: 59669 - RNA, 18 nt, Artificial Sequence
  Synthetic Oligonucleotide; CD80 exon 6; Set C
ugguaugauaguacuuac

SEQ ID NO: 59670 - RNA, 25 nt, Artificial Sequence
  Synthetic Oligonucleotide; CD80 exon 6; Set C
augaugguaugauaguacuuacagu

SEQ ID NO: 59671 - RNA, 19 nt, Artificial Sequence
  Synthetic Oligonucleotide; CD80 exon 6; Set C
augguaugauaguacuuac

SEQ ID NO: 59672 - RNA, 17 nt, Artificial Sequence
  Synthetic Oligonucleotide; CD80 exon 6; Set C
ugguaugauaguacuua

SEQ ID NO: 59673 - RNA, 15 nt, Artificial Sequence
  Synthetic Oligonucleotide; CD80 exon 6; Set C
gguaugauaguacuu

SEQ ID NO: 59674 - RNA, 18 nt, Artificial Sequence
  Synthetic Oligonucleotide; CD80 exon 6; Set C
augguaugauaguacuua

SEQ ID NO: 59675 - RNA, 15 nt, Artificial Sequence
  Synthetic Oligonucleotide; CD80 exon 6; Set C
augguaugauaguac

SEQ ID NO: 59676 - RNA, 15 nt, Artificial Sequence
  Synthetic Oligonucleotide; CD80 exon 6; Set C
augaugguaugauag

SEQ ID NO: 59677 - RNA, 31 nt, Artificial Sequence
  Synthetic Oligonucleotide; CD80 exon 6; Set B
agaucaggaugaugguaugauaguacuuaca

SEQ ID NO: 59678 - RNA, 32 nt, Artificial Sequence
  Synthetic Oligonucleotide; CD80 exon 6; Set B
gagaucaggaugaugguaugauaguacuuaca

SEQ ID NO: 59679 - RNA, 30 nt, Artificial Sequence
  Synthetic Oligonucleotide; CD80 exon 6; Set B
agaucaggaugaugguaugauaguacuuac

SEQ ID NO: 59680 - RNA, 31 nt, Artificial Sequence
  Synthetic Oligonucleotide; CD80 exon 6; Set B
gagaucaggaugaugguaugauaguacuuac

SEQ ID NO: 59681 - RNA, 29 nt, Artificial Sequence
  Synthetic Oligonucleotide; CD80 exon 6; Set B
agaucaggaugaugguaugauaguacuua

SEQ ID NO: 59682 - RNA, 32 nt, Artificial Sequence
  Synthetic Oligonucleotide; CD80 exon 6; Set B
ugagaucaggaugaugguaugauaguacuuac

SEQ ID NO: 59683 - RNA, 30 nt, Artificial Sequence
  Synthetic Oligonucleotide; CD80 exon 6; Set B
gagaucaggaugaugguaugauaguacuua

SEQ ID NO: 59684 - RNA, 28 nt, Artificial Sequence
  Synthetic Oligonucleotide; CD80 exon 6; Set B
agaucaggaugaugguaugauaguacuu

SEQ ID NO: 59685 - RNA, 31 nt, Artificial Sequence
  Synthetic Oligonucleotide; CD80 exon 6; Set B
ugagaucaggaugaugguaugauaguacuua

SEQ ID NO: 59686 - RNA, 27 nt, Artificial Sequence
  Synthetic Oligonucleotide; CD80 exon 6; Set B
agaucaggaugaugguaugauaguacu

SEQ ID NO: 59687 - RNA, 29 nt, Artificial Sequence
  Synthetic Oligonucleotide; CD80 exon 6; Set B
gagaucaggaugaugguaugauaguacuu

SEQ ID NO: 59688 - RNA, 26 nt, Artificial Sequence
  Synthetic Oligonucleotide; CD80 exon 6; Set C
agaucaggaugaugguaugauaguac

SEQ ID NO: 59689 - RNA, 32 nt, Artificial Sequence
  Synthetic Oligonucleotide; CD80 exon 6; Set B
uugagaucaggaugaugguaugauaguacuua

SEQ ID NO: 59690 - RNA, 28 nt, Artificial Sequence
  Synthetic Oligonucleotide; CD80 exon 6; Set B
gagaucaggaugaugguaugauaguacu

SEQ ID NO: 59691 - RNA, 30 nt, Artificial Sequence
  Synthetic Oligonucleotide; CD80 exon 6; Set B
ugagaucaggaugaugguaugauaguacuu

SEQ ID NO: 59692 - RNA, 27 nt, Artificial Sequence
  Synthetic Oligonucleotide; CD80 exon 6; Set B
gagaucaggaugaugguaugauaguac

SEQ ID NO: 59693 - RNA, 25 nt, Artificial Sequence
  Synthetic Oligonucleotide; CD80 exon 6; Set C
agaucaggaugaugguaugauagua

SEQ ID NO: 59694 - RNA, 29 nt, Artificial Sequence
  Synthetic Oligonucleotide; CD80 exon 6; Set B
ugagaucaggaugaugguaugauaguacu

SEQ ID NO: 59695 - RNA, 31 nt, Artificial Sequence
  Synthetic Oligonucleotide; CD80 exon 6; Set B
uugagaucaggaugaugguaugauaguacuu

SEQ ID NO: 59696 - RNA, 24 nt, Artificial Sequence
  Synthetic Oligonucleotide; CD80 exon 6; Set C
agaucaggaugaugguaugauagu

SEQ ID NO: 59697 - RNA, 26 nt, Artificial Sequence
  Synthetic Oligonucleotide; CD80 exon 6; Set B
gagaucaggaugaugguaugauagua

SEQ ID NO: 59698 - RNA, 30 nt, Artificial Sequence
  Synthetic Oligonucleotide; CD80 exon 6; Set B
uugagaucaggaugaugguaugauaguacu

SEQ ID NO: 59699 - RNA, 32 nt, Artificial Sequence
  Synthetic Oligonucleotide; CD80 exon 6; Set B
auugagaucaggaugaugguaugauaguacuu

SEQ ID NO: 59700 - RNA, 31 nt, Artificial Sequence
  Synthetic Oligonucleotide; CD80 exon 6; Set B
auugagaucaggaugaugguaugauaguacu

SEQ ID NO: 59701 - RNA, 16 nt, Artificial Sequence
  Synthetic Oligonucleotide; CD80 exon 6; Set C
agaucaggaugauggu

SEQ ID NO: 59702 - RNA, 16 nt, Artificial Sequence
  Synthetic Oligonucleotide; CD80 exon 6; Set C
gagaucaggaugaugg

SEQ ID NO: 59703 - RNA, 15 nt, Artificial Sequence
  Synthetic Oligonucleotide; CD80 exon 6; Set C
gagaucaggaugaug

SEQ ID NO: 59704 - RNA, 17 nt, Artificial Sequence
  Synthetic Oligonucleotide; CD80 exon 6; Set C
ugagaucaggaugaugg

SEQ ID NO: 59705 - RNA, 16 nt, Artificial Sequence
  Synthetic Oligonucleotide; CD80 exon 6; Set C
ugagaucaggaugaug

SEQ ID NO: 59706 - RNA, 18 nt, Artificial Sequence
  Synthetic Oligonucleotide; CD80 exon 6; Set C
uugagaucaggaugaugg

SEQ ID NO: 59707 - RNA, 17 nt, Artificial Sequence
  Synthetic Oligonucleotide; CD80 exon 6; Set C
uugagaucaggaugaug

SEQ ID NO: 59708 - RNA, 19 nt, Artificial Sequence
  Synthetic Oligonucleotide; CD80 exon 6; Set C
auugagaucaggaugaugg

SEQ ID NO: 59709 - RNA, 38 nt, Artificial Sequence
  Synthetic Oligonucleotide; CD80 exon 6; Set B
gaucuuccagaauugagaucaggaugaugguaugauag

SEQ ID NO: 59710 - RNA, 40 nt, Artificial Sequence
  Synthetic Oligonucleotide; CD80 exon 6; Set C
ugaucuuccagaauugagaucaggaugaugguaugauagu

SEQ ID NO: 59711 - RNA, 37 nt, Artificial Sequence
  Synthetic Oligonucleotide; CD80 exon 6; Set B
gaucuuccagaauugagaucaggaugaugguaugaua

SEQ ID NO: 59712 - RNA, 39 nt, Artificial Sequence
  Synthetic Oligonucleotide; CD80 exon 6; Set B
ugaucuuccagaauugagaucaggaugaugguaugauag

SEQ ID NO: 59713 - RNA, 15 nt, Artificial Sequence
  Synthetic Oligonucleotide; CD80 exon 6; Set C
auugagaucaggaug

SEQ ID NO: 59714 - RNA, 38 nt, Artificial Sequence
  Synthetic Oligonucleotide; CD80 exon 6; Set B
ugaucuuccagaauugagaucaggaugaugguaugaua

SEQ ID NO: 59715 - RNA, 36 nt, Artificial Sequence
  Synthetic Oligonucleotide; CD80 exon 6; Set B
gaucuuccagaauugagaucaggaugaugguaugau

SEQ ID NO: 59716 - RNA, 37 nt, Artificial Sequence
  Synthetic Oligonucleotide; CD80 exon 6; Set B
ugaucuuccagaauugagaucaggaugaugguaugau

SEQ ID NO: 59717 - RNA, 35 nt, Artificial Sequence
  Synthetic Oligonucleotide; CD80 exon 6; Set B
gaucuuccagaauugagaucaggaugaugguauga

SEQ ID NO: 59718 - RNA, 36 nt, Artificial Sequence
  Synthetic Oligonucleotide; CD80 exon 6; Set B
ugaucuuccagaauugagaucaggaugaugguauga

SEQ ID NO: 59719 - RNA, 34 nt, Artificial Sequence
  Synthetic Oligonucleotide; CD80 exon 6; Set B
gaucuuccagaauugagaucaggaugaugguaug

SEQ ID NO: 59720 - RNA, 33 nt, Artificial Sequence
  Synthetic Oligonucleotide; CD80 exon 6; Set B
gaucuuccagaauugagaucaggaugaugguau

SEQ ID NO: 59721 - RNA, 35 nt, Artificial Sequence
  Synthetic Oligonucleotide; CD80 exon 6; Set B
ugaucuuccagaauugagaucaggaugaugguaug

SEQ ID NO: 59722 - RNA, 32 nt, Artificial Sequence
  Synthetic Oligonucleotide; CD80 exon 6; Set B
gaucuuccagaauugagaucaggaugauggua

SEQ ID NO: 59723 - RNA, 34 nt, Artificial Sequence
  Synthetic Oligonucleotide; CD80 exon 6; Set B
ugaucuuccagaauugagaucaggaugaugguau

SEQ ID NO: 59724 - RNA, 33 nt, Artificial Sequence
  Synthetic Oligonucleotide; CD80 exon 6; Set B
ugaucuuccagaauugagaucaggaugauggua

SEQ ID NO: 59725 - RNA, 31 nt, Artificial Sequence
  Synthetic Oligonucleotide; CD80 exon 6; Set B
gaucuuccagaauugagaucaggaugauggu

SEQ ID NO: 59726 - RNA, 32 nt, Artificial Sequence
  Synthetic Oligonucleotide; CD80 exon 6; Set B
ugaucuuccagaauugagaucaggaugauggu

SEQ ID NO: 59727 - RNA, 30 nt, Artificial Sequence
  Synthetic Oligonucleotide; CD80 exon 6; Set B
ugaucuuccagaauugagaucaggaugaug

SEQ ID NO: 59728 - RNA, 32 nt, Artificial Sequence
  Synthetic Oligonucleotide; CD80 exon 6; Set B
uugaucuuccagaauugagaucaggaugaugg

SEQ ID NO: 59729 - RNA, 29 nt, Artificial Sequence
  Synthetic Oligonucleotide; CD80 exon 6; Set B
uugaucuuccagaauugagaucaggauga

SEQ ID NO: 59730 - RNA, 31 nt, Artificial Sequence
  Synthetic Oligonucleotide; CD80 exon 6; Set B
uuugaucuuccagaauugagaucaggaugau

SEQ ID NO: 59731 - RNA, 28 nt, Artificial Sequence
  Synthetic Oligonucleotide; CD80 exon 6; Set B
uugaucuuccagaauugagaucaggaug

SEQ ID NO: 59732 - RNA, 30 nt, Artificial Sequence
  Synthetic Oligonucleotide; CD80 exon 6; Set B
uuugaucuuccagaauugagaucaggauga

SEQ ID NO: 59733 - RNA, 32 nt, Artificial Sequence
  Synthetic Oligonucleotide; CD80 exon 6; Set B
guuugaucuuccagaauugagaucaggaugau

SEQ ID NO: 59734 - RNA, 29 nt, Artificial Sequence
  Synthetic Oligonucleotide; CD80 exon 6; Set B
uuugaucuuccagaauugagaucaggaug

SEQ ID NO: 59735 - RNA, 31 nt, Artificial Sequence
  Synthetic Oligonucleotide; CD80 exon 6; Set B
guuugaucuuccagaauugagaucaggauga

SEQ ID NO: 59736 - RNA, 33 nt, Artificial Sequence
  Synthetic Oligonucleotide; CD80 exon 6; Set B
aguuugaucuuccagaauugagaucaggaugau

SEQ ID NO: 59737 - RNA, 30 nt, Artificial Sequence
  Synthetic Oligonucleotide; CD80 exon 6; Set B
guuugaucuuccagaauugagaucaggaug

SEQ ID NO: 59738 - RNA, 32 nt, Artificial Sequence
  Synthetic Oligonucleotide; CD80 exon 6; Set B
aguuugaucuuccagaauugagaucaggauga

SEQ ID NO: 59739 - RNA, 15 nt, Artificial Sequence
  Synthetic Oligonucleotide; CD80 exon 6; Set C
cuuccagaauugaga

SEQ ID NO: 59740 - RNA, 31 nt, Artificial Sequence
  Synthetic Oligonucleotide; CD80 exon 6; Set B
aguuugaucuuccagaauugagaucaggaug

SEQ ID NO: 59741 - RNA, 17 nt, Artificial Sequence
  Synthetic Oligonucleotide; CD80 exon 6; Set C
aucuuccagaauugaga

SEQ ID NO: 59742 - RNA, 16 nt, Artificial Sequence
  Synthetic Oligonucleotide; CD80 exon 6; Set C
aucuuccagaauugag

SEQ ID NO: 59743 - RNA, 18 nt, Artificial Sequence
  Synthetic Oligonucleotide; CD80 exon 6; Set C
gaucuuccagaauugaga

SEQ ID NO: 59744 - RNA, 15 nt, Artificial Sequence
  Synthetic Oligonucleotide; CD80 exon 6; Set C
aucuuccagaauuga

SEQ ID NO: 59745 - RNA, 17 nt, Artificial Sequence
  Synthetic Oligonucleotide; CD80 exon 6; Set C
gaucuuccagaauugag

SEQ ID NO: 59746 - RNA, 16 nt, Artificial Sequence
  Synthetic Oligonucleotide; CD80 exon 6; Set C
gaucuuccagaauuga

SEQ ID NO: 59747 - RNA, 15 nt, Artificial Sequence
  Synthetic Oligonucleotide; CD80 exon 6; Set C
gaucuuccagaauug

SEQ ID NO: 59748 - RNA, 17 nt, Artificial Sequence
  Synthetic Oligonucleotide; CD80 exon 7; Set C
aaugauaaguaaguuuc

SEQ ID NO: 59749 - RNA, 16 nt, Artificial Sequence
  Synthetic Oligonucleotide; CD80 exon 7; Set C
aaugauaaguaaguuu

SEQ ID NO: 59750 - RNA, 18 nt, Artificial Sequence
  Synthetic Oligonucleotide; CD80 exon 7; Set C
aaaugauaaguaaguuuc

SEQ ID NO: 59751 - RNA, 17 nt, Artificial Sequence
  Synthetic Oligonucleotide; CD80 exon 7; Set C
aaaugauaaguaaguuu

SEQ ID NO: 59752 - RNA, 19 nt, Artificial Sequence
  Synthetic Oligonucleotide; CD80 exon 7; Set C
aaaaugauaaguaaguuuc

SEQ ID NO: 59753 - RNA, 18 nt, Artificial Sequence
  Synthetic Oligonucleotide; CD80 exon 7; Set C
aaaaugauaaguaaguuu

SEQ ID NO: 59754 - RNA, 20 nt, Artificial Sequence
  Synthetic Oligonucleotide; CD80 exon 7; Set C
aaaaaugauaaguaaguuuc

SEQ ID NO: 59755 - RNA, 19 nt, Artificial Sequence
  Synthetic Oligonucleotide; CD80 exon 7; Set C
aaaaaugauaaguaaguuu

SEQ ID NO: 59756 - RNA, 21 nt, Artificial Sequence
  Synthetic Oligonucleotide; CD80 exon 7; Set C
uaaaaaugauaaguaaguuuc

SEQ ID NO: 59757 - RNA, 20 nt, Artificial Sequence
  Synthetic Oligonucleotide; CD80 exon 7; Set C
uaaaaaugauaaguaaguuu

SEQ ID NO: 59758 - RNA, 22 nt, Artificial Sequence
  Synthetic Oligonucleotide; CD80 exon 7; Set C
auaaaaaugauaaguaaguuuc

SEQ ID NO: 59759 - RNA, 21 nt, Artificial Sequence
  Synthetic Oligonucleotide; CD80 exon 7; Set C
auaaaaaugauaaguaaguuu

SEQ ID NO: 59760 - RNA, 23 nt, Artificial Sequence
  Synthetic Oligonucleotide; CD80 exon 7; Set C
aauaaaaaugauaaguaaguuuc

SEQ ID NO: 59761 - RNA, 22 nt, Artificial Sequence
  Synthetic Oligonucleotide; CD80 exon 7; Set C
aauaaaaaugauaaguaaguuu

SEQ ID NO: 59762 - RNA, 24 nt, Artificial Sequence
  Synthetic Oligonucleotide; CD80 exon 7; Set C
caauaaaaaugauaaguaaguuuc

SEQ ID NO: 59763 - RNA, 23 nt, Artificial Sequence
  Synthetic Oligonucleotide; CD80 exon 7; Set C
caauaaaaaugauaaguaaguuu

SEQ ID NO: 59764 - RNA, 24 nt, Artificial Sequence
  Synthetic Oligonucleotide; CD80 exon 7; Set C
acaauaaaaaugauaaguaaguuu

SEQ ID NO: 59765 - RNA, 15 nt, Artificial Sequence
  Synthetic Oligonucleotide; CD80 exon 7; Set C
uaaaaaugauaagua

SEQ ID NO: 59766 - RNA, 16 nt, Artificial Sequence
  Synthetic Oligonucleotide; CD80 exon 7; Set C
auaaaaaugauaagua

SEQ ID NO: 59767 - RNA, 15 nt, Artificial Sequence
  Synthetic Oligonucleotide; CD80 exon 7; Set C
auaaaaaugauaagu

SEQ ID NO: 59768 - RNA, 29 nt, Artificial Sequence
  Synthetic Oligonucleotide; CD80 exon 7; Set C
acaaacaauaaaaaugauaaguaaguuuc

SEQ ID NO: 59769 - RNA, 17 nt, Artificial Sequence
  Synthetic Oligonucleotide; CD80 exon 7; Set C
aauaaaaaugauaagua

SEQ ID NO: 59770 - RNA, 16 nt, Artificial Sequence
  Synthetic Oligonucleotide; CD80 exon 7; Set C
aauaaaaaugauaagu

SEQ ID NO: 59771 - RNA, 28 nt, Artificial Sequence
  Synthetic Oligonucleotide; CD80 exon 7; Set C
acaaacaauaaaaaugauaaguaaguuu

SEQ ID NO: 59772 - RNA, 30 nt, Artificial Sequence
  Synthetic Oligonucleotide; CD80 exon 7; Set C
aacaaacaauaaaaaugauaaguaaguuuc

SEQ ID NO: 59773 - RNA, 18 nt, Artificial Sequence
  Synthetic Oligonucleotide; CD80 exon 7; Set C
caauaaaaaugauaagua

SEQ ID NO: 59774 - RNA, 15 nt, Artificial Sequence
  Synthetic Oligonucleotide; CD80 exon 7; Set C
aauaaaaaugauaag

SEQ ID NO: 59775 - RNA, 17 nt, Artificial Sequence
  Synthetic Oligonucleotide; CD80 exon 7; Set C
caauaaaaaugauaagu

SEQ ID NO: 59776 - RNA, 29 nt, Artificial Sequence
  Synthetic Oligonucleotide; CD80 exon 7; Set C
aacaaacaauaaaaaugauaaguaaguuu

SEQ ID NO: 59777 - RNA, 16 nt, Artificial Sequence
  Synthetic Oligonucleotide; CD80 exon 7; Set C
caauaaaaaugauaag

SEQ ID NO: 59778 - RNA, 18 nt, Artificial Sequence
  Synthetic Oligonucleotide; CD80 exon 7; Set C
acaauaaaaaugauaagu

SEQ ID NO: 59779 - RNA, 15 nt, Artificial Sequence
  Synthetic Oligonucleotide; CD80 exon 7; Set C
caauaaaaaugauaa

SEQ ID NO: 59780 - RNA, 17 nt, Artificial Sequence
  Synthetic Oligonucleotide; CD80 exon 7; Set C
acaauaaaaaugauaag

SEQ ID NO: 59781 - RNA, 16 nt, Artificial Sequence
  Synthetic Oligonucleotide; CD80 exon 7; Set C
acaauaaaaaugauaa

SEQ ID NO: 59782 - RNA, 21 nt, Artificial Sequence
  Synthetic Oligonucleotide; CD80 exon 7; Set C
caaacaauaaaaaugauaagu

SEQ ID NO: 59783 - RNA, 15 nt, Artificial Sequence
  Synthetic Oligonucleotide; CD80 exon 7; Set C
acaauaaaaaugaua

SEQ ID NO: 59784 - RNA, 23 nt, Artificial Sequence
  Synthetic Oligonucleotide; CD80 exon 7; Set C
acaaacaauaaaaaugauaagua

SEQ ID NO: 59785 - RNA, 22 nt, Artificial Sequence
  Synthetic Oligonucleotide; CD80 exon 7; Set C
acaaacaauaaaaaugauaagu

SEQ ID NO: 59786 - RNA, 20 nt, Artificial Sequence
  Synthetic Oligonucleotide; CD80 exon 7; Set C
caaacaauaaaaaugauaag

SEQ ID NO: 59787 - RNA, 36 nt, Artificial Sequence
  Synthetic Oligonucleotide; CD80 exon 7; Set C
gacaagaacaaacaauaaaaaugauaaguaaguuuc

SEQ ID NO: 59788 - RNA, 21 nt, Artificial Sequence
  Synthetic Oligonucleotide; CD80 exon 7; Set C
acaaacaauaaaaaugauaag

SEQ ID NO: 59789 - RNA, 23 nt, Artificial Sequence
  Synthetic Oligonucleotide; CD80 exon 7; Set C
aacaaacaauaaaaaugauaagu

SEQ ID NO: 59790 - RNA, 19 nt, Artificial Sequence
  Synthetic Oligonucleotide; CD80 exon 7; Set C
caaacaauaaaaaugauaa

SEQ ID NO: 59791 - RNA, 35 nt, Artificial Sequence
  Synthetic Oligonucleotide; CD80 exon 7; Set C
gacaagaacaaacaauaaaaaugauaaguaaguuu

SEQ ID NO: 59792 - RNA, 37 nt, Artificial Sequence
  Synthetic Oligonucleotide; CD80 exon 7; Set C
agacaagaacaaacaauaaaaaugauaaguaaguuuc

SEQ ID NO: 59793 - RNA, 20 nt, Artificial Sequence
  Synthetic Oligonucleotide; CD80 exon 7; Set C
acaaacaauaaaaaugauaa

SEQ ID NO: 59794 - RNA, 22 nt, Artificial Sequence
  Synthetic Oligonucleotide; CD80 exon 7; Set C
aacaaacaauaaaaaugauaag

SEQ ID NO: 59795 - RNA, 36 nt, Artificial Sequence
  Synthetic Oligonucleotide; CD80 exon 7; Set C
agacaagaacaaacaauaaaaaugauaaguaaguuu

SEQ ID NO: 59796 - RNA, 38 nt, Artificial Sequence
  Synthetic Oligonucleotide; CD80 exon 7; Set C
gagacaagaacaaacaauaaaaaugauaaguaaguuuc

SEQ ID NO: 59797 - RNA, 21 nt, Artificial Sequence
  Synthetic Oligonucleotide; CD80 exon 7; Set C
aacaaacaauaaaaaugauaa

SEQ ID NO: 59798 - RNA, 19 nt, Artificial Sequence
  Synthetic Oligonucleotide; CD80 exon 7; Set C
acaaacaauaaaaaugaua

SEQ ID NO: 59799 - RNA, 37 nt, Artificial Sequence
  Synthetic Oligonucleotide; CD80 exon 7; Set C
gagacaagaacaaacaauaaaaaugauaaguaaguuu

SEQ ID NO: 59800 - RNA, 39 nt, Artificial Sequence
  Synthetic Oligonucleotide; CD80 exon 7; Set C
ggagacaagaacaaacaauaaaaaugauaaguaaguuuc

SEQ ID NO: 59801 - RNA, 20 nt, Artificial Sequence
  Synthetic Oligonucleotide; CD80 exon 7; Set C
aacaaacaauaaaaaugaua

SEQ ID NO: 59802 - RNA, 38 nt, Artificial Sequence
  Synthetic Oligonucleotide; CD80 exon 7; Set C
ggagacaagaacaaacaauaaaaaugauaaguaaguuu

SEQ ID NO: 59803 - RNA, 40 nt, Artificial Sequence
  Synthetic Oligonucleotide; CD80 exon 7; Set C
uggagacaagaacaaacaauaaaaaugauaaguaaguuuc

SEQ ID NO: 59804 - RNA, 39 nt, Artificial Sequence
  Synthetic Oligonucleotide; CD80 exon 7; Set C
uggagacaagaacaaacaauaaaaaugauaaguaaguuu

SEQ ID NO: 59805 - RNA, 40 nt, Artificial Sequence
  Synthetic Oligonucleotide; CD80 exon 7; Set C
uuggagacaagaacaaacaauaaaaaugauaaguaaguuu

SEQ ID NO: 59806 - RNA, 29 nt, Artificial Sequence
  Synthetic Oligonucleotide; CD80 exon 7; Set C
gacaagaacaaacaauaaaaaugauaagu

SEQ ID NO: 59807 - RNA, 15 nt, Artificial Sequence
  Synthetic Oligonucleotide; CD80 exon 7; Set C
acaaacaauaaaaau

SEQ ID NO: 59808 - RNA, 31 nt, Artificial Sequence
  Synthetic Oligonucleotide; CD80 exon 7; Set C
agacaagaacaaacaauaaaaaugauaagua

SEQ ID NO: 59809 - RNA, 30 nt, Artificial Sequence
  Synthetic Oligonucleotide; CD80 exon 7; Set C
agacaagaacaaacaauaaaaaugauaagu

SEQ ID NO: 59810 - RNA, 28 nt, Artificial Sequence
  Synthetic Oligonucleotide; CD80 exon 7; Set C
gacaagaacaaacaauaaaaaugauaag

SEQ ID NO: 59811 - RNA, 16 nt, Artificial Sequence
  Synthetic Oligonucleotide; CD80 exon 7; Set C
aacaaacaauaaaaau

SEQ ID NO: 59812 - RNA, 32 nt, Artificial Sequence
  Synthetic Oligonucleotide; CD80 exon 7; Set C
gagacaagaacaaacaauaaaaaugauaagua

SEQ ID NO: 59813 - RNA, 31 nt, Artificial Sequence
  Synthetic Oligonucleotide; CD80 exon 7; Set C
gagacaagaacaaacaauaaaaaugauaagu

SEQ ID NO: 59814 - RNA, 29 nt, Artificial Sequence
  Synthetic Oligonucleotide; CD80 exon 7; Set C
agacaagaacaaacaauaaaaaugauaag

SEQ ID NO: 59815 - RNA, 27 nt, Artificial Sequence
  Synthetic Oligonucleotide; CD80 exon 7; Set C
gacaagaacaaacaauaaaaaugauaa

SEQ ID NO: 59816 - RNA, 15 nt, Artificial Sequence
  Synthetic Oligonucleotide; CD80 exon 7; Set C
aacaaacaauaaaaa

SEQ ID NO: 59817 - RNA, 30 nt, Artificial Sequence
  Synthetic Oligonucleotide; CD80 exon 7; Set C
gagacaagaacaaacaauaaaaaugauaag

SEQ ID NO: 59818 - RNA, 28 nt, Artificial Sequence
  Synthetic Oligonucleotide; CD80 exon 7; Set C
agacaagaacaaacaauaaaaaugauaa

SEQ ID NO: 59819 - RNA, 32 nt, Artificial Sequence
  Synthetic Oligonucleotide; CD80 exon 7; Set C
ggagacaagaacaaacaauaaaaaugauaagu

SEQ ID NO: 59820 - RNA, 26 nt, Artificial Sequence
  Synthetic Oligonucleotide; CD80 exon 7; Set C
gacaagaacaaacaauaaaaaugaua

SEQ ID NO: 59821 - RNA, 29 nt, Artificial Sequence
  Synthetic Oligonucleotide; CD80 exon 7; Set C
gagacaagaacaaacaauaaaaaugauaa

SEQ ID NO: 59822 - RNA, 31 nt, Artificial Sequence
  Synthetic Oligonucleotide; CD80 exon 7; Set C
ggagacaagaacaaacaauaaaaaugauaag

SEQ ID NO: 59823 - RNA, 33 nt, Artificial Sequence
  Synthetic Oligonucleotide; CD80 exon 7; Set C
uggagacaagaacaaacaauaaaaaugauaagu

SEQ ID NO: 59824 - RNA, 27 nt, Artificial Sequence
  Synthetic Oligonucleotide; CD80 exon 7; Set C
agacaagaacaaacaauaaaaaugaua

SEQ ID NO: 59825 - RNA, 30 nt, Artificial Sequence
  Synthetic Oligonucleotide; CD80 exon 7; Set C
ggagacaagaacaaacaauaaaaaugauaa

SEQ ID NO: 59826 - RNA, 34 nt, Artificial Sequence
  Synthetic Oligonucleotide; CD80 exon 7; Set C
uuggagacaagaacaaacaauaaaaaugauaagu

SEQ ID NO: 59827 - RNA, 32 nt, Artificial Sequence
  Synthetic Oligonucleotide; CD80 exon 7; Set C
uggagacaagaacaaacaauaaaaaugauaag

SEQ ID NO: 59828 - RNA, 28 nt, Artificial Sequence
  Synthetic Oligonucleotide; CD80 exon 7; Set C
gagacaagaacaaacaauaaaaaugaua

SEQ ID NO: 59829 - RNA, 35 nt, Artificial Sequence
  Synthetic Oligonucleotide; CD80 exon 7; Set C
cuuggagacaagaacaaacaauaaaaaugauaagu

SEQ ID NO: 59830 - RNA, 33 nt, Artificial Sequence
  Synthetic Oligonucleotide; CD80 exon 7; Set C
uuggagacaagaacaaacaauaaaaaugauaag

SEQ ID NO: 59831 - RNA, 31 nt, Artificial Sequence
  Synthetic Oligonucleotide; CD80 exon 7; Set C
uggagacaagaacaaacaauaaaaaugauaa

SEQ ID NO: 59832 - RNA, 29 nt, Artificial Sequence
  Synthetic Oligonucleotide; CD80 exon 7; Set C
ggagacaagaacaaacaauaaaaaugaua

SEQ ID NO: 59833 - RNA, 34 nt, Artificial Sequence
  Synthetic Oligonucleotide; CD80 exon 7; Set C
cuuggagacaagaacaaacaauaaaaaugauaag

SEQ ID NO: 59834 - RNA, 32 nt, Artificial Sequence
  Synthetic Oligonucleotide; CD80 exon 7; Set C
uuggagacaagaacaaacaauaaaaaugauaa

SEQ ID NO: 59835 - RNA, 30 nt, Artificial Sequence
  Synthetic Oligonucleotide; CD80 exon 7; Set C
uggagacaagaacaaacaauaaaaaugaua

SEQ ID NO: 59836 - RNA, 33 nt, Artificial Sequence
  Synthetic Oligonucleotide; CD80 exon 7; Set C
cuuggagacaagaacaaacaauaaaaaugauaa

SEQ ID NO: 59837 - RNA, 21 nt, Artificial Sequence
  Synthetic Oligonucleotide; CD80 exon 7; Set C
gacaagaacaaacaauaaaaa

SEQ ID NO: 59838 - RNA, 31 nt, Artificial Sequence
  Synthetic Oligonucleotide; CD80 exon 7; Set C
uuggagacaagaacaaacaauaaaaaugaua

SEQ ID NO: 59839 - RNA, 23 nt, Artificial Sequence
  Synthetic Oligonucleotide; CD80 exon 7; Set C
agacaagaacaaacaauaaaaau

SEQ ID NO: 59840 - RNA, 22 nt, Artificial Sequence
  Synthetic Oligonucleotide; CD80 exon 7; Set C
agacaagaacaaacaauaaaaa

SEQ ID NO: 59841 - RNA, 32 nt, Artificial Sequence
  Synthetic Oligonucleotide; CD80 exon 7; Set C
cuuggagacaagaacaaacaauaaaaaugaua

SEQ ID NO: 59842 - RNA, 24 nt, Artificial Sequence
  Synthetic Oligonucleotide; CD80 exon 7; Set C
gagacaagaacaaacaauaaaaau

SEQ ID NO: 59843 - RNA, 23 nt, Artificial Sequence
  Synthetic Oligonucleotide; CD80 exon 7; Set C
gagacaagaacaaacaauaaaaa

SEQ ID NO: 59844 - RNA, 21 nt, Artificial Sequence
  Synthetic Oligonucleotide; CD80 exon 7; Set C
agacaagaacaaacaauaaaa

SEQ ID NO: 59845 - RNA, 24 nt, Artificial Sequence
  Synthetic Oligonucleotide; CD80 exon 7; Set C
ggagacaagaacaaacaauaaaaa

SEQ ID NO: 59846 - RNA, 22 nt, Artificial Sequence
  Synthetic Oligonucleotide; CD80 exon 7; Set C
gagacaagaacaaacaauaaaa

SEQ ID NO: 59847 - RNA, 20 nt, Artificial Sequence
  Synthetic Oligonucleotide; CD80 exon 7; Set C
agacaagaacaaacaauaaa

SEQ ID NO: 59848 - RNA, 25 nt, Artificial Sequence
  Synthetic Oligonucleotide; CD80 exon 7; Set C
uggagacaagaacaaacaauaaaaa

SEQ ID NO: 59849 - RNA, 23 nt, Artificial Sequence
  Synthetic Oligonucleotide; CD80 exon 7; Set C
ggagacaagaacaaacaauaaaa

SEQ ID NO: 59850 - RNA, 21 nt, Artificial Sequence
  Synthetic Oligonucleotide; CD80 exon 7; Set C
gagacaagaacaaacaauaaa

SEQ ID NO: 59851 - RNA, 19 nt, Artificial Sequence
  Synthetic Oligonucleotide; CD80 exon 7; Set C
agacaagaacaaacaauaa

SEQ ID NO: 59852 - RNA, 26 nt, Artificial Sequence
  Synthetic Oligonucleotide; CD80 exon 7; Set C
uuggagacaagaacaaacaauaaaaa

SEQ ID NO: 59853 - RNA, 18 nt, Artificial Sequence
  Synthetic Oligonucleotide; CD80 exon 7; Set C
agacaagaacaaacaaua

SEQ ID NO: 59854 - RNA, 24 nt, Artificial Sequence
  Synthetic Oligonucleotide; CD80 exon 7; Set C
uggagacaagaacaaacaauaaaa

SEQ ID NO: 59855 - RNA, 28 nt, Artificial Sequence
  Synthetic Oligonucleotide; CD80 exon 7; Set C
cuuggagacaagaacaaacaauaaaaau

SEQ ID NO: 59856 - RNA, 20 nt, Artificial Sequence
  Synthetic Oligonucleotide; CD80 exon 7; Set C
gagacaagaacaaacaauaa

SEQ ID NO: 59857 - RNA, 27 nt, Artificial Sequence
  Synthetic Oligonucleotide; CD80 exon 7; Set C
cuuggagacaagaacaaacaauaaaaa

SEQ ID NO: 59858 - RNA, 17 nt, Artificial Sequence
  Synthetic Oligonucleotide; CD80 exon 7; Set C
agacaagaacaaacaau

SEQ ID NO: 59859 - RNA, 19 nt, Artificial Sequence
  Synthetic Oligonucleotide; CD80 exon 7; Set C
gagacaagaacaaacaaua

SEQ ID NO: 59860 - RNA, 25 nt, Artificial Sequence
  Synthetic Oligonucleotide; CD80 exon 7; Set C
uuggagacaagaacaaacaauaaaa

SEQ ID NO: 59861 - RNA, 18 nt, Artificial Sequence
  Synthetic Oligonucleotide; CD80 exon 7; Set C
gagacaagaacaaacaau

SEQ ID NO: 59862 - RNA, 20 nt, Artificial Sequence
  Synthetic Oligonucleotide; CD80 exon 7; Set C
ggagacaagaacaaacaaua

SEQ ID NO: 59863 - RNA, 26 nt, Artificial Sequence
  Synthetic Oligonucleotide; CD80 exon 7; Set C
cuuggagacaagaacaaacaauaaaa

SEQ ID NO: 59864 - RNA, 16 nt, Artificial Sequence
  Synthetic Oligonucleotide; CD80 exon 7; Set C
agacaagaacaaacaa

SEQ ID NO: 59865 - RNA, 19 nt, Artificial Sequence
  Synthetic Oligonucleotide; CD80 exon 7; Set C
ggagacaagaacaaacaau

SEQ ID NO: 59866 - RNA, 21 nt, Artificial Sequence
  Synthetic Oligonucleotide; CD80 exon 7; Set C
uggagacaagaacaaacaaua

SEQ ID NO: 59867 - RNA, 17 nt, Artificial Sequence
  Synthetic Oligonucleotide; CD80 exon 7; Set C
gagacaagaacaaacaa

SEQ ID NO: 59868 - RNA, 25 nt, Artificial Sequence
  Synthetic Oligonucleotide; CD80 exon 7; Set C
cuuggagacaagaacaaacaauaaa

SEQ ID NO: 59869 - RNA, 20 nt, Artificial Sequence
  Synthetic Oligonucleotide; CD80 exon 7; Set C
uggagacaagaacaaacaau

SEQ ID NO: 59870 - RNA, 22 nt, Artificial Sequence
  Synthetic Oligonucleotide; CD80 exon 7; Set C
uuggagacaagaacaaacaaua

SEQ ID NO: 59871 - RNA, 21 nt, Artificial Sequence
  Synthetic Oligonucleotide; CD80 exon 7; Set C
uuggagacaagaacaaacaau

SEQ ID NO: 59872 - RNA, 23 nt, Artificial Sequence
  Synthetic Oligonucleotide; CD80 exon 7; Set C
cuuggagacaagaacaaacaaua

SEQ ID NO: 59873 - RNA, 22 nt, Artificial Sequence
  Synthetic Oligonucleotide; CD80 exon 7; Set C
cuuggagacaagaacaaacaau

SEQ ID NO: 59874 - RNA, 21 nt, Artificial Sequence
  Synthetic Oligonucleotide; CD80 exon 7; Set C
cuuggagacaagaacaaacaa

SEQ ID NO: 59875 - RNA, 37 nt, Artificial Sequence
  Synthetic Oligonucleotide; CD80 exon 7; Set A
gggcaaagccuuggagacaagaacaaacaauaaaaau

SEQ ID NO: 59876 - RNA, 36 nt, Artificial Sequence
  Synthetic Oligonucleotide; CD80 exon 7; Set A
gggcaaagccuuggagacaagaacaaacaauaaaaa

SEQ ID NO: 59877 - RNA, 38 nt, Artificial Sequence
  Synthetic Oligonucleotide; CD80 exon 7; Set A
ggggcaaagccuuggagacaagaacaaacaauaaaaau

SEQ ID NO: 59878 - RNA, 37 nt, Artificial Sequence
  Synthetic Oligonucleotide; CD80 exon 7; Set A
ggggcaaagccuuggagacaagaacaaacaauaaaaa

SEQ ID NO: 59879 - RNA, 35 nt, Artificial Sequence
  Synthetic Oligonucleotide; CD80 exon 7; Set A
gggcaaagccuuggagacaagaacaaacaauaaaa

SEQ ID NO: 59880 - RNA, 39 nt, Artificial Sequence
  Synthetic Oligonucleotide; CD80 exon 7; Set A
uggggcaaagccuuggagacaagaacaaacaauaaaaau

SEQ ID NO: 59881 - RNA, 38 nt, Artificial Sequence
  Synthetic Oligonucleotide; CD80 exon 7; Set A
uggggcaaagccuuggagacaagaacaaacaauaaaaa

SEQ ID NO: 59882 - RNA, 36 nt, Artificial Sequence
  Synthetic Oligonucleotide; CD80 exon 7; Set A
ggggcaaagccuuggagacaagaacaaacaauaaaa

SEQ ID NO: 59883 - RNA, 16 nt, Artificial Sequence
  Synthetic Oligonucleotide; CD80 exon 7; Set C
cuuggagacaagaaca

SEQ ID NO: 59884 - RNA, 34 nt, Artificial Sequence
  Synthetic Oligonucleotide; CD80 exon 7; Set A
gggcaaagccuuggagacaagaacaaacaauaaa

SEQ ID NO: 59885 - RNA, 39 nt, Artificial Sequence
  Synthetic Oligonucleotide; CD80 exon 7; Set A
uuggggcaaagccuuggagacaagaacaaacaauaaaaa

SEQ ID NO: 59886 - RNA, 37 nt, Artificial Sequence
  Synthetic Oligonucleotide; CD80 exon 7; Set A
uggggcaaagccuuggagacaagaacaaacaauaaaa

SEQ ID NO: 59887 - RNA, 35 nt, Artificial Sequence
  Synthetic Oligonucleotide; CD80 exon 7; Set A
ggggcaaagccuuggagacaagaacaaacaauaaa

SEQ ID NO: 59888 - RNA, 33 nt, Artificial Sequence
  Synthetic Oligonucleotide; CD80 exon 7; Set A
gggcaaagccuuggagacaagaacaaacaauaa

SEQ ID NO: 59889 - RNA, 32 nt, Artificial Sequence
  Synthetic Oligonucleotide; CD80 exon 7; Set A
gggcaaagccuuggagacaagaacaaacaaua

SEQ ID NO: 59890 - RNA, 36 nt, Artificial Sequence
  Synthetic Oligonucleotide; CD80 exon 7; Set A
uggggcaaagccuuggagacaagaacaaacaauaaa

SEQ ID NO: 59891 - RNA, 34 nt, Artificial Sequence
  Synthetic Oligonucleotide; CD80 exon 7; Set A
ggggcaaagccuuggagacaagaacaaacaauaa

SEQ ID NO: 59892 - RNA, 31 nt, Artificial Sequence
  Synthetic Oligonucleotide; CD80 exon 7; Set A
gggcaaagccuuggagacaagaacaaacaau

SEQ ID NO: 59893 - RNA, 33 nt, Artificial Sequence
  Synthetic Oligonucleotide; CD80 exon 7; Set A
ggggcaaagccuuggagacaagaacaaacaaua

SEQ ID NO: 59894 - RNA, 35 nt, Artificial Sequence
  Synthetic Oligonucleotide; CD80 exon 7; Set A
uggggcaaagccuuggagacaagaacaaacaauaa

SEQ ID NO: 59895 - RNA, 32 nt, Artificial Sequence
  Synthetic Oligonucleotide; CD80 exon 7; Set A
ggggcaaagccuuggagacaagaacaaacaau

SEQ ID NO: 59896 - RNA, 34 nt, Artificial Sequence
  Synthetic Oligonucleotide; CD80 exon 7; Set A
uggggcaaagccuuggagacaagaacaaacaaua

SEQ ID NO: 59897 - RNA, 30 nt, Artificial Sequence
  Synthetic Oligonucleotide; CD80 exon 7; Set A
gggcaaagccuuggagacaagaacaaacaa

SEQ ID NO: 59898 - RNA, 33 nt, Artificial Sequence
  Synthetic Oligonucleotide; CD80 exon 7; Set A
uggggcaaagccuuggagacaagaacaaacaau

SEQ ID NO: 59899 - RNA, 31 nt, Artificial Sequence
  Synthetic Oligonucleotide; CD80 exon 7; Set A
ggggcaaagccuuggagacaagaacaaacaa

SEQ ID NO: 59900 - RNA, 32 nt, Artificial Sequence
  Synthetic Oligonucleotide; CD80 exon 7; Set A
uggggcaaagccuuggagacaagaacaaacaa

SEQ ID NO: 59901 - RNA, 25 nt, Artificial Sequence
  Synthetic Oligonucleotide; CD80 exon 7; Set A
gggcaaagccuuggagacaagaaca

SEQ ID NO: 59902 - RNA, 26 nt, Artificial Sequence
  Synthetic Oligonucleotide; CD80 exon 7; Set A
ggggcaaagccuuggagacaagaaca

SEQ ID NO: 59903 - RNA, 27 nt, Artificial Sequence
  Synthetic Oligonucleotide; CD80 exon 7; Set A
uggggcaaagccuuggagacaagaaca

SEQ ID NO: 59904 - RNA, 25 nt, Artificial Sequence
  Synthetic Oligonucleotide; CD80 exon 7; Set A
ggggcaaagccuuggagacaagaac

SEQ ID NO: 59905 - RNA, 17 nt, Artificial Sequence
  Synthetic Oligonucleotide; CD80 exon 7; Set C
gggcaaagccuuggaga

SEQ ID NO: 59906 - RNA, 19 nt, Artificial Sequence
  Synthetic Oligonucleotide; CD80 exon 7; Set A
ggggcaaagccuuggagac

SEQ ID NO: 59907 - RNA, 16 nt, Artificial Sequence
  Synthetic Oligonucleotide; CD80 exon 7; Set C
gggcaaagccuuggag

SEQ ID NO: 59908 - RNA, 18 nt, Artificial Sequence
  Synthetic Oligonucleotide; CD80 exon 7; Set A
ggggcaaagccuuggaga

SEQ ID NO: 59909 - RNA, 17 nt, Artificial Sequence
  Synthetic Oligonucleotide; CD80 exon 7; Set C
ggggcaaagccuuggag

SEQ ID NO: 59910 - RNA, 19 nt, Artificial Sequence
  Synthetic Oligonucleotide; CD80 exon 7; Set A
uggggcaaagccuuggaga

SEQ ID NO: 59911 - RNA, 18 nt, Artificial Sequence
  Synthetic Oligonucleotide; CD80 exon 7; Set C
uggggcaaagccuuggag

SEQ ID NO: 59912 - RNA, 20 nt, Artificial Sequence
  Synthetic Oligonucleotide; CD80 exon 7; Set A
uuggggcaaagccuuggaga

SEQ ID NO: 59913 - RNA, 19 nt, Artificial Sequence
  Synthetic Oligonucleotide; CD80 exon 7; Set C
uuggggcaaagccuuggag

SEQ ID NO: 59914 - RNA, 20 nt, Artificial Sequence
  Synthetic Oligonucleotide; CD80 exon 7; Set C
uuauacagggcguacacuuu

SEQ ID NO: 59915 - RNA, 15 nt, Artificial Sequence
  Synthetic Oligonucleotide; CD80 exon 7; Set C
guuauacagggcgua

SEQ ID NO: 59916 - RNA, 18 nt, Artificial Sequence
  Synthetic Oligonucleotide; CD80 exon 7; Set C
aguaaguuucccuugaau

SEQ ID NO: 59917 - RNA, 19 nt, Artificial Sequence
  Synthetic Oligonucleotide; CD80 exon 7; Set C
aaguaaguuucccuugaau

SEQ ID NO: 59918 - RNA, 17 nt, Artificial Sequence
  Synthetic Oligonucleotide; CD80 exon 7; Set C
aguaaguuucccuugaa

SEQ ID NO: 59919 - RNA, 20 nt, Artificial Sequence
  Synthetic Oligonucleotide; CD80 exon 7; Set C
uaaguaaguuucccuugaau

SEQ ID NO: 59920 - RNA, 18 nt, Artificial Sequence
  Synthetic Oligonucleotide; CD80 exon 7; Set C
aaguaaguuucccuugaa

SEQ ID NO: 59921 - RNA, 21 nt, Artificial Sequence
  Synthetic Oligonucleotide; CD80 exon 7; Set C
auaaguaaguuucccuugaau

SEQ ID NO: 59922 - RNA, 19 nt, Artificial Sequence
  Synthetic Oligonucleotide; CD80 exon 7; Set C
uaaguaaguuucccuugaa

SEQ ID NO: 59923 - RNA, 17 nt, Artificial Sequence
  Synthetic Oligonucleotide; CD80 exon 7; Set C
aaguaaguuucccuuga

SEQ ID NO: 59924 - RNA, 18 nt, Artificial Sequence
  Synthetic Oligonucleotide; CD80 exon 7; Set C
uaaguaaguuucccuuga

SEQ ID NO: 59925 - RNA, 20 nt, Artificial Sequence
  Synthetic Oligonucleotide; CD80 exon 7; Set C
auaaguaaguuucccuugaa

SEQ ID NO: 59926 - RNA, 19 nt, Artificial Sequence
  Synthetic Oligonucleotide; CD80 exon 7; Set C
auaaguaaguuucccuuga

SEQ ID NO: 59927 - RNA, 25 nt, Artificial Sequence
  Synthetic Oligonucleotide; CD80 exon 7; Set C
aaugauaaguaaguuucccuugaau

SEQ ID NO: 59928 - RNA, 26 nt, Artificial Sequence
  Synthetic Oligonucleotide; CD80 exon 7; Set C
aaaugauaaguaaguuucccuugaau

SEQ ID NO: 59929 - RNA, 24 nt, Artificial Sequence
  Synthetic Oligonucleotide; CD80 exon 7; Set C
aaugauaaguaaguuucccuugaa

SEQ ID NO: 59930 - RNA, 27 nt, Artificial Sequence
  Synthetic Oligonucleotide; CD80 exon 7; Set C
aaaaugauaaguaaguuucccuugaau

SEQ ID NO: 59931 - RNA, 25 nt, Artificial Sequence
  Synthetic Oligonucleotide; CD80 exon 7; Set C
aaaugauaaguaaguuucccuugaa

SEQ ID NO: 59932 - RNA, 23 nt, Artificial Sequence
  Synthetic Oligonucleotide; CD80 exon 7; Set C
aaugauaaguaaguuucccuuga

SEQ ID NO: 59933 - RNA, 28 nt, Artificial Sequence
  Synthetic Oligonucleotide; CD80 exon 7; Set C
aaaaaugauaaguaaguuucccuugaau

SEQ ID NO: 59934 - RNA, 24 nt, Artificial Sequence
  Synthetic Oligonucleotide; CD80 exon 7; Set C
aaaugauaaguaaguuucccuuga

SEQ ID NO: 59935 - RNA, 26 nt, Artificial Sequence
  Synthetic Oligonucleotide; CD80 exon 7; Set C
aaaaugauaaguaaguuucccuugaa

SEQ ID NO: 59936 - RNA, 29 nt, Artificial Sequence
  Synthetic Oligonucleotide; CD80 exon 7; Set C
uaaaaaugauaaguaaguuucccuugaau

SEQ ID NO: 59937 - RNA, 25 nt, Artificial Sequence
  Synthetic Oligonucleotide; CD80 exon 7; Set C
aaaaugauaaguaaguuucccuuga

SEQ ID NO: 59938 - RNA, 27 nt, Artificial Sequence
  Synthetic Oligonucleotide; CD80 exon 7; Set C
aaaaaugauaaguaaguuucccuugaa

SEQ ID NO: 59939 - RNA, 30 nt, Artificial Sequence
  Synthetic Oligonucleotide; CD80 exon 7; Set C
auaaaaaugauaaguaaguuucccuugaau

SEQ ID NO: 59940 - RNA, 26 nt, Artificial Sequence
  Synthetic Oligonucleotide; CD80 exon 7; Set C
aaaaaugauaaguaaguuucccuuga

SEQ ID NO: 59941 - RNA, 28 nt, Artificial Sequence
  Synthetic Oligonucleotide; CD80 exon 7; Set C
uaaaaaugauaaguaaguuucccuugaa

SEQ ID NO: 59942 - RNA, 15 nt, Artificial Sequence
  Synthetic Oligonucleotide; CD80 exon 7; Set C
ugauaaguaaguuuc

SEQ ID NO: 59943 - RNA, 31 nt, Artificial Sequence
  Synthetic Oligonucleotide; CD80 exon 7; Set C
aauaaaaaugauaaguaaguuucccuugaau

SEQ ID NO: 59944 - RNA, 29 nt, Artificial Sequence
  Synthetic Oligonucleotide; CD80 exon 7; Set C
auaaaaaugauaaguaaguuucccuugaa

SEQ ID NO: 59945 - RNA, 27 nt, Artificial Sequence
  Synthetic Oligonucleotide; CD80 exon 7; Set C
uaaaaaugauaaguaaguuucccuuga

SEQ ID NO: 59946 - RNA, 16 nt, Artificial Sequence
  Synthetic Oligonucleotide; CD80 exon 7; Set C
augauaaguaaguuuc

SEQ ID NO: 59947 - RNA, 32 nt, Artificial Sequence
  Synthetic Oligonucleotide; CD80 exon 7; Set C
caauaaaaaugauaaguaaguuucccuugaau

SEQ ID NO: 59948 - RNA, 30 nt, Artificial Sequence
  Synthetic Oligonucleotide; CD80 exon 7; Set C
aauaaaaaugauaaguaaguuucccuugaa

SEQ ID NO: 59949 - RNA, 28 nt, Artificial Sequence
  Synthetic Oligonucleotide; CD80 exon 7; Set C
auaaaaaugauaaguaaguuucccuuga

SEQ ID NO: 59950 - RNA, 15 nt, Artificial Sequence
  Synthetic Oligonucleotide; CD80 exon 7; Set C
augauaaguaaguuu

SEQ ID NO: 59951 - RNA, 33 nt, Artificial Sequence
  Synthetic Oligonucleotide; CD80 exon 7; Set C
acaauaaaaaugauaaguaaguuucccuugaau

SEQ ID NO: 59952 - RNA, 29 nt, Artificial Sequence
  Synthetic Oligonucleotide; CD80 exon 7; Set C
aauaaaaaugauaaguaaguuucccuuga

SEQ ID NO: 59953 - RNA, 31 nt, Artificial Sequence
  Synthetic Oligonucleotide; CD80 exon 7; Set C
caauaaaaaugauaaguaaguuucccuugaa

SEQ ID NO: 59954 - RNA, 30 nt, Artificial Sequence
  Synthetic Oligonucleotide; CD80 exon 7; Set C
caauaaaaaugauaaguaaguuucccuuga

SEQ ID NO: 59955 - RNA, 32 nt, Artificial Sequence
  Synthetic Oligonucleotide; CD80 exon 7; Set C
acaauaaaaaugauaaguaaguuucccuugaa

SEQ ID NO: 59956 - RNA, 31 nt, Artificial Sequence
  Synthetic Oligonucleotide; CD80 exon 7; Set C
acaauaaaaaugauaaguaaguuucccuuga

SEQ ID NO: 59957 - RNA, 15 nt, Artificial Sequence
  Synthetic Oligonucleotide; CD80 exon 7; Set C
aaugauaaguaaguu

SEQ ID NO: 59958 - RNA, 36 nt, Artificial Sequence
  Synthetic Oligonucleotide; CD80 exon 7; Set C
caaacaauaaaaaugauaaguaaguuucccuugaau

SEQ ID NO: 59959 - RNA, 16 nt, Artificial Sequence
  Synthetic Oligonucleotide; CD80 exon 7; Set C
aaaugauaaguaaguu

SEQ ID NO: 59960 - RNA, 37 nt, Artificial Sequence
  Synthetic Oligonucleotide; CD80 exon 7; Set C
acaaacaauaaaaaugauaaguaaguuucccuugaau

SEQ ID NO: 59961 - RNA, 35 nt, Artificial Sequence
  Synthetic Oligonucleotide; CD80 exon 7; Set C
caaacaauaaaaaugauaaguaaguuucccuugaa

SEQ ID NO: 59962 - RNA, 17 nt, Artificial Sequence
  Synthetic Oligonucleotide; CD80 exon 7; Set C
aaaaugauaaguaaguu

SEQ ID NO: 59963 - RNA, 15 nt, Artificial Sequence
  Synthetic Oligonucleotide; CD80 exon 7; Set C
aaaugauaaguaagu

SEQ ID NO: 59964 - RNA, 38 nt, Artificial Sequence
  Synthetic Oligonucleotide; CD80 exon 7; Set C
aacaaacaauaaaaaugauaaguaaguuucccuugaau

SEQ ID NO: 59965 - RNA, 36 nt, Artificial Sequence
  Synthetic Oligonucleotide; CD80 exon 7; Set C
acaaacaauaaaaaugauaaguaaguuucccuugaa

SEQ ID NO: 59966 - RNA, 34 nt, Artificial Sequence
  Synthetic Oligonucleotide; CD80 exon 7; Set C
caaacaauaaaaaugauaaguaaguuucccuuga

SEQ ID NO: 59967 - RNA, 18 nt, Artificial Sequence
  Synthetic Oligonucleotide; CD80 exon 7; Set C
aaaaaugauaaguaaguu

SEQ ID NO: 59968 - RNA, 16 nt, Artificial Sequence
  Synthetic Oligonucleotide; CD80 exon 7; Set C
aaaaugauaaguaagu

SEQ ID NO: 59969 - RNA, 35 nt, Artificial Sequence
  Synthetic Oligonucleotide; CD80 exon 7; Set C
acaaacaauaaaaaugauaaguaaguuucccuuga

SEQ ID NO: 59970 - RNA, 37 nt, Artificial Sequence
  Synthetic Oligonucleotide; CD80 exon 7; Set C
aacaaacaauaaaaaugauaaguaaguuucccuugaa

SEQ ID NO: 59971 - RNA, 15 nt, Artificial Sequence
  Synthetic Oligonucleotide; CD80 exon 7; Set C
aaaaugauaaguaag

SEQ ID NO: 59972 - RNA, 19 nt, Artificial Sequence
  Synthetic Oligonucleotide; CD80 exon 7; Set C
uaaaaaugauaaguaaguu

SEQ ID NO: 59973 - RNA, 17 nt, Artificial Sequence
  Synthetic Oligonucleotide; CD80 exon 7; Set C
aaaaaugauaaguaagu

SEQ ID NO: 59974 - RNA, 36 nt, Artificial Sequence
  Synthetic Oligonucleotide; CD80 exon 7; Set C
aacaaacaauaaaaaugauaaguaaguuucccuuga

SEQ ID NO: 59975 - RNA, 16 nt, Artificial Sequence
  Synthetic Oligonucleotide; CD80 exon 7; Set C
aaaaaugauaaguaag

SEQ ID NO: 59976 - RNA, 20 nt, Artificial Sequence
  Synthetic Oligonucleotide; CD80 exon 7; Set C
auaaaaaugauaaguaaguu

SEQ ID NO: 59977 - RNA, 18 nt, Artificial Sequence
  Synthetic Oligonucleotide; CD80 exon 7; Set C
uaaaaaugauaaguaagu

SEQ ID NO: 59978 - RNA, 25 nt, Artificial Sequence
  Synthetic Oligonucleotide; CD80 exon 7; Set C
acaauaaaaaugauaaguaaguuuc

SEQ ID NO: 59979 - RNA, 15 nt, Artificial Sequence
  Synthetic Oligonucleotide; CD80 exon 7; Set C
aaaaaugauaaguaa

SEQ ID NO: 59980 - RNA, 17 nt, Artificial Sequence
  Synthetic Oligonucleotide; CD80 exon 7; Set C
uaaaaaugauaaguaag

SEQ ID NO: 59981 - RNA, 21 nt, Artificial Sequence
  Synthetic Oligonucleotide; CD80 exon 7; Set C
aauaaaaaugauaaguaaguu

SEQ ID NO: 59982 - RNA, 19 nt, Artificial Sequence
  Synthetic Oligonucleotide; CD80 exon 7; Set C
auaaaaaugauaaguaagu

SEQ ID NO: 59983 - RNA, 26 nt, Artificial Sequence
  Synthetic Oligonucleotide; CD80 exon 7; Set C
aacaauaaaaaugauaaguaaguuuc

SEQ ID NO: 59984 - RNA, 16 nt, Artificial Sequence
  Synthetic Oligonucleotide; CD80 exon 7; Set C
uaaaaaugauaaguaa

SEQ ID NO: 59985 - RNA, 18 nt, Artificial Sequence
  Synthetic Oligonucleotide; CD80 exon 7; Set C
auaaaaaugauaaguaag

SEQ ID NO: 59986 - RNA, 22 nt, Artificial Sequence
  Synthetic Oligonucleotide; CD80 exon 7; Set C
caauaaaaaugauaaguaaguu

SEQ ID NO: 59987 - RNA, 20 nt, Artificial Sequence
  Synthetic Oligonucleotide; CD80 exon 7; Set C
aauaaaaaugauaaguaagu

SEQ ID NO: 59988 - RNA, 25 nt, Artificial Sequence
  Synthetic Oligonucleotide; CD80 exon 7; Set C
aacaauaaaaaugauaaguaaguuu

SEQ ID NO: 59989 - RNA, 27 nt, Artificial Sequence
  Synthetic Oligonucleotide; CD80 exon 7; Set C
aaacaauaaaaaugauaaguaaguuuc

SEQ ID NO: 59990 - RNA, 17 nt, Artificial Sequence
  Synthetic Oligonucleotide; CD80 exon 7; Set C
auaaaaaugauaaguaa

SEQ ID NO: 59991 - RNA, 19 nt, Artificial Sequence
  Synthetic Oligonucleotide; CD80 exon 7; Set C
aauaaaaaugauaaguaag

SEQ ID NO: 59992 - RNA, 23 nt, Artificial Sequence
  Synthetic Oligonucleotide; CD80 exon 7; Set C
acaauaaaaaugauaaguaaguu

SEQ ID NO: 59993 - RNA, 21 nt, Artificial Sequence
  Synthetic Oligonucleotide; CD80 exon 7; Set C
caauaaaaaugauaaguaagu

SEQ ID NO: 59994 - RNA, 26 nt, Artificial Sequence
  Synthetic Oligonucleotide; CD80 exon 7; Set C
aaacaauaaaaaugauaaguaaguuu

SEQ ID NO: 59995 - RNA, 28 nt, Artificial Sequence
  Synthetic Oligonucleotide; CD80 exon 7; Set C
caaacaauaaaaaugauaaguaaguuuc

SEQ ID NO: 59996 - RNA, 18 nt, Artificial Sequence
  Synthetic Oligonucleotide; CD80 exon 7; Set C
aauaaaaaugauaaguaa

SEQ ID NO: 59997 - RNA, 20 nt, Artificial Sequence
  Synthetic Oligonucleotide; CD80 exon 7; Set C
caauaaaaaugauaaguaag

SEQ ID NO: 59998 - RNA, 22 nt, Artificial Sequence
  Synthetic Oligonucleotide; CD80 exon 7; Set C
acaauaaaaaugauaaguaagu

SEQ ID NO: 59999 - RNA, 27 nt, Artificial Sequence
  Synthetic Oligonucleotide; CD80 exon 7; Set C
caaacaauaaaaaugauaaguaaguuu

SEQ ID NO: 60000 - RNA, 19 nt, Artificial Sequence
  Synthetic Oligonucleotide; CD80 exon 7; Set C
caauaaaaaugauaaguaa

SEQ ID NO: 60001 - RNA, 21 nt, Artificial Sequence
  Synthetic Oligonucleotide; CD80 exon 7; Set C
acaauaaaaaugauaaguaag

SEQ ID NO: 60002 - RNA, 20 nt, Artificial Sequence
  Synthetic Oligonucleotide; CD80 exon 7; Set C
acaauaaaaaugauaaguaa

SEQ ID NO: 60003 - RNA, 26 nt, Artificial Sequence
  Synthetic Oligonucleotide; CD80 exon 7; Set C
caaacaauaaaaaugauaaguaaguu

SEQ ID NO: 60004 - RNA, 31 nt, Artificial Sequence
  Synthetic Oligonucleotide; CD80 exon 7; Set C
gaacaaacaauaaaaaugauaaguaaguuuc

SEQ ID NO: 60005 - RNA, 19 nt, Artificial Sequence
  Synthetic Oligonucleotide; CD80 exon 7; Set C
acaauaaaaaugauaagua

SEQ ID NO: 60006 - RNA, 27 nt, Artificial Sequence
  Synthetic Oligonucleotide; CD80 exon 7; Set C
acaaacaauaaaaaugauaaguaaguu

SEQ ID NO: 60007 - RNA, 25 nt, Artificial Sequence
  Synthetic Oligonucleotide; CD80 exon 7; Set C
caaacaauaaaaaugauaaguaagu

SEQ ID NO: 60008 - RNA, 30 nt, Artificial Sequence
  Synthetic Oligonucleotide; CD80 exon 7; Set C
gaacaaacaauaaaaaugauaaguaaguuu

SEQ ID NO: 60009 - RNA, 32 nt, Artificial Sequence
  Synthetic Oligonucleotide; CD80 exon 7; Set C
agaacaaacaauaaaaaugauaaguaaguuuc

SEQ ID NO: 60010 - RNA, 20 nt, Artificial Sequence
  Synthetic Oligonucleotide; CD80 exon 7; Set C
aacaauaaaaaugauaagua

SEQ ID NO: 60011 - RNA, 22 nt, Artificial Sequence
  Synthetic Oligonucleotide; CD80 exon 7; Set C
aaacaauaaaaaugauaaguaa

SEQ ID NO: 60012 - RNA, 24 nt, Artificial Sequence
  Synthetic Oligonucleotide; CD80 exon 7; Set C
caaacaauaaaaaugauaaguaag

SEQ ID NO: 60013 - RNA, 28 nt, Artificial Sequence
  Synthetic Oligonucleotide; CD80 exon 7; Set C
aacaaacaauaaaaaugauaaguaaguu

SEQ ID NO: 60014 - RNA, 26 nt, Artificial Sequence
  Synthetic Oligonucleotide; CD80 exon 7; Set C
acaaacaauaaaaaugauaaguaagu

SEQ ID NO: 60015 - RNA, 19 nt, Artificial Sequence
  Synthetic Oligonucleotide; CD80 exon 7; Set C
aacaauaaaaaugauaagu

SEQ ID NO: 60016 - RNA, 31 nt, Artificial Sequence
  Synthetic Oligonucleotide; CD80 exon 7; Set C
agaacaaacaauaaaaaugauaaguaaguuu

SEQ ID NO: 60017 - RNA, 33 nt, Artificial Sequence
  Synthetic Oligonucleotide; CD80 exon 7; Set C
aagaacaaacaauaaaaaugauaaguaaguuuc

SEQ ID NO: 60018 - RNA, 21 nt, Artificial Sequence
  Synthetic Oligonucleotide; CD80 exon 7; Set C
aaacaauaaaaaugauaagua

SEQ ID NO: 60019 - RNA, 23 nt, Artificial Sequence
  Synthetic Oligonucleotide; CD80 exon 7; Set C
caaacaauaaaaaugauaaguaa

SEQ ID NO: 60020 - RNA, 25 nt, Artificial Sequence
  Synthetic Oligonucleotide; CD80 exon 7; Set C
acaaacaauaaaaaugauaaguaag

SEQ ID NO: 60021 - RNA, 27 nt, Artificial Sequence
  Synthetic Oligonucleotide; CD80 exon 7; Set C
aacaaacaauaaaaaugauaaguaagu

SEQ ID NO: 60022 - RNA, 20 nt, Artificial Sequence
  Synthetic Oligonucleotide; CD80 exon 7; Set C
aaacaauaaaaaugauaagu

SEQ ID NO: 60023 - RNA, 18 nt, Artificial Sequence
  Synthetic Oligonucleotide; CD80 exon 7; Set C
aacaauaaaaaugauaag

SEQ ID NO: 60024 - RNA, 32 nt, Artificial Sequence
  Synthetic Oligonucleotide; CD80 exon 7; Set C
aagaacaaacaauaaaaaugauaaguaaguuu

SEQ ID NO: 60025 - RNA, 22 nt, Artificial Sequence
  Synthetic Oligonucleotide; CD80 exon 7; Set C
caaacaauaaaaaugauaagua

SEQ ID NO: 60026 - RNA, 24 nt, Artificial Sequence
  Synthetic Oligonucleotide; CD80 exon 7; Set C
acaaacaauaaaaaugauaaguaa

SEQ ID NO: 60027 - RNA, 26 nt, Artificial Sequence
  Synthetic Oligonucleotide; CD80 exon 7; Set C
aacaaacaauaaaaaugauaaguaag

SEQ ID NO: 60028 - RNA, 19 nt, Artificial Sequence
  Synthetic Oligonucleotide; CD80 exon 7; Set C
aaacaauaaaaaugauaag

SEQ ID NO: 60029 - RNA, 17 nt, Artificial Sequence
  Synthetic Oligonucleotide; CD80 exon 7; Set C
aacaauaaaaaugauaa

SEQ ID NO: 60030 - RNA, 25 nt, Artificial Sequence
  Synthetic Oligonucleotide; CD80 exon 7; Set C
aacaaacaauaaaaaugauaaguaa

SEQ ID NO: 60031 - RNA, 18 nt, Artificial Sequence
  Synthetic Oligonucleotide; CD80 exon 7; Set C
aaacaauaaaaaugauaa

SEQ ID NO: 60032 - RNA, 16 nt, Artificial Sequence
  Synthetic Oligonucleotide; CD80 exon 7; Set C
aacaauaaaaaugaua

SEQ ID NO: 60033 - RNA, 34 nt, Artificial Sequence
  Synthetic Oligonucleotide; CD80 exon 7; Set C
acaagaacaaacaauaaaaaugauaaguaaguuu

SEQ ID NO: 60034 - RNA, 24 nt, Artificial Sequence
  Synthetic Oligonucleotide; CD80 exon 7; Set C
aacaaacaauaaaaaugauaagua

SEQ ID NO: 60035 - RNA, 17 nt, Artificial Sequence
  Synthetic Oligonucleotide; CD80 exon 7; Set C
aaacaauaaaaaugaua

SEQ ID NO: 60036 - RNA, 25 nt, Artificial Sequence
  Synthetic Oligonucleotide; CD80 exon 7; Set C
gaacaaacaauaaaaaugauaagua

SEQ ID NO: 60037 - RNA, 24 nt, Artificial Sequence
  Synthetic Oligonucleotide; CD80 exon 7; Set C
gaacaaacaauaaaaaugauaagu

SEQ ID NO: 60038 - RNA, 18 nt, Artificial Sequence
  Synthetic Oligonucleotide; CD80 exon 7; Set C
caaacaauaaaaaugaua

SEQ ID NO: 60039 - RNA, 26 nt, Artificial Sequence
  Synthetic Oligonucleotide; CD80 exon 7; Set C
agaacaaacaauaaaaaugauaagua

SEQ ID NO: 60040 - RNA, 16 nt, Artificial Sequence
  Synthetic Oligonucleotide; CD80 exon 7; Set C
aaacaauaaaaaugau

SEQ ID NO: 60041 - RNA, 34 nt, Artificial Sequence
  Synthetic Oligonucleotide; CD80 exon 7; Set C
gacaagaacaaacaauaaaaaugauaaguaaguu

SEQ ID NO: 60042 - RNA, 23 nt, Artificial Sequence
  Synthetic Oligonucleotide; CD80 exon 7; Set C
gaacaaacaauaaaaaugauaag

SEQ ID NO: 60043 - RNA, 25 nt, Artificial Sequence
  Synthetic Oligonucleotide; CD80 exon 7; Set C
agaacaaacaauaaaaaugauaagu

SEQ ID NO: 60044 - RNA, 27 nt, Artificial Sequence
  Synthetic Oligonucleotide; CD80 exon 7; Set C
aagaacaaacaauaaaaaugauaagua

SEQ ID NO: 60045 - RNA, 17 nt, Artificial Sequence
  Synthetic Oligonucleotide; CD80 exon 7; Set C
caaacaauaaaaaugau

SEQ ID NO: 60046 - RNA, 15 nt, Artificial Sequence
  Synthetic Oligonucleotide; CD80 exon 7; Set C
aaacaauaaaaauga

SEQ ID NO: 60047 - RNA, 35 nt, Artificial Sequence
  Synthetic Oligonucleotide; CD80 exon 7; Set C
agacaagaacaaacaauaaaaaugauaaguaaguu

SEQ ID NO: 60048 - RNA, 33 nt, Artificial Sequence
  Synthetic Oligonucleotide; CD80 exon 7; Set C
gacaagaacaaacaauaaaaaugauaaguaagu

SEQ ID NO: 60049 - RNA, 22 nt, Artificial Sequence
  Synthetic Oligonucleotide; CD80 exon 7; Set C
gaacaaacaauaaaaaugauaa

SEQ ID NO: 60050 - RNA, 24 nt, Artificial Sequence
  Synthetic Oligonucleotide; CD80 exon 7; Set C
agaacaaacaauaaaaaugauaag

SEQ ID NO: 60051 - RNA, 26 nt, Artificial Sequence
  Synthetic Oligonucleotide; CD80 exon 7; Set C
aagaacaaacaauaaaaaugauaagu

SEQ ID NO: 60052 - RNA, 18 nt, Artificial Sequence
  Synthetic Oligonucleotide; CD80 exon 7; Set C
acaaacaauaaaaaugau

SEQ ID NO: 60053 - RNA, 16 nt, Artificial Sequence
  Synthetic Oligonucleotide; CD80 exon 7; Set C
caaacaauaaaaauga

SEQ ID NO: 60054 - RNA, 32 nt, Artificial Sequence
  Synthetic Oligonucleotide; CD80 exon 7; Set C
gacaagaacaaacaauaaaaaugauaaguaag

SEQ ID NO: 60055 - RNA, 36 nt, Artificial Sequence
  Synthetic Oligonucleotide; CD80 exon 7; Set C
gagacaagaacaaacaauaaaaaugauaaguaaguu

SEQ ID NO: 60056 - RNA, 34 nt, Artificial Sequence
  Synthetic Oligonucleotide; CD80 exon 7; Set C
agacaagaacaaacaauaaaaaugauaaguaagu

SEQ ID NO: 60057 - RNA, 23 nt, Artificial Sequence
  Synthetic Oligonucleotide; CD80 exon 7; Set C
agaacaaacaauaaaaaugauaa

SEQ ID NO: 60058 - RNA, 25 nt, Artificial Sequence
  Synthetic Oligonucleotide; CD80 exon 7; Set C
aagaacaaacaauaaaaaugauaag

SEQ ID NO: 60059 - RNA, 27 nt, Artificial Sequence
  Synthetic Oligonucleotide; CD80 exon 7; Set C
caagaacaaacaauaaaaaugauaagu

SEQ ID NO: 60060 - RNA, 21 nt, Artificial Sequence
  Synthetic Oligonucleotide; CD80 exon 7; Set C
gaacaaacaauaaaaaugaua

SEQ ID NO: 60061 - RNA, 31 nt, Artificial Sequence
  Synthetic Oligonucleotide; CD80 exon 7; Set C
gacaagaacaaacaauaaaaaugauaaguaa

SEQ ID NO: 60062 - RNA, 19 nt, Artificial Sequence
  Synthetic Oligonucleotide; CD80 exon 7; Set C
aacaaacaauaaaaaugau

SEQ ID NO: 60063 - RNA, 17 nt, Artificial Sequence
  Synthetic Oligonucleotide; CD80 exon 7; Set C
acaaacaauaaaaauga

SEQ ID NO: 60064 - RNA, 15 nt, Artificial Sequence
  Synthetic Oligonucleotide; CD80 exon 7; Set C
caaacaauaaaaaug

SEQ ID NO: 60065 - RNA, 33 nt, Artificial Sequence
  Synthetic Oligonucleotide; CD80 exon 7; Set C
agacaagaacaaacaauaaaaaugauaaguaag

SEQ ID NO: 60066 - RNA, 37 nt, Artificial Sequence
  Synthetic Oligonucleotide; CD80 exon 7; Set C
ggagacaagaacaaacaauaaaaaugauaaguaaguu

SEQ ID NO: 60067 - RNA, 35 nt, Artificial Sequence
  Synthetic Oligonucleotide; CD80 exon 7; Set C
gagacaagaacaaacaauaaaaaugauaaguaagu

SEQ ID NO: 60068 - RNA, 24 nt, Artificial Sequence
  Synthetic Oligonucleotide; CD80 exon 7; Set C
aagaacaaacaauaaaaaugauaa

SEQ ID NO: 60069 - RNA, 28 nt, Artificial Sequence
  Synthetic Oligonucleotide; CD80 exon 7; Set C
acaagaacaaacaauaaaaaugauaagu

SEQ ID NO: 60070 - RNA, 26 nt, Artificial Sequence
  Synthetic Oligonucleotide; CD80 exon 7; Set C
caagaacaaacaauaaaaaugauaag

SEQ ID NO: 60071 - RNA, 22 nt, Artificial Sequence
  Synthetic Oligonucleotide; CD80 exon 7; Set C
agaacaaacaauaaaaaugaua

SEQ ID NO: 60072 - RNA, 30 nt, Artificial Sequence
  Synthetic Oligonucleotide; CD80 exon 7; Set C
gacaagaacaaacaauaaaaaugauaagua

SEQ ID NO: 60073 - RNA, 32 nt, Artificial Sequence
  Synthetic Oligonucleotide; CD80 exon 7; Set C
agacaagaacaaacaauaaaaaugauaaguaa

SEQ ID NO: 60074 - RNA, 16 nt, Artificial Sequence
  Synthetic Oligonucleotide; CD80 exon 7; Set C
acaaacaauaaaaaug

SEQ ID NO: 60075 - RNA, 18 nt, Artificial Sequence
  Synthetic Oligonucleotide; CD80 exon 7; Set C
aacaaacaauaaaaauga

SEQ ID NO: 60076 - RNA, 34 nt, Artificial Sequence
  Synthetic Oligonucleotide; CD80 exon 7; Set C
gagacaagaacaaacaauaaaaaugauaaguaag

SEQ ID NO: 60077 - RNA, 38 nt, Artificial Sequence
  Synthetic Oligonucleotide; CD80 exon 7; Set C
uggagacaagaacaaacaauaaaaaugauaaguaaguu

SEQ ID NO: 60078 - RNA, 36 nt, Artificial Sequence
  Synthetic Oligonucleotide; CD80 exon 7; Set C
ggagacaagaacaaacaauaaaaaugauaaguaagu

SEQ ID NO: 60079 - RNA, 27 nt, Artificial Sequence
  Synthetic Oligonucleotide; CD80 exon 7; Set C
acaagaacaaacaauaaaaaugauaag

SEQ ID NO: 60080 - RNA, 25 nt, Artificial Sequence
  Synthetic Oligonucleotide; CD80 exon 7; Set C
caagaacaaacaauaaaaaugauaa

SEQ ID NO: 60081 - RNA, 23 nt, Artificial Sequence
  Synthetic Oligonucleotide; CD80 exon 7; Set C
aagaacaaacaauaaaaaugaua

SEQ ID NO: 60082 - RNA, 33 nt, Artificial Sequence
  Synthetic Oligonucleotide; CD80 exon 7; Set C
gagacaagaacaaacaauaaaaaugauaaguaa

SEQ ID NO: 60083 - RNA, 17 nt, Artificial Sequence
  Synthetic Oligonucleotide; CD80 exon 7; Set C
aacaaacaauaaaaaug

SEQ ID NO: 60084 - RNA, 35 nt, Artificial Sequence
  Synthetic Oligonucleotide; CD80 exon 7; Set C
ggagacaagaacaaacaauaaaaaugauaaguaag

SEQ ID NO: 60085 - RNA, 39 nt, Artificial Sequence
  Synthetic Oligonucleotide; CD80 exon 7; Set C
uuggagacaagaacaaacaauaaaaaugauaaguaaguu

SEQ ID NO: 60086 - RNA, 37 nt, Artificial Sequence
  Synthetic Oligonucleotide; CD80 exon 7; Set C
uggagacaagaacaaacaauaaaaaugauaaguaagu

SEQ ID NO: 60087 - RNA, 26 nt, Artificial Sequence
  Synthetic Oligonucleotide; CD80 exon 7; Set C
acaagaacaaacaauaaaaaugauaa

SEQ ID NO: 60088 - RNA, 34 nt, Artificial Sequence
  Synthetic Oligonucleotide; CD80 exon 7; Set C
ggagacaagaacaaacaauaaaaaugauaaguaa

SEQ ID NO: 60089 - RNA, 36 nt, Artificial Sequence
  Synthetic Oligonucleotide; CD80 exon 7; Set C
uggagacaagaacaaacaauaaaaaugauaaguaag

SEQ ID NO: 60090 - RNA, 40 nt, Artificial Sequence
  Synthetic Oligonucleotide; CD80 exon 7; Set C
cuuggagacaagaacaaacaauaaaaaugauaaguaaguu

SEQ ID NO: 60091 - RNA, 38 nt, Artificial Sequence
  Synthetic Oligonucleotide; CD80 exon 7; Set C
uuggagacaagaacaaacaauaaaaaugauaaguaagu

SEQ ID NO: 60092 - RNA, 25 nt, Artificial Sequence
  Synthetic Oligonucleotide; CD80 exon 7; Set C
acaagaacaaacaauaaaaaugaua

SEQ ID NO: 60093 - RNA, 17 nt, Artificial Sequence
  Synthetic Oligonucleotide; CD80 exon 7; Set C
gaacaaacaauaaaaau

SEQ ID NO: 60094 - RNA, 33 nt, Artificial Sequence
  Synthetic Oligonucleotide; CD80 exon 7; Set C
ggagacaagaacaaacaauaaaaaugauaagua

SEQ ID NO: 60095 - RNA, 35 nt, Artificial Sequence
  Synthetic Oligonucleotide; CD80 exon 7; Set C
uggagacaagaacaaacaauaaaaaugauaaguaa

SEQ ID NO: 60096 - RNA, 37 nt, Artificial Sequence
  Synthetic Oligonucleotide; CD80 exon 7; Set C
uuggagacaagaacaaacaauaaaaaugauaaguaag

SEQ ID NO: 60097 - RNA, 39 nt, Artificial Sequence
  Synthetic Oligonucleotide; CD80 exon 7; Set C
cuuggagacaagaacaaacaauaaaaaugauaaguaagu

SEQ ID NO: 60098 - RNA, 16 nt, Artificial Sequence
  Synthetic Oligonucleotide; CD80 exon 7; Set C
gaacaaacaauaaaaa

SEQ ID NO: 60099 - RNA, 18 nt, Artificial Sequence
  Synthetic Oligonucleotide; CD80 exon 7; Set C
agaacaaacaauaaaaau

SEQ ID NO: 60100 - RNA, 34 nt, Artificial Sequence
  Synthetic Oligonucleotide; CD80 exon 7; Set C
uggagacaagaacaaacaauaaaaaugauaagua

SEQ ID NO: 60101 - RNA, 36 nt, Artificial Sequence
  Synthetic Oligonucleotide; CD80 exon 7; Set C
uuggagacaagaacaaacaauaaaaaugauaaguaa

SEQ ID NO: 60102 - RNA, 38 nt, Artificial Sequence
  Synthetic Oligonucleotide; CD80 exon 7; Set C
cuuggagacaagaacaaacaauaaaaaugauaaguaag

SEQ ID NO: 60103 - RNA, 17 nt, Artificial Sequence
  Synthetic Oligonucleotide; CD80 exon 7; Set C
agaacaaacaauaaaaa

SEQ ID NO: 60104 - RNA, 15 nt, Artificial Sequence
  Synthetic Oligonucleotide; CD80 exon 7; Set C
gaacaaacaauaaaa

SEQ ID NO: 60105 - RNA, 19 nt, Artificial Sequence
  Synthetic Oligonucleotide; CD80 exon 7; Set C
aagaacaaacaauaaaaau

SEQ ID NO: 60106 - RNA, 35 nt, Artificial Sequence
  Synthetic Oligonucleotide; CD80 exon 7; Set C
uuggagacaagaacaaacaauaaaaaugauaagua

SEQ ID NO: 60107 - RNA, 37 nt, Artificial Sequence
  Synthetic Oligonucleotide; CD80 exon 7; Set C
cuuggagacaagaacaaacaauaaaaaugauaaguaa

SEQ ID NO: 60108 - RNA, 25 nt, Artificial Sequence
  Synthetic Oligonucleotide; CD80 exon 7; Set C
gacaagaacaaacaauaaaaaugau

SEQ ID NO: 60109 - RNA, 18 nt, Artificial Sequence
  Synthetic Oligonucleotide; CD80 exon 7; Set C
aagaacaaacaauaaaaa

SEQ ID NO: 60110 - RNA, 16 nt, Artificial Sequence
  Synthetic Oligonucleotide; CD80 exon 7; Set C
agaacaaacaauaaaa

SEQ ID NO: 60111 - RNA, 36 nt, Artificial Sequence
  Synthetic Oligonucleotide; CD80 exon 7; Set C
cuuggagacaagaacaaacaauaaaaaugauaagua

SEQ ID NO: 60112 - RNA, 26 nt, Artificial Sequence
  Synthetic Oligonucleotide; CD80 exon 7; Set C
agacaagaacaaacaauaaaaaugau

SEQ ID NO: 60113 - RNA, 24 nt, Artificial Sequence
  Synthetic Oligonucleotide; CD80 exon 7; Set C
gacaagaacaaacaauaaaaauga

SEQ ID NO: 60114 - RNA, 17 nt, Artificial Sequence
  Synthetic Oligonucleotide; CD80 exon 7; Set C
aagaacaaacaauaaaa

SEQ ID NO: 60115 - RNA, 15 nt, Artificial Sequence
  Synthetic Oligonucleotide; CD80 exon 7; Set C
agaacaaacaauaaa

SEQ ID NO: 60116 - RNA, 37 nt, Artificial Sequence
  Synthetic Oligonucleotide; CD80 exon 7; Set C
ccuuggagacaagaacaaacaauaaaaaugauaagua

SEQ ID NO: 60117 - RNA, 27 nt, Artificial Sequence
  Synthetic Oligonucleotide; CD80 exon 7; Set C
gagacaagaacaaacaauaaaaaugau

SEQ ID NO: 60118 - RNA, 25 nt, Artificial Sequence
  Synthetic Oligonucleotide; CD80 exon 7; Set C
agacaagaacaaacaauaaaaauga

SEQ ID NO: 60119 - RNA, 23 nt, Artificial Sequence
  Synthetic Oligonucleotide; CD80 exon 7; Set C
gacaagaacaaacaauaaaaaug

SEQ ID NO: 60120 - RNA, 36 nt, Artificial Sequence
  Synthetic Oligonucleotide; CD80 exon 7; Set C
ccuuggagacaagaacaaacaauaaaaaugauaagu

SEQ ID NO: 60121 - RNA, 20 nt, Artificial Sequence
  Synthetic Oligonucleotide; CD80 exon 7; Set C
acaagaacaaacaauaaaaa

SEQ ID NO: 60122 - RNA, 16 nt, Artificial Sequence
  Synthetic Oligonucleotide; CD80 exon 7; Set C
aagaacaaacaauaaa

SEQ ID NO: 60123 - RNA, 22 nt, Artificial Sequence
  Synthetic Oligonucleotide; CD80 exon 7; Set C
gacaagaacaaacaauaaaaau

SEQ ID NO: 60124 - RNA, 28 nt, Artificial Sequence
  Synthetic Oligonucleotide; CD80 exon 7; Set C
ggagacaagaacaaacaauaaaaaugau

SEQ ID NO: 60125 - RNA, 26 nt, Artificial Sequence
  Synthetic Oligonucleotide; CD80 exon 7; Set C
gagacaagaacaaacaauaaaaauga

SEQ ID NO: 60126 - RNA, 24 nt, Artificial Sequence
  Synthetic Oligonucleotide; CD80 exon 7; Set C
agacaagaacaaacaauaaaaaug

SEQ ID NO: 60127 - RNA, 35 nt, Artificial Sequence
  Synthetic Oligonucleotide; CD80 exon 7; Set C
ccuuggagacaagaacaaacaauaaaaaugauaag

SEQ ID NO: 60128 - RNA, 37 nt, Artificial Sequence
  Synthetic Oligonucleotide; CD80 exon 7; Set A
gccuuggagacaagaacaaacaauaaaaaugauaagu

SEQ ID NO: 60129 - RNA, 29 nt, Artificial Sequence
  Synthetic Oligonucleotide; CD80 exon 7; Set C
uggagacaagaacaaacaauaaaaaugau

SEQ ID NO: 60130 - RNA, 25 nt, Artificial Sequence
  Synthetic Oligonucleotide; CD80 exon 7; Set C
gagacaagaacaaacaauaaaaaug

SEQ ID NO: 60131 - RNA, 27 nt, Artificial Sequence
  Synthetic Oligonucleotide; CD80 exon 7; Set C
ggagacaagaacaaacaauaaaaauga

SEQ ID NO: 60132 - RNA, 34 nt, Artificial Sequence
  Synthetic Oligonucleotide; CD80 exon 7; Set C
ccuuggagacaagaacaaacaauaaaaaugauaa

SEQ ID NO: 60133 - RNA, 38 nt, Artificial Sequence
  Synthetic Oligonucleotide; CD80 exon 7; Set A
agccuuggagacaagaacaaacaauaaaaaugauaagu

SEQ ID NO: 60134 - RNA, 36 nt, Artificial Sequence
  Synthetic Oligonucleotide; CD80 exon 7; Set C
gccuuggagacaagaacaaacaauaaaaaugauaag

SEQ ID NO: 60135 - RNA, 20 nt, Artificial Sequence
  Synthetic Oligonucleotide; CD80 exon 7; Set C
gacaagaacaaacaauaaaa

SEQ ID NO: 60136 - RNA, 30 nt, Artificial Sequence
  Synthetic Oligonucleotide; CD80 exon 7; Set C
uuggagacaagaacaaacaauaaaaaugau

SEQ ID NO: 60137 - RNA, 26 nt, Artificial Sequence
  Synthetic Oligonucleotide; CD80 exon 7; Set C
ggagacaagaacaaacaauaaaaaug

SEQ ID NO: 60138 - RNA, 28 nt, Artificial Sequence
  Synthetic Oligonucleotide; CD80 exon 7; Set C
uggagacaagaacaaacaauaaaaauga

SEQ ID NO: 60139 - RNA, 37 nt, Artificial Sequence
  Synthetic Oligonucleotide; CD80 exon 7; Set C
agccuuggagacaagaacaaacaauaaaaaugauaag

SEQ ID NO: 60140 - RNA, 35 nt, Artificial Sequence
  Synthetic Oligonucleotide; CD80 exon 7; Set C
gccuuggagacaagaacaaacaauaaaaaugauaa

SEQ ID NO: 60141 - RNA, 33 nt, Artificial Sequence
  Synthetic Oligonucleotide; CD80 exon 7; Set C
ccuuggagacaagaacaaacaauaaaaaugaua

SEQ ID NO: 60142 - RNA, 19 nt, Artificial Sequence
  Synthetic Oligonucleotide; CD80 exon 7; Set C
gacaagaacaaacaauaaa

SEQ ID NO: 60143 - RNA, 25 nt, Artificial Sequence
  Synthetic Oligonucleotide; CD80 exon 7; Set C
ggagacaagaacaaacaauaaaaau

SEQ ID NO: 60144 - RNA, 31 nt, Artificial Sequence
  Synthetic Oligonucleotide; CD80 exon 7; Set C
cuuggagacaagaacaaacaauaaaaaugau

SEQ ID NO: 60145 - RNA, 29 nt, Artificial Sequence
  Synthetic Oligonucleotide; CD80 exon 7; Set C
uuggagacaagaacaaacaauaaaaauga

SEQ ID NO: 60146 - RNA, 27 nt, Artificial Sequence
  Synthetic Oligonucleotide; CD80 exon 7; Set C
uggagacaagaacaaacaauaaaaaug

SEQ ID NO: 60147 - RNA, 36 nt, Artificial Sequence
  Synthetic Oligonucleotide; CD80 exon 7; Set C
agccuuggagacaagaacaaacaauaaaaaugauaa

SEQ ID NO: 60148 - RNA, 26 nt, Artificial Sequence
  Synthetic Oligonucleotide; CD80 exon 7; Set C
uggagacaagaacaaacaauaaaaau

SEQ ID NO: 60149 - RNA, 18 nt, Artificial Sequence
  Synthetic Oligonucleotide; CD80 exon 7; Set C
gacaagaacaaacaauaa

SEQ ID NO: 60150 - RNA, 30 nt, Artificial Sequence
  Synthetic Oligonucleotide; CD80 exon 7; Set C
cuuggagacaagaacaaacaauaaaaauga

SEQ ID NO: 60151 - RNA, 28 nt, Artificial Sequence
  Synthetic Oligonucleotide; CD80 exon 7; Set C
uuggagacaagaacaaacaauaaaaaug

SEQ ID NO: 60152 - RNA, 35 nt, Artificial Sequence
  Synthetic Oligonucleotide; CD80 exon 7; Set C
agccuuggagacaagaacaaacaauaaaaaugaua

SEQ ID NO: 60153 - RNA, 17 nt, Artificial Sequence
  Synthetic Oligonucleotide; CD80 exon 7; Set C
gacaagaacaaacaaua

SEQ ID NO: 60154 - RNA, 27 nt, Artificial Sequence
  Synthetic Oligonucleotide; CD80 exon 7; Set C
uuggagacaagaacaaacaauaaaaau

SEQ ID NO: 60155 - RNA, 29 nt, Artificial Sequence
  Synthetic Oligonucleotide; CD80 exon 7; Set C
cuuggagacaagaacaaacaauaaaaaug

SEQ ID NO: 60156 - RNA, 16 nt, Artificial Sequence
  Synthetic Oligonucleotide; CD80 exon 7; Set C
gacaagaacaaacaau

SEQ ID NO: 60157 - RNA, 22 nt, Artificial Sequence
  Synthetic Oligonucleotide; CD80 exon 7; Set C
ggagacaagaacaaacaauaaa

SEQ ID NO: 60158 - RNA, 15 nt, Artificial Sequence
  Synthetic Oligonucleotide; CD80 exon 7; Set C
gacaagaacaaacaa

SEQ ID NO: 60159 - RNA, 23 nt, Artificial Sequence
  Synthetic Oligonucleotide; CD80 exon 7; Set C
uggagacaagaacaaacaauaaa

SEQ ID NO: 60160 - RNA, 29 nt, Artificial Sequence
  Synthetic Oligonucleotide; CD80 exon 7; Set C
ccuuggagacaagaacaaacaauaaaaau

SEQ ID NO: 60161 - RNA, 21 nt, Artificial Sequence
  Synthetic Oligonucleotide; CD80 exon 7; Set C
ggagacaagaacaaacaauaa

SEQ ID NO: 60162 - RNA, 28 nt, Artificial Sequence
  Synthetic Oligonucleotide; CD80 exon 7; Set C
ccuuggagacaagaacaaacaauaaaaa

SEQ ID NO: 60163 - RNA, 24 nt, Artificial Sequence
  Synthetic Oligonucleotide; CD80 exon 7; Set C
uuggagacaagaacaaacaauaaa

SEQ ID NO: 60164 - RNA, 22 nt, Artificial Sequence
  Synthetic Oligonucleotide; CD80 exon 7; Set C
uggagacaagaacaaacaauaa

SEQ ID NO: 60165 - RNA, 29 nt, Artificial Sequence
  Synthetic Oligonucleotide; CD80 exon 7; Set C
gccuuggagacaagaacaaacaauaaaaa

SEQ ID NO: 60166 - RNA, 27 nt, Artificial Sequence
  Synthetic Oligonucleotide; CD80 exon 7; Set C
ccuuggagacaagaacaaacaauaaaa

SEQ ID NO: 60167 - RNA, 23 nt, Artificial Sequence
  Synthetic Oligonucleotide; CD80 exon 7; Set C
uuggagacaagaacaaacaauaa

SEQ ID NO: 60168 - RNA, 15 nt, Artificial Sequence
  Synthetic Oligonucleotide; CD80 exon 7; Set C
agacaagaacaaaca

SEQ ID NO: 60169 - RNA, 30 nt, Artificial Sequence
  Synthetic Oligonucleotide; CD80 exon 7; Set C
agccuuggagacaagaacaaacaauaaaaa

SEQ ID NO: 60170 - RNA, 40 nt, Artificial Sequence
  Synthetic Oligonucleotide; CD80 exon 7; Set A
ggcaaagccuuggagacaagaacaaacaauaaaaaugaua

SEQ ID NO: 60171 - RNA, 18 nt, Artificial Sequence
  Synthetic Oligonucleotide; CD80 exon 7; Set C
ggagacaagaacaaacaa

SEQ ID NO: 60172 - RNA, 26 nt, Artificial Sequence
  Synthetic Oligonucleotide; CD80 exon 7; Set C
ccuuggagacaagaacaaacaauaaa

SEQ ID NO: 60173 - RNA, 24 nt, Artificial Sequence
  Synthetic Oligonucleotide; CD80 exon 7; Set C
cuuggagacaagaacaaacaauaa

SEQ ID NO: 60174 - RNA, 16 nt, Artificial Sequence
  Synthetic Oligonucleotide; CD80 exon 7; Set C
gagacaagaacaaaca

SEQ ID NO: 60175 - RNA, 19 nt, Artificial Sequence
  Synthetic Oligonucleotide; CD80 exon 7; Set C
uggagacaagaacaaacaa

SEQ ID NO: 60176 - RNA, 25 nt, Artificial Sequence
  Synthetic Oligonucleotide; CD80 exon 7; Set C
ccuuggagacaagaacaaacaauaa

SEQ ID NO: 60177 - RNA, 17 nt, Artificial Sequence
  Synthetic Oligonucleotide; CD80 exon 7; Set C
ggagacaagaacaaaca

SEQ ID NO: 60178 - RNA, 39 nt, Artificial Sequence
  Synthetic Oligonucleotide; CD80 exon 7; Set A
ggcaaagccuuggagacaagaacaaacaauaaaaaugau

SEQ ID NO: 60179 - RNA, 15 nt, Artificial Sequence
  Synthetic Oligonucleotide; CD80 exon 7; Set C
gagacaagaacaaac

SEQ ID NO: 60180 - RNA, 24 nt, Artificial Sequence
  Synthetic Oligonucleotide; CD80 exon 7; Set C
ccuuggagacaagaacaaacaaua

SEQ ID NO: 60181 - RNA, 20 nt, Artificial Sequence
  Synthetic Oligonucleotide; CD80 exon 7; Set C
uuggagacaagaacaaacaa

SEQ ID NO: 60182 - RNA, 18 nt, Artificial Sequence
  Synthetic Oligonucleotide; CD80 exon 7; Set C
uggagacaagaacaaaca

SEQ ID NO: 60183 - RNA, 40 nt, Artificial Sequence
  Synthetic Oligonucleotide; CD80 exon 7; Set A
gggcaaagccuuggagacaagaacaaacaauaaaaaugau

SEQ ID NO: 60184 - RNA, 38 nt, Artificial Sequence
  Synthetic Oligonucleotide; CD80 exon 7; Set A
ggcaaagccuuggagacaagaacaaacaauaaaaauga

SEQ ID NO: 60185 - RNA, 16 nt, Artificial Sequence
  Synthetic Oligonucleotide; CD80 exon 7; Set C
ggagacaagaacaaac

SEQ ID NO: 60186 - RNA, 23 nt, Artificial Sequence
  Synthetic Oligonucleotide; CD80 exon 7; Set C
ccuuggagacaagaacaaacaau

SEQ ID NO: 60187 - RNA, 19 nt, Artificial Sequence
  Synthetic Oligonucleotide; CD80 exon 7; Set C
uuggagacaagaacaaaca

SEQ ID NO: 60188 - RNA, 39 nt, Artificial Sequence
  Synthetic Oligonucleotide; CD80 exon 7; Set A
gggcaaagccuuggagacaagaacaaacaauaaaaauga

SEQ ID NO: 60189 - RNA, 37 nt, Artificial Sequence
  Synthetic Oligonucleotide; CD80 exon 7; Set A
ggcaaagccuuggagacaagaacaaacaauaaaaaug

SEQ ID NO: 60190 - RNA, 15 nt, Artificial Sequence
  Synthetic Oligonucleotide; CD80 exon 7; Set C
ggagacaagaacaaa

SEQ ID NO: 60191 - RNA, 17 nt, Artificial Sequence
  Synthetic Oligonucleotide; CD80 exon 7; Set C
uggagacaagaacaaac

SEQ ID NO: 60192 - RNA, 22 nt, Artificial Sequence
  Synthetic Oligonucleotide; CD80 exon 7; Set C
ccuuggagacaagaacaaacaa

SEQ ID NO: 60193 - RNA, 36 nt, Artificial Sequence
  Synthetic Oligonucleotide; CD80 exon 7; Set A
ggcaaagccuuggagacaagaacaaacaauaaaaau

SEQ ID NO: 60194 - RNA, 20 nt, Artificial Sequence
  Synthetic Oligonucleotide; CD80 exon 7; Set C
cuuggagacaagaacaaaca

SEQ ID NO: 60195 - RNA, 40 nt, Artificial Sequence
  Synthetic Oligonucleotide; CD80 exon 7; Set A
ggggcaaagccuuggagacaagaacaaacaauaaaaauga

SEQ ID NO: 60196 - RNA, 38 nt, Artificial Sequence
  Synthetic Oligonucleotide; CD80 exon 7; Set A
gggcaaagccuuggagacaagaacaaacaauaaaaaug

SEQ ID NO: 60197 - RNA, 16 nt, Artificial Sequence
  Synthetic Oligonucleotide; CD80 exon 7; Set C
uggagacaagaacaaa

SEQ ID NO: 60198 - RNA, 18 nt, Artificial Sequence
  Synthetic Oligonucleotide; CD80 exon 7; Set C
uuggagacaagaacaaac

SEQ ID NO: 60199 - RNA, 35 nt, Artificial Sequence
  Synthetic Oligonucleotide; CD80 exon 7; Set A
ggcaaagccuuggagacaagaacaaacaauaaaaa

SEQ ID NO: 60200 - RNA, 15 nt, Artificial Sequence
  Synthetic Oligonucleotide; CD80 exon 7; Set C
uggagacaagaacaa

SEQ ID NO: 60201 - RNA, 39 nt, Artificial Sequence
  Synthetic Oligonucleotide; CD80 exon 7; Set A
ggggcaaagccuuggagacaagaacaaacaauaaaaaug

SEQ ID NO: 60202 - RNA, 17 nt, Artificial Sequence
  Synthetic Oligonucleotide; CD80 exon 7; Set C
uuggagacaagaacaaa

SEQ ID NO: 60203 - RNA, 19 nt, Artificial Sequence
  Synthetic Oligonucleotide; CD80 exon 7; Set C
cuuggagacaagaacaaac

SEQ ID NO: 60204 - RNA, 34 nt, Artificial Sequence
  Synthetic Oligonucleotide; CD80 exon 7; Set A
ggcaaagccuuggagacaagaacaaacaauaaaa

SEQ ID NO: 60205 - RNA, 16 nt, Artificial Sequence
  Synthetic Oligonucleotide; CD80 exon 7; Set C
uuggagacaagaacaa

SEQ ID NO: 60206 - RNA, 40 nt, Artificial Sequence
  Synthetic Oligonucleotide; CD80 exon 7; Set A
uggggcaaagccuuggagacaagaacaaacaauaaaaaug

SEQ ID NO: 60207 - RNA, 18 nt, Artificial Sequence
  Synthetic Oligonucleotide; CD80 exon 7; Set C
cuuggagacaagaacaaa

SEQ ID NO: 60208 - RNA, 15 nt, Artificial Sequence
  Synthetic Oligonucleotide; CD80 exon 7; Set C
uuggagacaagaaca

SEQ ID NO: 60209 - RNA, 33 nt, Artificial Sequence
  Synthetic Oligonucleotide; CD80 exon 7; Set A
ggcaaagccuuggagacaagaacaaacaauaaa

SEQ ID NO: 60210 - RNA, 17 nt, Artificial Sequence
  Synthetic Oligonucleotide; CD80 exon 7; Set C
cuuggagacaagaacaa

SEQ ID NO: 60211 - RNA, 40 nt, Artificial Sequence
  Synthetic Oligonucleotide; CD80 exon 7; Set A
uuggggcaaagccuuggagacaagaacaaacaauaaaaau

SEQ ID NO: 60212 - RNA, 32 nt, Artificial Sequence
  Synthetic Oligonucleotide; CD80 exon 7; Set A
ggcaaagccuuggagacaagaacaaacaauaa

SEQ ID NO: 60213 - RNA, 31 nt, Artificial Sequence
  Synthetic Oligonucleotide; CD80 exon 7; Set A
ggcaaagccuuggagacaagaacaaacaaua

SEQ ID NO: 60214 - RNA, 17 nt, Artificial Sequence
  Synthetic Oligonucleotide; CD80 exon 7; Set C
ccuuggagacaagaaca

SEQ ID NO: 60215 - RNA, 15 nt, Artificial Sequence
  Synthetic Oligonucleotide; CD80 exon 7; Set C
cuuggagacaagaac

SEQ ID NO: 60216 - RNA, 40 nt, Artificial Sequence
  Synthetic Oligonucleotide; CD80 exon 7; Set A
cuuggggcaaagccuuggagacaagaacaaacaauaaaaa

SEQ ID NO: 60217 - RNA, 30 nt, Artificial Sequence
  Synthetic Oligonucleotide; CD80 exon 7; Set A
ggcaaagccuuggagacaagaacaaacaau

SEQ ID NO: 60218 - RNA, 38 nt, Artificial Sequence
  Synthetic Oligonucleotide; CD80 exon 7; Set A
uuggggcaaagccuuggagacaagaacaaacaauaaaa

SEQ ID NO: 60219 - RNA, 16 nt, Artificial Sequence
  Synthetic Oligonucleotide; CD80 exon 7; Set C
ccuuggagacaagaac

SEQ ID NO: 60220 - RNA, 39 nt, Artificial Sequence
  Synthetic Oligonucleotide; CD80 exon 7; Set A
cuuggggcaaagccuuggagacaagaacaaacaauaaaa

SEQ ID NO: 60221 - RNA, 37 nt, Artificial Sequence
  Synthetic Oligonucleotide; CD80 exon 7; Set A
uuggggcaaagccuuggagacaagaacaaacaauaaa

SEQ ID NO: 60222 - RNA, 29 nt, Artificial Sequence
  Synthetic Oligonucleotide; CD80 exon 7; Set A
ggcaaagccuuggagacaagaacaaacaa

SEQ ID NO: 60223 - RNA, 40 nt, Artificial Sequence
  Synthetic Oligonucleotide; CD80 exon 7; Set A
ucuuggggcaaagccuuggagacaagaacaaacaauaaaa

SEQ ID NO: 60224 - RNA, 38 nt, Artificial Sequence
  Synthetic Oligonucleotide; CD80 exon 7; Set A
cuuggggcaaagccuuggagacaagaacaaacaauaaa

SEQ ID NO: 60225 - RNA, 36 nt, Artificial Sequence
  Synthetic Oligonucleotide; CD80 exon 7; Set A
uuggggcaaagccuuggagacaagaacaaacaauaa

SEQ ID NO: 60226 - RNA, 28 nt, Artificial Sequence
  Synthetic Oligonucleotide; CD80 exon 7; Set A
ggcaaagccuuggagacaagaacaaaca

SEQ ID NO: 60227 - RNA, 35 nt, Artificial Sequence
  Synthetic Oligonucleotide; CD80 exon 7; Set A
uuggggcaaagccuuggagacaagaacaaacaaua

SEQ ID NO: 60228 - RNA, 39 nt, Artificial Sequence
  Synthetic Oligonucleotide; CD80 exon 7; Set A
ucuuggggcaaagccuuggagacaagaacaaacaauaaa

SEQ ID NO: 60229 - RNA, 37 nt, Artificial Sequence
  Synthetic Oligonucleotide; CD80 exon 7; Set A
cuuggggcaaagccuuggagacaagaacaaacaauaa

SEQ ID NO: 60230 - RNA, 29 nt, Artificial Sequence
  Synthetic Oligonucleotide; CD80 exon 7; Set A
gggcaaagccuuggagacaagaacaaaca

SEQ ID NO: 60231 - RNA, 34 nt, Artificial Sequence
  Synthetic Oligonucleotide; CD80 exon 7; Set A
uuggggcaaagccuuggagacaagaacaaacaau

SEQ ID NO: 60232 - RNA, 36 nt, Artificial Sequence
  Synthetic Oligonucleotide; CD80 exon 7; Set C
cuuggggcaaagccuuggagacaagaacaaacaaua

SEQ ID NO: 60233 - RNA, 40 nt, Artificial Sequence
  Synthetic Oligonucleotide; CD80 exon 7; Set A
aucuuggggcaaagccuuggagacaagaacaaacaauaaa

SEQ ID NO: 60234 - RNA, 38 nt, Artificial Sequence
  Synthetic Oligonucleotide; CD80 exon 7; Set C
ucuuggggcaaagccuuggagacaagaacaaacaauaa

SEQ ID NO: 60235 - RNA, 30 nt, Artificial Sequence
  Synthetic Oligonucleotide; CD80 exon 7; Set C
ggggcaaagccuuggagacaagaacaaaca

SEQ ID NO: 60236 - RNA, 28 nt, Artificial Sequence
  Synthetic Oligonucleotide; CD80 exon 7; Set A
gggcaaagccuuggagacaagaacaaac

SEQ ID NO: 60237 - RNA, 35 nt, Artificial Sequence
  Synthetic Oligonucleotide; CD80 exon 7; Set C
cuuggggcaaagccuuggagacaagaacaaacaau

SEQ ID NO: 60238 - RNA, 37 nt, Artificial Sequence
  Synthetic Oligonucleotide; CD80 exon 7; Set C
ucuuggggcaaagccuuggagacaagaacaaacaaua

SEQ ID NO: 60239 - RNA, 33 nt, Artificial Sequence
  Synthetic Oligonucleotide; CD80 exon 7; Set A
uuggggcaaagccuuggagacaagaacaaacaa

SEQ ID NO: 60240 - RNA, 39 nt, Artificial Sequence
  Synthetic Oligonucleotide; CD80 exon 7; Set C
aucuuggggcaaagccuuggagacaagaacaaacaauaa

SEQ ID NO: 60241 - RNA, 31 nt, Artificial Sequence
  Synthetic Oligonucleotide; CD80 exon 7; Set C
uggggcaaagccuuggagacaagaacaaaca

SEQ ID NO: 60242 - RNA, 25 nt, Artificial Sequence
  Synthetic Oligonucleotide; CD80 exon 7; Set A
ggcaaagccuuggagacaagaacaa

SEQ ID NO: 60243 - RNA, 27 nt, Artificial Sequence
  Synthetic Oligonucleotide; CD80 exon 7; Set A
gggcaaagccuuggagacaagaacaaa

SEQ ID NO: 60244 - RNA, 29 nt, Artificial Sequence
  Synthetic Oligonucleotide; CD80 exon 7; Set A
ggggcaaagccuuggagacaagaacaaac

SEQ ID NO: 60245 - RNA, 36 nt, Artificial Sequence
  Synthetic Oligonucleotide; CD80 exon 7; Set C
ucuuggggcaaagccuuggagacaagaacaaacaau

SEQ ID NO: 60246 - RNA, 38 nt, Artificial Sequence
  Synthetic Oligonucleotide; CD80 exon 7; Set C
aucuuggggcaaagccuuggagacaagaacaaacaaua

SEQ ID NO: 60247 - RNA, 24 nt, Artificial Sequence
  Synthetic Oligonucleotide; CD80 exon 7; Set A
ggcaaagccuuggagacaagaaca

SEQ ID NO: 60248 - RNA, 34 nt, Artificial Sequence
  Synthetic Oligonucleotide; CD80 exon 7; Set C
cuuggggcaaagccuuggagacaagaacaaacaa

SEQ ID NO: 60249 - RNA, 32 nt, Artificial Sequence
  Synthetic Oligonucleotide; CD80 exon 7; Set C
uuggggcaaagccuuggagacaagaacaaaca

SEQ ID NO: 60250 - RNA, 26 nt, Artificial Sequence
  Synthetic Oligonucleotide; CD80 exon 7; Set A
gggcaaagccuuggagacaagaacaa

SEQ ID NO: 60251 - RNA, 28 nt, Artificial Sequence
  Synthetic Oligonucleotide; CD80 exon 7; Set A
ggggcaaagccuuggagacaagaacaaa

SEQ ID NO: 60252 - RNA, 30 nt, Artificial Sequence
  Synthetic Oligonucleotide; CD80 exon 7; Set A
uggggcaaagccuuggagacaagaacaaac

SEQ ID NO: 60253 - RNA, 37 nt, Artificial Sequence
  Synthetic Oligonucleotide; CD80 exon 7; Set C
aucuuggggcaaagccuuggagacaagaacaaacaau

SEQ ID NO: 60254 - RNA, 35 nt, Artificial Sequence
  Synthetic Oligonucleotide; CD80 exon 7; Set C
ucuuggggcaaagccuuggagacaagaacaaacaa

SEQ ID NO: 60255 - RNA, 23 nt, Artificial Sequence
  Synthetic Oligonucleotide; CD80 exon 7; Set A
ggcaaagccuuggagacaagaac

SEQ ID NO: 60256 - RNA, 33 nt, Artificial Sequence
  Synthetic Oligonucleotide; CD80 exon 7; Set C
cuuggggcaaagccuuggagacaagaacaaaca

SEQ ID NO: 60257 - RNA, 27 nt, Artificial Sequence
  Synthetic Oligonucleotide; CD80 exon 7; Set A
ggggcaaagccuuggagacaagaacaa

SEQ ID NO: 60258 - RNA, 29 nt, Artificial Sequence
  Synthetic Oligonucleotide; CD80 exon 7; Set A
uggggcaaagccuuggagacaagaacaaa

SEQ ID NO: 60259 - RNA, 31 nt, Artificial Sequence
  Synthetic Oligonucleotide; CD80 exon 7; Set A
uuggggcaaagccuuggagacaagaacaaac

SEQ ID NO: 60260 - RNA, 36 nt, Artificial Sequence
  Synthetic Oligonucleotide; CD80 exon 7; Set C
aucuuggggcaaagccuuggagacaagaacaaacaa

SEQ ID NO: 60261 - RNA, 24 nt, Artificial Sequence
  Synthetic Oligonucleotide; CD80 exon 7; Set A
gggcaaagccuuggagacaagaac

SEQ ID NO: 60262 - RNA, 34 nt, Artificial Sequence
  Synthetic Oligonucleotide; CD80 exon 7; Set C
ucuuggggcaaagccuuggagacaagaacaaaca

SEQ ID NO: 60263 - RNA, 28 nt, Artificial Sequence
  Synthetic Oligonucleotide; CD80 exon 7; Set A
uggggcaaagccuuggagacaagaacaa

SEQ ID NO: 60264 - RNA, 30 nt, Artificial Sequence
  Synthetic Oligonucleotide; CD80 exon 7; Set A
uuggggcaaagccuuggagacaagaacaaa

SEQ ID NO: 60265 - RNA, 35 nt, Artificial Sequence
  Synthetic Oligonucleotide; CD80 exon 7; Set C
aucuuggggcaaagccuuggagacaagaacaaaca

SEQ ID NO: 60266 - RNA, 29 nt, Artificial Sequence
  Synthetic Oligonucleotide; CD80 exon 7; Set A
uuggggcaaagccuuggagacaagaacaa

SEQ ID NO: 60267 - RNA, 23 nt, Artificial Sequence
  Synthetic Oligonucleotide; CD80 exon 7; Set A
gggcaaagccuuggagacaagaa

SEQ ID NO: 60268 - RNA, 28 nt, Artificial Sequence
  Synthetic Oligonucleotide; CD80 exon 7; Set A
uuggggcaaagccuuggagacaagaaca

SEQ ID NO: 60269 - RNA, 26 nt, Artificial Sequence
  Synthetic Oligonucleotide; CD80 exon 7; Set A
uggggcaaagccuuggagacaagaac

SEQ ID NO: 60270 - RNA, 24 nt, Artificial Sequence
  Synthetic Oligonucleotide; CD80 exon 7; Set A
ggggcaaagccuuggagacaagaa

SEQ ID NO: 60271 - RNA, 29 nt, Artificial Sequence
  Synthetic Oligonucleotide; CD80 exon 7; Set C
cuuggggcaaagccuuggagacaagaaca

SEQ ID NO: 60272 - RNA, 27 nt, Artificial Sequence
  Synthetic Oligonucleotide; CD80 exon 7; Set A
uuggggcaaagccuuggagacaagaac

SEQ ID NO: 60273 - RNA, 25 nt, Artificial Sequence
  Synthetic Oligonucleotide; CD80 exon 7; Set A
uggggcaaagccuuggagacaagaa

SEQ ID NO: 60274 - RNA, 23 nt, Artificial Sequence
  Synthetic Oligonucleotide; CD80 exon 7; Set A
ggggcaaagccuuggagacaaga

SEQ ID NO: 60275 - RNA, 30 nt, Artificial Sequence
  Synthetic Oligonucleotide; CD80 exon 7; Set C
ucuuggggcaaagccuuggagacaagaaca

SEQ ID NO: 60276 - RNA, 28 nt, Artificial Sequence
  Synthetic Oligonucleotide; CD80 exon 7; Set A
cuuggggcaaagccuuggagacaagaac

SEQ ID NO: 60277 - RNA, 24 nt, Artificial Sequence
  Synthetic Oligonucleotide; CD80 exon 7; Set A
uggggcaaagccuuggagacaaga

SEQ ID NO: 60278 - RNA, 22 nt, Artificial Sequence
  Synthetic Oligonucleotide; CD80 exon 7; Set A
ggggcaaagccuuggagacaag

SEQ ID NO: 60279 - RNA, 31 nt, Artificial Sequence
  Synthetic Oligonucleotide; CD80 exon 7; Set C
aucuuggggcaaagccuuggagacaagaaca

SEQ ID NO: 60280 - RNA, 29 nt, Artificial Sequence
  Synthetic Oligonucleotide; CD80 exon 7; Set A
ucuuggggcaaagccuuggagacaagaac

SEQ ID NO: 60281 - RNA, 17 nt, Artificial Sequence
  Synthetic Oligonucleotide; CD80 exon 7; Set C
ggcaaagccuuggagac

SEQ ID NO: 60282 - RNA, 23 nt, Artificial Sequence
  Synthetic Oligonucleotide; CD80 exon 7; Set A
uggggcaaagccuuggagacaag

SEQ ID NO: 60283 - RNA, 16 nt, Artificial Sequence
  Synthetic Oligonucleotide; CD80 exon 7; Set C
ggcaaagccuuggaga

SEQ ID NO: 60284 - RNA, 30 nt, Artificial Sequence
  Synthetic Oligonucleotide; CD80 exon 7; Set A
aucuuggggcaaagccuuggagacaagaac

SEQ ID NO: 60285 - RNA, 18 nt, Artificial Sequence
  Synthetic Oligonucleotide; CD80 exon 7; Set C
gggcaaagccuuggagac

SEQ ID NO: 60286 - RNA, 15 nt, Artificial Sequence
  Synthetic Oligonucleotide; CD80 exon 7; Set C
ggcaaagccuuggag

SEQ ID NO: 60287 - RNA, 20 nt, Artificial Sequence
  Synthetic Oligonucleotide; CD80 exon 7; Set A
uggggcaaagccuuggagac

SEQ ID NO: 60288 - RNA, 15 nt, Artificial Sequence
  Synthetic Oligonucleotide; CD80 exon 7; Set C
gggcaaagccuugga

SEQ ID NO: 60289 - RNA, 21 nt, Artificial Sequence
  Synthetic Oligonucleotide; CD80 exon 7; Set A
uuggggcaaagccuuggagac

SEQ ID NO: 60290 - RNA, 16 nt, Artificial Sequence
  Synthetic Oligonucleotide; CD80 exon 7; Set C
ggggcaaagccuugga

SEQ ID NO: 60291 - RNA, 22 nt, Artificial Sequence
  Synthetic Oligonucleotide; CD80 exon 7; Set A
cuuggggcaaagccuuggagac

SEQ ID NO: 60292 - RNA, 21 nt, Artificial Sequence
  Synthetic Oligonucleotide; CD80 exon 7; Set A
cuuggggcaaagccuuggaga

SEQ ID NO: 60293 - RNA, 17 nt, Artificial Sequence
  Synthetic Oligonucleotide; CD80 exon 7; Set C
uggggcaaagccuugga

SEQ ID NO: 60294 - RNA, 23 nt, Artificial Sequence
  Synthetic Oligonucleotide; CD80 exon 7; Set A
ucuuggggcaaagccuuggagac

SEQ ID NO: 60295 - RNA, 15 nt, Artificial Sequence
  Synthetic Oligonucleotide; CD80 exon 7; Set C
ggggcaaagccuugg

SEQ ID NO: 60296 - RNA, 20 nt, Artificial Sequence
  Synthetic Oligonucleotide; CD80 exon 7; Set A
cuuggggcaaagccuuggag

SEQ ID NO: 60297 - RNA, 22 nt, Artificial Sequence
  Synthetic Oligonucleotide; CD80 exon 7; Set A
ucuuggggcaaagccuuggaga

SEQ ID NO: 60298 - RNA, 18 nt, Artificial Sequence
  Synthetic Oligonucleotide; CD80 exon 7; Set A
uuggggcaaagccuugga

SEQ ID NO: 60299 - RNA, 24 nt, Artificial Sequence
  Synthetic Oligonucleotide; CD80 exon 7; Set A
aucuuggggcaaagccuuggagac

SEQ ID NO: 60300 - RNA, 16 nt, Artificial Sequence
  Synthetic Oligonucleotide; CD80 exon 7; Set C
uggggcaaagccuugg

SEQ ID NO: 60301 - RNA, 21 nt, Artificial Sequence
  Synthetic Oligonucleotide; CD80 exon 7; Set A
ucuuggggcaaagccuuggag

SEQ ID NO: 60302 - RNA, 23 nt, Artificial Sequence
  Synthetic Oligonucleotide; CD80 exon 7; Set A
aucuuggggcaaagccuuggaga

SEQ ID NO: 60303 - RNA, 19 nt, Artificial Sequence
  Synthetic Oligonucleotide; CD80 exon 7; Set A
cuuggggcaaagccuugga

SEQ ID NO: 60304 - RNA, 15 nt, Artificial Sequence
  Synthetic Oligonucleotide; CD80 exon 7; Set C
uggggcaaagccuug

SEQ ID NO: 60305 - RNA, 17 nt, Artificial Sequence
  Synthetic Oligonucleotide; CD80 exon 7; Set C
uuggggcaaagccuugg

SEQ ID NO: 60306 - RNA, 22 nt, Artificial Sequence
  Synthetic Oligonucleotide; CD80 exon 7; Set A
aucuuggggcaaagccuuggag

SEQ ID NO: 60307 - RNA, 40 nt, Artificial Sequence
  Synthetic Oligonucleotide; CD80 exon 7; Set C
ucucucugcaucuuggggcaaagccuuggagacaagaaca

SEQ ID NO: 60308 - RNA, 20 nt, Artificial Sequence
  Synthetic Oligonucleotide; CD80 exon 7; Set A
ucuuggggcaaagccuugga

SEQ ID NO: 60309 - RNA, 16 nt, Artificial Sequence
  Synthetic Oligonucleotide; CD80 exon 7; Set C
uuggggcaaagccuug

SEQ ID NO: 60310 - RNA, 18 nt, Artificial Sequence
  Synthetic Oligonucleotide; CD80 exon 7; Set C
cuuggggcaaagccuugg

SEQ ID NO: 60311 - RNA, 15 nt, Artificial Sequence
  Synthetic Oligonucleotide; CD80 exon 7; Set C
uuggggcaaagccuu

SEQ ID NO: 60312 - RNA, 21 nt, Artificial Sequence
  Synthetic Oligonucleotide; CD80 exon 7; Set A
aucuuggggcaaagccuugga

SEQ ID NO: 60313 - RNA, 17 nt, Artificial Sequence
  Synthetic Oligonucleotide; CD80 exon 7; Set C
cuuggggcaaagccuug

SEQ ID NO: 60314 - RNA, 19 nt, Artificial Sequence
  Synthetic Oligonucleotide; CD80 exon 7; Set A
ucuuggggcaaagccuugg

SEQ ID NO: 60315 - RNA, 16 nt, Artificial Sequence
  Synthetic Oligonucleotide; CD80 exon 7; Set C
cuuggggcaaagccuu

SEQ ID NO: 60316 - RNA, 18 nt, Artificial Sequence
  Synthetic Oligonucleotide; CD80 exon 7; Set C
ucuuggggcaaagccuug

SEQ ID NO: 60317 - RNA, 20 nt, Artificial Sequence
  Synthetic Oligonucleotide; CD80 exon 7; Set A
aucuuggggcaaagccuugg

SEQ ID NO: 60318 - RNA, 17 nt, Artificial Sequence
  Synthetic Oligonucleotide; CD80 exon 7; Set C
ucuuggggcaaagccuu

SEQ ID NO: 60319 - RNA, 19 nt, Artificial Sequence
  Synthetic Oligonucleotide; CD80 exon 7; Set C
aucuuggggcaaagccuug

SEQ ID NO: 60320 - RNA, 18 nt, Artificial Sequence
  Synthetic Oligonucleotide; CD80 exon 7; Set C
aucuuggggcaaagccuu

SEQ ID NO: 60321 - RNA, 32 nt, Artificial Sequence
  Synthetic Oligonucleotide; CD80 exon 7; Set C
ucucucugcaucuuggggcaaagccuuggaga

SEQ ID NO: 60322 - RNA, 31 nt, Artificial Sequence
  Synthetic Oligonucleotide; CD80 exon 7; Set C
ucucucugcaucuuggggcaaagccuuggag

SEQ ID NO: 60323 - RNA, 33 nt, Artificial Sequence
  Synthetic Oligonucleotide; CD80 exon 7; Set C
cucucucugcaucuuggggcaaagccuuggaga

SEQ ID NO: 60324 - RNA, 32 nt, Artificial Sequence
  Synthetic Oligonucleotide; CD80 exon 7; Set C
cucucucugcaucuuggggcaaagccuuggag

SEQ ID NO: 60325 - RNA, 34 nt, Artificial Sequence
  Synthetic Oligonucleotide; CD80 exon 7; Set C
ucucucucugcaucuuggggcaaagccuuggaga

SEQ ID NO: 60326 - RNA, 33 nt, Artificial Sequence
  Synthetic Oligonucleotide; CD80 exon 7; Set C
ucucucucugcaucuuggggcaaagccuuggag

SEQ ID NO: 60327 - RNA, 35 nt, Artificial Sequence
  Synthetic Oligonucleotide; CD80 exon 7; Set C
uucucucucugcaucuuggggcaaagccuuggaga

SEQ ID NO: 60328 - RNA, 34 nt, Artificial Sequence
  Synthetic Oligonucleotide; CD80 exon 7; Set C
uucucucucugcaucuuggggcaaagccuuggag

SEQ ID NO: 60329 - RNA, 17 nt, Artificial Sequence
  Synthetic Oligonucleotide; CD80 exon 7; Set C
ucucucugcaucuuggg

SEQ ID NO: 60330 - RNA, 20 nt, Artificial Sequence
  Synthetic Oligonucleotide; CD80 exon 7; Set C
uucucucucugcaucuuggg

SEQ ID NO: 60331 - RNA, 16 nt, Artificial Sequence
  Synthetic Oligonucleotide; CD80 exon 7; Set C
acagggcguacacuuu

SEQ ID NO: 60332 - RNA, 18 nt, Artificial Sequence
  Synthetic Oligonucleotide; CD80 exon 7; Set C
uacagggcguacacuuuc

SEQ ID NO: 60333 - RNA, 17 nt, Artificial Sequence
  Synthetic Oligonucleotide; CD80 exon 7; Set C
uacagggcguacacuuu

SEQ ID NO: 60334 - RNA, 15 nt, Artificial Sequence
  Synthetic Oligonucleotide; CD80 exon 7; Set C
acagggcguacacuu

SEQ ID NO: 60335 - RNA, 19 nt, Artificial Sequence
  Synthetic Oligonucleotide; CD80 exon 7; Set C
auacagggcguacacuuuc

SEQ ID NO: 60336 - RNA, 18 nt, Artificial Sequence
  Synthetic Oligonucleotide; CD80 exon 7; Set C
auacagggcguacacuuu

SEQ ID NO: 60337 - RNA, 16 nt, Artificial Sequence
  Synthetic Oligonucleotide; CD80 exon 7; Set C
uacagggcguacacuu

SEQ ID NO: 60338 - RNA, 20 nt, Artificial Sequence
  Synthetic Oligonucleotide; CD80 exon 7; Set C
uauacagggcguacacuuuc

SEQ ID NO: 60339 - RNA, 19 nt, Artificial Sequence
  Synthetic Oligonucleotide; CD80 exon 7; Set C
uauacagggcguacacuuu

SEQ ID NO: 60340 - RNA, 17 nt, Artificial Sequence
  Synthetic Oligonucleotide; CD80 exon 7; Set C
auacagggcguacacuu

SEQ ID NO: 60341 - RNA, 15 nt, Artificial Sequence
  Synthetic Oligonucleotide; CD80 exon 7; Set C
uacagggcguacacu

SEQ ID NO: 60342 - RNA, 21 nt, Artificial Sequence
  Synthetic Oligonucleotide; CD80 exon 7; Set C
uuauacagggcguacacuuuc

SEQ ID NO: 60343 - RNA, 18 nt, Artificial Sequence
  Synthetic Oligonucleotide; CD80 exon 7; Set C
uauacagggcguacacuu

SEQ ID NO: 60344 - RNA, 16 nt, Artificial Sequence
  Synthetic Oligonucleotide; CD80 exon 7; Set C
auacagggcguacacu

SEQ ID NO: 60345 - RNA, 22 nt, Artificial Sequence
  Synthetic Oligonucleotide; CD80 exon 7; Set A
guuauacagggcguacacuuuc

SEQ ID NO: 60346 - RNA, 21 nt, Artificial Sequence
  Synthetic Oligonucleotide; CD80 exon 7; Set A
guuauacagggcguacacuuu

SEQ ID NO: 60347 - RNA, 19 nt, Artificial Sequence
  Synthetic Oligonucleotide; CD80 exon 7; Set C
uuauacagggcguacacuu

SEQ ID NO: 60348 - RNA, 17 nt, Artificial Sequence
  Synthetic Oligonucleotide; CD80 exon 7; Set C
uauacagggcguacacu

SEQ ID NO: 60349 - RNA, 15 nt, Artificial Sequence
  Synthetic Oligonucleotide; CD80 exon 7; Set C
auacagggcguacac

SEQ ID NO: 60350 - RNA, 20 nt, Artificial Sequence
  Synthetic Oligonucleotide; CD80 exon 7; Set C
guuauacagggcguacacuu

SEQ ID NO: 60351 - RNA, 18 nt, Artificial Sequence
  Synthetic Oligonucleotide; CD80 exon 7; Set C
uuauacagggcguacacu

SEQ ID NO: 60352 - RNA, 16 nt, Artificial Sequence
  Synthetic Oligonucleotide; CD80 exon 7; Set C
uauacagggcguacac

SEQ ID NO: 60353 - RNA, 19 nt, Artificial Sequence
  Synthetic Oligonucleotide; CD80 exon 7; Set C
guuauacagggcguacacu

SEQ ID NO: 60354 - RNA, 17 nt, Artificial Sequence
  Synthetic Oligonucleotide; CD80 exon 7; Set C
uuauacagggcguacac

SEQ ID NO: 60355 - RNA, 15 nt, Artificial Sequence
  Synthetic Oligonucleotide; CD80 exon 7; Set C
uauacagggcguaca

SEQ ID NO: 60356 - RNA, 16 nt, Artificial Sequence
  Synthetic Oligonucleotide; CD80 exon 7; Set C
uuauacagggcguaca

SEQ ID NO: 60357 - RNA, 18 nt, Artificial Sequence
  Synthetic Oligonucleotide; CD80 exon 7; Set C
guuauacagggcguacac

SEQ ID NO: 60358 - RNA, 15 nt, Artificial Sequence
  Synthetic Oligonucleotide; CD80 exon 7; Set C
uuauacagggcguac

SEQ ID NO: 60359 - RNA, 17 nt, Artificial Sequence
  Synthetic Oligonucleotide; CD80 exon 7; Set C
guuauacagggcguaca

SEQ ID NO: 60360 - RNA, 16 nt, Artificial Sequence
  Synthetic Oligonucleotide; CD80 exon 7; Set C
guuauacagggcguac

SEQ ID NO: 60361 - RNA, 38 nt, Artificial Sequence
  Synthetic Oligonucleotide; CD80 exon 7; Set C
uugcuucugcggacacuguuauacagggcguacacuuu

SEQ ID NO: 60362 - RNA, 37 nt, Artificial Sequence
  Synthetic Oligonucleotide; CD80 exon 7; Set C
uugcuucugcggacacuguuauacagggcguacacuu

SEQ ID NO: 60363 - RNA, 32 nt, Artificial Sequence
  Synthetic Oligonucleotide; CD80 exon 7; Set C
uugcuucugcggacacuguuauacagggcgua

SEQ ID NO: 60364 - RNA, 31 nt, Artificial Sequence
  Synthetic Oligonucleotide; CD80 exon 7; Set C
uugcuucugcggacacuguuauacagggcgu

SEQ ID NO: 60365 - RNA, 24 nt, Artificial Sequence
  Synthetic Oligonucleotide; CD80 exon 7; Set A
uugcuucugcggacacuguuauac

SEQ ID NO: 60366 - RNA, 23 nt, Artificial Sequence
  Synthetic Oligonucleotide; CD80 exon 7; Set A
uugcuucugcggacacuguuaua

SEQ ID NO: 60367 - RNA, 22 nt, Artificial Sequence
  Synthetic Oligonucleotide; CD80 exon 7; Set A
uugcuucugcggacacuguuau

SEQ ID NO: 60368 - RNA, 22 nt, Artificial Sequence
  Synthetic Oligonucleotide; CD80 exon 7; Set C
uucagaucuuuucagccccuug

SEQ ID NO: 60369 - RNA, 15 nt, Artificial Sequence
  Synthetic Oligonucleotide; CD80 exon 7; Set C
accuucagaucuuuu

SEQ ID NO: 60370 - RNA, 20 nt, Artificial Sequence
  Synthetic Oligonucleotide; CD80 exon 7; Set C
aggcuaccuucagaucuuuu

SEQ ID NO: 60371 - RNA, 19 nt, Artificial Sequence
  Synthetic Oligonucleotide; CD80 exon 7; Set C
aggcuaccuucagaucuuu

SEQ ID NO: 60372 - RNA, 18 nt, Artificial Sequence
  Synthetic Oligonucleotide; CD80 exon 7; Set C
aggcuaccuucagaucuu

SEQ ID NO: 60373 - RNA, 25 nt, Artificial Sequence
  Synthetic Oligonucleotide; CD80 exon 7; Set B
gacggaggcuaccuucagaucuuuu

SEQ ID NO: 60374 - RNA, 26 nt, Artificial Sequence
  Synthetic Oligonucleotide; CD80 exon 7; Set B
ugacggaggcuaccuucagaucuuuu

SEQ ID NO: 60375 - RNA, 24 nt, Artificial Sequence
  Synthetic Oligonucleotide; CD80 exon 7; Set B
gacggaggcuaccuucagaucuuu

SEQ ID NO: 60376 - RNA, 27 nt, Artificial Sequence
  Synthetic Oligonucleotide; CD80 exon 7; Set B
augacggaggcuaccuucagaucuuuu

SEQ ID NO: 60377 - RNA, 25 nt, Artificial Sequence
  Synthetic Oligonucleotide; CD80 exon 7; Set B
ugacggaggcuaccuucagaucuuu

SEQ ID NO: 60378 - RNA, 23 nt, Artificial Sequence
  Synthetic Oligonucleotide; CD80 exon 7; Set B
gacggaggcuaccuucagaucuu

SEQ ID NO: 60379 - RNA, 28 nt, Artificial Sequence
  Synthetic Oligonucleotide; CD80 exon 7; Set C
gaugacggaggcuaccuucagaucuuuu

SEQ ID NO: 60380 - RNA, 26 nt, Artificial Sequence
  Synthetic Oligonucleotide; CD80 exon 7; Set B
augacggaggcuaccuucagaucuuu

SEQ ID NO: 60381 - RNA, 24 nt, Artificial Sequence
  Synthetic Oligonucleotide; CD80 exon 7; Set B
ugacggaggcuaccuucagaucuu

SEQ ID NO: 60382 - RNA, 22 nt, Artificial Sequence
  Synthetic Oligonucleotide; CD80 exon 7; Set B
gacggaggcuaccuucagaucu

SEQ ID NO: 60383 - RNA, 29 nt, Artificial Sequence
  Synthetic Oligonucleotide; CD80 exon 7; Set B
agaugacggaggcuaccuucagaucuuuu

SEQ ID NO: 60384 - RNA, 27 nt, Artificial Sequence
  Synthetic Oligonucleotide; CD80 exon 7; Set B
gaugacggaggcuaccuucagaucuuu

SEQ ID NO: 60385 - RNA, 25 nt, Artificial Sequence
  Synthetic Oligonucleotide; CD80 exon 7; Set B
augacggaggcuaccuucagaucuu

SEQ ID NO: 60386 - RNA, 23 nt, Artificial Sequence
  Synthetic Oligonucleotide; CD80 exon 7; Set B
ugacggaggcuaccuucagaucu

SEQ ID NO: 60387 - RNA, 21 nt, Artificial Sequence
  Synthetic Oligonucleotide; CD80 exon 7; Set B
gacggaggcuaccuucagauc

SEQ ID NO: 60388 - RNA, 28 nt, Artificial Sequence
  Synthetic Oligonucleotide; CD80 exon 7; Set B
agaugacggaggcuaccuucagaucuuu

SEQ ID NO: 60389 - RNA, 26 nt, Artificial Sequence
  Synthetic Oligonucleotide; CD80 exon 7; Set B
gaugacggaggcuaccuucagaucuu

SEQ ID NO: 60390 - RNA, 24 nt, Artificial Sequence
  Synthetic Oligonucleotide; CD80 exon 7; Set B
augacggaggcuaccuucagaucu

SEQ ID NO: 60391 - RNA, 22 nt, Artificial Sequence
  Synthetic Oligonucleotide; CD80 exon 7; Set B
ugacggaggcuaccuucagauc

SEQ ID NO: 60392 - RNA, 20 nt, Artificial Sequence
  Synthetic Oligonucleotide; CD80 exon 7; Set B
gacggaggcuaccuucagau

SEQ ID NO: 60393 - RNA, 27 nt, Artificial Sequence
  Synthetic Oligonucleotide; CD80 exon 7; Set B
agaugacggaggcuaccuucagaucuu

SEQ ID NO: 60394 - RNA, 19 nt, Artificial Sequence
  Synthetic Oligonucleotide; CD80 exon 7; Set B
gacggaggcuaccuucaga

SEQ ID NO: 60395 - RNA, 25 nt, Artificial Sequence
  Synthetic Oligonucleotide; CD80 exon 7; Set B
gaugacggaggcuaccuucagaucu

SEQ ID NO: 60396 - RNA, 21 nt, Artificial Sequence
  Synthetic Oligonucleotide; CD80 exon 7; Set B
ugacggaggcuaccuucagau

SEQ ID NO: 60397 - RNA, 23 nt, Artificial Sequence
  Synthetic Oligonucleotide; CD80 exon 7; Set B
augacggaggcuaccuucagauc

SEQ ID NO: 60398 - RNA, 18 nt, Artificial Sequence
  Synthetic Oligonucleotide; CD80 exon 7; Set B
gacggaggcuaccuucag

SEQ ID NO: 60399 - RNA, 20 nt, Artificial Sequence
  Synthetic Oligonucleotide; CD80 exon 7; Set B
ugacggaggcuaccuucaga

SEQ ID NO: 60400 - RNA, 26 nt, Artificial Sequence
  Synthetic Oligonucleotide; CD80 exon 7; Set B
agaugacggaggcuaccuucagaucu

SEQ ID NO: 60401 - RNA, 22 nt, Artificial Sequence
  Synthetic Oligonucleotide; CD80 exon 7; Set B
augacggaggcuaccuucagau

SEQ ID NO: 60402 - RNA, 24 nt, Artificial Sequence
  Synthetic Oligonucleotide; CD80 exon 7; Set B
gaugacggaggcuaccuucagauc

SEQ ID NO: 60403 - RNA, 33 nt, Artificial Sequence
  Synthetic Oligonucleotide; CD80 exon 7; Set C
gaagagaugacggaggcuaccuucagaucuuuu

SEQ ID NO: 60404 - RNA, 19 nt, Artificial Sequence
  Synthetic Oligonucleotide; CD80 exon 7; Set B
ugacggaggcuaccuucag

SEQ ID NO: 60405 - RNA, 21 nt, Artificial Sequence
  Synthetic Oligonucleotide; CD80 exon 7; Set B
augacggaggcuaccuucaga

SEQ ID NO: 60406 - RNA, 23 nt, Artificial Sequence
  Synthetic Oligonucleotide; CD80 exon 7; Set B
gaugacggaggcuaccuucagau

SEQ ID NO: 60407 - RNA, 25 nt, Artificial Sequence
  Synthetic Oligonucleotide; CD80 exon 7; Set B
agaugacggaggcuaccuucagauc

SEQ ID NO: 60408 - RNA, 34 nt, Artificial Sequence
  Synthetic Oligonucleotide; CD80 exon 7; Set C
agaagagaugacggaggcuaccuucagaucuuuu

SEQ ID NO: 60409 - RNA, 32 nt, Artificial Sequence
  Synthetic Oligonucleotide; CD80 exon 7; Set C
gaagagaugacggaggcuaccuucagaucuuu

SEQ ID NO: 60410 - RNA, 18 nt, Artificial Sequence
  Synthetic Oligonucleotide; CD80 exon 7; Set B
ugacggaggcuaccuuca

SEQ ID NO: 60411 - RNA, 20 nt, Artificial Sequence
  Synthetic Oligonucleotide; CD80 exon 7; Set B
augacggaggcuaccuucag

SEQ ID NO: 60412 - RNA, 22 nt, Artificial Sequence
  Synthetic Oligonucleotide; CD80 exon 7; Set B
gaugacggaggcuaccuucaga

SEQ ID NO: 60413 - RNA, 24 nt, Artificial Sequence
  Synthetic Oligonucleotide; CD80 exon 7; Set B
agaugacggaggcuaccuucagau

SEQ ID NO: 60414 - RNA, 33 nt, Artificial Sequence
  Synthetic Oligonucleotide; CD80 exon 7; Set C
agaagagaugacggaggcuaccuucagaucuuu

SEQ ID NO: 60415 - RNA, 31 nt, Artificial Sequence
  Synthetic Oligonucleotide; CD80 exon 7; Set C
gaagagaugacggaggcuaccuucagaucuu

SEQ ID NO: 60416 - RNA, 21 nt, Artificial Sequence
  Synthetic Oligonucleotide; CD80 exon 7; Set B
gaugacggaggcuaccuucag

SEQ ID NO: 60417 - RNA, 23 nt, Artificial Sequence
  Synthetic Oligonucleotide; CD80 exon 7; Set B
agaugacggaggcuaccuucaga

SEQ ID NO: 60418 - RNA, 32 nt, Artificial Sequence
  Synthetic Oligonucleotide; CD80 exon 7; Set C
agaagagaugacggaggcuaccuucagaucuu

SEQ ID NO: 60419 - RNA, 20 nt, Artificial Sequence
  Synthetic Oligonucleotide; CD80 exon 7; Set B
gaugacggaggcuaccuuca

SEQ ID NO: 60420 - RNA, 22 nt, Artificial Sequence
  Synthetic Oligonucleotide; CD80 exon 7; Set B
agaugacggaggcuaccuucag

SEQ ID NO: 60421 - RNA, 30 nt, Artificial Sequence
  Synthetic Oligonucleotide; CD80 exon 7; Set C
gaagagaugacggaggcuaccuucagaucu

SEQ ID NO: 60422 - RNA, 21 nt, Artificial Sequence
  Synthetic Oligonucleotide; CD80 exon 7; Set B
agaugacggaggcuaccuuca

SEQ ID NO: 60423 - RNA, 31 nt, Artificial Sequence
  Synthetic Oligonucleotide; CD80 exon 7; Set C
agaagagaugacggaggcuaccuucagaucu

SEQ ID NO: 60424 - RNA, 29 nt, Artificial Sequence
  Synthetic Oligonucleotide; CD80 exon 7; Set C
gaagagaugacggaggcuaccuucagauc

SEQ ID NO: 60425 - RNA, 28 nt, Artificial Sequence
  Synthetic Oligonucleotide; CD80 exon 7; Set B
gaagagaugacggaggcuaccuucagau

SEQ ID NO: 60426 - RNA, 30 nt, Artificial Sequence
  Synthetic Oligonucleotide; CD80 exon 7; Set B
agaagagaugacggaggcuaccuucagauc

SEQ ID NO: 60427 - RNA, 27 nt, Artificial Sequence
  Synthetic Oligonucleotide; CD80 exon 7; Set C
gaagagaugacggaggcuaccuucaga

SEQ ID NO: 60428 - RNA, 29 nt, Artificial Sequence
  Synthetic Oligonucleotide; CD80 exon 7; Set B
agaagagaugacggaggcuaccuucagau

SEQ ID NO: 60429 - RNA, 26 nt, Artificial Sequence
  Synthetic Oligonucleotide; CD80 exon 7; Set B
gaagagaugacggaggcuaccuucag

SEQ ID NO: 60430 - RNA, 28 nt, Artificial Sequence
  Synthetic Oligonucleotide; CD80 exon 7; Set B
agaagagaugacggaggcuaccuucaga

SEQ ID NO: 60431 - RNA, 25 nt, Artificial Sequence
  Synthetic Oligonucleotide; CD80 exon 7; Set B
gaagagaugacggaggcuaccuuca

SEQ ID NO: 60432 - RNA, 27 nt, Artificial Sequence
  Synthetic Oligonucleotide; CD80 exon 7; Set B
agaagagaugacggaggcuaccuucag

SEQ ID NO: 60433 - RNA, 26 nt, Artificial Sequence
  Synthetic Oligonucleotide; CD80 exon 7; Set B
agaagagaugacggaggcuaccuuca

SEQ ID NO: 60434 - RNA, 24 nt, Artificial Sequence
  Synthetic Oligonucleotide; CD80 exon 7; Set B
gaagagaugacggaggcuaccuuc

SEQ ID NO: 60435 - RNA, 25 nt, Artificial Sequence
  Synthetic Oligonucleotide; CD80 exon 7; Set B
agaagagaugacggaggcuaccuuc

SEQ ID NO: 60436 - RNA, 15 nt, Artificial Sequence
  Synthetic Oligonucleotide; CD80 exon 7; Set C
aaguuucccuugaau

SEQ ID NO: 60437 - RNA, 16 nt, Artificial Sequence
  Synthetic Oligonucleotide; CD80 exon 7; Set C
uaaguuucccuugaau

SEQ ID NO: 60438 - RNA, 17 nt, Artificial Sequence
  Synthetic Oligonucleotide; CD80 exon 7; Set C
guaaguuucccuugaau

SEQ ID NO: 60439 - RNA, 15 nt, Artificial Sequence
  Synthetic Oligonucleotide; CD80 exon 7; Set C
uaaguuucccuugaa

SEQ ID NO: 60440 - RNA, 16 nt, Artificial Sequence
  Synthetic Oligonucleotide; CD80 exon 7; Set C
guaaguuucccuugaa

SEQ ID NO: 60441 - RNA, 15 nt, Artificial Sequence
  Synthetic Oligonucleotide; CD80 exon 7; Set C
guaaguuucccuuga

SEQ ID NO: 60442 - RNA, 16 nt, Artificial Sequence
  Synthetic Oligonucleotide; CD80 exon 7; Set C
aguaaguuucccuuga

SEQ ID NO: 60443 - RNA, 22 nt, Artificial Sequence
  Synthetic Oligonucleotide; CD80 exon 7; Set C
gauaaguaaguuucccuugaau

SEQ ID NO: 60444 - RNA, 23 nt, Artificial Sequence
  Synthetic Oligonucleotide; CD80 exon 7; Set C
ugauaaguaaguuucccuugaau

SEQ ID NO: 60445 - RNA, 21 nt, Artificial Sequence
  Synthetic Oligonucleotide; CD80 exon 7; Set C
gauaaguaaguuucccuugaa

SEQ ID NO: 60446 - RNA, 24 nt, Artificial Sequence
  Synthetic Oligonucleotide; CD80 exon 7; Set C
augauaaguaaguuucccuugaau

SEQ ID NO: 60447 - RNA, 20 nt, Artificial Sequence
  Synthetic Oligonucleotide; CD80 exon 7; Set C
gauaaguaaguuucccuuga

SEQ ID NO: 60448 - RNA, 22 nt, Artificial Sequence
  Synthetic Oligonucleotide; CD80 exon 7; Set C
ugauaaguaaguuucccuugaa

SEQ ID NO: 60449 - RNA, 23 nt, Artificial Sequence
  Synthetic Oligonucleotide; CD80 exon 7; Set C
augauaaguaaguuucccuugaa

SEQ ID NO: 60450 - RNA, 21 nt, Artificial Sequence
  Synthetic Oligonucleotide; CD80 exon 7; Set C
ugauaaguaaguuucccuuga

SEQ ID NO: 60451 - RNA, 22 nt, Artificial Sequence
  Synthetic Oligonucleotide; CD80 exon 7; Set C
augauaaguaaguuucccuuga

SEQ ID NO: 60452 - RNA, 34 nt, Artificial Sequence
  Synthetic Oligonucleotide; CD80 exon 7; Set C
aacaauaaaaaugauaaguaaguuucccuugaau

SEQ ID NO: 60453 - RNA, 35 nt, Artificial Sequence
  Synthetic Oligonucleotide; CD80 exon 7; Set C
aaacaauaaaaaugauaaguaaguuucccuugaau

SEQ ID NO: 60454 - RNA, 33 nt, Artificial Sequence
  Synthetic Oligonucleotide; CD80 exon 7; Set C
aacaauaaaaaugauaaguaaguuucccuugaa

SEQ ID NO: 60455 - RNA, 34 nt, Artificial Sequence
  Synthetic Oligonucleotide; CD80 exon 7; Set C
aaacaauaaaaaugauaaguaaguuucccuugaa

SEQ ID NO: 60456 - RNA, 32 nt, Artificial Sequence
  Synthetic Oligonucleotide; CD80 exon 7; Set C
aacaauaaaaaugauaaguaaguuucccuuga

SEQ ID NO: 60457 - RNA, 33 nt, Artificial Sequence
  Synthetic Oligonucleotide; CD80 exon 7; Set C
aaacaauaaaaaugauaaguaaguuucccuuga

SEQ ID NO: 60458 - RNA, 39 nt, Artificial Sequence
  Synthetic Oligonucleotide; CD80 exon 7; Set C
gaacaaacaauaaaaaugauaaguaaguuucccuugaau

SEQ ID NO: 60459 - RNA, 40 nt, Artificial Sequence
  Synthetic Oligonucleotide; CD80 exon 7; Set C
agaacaaacaauaaaaaugauaaguaaguuucccuugaau

SEQ ID NO: 60460 - RNA, 38 nt, Artificial Sequence
  Synthetic Oligonucleotide; CD80 exon 7; Set C
gaacaaacaauaaaaaugauaaguaaguuucccuugaa

SEQ ID NO: 60461 - RNA, 37 nt, Artificial Sequence
  Synthetic Oligonucleotide; CD80 exon 7; Set C
gaacaaacaauaaaaaugauaaguaaguuucccuuga

SEQ ID NO: 60462 - RNA, 39 nt, Artificial Sequence
  Synthetic Oligonucleotide; CD80 exon 7; Set C
agaacaaacaauaaaaaugauaaguaaguuucccuugaa

SEQ ID NO: 60463 - RNA, 38 nt, Artificial Sequence
  Synthetic Oligonucleotide; CD80 exon 7; Set C
agaacaaacaauaaaaaugauaaguaaguuucccuuga

SEQ ID NO: 60464 - RNA, 40 nt, Artificial Sequence
  Synthetic Oligonucleotide; CD80 exon 7; Set C
aagaacaaacaauaaaaaugauaaguaaguuucccuugaa

SEQ ID NO: 60465 - RNA, 39 nt, Artificial Sequence
  Synthetic Oligonucleotide; CD80 exon 7; Set C
aagaacaaacaauaaaaaugauaaguaaguuucccuuga

SEQ ID NO: 60466 - RNA, 40 nt, Artificial Sequence
  Synthetic Oligonucleotide; CD80 exon 7; Set C
caagaacaaacaauaaaaaugauaaguaaguuucccuuga

SEQ ID NO: 60467 - RNA, 24 nt, Artificial Sequence
  Synthetic Oligonucleotide; CD80 exon 7; Set C
aacaauaaaaaugauaaguaaguu

SEQ ID NO: 60468 - RNA, 25 nt, Artificial Sequence
  Synthetic Oligonucleotide; CD80 exon 7; Set C
aaacaauaaaaaugauaaguaaguu

SEQ ID NO: 60469 - RNA, 23 nt, Artificial Sequence
  Synthetic Oligonucleotide; CD80 exon 7; Set C
aacaauaaaaaugauaaguaagu

SEQ ID NO: 60470 - RNA, 22 nt, Artificial Sequence
  Synthetic Oligonucleotide; CD80 exon 7; Set C
aacaauaaaaaugauaaguaag

SEQ ID NO: 60471 - RNA, 24 nt, Artificial Sequence
  Synthetic Oligonucleotide; CD80 exon 7; Set C
aaacaauaaaaaugauaaguaagu

SEQ ID NO: 60472 - RNA, 21 nt, Artificial Sequence
  Synthetic Oligonucleotide; CD80 exon 7; Set C
aacaauaaaaaugauaaguaa

SEQ ID NO: 60473 - RNA, 23 nt, Artificial Sequence
  Synthetic Oligonucleotide; CD80 exon 7; Set C
aaacaauaaaaaugauaaguaag

SEQ ID NO: 60474 - RNA, 29 nt, Artificial Sequence
  Synthetic Oligonucleotide; CD80 exon 7; Set C
gaacaaacaauaaaaaugauaaguaaguu

SEQ ID NO: 60475 - RNA, 34 nt, Artificial Sequence
  Synthetic Oligonucleotide; CD80 exon 7; Set C
caagaacaaacaauaaaaaugauaaguaaguuuc

SEQ ID NO: 60476 - RNA, 30 nt, Artificial Sequence
  Synthetic Oligonucleotide; CD80 exon 7; Set C
agaacaaacaauaaaaaugauaaguaaguu

SEQ ID NO: 60477 - RNA, 28 nt, Artificial Sequence
  Synthetic Oligonucleotide; CD80 exon 7; Set C
gaacaaacaauaaaaaugauaaguaagu

SEQ ID NO: 60478 - RNA, 33 nt, Artificial Sequence
  Synthetic Oligonucleotide; CD80 exon 7; Set C
caagaacaaacaauaaaaaugauaaguaaguuu

SEQ ID NO: 60479 - RNA, 35 nt, Artificial Sequence
  Synthetic Oligonucleotide; CD80 exon 7; Set C
acaagaacaaacaauaaaaaugauaaguaaguuuc

SEQ ID NO: 60480 - RNA, 27 nt, Artificial Sequence
  Synthetic Oligonucleotide; CD80 exon 7; Set C
gaacaaacaauaaaaaugauaaguaag

SEQ ID NO: 60481 - RNA, 31 nt, Artificial Sequence
  Synthetic Oligonucleotide; CD80 exon 7; Set C
aagaacaaacaauaaaaaugauaaguaaguu

SEQ ID NO: 60482 - RNA, 29 nt, Artificial Sequence
  Synthetic Oligonucleotide; CD80 exon 7; Set C
agaacaaacaauaaaaaugauaaguaagu

SEQ ID NO: 60483 - RNA, 26 nt, Artificial Sequence
  Synthetic Oligonucleotide; CD80 exon 7; Set C
gaacaaacaauaaaaaugauaaguaa

SEQ ID NO: 60484 - RNA, 28 nt, Artificial Sequence
  Synthetic Oligonucleotide; CD80 exon 7; Set C
agaacaaacaauaaaaaugauaaguaag

SEQ ID NO: 60485 - RNA, 32 nt, Artificial Sequence
  Synthetic Oligonucleotide; CD80 exon 7; Set C
caagaacaaacaauaaaaaugauaaguaaguu

SEQ ID NO: 60486 - RNA, 30 nt, Artificial Sequence
  Synthetic Oligonucleotide; CD80 exon 7; Set C
aagaacaaacaauaaaaaugauaaguaagu

SEQ ID NO: 60487 - RNA, 27 nt, Artificial Sequence
  Synthetic Oligonucleotide; CD80 exon 7; Set C
agaacaaacaauaaaaaugauaaguaa

SEQ ID NO: 60488 - RNA, 15 nt, Artificial Sequence
  Synthetic Oligonucleotide; CD80 exon 7; Set C
aacaauaaaaaugau

SEQ ID NO: 60489 - RNA, 29 nt, Artificial Sequence
  Synthetic Oligonucleotide; CD80 exon 7; Set C
aagaacaaacaauaaaaaugauaaguaag

SEQ ID NO: 60490 - RNA, 33 nt, Artificial Sequence
  Synthetic Oligonucleotide; CD80 exon 7; Set C
acaagaacaaacaauaaaaaugauaaguaaguu

SEQ ID NO: 60491 - RNA, 31 nt, Artificial Sequence
  Synthetic Oligonucleotide; CD80 exon 7; Set C
caagaacaaacaauaaaaaugauaaguaagu

SEQ ID NO: 60492 - RNA, 28 nt, Artificial Sequence
  Synthetic Oligonucleotide; CD80 exon 7; Set C
aagaacaaacaauaaaaaugauaaguaa

SEQ ID NO: 60493 - RNA, 30 nt, Artificial Sequence
  Synthetic Oligonucleotide; CD80 exon 7; Set C
caagaacaaacaauaaaaaugauaaguaag

SEQ ID NO: 60494 - RNA, 32 nt, Artificial Sequence
  Synthetic Oligonucleotide; CD80 exon 7; Set C
acaagaacaaacaauaaaaaugauaaguaagu

SEQ ID NO: 60495 - RNA, 29 nt, Artificial Sequence
  Synthetic Oligonucleotide; CD80 exon 7; Set C
caagaacaaacaauaaaaaugauaaguaa

SEQ ID NO: 60496 - RNA, 31 nt, Artificial Sequence
  Synthetic Oligonucleotide; CD80 exon 7; Set C
acaagaacaaacaauaaaaaugauaaguaag

SEQ ID NO: 60497 - RNA, 28 nt, Artificial Sequence
  Synthetic Oligonucleotide; CD80 exon 7; Set C
caagaacaaacaauaaaaaugauaagua

SEQ ID NO: 60498 - RNA, 30 nt, Artificial Sequence
  Synthetic Oligonucleotide; CD80 exon 7; Set C
acaagaacaaacaauaaaaaugauaaguaa

SEQ ID NO: 60499 - RNA, 29 nt, Artificial Sequence
  Synthetic Oligonucleotide; CD80 exon 7; Set C
acaagaacaaacaauaaaaaugauaagua

SEQ ID NO: 60500 - RNA, 20 nt, Artificial Sequence
  Synthetic Oligonucleotide; CD80 exon 7; Set C
gaacaaacaauaaaaaugau

SEQ ID NO: 60501 - RNA, 21 nt, Artificial Sequence
  Synthetic Oligonucleotide; CD80 exon 7; Set C
agaacaaacaauaaaaaugau

SEQ ID NO: 60502 - RNA, 19 nt, Artificial Sequence
  Synthetic Oligonucleotide; CD80 exon 7; Set C
gaacaaacaauaaaaauga

SEQ ID NO: 60503 - RNA, 24 nt, Artificial Sequence
  Synthetic Oligonucleotide; CD80 exon 7; Set C
caagaacaaacaauaaaaaugaua

SEQ ID NO: 60504 - RNA, 22 nt, Artificial Sequence
  Synthetic Oligonucleotide; CD80 exon 7; Set C
aagaacaaacaauaaaaaugau

SEQ ID NO: 60505 - RNA, 18 nt, Artificial Sequence
  Synthetic Oligonucleotide; CD80 exon 7; Set C
gaacaaacaauaaaaaug

SEQ ID NO: 60506 - RNA, 20 nt, Artificial Sequence
  Synthetic Oligonucleotide; CD80 exon 7; Set C
agaacaaacaauaaaaauga

SEQ ID NO: 60507 - RNA, 23 nt, Artificial Sequence
  Synthetic Oligonucleotide; CD80 exon 7; Set C
caagaacaaacaauaaaaaugau

SEQ ID NO: 60508 - RNA, 19 nt, Artificial Sequence
  Synthetic Oligonucleotide; CD80 exon 7; Set C
agaacaaacaauaaaaaug

SEQ ID NO: 60509 - RNA, 21 nt, Artificial Sequence
  Synthetic Oligonucleotide; CD80 exon 7; Set C
aagaacaaacaauaaaaauga

SEQ ID NO: 60510 - RNA, 24 nt, Artificial Sequence
  Synthetic Oligonucleotide; CD80 exon 7; Set C
acaagaacaaacaauaaaaaugau

SEQ ID NO: 60511 - RNA, 20 nt, Artificial Sequence
  Synthetic Oligonucleotide; CD80 exon 7; Set C
aagaacaaacaauaaaaaug

SEQ ID NO: 60512 - RNA, 22 nt, Artificial Sequence
  Synthetic Oligonucleotide; CD80 exon 7; Set C
caagaacaaacaauaaaaauga

SEQ ID NO: 60513 - RNA, 40 nt, Artificial Sequence
  Synthetic Oligonucleotide; CD80 exon 7; Set C
ccuuggagacaagaacaaacaauaaaaaugauaaguaagu

SEQ ID NO: 60514 - RNA, 23 nt, Artificial Sequence
  Synthetic Oligonucleotide; CD80 exon 7; Set C
acaagaacaaacaauaaaaauga

SEQ ID NO: 60515 - RNA, 21 nt, Artificial Sequence
  Synthetic Oligonucleotide; CD80 exon 7; Set C
caagaacaaacaauaaaaaug

SEQ ID NO: 60516 - RNA, 39 nt, Artificial Sequence
  Synthetic Oligonucleotide; CD80 exon 7; Set C
ccuuggagacaagaacaaacaauaaaaaugauaaguaag

SEQ ID NO: 60517 - RNA, 20 nt, Artificial Sequence
  Synthetic Oligonucleotide; CD80 exon 7; Set C
caagaacaaacaauaaaaau

SEQ ID NO: 60518 - RNA, 38 nt, Artificial Sequence
  Synthetic Oligonucleotide; CD80 exon 7; Set C
ccuuggagacaagaacaaacaauaaaaaugauaaguaa

SEQ ID NO: 60519 - RNA, 22 nt, Artificial Sequence
  Synthetic Oligonucleotide; CD80 exon 7; Set C
acaagaacaaacaauaaaaaug

SEQ ID NO: 60520 - RNA, 40 nt, Artificial Sequence
  Synthetic Oligonucleotide; CD80 exon 7; Set A
gccuuggagacaagaacaaacaauaaaaaugauaaguaag

SEQ ID NO: 60521 - RNA, 19 nt, Artificial Sequence
  Synthetic Oligonucleotide; CD80 exon 7; Set C
caagaacaaacaauaaaaa

SEQ ID NO: 60522 - RNA, 21 nt, Artificial Sequence
  Synthetic Oligonucleotide; CD80 exon 7; Set C
acaagaacaaacaauaaaaau

SEQ ID NO: 60523 - RNA, 39 nt, Artificial Sequence
  Synthetic Oligonucleotide; CD80 exon 7; Set A
gccuuggagacaagaacaaacaauaaaaaugauaaguaa

SEQ ID NO: 60524 - RNA, 18 nt, Artificial Sequence
  Synthetic Oligonucleotide; CD80 exon 7; Set C
caagaacaaacaauaaaa

SEQ ID NO: 60525 - RNA, 38 nt, Artificial Sequence
  Synthetic Oligonucleotide; CD80 exon 7; Set A
gccuuggagacaagaacaaacaauaaaaaugauaagua

SEQ ID NO: 60526 - RNA, 40 nt, Artificial Sequence
  Synthetic Oligonucleotide; CD80 exon 7; Set A
agccuuggagacaagaacaaacaauaaaaaugauaaguaa

SEQ ID NO: 60527 - RNA, 19 nt, Artificial Sequence
  Synthetic Oligonucleotide; CD80 exon 7; Set C
acaagaacaaacaauaaaa

SEQ ID NO: 60528 - RNA, 17 nt, Artificial Sequence
  Synthetic Oligonucleotide; CD80 exon 7; Set C
caagaacaaacaauaaa

SEQ ID NO: 60529 - RNA, 15 nt, Artificial Sequence
  Synthetic Oligonucleotide; CD80 exon 7; Set C
aagaacaaacaauaa

SEQ ID NO: 60530 - RNA, 39 nt, Artificial Sequence
  Synthetic Oligonucleotide; CD80 exon 7; Set A
agccuuggagacaagaacaaacaauaaaaaugauaagua

SEQ ID NO: 60531 - RNA, 18 nt, Artificial Sequence
  Synthetic Oligonucleotide; CD80 exon 7; Set C
acaagaacaaacaauaaa

SEQ ID NO: 60532 - RNA, 16 nt, Artificial Sequence
  Synthetic Oligonucleotide; CD80 exon 7; Set C
caagaacaaacaauaa

SEQ ID NO: 60533 - RNA, 40 nt, Artificial Sequence
  Synthetic Oligonucleotide; CD80 exon 7; Set A
aagccuuggagacaagaacaaacaauaaaaaugauaagua

SEQ ID NO: 60534 - RNA, 39 nt, Artificial Sequence
  Synthetic Oligonucleotide; CD80 exon 7; Set C
aagccuuggagacaagaacaaacaauaaaaaugauaagu

SEQ ID NO: 60535 - RNA, 15 nt, Artificial Sequence
  Synthetic Oligonucleotide; CD80 exon 7; Set C
caagaacaaacaaua

SEQ ID NO: 60536 - RNA, 17 nt, Artificial Sequence
  Synthetic Oligonucleotide; CD80 exon 7; Set C
acaagaacaaacaauaa

SEQ ID NO: 60537 - RNA, 38 nt, Artificial Sequence
  Synthetic Oligonucleotide; CD80 exon 7; Set C
aagccuuggagacaagaacaaacaauaaaaaugauaag

SEQ ID NO: 60538 - RNA, 40 nt, Artificial Sequence
  Synthetic Oligonucleotide; CD80 exon 7; Set C
aaagccuuggagacaagaacaaacaauaaaaaugauaagu

SEQ ID NO: 60539 - RNA, 34 nt, Artificial Sequence
  Synthetic Oligonucleotide; CD80 exon 7; Set C
gccuuggagacaagaacaaacaauaaaaaugaua

SEQ ID NO: 60540 - RNA, 16 nt, Artificial Sequence
  Synthetic Oligonucleotide; CD80 exon 7; Set C
acaagaacaaacaaua

SEQ ID NO: 60541 - RNA, 32 nt, Artificial Sequence
  Synthetic Oligonucleotide; CD80 exon 7; Set C
ccuuggagacaagaacaaacaauaaaaaugau

SEQ ID NO: 60542 - RNA, 37 nt, Artificial Sequence
  Synthetic Oligonucleotide; CD80 exon 7; Set C
aagccuuggagacaagaacaaacaauaaaaaugauaa

SEQ ID NO: 60543 - RNA, 39 nt, Artificial Sequence
  Synthetic Oligonucleotide; CD80 exon 7; Set C
aaagccuuggagacaagaacaaacaauaaaaaugauaag

SEQ ID NO: 60544 - RNA, 15 nt, Artificial Sequence
  Synthetic Oligonucleotide; CD80 exon 7; Set C
acaagaacaaacaau

SEQ ID NO: 60545 - RNA, 33 nt, Artificial Sequence
  Synthetic Oligonucleotide; CD80 exon 7; Set C
gccuuggagacaagaacaaacaauaaaaaugau

SEQ ID NO: 60546 - RNA, 31 nt, Artificial Sequence
  Synthetic Oligonucleotide; CD80 exon 7; Set C
ccuuggagacaagaacaaacaauaaaaauga

SEQ ID NO: 60547 - RNA, 38 nt, Artificial Sequence
  Synthetic Oligonucleotide; CD80 exon 7; Set C
aaagccuuggagacaagaacaaacaauaaaaaugauaa

SEQ ID NO: 60548 - RNA, 36 nt, Artificial Sequence
  Synthetic Oligonucleotide; CD80 exon 7; Set C
aagccuuggagacaagaacaaacaauaaaaaugaua

SEQ ID NO: 60549 - RNA, 34 nt, Artificial Sequence
  Synthetic Oligonucleotide; CD80 exon 7; Set C
agccuuggagacaagaacaaacaauaaaaaugau

SEQ ID NO: 60550 - RNA, 30 nt, Artificial Sequence
  Synthetic Oligonucleotide; CD80 exon 7; Set C
ccuuggagacaagaacaaacaauaaaaaug

SEQ ID NO: 60551 - RNA, 32 nt, Artificial Sequence
  Synthetic Oligonucleotide; CD80 exon 7; Set C
gccuuggagacaagaacaaacaauaaaaauga

SEQ ID NO: 60552 - RNA, 33 nt, Artificial Sequence
  Synthetic Oligonucleotide; CD80 exon 7; Set C
agccuuggagacaagaacaaacaauaaaaauga

SEQ ID NO: 60553 - RNA, 31 nt, Artificial Sequence
  Synthetic Oligonucleotide; CD80 exon 7; Set C
gccuuggagacaagaacaaacaauaaaaaug

SEQ ID NO: 60554 - RNA, 30 nt, Artificial Sequence
  Synthetic Oligonucleotide; CD80 exon 7; Set C
gccuuggagacaagaacaaacaauaaaaau

SEQ ID NO: 60555 - RNA, 32 nt, Artificial Sequence
  Synthetic Oligonucleotide; CD80 exon 7; Set C
agccuuggagacaagaacaaacaauaaaaaug

SEQ ID NO: 60556 - RNA, 31 nt, Artificial Sequence
  Synthetic Oligonucleotide; CD80 exon 7; Set C
agccuuggagacaagaacaaacaauaaaaau

SEQ ID NO: 60557 - RNA, 28 nt, Artificial Sequence
  Synthetic Oligonucleotide; CD80 exon 7; Set C
gccuuggagacaagaacaaacaauaaaa

SEQ ID NO: 60558 - RNA, 32 nt, Artificial Sequence
  Synthetic Oligonucleotide; CD80 exon 7; Set C
aagccuuggagacaagaacaaacaauaaaaau

SEQ ID NO: 60559 - RNA, 31 nt, Artificial Sequence
  Synthetic Oligonucleotide; CD80 exon 7; Set C
aagccuuggagacaagaacaaacaauaaaaa

SEQ ID NO: 60560 - RNA, 29 nt, Artificial Sequence
  Synthetic Oligonucleotide; CD80 exon 7; Set C
agccuuggagacaagaacaaacaauaaaa

SEQ ID NO: 60561 - RNA, 27 nt, Artificial Sequence
  Synthetic Oligonucleotide; CD80 exon 7; Set C
gccuuggagacaagaacaaacaauaaa

SEQ ID NO: 60562 - RNA, 30 nt, Artificial Sequence
  Synthetic Oligonucleotide; CD80 exon 7; Set C
aagccuuggagacaagaacaaacaauaaaa

SEQ ID NO: 60563 - RNA, 28 nt, Artificial Sequence
  Synthetic Oligonucleotide; CD80 exon 7; Set C
agccuuggagacaagaacaaacaauaaa

SEQ ID NO: 60564 - RNA, 26 nt, Artificial Sequence
  Synthetic Oligonucleotide; CD80 exon 7; Set C
gccuuggagacaagaacaaacaauaa

SEQ ID NO: 60565 - RNA, 25 nt, Artificial Sequence
  Synthetic Oligonucleotide; CD80 exon 7; Set C
gccuuggagacaagaacaaacaaua

SEQ ID NO: 60566 - RNA, 29 nt, Artificial Sequence
  Synthetic Oligonucleotide; CD80 exon 7; Set C
aagccuuggagacaagaacaaacaauaaa

SEQ ID NO: 60567 - RNA, 27 nt, Artificial Sequence
  Synthetic Oligonucleotide; CD80 exon 7; Set C
agccuuggagacaagaacaaacaauaa

SEQ ID NO: 60568 - RNA, 24 nt, Artificial Sequence
  Synthetic Oligonucleotide; CD80 exon 7; Set C
gccuuggagacaagaacaaacaau

SEQ ID NO: 60569 - RNA, 26 nt, Artificial Sequence
  Synthetic Oligonucleotide; CD80 exon 7; Set C
agccuuggagacaagaacaaacaaua

SEQ ID NO: 60570 - RNA, 28 nt, Artificial Sequence
  Synthetic Oligonucleotide; CD80 exon 7; Set C
aagccuuggagacaagaacaaacaauaa

SEQ ID NO: 60571 - RNA, 25 nt, Artificial Sequence
  Synthetic Oligonucleotide; CD80 exon 7; Set C
agccuuggagacaagaacaaacaau

SEQ ID NO: 60572 - RNA, 27 nt, Artificial Sequence
  Synthetic Oligonucleotide; CD80 exon 7; Set C
aagccuuggagacaagaacaaacaaua

SEQ ID NO: 60573 - RNA, 23 nt, Artificial Sequence
  Synthetic Oligonucleotide; CD80 exon 7; Set C
gccuuggagacaagaacaaacaa

SEQ ID NO: 60574 - RNA, 21 nt, Artificial Sequence
  Synthetic Oligonucleotide; CD80 exon 7; Set C
ccuuggagacaagaacaaaca

SEQ ID NO: 60575 - RNA, 26 nt, Artificial Sequence
  Synthetic Oligonucleotide; CD80 exon 7; Set C
aagccuuggagacaagaacaaacaau

SEQ ID NO: 60576 - RNA, 24 nt, Artificial Sequence
  Synthetic Oligonucleotide; CD80 exon 7; Set C
agccuuggagacaagaacaaacaa

SEQ ID NO: 60577 - RNA, 22 nt, Artificial Sequence
  Synthetic Oligonucleotide; CD80 exon 7; Set C
gccuuggagacaagaacaaaca

SEQ ID NO: 60578 - RNA, 20 nt, Artificial Sequence
  Synthetic Oligonucleotide; CD80 exon 7; Set C
ccuuggagacaagaacaaac

SEQ ID NO: 60579 - RNA, 25 nt, Artificial Sequence
  Synthetic Oligonucleotide; CD80 exon 7; Set C
aagccuuggagacaagaacaaacaa

SEQ ID NO: 60580 - RNA, 23 nt, Artificial Sequence
  Synthetic Oligonucleotide; CD80 exon 7; Set C
agccuuggagacaagaacaaaca

SEQ ID NO: 60581 - RNA, 19 nt, Artificial Sequence
  Synthetic Oligonucleotide; CD80 exon 7; Set C
ccuuggagacaagaacaaa

SEQ ID NO: 60582 - RNA, 18 nt, Artificial Sequence
  Synthetic Oligonucleotide; CD80 exon 7; Set C
ccuuggagacaagaacaa

SEQ ID NO: 60583 - RNA, 22 nt, Artificial Sequence
  Synthetic Oligonucleotide; CD80 exon 7; Set C
agccuuggagacaagaacaaac

SEQ ID NO: 60584 - RNA, 19 nt, Artificial Sequence
  Synthetic Oligonucleotide; CD80 exon 7; Set C
gccuuggagacaagaacaa

SEQ ID NO: 60585 - RNA, 21 nt, Artificial Sequence
  Synthetic Oligonucleotide; CD80 exon 7; Set C
agccuuggagacaagaacaaa

SEQ ID NO: 60586 - RNA, 18 nt, Artificial Sequence
  Synthetic Oligonucleotide; CD80 exon 7; Set C
gccuuggagacaagaaca

SEQ ID NO: 60587 - RNA, 20 nt, Artificial Sequence
  Synthetic Oligonucleotide; CD80 exon 7; Set C
agccuuggagacaagaacaa

SEQ ID NO: 60588 - RNA, 19 nt, Artificial Sequence
  Synthetic Oligonucleotide; CD80 exon 7; Set C
agccuuggagacaagaaca

SEQ ID NO: 60589 - RNA, 17 nt, Artificial Sequence
  Synthetic Oligonucleotide; CD80 exon 7; Set C
gccuuggagacaagaac

SEQ ID NO: 60590 - RNA, 15 nt, Artificial Sequence
  Synthetic Oligonucleotide; CD80 exon 7; Set C
ccuuggagacaagaa

SEQ ID NO: 60591 - RNA, 20 nt, Artificial Sequence
  Synthetic Oligonucleotide; CD80 exon 7; Set C
aagccuuggagacaagaaca

SEQ ID NO: 60592 - RNA, 18 nt, Artificial Sequence
  Synthetic Oligonucleotide; CD80 exon 7; Set C
agccuuggagacaagaac

SEQ ID NO: 60593 - RNA, 19 nt, Artificial Sequence
  Synthetic Oligonucleotide; CD80 exon 7; Set C
aagccuuggagacaagaac

SEQ ID NO: 60594 - RNA, 27 nt, Artificial Sequence
  Synthetic Oligonucleotide; CD80 exon 7; Set A
ggcaaagccuuggagacaagaacaaac

SEQ ID NO: 60595 - RNA, 26 nt, Artificial Sequence
  Synthetic Oligonucleotide; CD80 exon 7; Set A
ggcaaagccuuggagacaagaacaaa

SEQ ID NO: 60596 - RNA, 32 nt, Artificial Sequence
  Synthetic Oligonucleotide; CD80 exon 7; Set A
cuuggggcaaagccuuggagacaagaacaaac

SEQ ID NO: 60597 - RNA, 22 nt, Artificial Sequence
  Synthetic Oligonucleotide; CD80 exon 7; Set A
ggcaaagccuuggagacaagaa

SEQ ID NO: 60598 - RNA, 31 nt, Artificial Sequence
  Synthetic Oligonucleotide; CD80 exon 7; Set A
cuuggggcaaagccuuggagacaagaacaaa

SEQ ID NO: 60599 - RNA, 33 nt, Artificial Sequence
  Synthetic Oligonucleotide; CD80 exon 7; Set C
ucuuggggcaaagccuuggagacaagaacaaac

SEQ ID NO: 60600 - RNA, 21 nt, Artificial Sequence
  Synthetic Oligonucleotide; CD80 exon 7; Set A
ggcaaagccuuggagacaaga

SEQ ID NO: 60601 - RNA, 30 nt, Artificial Sequence
  Synthetic Oligonucleotide; CD80 exon 7; Set A
cuuggggcaaagccuuggagacaagaacaa

SEQ ID NO: 60602 - RNA, 32 nt, Artificial Sequence
  Synthetic Oligonucleotide; CD80 exon 7; Set A
ucuuggggcaaagccuuggagacaagaacaaa

SEQ ID NO: 60603 - RNA, 34 nt, Artificial Sequence
  Synthetic Oligonucleotide; CD80 exon 7; Set C
aucuuggggcaaagccuuggagacaagaacaaac

SEQ ID NO: 60604 - RNA, 22 nt, Artificial Sequence
  Synthetic Oligonucleotide; CD80 exon 7; Set A
gggcaaagccuuggagacaaga

SEQ ID NO: 60605 - RNA, 20 nt, Artificial Sequence
  Synthetic Oligonucleotide; CD80 exon 7; Set C
ggcaaagccuuggagacaag

SEQ ID NO: 60606 - RNA, 31 nt, Artificial Sequence
  Synthetic Oligonucleotide; CD80 exon 7; Set C
ucuuggggcaaagccuuggagacaagaacaa

SEQ ID NO: 60607 - RNA, 33 nt, Artificial Sequence
  Synthetic Oligonucleotide; CD80 exon 7; Set A
aucuuggggcaaagccuuggagacaagaacaaa

SEQ ID NO: 60608 - RNA, 21 nt, Artificial Sequence
  Synthetic Oligonucleotide; CD80 exon 7; Set A
gggcaaagccuuggagacaag

SEQ ID NO: 60609 - RNA, 19 nt, Artificial Sequence
  Synthetic Oligonucleotide; CD80 exon 7; Set C
ggcaaagccuuggagacaa

SEQ ID NO: 60610 - RNA, 32 nt, Artificial Sequence
  Synthetic Oligonucleotide; CD80 exon 7; Set C
aucuuggggcaaagccuuggagacaagaacaa

SEQ ID NO: 60611 - RNA, 26 nt, Artificial Sequence
  Synthetic Oligonucleotide; CD80 exon 7; Set A
uuggggcaaagccuuggagacaagaa

SEQ ID NO: 60612 - RNA, 18 nt, Artificial Sequence
  Synthetic Oligonucleotide; CD80 exon 7; Set C
ggcaaagccuuggagaca

SEQ ID NO: 60613 - RNA, 20 nt, Artificial Sequence
  Synthetic Oligonucleotide; CD80 exon 7; Set A
gggcaaagccuuggagacaa

SEQ ID NO: 60614 - RNA, 27 nt, Artificial Sequence
  Synthetic Oligonucleotide; CD80 exon 7; Set A
cuuggggcaaagccuuggagacaagaa

SEQ ID NO: 60615 - RNA, 25 nt, Artificial Sequence
  Synthetic Oligonucleotide; CD80 exon 7; Set A
uuggggcaaagccuuggagacaaga

SEQ ID NO: 60616 - RNA, 19 nt, Artificial Sequence
  Synthetic Oligonucleotide; CD80 exon 7; Set A
gggcaaagccuuggagaca

SEQ ID NO: 60617 - RNA, 21 nt, Artificial Sequence
  Synthetic Oligonucleotide; CD80 exon 7; Set A
ggggcaaagccuuggagacaa

SEQ ID NO: 60618 - RNA, 40 nt, Artificial Sequence
  Synthetic Oligonucleotide; CD80 exon 7; Set C
ucugcaucuuggggcaaagccuuggagacaagaacaaaca

SEQ ID NO: 60619 - RNA, 28 nt, Artificial Sequence
  Synthetic Oligonucleotide; CD80 exon 7; Set A
ucuuggggcaaagccuuggagacaagaa

SEQ ID NO: 60620 - RNA, 26 nt, Artificial Sequence
  Synthetic Oligonucleotide; CD80 exon 7; Set A
cuuggggcaaagccuuggagacaaga

SEQ ID NO: 60621 - RNA, 24 nt, Artificial Sequence
  Synthetic Oligonucleotide; CD80 exon 7; Set A
uuggggcaaagccuuggagacaag

SEQ ID NO: 60622 - RNA, 20 nt, Artificial Sequence
  Synthetic Oligonucleotide; CD80 exon 7; Set A
ggggcaaagccuuggagaca

SEQ ID NO: 60623 - RNA, 22 nt, Artificial Sequence
  Synthetic Oligonucleotide; CD80 exon 7; Set A
uggggcaaagccuuggagacaa

SEQ ID NO: 60624 - RNA, 39 nt, Artificial Sequence
  Synthetic Oligonucleotide; CD80 exon 7; Set C
ucugcaucuuggggcaaagccuuggagacaagaacaaac

SEQ ID NO: 60625 - RNA, 29 nt, Artificial Sequence
  Synthetic Oligonucleotide; CD80 exon 7; Set A
aucuuggggcaaagccuuggagacaagaa

SEQ ID NO: 60626 - RNA, 27 nt, Artificial Sequence
  Synthetic Oligonucleotide; CD80 exon 7; Set C
ucuuggggcaaagccuuggagacaaga

SEQ ID NO: 60627 - RNA, 25 nt, Artificial Sequence
  Synthetic Oligonucleotide; CD80 exon 7; Set A
cuuggggcaaagccuuggagacaag

SEQ ID NO: 60628 - RNA, 21 nt, Artificial Sequence
  Synthetic Oligonucleotide; CD80 exon 7; Set A
uggggcaaagccuuggagaca

SEQ ID NO: 60629 - RNA, 23 nt, Artificial Sequence
  Synthetic Oligonucleotide; CD80 exon 7; Set A
uuggggcaaagccuuggagacaa

SEQ ID NO: 60630 - RNA, 38 nt, Artificial Sequence
  Synthetic Oligonucleotide; CD80 exon 7; Set C
ucugcaucuuggggcaaagccuuggagacaagaacaaa

SEQ ID NO: 60631 - RNA, 28 nt, Artificial Sequence
  Synthetic Oligonucleotide; CD80 exon 7; Set A
aucuuggggcaaagccuuggagacaaga

SEQ ID NO: 60632 - RNA, 26 nt, Artificial Sequence
  Synthetic Oligonucleotide; CD80 exon 7; Set A
ucuuggggcaaagccuuggagacaag

SEQ ID NO: 60633 - RNA, 22 nt, Artificial Sequence
  Synthetic Oligonucleotide; CD80 exon 7; Set A
uuggggcaaagccuuggagaca

SEQ ID NO: 60634 - RNA, 24 nt, Artificial Sequence
  Synthetic Oligonucleotide; CD80 exon 7; Set A
cuuggggcaaagccuuggagacaa

SEQ ID NO: 60635 - RNA, 37 nt, Artificial Sequence
  Synthetic Oligonucleotide; CD80 exon 7; Set C
ucugcaucuuggggcaaagccuuggagacaagaacaa

SEQ ID NO: 60636 - RNA, 27 nt, Artificial Sequence
  Synthetic Oligonucleotide; CD80 exon 7; Set A
aucuuggggcaaagccuuggagacaag

SEQ ID NO: 60637 - RNA, 23 nt, Artificial Sequence
  Synthetic Oligonucleotide; CD80 exon 7; Set A
cuuggggcaaagccuuggagaca

SEQ ID NO: 60638 - RNA, 25 nt, Artificial Sequence
  Synthetic Oligonucleotide; CD80 exon 7; Set A
ucuuggggcaaagccuuggagacaa

SEQ ID NO: 60639 - RNA, 36 nt, Artificial Sequence
  Synthetic Oligonucleotide; CD80 exon 7; Set C
ucugcaucuuggggcaaagccuuggagacaagaaca

SEQ ID NO: 60640 - RNA, 24 nt, Artificial Sequence
  Synthetic Oligonucleotide; CD80 exon 7; Set A
ucuuggggcaaagccuuggagaca

SEQ ID NO: 60641 - RNA, 26 nt, Artificial Sequence
  Synthetic Oligonucleotide; CD80 exon 7; Set A
aucuuggggcaaagccuuggagacaa

SEQ ID NO: 60642 - RNA, 35 nt, Artificial Sequence
  Synthetic Oligonucleotide; CD80 exon 7; Set C
ucugcaucuuggggcaaagccuuggagacaagaac

SEQ ID NO: 60643 - RNA, 25 nt, Artificial Sequence
  Synthetic Oligonucleotide; CD80 exon 7; Set A
aucuuggggcaaagccuuggagaca

SEQ ID NO: 60644 - RNA, 39 nt, Artificial Sequence
  Synthetic Oligonucleotide; CD80 exon 7; Set C
ucucucugcaucuuggggcaaagccuuggagacaagaac

SEQ ID NO: 60645 - RNA, 40 nt, Artificial Sequence
  Synthetic Oligonucleotide; CD80 exon 7; Set C
cucucucugcaucuuggggcaaagccuuggagacaagaac

SEQ ID NO: 60646 - RNA, 38 nt, Artificial Sequence
  Synthetic Oligonucleotide; CD80 exon 7; Set C
ucucucugcaucuuggggcaaagccuuggagacaagaa

SEQ ID NO: 60647 - RNA, 29 nt, Artificial Sequence
  Synthetic Oligonucleotide; CD80 exon 7; Set C
ucugcaucuuggggcaaagccuuggagac

SEQ ID NO: 60648 - RNA, 15 nt, Artificial Sequence
  Synthetic Oligonucleotide; CD80 exon 7; Set C
cuuggggcaaagccu

SEQ ID NO: 60649 - RNA, 39 nt, Artificial Sequence
  Synthetic Oligonucleotide; CD80 exon 7; Set C
cucucucugcaucuuggggcaaagccuuggagacaagaa

SEQ ID NO: 60650 - RNA, 37 nt, Artificial Sequence
  Synthetic Oligonucleotide; CD80 exon 7; Set C
ucucucugcaucuuggggcaaagccuuggagacaaga

SEQ ID NO: 60651 - RNA, 28 nt, Artificial Sequence
  Synthetic Oligonucleotide; CD80 exon 7; Set C
ucugcaucuuggggcaaagccuuggaga

SEQ ID NO: 60652 - RNA, 16 nt, Artificial Sequence
  Synthetic Oligonucleotide; CD80 exon 7; Set C
ucuuggggcaaagccu

SEQ ID NO: 60653 - RNA, 40 nt, Artificial Sequence
  Synthetic Oligonucleotide; CD80 exon 7; Set C
ucucucucugcaucuuggggcaaagccuuggagacaagaa

SEQ ID NO: 60654 - RNA, 38 nt, Artificial Sequence
  Synthetic Oligonucleotide; CD80 exon 7; Set C
cucucucugcaucuuggggcaaagccuuggagacaaga

SEQ ID NO: 60655 - RNA, 36 nt, Artificial Sequence
  Synthetic Oligonucleotide; CD80 exon 7; Set C
ucucucugcaucuuggggcaaagccuuggagacaag

SEQ ID NO: 60656 - RNA, 27 nt, Artificial Sequence
  Synthetic Oligonucleotide; CD80 exon 7; Set C
ucugcaucuuggggcaaagccuuggag

SEQ ID NO: 60657 - RNA, 17 nt, Artificial Sequence
  Synthetic Oligonucleotide; CD80 exon 7; Set C
aucuuggggcaaagccu

SEQ ID NO: 60658 - RNA, 15 nt, Artificial Sequence
  Synthetic Oligonucleotide; CD80 exon 7; Set C
ucuuggggcaaagcc

SEQ ID NO: 60659 - RNA, 26 nt, Artificial Sequence
  Synthetic Oligonucleotide; CD80 exon 7; Set C
ucugcaucuuggggcaaagccuugga

SEQ ID NO: 60660 - RNA, 40 nt, Artificial Sequence
  Synthetic Oligonucleotide; CD80 exon 7; Set C
uucucucucugcaucuuggggcaaagccuuggagacaaga

SEQ ID NO: 60661 - RNA, 16 nt, Artificial Sequence
  Synthetic Oligonucleotide; CD80 exon 7; Set C
aucuuggggcaaagcc

SEQ ID NO: 60662 - RNA, 33 nt, Artificial Sequence
  Synthetic Oligonucleotide; CD80 exon 7; Set C
ucucucugcaucuuggggcaaagccuuggagac

SEQ ID NO: 60663 - RNA, 25 nt, Artificial Sequence
  Synthetic Oligonucleotide; CD80 exon 7; Set A
ucugcaucuuggggcaaagccuugg

SEQ ID NO: 60664 - RNA, 15 nt, Artificial Sequence
  Synthetic Oligonucleotide; CD80 exon 7; Set C
aucuuggggcaaagc

SEQ ID NO: 60665 - RNA, 34 nt, Artificial Sequence
  Synthetic Oligonucleotide; CD80 exon 7; Set C
cucucucugcaucuuggggcaaagccuuggagac

SEQ ID NO: 60666 - RNA, 24 nt, Artificial Sequence
  Synthetic Oligonucleotide; CD80 exon 7; Set A
ucugcaucuuggggcaaagccuug

SEQ ID NO: 60667 - RNA, 23 nt, Artificial Sequence
  Synthetic Oligonucleotide; CD80 exon 7; Set A
ucugcaucuuggggcaaagccuu

SEQ ID NO: 60668 - RNA, 35 nt, Artificial Sequence
  Synthetic Oligonucleotide; CD80 exon 7; Set C
ucucucucugcaucuuggggcaaagccuuggagac

SEQ ID NO: 60669 - RNA, 30 nt, Artificial Sequence
  Synthetic Oligonucleotide; CD80 exon 7; Set C
ucucucugcaucuuggggcaaagccuugga

SEQ ID NO: 60670 - RNA, 36 nt, Artificial Sequence
  Synthetic Oligonucleotide; CD80 exon 7; Set C
uucucucucugcaucuuggggcaaagccuuggagac

SEQ ID NO: 60671 - RNA, 31 nt, Artificial Sequence
  Synthetic Oligonucleotide; CD80 exon 7; Set C
cucucucugcaucuuggggcaaagccuugga

SEQ ID NO: 60672 - RNA, 29 nt, Artificial Sequence
  Synthetic Oligonucleotide; CD80 exon 7; Set C
ucucucugcaucuuggggcaaagccuugg

SEQ ID NO: 60673 - RNA, 32 nt, Artificial Sequence
  Synthetic Oligonucleotide; CD80 exon 7; Set C
ucucucucugcaucuuggggcaaagccuugga

SEQ ID NO: 60674 - RNA, 28 nt, Artificial Sequence
  Synthetic Oligonucleotide; CD80 exon 7; Set C
ucucucugcaucuuggggcaaagccuug

SEQ ID NO: 60675 - RNA, 30 nt, Artificial Sequence
  Synthetic Oligonucleotide; CD80 exon 7; Set C
cucucucugcaucuuggggcaaagccuugg

SEQ ID NO: 60676 - RNA, 27 nt, Artificial Sequence
  Synthetic Oligonucleotide; CD80 exon 7; Set C
ucucucugcaucuuggggcaaagccuu

SEQ ID NO: 60677 - RNA, 33 nt, Artificial Sequence
  Synthetic Oligonucleotide; CD80 exon 7; Set C
uucucucucugcaucuuggggcaaagccuugga

SEQ ID NO: 60678 - RNA, 29 nt, Artificial Sequence
  Synthetic Oligonucleotide; CD80 exon 7; Set C
cucucucugcaucuuggggcaaagccuug

SEQ ID NO: 60679 - RNA, 31 nt, Artificial Sequence
  Synthetic Oligonucleotide; CD80 exon 7; Set C
ucucucucugcaucuuggggcaaagccuugg

SEQ ID NO: 60680 - RNA, 28 nt, Artificial Sequence
  Synthetic Oligonucleotide; CD80 exon 7; Set C
cucucucugcaucuuggggcaaagccuu

SEQ ID NO: 60681 - RNA, 30 nt, Artificial Sequence
  Synthetic Oligonucleotide; CD80 exon 7; Set C
ucucucucugcaucuuggggcaaagccuug

SEQ ID NO: 60682 - RNA, 32 nt, Artificial Sequence
  Synthetic Oligonucleotide; CD80 exon 7; Set C
uucucucucugcaucuuggggcaaagccuugg

SEQ ID NO: 60683 - RNA, 26 nt, Artificial Sequence
  Synthetic Oligonucleotide; CD80 exon 7; Set C
ucucucugcaucuuggggcaaagccu

SEQ ID NO: 60684 - RNA, 29 nt, Artificial Sequence
  Synthetic Oligonucleotide; CD80 exon 7; Set C
ucucucucugcaucuuggggcaaagccuu

SEQ ID NO: 60685 - RNA, 31 nt, Artificial Sequence
  Synthetic Oligonucleotide; CD80 exon 7; Set C
uucucucucugcaucuuggggcaaagccuug

SEQ ID NO: 60686 - RNA, 30 nt, Artificial Sequence
  Synthetic Oligonucleotide; CD80 exon 7; Set C
uucucucucugcaucuuggggcaaagccuu

SEQ ID NO: 60687 - RNA, 15 nt, Artificial Sequence
  Synthetic Oligonucleotide; CD80 exon 7; Set C
ucugcaucuuggggc

SEQ ID NO: 60688 - RNA, 29 nt, Artificial Sequence
  Synthetic Oligonucleotide; CD80 exon 7; Set C
uucucucucugcaucuuggggcaaagccu

SEQ ID NO: 60689 - RNA, 40 nt, Artificial Sequence
  Synthetic Oligonucleotide; CD80 exon 7; Set C
uccuccuucucucucugcaucuuggggcaaagccuuggag

SEQ ID NO: 60690 - RNA, 39 nt, Artificial Sequence
  Synthetic Oligonucleotide; CD80 exon 7; Set C
uccuccuucucucucugcaucuuggggcaaagccuugga

SEQ ID NO: 60691 - RNA, 40 nt, Artificial Sequence
  Synthetic Oligonucleotide; CD80 exon 7; Set C
uuccuccuucucucucugcaucuuggggcaaagccuugga

SEQ ID NO: 60692 - RNA, 38 nt, Artificial Sequence
  Synthetic Oligonucleotide; CD80 exon 7; Set C
uccuccuucucucucugcaucuuggggcaaagccuugg

SEQ ID NO: 60693 - RNA, 37 nt, Artificial Sequence
  Synthetic Oligonucleotide; CD80 exon 7; Set C
uccuccuucucucucugcaucuuggggcaaagccuug

SEQ ID NO: 60694 - RNA, 39 nt, Artificial Sequence
  Synthetic Oligonucleotide; CD80 exon 7; Set C
uuccuccuucucucucugcaucuuggggcaaagccuugg

SEQ ID NO: 60695 - RNA, 19 nt, Artificial Sequence
  Synthetic Oligonucleotide; CD80 exon 7; Set A
ucucucugcaucuuggggc

SEQ ID NO: 60696 - RNA, 18 nt, Artificial Sequence
  Synthetic Oligonucleotide; CD80 exon 7; Set C
ucucucugcaucuugggg

SEQ ID NO: 60697 - RNA, 36 nt, Artificial Sequence
  Synthetic Oligonucleotide; CD80 exon 7; Set C
uccuccuucucucucugcaucuuggggcaaagccuu

SEQ ID NO: 60698 - RNA, 38 nt, Artificial Sequence
  Synthetic Oligonucleotide; CD80 exon 7; Set C
uuccuccuucucucucugcaucuuggggcaaagccuug

SEQ ID NO: 60699 - RNA, 20 nt, Artificial Sequence
  Synthetic Oligonucleotide; CD80 exon 7; Set A
cucucucugcaucuuggggc

SEQ ID NO: 60700 - RNA, 19 nt, Artificial Sequence
  Synthetic Oligonucleotide; CD80 exon 7; Set A
cucucucugcaucuugggg

SEQ ID NO: 60701 - RNA, 37 nt, Artificial Sequence
  Synthetic Oligonucleotide; CD80 exon 7; Set C
uuccuccuucucucucugcaucuuggggcaaagccuu

SEQ ID NO: 60702 - RNA, 21 nt, Artificial Sequence
  Synthetic Oligonucleotide; CD80 exon 7; Set A
ucucucucugcaucuuggggc

SEQ ID NO: 60703 - RNA, 18 nt, Artificial Sequence
  Synthetic Oligonucleotide; CD80 exon 7; Set C
cucucucugcaucuuggg

SEQ ID NO: 60704 - RNA, 16 nt, Artificial Sequence
  Synthetic Oligonucleotide; CD80 exon 7; Set C
ucucucugcaucuugg

SEQ ID NO: 60705 - RNA, 20 nt, Artificial Sequence
  Synthetic Oligonucleotide; CD80 exon 7; Set A
ucucucucugcaucuugggg

SEQ ID NO: 60706 - RNA, 22 nt, Artificial Sequence
  Synthetic Oligonucleotide; CD80 exon 7; Set A
uucucucucugcaucuuggggc

SEQ ID NO: 60707 - RNA, 19 nt, Artificial Sequence
  Synthetic Oligonucleotide; CD80 exon 7; Set C
ucucucucugcaucuuggg

SEQ ID NO: 60708 - RNA, 17 nt, Artificial Sequence
  Synthetic Oligonucleotide; CD80 exon 7; Set C
cucucucugcaucuugg

SEQ ID NO: 60709 - RNA, 21 nt, Artificial Sequence
  Synthetic Oligonucleotide; CD80 exon 7; Set A
uucucucucugcaucuugggg

SEQ ID NO: 60710 - RNA, 15 nt, Artificial Sequence
  Synthetic Oligonucleotide; CD80 exon 7; Set C
ucucucugcaucuug

SEQ ID NO: 60711 - RNA, 18 nt, Artificial Sequence
  Synthetic Oligonucleotide; CD80 exon 7; Set C
ucucucucugcaucuugg

SEQ ID NO: 60712 - RNA, 16 nt, Artificial Sequence
  Synthetic Oligonucleotide; CD80 exon 7; Set C
cucucucugcaucuug

SEQ ID NO: 60713 - RNA, 19 nt, Artificial Sequence
  Synthetic Oligonucleotide; CD80 exon 7; Set C
uucucucucugcaucuugg

SEQ ID NO: 60714 - RNA, 17 nt, Artificial Sequence
  Synthetic Oligonucleotide; CD80 exon 7; Set C
ucucucucugcaucuug

SEQ ID NO: 60715 - RNA, 18 nt, Artificial Sequence
  Synthetic Oligonucleotide; CD80 exon 7; Set C
uucucucucugcaucuug

SEQ ID NO: 60716 - RNA, 17 nt, Artificial Sequence
  Synthetic Oligonucleotide; CD80 exon 7; Set C
uucucucucugcaucuu

SEQ ID NO: 60717 - RNA, 28 nt, Artificial Sequence
  Synthetic Oligonucleotide; CD80 exon 7; Set C
uccuccuucucucucugcaucuuggggc

SEQ ID NO: 60718 - RNA, 27 nt, Artificial Sequence
  Synthetic Oligonucleotide; CD80 exon 7; Set C
uccuccuucucucucugcaucuugggg

SEQ ID NO: 60719 - RNA, 29 nt, Artificial Sequence
  Synthetic Oligonucleotide; CD80 exon 7; Set C
uuccuccuucucucucugcaucuuggggc

SEQ ID NO: 60720 - RNA, 26 nt, Artificial Sequence
  Synthetic Oligonucleotide; CD80 exon 7; Set C
uccuccuucucucucugcaucuuggg

SEQ ID NO: 60721 - RNA, 28 nt, Artificial Sequence
  Synthetic Oligonucleotide; CD80 exon 7; Set C
uuccuccuucucucucugcaucuugggg

SEQ ID NO: 60722 - RNA, 27 nt, Artificial Sequence
  Synthetic Oligonucleotide; CD80 exon 7; Set C
uuccuccuucucucucugcaucuuggg

SEQ ID NO: 60723 - RNA, 25 nt, Artificial Sequence
  Synthetic Oligonucleotide; CD80 exon 7; Set A
uccuccuucucucucugcaucuugg

SEQ ID NO: 60724 - RNA, 26 nt, Artificial Sequence
  Synthetic Oligonucleotide; CD80 exon 7; Set A
uuccuccuucucucucugcaucuugg

SEQ ID NO: 60725 - RNA, 24 nt, Artificial Sequence
  Synthetic Oligonucleotide; CD80 exon 7; Set A
uccuccuucucucucugcaucuug

SEQ ID NO: 60726 - RNA, 25 nt, Artificial Sequence
  Synthetic Oligonucleotide; CD80 exon 7; Set A
uuccuccuucucucucugcaucuug

SEQ ID NO: 60727 - RNA, 38 nt, Artificial Sequence
  Synthetic Oligonucleotide; CD80 exon 7; Set C
uacagggcguacacuuucccuucucaaucucucauucc

SEQ ID NO: 60728 - RNA, 37 nt, Artificial Sequence
  Synthetic Oligonucleotide; CD80 exon 7; Set C
uacagggcguacacuuucccuucucaaucucucauuc

SEQ ID NO: 60729 - RNA, 39 nt, Artificial Sequence
  Synthetic Oligonucleotide; CD80 exon 7; Set C
auacagggcguacacuuucccuucucaaucucucauucc

SEQ ID NO: 60730 - RNA, 38 nt, Artificial Sequence
  Synthetic Oligonucleotide; CD80 exon 7; Set C
auacagggcguacacuuucccuucucaaucucucauuc

SEQ ID NO: 60731 - RNA, 40 nt, Artificial Sequence
  Synthetic Oligonucleotide; CD80 exon 7; Set C
uauacagggcguacacuuucccuucucaaucucucauucc

SEQ ID NO: 60732 - RNA, 39 nt, Artificial Sequence
  Synthetic Oligonucleotide; CD80 exon 7; Set C
uauacagggcguacacuuucccuucucaaucucucauuc

SEQ ID NO: 60733 - RNA, 40 nt, Artificial Sequence
  Synthetic Oligonucleotide; CD80 exon 7; Set C
uuauacagggcguacacuuucccuucucaaucucucauuc

SEQ ID NO: 60734 - RNA, 16 nt, Artificial Sequence
  Synthetic Oligonucleotide; CD80 exon 7; Set C
guacacuuucccuucu

SEQ ID NO: 60735 - RNA, 17 nt, Artificial Sequence
  Synthetic Oligonucleotide; CD80 exon 7; Set C
cguacacuuucccuucu

SEQ ID NO: 60736 - RNA, 28 nt, Artificial Sequence
  Synthetic Oligonucleotide; CD80 exon 7; Set C
uacagggcguacacuuucccuucucaau

SEQ ID NO: 60737 - RNA, 29 nt, Artificial Sequence
  Synthetic Oligonucleotide; CD80 exon 7; Set C
auacagggcguacacuuucccuucucaau

SEQ ID NO: 60738 - RNA, 30 nt, Artificial Sequence
  Synthetic Oligonucleotide; CD80 exon 7; Set C
uauacagggcguacacuuucccuucucaau

SEQ ID NO: 60739 - RNA, 31 nt, Artificial Sequence
  Synthetic Oligonucleotide; CD80 exon 7; Set C
uuauacagggcguacacuuucccuucucaau

SEQ ID NO: 60740 - RNA, 24 nt, Artificial Sequence
  Synthetic Oligonucleotide; CD80 exon 7; Set C
uacagggcguacacuuucccuucu

SEQ ID NO: 60741 - RNA, 32 nt, Artificial Sequence
  Synthetic Oligonucleotide; CD80 exon 7; Set C
guuauacagggcguacacuuucccuucucaau

SEQ ID NO: 60742 - RNA, 25 nt, Artificial Sequence
  Synthetic Oligonucleotide; CD80 exon 7; Set C
auacagggcguacacuuucccuucu

SEQ ID NO: 60743 - RNA, 26 nt, Artificial Sequence
  Synthetic Oligonucleotide; CD80 exon 7; Set C
uauacagggcguacacuuucccuucu

SEQ ID NO: 60744 - RNA, 27 nt, Artificial Sequence
  Synthetic Oligonucleotide; CD80 exon 7; Set C
uuauacagggcguacacuuucccuucu

SEQ ID NO: 60745 - RNA, 28 nt, Artificial Sequence
  Synthetic Oligonucleotide; CD80 exon 7; Set C
guuauacagggcguacacuuucccuucu

SEQ ID NO: 60746 - RNA, 15 nt, Artificial Sequence
  Synthetic Oligonucleotide; CD80 exon 7; Set C
cagggcguacacuuu

SEQ ID NO: 60747 - RNA, 17 nt, Artificial Sequence
  Synthetic Oligonucleotide; CD80 exon 7; Set C
acagggcguacacuuuc

SEQ ID NO: 60748 - RNA, 20 nt, Artificial Sequence
  Synthetic Oligonucleotide; CD80 exon 7; Set A
auacagggcguacacuuucc

SEQ ID NO: 60749 - RNA, 21 nt, Artificial Sequence
  Synthetic Oligonucleotide; CD80 exon 7; Set A
uauacagggcguacacuuucc

SEQ ID NO: 60750 - RNA, 22 nt, Artificial Sequence
  Synthetic Oligonucleotide; CD80 exon 7; Set A
uuauacagggcguacacuuucc

SEQ ID NO: 60751 - RNA, 23 nt, Artificial Sequence
  Synthetic Oligonucleotide; CD80 exon 7; Set A
uguuauacagggcguacacuuuc

SEQ ID NO: 60752 - RNA, 22 nt, Artificial Sequence
  Synthetic Oligonucleotide; CD80 exon 7; Set A
uguuauacagggcguacacuuu

SEQ ID NO: 60753 - RNA, 21 nt, Artificial Sequence
  Synthetic Oligonucleotide; CD80 exon 7; Set A
uguuauacagggcguacacuu

SEQ ID NO: 60754 - RNA, 20 nt, Artificial Sequence
  Synthetic Oligonucleotide; CD80 exon 7; Set A
uguuauacagggcguacacu

SEQ ID NO: 60755 - RNA, 19 nt, Artificial Sequence
  Synthetic Oligonucleotide; CD80 exon 7; Set C
uguuauacagggcguacac

SEQ ID NO: 60756 - RNA, 18 nt, Artificial Sequence
  Synthetic Oligonucleotide; CD80 exon 7; Set C
uguuauacagggcguaca

SEQ ID NO: 60757 - RNA, 17 nt, Artificial Sequence
  Synthetic Oligonucleotide; CD80 exon 7; Set C
uguuauacagggcguac

SEQ ID NO: 60758 - RNA, 16 nt, Artificial Sequence
  Synthetic Oligonucleotide; CD80 exon 7; Set C
uguuauacagggcgua

SEQ ID NO: 60759 - RNA, 15 nt, Artificial Sequence
  Synthetic Oligonucleotide; CD80 exon 7; Set C
uguuauacagggcgu

SEQ ID NO: 60760 - RNA, 39 nt, Artificial Sequence
  Synthetic Oligonucleotide; CD80 exon 7; Set C
uugcuucugcggacacuguuauacagggcguacacuuuc

SEQ ID NO: 60761 - RNA, 36 nt, Artificial Sequence
  Synthetic Oligonucleotide; CD80 exon 7; Set C
uugcuucugcggacacuguuauacagggcguacacu

SEQ ID NO: 60762 - RNA, 35 nt, Artificial Sequence
  Synthetic Oligonucleotide; CD80 exon 7; Set C
uugcuucugcggacacuguuauacagggcguacac

SEQ ID NO: 60763 - RNA, 34 nt, Artificial Sequence
  Synthetic Oligonucleotide; CD80 exon 7; Set C
uugcuucugcggacacuguuauacagggcguaca

SEQ ID NO: 60764 - RNA, 33 nt, Artificial Sequence
  Synthetic Oligonucleotide; CD80 exon 7; Set C
uugcuucugcggacacuguuauacagggcguac

SEQ ID NO: 60765 - RNA, 25 nt, Artificial Sequence
  Synthetic Oligonucleotide; CD80 exon 7; Set A
uugcuucugcggacacuguuauaca

SEQ ID NO: 60766 - RNA, 21 nt, Artificial Sequence
  Synthetic Oligonucleotide; CD80 exon 7; Set A
uugcuucugcggacacuguua

SEQ ID NO: 60767 - RNA, 20 nt, Artificial Sequence
  Synthetic Oligonucleotide; CD80 exon 7; Set A
uugcuucugcggacacuguu

SEQ ID NO: 60768 - RNA, 35 nt, Artificial Sequence
  Synthetic Oligonucleotide; CD80 exon 7; Set C
uuucagccccuugcuucugcggacacuguuauaca

SEQ ID NO: 60769 - RNA, 34 nt, Artificial Sequence
  Synthetic Oligonucleotide; CD80 exon 7; Set C
uuucagccccuugcuucugcggacacuguuauac

SEQ ID NO: 60770 - RNA, 36 nt, Artificial Sequence
  Synthetic Oligonucleotide; CD80 exon 7; Set C
uuuucagccccuugcuucugcggacacuguuauaca

SEQ ID NO: 60771 - RNA, 33 nt, Artificial Sequence
  Synthetic Oligonucleotide; CD80 exon 7; Set C
uuucagccccuugcuucugcggacacuguuaua

SEQ ID NO: 60772 - RNA, 35 nt, Artificial Sequence
  Synthetic Oligonucleotide; CD80 exon 7; Set C
uuuucagccccuugcuucugcggacacuguuauac

SEQ ID NO: 60773 - RNA, 37 nt, Artificial Sequence
  Synthetic Oligonucleotide; CD80 exon 7; Set C
cuuuucagccccuugcuucugcggacacuguuauaca

SEQ ID NO: 60774 - RNA, 32 nt, Artificial Sequence
  Synthetic Oligonucleotide; CD80 exon 7; Set C
uuucagccccuugcuucugcggacacuguuau

SEQ ID NO: 60775 - RNA, 34 nt, Artificial Sequence
  Synthetic Oligonucleotide; CD80 exon 7; Set C
uuuucagccccuugcuucugcggacacuguuaua

SEQ ID NO: 60776 - RNA, 36 nt, Artificial Sequence
  Synthetic Oligonucleotide; CD80 exon 7; Set C
cuuuucagccccuugcuucugcggacacuguuauac

SEQ ID NO: 60777 - RNA, 38 nt, Artificial Sequence
  Synthetic Oligonucleotide; CD80 exon 7; Set C
ucuuuucagccccuugcuucugcggacacuguuauaca

SEQ ID NO: 60778 - RNA, 31 nt, Artificial Sequence
  Synthetic Oligonucleotide; CD80 exon 7; Set C
uuucagccccuugcuucugcggacacuguua

SEQ ID NO: 60779 - RNA, 33 nt, Artificial Sequence
  Synthetic Oligonucleotide; CD80 exon 7; Set C
uuuucagccccuugcuucugcggacacuguuau

SEQ ID NO: 60780 - RNA, 35 nt, Artificial Sequence
  Synthetic Oligonucleotide; CD80 exon 7; Set C
cuuuucagccccuugcuucugcggacacuguuaua

SEQ ID NO: 60781 - RNA, 37 nt, Artificial Sequence
  Synthetic Oligonucleotide; CD80 exon 7; Set C
ucuuuucagccccuugcuucugcggacacuguuauac

SEQ ID NO: 60782 - RNA, 39 nt, Artificial Sequence
  Synthetic Oligonucleotide; CD80 exon 7; Set C
aucuuuucagccccuugcuucugcggacacuguuauaca

SEQ ID NO: 60783 - RNA, 32 nt, Artificial Sequence
  Synthetic Oligonucleotide; CD80 exon 7; Set C
uuuucagccccuugcuucugcggacacuguua

SEQ ID NO: 60784 - RNA, 34 nt, Artificial Sequence
  Synthetic Oligonucleotide; CD80 exon 7; Set C
cuuuucagccccuugcuucugcggacacuguuau

SEQ ID NO: 60785 - RNA, 36 nt, Artificial Sequence
  Synthetic Oligonucleotide; CD80 exon 7; Set C
ucuuuucagccccuugcuucugcggacacuguuaua

SEQ ID NO: 60786 - RNA, 38 nt, Artificial Sequence
  Synthetic Oligonucleotide; CD80 exon 7; Set C
aucuuuucagccccuugcuucugcggacacuguuauac

SEQ ID NO: 60787 - RNA, 30 nt, Artificial Sequence
  Synthetic Oligonucleotide; CD80 exon 7; Set C
uuucagccccuugcuucugcggacacuguu

SEQ ID NO: 60788 - RNA, 40 nt, Artificial Sequence
  Synthetic Oligonucleotide; CD80 exon 7; Set C
gaucuuuucagccccuugcuucugcggacacuguuauaca

SEQ ID NO: 60789 - RNA, 33 nt, Artificial Sequence
  Synthetic Oligonucleotide; CD80 exon 7; Set C
cuuuucagccccuugcuucugcggacacuguua

SEQ ID NO: 60790 - RNA, 35 nt, Artificial Sequence
  Synthetic Oligonucleotide; CD80 exon 7; Set C
ucuuuucagccccuugcuucugcggacacuguuau

SEQ ID NO: 60791 - RNA, 37 nt, Artificial Sequence
  Synthetic Oligonucleotide; CD80 exon 7; Set C
aucuuuucagccccuugcuucugcggacacuguuaua

SEQ ID NO: 60792 - RNA, 39 nt, Artificial Sequence
  Synthetic Oligonucleotide; CD80 exon 7; Set C
gaucuuuucagccccuugcuucugcggacacuguuauac

SEQ ID NO: 60793 - RNA, 31 nt, Artificial Sequence
  Synthetic Oligonucleotide; CD80 exon 7; Set C
uuuucagccccuugcuucugcggacacuguu

SEQ ID NO: 60794 - RNA, 34 nt, Artificial Sequence
  Synthetic Oligonucleotide; CD80 exon 7; Set C
ucuuuucagccccuugcuucugcggacacuguua

SEQ ID NO: 60795 - RNA, 36 nt, Artificial Sequence
  Synthetic Oligonucleotide; CD80 exon 7; Set C
aucuuuucagccccuugcuucugcggacacuguuau

SEQ ID NO: 60796 - RNA, 38 nt, Artificial Sequence
  Synthetic Oligonucleotide; CD80 exon 7; Set C
gaucuuuucagccccuugcuucugcggacacuguuaua

SEQ ID NO: 60797 - RNA, 40 nt, Artificial Sequence
  Synthetic Oligonucleotide; CD80 exon 7; Set C
agaucuuuucagccccuugcuucugcggacacuguuauac

SEQ ID NO: 60798 - RNA, 32 nt, Artificial Sequence
  Synthetic Oligonucleotide; CD80 exon 7; Set C
cuuuucagccccuugcuucugcggacacuguu

SEQ ID NO: 60799 - RNA, 37 nt, Artificial Sequence
  Synthetic Oligonucleotide; CD80 exon 7; Set C
gaucuuuucagccccuugcuucugcggacacuguuau

SEQ ID NO: 60800 - RNA, 35 nt, Artificial Sequence
  Synthetic Oligonucleotide; CD80 exon 7; Set C
aucuuuucagccccuugcuucugcggacacuguua

SEQ ID NO: 60801 - RNA, 39 nt, Artificial Sequence
  Synthetic Oligonucleotide; CD80 exon 7; Set C
agaucuuuucagccccuugcuucugcggacacuguuaua

SEQ ID NO: 60802 - RNA, 33 nt, Artificial Sequence
  Synthetic Oligonucleotide; CD80 exon 7; Set C
ucuuuucagccccuugcuucugcggacacuguu

SEQ ID NO: 60803 - RNA, 38 nt, Artificial Sequence
  Synthetic Oligonucleotide; CD80 exon 7; Set C
agaucuuuucagccccuugcuucugcggacacuguuau

SEQ ID NO: 60804 - RNA, 36 nt, Artificial Sequence
  Synthetic Oligonucleotide; CD80 exon 7; Set C
gaucuuuucagccccuugcuucugcggacacuguua

SEQ ID NO: 60805 - RNA, 40 nt, Artificial Sequence
  Synthetic Oligonucleotide; CD80 exon 7; Set C
cagaucuuuucagccccuugcuucugcggacacuguuaua

SEQ ID NO: 60806 - RNA, 34 nt, Artificial Sequence
  Synthetic Oligonucleotide; CD80 exon 7; Set C
aucuuuucagccccuugcuucugcggacacuguu

SEQ ID NO: 60807 - RNA, 39 nt, Artificial Sequence
  Synthetic Oligonucleotide; CD80 exon 7; Set C
cagaucuuuucagccccuugcuucugcggacacuguuau

SEQ ID NO: 60808 - RNA, 37 nt, Artificial Sequence
  Synthetic Oligonucleotide; CD80 exon 7; Set C
agaucuuuucagccccuugcuucugcggacacuguua

SEQ ID NO: 60809 - RNA, 35 nt, Artificial Sequence
  Synthetic Oligonucleotide; CD80 exon 7; Set C
gaucuuuucagccccuugcuucugcggacacuguu

SEQ ID NO: 60810 - RNA, 40 nt, Artificial Sequence
  Synthetic Oligonucleotide; CD80 exon 7; Set C
ucagaucuuuucagccccuugcuucugcggacacuguuau

SEQ ID NO: 60811 - RNA, 38 nt, Artificial Sequence
  Synthetic Oligonucleotide; CD80 exon 7; Set C
cagaucuuuucagccccuugcuucugcggacacuguua

SEQ ID NO: 60812 - RNA, 36 nt, Artificial Sequence
  Synthetic Oligonucleotide; CD80 exon 7; Set C
agaucuuuucagccccuugcuucugcggacacuguu

SEQ ID NO: 60813 - RNA, 39 nt, Artificial Sequence
  Synthetic Oligonucleotide; CD80 exon 7; Set C
ucagaucuuuucagccccuugcuucugcggacacuguua

SEQ ID NO: 60814 - RNA, 37 nt, Artificial Sequence
  Synthetic Oligonucleotide; CD80 exon 7; Set C
cagaucuuuucagccccuugcuucugcggacacuguu

SEQ ID NO: 60815 - RNA, 40 nt, Artificial Sequence
  Synthetic Oligonucleotide; CD80 exon 7; Set C
uucagaucuuuucagccccuugcuucugcggacacuguua

SEQ ID NO: 60816 - RNA, 38 nt, Artificial Sequence
  Synthetic Oligonucleotide; CD80 exon 7; Set C
ucagaucuuuucagccccuugcuucugcggacacuguu

SEQ ID NO: 60817 - RNA, 39 nt, Artificial Sequence
  Synthetic Oligonucleotide; CD80 exon 7; Set C
uucagaucuuuucagccccuugcuucugcggacacuguu

SEQ ID NO: 60818 - RNA, 40 nt, Artificial Sequence
  Synthetic Oligonucleotide; CD80 exon 7; Set C
cuucagaucuuuucagccccuugcuucugcggacacuguu

SEQ ID NO: 60819 - RNA, 15 nt, Artificial Sequence
  Synthetic Oligonucleotide; CD80 exon 7; Set C
cuuuucagccccuug

SEQ ID NO: 60820 - RNA, 16 nt, Artificial Sequence
  Synthetic Oligonucleotide; CD80 exon 7; Set C
ucuuuucagccccuug

SEQ ID NO: 60821 - RNA, 17 nt, Artificial Sequence
  Synthetic Oligonucleotide; CD80 exon 7; Set C
aucuuuucagccccuug

SEQ ID NO: 60822 - RNA, 18 nt, Artificial Sequence
  Synthetic Oligonucleotide; CD80 exon 7; Set C
gaucuuuucagccccuug

SEQ ID NO: 60823 - RNA, 19 nt, Artificial Sequence
  Synthetic Oligonucleotide; CD80 exon 7; Set C
agaucuuuucagccccuug

SEQ ID NO: 60824 - RNA, 20 nt, Artificial Sequence
  Synthetic Oligonucleotide; CD80 exon 7; Set C
cagaucuuuucagccccuug

SEQ ID NO: 60825 - RNA, 21 nt, Artificial Sequence
  Synthetic Oligonucleotide; CD80 exon 7; Set C
ucagaucuuuucagccccuug

SEQ ID NO: 60826 - RNA, 23 nt, Artificial Sequence
  Synthetic Oligonucleotide; CD80 exon 7; Set A
cuucagaucuuuucagccccuug

SEQ ID NO: 60827 - RNA, 24 nt, Artificial Sequence
  Synthetic Oligonucleotide; CD80 exon 7; Set A
ccuucagaucuuuucagccccuug

SEQ ID NO: 60828 - RNA, 30 nt, Artificial Sequence
  Synthetic Oligonucleotide; CD80 exon 7; Set C
aggcuaccuucagaucuuuucagccccuug

SEQ ID NO: 60829 - RNA, 35 nt, Artificial Sequence
  Synthetic Oligonucleotide; CD80 exon 7; Set C
gacggaggcuaccuucagaucuuuucagccccuug

SEQ ID NO: 60830 - RNA, 36 nt, Artificial Sequence
  Synthetic Oligonucleotide; CD80 exon 7; Set C
ugacggaggcuaccuucagaucuuuucagccccuug

SEQ ID NO: 60831 - RNA, 37 nt, Artificial Sequence
  Synthetic Oligonucleotide; CD80 exon 7; Set C
augacggaggcuaccuucagaucuuuucagccccuug

SEQ ID NO: 60832 - RNA, 38 nt, Artificial Sequence
  Synthetic Oligonucleotide; CD80 exon 7; Set C
gaugacggaggcuaccuucagaucuuuucagccccuug

SEQ ID NO: 60833 - RNA, 39 nt, Artificial Sequence
  Synthetic Oligonucleotide; CD80 exon 7; Set C
agaugacggaggcuaccuucagaucuuuucagccccuug

SEQ ID NO: 60834 - RNA, 17 nt, Artificial Sequence
  Synthetic Oligonucleotide; CD80 exon 7; Set C
aggcuaccuucagaucu

SEQ ID NO: 60835 - RNA, 16 nt, Artificial Sequence
  Synthetic Oligonucleotide; CD80 exon 7; Set C
aggcuaccuucagauc

SEQ ID NO: 60836 - RNA, 15 nt, Artificial Sequence
  Synthetic Oligonucleotide; CD80 exon 7; Set C
aggcuaccuucagau

SEQ ID NO: 60837 - RNA, 17 nt, Artificial Sequence
  Synthetic Oligonucleotide; CD80 exon 7; Set B
gacggaggcuaccuuca

SEQ ID NO: 60838 - RNA, 16 nt, Artificial Sequence
  Synthetic Oligonucleotide; CD80 exon 7; Set C
gacggaggcuaccuuc

SEQ ID NO: 60839 - RNA, 19 nt, Artificial Sequence
  Synthetic Oligonucleotide; CD80 exon 7; Set B
augacggaggcuaccuuca

SEQ ID NO: 60840 - RNA, 17 nt, Artificial Sequence
  Synthetic Oligonucleotide; CD80 exon 7; Set C
ugacggaggcuaccuuc

SEQ ID NO: 60841 - RNA, 15 nt, Artificial Sequence
  Synthetic Oligonucleotide; CD80 exon 7; Set C
gacggaggcuaccuu

SEQ ID NO: 60842 - RNA, 18 nt, Artificial Sequence
  Synthetic Oligonucleotide; CD80 exon 7; Set C
augacggaggcuaccuuc

SEQ ID NO: 60843 - RNA, 16 nt, Artificial Sequence
  Synthetic Oligonucleotide; CD80 exon 7; Set C
ugacggaggcuaccuu

SEQ ID NO: 60844 - RNA, 19 nt, Artificial Sequence
  Synthetic Oligonucleotide; CD80 exon 7; Set B
gaugacggaggcuaccuuc

SEQ ID NO: 60845 - RNA, 17 nt, Artificial Sequence
  Synthetic Oligonucleotide; CD80 exon 7; Set C
augacggaggcuaccuu

SEQ ID NO: 60846 - RNA, 15 nt, Artificial Sequence
  Synthetic Oligonucleotide; CD80 exon 7; Set C
ugacggaggcuaccu

SEQ ID NO: 60847 - RNA, 20 nt, Artificial Sequence
  Synthetic Oligonucleotide; CD80 exon 7; Set B
agaugacggaggcuaccuuc

SEQ ID NO: 60848 - RNA, 18 nt, Artificial Sequence
  Synthetic Oligonucleotide; CD80 exon 7; Set B
gaugacggaggcuaccuu

SEQ ID NO: 60849 - RNA, 16 nt, Artificial Sequence
  Synthetic Oligonucleotide; CD80 exon 7; Set C
augacggaggcuaccu

SEQ ID NO: 60850 - RNA, 19 nt, Artificial Sequence
  Synthetic Oligonucleotide; CD80 exon 7; Set B
agaugacggaggcuaccuu

SEQ ID NO: 60851 - RNA, 17 nt, Artificial Sequence
  Synthetic Oligonucleotide; CD80 exon 7; Set C
gaugacggaggcuaccu

SEQ ID NO: 60852 - RNA, 18 nt, Artificial Sequence
  Synthetic Oligonucleotide; CD80 exon 7; Set B
agaugacggaggcuaccu

SEQ ID NO: 60853 - RNA, 23 nt, Artificial Sequence
  Synthetic Oligonucleotide; CD80 exon 7; Set B
gaagagaugacggaggcuaccuu

SEQ ID NO: 60854 - RNA, 40 nt, Artificial Sequence
  Synthetic Oligonucleotide; CD80 exon 7; Set C
uguaucccagaagagaugacggaggcuaccuucagaucuu

SEQ ID NO: 60855 - RNA, 24 nt, Artificial Sequence
  Synthetic Oligonucleotide; CD80 exon 7; Set B
agaagagaugacggaggcuaccuu

SEQ ID NO: 60856 - RNA, 22 nt, Artificial Sequence
  Synthetic Oligonucleotide; CD80 exon 7; Set B
gaagagaugacggaggcuaccu

SEQ ID NO: 60857 - RNA, 23 nt, Artificial Sequence
  Synthetic Oligonucleotide; CD80 exon 7; Set B
agaagagaugacggaggcuaccu

SEQ ID NO: 60858 - RNA, 16 nt, Artificial Sequence
  Synthetic Oligonucleotide; CD80 exon 7; Set C
gaagagaugacggagg

SEQ ID NO: 60859 - RNA, 17 nt, Artificial Sequence
  Synthetic Oligonucleotide; CD80 exon 7; Set C
agaagagaugacggagg

SEQ ID NO: 60860 - RNA, 40 nt, Artificial Sequence
  Synthetic Oligonucleotide; CD80 exon 7; Set C
gauccauguaucccagaagagaugacggaggcuaccuuca

SEQ ID NO: 60861 - RNA, 39 nt, Artificial Sequence
  Synthetic Oligonucleotide; CD80 exon 7; Set C
gauccauguaucccagaagagaugacggaggcuaccuuc

SEQ ID NO: 60862 - RNA, 26 nt, Artificial Sequence
  Synthetic Oligonucleotide; CD80 exon 7; Set B
gauccauguaucccagaagagaugac

SEQ ID NO: 60863 - RNA, 25 nt, Artificial Sequence
  Synthetic Oligonucleotide; CD80 exon 7; Set B
gauccauguaucccagaagagauga

SEQ ID NO: 60864 - RNA, 36 nt, Artificial Sequence
  Synthetic Oligonucleotide; CD80 exon 7; Set C
ugauccccacgauccauguaucccagaagagaugac

SEQ ID NO: 60865 - RNA, 37 nt, Artificial Sequence
  Synthetic Oligonucleotide; CD80 exon 7; Set C
augauccccacgauccauguaucccagaagagaugac

SEQ ID NO: 60866 - RNA, 35 nt, Artificial Sequence
  Synthetic Oligonucleotide; CD80 exon 7; Set C
ugauccccacgauccauguaucccagaagagauga

SEQ ID NO: 60867 - RNA, 36 nt, Artificial Sequence
  Synthetic Oligonucleotide; CD80 exon 7; Set C
augauccccacgauccauguaucccagaagagauga

SEQ ID NO: 60868 - RNA, 35 nt, Artificial Sequence
  Synthetic Oligonucleotide; CD80 exon 7; Set C
augauccccacgauccauguaucccagaagagaug

SEQ ID NO: 60869 - RNA, 29 nt, Artificial Sequence
  Synthetic Oligonucleotide; CD80 exon 7; Set C
augauccccacgauccauguaucccagaa

SEQ ID NO: 60870 - RNA, 19 nt, Artificial Sequence
  Synthetic Oligonucleotide; CD80 exon 7; Set B
ugauccccacgauccaugu

SEQ ID NO: 60871 - RNA, 20 nt, Artificial Sequence
  Synthetic Oligonucleotide; CD80 exon 7; Set B
augauccccacgauccaugu

SEQ ID NO: 60872 - RNA, 40 nt, Artificial Sequence
  Synthetic Oligonucleotide; CD80 exon 7; Set C
caaagccuuggagacaagaacaaacaauaaaaaugauaag

SEQ ID NO: 60873 - RNA, 39 nt, Artificial Sequence
  Synthetic Oligonucleotide; CD80 exon 7; Set C
caaagccuuggagacaagaacaaacaauaaaaaugauaa

SEQ ID NO: 60874 - RNA, 37 nt, Artificial Sequence
  Synthetic Oligonucleotide; CD80 exon 7; Set C
aaagccuuggagacaagaacaaacaauaaaaaugaua

SEQ ID NO: 60875 - RNA, 35 nt, Artificial Sequence
  Synthetic Oligonucleotide; CD80 exon 7; Set C
aagccuuggagacaagaacaaacaauaaaaaugau

SEQ ID NO: 60876 - RNA, 40 nt, Artificial Sequence
  Synthetic Oligonucleotide; CD80 exon 7; Set A
gcaaagccuuggagacaagaacaaacaauaaaaaugauaa

SEQ ID NO: 60877 - RNA, 38 nt, Artificial Sequence
  Synthetic Oligonucleotide; CD80 exon 7; Set C
caaagccuuggagacaagaacaaacaauaaaaaugaua

SEQ ID NO: 60878 - RNA, 36 nt, Artificial Sequence
  Synthetic Oligonucleotide; CD80 exon 7; Set C
aaagccuuggagacaagaacaaacaauaaaaaugau

SEQ ID NO: 60879 - RNA, 34 nt, Artificial Sequence
  Synthetic Oligonucleotide; CD80 exon 7; Set C
aagccuuggagacaagaacaaacaauaaaaauga

SEQ ID NO: 60880 - RNA, 39 nt, Artificial Sequence
  Synthetic Oligonucleotide; CD80 exon 7; Set A
gcaaagccuuggagacaagaacaaacaauaaaaaugaua

SEQ ID NO: 60881 - RNA, 33 nt, Artificial Sequence
  Synthetic Oligonucleotide; CD80 exon 7; Set C
aagccuuggagacaagaacaaacaauaaaaaug

SEQ ID NO: 60882 - RNA, 35 nt, Artificial Sequence
  Synthetic Oligonucleotide; CD80 exon 7; Set C
aaagccuuggagacaagaacaaacaauaaaaauga

SEQ ID NO: 60883 - RNA, 34 nt, Artificial Sequence
  Synthetic Oligonucleotide; CD80 exon 7; Set C
aaagccuuggagacaagaacaaacaauaaaaaug

SEQ ID NO: 60884 - RNA, 33 nt, Artificial Sequence
  Synthetic Oligonucleotide; CD80 exon 7; Set C
aaagccuuggagacaagaacaaacaauaaaaau

SEQ ID NO: 60885 - RNA, 32 nt, Artificial Sequence
  Synthetic Oligonucleotide; CD80 exon 7; Set C
aaagccuuggagacaagaacaaacaauaaaaa

SEQ ID NO: 60886 - RNA, 34 nt, Artificial Sequence
  Synthetic Oligonucleotide; CD80 exon 7; Set C
caaagccuuggagacaagaacaaacaauaaaaau

SEQ ID NO: 60887 - RNA, 33 nt, Artificial Sequence
  Synthetic Oligonucleotide; CD80 exon 7; Set C
caaagccuuggagacaagaacaaacaauaaaaa

SEQ ID NO: 60888 - RNA, 31 nt, Artificial Sequence
  Synthetic Oligonucleotide; CD80 exon 7; Set C
aaagccuuggagacaagaacaaacaauaaaa

SEQ ID NO: 60889 - RNA, 35 nt, Artificial Sequence
  Synthetic Oligonucleotide; CD80 exon 7; Set C
gcaaagccuuggagacaagaacaaacaauaaaaau

SEQ ID NO: 60890 - RNA, 34 nt, Artificial Sequence
  Synthetic Oligonucleotide; CD80 exon 7; Set C
gcaaagccuuggagacaagaacaaacaauaaaaa

SEQ ID NO: 60891 - RNA, 32 nt, Artificial Sequence
  Synthetic Oligonucleotide; CD80 exon 7; Set C
caaagccuuggagacaagaacaaacaauaaaa

SEQ ID NO: 60892 - RNA, 30 nt, Artificial Sequence
  Synthetic Oligonucleotide; CD80 exon 7; Set C
aaagccuuggagacaagaacaaacaauaaa

SEQ ID NO: 60893 - RNA, 33 nt, Artificial Sequence
  Synthetic Oligonucleotide; CD80 exon 7; Set A
gcaaagccuuggagacaagaacaaacaauaaaa

SEQ ID NO: 60894 - RNA, 31 nt, Artificial Sequence
  Synthetic Oligonucleotide; CD80 exon 7; Set C
caaagccuuggagacaagaacaaacaauaaa

SEQ ID NO: 60895 - RNA, 29 nt, Artificial Sequence
  Synthetic Oligonucleotide; CD80 exon 7; Set C
aaagccuuggagacaagaacaaacaauaa

SEQ ID NO: 60896 - RNA, 28 nt, Artificial Sequence
  Synthetic Oligonucleotide; CD80 exon 7; Set C
aaagccuuggagacaagaacaaacaaua

SEQ ID NO: 60897 - RNA, 32 nt, Artificial Sequence
  Synthetic Oligonucleotide; CD80 exon 7; Set A
gcaaagccuuggagacaagaacaaacaauaaa

SEQ ID NO: 60898 - RNA, 30 nt, Artificial Sequence
  Synthetic Oligonucleotide; CD80 exon 7; Set C
caaagccuuggagacaagaacaaacaauaa

SEQ ID NO: 60899 - RNA, 27 nt, Artificial Sequence
  Synthetic Oligonucleotide; CD80 exon 7; Set C
aaagccuuggagacaagaacaaacaau

SEQ ID NO: 60900 - RNA, 29 nt, Artificial Sequence
  Synthetic Oligonucleotide; CD80 exon 7; Set C
caaagccuuggagacaagaacaaacaaua

SEQ ID NO: 60901 - RNA, 31 nt, Artificial Sequence
  Synthetic Oligonucleotide; CD80 exon 7; Set A
gcaaagccuuggagacaagaacaaacaauaa

SEQ ID NO: 60902 - RNA, 21 nt, Artificial Sequence
  Synthetic Oligonucleotide; CD80 exon 7; Set C
gccuuggagacaagaacaaac

SEQ ID NO: 60903 - RNA, 28 nt, Artificial Sequence
  Synthetic Oligonucleotide; CD80 exon 7; Set C
caaagccuuggagacaagaacaaacaau

SEQ ID NO: 60904 - RNA, 30 nt, Artificial Sequence
  Synthetic Oligonucleotide; CD80 exon 7; Set A
gcaaagccuuggagacaagaacaaacaaua

SEQ ID NO: 60905 - RNA, 26 nt, Artificial Sequence
  Synthetic Oligonucleotide; CD80 exon 7; Set C
aaagccuuggagacaagaacaaacaa

SEQ ID NO: 60906 - RNA, 24 nt, Artificial Sequence
  Synthetic Oligonucleotide; CD80 exon 7; Set C
aagccuuggagacaagaacaaaca

SEQ ID NO: 60907 - RNA, 20 nt, Artificial Sequence
  Synthetic Oligonucleotide; CD80 exon 7; Set C
gccuuggagacaagaacaaa

SEQ ID NO: 60908 - RNA, 29 nt, Artificial Sequence
  Synthetic Oligonucleotide; CD80 exon 7; Set A
gcaaagccuuggagacaagaacaaacaau

SEQ ID NO: 60909 - RNA, 27 nt, Artificial Sequence
  Synthetic Oligonucleotide; CD80 exon 7; Set C
caaagccuuggagacaagaacaaacaa

SEQ ID NO: 60910 - RNA, 25 nt, Artificial Sequence
  Synthetic Oligonucleotide; CD80 exon 7; Set C
aaagccuuggagacaagaacaaaca

SEQ ID NO: 60911 - RNA, 23 nt, Artificial Sequence
  Synthetic Oligonucleotide; CD80 exon 7; Set C
aagccuuggagacaagaacaaac

SEQ ID NO: 60912 - RNA, 28 nt, Artificial Sequence
  Synthetic Oligonucleotide; CD80 exon 7; Set A
gcaaagccuuggagacaagaacaaacaa

SEQ ID NO: 60913 - RNA, 26 nt, Artificial Sequence
  Synthetic Oligonucleotide; CD80 exon 7; Set C
caaagccuuggagacaagaacaaaca

SEQ ID NO: 60914 - RNA, 22 nt, Artificial Sequence
  Synthetic Oligonucleotide; CD80 exon 7; Set C
aagccuuggagacaagaacaaa

SEQ ID NO: 60915 - RNA, 21 nt, Artificial Sequence
  Synthetic Oligonucleotide; CD80 exon 7; Set C
aagccuuggagacaagaacaa

SEQ ID NO: 60916 - RNA, 22 nt, Artificial Sequence
  Synthetic Oligonucleotide; CD80 exon 7; Set C
aaagccuuggagacaagaacaa

SEQ ID NO: 60917 - RNA, 16 nt, Artificial Sequence
  Synthetic Oligonucleotide; CD80 exon 7; Set C
gccuuggagacaagaa

SEQ ID NO: 60918 - RNA, 21 nt, Artificial Sequence
  Synthetic Oligonucleotide; CD80 exon 7; Set C
aaagccuuggagacaagaaca

SEQ ID NO: 60919 - RNA, 17 nt, Artificial Sequence
  Synthetic Oligonucleotide; CD80 exon 7; Set C
agccuuggagacaagaa

SEQ ID NO: 60920 - RNA, 15 nt, Artificial Sequence
  Synthetic Oligonucleotide; CD80 exon 7; Set C
gccuuggagacaaga

SEQ ID NO: 60921 - RNA, 22 nt, Artificial Sequence
  Synthetic Oligonucleotide; CD80 exon 7; Set C
caaagccuuggagacaagaaca

SEQ ID NO: 60922 - RNA, 20 nt, Artificial Sequence
  Synthetic Oligonucleotide; CD80 exon 7; Set C
aaagccuuggagacaagaac

SEQ ID NO: 60923 - RNA, 18 nt, Artificial Sequence
  Synthetic Oligonucleotide; CD80 exon 7; Set C
aagccuuggagacaagaa

SEQ ID NO: 60924 - RNA, 16 nt, Artificial Sequence
  Synthetic Oligonucleotide; CD80 exon 7; Set C
agccuuggagacaaga

SEQ ID NO: 60925 - RNA, 23 nt, Artificial Sequence
  Synthetic Oligonucleotide; CD80 exon 7; Set A
gcaaagccuuggagacaagaaca

SEQ ID NO: 60926 - RNA, 21 nt, Artificial Sequence
  Synthetic Oligonucleotide; CD80 exon 7; Set C
caaagccuuggagacaagaac

SEQ ID NO: 60927 - RNA, 17 nt, Artificial Sequence
  Synthetic Oligonucleotide; CD80 exon 7; Set C
aagccuuggagacaaga

SEQ ID NO: 60928 - RNA, 15 nt, Artificial Sequence
  Synthetic Oligonucleotide; CD80 exon 7; Set C
agccuuggagacaag

SEQ ID NO: 60929 - RNA, 22 nt, Artificial Sequence
  Synthetic Oligonucleotide; CD80 exon 7; Set C
gcaaagccuuggagacaagaac

SEQ ID NO: 60930 - RNA, 16 nt, Artificial Sequence
  Synthetic Oligonucleotide; CD80 exon 7; Set C
aagccuuggagacaag

SEQ ID NO: 60931 - RNA, 15 nt, Artificial Sequence
  Synthetic Oligonucleotide; CD80 exon 7; Set C
caaagccuuggagac

SEQ ID NO: 60932 - RNA, 16 nt, Artificial Sequence
  Synthetic Oligonucleotide; CD80 exon 7; Set C
gcaaagccuuggagac

SEQ ID NO: 60933 - RNA, 15 nt, Artificial Sequence
  Synthetic Oligonucleotide; CD80 exon 7; Set C
gcaaagccuuggaga

SEQ ID NO: 60934 - RNA, 38 nt, Artificial Sequence
  Synthetic Oligonucleotide; CD80 exon 7; Set C
cucugcaucuuggggcaaagccuuggagacaagaacaa

SEQ ID NO: 60935 - RNA, 37 nt, Artificial Sequence
  Synthetic Oligonucleotide; CD80 exon 7; Set C
cucugcaucuuggggcaaagccuuggagacaagaaca

SEQ ID NO: 60936 - RNA, 39 nt, Artificial Sequence
  Synthetic Oligonucleotide; CD80 exon 7; Set C
ucucugcaucuuggggcaaagccuuggagacaagaacaa

SEQ ID NO: 60937 - RNA, 38 nt, Artificial Sequence
  Synthetic Oligonucleotide; CD80 exon 7; Set C
ucucugcaucuuggggcaaagccuuggagacaagaaca

SEQ ID NO: 60938 - RNA, 36 nt, Artificial Sequence
  Synthetic Oligonucleotide; CD80 exon 7; Set C
cucugcaucuuggggcaaagccuuggagacaagaac

SEQ ID NO: 60939 - RNA, 40 nt, Artificial Sequence
  Synthetic Oligonucleotide; CD80 exon 7; Set C
cucucugcaucuuggggcaaagccuuggagacaagaacaa

SEQ ID NO: 60940 - RNA, 34 nt, Artificial Sequence
  Synthetic Oligonucleotide; CD80 exon 7; Set C
ucugcaucuuggggcaaagccuuggagacaagaa

SEQ ID NO: 60941 - RNA, 39 nt, Artificial Sequence
  Synthetic Oligonucleotide; CD80 exon 7; Set C
cucucugcaucuuggggcaaagccuuggagacaagaaca

SEQ ID NO: 60942 - RNA, 37 nt, Artificial Sequence
  Synthetic Oligonucleotide; CD80 exon 7; Set C
ucucugcaucuuggggcaaagccuuggagacaagaac

SEQ ID NO: 60943 - RNA, 33 nt, Artificial Sequence
  Synthetic Oligonucleotide; CD80 exon 7; Set C
ucugcaucuuggggcaaagccuuggagacaaga

SEQ ID NO: 60944 - RNA, 38 nt, Artificial Sequence
  Synthetic Oligonucleotide; CD80 exon 7; Set C
cucucugcaucuuggggcaaagccuuggagacaagaac

SEQ ID NO: 60945 - RNA, 32 nt, Artificial Sequence
  Synthetic Oligonucleotide; CD80 exon 7; Set C
ucugcaucuuggggcaaagccuuggagacaag

SEQ ID NO: 60946 - RNA, 31 nt, Artificial Sequence
  Synthetic Oligonucleotide; CD80 exon 7; Set C
ucugcaucuuggggcaaagccuuggagacaa

SEQ ID NO: 60947 - RNA, 30 nt, Artificial Sequence
  Synthetic Oligonucleotide; CD80 exon 7; Set C
ucugcaucuuggggcaaagccuuggagaca

SEQ ID NO: 60948 - RNA, 30 nt, Artificial Sequence
  Synthetic Oligonucleotide; CD80 exon 7; Set C
cucugcaucuuggggcaaagccuuggagac

SEQ ID NO: 60949 - RNA, 29 nt, Artificial Sequence
  Synthetic Oligonucleotide; CD80 exon 7; Set C
cucugcaucuuggggcaaagccuuggaga

SEQ ID NO: 60950 - RNA, 31 nt, Artificial Sequence
  Synthetic Oligonucleotide; CD80 exon 7; Set C
ucucugcaucuuggggcaaagccuuggagac

SEQ ID NO: 60951 - RNA, 39 nt, Artificial Sequence
  Synthetic Oligonucleotide; CD80 exon 7; Set C
ucucucucugcaucuuggggcaaagccuuggagacaaga

SEQ ID NO: 60952 - RNA, 37 nt, Artificial Sequence
  Synthetic Oligonucleotide; CD80 exon 7; Set C
cucucucugcaucuuggggcaaagccuuggagacaag

SEQ ID NO: 60953 - RNA, 35 nt, Artificial Sequence
  Synthetic Oligonucleotide; CD80 exon 7; Set C
ucucucugcaucuuggggcaaagccuuggagacaa

SEQ ID NO: 60954 - RNA, 28 nt, Artificial Sequence
  Synthetic Oligonucleotide; CD80 exon 7; Set C
cucugcaucuuggggcaaagccuuggag

SEQ ID NO: 60955 - RNA, 30 nt, Artificial Sequence
  Synthetic Oligonucleotide; CD80 exon 7; Set C
ucucugcaucuuggggcaaagccuuggaga

SEQ ID NO: 60956 - RNA, 32 nt, Artificial Sequence
  Synthetic Oligonucleotide; CD80 exon 7; Set C
cucucugcaucuuggggcaaagccuuggagac

SEQ ID NO: 60957 - RNA, 38 nt, Artificial Sequence
  Synthetic Oligonucleotide; CD80 exon 7; Set C
ucucucucugcaucuuggggcaaagccuuggagacaag

SEQ ID NO: 60958 - RNA, 34 nt, Artificial Sequence
  Synthetic Oligonucleotide; CD80 exon 7; Set C
ucucucugcaucuuggggcaaagccuuggagaca

SEQ ID NO: 60959 - RNA, 36 nt, Artificial Sequence
  Synthetic Oligonucleotide; CD80 exon 7; Set C
cucucucugcaucuuggggcaaagccuuggagacaa

SEQ ID NO: 60960 - RNA, 29 nt, Artificial Sequence
  Synthetic Oligonucleotide; CD80 exon 7; Set C
ucucugcaucuuggggcaaagccuuggag

SEQ ID NO: 60961 - RNA, 31 nt, Artificial Sequence
  Synthetic Oligonucleotide; CD80 exon 7; Set C
cucucugcaucuuggggcaaagccuuggaga

SEQ ID NO: 60962 - RNA, 27 nt, Artificial Sequence
  Synthetic Oligonucleotide; CD80 exon 7; Set C
cucugcaucuuggggcaaagccuugga

SEQ ID NO: 60963 - RNA, 39 nt, Artificial Sequence
  Synthetic Oligonucleotide; CD80 exon 7; Set C
uucucucucugcaucuuggggcaaagccuuggagacaag

SEQ ID NO: 60964 - RNA, 35 nt, Artificial Sequence
  Synthetic Oligonucleotide; CD80 exon 7; Set C
cucucucugcaucuuggggcaaagccuuggagaca

SEQ ID NO: 60965 - RNA, 37 nt, Artificial Sequence
  Synthetic Oligonucleotide; CD80 exon 7; Set C
ucucucucugcaucuuggggcaaagccuuggagacaa

SEQ ID NO: 60966 - RNA, 30 nt, Artificial Sequence
  Synthetic Oligonucleotide; CD80 exon 7; Set C
cucucugcaucuuggggcaaagccuuggag

SEQ ID NO: 60967 - RNA, 28 nt, Artificial Sequence
  Synthetic Oligonucleotide; CD80 exon 7; Set C
ucucugcaucuuggggcaaagccuugga

SEQ ID NO: 60968 - RNA, 26 nt, Artificial Sequence
  Synthetic Oligonucleotide; CD80 exon 7; Set C
cucugcaucuuggggcaaagccuugg

SEQ ID NO: 60969 - RNA, 36 nt, Artificial Sequence
  Synthetic Oligonucleotide; CD80 exon 7; Set C
ucucucucugcaucuuggggcaaagccuuggagaca

SEQ ID NO: 60970 - RNA, 38 nt, Artificial Sequence
  Synthetic Oligonucleotide; CD80 exon 7; Set C
uucucucucugcaucuuggggcaaagccuuggagacaa

SEQ ID NO: 60971 - RNA, 29 nt, Artificial Sequence
  Synthetic Oligonucleotide; CD80 exon 7; Set C
cucucugcaucuuggggcaaagccuugga

SEQ ID NO: 60972 - RNA, 25 nt, Artificial Sequence
  Synthetic Oligonucleotide; CD80 exon 7; Set A
cucugcaucuuggggcaaagccuug

SEQ ID NO: 60973 - RNA, 27 nt, Artificial Sequence
  Synthetic Oligonucleotide; CD80 exon 7; Set C
ucucugcaucuuggggcaaagccuugg

SEQ ID NO: 60974 - RNA, 37 nt, Artificial Sequence
  Synthetic Oligonucleotide; CD80 exon 7; Set C
uucucucucugcaucuuggggcaaagccuuggagaca

SEQ ID NO: 60975 - RNA, 24 nt, Artificial Sequence
  Synthetic Oligonucleotide; CD80 exon 7; Set A
cucugcaucuuggggcaaagccuu

SEQ ID NO: 60976 - RNA, 26 nt, Artificial Sequence
  Synthetic Oligonucleotide; CD80 exon 7; Set A
ucucugcaucuuggggcaaagccuug

SEQ ID NO: 60977 - RNA, 28 nt, Artificial Sequence
  Synthetic Oligonucleotide; CD80 exon 7; Set C
cucucugcaucuuggggcaaagccuugg

SEQ ID NO: 60978 - RNA, 22 nt, Artificial Sequence
  Synthetic Oligonucleotide; CD80 exon 7; Set A
ucugcaucuuggggcaaagccu

SEQ ID NO: 60979 - RNA, 25 nt, Artificial Sequence
  Synthetic Oligonucleotide; CD80 exon 7; Set A
ucucugcaucuuggggcaaagccuu

SEQ ID NO: 60980 - RNA, 37 nt, Artificial Sequence
  Synthetic Oligonucleotide; CD80 exon 7; Set C
cuucucucucugcaucuuggggcaaagccuuggagac

SEQ ID NO: 60981 - RNA, 27 nt, Artificial Sequence
  Synthetic Oligonucleotide; CD80 exon 7; Set C
cucucugcaucuuggggcaaagccuug

SEQ ID NO: 60982 - RNA, 21 nt, Artificial Sequence
  Synthetic Oligonucleotide; CD80 exon 7; Set A
ucugcaucuuggggcaaagcc

SEQ ID NO: 60983 - RNA, 36 nt, Artificial Sequence
  Synthetic Oligonucleotide; CD80 exon 7; Set C
cuucucucucugcaucuuggggcaaagccuuggaga

SEQ ID NO: 60984 - RNA, 26 nt, Artificial Sequence
  Synthetic Oligonucleotide; CD80 exon 7; Set C
cucucugcaucuuggggcaaagccuu

SEQ ID NO: 60985 - RNA, 20 nt, Artificial Sequence
  Synthetic Oligonucleotide; CD80 exon 7; Set A
ucugcaucuuggggcaaagc

SEQ ID NO: 60986 - RNA, 35 nt, Artificial Sequence
  Synthetic Oligonucleotide; CD80 exon 7; Set C
cuucucucucugcaucuuggggcaaagccuuggag

SEQ ID NO: 60987 - RNA, 34 nt, Artificial Sequence
  Synthetic Oligonucleotide; CD80 exon 7; Set C
cuucucucucugcaucuuggggcaaagccuugga

SEQ ID NO: 60988 - RNA, 33 nt, Artificial Sequence
  Synthetic Oligonucleotide; CD80 exon 7; Set C
cuucucucucugcaucuuggggcaaagccuugg

SEQ ID NO: 60989 - RNA, 27 nt, Artificial Sequence
  Synthetic Oligonucleotide; CD80 exon 7; Set C
cucucucugcaucuuggggcaaagccu

SEQ ID NO: 60990 - RNA, 25 nt, Artificial Sequence
  Synthetic Oligonucleotide; CD80 exon 7; Set C
ucucucugcaucuuggggcaaagcc

SEQ ID NO: 60991 - RNA, 32 nt, Artificial Sequence
  Synthetic Oligonucleotide; CD80 exon 7; Set C
cuucucucucugcaucuuggggcaaagccuug

SEQ ID NO: 60992 - RNA, 28 nt, Artificial Sequence
  Synthetic Oligonucleotide; CD80 exon 7; Set C
ucucucucugcaucuuggggcaaagccu

SEQ ID NO: 60993 - RNA, 24 nt, Artificial Sequence
  Synthetic Oligonucleotide; CD80 exon 7; Set A
ucucucugcaucuuggggcaaagc

SEQ ID NO: 60994 - RNA, 26 nt, Artificial Sequence
  Synthetic Oligonucleotide; CD80 exon 7; Set C
cucucucugcaucuuggggcaaagcc

SEQ ID NO: 60995 - RNA, 31 nt, Artificial Sequence
  Synthetic Oligonucleotide; CD80 exon 7; Set C
cuucucucucugcaucuuggggcaaagccuu

SEQ ID NO: 60996 - RNA, 25 nt, Artificial Sequence
  Synthetic Oligonucleotide; CD80 exon 7; Set A
cucucucugcaucuuggggcaaagc

SEQ ID NO: 60997 - RNA, 27 nt, Artificial Sequence
  Synthetic Oligonucleotide; CD80 exon 7; Set C
ucucucucugcaucuuggggcaaagcc

SEQ ID NO: 60998 - RNA, 23 nt, Artificial Sequence
  Synthetic Oligonucleotide; CD80 exon 7; Set A
ucucucugcaucuuggggcaaag

SEQ ID NO: 60999 - RNA, 26 nt, Artificial Sequence
  Synthetic Oligonucleotide; CD80 exon 7; Set A
ucucucucugcaucuuggggcaaagc

SEQ ID NO: 61000 - RNA, 28 nt, Artificial Sequence
  Synthetic Oligonucleotide; CD80 exon 7; Set C
uucucucucugcaucuuggggcaaagcc

SEQ ID NO: 61001 - RNA, 24 nt, Artificial Sequence
  Synthetic Oligonucleotide; CD80 exon 7; Set A
cucucucugcaucuuggggcaaag

SEQ ID NO: 61002 - RNA, 15 nt, Artificial Sequence
  Synthetic Oligonucleotide; CD80 exon 7; Set C
cucugcaucuugggg

SEQ ID NO: 61003 - RNA, 27 nt, Artificial Sequence
  Synthetic Oligonucleotide; CD80 exon 7; Set A
uucucucucugcaucuuggggcaaagc

SEQ ID NO: 61004 - RNA, 16 nt, Artificial Sequence
  Synthetic Oligonucleotide; CD80 exon 7; Set C
ucucugcaucuugggg

SEQ ID NO: 61005 - RNA, 26 nt, Artificial Sequence
  Synthetic Oligonucleotide; CD80 exon 7; Set A
uucucucucugcaucuuggggcaaag

SEQ ID NO: 61006 - RNA, 15 nt, Artificial Sequence
  Synthetic Oligonucleotide; CD80 exon 7; Set C
ucucugcaucuuggg

SEQ ID NO: 61007 - RNA, 17 nt, Artificial Sequence
  Synthetic Oligonucleotide; CD80 exon 7; Set C
cucucugcaucuugggg

SEQ ID NO: 61008 - RNA, 16 nt, Artificial Sequence
  Synthetic Oligonucleotide; CD80 exon 7; Set C
cucucugcaucuuggg

SEQ ID NO: 61009 - RNA, 15 nt, Artificial Sequence
  Synthetic Oligonucleotide; CD80 exon 7; Set C
cucucugcaucuugg

SEQ ID NO: 61010 - RNA, 35 nt, Artificial Sequence
  Synthetic Oligonucleotide; CD80 exon 7; Set C
uccuccuucucucucugcaucuuggggcaaagccu

SEQ ID NO: 61011 - RNA, 36 nt, Artificial Sequence
  Synthetic Oligonucleotide; CD80 exon 7; Set C
uuccuccuucucucucugcaucuuggggcaaagccu

SEQ ID NO: 61012 - RNA, 34 nt, Artificial Sequence
  Synthetic Oligonucleotide; CD80 exon 7; Set C
uccuccuucucucucugcaucuuggggcaaagcc

SEQ ID NO: 61013 - RNA, 33 nt, Artificial Sequence
  Synthetic Oligonucleotide; CD80 exon 7; Set C
uccuccuucucucucugcaucuuggggcaaagc

SEQ ID NO: 61014 - RNA, 35 nt, Artificial Sequence
  Synthetic Oligonucleotide; CD80 exon 7; Set C
uuccuccuucucucucugcaucuuggggcaaagcc

SEQ ID NO: 61015 - RNA, 22 nt, Artificial Sequence
  Synthetic Oligonucleotide; CD80 exon 7; Set A
cuucucucucugcaucuugggg

SEQ ID NO: 61016 - RNA, 34 nt, Artificial Sequence
  Synthetic Oligonucleotide; CD80 exon 7; Set C
uuccuccuucucucucugcaucuuggggcaaagc

SEQ ID NO: 61017 - RNA, 21 nt, Artificial Sequence
  Synthetic Oligonucleotide; CD80 exon 7; Set A
cuucucucucugcaucuuggg

SEQ ID NO: 61018 - RNA, 15 nt, Artificial Sequence
  Synthetic Oligonucleotide; CD80 exon 7; Set C
cucucucugcaucuu

SEQ ID NO: 61019 - RNA, 20 nt, Artificial Sequence
  Synthetic Oligonucleotide; CD80 exon 7; Set C
cuucucucucugcaucuugg

SEQ ID NO: 61020 - RNA, 16 nt, Artificial Sequence
  Synthetic Oligonucleotide; CD80 exon 7; Set C
ucucucucugcaucuu

SEQ ID NO: 61021 - RNA, 15 nt, Artificial Sequence
  Synthetic Oligonucleotide; CD80 exon 7; Set C
ucucucucugcaucu

SEQ ID NO: 61022 - RNA, 16 nt, Artificial Sequence
  Synthetic Oligonucleotide; CD80 exon 7; Set C
uucucucucugcaucu

SEQ ID NO: 61023 - RNA, 15 nt, Artificial Sequence
  Synthetic Oligonucleotide; CD80 exon 7; Set C
uucucucucugcauc

SEQ ID NO: 61024 - RNA, 23 nt, Artificial Sequence
  Synthetic Oligonucleotide; CD80 exon 7; Set A
uccuccuucucucucugcaucuu

SEQ ID NO: 61025 - RNA, 24 nt, Artificial Sequence
  Synthetic Oligonucleotide; CD80 exon 7; Set A
uuccuccuucucucucugcaucuu

SEQ ID NO: 61026 - RNA, 22 nt, Artificial Sequence
  Synthetic Oligonucleotide; CD80 exon 7; Set A
uccuccuucucucucugcaucu

SEQ ID NO: 61027 - RNA, 21 nt, Artificial Sequence
  Synthetic Oligonucleotide; CD80 exon 7; Set A
uccuccuucucucucugcauc

SEQ ID NO: 61028 - RNA, 23 nt, Artificial Sequence
  Synthetic Oligonucleotide; CD80 exon 7; Set A
uuccuccuucucucucugcaucu

SEQ ID NO: 61029 - RNA, 22 nt, Artificial Sequence
  Synthetic Oligonucleotide; CD80 exon 7; Set A
uuccuccuucucucucugcauc

SEQ ID NO: 61030 - RNA, 36 nt, Artificial Sequence
  Synthetic Oligonucleotide; CD80 exon 7; Set C
aaucucucauuccuccuucucucucugcaucuuggg

SEQ ID NO: 61031 - RNA, 16 nt, Artificial Sequence
  Synthetic Oligonucleotide; CD80 exon 7; Set C
uccuccuucucucucu

SEQ ID NO: 61032 - RNA, 17 nt, Artificial Sequence
  Synthetic Oligonucleotide; CD80 exon 7; Set C
uuccuccuucucucucu

SEQ ID NO: 61033 - RNA, 40 nt, Artificial Sequence
  Synthetic Oligonucleotide; CD80 exon 7; Set C
ucucaaucucucauuccuccuucucucucugcaucuuggg

SEQ ID NO: 61034 - RNA, 39 nt, Artificial Sequence
  Synthetic Oligonucleotide; CD80 exon 7; Set C
ucucaaucucucauuccuccuucucucucugcaucuugg

SEQ ID NO: 61035 - RNA, 37 nt, Artificial Sequence
  Synthetic Oligonucleotide; CD80 exon 7; Set C
uuucccuucucaaucucucauuccuccuucucucucu

SEQ ID NO: 61036 - RNA, 38 nt, Artificial Sequence
  Synthetic Oligonucleotide; CD80 exon 7; Set C
cuuucccuucucaaucucucauuccuccuucucucucu

SEQ ID NO: 61037 - RNA, 39 nt, Artificial Sequence
  Synthetic Oligonucleotide; CD80 exon 7; Set C
acuuucccuucucaaucucucauuccuccuucucucucu

SEQ ID NO: 61038 - RNA, 33 nt, Artificial Sequence
  Synthetic Oligonucleotide; CD80 exon 7; Set C
uuucccuucucaaucucucauuccuccuucucu

SEQ ID NO: 61039 - RNA, 34 nt, Artificial Sequence
  Synthetic Oligonucleotide; CD80 exon 7; Set C
cuuucccuucucaaucucucauuccuccuucucu

SEQ ID NO: 61040 - RNA, 32 nt, Artificial Sequence
  Synthetic Oligonucleotide; CD80 exon 7; Set A
uuucccuucucaaucucucauuccuccuucuc

SEQ ID NO: 61041 - RNA, 35 nt, Artificial Sequence
  Synthetic Oligonucleotide; CD80 exon 7; Set C
acuuucccuucucaaucucucauuccuccuucucu

SEQ ID NO: 61042 - RNA, 33 nt, Artificial Sequence
  Synthetic Oligonucleotide; CD80 exon 7; Set C
cuuucccuucucaaucucucauuccuccuucuc

SEQ ID NO: 61043 - RNA, 36 nt, Artificial Sequence
  Synthetic Oligonucleotide; CD80 exon 7; Set C
cacuuucccuucucaaucucucauuccuccuucucu

SEQ ID NO: 61044 - RNA, 34 nt, Artificial Sequence
  Synthetic Oligonucleotide; CD80 exon 7; Set C
acuuucccuucucaaucucucauuccuccuucuc

SEQ ID NO: 61045 - RNA, 37 nt, Artificial Sequence
  Synthetic Oligonucleotide; CD80 exon 7; Set C
acacuuucccuucucaaucucucauuccuccuucucu

SEQ ID NO: 61046 - RNA, 35 nt, Artificial Sequence
  Synthetic Oligonucleotide; CD80 exon 7; Set C
cacuuucccuucucaaucucucauuccuccuucuc

SEQ ID NO: 61047 - RNA, 38 nt, Artificial Sequence
  Synthetic Oligonucleotide; CD80 exon 7; Set C
uacacuuucccuucucaaucucucauuccuccuucucu

SEQ ID NO: 61048 - RNA, 36 nt, Artificial Sequence
  Synthetic Oligonucleotide; CD80 exon 7; Set C
acacuuucccuucucaaucucucauuccuccuucuc

SEQ ID NO: 61049 - RNA, 39 nt, Artificial Sequence
  Synthetic Oligonucleotide; CD80 exon 7; Set C
guacacuuucccuucucaaucucucauuccuccuucucu

SEQ ID NO: 61050 - RNA, 37 nt, Artificial Sequence
  Synthetic Oligonucleotide; CD80 exon 7; Set C
uacacuuucccuucucaaucucucauuccuccuucuc

SEQ ID NO: 61051 - RNA, 40 nt, Artificial Sequence
  Synthetic Oligonucleotide; CD80 exon 7; Set C
cguacacuuucccuucucaaucucucauuccuccuucucu

SEQ ID NO: 61052 - RNA, 38 nt, Artificial Sequence
  Synthetic Oligonucleotide; CD80 exon 7; Set C
guacacuuucccuucucaaucucucauuccuccuucuc

SEQ ID NO: 61053 - RNA, 36 nt, Artificial Sequence
  Synthetic Oligonucleotide; CD80 exon 7; Set C
uacacuuucccuucucaaucucucauuccuccuucu

SEQ ID NO: 61054 - RNA, 39 nt, Artificial Sequence
  Synthetic Oligonucleotide; CD80 exon 7; Set C
cguacacuuucccuucucaaucucucauuccuccuucuc

SEQ ID NO: 61055 - RNA, 35 nt, Artificial Sequence
  Synthetic Oligonucleotide; CD80 exon 7; Set C
uacacuuucccuucucaaucucucauuccuccuuc

SEQ ID NO: 61056 - RNA, 37 nt, Artificial Sequence
  Synthetic Oligonucleotide; CD80 exon 7; Set C
guacacuuucccuucucaaucucucauuccuccuucu

SEQ ID NO: 61057 - RNA, 36 nt, Artificial Sequence
  Synthetic Oligonucleotide; CD80 exon 7; Set C
guacacuuucccuucucaaucucucauuccuccuuc

SEQ ID NO: 61058 - RNA, 38 nt, Artificial Sequence
  Synthetic Oligonucleotide; CD80 exon 7; Set C
cguacacuuucccuucucaaucucucauuccuccuucu

SEQ ID NO: 61059 - RNA, 23 nt, Artificial Sequence
  Synthetic Oligonucleotide; CD80 exon 7; Set C
uuucccuucucaaucucucauuc

SEQ ID NO: 61060 - RNA, 25 nt, Artificial Sequence
  Synthetic Oligonucleotide; CD80 exon 7; Set A
cuuucccuucucaaucucucauucc

SEQ ID NO: 61061 - RNA, 37 nt, Artificial Sequence
  Synthetic Oligonucleotide; CD80 exon 7; Set C
cguacacuuucccuucucaaucucucauuccuccuuc

SEQ ID NO: 61062 - RNA, 24 nt, Artificial Sequence
  Synthetic Oligonucleotide; CD80 exon 7; Set C
cuuucccuucucaaucucucauuc

SEQ ID NO: 61063 - RNA, 26 nt, Artificial Sequence
  Synthetic Oligonucleotide; CD80 exon 7; Set A
acuuucccuucucaaucucucauucc

SEQ ID NO: 61064 - RNA, 25 nt, Artificial Sequence
  Synthetic Oligonucleotide; CD80 exon 7; Set C
acuuucccuucucaaucucucauuc

SEQ ID NO: 61065 - RNA, 27 nt, Artificial Sequence
  Synthetic Oligonucleotide; CD80 exon 7; Set A
cacuuucccuucucaaucucucauucc

SEQ ID NO: 61066 - RNA, 26 nt, Artificial Sequence
  Synthetic Oligonucleotide; CD80 exon 7; Set A
cacuuucccuucucaaucucucauuc

SEQ ID NO: 61067 - RNA, 28 nt, Artificial Sequence
  Synthetic Oligonucleotide; CD80 exon 7; Set A
acacuuucccuucucaaucucucauucc

SEQ ID NO: 61068 - RNA, 27 nt, Artificial Sequence
  Synthetic Oligonucleotide; CD80 exon 7; Set A
acacuuucccuucucaaucucucauuc

SEQ ID NO: 61069 - RNA, 29 nt, Artificial Sequence
  Synthetic Oligonucleotide; CD80 exon 7; Set A
uacacuuucccuucucaaucucucauucc

SEQ ID NO: 61070 - RNA, 28 nt, Artificial Sequence
  Synthetic Oligonucleotide; CD80 exon 7; Set A
uacacuuucccuucucaaucucucauuc

SEQ ID NO: 61071 - RNA, 30 nt, Artificial Sequence
  Synthetic Oligonucleotide; CD80 exon 7; Set A
guacacuuucccuucucaaucucucauucc

SEQ ID NO: 61072 - RNA, 29 nt, Artificial Sequence
  Synthetic Oligonucleotide; CD80 exon 7; Set A
guacacuuucccuucucaaucucucauuc

SEQ ID NO: 61073 - RNA, 31 nt, Artificial Sequence
  Synthetic Oligonucleotide; CD80 exon 7; Set C
cguacacuuucccuucucaaucucucauucc

SEQ ID NO: 61074 - RNA, 30 nt, Artificial Sequence
  Synthetic Oligonucleotide; CD80 exon 7; Set A
cguacacuuucccuucucaaucucucauuc

SEQ ID NO: 61075 - RNA, 15 nt, Artificial Sequence
  Synthetic Oligonucleotide; CD80 exon 7; Set C
cuuucccuucucaau

SEQ ID NO: 61076 - RNA, 16 nt, Artificial Sequence
  Synthetic Oligonucleotide; CD80 exon 7; Set C
acuuucccuucucaau

SEQ ID NO: 61077 - RNA, 37 nt, Artificial Sequence
  Synthetic Oligonucleotide; CD80 exon 7; Set C
acagggcguacacuuucccuucucaaucucucauucc

SEQ ID NO: 61078 - RNA, 17 nt, Artificial Sequence
  Synthetic Oligonucleotide; CD80 exon 7; Set C
cacuuucccuucucaau

SEQ ID NO: 61079 - RNA, 36 nt, Artificial Sequence
  Synthetic Oligonucleotide; CD80 exon 7; Set C
acagggcguacacuuucccuucucaaucucucauuc

SEQ ID NO: 61080 - RNA, 18 nt, Artificial Sequence
  Synthetic Oligonucleotide; CD80 exon 7; Set C
acacuuucccuucucaau

SEQ ID NO: 61081 - RNA, 19 nt, Artificial Sequence
  Synthetic Oligonucleotide; CD80 exon 7; Set C
uacacuuucccuucucaau

SEQ ID NO: 61082 - RNA, 20 nt, Artificial Sequence
  Synthetic Oligonucleotide; CD80 exon 7; Set C
guacacuuucccuucucaau

SEQ ID NO: 61083 - RNA, 21 nt, Artificial Sequence
  Synthetic Oligonucleotide; CD80 exon 7; Set C
cguacacuuucccuucucaau

SEQ ID NO: 61084 - RNA, 15 nt, Artificial Sequence
  Synthetic Oligonucleotide; CD80 exon 7; Set C
uacacuuucccuucu

SEQ ID NO: 61085 - RNA, 27 nt, Artificial Sequence
  Synthetic Oligonucleotide; CD80 exon 7; Set C
acagggcguacacuuucccuucucaau

SEQ ID NO: 61086 - RNA, 23 nt, Artificial Sequence
  Synthetic Oligonucleotide; CD80 exon 7; Set C
acagggcguacacuuucccuucu

SEQ ID NO: 61087 - RNA, 26 nt, Artificial Sequence
  Synthetic Oligonucleotide; CD80 exon 7; Set C
auacagggcguacacuuucccuucuc

SEQ ID NO: 61088 - RNA, 27 nt, Artificial Sequence
  Synthetic Oligonucleotide; CD80 exon 7; Set C
uauacagggcguacacuuucccuucuc

SEQ ID NO: 61089 - RNA, 28 nt, Artificial Sequence
  Synthetic Oligonucleotide; CD80 exon 7; Set C
uuauacagggcguacacuuucccuucuc

SEQ ID NO: 61090 - RNA, 15 nt, Artificial Sequence
  Synthetic Oligonucleotide; CD80 exon 7; Set C
agggcguacacuuuc

SEQ ID NO: 61091 - RNA, 16 nt, Artificial Sequence
  Synthetic Oligonucleotide; CD80 exon 7; Set C
cagggcguacacuuuc

SEQ ID NO: 61092 - RNA, 18 nt, Artificial Sequence
  Synthetic Oligonucleotide; CD80 exon 7; Set A
acagggcguacacuuucc

SEQ ID NO: 61093 - RNA, 29 nt, Artificial Sequence
  Synthetic Oligonucleotide; CD80 exon 7; Set C
uguuauacagggcguacacuuucccuucu

SEQ ID NO: 61094 - RNA, 19 nt, Artificial Sequence
  Synthetic Oligonucleotide; CD80 exon 7; Set A
uacagggcguacacuuucc

SEQ ID NO: 61095 - RNA, 23 nt, Artificial Sequence
  Synthetic Oligonucleotide; CD80 exon 7; Set A
guuauacagggcguacacuuucc

SEQ ID NO: 61096 - RNA, 40 nt, Artificial Sequence
  Synthetic Oligonucleotide; CD80 exon 7; Set C
uugcuucugcggacacuguuauacagggcguacacuuucc

SEQ ID NO: 61097 - RNA, 39 nt, Artificial Sequence
  Synthetic Oligonucleotide; CD80 exon 7; Set C
cuugcuucugcggacacuguuauacagggcguacacuuu

SEQ ID NO: 61098 - RNA, 38 nt, Artificial Sequence
  Synthetic Oligonucleotide; CD80 exon 7; Set C
cuugcuucugcggacacuguuauacagggcguacacuu

SEQ ID NO: 61099 - RNA, 30 nt, Artificial Sequence
  Synthetic Oligonucleotide; CD80 exon 7; Set C
gcuucugcggacacuguuauacagggcgua

SEQ ID NO: 61100 - RNA, 31 nt, Artificial Sequence
  Synthetic Oligonucleotide; CD80 exon 7; Set C
ugcuucugcggacacuguuauacagggcgua

SEQ ID NO: 61101 - RNA, 33 nt, Artificial Sequence
  Synthetic Oligonucleotide; CD80 exon 7; Set C
cuugcuucugcggacacuguuauacagggcgua

SEQ ID NO: 61102 - RNA, 32 nt, Artificial Sequence
  Synthetic Oligonucleotide; CD80 exon 7; Set C
cuugcuucugcggacacuguuauacagggcgu

SEQ ID NO: 61103 - RNA, 27 nt, Artificial Sequence
  Synthetic Oligonucleotide; CD80 exon 7; Set C
uugcuucugcggacacuguuauacagg

SEQ ID NO: 61104 - RNA, 26 nt, Artificial Sequence
  Synthetic Oligonucleotide; CD80 exon 7; Set A
uugcuucugcggacacuguuauacag

SEQ ID NO: 61105 - RNA, 25 nt, Artificial Sequence
  Synthetic Oligonucleotide; CD80 exon 7; Set A
cuugcuucugcggacacuguuauac

SEQ ID NO: 61106 - RNA, 24 nt, Artificial Sequence
  Synthetic Oligonucleotide; CD80 exon 7; Set A
cuugcuucugcggacacuguuaua

SEQ ID NO: 61107 - RNA, 23 nt, Artificial Sequence
  Synthetic Oligonucleotide; CD80 exon 7; Set A
cuugcuucugcggacacuguuau

SEQ ID NO: 61108 - RNA, 19 nt, Artificial Sequence
  Synthetic Oligonucleotide; CD80 exon 7; Set A
uugcuucugcggacacugu

SEQ ID NO: 61109 - RNA, 37 nt, Artificial Sequence
  Synthetic Oligonucleotide; CD80 exon 7; Set C
uuucagccccuugcuucugcggacacuguuauacagg

SEQ ID NO: 61110 - RNA, 38 nt, Artificial Sequence
  Synthetic Oligonucleotide; CD80 exon 7; Set C
uuuucagccccuugcuucugcggacacuguuauacagg

SEQ ID NO: 61111 - RNA, 36 nt, Artificial Sequence
  Synthetic Oligonucleotide; CD80 exon 7; Set C
uuucagccccuugcuucugcggacacuguuauacag

SEQ ID NO: 61112 - RNA, 39 nt, Artificial Sequence
  Synthetic Oligonucleotide; CD80 exon 7; Set C
cuuuucagccccuugcuucugcggacacuguuauacagg

SEQ ID NO: 61113 - RNA, 37 nt, Artificial Sequence
  Synthetic Oligonucleotide; CD80 exon 7; Set C
uuuucagccccuugcuucugcggacacuguuauacag

SEQ ID NO: 61114 - RNA, 40 nt, Artificial Sequence
  Synthetic Oligonucleotide; CD80 exon 7; Set C
ucuuuucagccccuugcuucugcggacacuguuauacagg

SEQ ID NO: 61115 - RNA, 38 nt, Artificial Sequence
  Synthetic Oligonucleotide; CD80 exon 7; Set C
cuuuucagccccuugcuucugcggacacuguuauacag

SEQ ID NO: 61116 - RNA, 39 nt, Artificial Sequence
  Synthetic Oligonucleotide; CD80 exon 7; Set C
ucuuuucagccccuugcuucugcggacacuguuauacag

SEQ ID NO: 61117 - RNA, 40 nt, Artificial Sequence
  Synthetic Oligonucleotide; CD80 exon 7; Set C
aucuuuucagccccuugcuucugcggacacuguuauacag

SEQ ID NO: 61118 - RNA, 31 nt, Artificial Sequence
  Synthetic Oligonucleotide; CD80 exon 7; Set C
cuuuucagccccuugcuucugcggacacugu

SEQ ID NO: 61119 - RNA, 33 nt, Artificial Sequence
  Synthetic Oligonucleotide; CD80 exon 7; Set C
aucuuuucagccccuugcuucugcggacacugu

SEQ ID NO: 61120 - RNA, 34 nt, Artificial Sequence
  Synthetic Oligonucleotide; CD80 exon 7; Set C
gaucuuuucagccccuugcuucugcggacacugu

SEQ ID NO: 61121 - RNA, 35 nt, Artificial Sequence
  Synthetic Oligonucleotide; CD80 exon 7; Set C
agaucuuuucagccccuugcuucugcggacacugu

SEQ ID NO: 61122 - RNA, 36 nt, Artificial Sequence
  Synthetic Oligonucleotide; CD80 exon 7; Set C
cagaucuuuucagccccuugcuucugcggacacugu

SEQ ID NO: 61123 - RNA, 37 nt, Artificial Sequence
  Synthetic Oligonucleotide; CD80 exon 7; Set C
ucagaucuuuucagccccuugcuucugcggacacugu

SEQ ID NO: 61124 - RNA, 38 nt, Artificial Sequence
  Synthetic Oligonucleotide; CD80 exon 7; Set C
uucagaucuuuucagccccuugcuucugcggacacugu

SEQ ID NO: 61125 - RNA, 39 nt, Artificial Sequence
  Synthetic Oligonucleotide; CD80 exon 7; Set C
cuucagaucuuuucagccccuugcuucugcggacacugu

SEQ ID NO: 61126 - RNA, 40 nt, Artificial Sequence
  Synthetic Oligonucleotide; CD80 exon 7; Set C
ccuucagaucuuuucagccccuugcuucugcggacacugu

SEQ ID NO: 61127 - RNA, 25 nt, Artificial Sequence
  Synthetic Oligonucleotide; CD80 exon 7; Set A
accuucagaucuuuucagccccuug

SEQ ID NO: 61128 - RNA, 15 nt, Artificial Sequence
  Synthetic Oligonucleotide; CD80 exon 7; Set C
augacggaggcuacc

SEQ ID NO: 61129 - RNA, 16 nt, Artificial Sequence
  Synthetic Oligonucleotide; CD80 exon 7; Set C
gaugacggaggcuacc

SEQ ID NO: 61130 - RNA, 17 nt, Artificial Sequence
  Synthetic Oligonucleotide; CD80 exon 7; Set C
agaugacggaggcuacc

SEQ ID NO: 61131 - RNA, 39 nt, Artificial Sequence
  Synthetic Oligonucleotide; CD80 exon 7; Set C
uguaucccagaagagaugacggaggcuaccuucagaucu

SEQ ID NO: 61132 - RNA, 21 nt, Artificial Sequence
  Synthetic Oligonucleotide; CD80 exon 7; Set B
gaagagaugacggaggcuacc

SEQ ID NO: 61133 - RNA, 38 nt, Artificial Sequence
  Synthetic Oligonucleotide; CD80 exon 7; Set C
uguaucccagaagagaugacggaggcuaccuucagauc

SEQ ID NO: 61134 - RNA, 22 nt, Artificial Sequence
  Synthetic Oligonucleotide; CD80 exon 7; Set B
agaagagaugacggaggcuacc

SEQ ID NO: 61135 - RNA, 37 nt, Artificial Sequence
  Synthetic Oligonucleotide; CD80 exon 7; Set C
uguaucccagaagagaugacggaggcuaccuucagau

SEQ ID NO: 61136 - RNA, 36 nt, Artificial Sequence
  Synthetic Oligonucleotide; CD80 exon 7; Set C
uguaucccagaagagaugacggaggcuaccuucaga

SEQ ID NO: 61137 - RNA, 35 nt, Artificial Sequence
  Synthetic Oligonucleotide; CD80 exon 7; Set C
uguaucccagaagagaugacggaggcuaccuucag

SEQ ID NO: 61138 - RNA, 34 nt, Artificial Sequence
  Synthetic Oligonucleotide; CD80 exon 7; Set C
uguaucccagaagagaugacggaggcuaccuuca

SEQ ID NO: 61139 - RNA, 33 nt, Artificial Sequence
  Synthetic Oligonucleotide; CD80 exon 7; Set C
uguaucccagaagagaugacggaggcuaccuuc

SEQ ID NO: 61140 - RNA, 32 nt, Artificial Sequence
  Synthetic Oligonucleotide; CD80 exon 7; Set C
uguaucccagaagagaugacggaggcuaccuu

SEQ ID NO: 61141 - RNA, 31 nt, Artificial Sequence
  Synthetic Oligonucleotide; CD80 exon 7; Set C
uguaucccagaagagaugacggaggcuaccu

SEQ ID NO: 61142 - RNA, 40 nt, Artificial Sequence
  Synthetic Oligonucleotide; CD80 exon 7; Set C
auccauguaucccagaagagaugacggaggcuaccuucag

SEQ ID NO: 61143 - RNA, 39 nt, Artificial Sequence
  Synthetic Oligonucleotide; CD80 exon 7; Set C
auccauguaucccagaagagaugacggaggcuaccuuca

SEQ ID NO: 61144 - RNA, 38 nt, Artificial Sequence
  Synthetic Oligonucleotide; CD80 exon 7; Set C
auccauguaucccagaagagaugacggaggcuaccuuc

SEQ ID NO: 61145 - RNA, 38 nt, Artificial Sequence
  Synthetic Oligonucleotide; CD80 exon 7; Set C
gauccauguaucccagaagagaugacggaggcuaccuu

SEQ ID NO: 61146 - RNA, 37 nt, Artificial Sequence
  Synthetic Oligonucleotide; CD80 exon 7; Set C
gauccauguaucccagaagagaugacggaggcuaccu

SEQ ID NO: 61147 - RNA, 20 nt, Artificial Sequence
  Synthetic Oligonucleotide; CD80 exon 7; Set C
uguaucccagaagagaugac

SEQ ID NO: 61148 - RNA, 19 nt, Artificial Sequence
  Synthetic Oligonucleotide; CD80 exon 7; Set C
uguaucccagaagagauga

SEQ ID NO: 61149 - RNA, 31 nt, Artificial Sequence
  Synthetic Oligonucleotide; CD80 exon 7; Set C
gauccauguaucccagaagagaugacggagg

SEQ ID NO: 61150 - RNA, 18 nt, Artificial Sequence
  Synthetic Oligonucleotide; CD80 exon 7; Set C
uguaucccagaagagaug

SEQ ID NO: 61151 - RNA, 25 nt, Artificial Sequence
  Synthetic Oligonucleotide; CD80 exon 7; Set B
auccauguaucccagaagagaugac

SEQ ID NO: 61152 - RNA, 24 nt, Artificial Sequence
  Synthetic Oligonucleotide; CD80 exon 7; Set C
gauccauguaucccagaagagaug

SEQ ID NO: 61153 - RNA, 23 nt, Artificial Sequence
  Synthetic Oligonucleotide; CD80 exon 7; Set C
gauccauguaucccagaagagau

SEQ ID NO: 61154 - RNA, 22 nt, Artificial Sequence
  Synthetic Oligonucleotide; CD80 exon 7; Set C
gauccauguaucccagaagaga

SEQ ID NO: 61155 - RNA, 40 nt, Artificial Sequence
  Synthetic Oligonucleotide; CD80 exon 7; Set C
gauccccacgauccauguaucccagaagagaugacggagg

SEQ ID NO: 61156 - RNA, 18 nt, Artificial Sequence
  Synthetic Oligonucleotide; CD80 exon 7; Set C
gauccauguaucccagaa

SEQ ID NO: 61157 - RNA, 34 nt, Artificial Sequence
  Synthetic Oligonucleotide; CD80 exon 7; Set C
auccccacgauccauguaucccagaagagaugac

SEQ ID NO: 61158 - RNA, 17 nt, Artificial Sequence
  Synthetic Oligonucleotide; CD80 exon 7; Set C
gauccauguaucccaga

SEQ ID NO: 61159 - RNA, 35 nt, Artificial Sequence
  Synthetic Oligonucleotide; CD80 exon 7; Set C
gauccccacgauccauguaucccagaagagaugac

SEQ ID NO: 61160 - RNA, 33 nt, Artificial Sequence
  Synthetic Oligonucleotide; CD80 exon 7; Set C
auccccacgauccauguaucccagaagagauga

SEQ ID NO: 61161 - RNA, 34 nt, Artificial Sequence
  Synthetic Oligonucleotide; CD80 exon 7; Set C
gauccccacgauccauguaucccagaagagauga

SEQ ID NO: 61162 - RNA, 32 nt, Artificial Sequence
  Synthetic Oligonucleotide; CD80 exon 7; Set C
auccccacgauccauguaucccagaagagaug

SEQ ID NO: 61163 - RNA, 33 nt, Artificial Sequence
  Synthetic Oligonucleotide; CD80 exon 7; Set C
gauccccacgauccauguaucccagaagagaug

SEQ ID NO: 61164 - RNA, 31 nt, Artificial Sequence
  Synthetic Oligonucleotide; CD80 exon 7; Set C
auccccacgauccauguaucccagaagagau

SEQ ID NO: 61165 - RNA, 34 nt, Artificial Sequence
  Synthetic Oligonucleotide; CD80 exon 7; Set C
ugauccccacgauccauguaucccagaagagaug

SEQ ID NO: 61166 - RNA, 32 nt, Artificial Sequence
  Synthetic Oligonucleotide; CD80 exon 7; Set C
gauccccacgauccauguaucccagaagagau

SEQ ID NO: 61167 - RNA, 30 nt, Artificial Sequence
  Synthetic Oligonucleotide; CD80 exon 7; Set C
auccccacgauccauguaucccagaagaga

SEQ ID NO: 61168 - RNA, 33 nt, Artificial Sequence
  Synthetic Oligonucleotide; CD80 exon 7; Set C
ugauccccacgauccauguaucccagaagagau

SEQ ID NO: 61169 - RNA, 31 nt, Artificial Sequence
  Synthetic Oligonucleotide; CD80 exon 7; Set C
gauccccacgauccauguaucccagaagaga

SEQ ID NO: 61170 - RNA, 34 nt, Artificial Sequence
  Synthetic Oligonucleotide; CD80 exon 7; Set C
augauccccacgauccauguaucccagaagagau

SEQ ID NO: 61171 - RNA, 32 nt, Artificial Sequence
  Synthetic Oligonucleotide; CD80 exon 7; Set C
ugauccccacgauccauguaucccagaagaga

SEQ ID NO: 61172 - RNA, 33 nt, Artificial Sequence
  Synthetic Oligonucleotide; CD80 exon 7; Set C
augauccccacgauccauguaucccagaagaga

SEQ ID NO: 61173 - RNA, 26 nt, Artificial Sequence
  Synthetic Oligonucleotide; CD80 exon 7; Set C
auccccacgauccauguaucccagaa

SEQ ID NO: 61174 - RNA, 27 nt, Artificial Sequence
  Synthetic Oligonucleotide; CD80 exon 7; Set C
gauccccacgauccauguaucccagaa

SEQ ID NO: 61175 - RNA, 25 nt, Artificial Sequence
  Synthetic Oligonucleotide; CD80 exon 7; Set C
auccccacgauccauguaucccaga

SEQ ID NO: 61176 - RNA, 28 nt, Artificial Sequence
  Synthetic Oligonucleotide; CD80 exon 7; Set C
ugauccccacgauccauguaucccagaa

SEQ ID NO: 61177 - RNA, 26 nt, Artificial Sequence
  Synthetic Oligonucleotide; CD80 exon 7; Set C
gauccccacgauccauguaucccaga

SEQ ID NO: 61178 - RNA, 27 nt, Artificial Sequence
  Synthetic Oligonucleotide; CD80 exon 7; Set C
ugauccccacgauccauguaucccaga

SEQ ID NO: 61179 - RNA, 28 nt, Artificial Sequence
  Synthetic Oligonucleotide; CD80 exon 7; Set C
augauccccacgauccauguaucccaga

SEQ ID NO: 61180 - RNA, 17 nt, Artificial Sequence
  Synthetic Oligonucleotide; CD80 exon 7; Set C
auccccacgauccaugu

SEQ ID NO: 61181 - RNA, 18 nt, Artificial Sequence
  Synthetic Oligonucleotide; CD80 exon 7; Set B
gauccccacgauccaugu

SEQ ID NO: 61182 - RNA, 15 nt, Artificial Sequence
  Synthetic Oligonucleotide; CD80 exon 7; Set C
augauccccacgauc

SEQ ID NO: 61183 - RNA, 15 nt, Artificial Sequence
  Synthetic Oligonucleotide; CD80 exon 7; Set C
caugauccccacgau

SEQ ID NO: 61184 - RNA, 16 nt, Artificial Sequence
  Synthetic Oligonucleotide; CD80 exon 7; Set C
ucaugauccccacgau

SEQ ID NO: 61185 - RNA, 17 nt, Artificial Sequence
  Synthetic Oligonucleotide; CD80 exon 7; Set C
cucaugauccccacgau

SEQ ID NO: 61186 - RNA, 37 nt, Artificial Sequence
  Synthetic Oligonucleotide; CD80 exon 7; Set C
caaagccuuggagacaagaacaaacaauaaaaaugau

SEQ ID NO: 61187 - RNA, 38 nt, Artificial Sequence
  Synthetic Oligonucleotide; CD80 exon 7; Set A
gcaaagccuuggagacaagaacaaacaauaaaaaugau

SEQ ID NO: 61188 - RNA, 36 nt, Artificial Sequence
  Synthetic Oligonucleotide; CD80 exon 7; Set C
caaagccuuggagacaagaacaaacaauaaaaauga

SEQ ID NO: 61189 - RNA, 35 nt, Artificial Sequence
  Synthetic Oligonucleotide; CD80 exon 7; Set C
caaagccuuggagacaagaacaaacaauaaaaaug

SEQ ID NO: 61190 - RNA, 37 nt, Artificial Sequence
  Synthetic Oligonucleotide; CD80 exon 7; Set A
gcaaagccuuggagacaagaacaaacaauaaaaauga

SEQ ID NO: 61191 - RNA, 36 nt, Artificial Sequence
  Synthetic Oligonucleotide; CD80 exon 7; Set A
gcaaagccuuggagacaagaacaaacaauaaaaaug

SEQ ID NO: 61192 - RNA, 24 nt, Artificial Sequence
  Synthetic Oligonucleotide; CD80 exon 7; Set C
aaagccuuggagacaagaacaaac

SEQ ID NO: 61193 - RNA, 27 nt, Artificial Sequence
  Synthetic Oligonucleotide; CD80 exon 7; Set A
gcaaagccuuggagacaagaacaaaca

SEQ ID NO: 61194 - RNA, 23 nt, Artificial Sequence
  Synthetic Oligonucleotide; CD80 exon 7; Set C
aaagccuuggagacaagaacaaa

SEQ ID NO: 61195 - RNA, 25 nt, Artificial Sequence
  Synthetic Oligonucleotide; CD80 exon 7; Set C
caaagccuuggagacaagaacaaac

SEQ ID NO: 61196 - RNA, 24 nt, Artificial Sequence
  Synthetic Oligonucleotide; CD80 exon 7; Set C
caaagccuuggagacaagaacaaa

SEQ ID NO: 61197 - RNA, 26 nt, Artificial Sequence
  Synthetic Oligonucleotide; CD80 exon 7; Set A
gcaaagccuuggagacaagaacaaac

SEQ ID NO: 61198 - RNA, 23 nt, Artificial Sequence
  Synthetic Oligonucleotide; CD80 exon 7; Set C
caaagccuuggagacaagaacaa

SEQ ID NO: 61199 - RNA, 25 nt, Artificial Sequence
  Synthetic Oligonucleotide; CD80 exon 7; Set C
gcaaagccuuggagacaagaacaaa

SEQ ID NO: 61200 - RNA, 24 nt, Artificial Sequence
  Synthetic Oligonucleotide; CD80 exon 7; Set A
gcaaagccuuggagacaagaacaa

SEQ ID NO: 61201 - RNA, 19 nt, Artificial Sequence
  Synthetic Oligonucleotide; CD80 exon 7; Set C
aaagccuuggagacaagaa

SEQ ID NO: 61202 - RNA, 20 nt, Artificial Sequence
  Synthetic Oligonucleotide; CD80 exon 7; Set C
caaagccuuggagacaagaa

SEQ ID NO: 61203 - RNA, 18 nt, Artificial Sequence
  Synthetic Oligonucleotide; CD80 exon 7; Set C
aaagccuuggagacaaga

SEQ ID NO: 61204 - RNA, 21 nt, Artificial Sequence
  Synthetic Oligonucleotide; CD80 exon 7; Set C
gcaaagccuuggagacaagaa

SEQ ID NO: 61205 - RNA, 19 nt, Artificial Sequence
  Synthetic Oligonucleotide; CD80 exon 7; Set C
caaagccuuggagacaaga

SEQ ID NO: 61206 - RNA, 17 nt, Artificial Sequence
  Synthetic Oligonucleotide; CD80 exon 7; Set C
aaagccuuggagacaag

SEQ ID NO: 61207 - RNA, 15 nt, Artificial Sequence
  Synthetic Oligonucleotide; CD80 exon 7; Set C
aagccuuggagacaa

SEQ ID NO: 61208 - RNA, 20 nt, Artificial Sequence
  Synthetic Oligonucleotide; CD80 exon 7; Set C
gcaaagccuuggagacaaga

SEQ ID NO: 61209 - RNA, 18 nt, Artificial Sequence
  Synthetic Oligonucleotide; CD80 exon 7; Set C
caaagccuuggagacaag

SEQ ID NO: 61210 - RNA, 16 nt, Artificial Sequence
  Synthetic Oligonucleotide; CD80 exon 7; Set C
aaagccuuggagacaa

SEQ ID NO: 61211 - RNA, 19 nt, Artificial Sequence
  Synthetic Oligonucleotide; CD80 exon 7; Set C
gcaaagccuuggagacaag

SEQ ID NO: 61212 - RNA, 15 nt, Artificial Sequence
  Synthetic Oligonucleotide; CD80 exon 7; Set C
aaagccuuggagaca

SEQ ID NO: 61213 - RNA, 16 nt, Artificial Sequence
  Synthetic Oligonucleotide; CD80 exon 7; Set C
caaagccuuggagaca

SEQ ID NO: 61214 - RNA, 17 nt, Artificial Sequence
  Synthetic Oligonucleotide; CD80 exon 7; Set C
gcaaagccuuggagaca

SEQ ID NO: 61215 - RNA, 40 nt, Artificial Sequence
  Synthetic Oligonucleotide; CD80 exon 7; Set C
cucugcaucuuggggcaaagccuuggagacaagaacaaac

SEQ ID NO: 61216 - RNA, 39 nt, Artificial Sequence
  Synthetic Oligonucleotide; CD80 exon 7; Set C
cucugcaucuuggggcaaagccuuggagacaagaacaaa

SEQ ID NO: 61217 - RNA, 40 nt, Artificial Sequence
  Synthetic Oligonucleotide; CD80 exon 7; Set C
ucucugcaucuuggggcaaagccuuggagacaagaacaaa

SEQ ID NO: 61218 - RNA, 35 nt, Artificial Sequence
  Synthetic Oligonucleotide; CD80 exon 7; Set C
cucugcaucuuggggcaaagccuuggagacaagaa

SEQ ID NO: 61219 - RNA, 36 nt, Artificial Sequence
  Synthetic Oligonucleotide; CD80 exon 7; Set C
ucucugcaucuuggggcaaagccuuggagacaagaa

SEQ ID NO: 61220 - RNA, 34 nt, Artificial Sequence
  Synthetic Oligonucleotide; CD80 exon 7; Set C
cucugcaucuuggggcaaagccuuggagacaaga

SEQ ID NO: 61221 - RNA, 37 nt, Artificial Sequence
  Synthetic Oligonucleotide; CD80 exon 7; Set C
cucucugcaucuuggggcaaagccuuggagacaagaa

SEQ ID NO: 61222 - RNA, 35 nt, Artificial Sequence
  Synthetic Oligonucleotide; CD80 exon 7; Set C
ucucugcaucuuggggcaaagccuuggagacaaga

SEQ ID NO: 61223 - RNA, 33 nt, Artificial Sequence
  Synthetic Oligonucleotide; CD80 exon 7; Set C
cucugcaucuuggggcaaagccuuggagacaag

SEQ ID NO: 61224 - RNA, 36 nt, Artificial Sequence
  Synthetic Oligonucleotide; CD80 exon 7; Set C
cucucugcaucuuggggcaaagccuuggagacaaga

SEQ ID NO: 61225 - RNA, 34 nt, Artificial Sequence
  Synthetic Oligonucleotide; CD80 exon 7; Set C
ucucugcaucuuggggcaaagccuuggagacaag

SEQ ID NO: 61226 - RNA, 32 nt, Artificial Sequence
  Synthetic Oligonucleotide; CD80 exon 7; Set C
cucugcaucuuggggcaaagccuuggagacaa

SEQ ID NO: 61227 - RNA, 35 nt, Artificial Sequence
  Synthetic Oligonucleotide; CD80 exon 7; Set C
cucucugcaucuuggggcaaagccuuggagacaag

SEQ ID NO: 61228 - RNA, 31 nt, Artificial Sequence
  Synthetic Oligonucleotide; CD80 exon 7; Set C
cucugcaucuuggggcaaagccuuggagaca

SEQ ID NO: 61229 - RNA, 33 nt, Artificial Sequence
  Synthetic Oligonucleotide; CD80 exon 7; Set C
ucucugcaucuuggggcaaagccuuggagacaa

SEQ ID NO: 61230 - RNA, 32 nt, Artificial Sequence
  Synthetic Oligonucleotide; CD80 exon 7; Set C
ucucugcaucuuggggcaaagccuuggagaca

SEQ ID NO: 61231 - RNA, 34 nt, Artificial Sequence
  Synthetic Oligonucleotide; CD80 exon 7; Set C
cucucugcaucuuggggcaaagccuuggagacaa

SEQ ID NO: 61232 - RNA, 33 nt, Artificial Sequence
  Synthetic Oligonucleotide; CD80 exon 7; Set C
cucucugcaucuuggggcaaagccuuggagaca

SEQ ID NO: 61233 - RNA, 40 nt, Artificial Sequence
  Synthetic Oligonucleotide; CD80 exon 7; Set C
cuucucucucugcaucuuggggcaaagccuuggagacaag

SEQ ID NO: 61234 - RNA, 39 nt, Artificial Sequence
  Synthetic Oligonucleotide; CD80 exon 7; Set C
cuucucucucugcaucuuggggcaaagccuuggagacaa

SEQ ID NO: 61235 - RNA, 38 nt, Artificial Sequence
  Synthetic Oligonucleotide; CD80 exon 7; Set C
cuucucucucugcaucuuggggcaaagccuuggagaca

SEQ ID NO: 61236 - RNA, 23 nt, Artificial Sequence
  Synthetic Oligonucleotide; CD80 exon 7; Set A
cucugcaucuuggggcaaagccu

SEQ ID NO: 61237 - RNA, 24 nt, Artificial Sequence
  Synthetic Oligonucleotide; CD80 exon 7; Set A
ucucugcaucuuggggcaaagccu

SEQ ID NO: 61238 - RNA, 25 nt, Artificial Sequence
  Synthetic Oligonucleotide; CD80 exon 7; Set C
cucucugcaucuuggggcaaagccu

SEQ ID NO: 61239 - RNA, 19 nt, Artificial Sequence
  Synthetic Oligonucleotide; CD80 exon 7; Set C
ucugcaucuuggggcaaag

SEQ ID NO: 61240 - RNA, 18 nt, Artificial Sequence
  Synthetic Oligonucleotide; CD80 exon 7; Set C
ucugcaucuuggggcaaa

SEQ ID NO: 61241 - RNA, 16 nt, Artificial Sequence
  Synthetic Oligonucleotide; CD80 exon 7; Set C
cucugcaucuuggggc

SEQ ID NO: 61242 - RNA, 30 nt, Artificial Sequence
  Synthetic Oligonucleotide; CD80 exon 7; Set C
cuucucucucugcaucuuggggcaaagccu

SEQ ID NO: 61243 - RNA, 22 nt, Artificial Sequence
  Synthetic Oligonucleotide; CD80 exon 7; Set A
ucucucugcaucuuggggcaaa

SEQ ID NO: 61244 - RNA, 17 nt, Artificial Sequence
  Synthetic Oligonucleotide; CD80 exon 7; Set C
ucucugcaucuuggggc

SEQ ID NO: 61245 - RNA, 29 nt, Artificial Sequence
  Synthetic Oligonucleotide; CD80 exon 7; Set C
cuucucucucugcaucuuggggcaaagcc

SEQ ID NO: 61246 - RNA, 25 nt, Artificial Sequence
  Synthetic Oligonucleotide; CD80 exon 7; Set A
ucucucucugcaucuuggggcaaag

SEQ ID NO: 61247 - RNA, 23 nt, Artificial Sequence
  Synthetic Oligonucleotide; CD80 exon 7; Set A
cucucucugcaucuuggggcaaa

SEQ ID NO: 61248 - RNA, 21 nt, Artificial Sequence
  Synthetic Oligonucleotide; CD80 exon 7; Set A
ucucucugcaucuuggggcaa

SEQ ID NO: 61249 - RNA, 18 nt, Artificial Sequence
  Synthetic Oligonucleotide; CD80 exon 7; Set A
cucucugcaucuuggggc

SEQ ID NO: 61250 - RNA, 28 nt, Artificial Sequence
  Synthetic Oligonucleotide; CD80 exon 7; Set C
cuucucucucugcaucuuggggcaaagc

SEQ ID NO: 61251 - RNA, 24 nt, Artificial Sequence
  Synthetic Oligonucleotide; CD80 exon 7; Set A
ucucucucugcaucuuggggcaaa

SEQ ID NO: 61252 - RNA, 22 nt, Artificial Sequence
  Synthetic Oligonucleotide; CD80 exon 7; Set A
cucucucugcaucuuggggcaa

SEQ ID NO: 61253 - RNA, 20 nt, Artificial Sequence
  Synthetic Oligonucleotide; CD80 exon 7; Set A
ucucucugcaucuuggggca

SEQ ID NO: 61254 - RNA, 25 nt, Artificial Sequence
  Synthetic Oligonucleotide; CD80 exon 7; Set A
uucucucucugcaucuuggggcaaa

SEQ ID NO: 61255 - RNA, 23 nt, Artificial Sequence
  Synthetic Oligonucleotide; CD80 exon 7; Set A
ucucucucugcaucuuggggcaa

SEQ ID NO: 61256 - RNA, 21 nt, Artificial Sequence
  Synthetic Oligonucleotide; CD80 exon 7; Set A
cucucucugcaucuuggggca

SEQ ID NO: 61257 - RNA, 40 nt, Artificial Sequence
  Synthetic Oligonucleotide; CD80 exon 7; Set C
auuccuccuucucucucugcaucuuggggcaaagccuugg

SEQ ID NO: 61258 - RNA, 24 nt, Artificial Sequence
  Synthetic Oligonucleotide; CD80 exon 7; Set A
uucucucucugcaucuuggggcaa

SEQ ID NO: 61259 - RNA, 22 nt, Artificial Sequence
  Synthetic Oligonucleotide; CD80 exon 7; Set A
ucucucucugcaucuuggggca

SEQ ID NO: 61260 - RNA, 39 nt, Artificial Sequence
  Synthetic Oligonucleotide; CD80 exon 7; Set C
auuccuccuucucucucugcaucuuggggcaaagccuug

SEQ ID NO: 61261 - RNA, 23 nt, Artificial Sequence
  Synthetic Oligonucleotide; CD80 exon 7; Set A
uucucucucugcaucuuggggca

SEQ ID NO: 61262 - RNA, 38 nt, Artificial Sequence
  Synthetic Oligonucleotide; CD80 exon 7; Set C
auuccuccuucucucucugcaucuuggggcaaagccuu

SEQ ID NO: 61263 - RNA, 23 nt, Artificial Sequence
  Synthetic Oligonucleotide; CD80 exon 7; Set A
cuucucucucugcaucuuggggc

SEQ ID NO: 61264 - RNA, 32 nt, Artificial Sequence
  Synthetic Oligonucleotide; CD80 exon 7; Set C
uccuccuucucucucugcaucuuggggcaaag

SEQ ID NO: 61265 - RNA, 33 nt, Artificial Sequence
  Synthetic Oligonucleotide; CD80 exon 7; Set C
uuccuccuucucucucugcaucuuggggcaaag

SEQ ID NO: 61266 - RNA, 31 nt, Artificial Sequence
  Synthetic Oligonucleotide; CD80 exon 7; Set C
uccuccuucucucucugcaucuuggggcaaa

SEQ ID NO: 61267 - RNA, 32 nt, Artificial Sequence
  Synthetic Oligonucleotide; CD80 exon 7; Set C
uuccuccuucucucucugcaucuuggggcaaa

SEQ ID NO: 61268 - RNA, 19 nt, Artificial Sequence
  Synthetic Oligonucleotide; CD80 exon 7; Set C
cuucucucucugcaucuug

SEQ ID NO: 61269 - RNA, 31 nt, Artificial Sequence
  Synthetic Oligonucleotide; CD80 exon 7; Set C
uuccuccuucucucucugcaucuuggggcaa

SEQ ID NO: 61270 - RNA, 18 nt, Artificial Sequence
  Synthetic Oligonucleotide; CD80 exon 7; Set C
cuucucucucugcaucuu

SEQ ID NO: 61271 - RNA, 30 nt, Artificial Sequence
  Synthetic Oligonucleotide; CD80 exon 7; Set C
uuccuccuucucucucugcaucuuggggca

SEQ ID NO: 61272 - RNA, 17 nt, Artificial Sequence
  Synthetic Oligonucleotide; CD80 exon 7; Set C
cuucucucucugcaucu

SEQ ID NO: 61273 - RNA, 16 nt, Artificial Sequence
  Synthetic Oligonucleotide; CD80 exon 7; Set C
cuucucucucugcauc

SEQ ID NO: 61274 - RNA, 29 nt, Artificial Sequence
  Synthetic Oligonucleotide; CD80 exon 7; Set C
auuccuccuucucucucugcaucuugggg

SEQ ID NO: 61275 - RNA, 28 nt, Artificial Sequence
  Synthetic Oligonucleotide; CD80 exon 7; Set C
auuccuccuucucucucugcaucuuggg

SEQ ID NO: 61276 - RNA, 27 nt, Artificial Sequence
  Synthetic Oligonucleotide; CD80 exon 7; Set A
auuccuccuucucucucugcaucuugg

SEQ ID NO: 61277 - RNA, 38 nt, Artificial Sequence
  Synthetic Oligonucleotide; CD80 exon 7; Set C
aaucucucauuccuccuucucucucugcaucuuggggc

SEQ ID NO: 61278 - RNA, 37 nt, Artificial Sequence
  Synthetic Oligonucleotide; CD80 exon 7; Set C
aaucucucauuccuccuucucucucugcaucuugggg

SEQ ID NO: 61279 - RNA, 35 nt, Artificial Sequence
  Synthetic Oligonucleotide; CD80 exon 7; Set C
aaucucucauuccuccuucucucucugcaucuugg

SEQ ID NO: 61280 - RNA, 15 nt, Artificial Sequence
  Synthetic Oligonucleotide; CD80 exon 7; Set C
uccuccuucucucuc

SEQ ID NO: 61281 - RNA, 34 nt, Artificial Sequence
  Synthetic Oligonucleotide; CD80 exon 7; Set C
aaucucucauuccuccuucucucucugcaucuug

SEQ ID NO: 61282 - RNA, 16 nt, Artificial Sequence
  Synthetic Oligonucleotide; CD80 exon 7; Set C
uuccuccuucucucuc

SEQ ID NO: 61283 - RNA, 33 nt, Artificial Sequence
  Synthetic Oligonucleotide; CD80 exon 7; Set C
aaucucucauuccuccuucucucucugcaucuu

SEQ ID NO: 61284 - RNA, 15 nt, Artificial Sequence
  Synthetic Oligonucleotide; CD80 exon 7; Set C
uuccuccuucucucu

SEQ ID NO: 61285 - RNA, 32 nt, Artificial Sequence
  Synthetic Oligonucleotide; CD80 exon 7; Set C
aaucucucauuccuccuucucucucugcaucu

SEQ ID NO: 61286 - RNA, 38 nt, Artificial Sequence
  Synthetic Oligonucleotide; CD80 exon 7; Set C
ucucaaucucucauuccuccuucucucucugcaucuug

SEQ ID NO: 61287 - RNA, 37 nt, Artificial Sequence
  Synthetic Oligonucleotide; CD80 exon 7; Set C
ucucaaucucucauuccuccuucucucucugcaucuu

SEQ ID NO: 61288 - RNA, 36 nt, Artificial Sequence
  Synthetic Oligonucleotide; CD80 exon 7; Set C
ucucaaucucucauuccuccuucucucucugcaucu

SEQ ID NO: 61289 - RNA, 35 nt, Artificial Sequence
  Synthetic Oligonucleotide; CD80 exon 7; Set C
ucucaaucucucauuccuccuucucucucugcauc

SEQ ID NO: 61290 - RNA, 30 nt, Artificial Sequence
  Synthetic Oligonucleotide; CD80 exon 7; Set A
ucucaaucucucauuccuccuucucucucu

SEQ ID NO: 61291 - RNA, 26 nt, Artificial Sequence
  Synthetic Oligonucleotide; CD80 exon 7; Set A
ucucaaucucucauuccuccuucucu

SEQ ID NO: 61292 - RNA, 25 nt, Artificial Sequence
  Synthetic Oligonucleotide; CD80 exon 7; Set A
ucucaaucucucauuccuccuucuc

SEQ ID NO: 61293 - RNA, 36 nt, Artificial Sequence
  Synthetic Oligonucleotide; CD80 exon 7; Set C
uucccuucucaaucucucauuccuccuucucucucu

SEQ ID NO: 61294 - RNA, 32 nt, Artificial Sequence
  Synthetic Oligonucleotide; CD80 exon 7; Set C
uucccuucucaaucucucauuccuccuucucu

SEQ ID NO: 61295 - RNA, 40 nt, Artificial Sequence
  Synthetic Oligonucleotide; CD80 exon 7; Set C
cacuuucccuucucaaucucucauuccuccuucucucucu

SEQ ID NO: 61296 - RNA, 31 nt, Artificial Sequence
  Synthetic Oligonucleotide; CD80 exon 7; Set A
uucccuucucaaucucucauuccuccuucuc

SEQ ID NO: 61297 - RNA, 30 nt, Artificial Sequence
  Synthetic Oligonucleotide; CD80 exon 7; Set A
uucccuucucaaucucucauuccuccuucu

SEQ ID NO: 61298 - RNA, 29 nt, Artificial Sequence
  Synthetic Oligonucleotide; CD80 exon 7; Set A
uucccuucucaaucucucauuccuccuuc

SEQ ID NO: 61299 - RNA, 31 nt, Artificial Sequence
  Synthetic Oligonucleotide; CD80 exon 7; Set A
uuucccuucucaaucucucauuccuccuucu

SEQ ID NO: 61300 - RNA, 30 nt, Artificial Sequence
  Synthetic Oligonucleotide; CD80 exon 7; Set A
uuucccuucucaaucucucauuccuccuuc

SEQ ID NO: 61301 - RNA, 32 nt, Artificial Sequence
  Synthetic Oligonucleotide; CD80 exon 7; Set C
cuuucccuucucaaucucucauuccuccuucu

SEQ ID NO: 61302 - RNA, 31 nt, Artificial Sequence
  Synthetic Oligonucleotide; CD80 exon 7; Set A
cuuucccuucucaaucucucauuccuccuuc

SEQ ID NO: 61303 - RNA, 33 nt, Artificial Sequence
  Synthetic Oligonucleotide; CD80 exon 7; Set C
acuuucccuucucaaucucucauuccuccuucu

SEQ ID NO: 61304 - RNA, 32 nt, Artificial Sequence
  Synthetic Oligonucleotide; CD80 exon 7; Set C
acuuucccuucucaaucucucauuccuccuuc

SEQ ID NO: 61305 - RNA, 34 nt, Artificial Sequence
  Synthetic Oligonucleotide; CD80 exon 7; Set C
cacuuucccuucucaaucucucauuccuccuucu

SEQ ID NO: 61306 - RNA, 40 nt, Artificial Sequence
  Synthetic Oligonucleotide; CD80 exon 7; Set C
guacacuuucccuucucaaucucucauuccuccuucucuc

SEQ ID NO: 61307 - RNA, 33 nt, Artificial Sequence
  Synthetic Oligonucleotide; CD80 exon 7; Set C
cacuuucccuucucaaucucucauuccuccuuc

SEQ ID NO: 61308 - RNA, 35 nt, Artificial Sequence
  Synthetic Oligonucleotide; CD80 exon 7; Set C
acacuuucccuucucaaucucucauuccuccuucu

SEQ ID NO: 61309 - RNA, 34 nt, Artificial Sequence
  Synthetic Oligonucleotide; CD80 exon 7; Set C
acacuuucccuucucaaucucucauuccuccuuc

SEQ ID NO: 61310 - RNA, 23 nt, Artificial Sequence
  Synthetic Oligonucleotide; CD80 exon 7; Set C
uucccuucucaaucucucauucc

SEQ ID NO: 61311 - RNA, 22 nt, Artificial Sequence
  Synthetic Oligonucleotide; CD80 exon 7; Set C
uucccuucucaaucucucauuc

SEQ ID NO: 61312 - RNA, 24 nt, Artificial Sequence
  Synthetic Oligonucleotide; CD80 exon 7; Set C
uuucccuucucaaucucucauucc

SEQ ID NO: 61313 - RNA, 35 nt, Artificial Sequence
  Synthetic Oligonucleotide; CD80 exon 7; Set C
guacacuuucccuucucaaucucucauuccuccuu

SEQ ID NO: 61314 - RNA, 36 nt, Artificial Sequence
  Synthetic Oligonucleotide; CD80 exon 7; Set C
cguacacuuucccuucucaaucucucauuccuccuu

SEQ ID NO: 61315 - RNA, 35 nt, Artificial Sequence
  Synthetic Oligonucleotide; CD80 exon 7; Set C
agggcguacacuuucccuucucaaucucucauucc

SEQ ID NO: 61316 - RNA, 34 nt, Artificial Sequence
  Synthetic Oligonucleotide; CD80 exon 7; Set C
agggcguacacuuucccuucucaaucucucauuc

SEQ ID NO: 61317 - RNA, 36 nt, Artificial Sequence
  Synthetic Oligonucleotide; CD80 exon 7; Set C
cagggcguacacuuucccuucucaaucucucauucc

SEQ ID NO: 61318 - RNA, 35 nt, Artificial Sequence
  Synthetic Oligonucleotide; CD80 exon 7; Set C
cagggcguacacuuucccuucucaaucucucauuc

SEQ ID NO: 61319 - RNA, 19 nt, Artificial Sequence
  Synthetic Oligonucleotide; CD80 exon 7; Set C
guacacuuucccuucucaa

SEQ ID NO: 61320 - RNA, 16 nt, Artificial Sequence
  Synthetic Oligonucleotide; CD80 exon 7; Set C
uacacuuucccuucuc

SEQ ID NO: 61321 - RNA, 20 nt, Artificial Sequence
  Synthetic Oligonucleotide; CD80 exon 7; Set C
cguacacuuucccuucucaa

SEQ ID NO: 61322 - RNA, 18 nt, Artificial Sequence
  Synthetic Oligonucleotide; CD80 exon 7; Set C
guacacuuucccuucuca

SEQ ID NO: 61323 - RNA, 17 nt, Artificial Sequence
  Synthetic Oligonucleotide; CD80 exon 7; Set C
guacacuuucccuucuc

SEQ ID NO: 61324 - RNA, 19 nt, Artificial Sequence
  Synthetic Oligonucleotide; CD80 exon 7; Set C
cguacacuuucccuucuca

SEQ ID NO: 61325 - RNA, 18 nt, Artificial Sequence
  Synthetic Oligonucleotide; CD80 exon 7; Set C
cguacacuuucccuucuc

SEQ ID NO: 61326 - RNA, 25 nt, Artificial Sequence
  Synthetic Oligonucleotide; CD80 exon 7; Set A
agggcguacacuuucccuucucaau

SEQ ID NO: 61327 - RNA, 26 nt, Artificial Sequence
  Synthetic Oligonucleotide; CD80 exon 7; Set C
cagggcguacacuuucccuucucaau

SEQ ID NO: 61328 - RNA, 26 nt, Artificial Sequence
  Synthetic Oligonucleotide; CD80 exon 7; Set C
acagggcguacacuuucccuucucaa

SEQ ID NO: 61329 - RNA, 21 nt, Artificial Sequence
  Synthetic Oligonucleotide; CD80 exon 7; Set A
agggcguacacuuucccuucu

SEQ ID NO: 61330 - RNA, 27 nt, Artificial Sequence
  Synthetic Oligonucleotide; CD80 exon 7; Set C
uacagggcguacacuuucccuucucaa

SEQ ID NO: 61331 - RNA, 25 nt, Artificial Sequence
  Synthetic Oligonucleotide; CD80 exon 7; Set C
acagggcguacacuuucccuucuca

SEQ ID NO: 61332 - RNA, 22 nt, Artificial Sequence
  Synthetic Oligonucleotide; CD80 exon 7; Set A
cagggcguacacuuucccuucu

SEQ ID NO: 61333 - RNA, 24 nt, Artificial Sequence
  Synthetic Oligonucleotide; CD80 exon 7; Set C
acagggcguacacuuucccuucuc

SEQ ID NO: 61334 - RNA, 28 nt, Artificial Sequence
  Synthetic Oligonucleotide; CD80 exon 7; Set C
auacagggcguacacuuucccuucucaa

SEQ ID NO: 61335 - RNA, 26 nt, Artificial Sequence
  Synthetic Oligonucleotide; CD80 exon 7; Set C
uacagggcguacacuuucccuucuca

SEQ ID NO: 61336 - RNA, 25 nt, Artificial Sequence
  Synthetic Oligonucleotide; CD80 exon 7; Set C
uacagggcguacacuuucccuucuc

SEQ ID NO: 61337 - RNA, 29 nt, Artificial Sequence
  Synthetic Oligonucleotide; CD80 exon 7; Set C
uauacagggcguacacuuucccuucucaa

SEQ ID NO: 61338 - RNA, 27 nt, Artificial Sequence
  Synthetic Oligonucleotide; CD80 exon 7; Set C
auacagggcguacacuuucccuucuca

SEQ ID NO: 61339 - RNA, 30 nt, Artificial Sequence
  Synthetic Oligonucleotide; CD80 exon 7; Set C
uuauacagggcguacacuuucccuucucaa

SEQ ID NO: 61340 - RNA, 28 nt, Artificial Sequence
  Synthetic Oligonucleotide; CD80 exon 7; Set C
uauacagggcguacacuuucccuucuca

SEQ ID NO: 61341 - RNA, 33 nt, Artificial Sequence
  Synthetic Oligonucleotide; CD80 exon 7; Set C
uguuauacagggcguacacuuucccuucucaau

SEQ ID NO: 61342 - RNA, 31 nt, Artificial Sequence
  Synthetic Oligonucleotide; CD80 exon 7; Set C
guuauacagggcguacacuuucccuucucaa

SEQ ID NO: 61343 - RNA, 29 nt, Artificial Sequence
  Synthetic Oligonucleotide; CD80 exon 7; Set C
uuauacagggcguacacuuucccuucuca

SEQ ID NO: 61344 - RNA, 16 nt, Artificial Sequence
  Synthetic Oligonucleotide; CD80 exon 7; Set C
agggcguacacuuucc

SEQ ID NO: 61345 - RNA, 30 nt, Artificial Sequence
  Synthetic Oligonucleotide; CD80 exon 7; Set C
guuauacagggcguacacuuucccuucuca

SEQ ID NO: 61346 - RNA, 17 nt, Artificial Sequence
  Synthetic Oligonucleotide; CD80 exon 7; Set C
cagggcguacacuuucc

SEQ ID NO: 61347 - RNA, 29 nt, Artificial Sequence
  Synthetic Oligonucleotide; CD80 exon 7; Set C
guuauacagggcguacacuuucccuucuc

SEQ ID NO: 61348 - RNA, 24 nt, Artificial Sequence
  Synthetic Oligonucleotide; CD80 exon 7; Set A
uguuauacagggcguacacuuucc

SEQ ID NO: 61349 - RNA, 36 nt, Artificial Sequence
  Synthetic Oligonucleotide; CD80 exon 7; Set C
cuucugcggacacuguuauacagggcguacacuuuc

SEQ ID NO: 61350 - RNA, 35 nt, Artificial Sequence
  Synthetic Oligonucleotide; CD80 exon 7; Set C
cuucugcggacacuguuauacagggcguacacuuu

SEQ ID NO: 61351 - RNA, 37 nt, Artificial Sequence
  Synthetic Oligonucleotide; CD80 exon 7; Set C
gcuucugcggacacuguuauacagggcguacacuuuc

SEQ ID NO: 61352 - RNA, 36 nt, Artificial Sequence
  Synthetic Oligonucleotide; CD80 exon 7; Set C
gcuucugcggacacuguuauacagggcguacacuuu

SEQ ID NO: 61353 - RNA, 34 nt, Artificial Sequence
  Synthetic Oligonucleotide; CD80 exon 7; Set C
cuucugcggacacuguuauacagggcguacacuu

SEQ ID NO: 61354 - RNA, 38 nt, Artificial Sequence
  Synthetic Oligonucleotide; CD80 exon 7; Set C
ugcuucugcggacacuguuauacagggcguacacuuuc

SEQ ID NO: 61355 - RNA, 37 nt, Artificial Sequence
  Synthetic Oligonucleotide; CD80 exon 7; Set C
ugcuucugcggacacuguuauacagggcguacacuuu

SEQ ID NO: 61356 - RNA, 35 nt, Artificial Sequence
  Synthetic Oligonucleotide; CD80 exon 7; Set C
gcuucugcggacacuguuauacagggcguacacuu

SEQ ID NO: 61357 - RNA, 33 nt, Artificial Sequence
  Synthetic Oligonucleotide; CD80 exon 7; Set C
cuucugcggacacuguuauacagggcguacacu

SEQ ID NO: 61358 - RNA, 36 nt, Artificial Sequence
  Synthetic Oligonucleotide; CD80 exon 7; Set C
ugcuucugcggacacuguuauacagggcguacacuu

SEQ ID NO: 61359 - RNA, 34 nt, Artificial Sequence
  Synthetic Oligonucleotide; CD80 exon 7; Set C
gcuucugcggacacuguuauacagggcguacacu

SEQ ID NO: 61360 - RNA, 32 nt, Artificial Sequence
  Synthetic Oligonucleotide; CD80 exon 7; Set C
cuucugcggacacuguuauacagggcguacac

SEQ ID NO: 61361 - RNA, 40 nt, Artificial Sequence
  Synthetic Oligonucleotide; CD80 exon 7; Set C
cuugcuucugcggacacuguuauacagggcguacacuuuc

SEQ ID NO: 61362 - RNA, 35 nt, Artificial Sequence
  Synthetic Oligonucleotide; CD80 exon 7; Set C
ugcuucugcggacacuguuauacagggcguacacu

SEQ ID NO: 61363 - RNA, 33 nt, Artificial Sequence
  Synthetic Oligonucleotide; CD80 exon 7; Set C
gcuucugcggacacuguuauacagggcguacac

SEQ ID NO: 61364 - RNA, 31 nt, Artificial Sequence
  Synthetic Oligonucleotide; CD80 exon 7; Set C
cuucugcggacacuguuauacagggcguaca

SEQ ID NO: 61365 - RNA, 40 nt, Artificial Sequence
  Synthetic Oligonucleotide; CD80 exon 7; Set C
ccuugcuucugcggacacuguuauacagggcguacacuuu

SEQ ID NO: 61366 - RNA, 30 nt, Artificial Sequence
  Synthetic Oligonucleotide; CD80 exon 7; Set C
cuucugcggacacuguuauacagggcguac

SEQ ID NO: 61367 - RNA, 34 nt, Artificial Sequence
  Synthetic Oligonucleotide; CD80 exon 7; Set C
ugcuucugcggacacuguuauacagggcguacac

SEQ ID NO: 61368 - RNA, 32 nt, Artificial Sequence
  Synthetic Oligonucleotide; CD80 exon 7; Set C
gcuucugcggacacuguuauacagggcguaca

SEQ ID NO: 61369 - RNA, 29 nt, Artificial Sequence
  Synthetic Oligonucleotide; CD80 exon 7; Set C
cuucugcggacacuguuauacagggcgua

SEQ ID NO: 61370 - RNA, 39 nt, Artificial Sequence
  Synthetic Oligonucleotide; CD80 exon 7; Set C
ccuugcuucugcggacacuguuauacagggcguacacuu

SEQ ID NO: 61371 - RNA, 31 nt, Artificial Sequence
  Synthetic Oligonucleotide; CD80 exon 7; Set C
gcuucugcggacacuguuauacagggcguac

SEQ ID NO: 61372 - RNA, 37 nt, Artificial Sequence
  Synthetic Oligonucleotide; CD80 exon 7; Set C
cuugcuucugcggacacuguuauacagggcguacacu

SEQ ID NO: 61373 - RNA, 33 nt, Artificial Sequence
  Synthetic Oligonucleotide; CD80 exon 7; Set C
ugcuucugcggacacuguuauacagggcguaca

SEQ ID NO: 61374 - RNA, 28 nt, Artificial Sequence
  Synthetic Oligonucleotide; CD80 exon 7; Set C
cuucugcggacacuguuauacagggcgu

SEQ ID NO: 61375 - RNA, 32 nt, Artificial Sequence
  Synthetic Oligonucleotide; CD80 exon 7; Set C
ugcuucugcggacacuguuauacagggcguac

SEQ ID NO: 61376 - RNA, 38 nt, Artificial Sequence
  Synthetic Oligonucleotide; CD80 exon 7; Set C
ccuugcuucugcggacacuguuauacagggcguacacu

SEQ ID NO: 61377 - RNA, 36 nt, Artificial Sequence
  Synthetic Oligonucleotide; CD80 exon 7; Set C
cuugcuucugcggacacuguuauacagggcguacac

SEQ ID NO: 61378 - RNA, 29 nt, Artificial Sequence
  Synthetic Oligonucleotide; CD80 exon 7; Set C
gcuucugcggacacuguuauacagggcgu

SEQ ID NO: 61379 - RNA, 35 nt, Artificial Sequence
  Synthetic Oligonucleotide; CD80 exon 7; Set C
cuugcuucugcggacacuguuauacagggcguaca

SEQ ID NO: 61380 - RNA, 37 nt, Artificial Sequence
  Synthetic Oligonucleotide; CD80 exon 7; Set C
ccuugcuucugcggacacuguuauacagggcguacac

SEQ ID NO: 61381 - RNA, 30 nt, Artificial Sequence
  Synthetic Oligonucleotide; CD80 exon 7; Set C
ugcuucugcggacacuguuauacagggcgu

SEQ ID NO: 61382 - RNA, 34 nt, Artificial Sequence
  Synthetic Oligonucleotide; CD80 exon 7; Set C
cuugcuucugcggacacuguuauacagggcguac

SEQ ID NO: 61383 - RNA, 36 nt, Artificial Sequence
  Synthetic Oligonucleotide; CD80 exon 7; Set C
ccuugcuucugcggacacuguuauacagggcguaca

SEQ ID NO: 61384 - RNA, 35 nt, Artificial Sequence
  Synthetic Oligonucleotide; CD80 exon 7; Set C
ccuugcuucugcggacacuguuauacagggcguac

SEQ ID NO: 61385 - RNA, 34 nt, Artificial Sequence
  Synthetic Oligonucleotide; CD80 exon 7; Set C
ccuugcuucugcggacacuguuauacagggcgua

SEQ ID NO: 61386 - RNA, 33 nt, Artificial Sequence
  Synthetic Oligonucleotide; CD80 exon 7; Set C
ccuugcuucugcggacacuguuauacagggcgu

SEQ ID NO: 61387 - RNA, 22 nt, Artificial Sequence
  Synthetic Oligonucleotide; CD80 exon 7; Set A
cuucugcggacacuguuauaca

SEQ ID NO: 61388 - RNA, 21 nt, Artificial Sequence
  Synthetic Oligonucleotide; CD80 exon 7; Set A
cuucugcggacacuguuauac

SEQ ID NO: 61389 - RNA, 23 nt, Artificial Sequence
  Synthetic Oligonucleotide; CD80 exon 7; Set A
gcuucugcggacacuguuauaca

SEQ ID NO: 61390 - RNA, 20 nt, Artificial Sequence
  Synthetic Oligonucleotide; CD80 exon 7; Set C
cuucugcggacacuguuaua

SEQ ID NO: 61391 - RNA, 22 nt, Artificial Sequence
  Synthetic Oligonucleotide; CD80 exon 7; Set A
gcuucugcggacacuguuauac

SEQ ID NO: 61392 - RNA, 24 nt, Artificial Sequence
  Synthetic Oligonucleotide; CD80 exon 7; Set A
ugcuucugcggacacuguuauaca

SEQ ID NO: 61393 - RNA, 19 nt, Artificial Sequence
  Synthetic Oligonucleotide; CD80 exon 7; Set C
cuucugcggacacuguuau

SEQ ID NO: 61394 - RNA, 21 nt, Artificial Sequence
  Synthetic Oligonucleotide; CD80 exon 7; Set A
gcuucugcggacacuguuaua

SEQ ID NO: 61395 - RNA, 23 nt, Artificial Sequence
  Synthetic Oligonucleotide; CD80 exon 7; Set A
ugcuucugcggacacuguuauac

SEQ ID NO: 61396 - RNA, 20 nt, Artificial Sequence
  Synthetic Oligonucleotide; CD80 exon 7; Set A
gcuucugcggacacuguuau

SEQ ID NO: 61397 - RNA, 18 nt, Artificial Sequence
  Synthetic Oligonucleotide; CD80 exon 7; Set C
cuucugcggacacuguua

SEQ ID NO: 61398 - RNA, 22 nt, Artificial Sequence
  Synthetic Oligonucleotide; CD80 exon 7; Set A
ugcuucugcggacacuguuaua

SEQ ID NO: 61399 - RNA, 26 nt, Artificial Sequence
  Synthetic Oligonucleotide; CD80 exon 7; Set A
cuugcuucugcggacacuguuauaca

SEQ ID NO: 61400 - RNA, 21 nt, Artificial Sequence
  Synthetic Oligonucleotide; CD80 exon 7; Set A
ugcuucugcggacacuguuau

SEQ ID NO: 61401 - RNA, 19 nt, Artificial Sequence
  Synthetic Oligonucleotide; CD80 exon 7; Set A
gcuucugcggacacuguua

SEQ ID NO: 61402 - RNA, 17 nt, Artificial Sequence
  Synthetic Oligonucleotide; CD80 exon 7; Set C
cuucugcggacacuguu

SEQ ID NO: 61403 - RNA, 27 nt, Artificial Sequence
  Synthetic Oligonucleotide; CD80 exon 7; Set C
ccuugcuucugcggacacuguuauaca

SEQ ID NO: 61404 - RNA, 20 nt, Artificial Sequence
  Synthetic Oligonucleotide; CD80 exon 7; Set A
ugcuucugcggacacuguua

SEQ ID NO: 61405 - RNA, 26 nt, Artificial Sequence
  Synthetic Oligonucleotide; CD80 exon 7; Set C
ccuugcuucugcggacacuguuauac

SEQ ID NO: 61406 - RNA, 18 nt, Artificial Sequence
  Synthetic Oligonucleotide; CD80 exon 7; Set A
gcuucugcggacacuguu

SEQ ID NO: 61407 - RNA, 25 nt, Artificial Sequence
  Synthetic Oligonucleotide; CD80 exon 7; Set A
ccuugcuucugcggacacuguuaua

SEQ ID NO: 61408 - RNA, 19 nt, Artificial Sequence
  Synthetic Oligonucleotide; CD80 exon 7; Set A
ugcuucugcggacacuguu

SEQ ID NO: 61409 - RNA, 22 nt, Artificial Sequence
  Synthetic Oligonucleotide; CD80 exon 7; Set A
cuugcuucugcggacacuguua

SEQ ID NO: 61410 - RNA, 24 nt, Artificial Sequence
  Synthetic Oligonucleotide; CD80 exon 7; Set A
ccuugcuucugcggacacuguuau

SEQ ID NO: 61411 - RNA, 23 nt, Artificial Sequence
  Synthetic Oligonucleotide; CD80 exon 7; Set A
ccuugcuucugcggacacuguua

SEQ ID NO: 61412 - RNA, 21 nt, Artificial Sequence
  Synthetic Oligonucleotide; CD80 exon 7; Set A
cuugcuucugcggacacuguu

SEQ ID NO: 61413 - RNA, 22 nt, Artificial Sequence
  Synthetic Oligonucleotide; CD80 exon 7; Set A
ccuugcuucugcggacacuguu

SEQ ID NO: 61414 - RNA, 29 nt, Artificial Sequence
  Synthetic Oligonucleotide; CD80 exon 7; Set C
uuucagccccuugcuucugcggacacugu

SEQ ID NO: 61415 - RNA, 30 nt, Artificial Sequence
  Synthetic Oligonucleotide; CD80 exon 7; Set C
uuuucagccccuugcuucugcggacacugu

SEQ ID NO: 61416 - RNA, 32 nt, Artificial Sequence
  Synthetic Oligonucleotide; CD80 exon 7; Set C
ucuuuucagccccuugcuucugcggacacugu

SEQ ID NO: 61417 - RNA, 16 nt, Artificial Sequence
  Synthetic Oligonucleotide; CD80 exon 7; Set C
uuucagccccuugcuu

SEQ ID NO: 61418 - RNA, 15 nt, Artificial Sequence
  Synthetic Oligonucleotide; CD80 exon 7; Set C
uuucagccccuugcu

SEQ ID NO: 61419 - RNA, 17 nt, Artificial Sequence
  Synthetic Oligonucleotide; CD80 exon 7; Set C
uuuucagccccuugcuu

SEQ ID NO: 61420 - RNA, 16 nt, Artificial Sequence
  Synthetic Oligonucleotide; CD80 exon 7; Set C
uuuucagccccuugcu

SEQ ID NO: 61421 - RNA, 18 nt, Artificial Sequence
  Synthetic Oligonucleotide; CD80 exon 7; Set C
cuuuucagccccuugcuu

SEQ ID NO: 61422 - RNA, 15 nt, Artificial Sequence
  Synthetic Oligonucleotide; CD80 exon 7; Set C
uuuucagccccuugc

SEQ ID NO: 61423 - RNA, 17 nt, Artificial Sequence
  Synthetic Oligonucleotide; CD80 exon 7; Set C
cuuuucagccccuugcu

SEQ ID NO: 61424 - RNA, 19 nt, Artificial Sequence
  Synthetic Oligonucleotide; CD80 exon 7; Set C
ucuuuucagccccuugcuu

SEQ ID NO: 61425 - RNA, 16 nt, Artificial Sequence
  Synthetic Oligonucleotide; CD80 exon 7; Set C
cuuuucagccccuugc

SEQ ID NO: 61426 - RNA, 18 nt, Artificial Sequence
  Synthetic Oligonucleotide; CD80 exon 7; Set C
ucuuuucagccccuugcu

SEQ ID NO: 61427 - RNA, 20 nt, Artificial Sequence
  Synthetic Oligonucleotide; CD80 exon 7; Set C
aucuuuucagccccuugcuu

SEQ ID NO: 61428 - RNA, 17 nt, Artificial Sequence
  Synthetic Oligonucleotide; CD80 exon 7; Set C
ucuuuucagccccuugc

SEQ ID NO: 61429 - RNA, 21 nt, Artificial Sequence
  Synthetic Oligonucleotide; CD80 exon 7; Set A
gaucuuuucagccccuugcuu

SEQ ID NO: 61430 - RNA, 19 nt, Artificial Sequence
  Synthetic Oligonucleotide; CD80 exon 7; Set C
aucuuuucagccccuugcu

SEQ ID NO: 61431 - RNA, 18 nt, Artificial Sequence
  Synthetic Oligonucleotide; CD80 exon 7; Set C
aucuuuucagccccuugc

SEQ ID NO: 61432 - RNA, 22 nt, Artificial Sequence
  Synthetic Oligonucleotide; CD80 exon 7; Set A
agaucuuuucagccccuugcuu

SEQ ID NO: 61433 - RNA, 20 nt, Artificial Sequence
  Synthetic Oligonucleotide; CD80 exon 7; Set A
gaucuuuucagccccuugcu

SEQ ID NO: 61434 - RNA, 15 nt, Artificial Sequence
  Synthetic Oligonucleotide; CD80 exon 7; Set C
ucuuuucagccccuu

SEQ ID NO: 61435 - RNA, 19 nt, Artificial Sequence
  Synthetic Oligonucleotide; CD80 exon 7; Set C
gaucuuuucagccccuugc

SEQ ID NO: 61436 - RNA, 23 nt, Artificial Sequence
  Synthetic Oligonucleotide; CD80 exon 7; Set A
cagaucuuuucagccccuugcuu

SEQ ID NO: 61437 - RNA, 21 nt, Artificial Sequence
  Synthetic Oligonucleotide; CD80 exon 7; Set A
agaucuuuucagccccuugcu

SEQ ID NO: 61438 - RNA, 16 nt, Artificial Sequence
  Synthetic Oligonucleotide; CD80 exon 7; Set C
aucuuuucagccccuu

SEQ ID NO: 61439 - RNA, 20 nt, Artificial Sequence
  Synthetic Oligonucleotide; CD80 exon 7; Set A
agaucuuuucagccccuugc

SEQ ID NO: 61440 - RNA, 24 nt, Artificial Sequence
  Synthetic Oligonucleotide; CD80 exon 7; Set A
ucagaucuuuucagccccuugcuu

SEQ ID NO: 61441 - RNA, 22 nt, Artificial Sequence
  Synthetic Oligonucleotide; CD80 exon 7; Set A
cagaucuuuucagccccuugcu

SEQ ID NO: 61442 - RNA, 17 nt, Artificial Sequence
  Synthetic Oligonucleotide; CD80 exon 7; Set C
gaucuuuucagccccuu

SEQ ID NO: 61443 - RNA, 21 nt, Artificial Sequence
  Synthetic Oligonucleotide; CD80 exon 7; Set A
cagaucuuuucagccccuugc

SEQ ID NO: 61444 - RNA, 23 nt, Artificial Sequence
  Synthetic Oligonucleotide; CD80 exon 7; Set A
ucagaucuuuucagccccuugcu

SEQ ID NO: 61445 - RNA, 25 nt, Artificial Sequence
  Synthetic Oligonucleotide; CD80 exon 7; Set A
uucagaucuuuucagccccuugcuu

SEQ ID NO: 61446 - RNA, 18 nt, Artificial Sequence
  Synthetic Oligonucleotide; CD80 exon 7; Set C
agaucuuuucagccccuu

SEQ ID NO: 61447 - RNA, 22 nt, Artificial Sequence
  Synthetic Oligonucleotide; CD80 exon 7; Set A
ucagaucuuuucagccccuugc

SEQ ID NO: 61448 - RNA, 24 nt, Artificial Sequence
  Synthetic Oligonucleotide; CD80 exon 7; Set A
uucagaucuuuucagccccuugcu

SEQ ID NO: 61449 - RNA, 26 nt, Artificial Sequence
  Synthetic Oligonucleotide; CD80 exon 7; Set A
cuucagaucuuuucagccccuugcuu

SEQ ID NO: 61450 - RNA, 19 nt, Artificial Sequence
  Synthetic Oligonucleotide; CD80 exon 7; Set C
cagaucuuuucagccccuu

SEQ ID NO: 61451 - RNA, 23 nt, Artificial Sequence
  Synthetic Oligonucleotide; CD80 exon 7; Set A
uucagaucuuuucagccccuugc

SEQ ID NO: 61452 - RNA, 25 nt, Artificial Sequence
  Synthetic Oligonucleotide; CD80 exon 7; Set A
cuucagaucuuuucagccccuugcu

SEQ ID NO: 61453 - RNA, 27 nt, Artificial Sequence
  Synthetic Oligonucleotide; CD80 exon 7; Set C
ccuucagaucuuuucagccccuugcuu

SEQ ID NO: 61454 - RNA, 20 nt, Artificial Sequence
  Synthetic Oligonucleotide; CD80 exon 7; Set C
ucagaucuuuucagccccuu

SEQ ID NO: 61455 - RNA, 24 nt, Artificial Sequence
  Synthetic Oligonucleotide; CD80 exon 7; Set A
cuucagaucuuuucagccccuugc

SEQ ID NO: 61456 - RNA, 26 nt, Artificial Sequence
  Synthetic Oligonucleotide; CD80 exon 7; Set C
ccuucagaucuuuucagccccuugcu

SEQ ID NO: 61457 - RNA, 18 nt, Artificial Sequence
  Synthetic Oligonucleotide; CD80 exon 7; Set C
cagaucuuuucagccccu

SEQ ID NO: 61458 - RNA, 21 nt, Artificial Sequence
  Synthetic Oligonucleotide; CD80 exon 7; Set C
uucagaucuuuucagccccuu

SEQ ID NO: 61459 - RNA, 25 nt, Artificial Sequence
  Synthetic Oligonucleotide; CD80 exon 7; Set A
ccuucagaucuuuucagccccuugc

SEQ ID NO: 61460 - RNA, 19 nt, Artificial Sequence
  Synthetic Oligonucleotide; CD80 exon 7; Set C
ucagaucuuuucagccccu

SEQ ID NO: 61461 - RNA, 22 nt, Artificial Sequence
  Synthetic Oligonucleotide; CD80 exon 7; Set A
cuucagaucuuuucagccccuu

SEQ ID NO: 61462 - RNA, 20 nt, Artificial Sequence
  Synthetic Oligonucleotide; CD80 exon 7; Set C
uucagaucuuuucagccccu

SEQ ID NO: 61463 - RNA, 23 nt, Artificial Sequence
  Synthetic Oligonucleotide; CD80 exon 7; Set A
ccuucagaucuuuucagccccuu

SEQ ID NO: 61464 - RNA, 21 nt, Artificial Sequence
  Synthetic Oligonucleotide; CD80 exon 7; Set A
cuucagaucuuuucagccccu

SEQ ID NO: 61465 - RNA, 22 nt, Artificial Sequence
  Synthetic Oligonucleotide; CD80 exon 7; Set A
ccuucagaucuuuucagccccu

SEQ ID NO: 61466 - RNA, 33 nt, Artificial Sequence
  Synthetic Oligonucleotide; CD80 exon 7; Set C
aggcuaccuucagaucuuuucagccccuugcuu

SEQ ID NO: 61467 - RNA, 32 nt, Artificial Sequence
  Synthetic Oligonucleotide; CD80 exon 7; Set C
aggcuaccuucagaucuuuucagccccuugcu

SEQ ID NO: 61468 - RNA, 31 nt, Artificial Sequence
  Synthetic Oligonucleotide; CD80 exon 7; Set C
aggcuaccuucagaucuuuucagccccuugc

SEQ ID NO: 61469 - RNA, 29 nt, Artificial Sequence
  Synthetic Oligonucleotide; CD80 exon 7; Set C
aggcuaccuucagaucuuuucagccccuu

SEQ ID NO: 61470 - RNA, 38 nt, Artificial Sequence
  Synthetic Oligonucleotide; CD80 exon 7; Set C
gacggaggcuaccuucagaucuuuucagccccuugcuu

SEQ ID NO: 61471 - RNA, 39 nt, Artificial Sequence
  Synthetic Oligonucleotide; CD80 exon 7; Set C
ugacggaggcuaccuucagaucuuuucagccccuugcuu

SEQ ID NO: 61472 - RNA, 37 nt, Artificial Sequence
  Synthetic Oligonucleotide; CD80 exon 7; Set C
gacggaggcuaccuucagaucuuuucagccccuugcu

SEQ ID NO: 61473 - RNA, 36 nt, Artificial Sequence
  Synthetic Oligonucleotide; CD80 exon 7; Set C
gacggaggcuaccuucagaucuuuucagccccuugc

SEQ ID NO: 61474 - RNA, 38 nt, Artificial Sequence
  Synthetic Oligonucleotide; CD80 exon 7; Set C
ugacggaggcuaccuucagaucuuuucagccccuugcu

SEQ ID NO: 61475 - RNA, 40 nt, Artificial Sequence
  Synthetic Oligonucleotide; CD80 exon 7; Set C
augacggaggcuaccuucagaucuuuucagccccuugcuu

SEQ ID NO: 61476 - RNA, 37 nt, Artificial Sequence
  Synthetic Oligonucleotide; CD80 exon 7; Set C
ugacggaggcuaccuucagaucuuuucagccccuugc

SEQ ID NO: 61477 - RNA, 39 nt, Artificial Sequence
  Synthetic Oligonucleotide; CD80 exon 7; Set C
augacggaggcuaccuucagaucuuuucagccccuugcu

SEQ ID NO: 61478 - RNA, 34 nt, Artificial Sequence
  Synthetic Oligonucleotide; CD80 exon 7; Set C
gacggaggcuaccuucagaucuuuucagccccuu

SEQ ID NO: 61479 - RNA, 38 nt, Artificial Sequence
  Synthetic Oligonucleotide; CD80 exon 7; Set C
augacggaggcuaccuucagaucuuuucagccccuugc

SEQ ID NO: 61480 - RNA, 40 nt, Artificial Sequence
  Synthetic Oligonucleotide; CD80 exon 7; Set C
gaugacggaggcuaccuucagaucuuuucagccccuugcu

SEQ ID NO: 61481 - RNA, 35 nt, Artificial Sequence
  Synthetic Oligonucleotide; CD80 exon 7; Set C
ugacggaggcuaccuucagaucuuuucagccccuu

SEQ ID NO: 61482 - RNA, 39 nt, Artificial Sequence
  Synthetic Oligonucleotide; CD80 exon 7; Set C
gaugacggaggcuaccuucagaucuuuucagccccuugc

SEQ ID NO: 61483 - RNA, 33 nt, Artificial Sequence
  Synthetic Oligonucleotide; CD80 exon 7; Set C
gacggaggcuaccuucagaucuuuucagccccu

SEQ ID NO: 61484 - RNA, 36 nt, Artificial Sequence
  Synthetic Oligonucleotide; CD80 exon 7; Set C
augacggaggcuaccuucagaucuuuucagccccuu

SEQ ID NO: 61485 - RNA, 40 nt, Artificial Sequence
  Synthetic Oligonucleotide; CD80 exon 7; Set C
agaugacggaggcuaccuucagaucuuuucagccccuugc

SEQ ID NO: 61486 - RNA, 34 nt, Artificial Sequence
  Synthetic Oligonucleotide; CD80 exon 7; Set C
ugacggaggcuaccuucagaucuuuucagccccu

SEQ ID NO: 61487 - RNA, 37 nt, Artificial Sequence
  Synthetic Oligonucleotide; CD80 exon 7; Set C
gaugacggaggcuaccuucagaucuuuucagccccuu

SEQ ID NO: 61488 - RNA, 35 nt, Artificial Sequence
  Synthetic Oligonucleotide; CD80 exon 7; Set C
augacggaggcuaccuucagaucuuuucagccccu

SEQ ID NO: 61489 - RNA, 38 nt, Artificial Sequence
  Synthetic Oligonucleotide; CD80 exon 7; Set C
agaugacggaggcuaccuucagaucuuuucagccccuu

SEQ ID NO: 61490 - RNA, 36 nt, Artificial Sequence
  Synthetic Oligonucleotide; CD80 exon 7; Set C
gaugacggaggcuaccuucagaucuuuucagccccu

SEQ ID NO: 61491 - RNA, 37 nt, Artificial Sequence
  Synthetic Oligonucleotide; CD80 exon 7; Set C
agaugacggaggcuaccuucagaucuuuucagccccu

SEQ ID NO: 61492 - RNA, 40 nt, Artificial Sequence
  Synthetic Oligonucleotide; CD80 exon 7; Set C
auguaucccagaagagaugacggaggcuaccuucagaucu

SEQ ID NO: 61493 - RNA, 39 nt, Artificial Sequence
  Synthetic Oligonucleotide; CD80 exon 7; Set C
auguaucccagaagagaugacggaggcuaccuucagauc

SEQ ID NO: 61494 - RNA, 37 nt, Artificial Sequence
  Synthetic Oligonucleotide; CD80 exon 7; Set C
auccauguaucccagaagagaugacggaggcuaccuu

SEQ ID NO: 61495 - RNA, 36 nt, Artificial Sequence
  Synthetic Oligonucleotide; CD80 exon 7; Set C
auccauguaucccagaagagaugacggaggcuaccu

SEQ ID NO: 61496 - RNA, 25 nt, Artificial Sequence
  Synthetic Oligonucleotide; CD80 exon 7; Set B
uguaucccagaagagaugacggagg

SEQ ID NO: 61497 - RNA, 36 nt, Artificial Sequence
  Synthetic Oligonucleotide; CD80 exon 7; Set C
gauccauguaucccagaagagaugacggaggcuacc

SEQ ID NO: 61498 - RNA, 30 nt, Artificial Sequence
  Synthetic Oligonucleotide; CD80 exon 7; Set B
auccauguaucccagaagagaugacggagg

SEQ ID NO: 61499 - RNA, 17 nt, Artificial Sequence
  Synthetic Oligonucleotide; CD80 exon 7; Set C
uguaucccagaagagau

SEQ ID NO: 61500 - RNA, 16 nt, Artificial Sequence
  Synthetic Oligonucleotide; CD80 exon 7; Set C
uguaucccagaagaga

SEQ ID NO: 61501 - RNA, 24 nt, Artificial Sequence
  Synthetic Oligonucleotide; CD80 exon 7; Set C
auccauguaucccagaagagauga

SEQ ID NO: 61502 - RNA, 23 nt, Artificial Sequence
  Synthetic Oligonucleotide; CD80 exon 7; Set C
auccauguaucccagaagagaug

SEQ ID NO: 61503 - RNA, 22 nt, Artificial Sequence
  Synthetic Oligonucleotide; CD80 exon 7; Set C
auccauguaucccagaagagau

SEQ ID NO: 61504 - RNA, 21 nt, Artificial Sequence
  Synthetic Oligonucleotide; CD80 exon 7; Set C
auccauguaucccagaagaga

SEQ ID NO: 61505 - RNA, 39 nt, Artificial Sequence
  Synthetic Oligonucleotide; CD80 exon 7; Set C
auccccacgauccauguaucccagaagagaugacggagg

SEQ ID NO: 61506 - RNA, 17 nt, Artificial Sequence
  Synthetic Oligonucleotide; CD80 exon 7; Set C
auccauguaucccagaa

SEQ ID NO: 61507 - RNA, 16 nt, Artificial Sequence
  Synthetic Oligonucleotide; CD80 exon 7; Set C
auccauguaucccaga

SEQ ID NO: 61508 - RNA, 38 nt, Artificial Sequence
  Synthetic Oligonucleotide; CD80 exon 7; Set C
caugauccccacgauccauguaucccagaagagaugac

SEQ ID NO: 61509 - RNA, 39 nt, Artificial Sequence
  Synthetic Oligonucleotide; CD80 exon 7; Set C
ucaugauccccacgauccauguaucccagaagagaugac

SEQ ID NO: 61510 - RNA, 37 nt, Artificial Sequence
  Synthetic Oligonucleotide; CD80 exon 7; Set C
caugauccccacgauccauguaucccagaagagauga

SEQ ID NO: 61511 - RNA, 38 nt, Artificial Sequence
  Synthetic Oligonucleotide; CD80 exon 7; Set C
ucaugauccccacgauccauguaucccagaagagauga

SEQ ID NO: 61512 - RNA, 40 nt, Artificial Sequence
  Synthetic Oligonucleotide; CD80 exon 7; Set C
cucaugauccccacgauccauguaucccagaagagaugac

SEQ ID NO: 61513 - RNA, 36 nt, Artificial Sequence
  Synthetic Oligonucleotide; CD80 exon 7; Set C
caugauccccacgauccauguaucccagaagagaug

SEQ ID NO: 61514 - RNA, 39 nt, Artificial Sequence
  Synthetic Oligonucleotide; CD80 exon 7; Set C
cucaugauccccacgauccauguaucccagaagagauga

SEQ ID NO: 61515 - RNA, 37 nt, Artificial Sequence
  Synthetic Oligonucleotide; CD80 exon 7; Set C
ucaugauccccacgauccauguaucccagaagagaug

SEQ ID NO: 61516 - RNA, 35 nt, Artificial Sequence
  Synthetic Oligonucleotide; CD80 exon 7; Set C
caugauccccacgauccauguaucccagaagagau

SEQ ID NO: 61517 - RNA, 38 nt, Artificial Sequence
  Synthetic Oligonucleotide; CD80 exon 7; Set C
cucaugauccccacgauccauguaucccagaagagaug

SEQ ID NO: 61518 - RNA, 36 nt, Artificial Sequence
  Synthetic Oligonucleotide; CD80 exon 7; Set C
ucaugauccccacgauccauguaucccagaagagau

SEQ ID NO: 61519 - RNA, 34 nt, Artificial Sequence
  Synthetic Oligonucleotide; CD80 exon 7; Set C
caugauccccacgauccauguaucccagaagaga

SEQ ID NO: 61520 - RNA, 37 nt, Artificial Sequence
  Synthetic Oligonucleotide; CD80 exon 7; Set C
cucaugauccccacgauccauguaucccagaagagau

SEQ ID NO: 61521 - RNA, 35 nt, Artificial Sequence
  Synthetic Oligonucleotide; CD80 exon 7; Set C
ucaugauccccacgauccauguaucccagaagaga

SEQ ID NO: 61522 - RNA, 36 nt, Artificial Sequence
  Synthetic Oligonucleotide; CD80 exon 7; Set C
cucaugauccccacgauccauguaucccagaagaga

SEQ ID NO: 61523 - RNA, 30 nt, Artificial Sequence
  Synthetic Oligonucleotide; CD80 exon 7; Set C
caugauccccacgauccauguaucccagaa

SEQ ID NO: 61524 - RNA, 31 nt, Artificial Sequence
  Synthetic Oligonucleotide; CD80 exon 7; Set C
ucaugauccccacgauccauguaucccagaa

SEQ ID NO: 61525 - RNA, 29 nt, Artificial Sequence
  Synthetic Oligonucleotide; CD80 exon 7; Set C
caugauccccacgauccauguaucccaga

SEQ ID NO: 61526 - RNA, 32 nt, Artificial Sequence
  Synthetic Oligonucleotide; CD80 exon 7; Set C
cucaugauccccacgauccauguaucccagaa

SEQ ID NO: 61527 - RNA, 30 nt, Artificial Sequence
  Synthetic Oligonucleotide; CD80 exon 7; Set C
ucaugauccccacgauccauguaucccaga

SEQ ID NO: 61528 - RNA, 31 nt, Artificial Sequence
  Synthetic Oligonucleotide; CD80 exon 7; Set C
cucaugauccccacgauccauguaucccaga

SEQ ID NO: 61529 - RNA, 18 nt, Artificial Sequence
  Synthetic Oligonucleotide; CD80 exon 7; Set C
ugauccccacgauccaug

SEQ ID NO: 61530 - RNA, 21 nt, Artificial Sequence
  Synthetic Oligonucleotide; CD80 exon 7; Set B
caugauccccacgauccaugu

SEQ ID NO: 61531 - RNA, 19 nt, Artificial Sequence
  Synthetic Oligonucleotide; CD80 exon 7; Set C
augauccccacgauccaug

SEQ ID NO: 61532 - RNA, 22 nt, Artificial Sequence
  Synthetic Oligonucleotide; CD80 exon 7; Set B
ucaugauccccacgauccaugu

SEQ ID NO: 61533 - RNA, 23 nt, Artificial Sequence
  Synthetic Oligonucleotide; CD80 exon 7; Set B
cucaugauccccacgauccaugu

SEQ ID NO: 61534 - RNA, 16 nt, Artificial Sequence
  Synthetic Oligonucleotide; CD80 exon 7; Set C
caugauccccacgauc

SEQ ID NO: 61535 - RNA, 17 nt, Artificial Sequence
  Synthetic Oligonucleotide; CD80 exon 7; Set C
ucaugauccccacgauc

SEQ ID NO: 61536 - RNA, 18 nt, Artificial Sequence
  Synthetic Oligonucleotide; CD80 exon 7; Set C
cucaugauccccacgauc

SEQ ID NO: 61537 - RNA, 21 nt, Artificial Sequence
  Synthetic Oligonucleotide; CD160 exon 3; Set C
auuacugucucaaaccugguu

SEQ ID NO: 61538 - RNA, 22 nt, Artificial Sequence
  Synthetic Oligonucleotide; CD160 exon 3; Set C
uauuacugucucaaaccugguu

SEQ ID NO: 61539 - RNA, 23 nt, Artificial Sequence
  Synthetic Oligonucleotide; CD160 exon 3; Set C
auauuacugucucaaaccugguu

SEQ ID NO: 61540 - RNA, 24 nt, Artificial Sequence
  Synthetic Oligonucleotide; CD160 exon 3; Set C
aauauuacugucucaaaccugguu

SEQ ID NO: 61541 - RNA, 15 nt, Artificial Sequence
  Synthetic Oligonucleotide; CD160 exon 3; Set C
uuacugucucaaacc

SEQ ID NO: 61542 - RNA, 25 nt, Artificial Sequence
  Synthetic Oligonucleotide; CD160 exon 3; Set C
caauauuacugucucaaaccugguu

SEQ ID NO: 61543 - RNA, 17 nt, Artificial Sequence
  Synthetic Oligonucleotide; CD160 exon 3; Set C
auuacugucucaaaccu

SEQ ID NO: 61544 - RNA, 16 nt, Artificial Sequence
  Synthetic Oligonucleotide; CD160 exon 3; Set C
auuacugucucaaacc

SEQ ID NO: 61545 - RNA, 26 nt, Artificial Sequence
  Synthetic Oligonucleotide; CD160 exon 3; Set C
ucaauauuacugucucaaaccugguu

SEQ ID NO: 61546 - RNA, 18 nt, Artificial Sequence
  Synthetic Oligonucleotide; CD160 exon 3; Set C
uauuacugucucaaaccu

SEQ ID NO: 61547 - RNA, 17 nt, Artificial Sequence
  Synthetic Oligonucleotide; CD160 exon 3; Set C
uauuacugucucaaacc

SEQ ID NO: 61548 - RNA, 15 nt, Artificial Sequence
  Synthetic Oligonucleotide; CD160 exon 3; Set C
auuacugucucaaac

SEQ ID NO: 61549 - RNA, 27 nt, Artificial Sequence
  Synthetic Oligonucleotide; CD160 exon 3; Set C
cucaauauuacugucucaaaccugguu

SEQ ID NO: 61550 - RNA, 19 nt, Artificial Sequence
  Synthetic Oligonucleotide; CD160 exon 3; Set C
auauuacugucucaaaccu

SEQ ID NO: 61551 - RNA, 18 nt, Artificial Sequence
  Synthetic Oligonucleotide; CD160 exon 3; Set C
auauuacugucucaaacc

SEQ ID NO: 61552 - RNA, 16 nt, Artificial Sequence
  Synthetic Oligonucleotide; CD160 exon 3; Set C
uauuacugucucaaac

SEQ ID NO: 61553 - RNA, 28 nt, Artificial Sequence
  Synthetic Oligonucleotide; CD160 exon 3; Set B
ucucaauauuacugucucaaaccugguu

SEQ ID NO: 61554 - RNA, 19 nt, Artificial Sequence
  Synthetic Oligonucleotide; CD160 exon 3; Set C
aauauuacugucucaaacc

SEQ ID NO: 61555 - RNA, 17 nt, Artificial Sequence
  Synthetic Oligonucleotide; CD160 exon 3; Set C
auauuacugucucaaac

SEQ ID NO: 61556 - RNA, 15 nt, Artificial Sequence
  Synthetic Oligonucleotide; CD160 exon 3; Set C
uauuacugucucaaa

SEQ ID NO: 61557 - RNA, 29 nt, Artificial Sequence
  Synthetic Oligonucleotide; CD160 exon 3; Set B
aucucaauauuacugucucaaaccugguu

SEQ ID NO: 61558 - RNA, 20 nt, Artificial Sequence
  Synthetic Oligonucleotide; CD160 exon 3; Set C
caauauuacugucucaaacc

SEQ ID NO: 61559 - RNA, 18 nt, Artificial Sequence
  Synthetic Oligonucleotide; CD160 exon 3; Set C
aauauuacugucucaaac

SEQ ID NO: 61560 - RNA, 16 nt, Artificial Sequence
  Synthetic Oligonucleotide; CD160 exon 3; Set C
auauuacugucucaaa

SEQ ID NO: 61561 - RNA, 30 nt, Artificial Sequence
  Synthetic Oligonucleotide; CD160 exon 3; Set B
aaucucaauauuacugucucaaaccugguu

SEQ ID NO: 61562 - RNA, 21 nt, Artificial Sequence
  Synthetic Oligonucleotide; CD160 exon 3; Set C
ucaauauuacugucucaaacc

SEQ ID NO: 61563 - RNA, 19 nt, Artificial Sequence
  Synthetic Oligonucleotide; CD160 exon 3; Set C
caauauuacugucucaaac

SEQ ID NO: 61564 - RNA, 17 nt, Artificial Sequence
  Synthetic Oligonucleotide; CD160 exon 3; Set C
aauauuacugucucaaa

SEQ ID NO: 61565 - RNA, 23 nt, Artificial Sequence
  Synthetic Oligonucleotide; CD160 exon 3; Set C
cucaauauuacugucucaaaccu

SEQ ID NO: 61566 - RNA, 22 nt, Artificial Sequence
  Synthetic Oligonucleotide; CD160 exon 3; Set C
cucaauauuacugucucaaacc

SEQ ID NO: 61567 - RNA, 20 nt, Artificial Sequence
  Synthetic Oligonucleotide; CD160 exon 3; Set C
ucaauauuacugucucaaac

SEQ ID NO: 61568 - RNA, 18 nt, Artificial Sequence
  Synthetic Oligonucleotide; CD160 exon 3; Set C
caauauuacugucucaaa

SEQ ID NO: 61569 - RNA, 23 nt, Artificial Sequence
  Synthetic Oligonucleotide; CD160 exon 3; Set C
ucucaauauuacugucucaaacc

SEQ ID NO: 61570 - RNA, 21 nt, Artificial Sequence
  Synthetic Oligonucleotide; CD160 exon 3; Set C
cucaauauuacugucucaaac

SEQ ID NO: 61571 - RNA, 19 nt, Artificial Sequence
  Synthetic Oligonucleotide; CD160 exon 3; Set C
ucaauauuacugucucaaa

SEQ ID NO: 61572 - RNA, 15 nt, Artificial Sequence
  Synthetic Oligonucleotide; CD160 exon 3; Set C
aauauuacugucuca

SEQ ID NO: 61573 - RNA, 24 nt, Artificial Sequence
  Synthetic Oligonucleotide; CD160 exon 3; Set C
aucucaauauuacugucucaaacc

SEQ ID NO: 61574 - RNA, 22 nt, Artificial Sequence
  Synthetic Oligonucleotide; CD160 exon 3; Set C
ucucaauauuacugucucaaac

SEQ ID NO: 61575 - RNA, 20 nt, Artificial Sequence
  Synthetic Oligonucleotide; CD160 exon 3; Set C
cucaauauuacugucucaaa

SEQ ID NO: 61576 - RNA, 25 nt, Artificial Sequence
  Synthetic Oligonucleotide; CD160 exon 3; Set C
aaucucaauauuacugucucaaacc

SEQ ID NO: 61577 - RNA, 23 nt, Artificial Sequence
  Synthetic Oligonucleotide; CD160 exon 3; Set C
aucucaauauuacugucucaaac

SEQ ID NO: 61578 - RNA, 21 nt, Artificial Sequence
  Synthetic Oligonucleotide; CD160 exon 3; Set C
ucucaauauuacugucucaaa

SEQ ID NO: 61579 - RNA, 24 nt, Artificial Sequence
  Synthetic Oligonucleotide; CD160 exon 3; Set C
aaucucaauauuacugucucaaac

SEQ ID NO: 61580 - RNA, 22 nt, Artificial Sequence
  Synthetic Oligonucleotide; CD160 exon 3; Set C
aucucaauauuacugucucaaa

SEQ ID NO: 61581 - RNA, 18 nt, Artificial Sequence
  Synthetic Oligonucleotide; CD160 exon 3; Set C
cucaauauuacugucuca

SEQ ID NO: 61582 - RNA, 15 nt, Artificial Sequence
  Synthetic Oligonucleotide; CD160 exon 3; Set C
ucaauauuacugucu

SEQ ID NO: 61583 - RNA, 23 nt, Artificial Sequence
  Synthetic Oligonucleotide; CD160 exon 3; Set C
aaucucaauauuacugucucaaa

SEQ ID NO: 61584 - RNA, 19 nt, Artificial Sequence
  Synthetic Oligonucleotide; CD160 exon 3; Set C
ucucaauauuacugucuca

SEQ ID NO: 61585 - RNA, 17 nt, Artificial Sequence
  Synthetic Oligonucleotide; CD160 exon 3; Set C
cucaauauuacugucuc

SEQ ID NO: 61586 - RNA, 16 nt, Artificial Sequence
  Synthetic Oligonucleotide; CD160 exon 3; Set C
cucaauauuacugucu

SEQ ID NO: 61587 - RNA, 18 nt, Artificial Sequence
  Synthetic Oligonucleotide; CD160 exon 3; Set C
ucucaauauuacugucuc

SEQ ID NO: 61588 - RNA, 17 nt, Artificial Sequence
  Synthetic Oligonucleotide; CD160 exon 3; Set C
ucucaauauuacugucu

SEQ ID NO: 61589 - RNA, 18 nt, Artificial Sequence
  Synthetic Oligonucleotide; CD160 exon 3; Set C
aucucaauauuacugucu

SEQ ID NO: 61590 - RNA, 19 nt, Artificial Sequence
  Synthetic Oligonucleotide; CD160 exon 3; Set C
aaucucaauauuacugucu

SEQ ID NO: 61591 - RNA, 25 nt, Artificial Sequence
  Synthetic Oligonucleotide; CD160 exon 3; Set C
gucagcaccuggaaaucucaauauu

SEQ ID NO: 61592 - RNA, 16 nt, Artificial Sequence
  Synthetic Oligonucleotide; CD160 exon 3; Set C
aguaccuaggacauua

SEQ ID NO: 61593 - RNA, 15 nt, Artificial Sequence
  Synthetic Oligonucleotide; CD160 exon 3; Set C
aguaccuaggacauu

SEQ ID NO: 61594 - RNA, 18 nt, Artificial Sequence
  Synthetic Oligonucleotide; CD160 exon 3; Set C
ugggugcaaggauucaaa

SEQ ID NO: 61595 - RNA, 19 nt, Artificial Sequence
  Synthetic Oligonucleotide; CD160 exon 3; Set C
gugggugcaaggauucaaa

SEQ ID NO: 61596 - RNA, 20 nt, Artificial Sequence
  Synthetic Oligonucleotide; CD160 exon 3; Set C
agugggugcaaggauucaaa

SEQ ID NO: 61597 - RNA, 15 nt, Artificial Sequence
  Synthetic Oligonucleotide; CD160 exon 3; Set C
agugggugcaaggau

SEQ ID NO: 61598 - RNA, 32 nt, Artificial Sequence
  Synthetic Oligonucleotide; CD160 exon 3; Set C
ccuacccaacccagugggugcaaggauucaaa

SEQ ID NO: 61599 - RNA, 33 nt, Artificial Sequence
  Synthetic Oligonucleotide; CD160 exon 3; Set C
accuacccaacccagugggugcaaggauucaaa

SEQ ID NO: 61600 - RNA, 34 nt, Artificial Sequence
  Synthetic Oligonucleotide; CD160 exon 3; Set C
caccuacccaacccagugggugcaaggauucaaa

SEQ ID NO: 61601 - RNA, 35 nt, Artificial Sequence
  Synthetic Oligonucleotide; CD160 exon 3; Set C
acaccuacccaacccagugggugcaaggauucaaa

SEQ ID NO: 61602 - RNA, 36 nt, Artificial Sequence
  Synthetic Oligonucleotide; CD160 exon 3; Set C
aacaccuacccaacccagugggugcaaggauucaaa

SEQ ID NO: 61603 - RNA, 37 nt, Artificial Sequence
  Synthetic Oligonucleotide; CD160 exon 3; Set C
uaacaccuacccaacccagugggugcaaggauucaaa

SEQ ID NO: 61604 - RNA, 38 nt, Artificial Sequence
  Synthetic Oligonucleotide; CD160 exon 3; Set C
guaacaccuacccaacccagugggugcaaggauucaaa

SEQ ID NO: 61605 - RNA, 39 nt, Artificial Sequence
  Synthetic Oligonucleotide; CD160 exon 3; Set C
uguaacaccuacccaacccagugggugcaaggauucaaa

SEQ ID NO: 61606 - RNA, 40 nt, Artificial Sequence
  Synthetic Oligonucleotide; CD160 exon 3; Set C
uuguaacaccuacccaacccagugggugcaaggauucaaa

SEQ ID NO: 61607 - RNA, 34 nt, Artificial Sequence
  Synthetic Oligonucleotide; CD160 exon 3; Set C
uguaacaccuacccaacccagugggugcaaggau

SEQ ID NO: 61608 - RNA, 35 nt, Artificial Sequence
  Synthetic Oligonucleotide; CD160 exon 3; Set C
uuguaacaccuacccaacccagugggugcaaggau

SEQ ID NO: 61609 - RNA, 23 nt, Artificial Sequence
  Synthetic Oligonucleotide; CD160 exon 3; Set A
uguaacaccuacccaacccagug

SEQ ID NO: 61610 - RNA, 22 nt, Artificial Sequence
  Synthetic Oligonucleotide; CD160 exon 3; Set A
uguaacaccuacccaacccagu

SEQ ID NO: 61611 - RNA, 24 nt, Artificial Sequence
  Synthetic Oligonucleotide; CD160 exon 3; Set A
uuguaacaccuacccaacccagug

SEQ ID NO: 61612 - RNA, 23 nt, Artificial Sequence
  Synthetic Oligonucleotide; CD160 exon 3; Set A
uuguaacaccuacccaacccagu

SEQ ID NO: 61613 - RNA, 22 nt, Artificial Sequence
  Synthetic Oligonucleotide; CD160 exon 3; Set C
uugaaugggcauuguaacaccu

SEQ ID NO: 61614 - RNA, 21 nt, Artificial Sequence
  Synthetic Oligonucleotide; CD160 exon 3; Set C
uugaaugggcauuguaacacc

SEQ ID NO: 61615 - RNA, 23 nt, Artificial Sequence
  Synthetic Oligonucleotide; CD160 exon 3; Set C
uuugaaugggcauuguaacaccu

SEQ ID NO: 61616 - RNA, 22 nt, Artificial Sequence
  Synthetic Oligonucleotide; CD160 exon 3; Set C
uuugaaugggcauuguaacacc

SEQ ID NO: 61617 - RNA, 20 nt, Artificial Sequence
  Synthetic Oligonucleotide; CD160 exon 3; Set C
uugaaugggcauuguaacac

SEQ ID NO: 61618 - RNA, 19 nt, Artificial Sequence
  Synthetic Oligonucleotide; CD160 exon 3; Set C
uugaaugggcauuguaaca

SEQ ID NO: 61619 - RNA, 21 nt, Artificial Sequence
  Synthetic Oligonucleotide; CD160 exon 3; Set C
uuugaaugggcauuguaacac

SEQ ID NO: 61620 - RNA, 18 nt, Artificial Sequence
  Synthetic Oligonucleotide; CD160 exon 3; Set C
uugaaugggcauuguaac

SEQ ID NO: 61621 - RNA, 20 nt, Artificial Sequence
  Synthetic Oligonucleotide; CD160 exon 3; Set C
uuugaaugggcauuguaaca

SEQ ID NO: 61622 - RNA, 17 nt, Artificial Sequence
  Synthetic Oligonucleotide; CD160 exon 3; Set C
uugaaugggcauuguaa

SEQ ID NO: 61623 - RNA, 19 nt, Artificial Sequence
  Synthetic Oligonucleotide; CD160 exon 3; Set C
uuugaaugggcauuguaac

SEQ ID NO: 61624 - RNA, 16 nt, Artificial Sequence
  Synthetic Oligonucleotide; CD160 exon 3; Set C
uugaaugggcauugua

SEQ ID NO: 61625 - RNA, 18 nt, Artificial Sequence
  Synthetic Oligonucleotide; CD160 exon 3; Set C
uuugaaugggcauuguaa

SEQ ID NO: 61626 - RNA, 15 nt, Artificial Sequence
  Synthetic Oligonucleotide; CD160 exon 3; Set C
uugaaugggcauugu

SEQ ID NO: 61627 - RNA, 17 nt, Artificial Sequence
  Synthetic Oligonucleotide; CD160 exon 3; Set C
uuugaaugggcauugua

SEQ ID NO: 61628 - RNA, 16 nt, Artificial Sequence
  Synthetic Oligonucleotide; CD160 exon 3; Set C
uuugaaugggcauugu

SEQ ID NO: 61629 - RNA, 15 nt, Artificial Sequence
  Synthetic Oligonucleotide; CD160 exon 3; Set C
uuugaaugggcauug

SEQ ID NO: 61630 - RNA, 31 nt, Artificial Sequence
  Synthetic Oligonucleotide; CD160 exon 3; Set A
uugccauuuuugaaugggcauuguaacaccu

SEQ ID NO: 61631 - RNA, 30 nt, Artificial Sequence
  Synthetic Oligonucleotide; CD160 exon 3; Set A
uugccauuuuugaaugggcauuguaacacc

SEQ ID NO: 61632 - RNA, 29 nt, Artificial Sequence
  Synthetic Oligonucleotide; CD160 exon 3; Set A
uugccauuuuugaaugggcauuguaacac

SEQ ID NO: 61633 - RNA, 28 nt, Artificial Sequence
  Synthetic Oligonucleotide; CD160 exon 3; Set A
uugccauuuuugaaugggcauuguaaca

SEQ ID NO: 61634 - RNA, 27 nt, Artificial Sequence
  Synthetic Oligonucleotide; CD160 exon 3; Set A
uugccauuuuugaaugggcauuguaac

SEQ ID NO: 61635 - RNA, 26 nt, Artificial Sequence
  Synthetic Oligonucleotide; CD160 exon 3; Set A
uugccauuuuugaaugggcauuguaa

SEQ ID NO: 61636 - RNA, 25 nt, Artificial Sequence
  Synthetic Oligonucleotide; CD160 exon 3; Set A
uugccauuuuugaaugggcauugua

SEQ ID NO: 61637 - RNA, 24 nt, Artificial Sequence
  Synthetic Oligonucleotide; CD160 exon 3; Set A
uugccauuuuugaaugggcauugu

SEQ ID NO: 61638 - RNA, 23 nt, Artificial Sequence
  Synthetic Oligonucleotide; CD160 exon 3; Set C
uugccauuuuugaaugggcauug

SEQ ID NO: 61639 - RNA, 34 nt, Artificial Sequence
  Synthetic Oligonucleotide; CD160 exon 3; Set C
ucucaaaccugguugaacuucugagcuugcuuug

SEQ ID NO: 61640 - RNA, 40 nt, Artificial Sequence
  Synthetic Oligonucleotide; CD160 exon 3; Set C
uuacugucucaaaccugguugaacuucugagcuugcuuug

SEQ ID NO: 61641 - RNA, 28 nt, Artificial Sequence
  Synthetic Oligonucleotide; CD160 exon 3; Set A
ucucaaaccugguugaacuucugagcuu

SEQ ID NO: 61642 - RNA, 34 nt, Artificial Sequence
  Synthetic Oligonucleotide; CD160 exon 3; Set C
uuacugucucaaaccugguugaacuucugagcuu

SEQ ID NO: 61643 - RNA, 35 nt, Artificial Sequence
  Synthetic Oligonucleotide; CD160 exon 3; Set C
auuacugucucaaaccugguugaacuucugagcuu

SEQ ID NO: 61644 - RNA, 36 nt, Artificial Sequence
  Synthetic Oligonucleotide; CD160 exon 3; Set C
uauuacugucucaaaccugguugaacuucugagcuu

SEQ ID NO: 61645 - RNA, 37 nt, Artificial Sequence
  Synthetic Oligonucleotide; CD160 exon 3; Set C
auauuacugucucaaaccugguugaacuucugagcuu

SEQ ID NO: 61646 - RNA, 38 nt, Artificial Sequence
  Synthetic Oligonucleotide; CD160 exon 3; Set A
aauauuacugucucaaaccugguugaacuucugagcuu

SEQ ID NO: 61647 - RNA, 39 nt, Artificial Sequence
  Synthetic Oligonucleotide; CD160 exon 3; Set C
caauauuacugucucaaaccugguugaacuucugagcuu

SEQ ID NO: 61648 - RNA, 40 nt, Artificial Sequence
  Synthetic Oligonucleotide; CD160 exon 3; Set C
ucaauauuacugucucaaaccugguugaacuucugagcuu

SEQ ID NO: 61649 - RNA, 15 nt, Artificial Sequence
  Synthetic Oligonucleotide; CD160 exon 3; Set C
gucucaaaccugguu

SEQ ID NO: 61650 - RNA, 16 nt, Artificial Sequence
  Synthetic Oligonucleotide; CD160 exon 3; Set C
ugucucaaaccugguu

SEQ ID NO: 61651 - RNA, 20 nt, Artificial Sequence
  Synthetic Oligonucleotide; CD160 exon 3; Set C
uuacugucucaaaccugguu

SEQ ID NO: 61652 - RNA, 16 nt, Artificial Sequence
  Synthetic Oligonucleotide; CD160 exon 3; Set C
uuacugucucaaaccu

SEQ ID NO: 61653 - RNA, 20 nt, Artificial Sequence
  Synthetic Oligonucleotide; CD160 exon 3; Set C
aauauuacugucucaaaccu

SEQ ID NO: 61654 - RNA, 21 nt, Artificial Sequence
  Synthetic Oligonucleotide; CD160 exon 3; Set C
caauauuacugucucaaaccu

SEQ ID NO: 61655 - RNA, 22 nt, Artificial Sequence
  Synthetic Oligonucleotide; CD160 exon 3; Set C
ucaauauuacugucucaaaccu

SEQ ID NO: 61656 - RNA, 31 nt, Artificial Sequence
  Synthetic Oligonucleotide; CD160 exon 3; Set C
aaaucucaauauuacugucucaaaccugguu

SEQ ID NO: 61657 - RNA, 15 nt, Artificial Sequence
  Synthetic Oligonucleotide; CD160 exon 3; Set C
auauuacugucucaa

SEQ ID NO: 61658 - RNA, 24 nt, Artificial Sequence
  Synthetic Oligonucleotide; CD160 exon 3; Set C
ucucaauauuacugucucaaaccu

SEQ ID NO: 61659 - RNA, 16 nt, Artificial Sequence
  Synthetic Oligonucleotide; CD160 exon 3; Set C
aauauuacugucucaa

SEQ ID NO: 61660 - RNA, 25 nt, Artificial Sequence
  Synthetic Oligonucleotide; CD160 exon 3; Set C
aucucaauauuacugucucaaaccu

SEQ ID NO: 61661 - RNA, 17 nt, Artificial Sequence
  Synthetic Oligonucleotide; CD160 exon 3; Set C
caauauuacugucucaa

SEQ ID NO: 61662 - RNA, 16 nt, Artificial Sequence
  Synthetic Oligonucleotide; CD160 exon 3; Set C
caauauuacugucuca

SEQ ID NO: 61663 - RNA, 26 nt, Artificial Sequence
  Synthetic Oligonucleotide; CD160 exon 3; Set C
aaucucaauauuacugucucaaaccu

SEQ ID NO: 61664 - RNA, 18 nt, Artificial Sequence
  Synthetic Oligonucleotide; CD160 exon 3; Set C
ucaauauuacugucucaa

SEQ ID NO: 61665 - RNA, 17 nt, Artificial Sequence
  Synthetic Oligonucleotide; CD160 exon 3; Set C
ucaauauuacugucuca

SEQ ID NO: 61666 - RNA, 15 nt, Artificial Sequence
  Synthetic Oligonucleotide; CD160 exon 3; Set C
caauauuacugucuc

SEQ ID NO: 61667 - RNA, 27 nt, Artificial Sequence
  Synthetic Oligonucleotide; CD160 exon 3; Set C
aaaucucaauauuacugucucaaaccu

SEQ ID NO: 61668 - RNA, 19 nt, Artificial Sequence
  Synthetic Oligonucleotide; CD160 exon 3; Set C
cucaauauuacugucucaa

SEQ ID NO: 61669 - RNA, 26 nt, Artificial Sequence
  Synthetic Oligonucleotide; CD160 exon 3; Set C
aaaucucaauauuacugucucaaacc

SEQ ID NO: 61670 - RNA, 16 nt, Artificial Sequence
  Synthetic Oligonucleotide; CD160 exon 3; Set C
ucaauauuacugucuc

SEQ ID NO: 61671 - RNA, 20 nt, Artificial Sequence
  Synthetic Oligonucleotide; CD160 exon 3; Set C
ucucaauauuacugucucaa

SEQ ID NO: 61672 - RNA, 25 nt, Artificial Sequence
  Synthetic Oligonucleotide; CD160 exon 3; Set C
aaaucucaauauuacugucucaaac

SEQ ID NO: 61673 - RNA, 21 nt, Artificial Sequence
  Synthetic Oligonucleotide; CD160 exon 3; Set C
aucucaauauuacugucucaa

SEQ ID NO: 61674 - RNA, 24 nt, Artificial Sequence
  Synthetic Oligonucleotide; CD160 exon 3; Set C
aaaucucaauauuacugucucaaa

SEQ ID NO: 61675 - RNA, 20 nt, Artificial Sequence
  Synthetic Oligonucleotide; CD160 exon 3; Set C
aucucaauauuacugucuca

SEQ ID NO: 61676 - RNA, 22 nt, Artificial Sequence
  Synthetic Oligonucleotide; CD160 exon 3; Set C
aaucucaauauuacugucucaa

SEQ ID NO: 61677 - RNA, 39 nt, Artificial Sequence
  Synthetic Oligonucleotide; CD160 exon 3; Set C
gcaccuggaaaucucaauauuacugucucaaaccugguu

SEQ ID NO: 61678 - RNA, 21 nt, Artificial Sequence
  Synthetic Oligonucleotide; CD160 exon 3; Set C
aaucucaauauuacugucuca

SEQ ID NO: 61679 - RNA, 19 nt, Artificial Sequence
  Synthetic Oligonucleotide; CD160 exon 3; Set C
aucucaauauuacugucuc

SEQ ID NO: 61680 - RNA, 23 nt, Artificial Sequence
  Synthetic Oligonucleotide; CD160 exon 3; Set C
aaaucucaauauuacugucucaa

SEQ ID NO: 61681 - RNA, 15 nt, Artificial Sequence
  Synthetic Oligonucleotide; CD160 exon 3; Set C
cucaauauuacuguc

SEQ ID NO: 61682 - RNA, 40 nt, Artificial Sequence
  Synthetic Oligonucleotide; CD160 exon 3; Set C
agcaccuggaaaucucaauauuacugucucaaaccugguu

SEQ ID NO: 61683 - RNA, 22 nt, Artificial Sequence
  Synthetic Oligonucleotide; CD160 exon 3; Set C
aaaucucaauauuacugucuca

SEQ ID NO: 61684 - RNA, 20 nt, Artificial Sequence
  Synthetic Oligonucleotide; CD160 exon 3; Set C
aaucucaauauuacugucuc

SEQ ID NO: 61685 - RNA, 16 nt, Artificial Sequence
  Synthetic Oligonucleotide; CD160 exon 3; Set C
ucucaauauuacuguc

SEQ ID NO: 61686 - RNA, 21 nt, Artificial Sequence
  Synthetic Oligonucleotide; CD160 exon 3; Set C
aaaucucaauauuacugucuc

SEQ ID NO: 61687 - RNA, 15 nt, Artificial Sequence
  Synthetic Oligonucleotide; CD160 exon 3; Set C
ucucaauauuacugu

SEQ ID NO: 61688 - RNA, 17 nt, Artificial Sequence
  Synthetic Oligonucleotide; CD160 exon 3; Set C
aucucaauauuacuguc

SEQ ID NO: 61689 - RNA, 20 nt, Artificial Sequence
  Synthetic Oligonucleotide; CD160 exon 3; Set C
aaaucucaauauuacugucu

SEQ ID NO: 61690 - RNA, 16 nt, Artificial Sequence
  Synthetic Oligonucleotide; CD160 exon 3; Set C
aucucaauauuacugu

SEQ ID NO: 61691 - RNA, 18 nt, Artificial Sequence
  Synthetic Oligonucleotide; CD160 exon 3; Set C
aaucucaauauuacuguc

SEQ ID NO: 61692 - RNA, 17 nt, Artificial Sequence
  Synthetic Oligonucleotide; CD160 exon 3; Set C
aaucucaauauuacugu

SEQ ID NO: 61693 - RNA, 19 nt, Artificial Sequence
  Synthetic Oligonucleotide; CD160 exon 3; Set C
aaaucucaauauuacuguc

SEQ ID NO: 61694 - RNA, 34 nt, Artificial Sequence
  Synthetic Oligonucleotide; CD160 exon 3; Set B
gcaccuggaaaucucaauauuacugucucaaacc

SEQ ID NO: 61695 - RNA, 36 nt, Artificial Sequence
  Synthetic Oligonucleotide; CD160 exon 3; Set B
agcaccuggaaaucucaauauuacugucucaaaccu

SEQ ID NO: 61696 - RNA, 18 nt, Artificial Sequence
  Synthetic Oligonucleotide; CD160 exon 3; Set C
aaaucucaauauuacugu

SEQ ID NO: 61697 - RNA, 35 nt, Artificial Sequence
  Synthetic Oligonucleotide; CD160 exon 3; Set B
agcaccuggaaaucucaauauuacugucucaaacc

SEQ ID NO: 61698 - RNA, 33 nt, Artificial Sequence
  Synthetic Oligonucleotide; CD160 exon 3; Set B
gcaccuggaaaucucaauauuacugucucaaac

SEQ ID NO: 61699 - RNA, 37 nt, Artificial Sequence
  Synthetic Oligonucleotide; CD160 exon 3; Set C
cagcaccuggaaaucucaauauuacugucucaaaccu

SEQ ID NO: 61700 - RNA, 36 nt, Artificial Sequence
  Synthetic Oligonucleotide; CD160 exon 3; Set B
cagcaccuggaaaucucaauauuacugucucaaacc

SEQ ID NO: 61701 - RNA, 34 nt, Artificial Sequence
  Synthetic Oligonucleotide; CD160 exon 3; Set B
agcaccuggaaaucucaauauuacugucucaaac

SEQ ID NO: 61702 - RNA, 32 nt, Artificial Sequence
  Synthetic Oligonucleotide; CD160 exon 3; Set B
gcaccuggaaaucucaauauuacugucucaaa

SEQ ID NO: 61703 - RNA, 38 nt, Artificial Sequence
  Synthetic Oligonucleotide; CD160 exon 3; Set C
ucagcaccuggaaaucucaauauuacugucucaaaccu

SEQ ID NO: 61704 - RNA, 37 nt, Artificial Sequence
  Synthetic Oligonucleotide; CD160 exon 3; Set B
ucagcaccuggaaaucucaauauuacugucucaaacc

SEQ ID NO: 61705 - RNA, 35 nt, Artificial Sequence
  Synthetic Oligonucleotide; CD160 exon 3; Set B
cagcaccuggaaaucucaauauuacugucucaaac

SEQ ID NO: 61706 - RNA, 33 nt, Artificial Sequence
  Synthetic Oligonucleotide; CD160 exon 3; Set B
agcaccuggaaaucucaauauuacugucucaaa

SEQ ID NO: 61707 - RNA, 39 nt, Artificial Sequence
  Synthetic Oligonucleotide; CD160 exon 3; Set C
gucagcaccuggaaaucucaauauuacugucucaaaccu

SEQ ID NO: 61708 - RNA, 38 nt, Artificial Sequence
  Synthetic Oligonucleotide; CD160 exon 3; Set C
gucagcaccuggaaaucucaauauuacugucucaaacc

SEQ ID NO: 61709 - RNA, 36 nt, Artificial Sequence
  Synthetic Oligonucleotide; CD160 exon 3; Set B
ucagcaccuggaaaucucaauauuacugucucaaac

SEQ ID NO: 61710 - RNA, 34 nt, Artificial Sequence
  Synthetic Oligonucleotide; CD160 exon 3; Set B
cagcaccuggaaaucucaauauuacugucucaaa

SEQ ID NO: 61711 - RNA, 30 nt, Artificial Sequence
  Synthetic Oligonucleotide; CD160 exon 3; Set B
gcaccuggaaaucucaauauuacugucuca

SEQ ID NO: 61712 - RNA, 40 nt, Artificial Sequence
  Synthetic Oligonucleotide; CD160 exon 3; Set C
agucagcaccuggaaaucucaauauuacugucucaaaccu

SEQ ID NO: 61713 - RNA, 39 nt, Artificial Sequence
  Synthetic Oligonucleotide; CD160 exon 3; Set C
agucagcaccuggaaaucucaauauuacugucucaaacc

SEQ ID NO: 61714 - RNA, 37 nt, Artificial Sequence
  Synthetic Oligonucleotide; CD160 exon 3; Set B
gucagcaccuggaaaucucaauauuacugucucaaac

SEQ ID NO: 61715 - RNA, 35 nt, Artificial Sequence
  Synthetic Oligonucleotide; CD160 exon 3; Set B
ucagcaccuggaaaucucaauauuacugucucaaa

SEQ ID NO: 61716 - RNA, 31 nt, Artificial Sequence
  Synthetic Oligonucleotide; CD160 exon 3; Set B
agcaccuggaaaucucaauauuacugucuca

SEQ ID NO: 61717 - RNA, 29 nt, Artificial Sequence
  Synthetic Oligonucleotide; CD160 exon 3; Set B
gcaccuggaaaucucaauauuacugucuc

SEQ ID NO: 61718 - RNA, 33 nt, Artificial Sequence
  Synthetic Oligonucleotide; CD160 exon 3; Set B
cagcaccuggaaaucucaauauuacugucucaa

SEQ ID NO: 61719 - RNA, 40 nt, Artificial Sequence
  Synthetic Oligonucleotide; CD160 exon 3; Set C
aagucagcaccuggaaaucucaauauuacugucucaaacc

SEQ ID NO: 61720 - RNA, 38 nt, Artificial Sequence
  Synthetic Oligonucleotide; CD160 exon 3; Set B
agucagcaccuggaaaucucaauauuacugucucaaac

SEQ ID NO: 61721 - RNA, 28 nt, Artificial Sequence
  Synthetic Oligonucleotide; CD160 exon 3; Set B
gcaccuggaaaucucaauauuacugucu

SEQ ID NO: 61722 - RNA, 36 nt, Artificial Sequence
  Synthetic Oligonucleotide; CD160 exon 3; Set B
gucagcaccuggaaaucucaauauuacugucucaaa

SEQ ID NO: 61723 - RNA, 32 nt, Artificial Sequence
  Synthetic Oligonucleotide; CD160 exon 3; Set B
cagcaccuggaaaucucaauauuacugucuca

SEQ ID NO: 61724 - RNA, 30 nt, Artificial Sequence
  Synthetic Oligonucleotide; CD160 exon 3; Set B
agcaccuggaaaucucaauauuacugucuc

SEQ ID NO: 61725 - RNA, 34 nt, Artificial Sequence
  Synthetic Oligonucleotide; CD160 exon 3; Set B
ucagcaccuggaaaucucaauauuacugucucaa

SEQ ID NO: 61726 - RNA, 39 nt, Artificial Sequence
  Synthetic Oligonucleotide; CD160 exon 3; Set B
aagucagcaccuggaaaucucaauauuacugucucaaac

SEQ ID NO: 61727 - RNA, 29 nt, Artificial Sequence
  Synthetic Oligonucleotide; CD160 exon 3; Set B
agcaccuggaaaucucaauauuacugucu

SEQ ID NO: 61728 - RNA, 37 nt, Artificial Sequence
  Synthetic Oligonucleotide; CD160 exon 3; Set B
agucagcaccuggaaaucucaauauuacugucucaaa

SEQ ID NO: 61729 - RNA, 33 nt, Artificial Sequence
  Synthetic Oligonucleotide; CD160 exon 3; Set B
ucagcaccuggaaaucucaauauuacugucuca

SEQ ID NO: 61730 - RNA, 31 nt, Artificial Sequence
  Synthetic Oligonucleotide; CD160 exon 3; Set B
cagcaccuggaaaucucaauauuacugucuc

SEQ ID NO: 61731 - RNA, 35 nt, Artificial Sequence
  Synthetic Oligonucleotide; CD160 exon 3; Set B
gucagcaccuggaaaucucaauauuacugucucaa

SEQ ID NO: 61732 - RNA, 40 nt, Artificial Sequence
  Synthetic Oligonucleotide; CD160 exon 3; Set B
aaagucagcaccuggaaaucucaauauuacugucucaaac

SEQ ID NO: 61733 - RNA, 30 nt, Artificial Sequence
  Synthetic Oligonucleotide; CD160 exon 3; Set B
cagcaccuggaaaucucaauauuacugucu

SEQ ID NO: 61734 - RNA, 38 nt, Artificial Sequence
  Synthetic Oligonucleotide; CD160 exon 3; Set B
aagucagcaccuggaaaucucaauauuacugucucaaa

SEQ ID NO: 61735 - RNA, 34 nt, Artificial Sequence
  Synthetic Oligonucleotide; CD160 exon 3; Set C
gucagcaccuggaaaucucaauauuacugucuca

SEQ ID NO: 61736 - RNA, 32 nt, Artificial Sequence
  Synthetic Oligonucleotide; CD160 exon 3; Set B
ucagcaccuggaaaucucaauauuacugucuc

SEQ ID NO: 61737 - RNA, 36 nt, Artificial Sequence
  Synthetic Oligonucleotide; CD160 exon 3; Set B
agucagcaccuggaaaucucaauauuacugucucaa

SEQ ID NO: 61738 - RNA, 31 nt, Artificial Sequence
  Synthetic Oligonucleotide; CD160 exon 3; Set B
ucagcaccuggaaaucucaauauuacugucu

SEQ ID NO: 61739 - RNA, 39 nt, Artificial Sequence
  Synthetic Oligonucleotide; CD160 exon 3; Set B
aaagucagcaccuggaaaucucaauauuacugucucaaa

SEQ ID NO: 61740 - RNA, 35 nt, Artificial Sequence
  Synthetic Oligonucleotide; CD160 exon 3; Set C
agucagcaccuggaaaucucaauauuacugucuca

SEQ ID NO: 61741 - RNA, 33 nt, Artificial Sequence
  Synthetic Oligonucleotide; CD160 exon 3; Set B
gucagcaccuggaaaucucaauauuacugucuc

SEQ ID NO: 61742 - RNA, 37 nt, Artificial Sequence
  Synthetic Oligonucleotide; CD160 exon 3; Set B
aagucagcaccuggaaaucucaauauuacugucucaa

SEQ ID NO: 61743 - RNA, 32 nt, Artificial Sequence
  Synthetic Oligonucleotide; CD160 exon 3; Set B
gucagcaccuggaaaucucaauauuacugucu

SEQ ID NO: 61744 - RNA, 36 nt, Artificial Sequence
  Synthetic Oligonucleotide; CD160 exon 3; Set B
aagucagcaccuggaaaucucaauauuacugucuca

SEQ ID NO: 61745 - RNA, 34 nt, Artificial Sequence
  Synthetic Oligonucleotide; CD160 exon 3; Set B
agucagcaccuggaaaucucaauauuacugucuc

SEQ ID NO: 61746 - RNA, 38 nt, Artificial Sequence
  Synthetic Oligonucleotide; CD160 exon 3; Set B
aaagucagcaccuggaaaucucaauauuacugucucaa

SEQ ID NO: 61747 - RNA, 30 nt, Artificial Sequence
  Synthetic Oligonucleotide; CD160 exon 3; Set B
ucagcaccuggaaaucucaauauuacuguc

SEQ ID NO: 61748 - RNA, 33 nt, Artificial Sequence
  Synthetic Oligonucleotide; CD160 exon 3; Set B
agucagcaccuggaaaucucaauauuacugucu

SEQ ID NO: 61749 - RNA, 37 nt, Artificial Sequence
  Synthetic Oligonucleotide; CD160 exon 3; Set B
aaagucagcaccuggaaaucucaauauuacugucuca

SEQ ID NO: 61750 - RNA, 35 nt, Artificial Sequence
  Synthetic Oligonucleotide; CD160 exon 3; Set B
aagucagcaccuggaaaucucaauauuacugucuc

SEQ ID NO: 61751 - RNA, 29 nt, Artificial Sequence
  Synthetic Oligonucleotide; CD160 exon 3; Set B
ucagcaccuggaaaucucaauauuacugu

SEQ ID NO: 61752 - RNA, 31 nt, Artificial Sequence
  Synthetic Oligonucleotide; CD160 exon 3; Set B
gucagcaccuggaaaucucaauauuacuguc

SEQ ID NO: 61753 - RNA, 34 nt, Artificial Sequence
  Synthetic Oligonucleotide; CD160 exon 3; Set B
aagucagcaccuggaaaucucaauauuacugucu

SEQ ID NO: 61754 - RNA, 22 nt, Artificial Sequence
  Synthetic Oligonucleotide; CD160 exon 3; Set C
gcaccuggaaaucucaauauua

SEQ ID NO: 61755 - RNA, 36 nt, Artificial Sequence
  Synthetic Oligonucleotide; CD160 exon 3; Set B
aaagucagcaccuggaaaucucaauauuacugucuc

SEQ ID NO: 61756 - RNA, 30 nt, Artificial Sequence
  Synthetic Oligonucleotide; CD160 exon 3; Set B
gucagcaccuggaaaucucaauauuacugu

SEQ ID NO: 61757 - RNA, 32 nt, Artificial Sequence
  Synthetic Oligonucleotide; CD160 exon 3; Set B
agucagcaccuggaaaucucaauauuacuguc

SEQ ID NO: 61758 - RNA, 21 nt, Artificial Sequence
  Synthetic Oligonucleotide; CD160 exon 3; Set C
gcaccuggaaaucucaauauu

SEQ ID NO: 61759 - RNA, 35 nt, Artificial Sequence
  Synthetic Oligonucleotide; CD160 exon 3; Set B
aaagucagcaccuggaaaucucaauauuacugucu

SEQ ID NO: 61760 - RNA, 23 nt, Artificial Sequence
  Synthetic Oligonucleotide; CD160 exon 3; Set C
agcaccuggaaaucucaauauua

SEQ ID NO: 61761 - RNA, 31 nt, Artificial Sequence
  Synthetic Oligonucleotide; CD160 exon 3; Set B
agucagcaccuggaaaucucaauauuacugu

SEQ ID NO: 61762 - RNA, 22 nt, Artificial Sequence
  Synthetic Oligonucleotide; CD160 exon 3; Set C
agcaccuggaaaucucaauauu

SEQ ID NO: 61763 - RNA, 20 nt, Artificial Sequence
  Synthetic Oligonucleotide; CD160 exon 3; Set C
gcaccuggaaaucucaauau

SEQ ID NO: 61764 - RNA, 24 nt, Artificial Sequence
  Synthetic Oligonucleotide; CD160 exon 3; Set C
cagcaccuggaaaucucaauauua

SEQ ID NO: 61765 - RNA, 23 nt, Artificial Sequence
  Synthetic Oligonucleotide; CD160 exon 3; Set C
cagcaccuggaaaucucaauauu

SEQ ID NO: 61766 - RNA, 21 nt, Artificial Sequence
  Synthetic Oligonucleotide; CD160 exon 3; Set C
agcaccuggaaaucucaauau

SEQ ID NO: 61767 - RNA, 19 nt, Artificial Sequence
  Synthetic Oligonucleotide; CD160 exon 3; Set C
gcaccuggaaaucucaaua

SEQ ID NO: 61768 - RNA, 25 nt, Artificial Sequence
  Synthetic Oligonucleotide; CD160 exon 3; Set C
ucagcaccuggaaaucucaauauua

SEQ ID NO: 61769 - RNA, 24 nt, Artificial Sequence
  Synthetic Oligonucleotide; CD160 exon 3; Set C
ucagcaccuggaaaucucaauauu

SEQ ID NO: 61770 - RNA, 22 nt, Artificial Sequence
  Synthetic Oligonucleotide; CD160 exon 3; Set C
cagcaccuggaaaucucaauau

SEQ ID NO: 61771 - RNA, 20 nt, Artificial Sequence
  Synthetic Oligonucleotide; CD160 exon 3; Set C
agcaccuggaaaucucaaua

SEQ ID NO: 61772 - RNA, 18 nt, Artificial Sequence
  Synthetic Oligonucleotide; CD160 exon 3; Set C
gcaccuggaaaucucaau

SEQ ID NO: 61773 - RNA, 26 nt, Artificial Sequence
  Synthetic Oligonucleotide; CD160 exon 3; Set B
gucagcaccuggaaaucucaauauua

SEQ ID NO: 61774 - RNA, 23 nt, Artificial Sequence
  Synthetic Oligonucleotide; CD160 exon 3; Set C
ucagcaccuggaaaucucaauau

SEQ ID NO: 61775 - RNA, 21 nt, Artificial Sequence
  Synthetic Oligonucleotide; CD160 exon 3; Set C
cagcaccuggaaaucucaaua

SEQ ID NO: 61776 - RNA, 19 nt, Artificial Sequence
  Synthetic Oligonucleotide; CD160 exon 3; Set C
agcaccuggaaaucucaau

SEQ ID NO: 61777 - RNA, 27 nt, Artificial Sequence
  Synthetic Oligonucleotide; CD160 exon 3; Set B
agucagcaccuggaaaucucaauauua

SEQ ID NO: 61778 - RNA, 17 nt, Artificial Sequence
  Synthetic Oligonucleotide; CD160 exon 3; Set C
gcaccuggaaaucucaa

SEQ ID NO: 61779 - RNA, 26 nt, Artificial Sequence
  Synthetic Oligonucleotide; CD160 exon 3; Set C
agucagcaccuggaaaucucaauauu

SEQ ID NO: 61780 - RNA, 24 nt, Artificial Sequence
  Synthetic Oligonucleotide; CD160 exon 3; Set C
gucagcaccuggaaaucucaauau

SEQ ID NO: 61781 - RNA, 22 nt, Artificial Sequence
  Synthetic Oligonucleotide; CD160 exon 3; Set C
ucagcaccuggaaaucucaaua

SEQ ID NO: 61782 - RNA, 20 nt, Artificial Sequence
  Synthetic Oligonucleotide; CD160 exon 3; Set C
cagcaccuggaaaucucaau

SEQ ID NO: 61783 - RNA, 28 nt, Artificial Sequence
  Synthetic Oligonucleotide; CD160 exon 3; Set C
aagucagcaccuggaaaucucaauauua

SEQ ID NO: 61784 - RNA, 18 nt, Artificial Sequence
  Synthetic Oligonucleotide; CD160 exon 3; Set C
agcaccuggaaaucucaa

SEQ ID NO: 61785 - RNA, 16 nt, Artificial Sequence
  Synthetic Oligonucleotide; CD160 exon 3; Set C
gcaccuggaaaucuca

SEQ ID NO: 61786 - RNA, 27 nt, Artificial Sequence
  Synthetic Oligonucleotide; CD160 exon 3; Set C
aagucagcaccuggaaaucucaauauu

SEQ ID NO: 61787 - RNA, 25 nt, Artificial Sequence
  Synthetic Oligonucleotide; CD160 exon 3; Set C
agucagcaccuggaaaucucaauau

SEQ ID NO: 61788 - RNA, 15 nt, Artificial Sequence
  Synthetic Oligonucleotide; CD160 exon 3; Set C
gcaccuggaaaucuc

SEQ ID NO: 61789 - RNA, 23 nt, Artificial Sequence
  Synthetic Oligonucleotide; CD160 exon 3; Set C
gucagcaccuggaaaucucaaua

SEQ ID NO: 61790 - RNA, 21 nt, Artificial Sequence
  Synthetic Oligonucleotide; CD160 exon 3; Set C
ucagcaccuggaaaucucaau

SEQ ID NO: 61791 - RNA, 29 nt, Artificial Sequence
  Synthetic Oligonucleotide; CD160 exon 3; Set C
aaagucagcaccuggaaaucucaauauua

SEQ ID NO: 61792 - RNA, 19 nt, Artificial Sequence
  Synthetic Oligonucleotide; CD160 exon 3; Set C
cagcaccuggaaaucucaa

SEQ ID NO: 61793 - RNA, 17 nt, Artificial Sequence
  Synthetic Oligonucleotide; CD160 exon 3; Set C
agcaccuggaaaucuca

SEQ ID NO: 61794 - RNA, 28 nt, Artificial Sequence
  Synthetic Oligonucleotide; CD160 exon 3; Set C
aaagucagcaccuggaaaucucaauauu

SEQ ID NO: 61795 - RNA, 26 nt, Artificial Sequence
  Synthetic Oligonucleotide; CD160 exon 3; Set C
aagucagcaccuggaaaucucaauau

SEQ ID NO: 61796 - RNA, 16 nt, Artificial Sequence
  Synthetic Oligonucleotide; CD160 exon 3; Set C
agcaccuggaaaucuc

SEQ ID NO: 61797 - RNA, 24 nt, Artificial Sequence
  Synthetic Oligonucleotide; CD160 exon 3; Set C
agucagcaccuggaaaucucaaua

SEQ ID NO: 61798 - RNA, 22 nt, Artificial Sequence
  Synthetic Oligonucleotide; CD160 exon 3; Set C
gucagcaccuggaaaucucaau

SEQ ID NO: 61799 - RNA, 20 nt, Artificial Sequence
  Synthetic Oligonucleotide; CD160 exon 3; Set C
ucagcaccuggaaaucucaa

SEQ ID NO: 61800 - RNA, 18 nt, Artificial Sequence
  Synthetic Oligonucleotide; CD160 exon 3; Set C
cagcaccuggaaaucuca

SEQ ID NO: 61801 - RNA, 27 nt, Artificial Sequence
  Synthetic Oligonucleotide; CD160 exon 3; Set C
aaagucagcaccuggaaaucucaauau

SEQ ID NO: 61802 - RNA, 17 nt, Artificial Sequence
  Synthetic Oligonucleotide; CD160 exon 3; Set C
cagcaccuggaaaucuc

SEQ ID NO: 61803 - RNA, 25 nt, Artificial Sequence
  Synthetic Oligonucleotide; CD160 exon 3; Set C
aagucagcaccuggaaaucucaaua

SEQ ID NO: 61804 - RNA, 23 nt, Artificial Sequence
  Synthetic Oligonucleotide; CD160 exon 3; Set C
agucagcaccuggaaaucucaau

SEQ ID NO: 61805 - RNA, 15 nt, Artificial Sequence
  Synthetic Oligonucleotide; CD160 exon 3; Set C
agcaccuggaaaucu

SEQ ID NO: 61806 - RNA, 21 nt, Artificial Sequence
  Synthetic Oligonucleotide; CD160 exon 3; Set C
gucagcaccuggaaaucucaa

SEQ ID NO: 61807 - RNA, 19 nt, Artificial Sequence
  Synthetic Oligonucleotide; CD160 exon 3; Set C
ucagcaccuggaaaucuca

SEQ ID NO: 61808 - RNA, 18 nt, Artificial Sequence
  Synthetic Oligonucleotide; CD160 exon 3; Set C
ucagcaccuggaaaucuc

SEQ ID NO: 61809 - RNA, 26 nt, Artificial Sequence
  Synthetic Oligonucleotide; CD160 exon 3; Set C
aaagucagcaccuggaaaucucaaua

SEQ ID NO: 61810 - RNA, 24 nt, Artificial Sequence
  Synthetic Oligonucleotide; CD160 exon 3; Set C
aagucagcaccuggaaaucucaau

SEQ ID NO: 61811 - RNA, 16 nt, Artificial Sequence
  Synthetic Oligonucleotide; CD160 exon 3; Set C
cagcaccuggaaaucu

SEQ ID NO: 61812 - RNA, 20 nt, Artificial Sequence
  Synthetic Oligonucleotide; CD160 exon 3; Set C
gucagcaccuggaaaucuca

SEQ ID NO: 61813 - RNA, 22 nt, Artificial Sequence
  Synthetic Oligonucleotide; CD160 exon 3; Set C
agucagcaccuggaaaucucaa

SEQ ID NO: 61814 - RNA, 19 nt, Artificial Sequence
  Synthetic Oligonucleotide; CD160 exon 3; Set C
gucagcaccuggaaaucuc

SEQ ID NO: 61815 - RNA, 25 nt, Artificial Sequence
  Synthetic Oligonucleotide; CD160 exon 3; Set C
aaagucagcaccuggaaaucucaau

SEQ ID NO: 61816 - RNA, 17 nt, Artificial Sequence
  Synthetic Oligonucleotide; CD160 exon 3; Set C
ucagcaccuggaaaucu

SEQ ID NO: 61817 - RNA, 21 nt, Artificial Sequence
  Synthetic Oligonucleotide; CD160 exon 3; Set C
agucagcaccuggaaaucuca

SEQ ID NO: 61818 - RNA, 23 nt, Artificial Sequence
  Synthetic Oligonucleotide; CD160 exon 3; Set C
aagucagcaccuggaaaucucaa

SEQ ID NO: 61819 - RNA, 15 nt, Artificial Sequence
  Synthetic Oligonucleotide; CD160 exon 3; Set C
cagcaccuggaaauc

SEQ ID NO: 61820 - RNA, 20 nt, Artificial Sequence
  Synthetic Oligonucleotide; CD160 exon 3; Set C
agucagcaccuggaaaucuc

SEQ ID NO: 61821 - RNA, 18 nt, Artificial Sequence
  Synthetic Oligonucleotide; CD160 exon 3; Set C
gucagcaccuggaaaucu

SEQ ID NO: 61822 - RNA, 24 nt, Artificial Sequence
  Synthetic Oligonucleotide; CD160 exon 3; Set C
aaagucagcaccuggaaaucucaa

SEQ ID NO: 61823 - RNA, 22 nt, Artificial Sequence
  Synthetic Oligonucleotide; CD160 exon 3; Set C
aagucagcaccuggaaaucuca

SEQ ID NO: 61824 - RNA, 16 nt, Artificial Sequence
  Synthetic Oligonucleotide; CD160 exon 3; Set C
ucagcaccuggaaauc

SEQ ID NO: 61825 - RNA, 21 nt, Artificial Sequence
  Synthetic Oligonucleotide; CD160 exon 3; Set C
aagucagcaccuggaaaucuc

SEQ ID NO: 61826 - RNA, 19 nt, Artificial Sequence
  Synthetic Oligonucleotide; CD160 exon 3; Set C
agucagcaccuggaaaucu

SEQ ID NO: 61827 - RNA, 23 nt, Artificial Sequence
  Synthetic Oligonucleotide; CD160 exon 3; Set C
aaagucagcaccuggaaaucuca

SEQ ID NO: 61828 - RNA, 17 nt, Artificial Sequence
  Synthetic Oligonucleotide; CD160 exon 3; Set C
gucagcaccuggaaauc

SEQ ID NO: 61829 - RNA, 15 nt, Artificial Sequence
  Synthetic Oligonucleotide; CD160 exon 3; Set C
ucagcaccuggaaau

SEQ ID NO: 61830 - RNA, 22 nt, Artificial Sequence
  Synthetic Oligonucleotide; CD160 exon 3; Set C
aaagucagcaccuggaaaucuc

SEQ ID NO: 61831 - RNA, 20 nt, Artificial Sequence
  Synthetic Oligonucleotide; CD160 exon 3; Set C
aagucagcaccuggaaaucu

SEQ ID NO: 61832 - RNA, 36 nt, Artificial Sequence
  Synthetic Oligonucleotide; CD160 exon 3; Set C
ggcggggaaagucagcaccuggaaaucucaauauua

SEQ ID NO: 61833 - RNA, 18 nt, Artificial Sequence
  Synthetic Oligonucleotide; CD160 exon 3; Set C
agucagcaccuggaaauc

SEQ ID NO: 61834 - RNA, 16 nt, Artificial Sequence
  Synthetic Oligonucleotide; CD160 exon 3; Set C
gucagcaccuggaaau

SEQ ID NO: 61835 - RNA, 35 nt, Artificial Sequence
  Synthetic Oligonucleotide; CD160 exon 3; Set C
ggcggggaaagucagcaccuggaaaucucaauauu

SEQ ID NO: 61836 - RNA, 21 nt, Artificial Sequence
  Synthetic Oligonucleotide; CD160 exon 3; Set C
aaagucagcaccuggaaaucu

SEQ ID NO: 61837 - RNA, 37 nt, Artificial Sequence
  Synthetic Oligonucleotide; CD160 exon 3; Set C
uggcggggaaagucagcaccuggaaaucucaauauua

SEQ ID NO: 61838 - RNA, 19 nt, Artificial Sequence
  Synthetic Oligonucleotide; CD160 exon 3; Set C
aagucagcaccuggaaauc

SEQ ID NO: 61839 - RNA, 17 nt, Artificial Sequence
  Synthetic Oligonucleotide; CD160 exon 3; Set C
agucagcaccuggaaau

SEQ ID NO: 61840 - RNA, 15 nt, Artificial Sequence
  Synthetic Oligonucleotide; CD160 exon 3; Set C
gucagcaccuggaaa

SEQ ID NO: 61841 - RNA, 36 nt, Artificial Sequence
  Synthetic Oligonucleotide; CD160 exon 3; Set C
uggcggggaaagucagcaccuggaaaucucaauauu

SEQ ID NO: 61842 - RNA, 34 nt, Artificial Sequence
  Synthetic Oligonucleotide; CD160 exon 3; Set C
ggcggggaaagucagcaccuggaaaucucaauau

SEQ ID NO: 61843 - RNA, 20 nt, Artificial Sequence
  Synthetic Oligonucleotide; CD160 exon 3; Set C
aaagucagcaccuggaaauc

SEQ ID NO: 61844 - RNA, 18 nt, Artificial Sequence
  Synthetic Oligonucleotide; CD160 exon 3; Set C
aagucagcaccuggaaau

SEQ ID NO: 61845 - RNA, 16 nt, Artificial Sequence
  Synthetic Oligonucleotide; CD160 exon 3; Set C
agucagcaccuggaaa

SEQ ID NO: 61846 - RNA, 37 nt, Artificial Sequence
  Synthetic Oligonucleotide; CD160 exon 3; Set C
cuggcggggaaagucagcaccuggaaaucucaauauu

SEQ ID NO: 61847 - RNA, 35 nt, Artificial Sequence
  Synthetic Oligonucleotide; CD160 exon 3; Set C
uggcggggaaagucagcaccuggaaaucucaauau

SEQ ID NO: 61848 - RNA, 33 nt, Artificial Sequence
  Synthetic Oligonucleotide; CD160 exon 3; Set C
ggcggggaaagucagcaccuggaaaucucaaua

SEQ ID NO: 61849 - RNA, 19 nt, Artificial Sequence
  Synthetic Oligonucleotide; CD160 exon 3; Set C
aaagucagcaccuggaaau

SEQ ID NO: 61850 - RNA, 36 nt, Artificial Sequence
  Synthetic Oligonucleotide; CD160 exon 3; Set C
cuggcggggaaagucagcaccuggaaaucucaauau

SEQ ID NO: 61851 - RNA, 34 nt, Artificial Sequence
  Synthetic Oligonucleotide; CD160 exon 3; Set C
uggcggggaaagucagcaccuggaaaucucaaua

SEQ ID NO: 61852 - RNA, 32 nt, Artificial Sequence
  Synthetic Oligonucleotide; CD160 exon 3; Set C
ggcggggaaagucagcaccuggaaaucucaau

SEQ ID NO: 61853 - RNA, 35 nt, Artificial Sequence
  Synthetic Oligonucleotide; CD160 exon 3; Set C
cuggcggggaaagucagcaccuggaaaucucaaua

SEQ ID NO: 61854 - RNA, 33 nt, Artificial Sequence
  Synthetic Oligonucleotide; CD160 exon 3; Set C
uggcggggaaagucagcaccuggaaaucucaau

SEQ ID NO: 61855 - RNA, 31 nt, Artificial Sequence
  Synthetic Oligonucleotide; CD160 exon 3; Set C
ggcggggaaagucagcaccuggaaaucucaa

SEQ ID NO: 61856 - RNA, 34 nt, Artificial Sequence
  Synthetic Oligonucleotide; CD160 exon 3; Set C
cuggcggggaaagucagcaccuggaaaucucaau

SEQ ID NO: 61857 - RNA, 32 nt, Artificial Sequence
  Synthetic Oligonucleotide; CD160 exon 3; Set C
uggcggggaaagucagcaccuggaaaucucaa

SEQ ID NO: 61858 - RNA, 30 nt, Artificial Sequence
  Synthetic Oligonucleotide; CD160 exon 3; Set C
ggcggggaaagucagcaccuggaaaucuca

SEQ ID NO: 61859 - RNA, 29 nt, Artificial Sequence
  Synthetic Oligonucleotide; CD160 exon 3; Set C
ggcggggaaagucagcaccuggaaaucuc

SEQ ID NO: 61860 - RNA, 31 nt, Artificial Sequence
  Synthetic Oligonucleotide; CD160 exon 3; Set C
uggcggggaaagucagcaccuggaaaucuca

SEQ ID NO: 61861 - RNA, 30 nt, Artificial Sequence
  Synthetic Oligonucleotide; CD160 exon 3; Set C
uggcggggaaagucagcaccuggaaaucuc

SEQ ID NO: 61862 - RNA, 28 nt, Artificial Sequence
  Synthetic Oligonucleotide; CD160 exon 3; Set C
ggcggggaaagucagcaccuggaaaucu

SEQ ID NO: 61863 - RNA, 31 nt, Artificial Sequence
  Synthetic Oligonucleotide; CD160 exon 3; Set C
cuggcggggaaagucagcaccuggaaaucuc

SEQ ID NO: 61864 - RNA, 29 nt, Artificial Sequence
  Synthetic Oligonucleotide; CD160 exon 3; Set C
uggcggggaaagucagcaccuggaaaucu

SEQ ID NO: 61865 - RNA, 27 nt, Artificial Sequence
  Synthetic Oligonucleotide; CD160 exon 3; Set C
ggcggggaaagucagcaccuggaaauc

SEQ ID NO: 61866 - RNA, 28 nt, Artificial Sequence
  Synthetic Oligonucleotide; CD160 exon 3; Set C
uggcggggaaagucagcaccuggaaauc

SEQ ID NO: 61867 - RNA, 26 nt, Artificial Sequence
  Synthetic Oligonucleotide; CD160 exon 3; Set C
ggcggggaaagucagcaccuggaaau

SEQ ID NO: 61868 - RNA, 27 nt, Artificial Sequence
  Synthetic Oligonucleotide; CD160 exon 3; Set C
uggcggggaaagucagcaccuggaaau

SEQ ID NO: 61869 - RNA, 40 nt, Artificial Sequence
  Synthetic Oligonucleotide; CD160 exon 3; Set C
ucagugacuggcggggaaagucagcaccuggaaaucucaa

SEQ ID NO: 61870 - RNA, 39 nt, Artificial Sequence
  Synthetic Oligonucleotide; CD160 exon 3; Set C
ucagugacuggcggggaaagucagcaccuggaaaucuca

SEQ ID NO: 61871 - RNA, 38 nt, Artificial Sequence
  Synthetic Oligonucleotide; CD160 exon 3; Set C
ucagugacuggcggggaaagucagcaccuggaaaucuc

SEQ ID NO: 61872 - RNA, 40 nt, Artificial Sequence
  Synthetic Oligonucleotide; CD160 exon 3; Set C
uucagugacuggcggggaaagucagcaccuggaaaucuca

SEQ ID NO: 61873 - RNA, 39 nt, Artificial Sequence
  Synthetic Oligonucleotide; CD160 exon 3; Set C
uucagugacuggcggggaaagucagcaccuggaaaucuc

SEQ ID NO: 61874 - RNA, 37 nt, Artificial Sequence
  Synthetic Oligonucleotide; CD160 exon 3; Set C
ucagugacuggcggggaaagucagcaccuggaaaucu

SEQ ID NO: 61875 - RNA, 38 nt, Artificial Sequence
  Synthetic Oligonucleotide; CD160 exon 3; Set C
uucagugacuggcggggaaagucagcaccuggaaaucu

SEQ ID NO: 61876 - RNA, 36 nt, Artificial Sequence
  Synthetic Oligonucleotide; CD160 exon 3; Set C
ucagugacuggcggggaaagucagcaccuggaaauc

SEQ ID NO: 61877 - RNA, 37 nt, Artificial Sequence
  Synthetic Oligonucleotide; CD160 exon 3; Set C
uucagugacuggcggggaaagucagcaccuggaaauc

SEQ ID NO: 61878 - RNA, 35 nt, Artificial Sequence
  Synthetic Oligonucleotide; CD160 exon 3; Set C
ucagugacuggcggggaaagucagcaccuggaaau

SEQ ID NO: 61879 - RNA, 36 nt, Artificial Sequence
  Synthetic Oligonucleotide; CD160 exon 3; Set C
uucagugacuggcggggaaagucagcaccuggaaau

SEQ ID NO: 61880 - RNA, 40 nt, Artificial Sequence
  Synthetic Oligonucleotide; CD160 exon 3; Set C
uagagggagccagugucuuccccagagauccacacaguuc

SEQ ID NO: 61881 - RNA, 19 nt, Artificial Sequence
  Synthetic Oligonucleotide; CD160 exon 3; Set A
agagggagccagugucuuc

SEQ ID NO: 61882 - RNA, 20 nt, Artificial Sequence
  Synthetic Oligonucleotide; CD160 exon 3; Set A
uagagggagccagugucuuc

SEQ ID NO: 61883 - RNA, 21 nt, Artificial Sequence
  Synthetic Oligonucleotide; CD160 exon 3; Set A
uuagagggagccagugucuuc

SEQ ID NO: 61884 - RNA, 22 nt, Artificial Sequence
  Synthetic Oligonucleotide; CD160 exon 3; Set A
auuagagggagccagugucuuc

SEQ ID NO: 61885 - RNA, 23 nt, Artificial Sequence
  Synthetic Oligonucleotide; CD160 exon 3; Set A
cauuagagggagccagugucuuc

SEQ ID NO: 61886 - RNA, 16 nt, Artificial Sequence
  Synthetic Oligonucleotide; CD160 exon 3; Set C
uagagggagccagugu

SEQ ID NO: 61887 - RNA, 15 nt, Artificial Sequence
  Synthetic Oligonucleotide; CD160 exon 3; Set C
uagagggagccagug

SEQ ID NO: 61888 - RNA, 17 nt, Artificial Sequence
  Synthetic Oligonucleotide; CD160 exon 3; Set C
uuagagggagccagugu

SEQ ID NO: 61889 - RNA, 16 nt, Artificial Sequence
  Synthetic Oligonucleotide; CD160 exon 3; Set C
uuagagggagccagug

SEQ ID NO: 61890 - RNA, 18 nt, Artificial Sequence
  Synthetic Oligonucleotide; CD160 exon 3; Set C
auuagagggagccagugu

SEQ ID NO: 61891 - RNA, 17 nt, Artificial Sequence
  Synthetic Oligonucleotide; CD160 exon 3; Set C
auuagagggagccagug

SEQ ID NO: 61892 - RNA, 15 nt, Artificial Sequence
  Synthetic Oligonucleotide; CD160 exon 3; Set C
uuagagggagccagu

SEQ ID NO: 61893 - RNA, 19 nt, Artificial Sequence
  Synthetic Oligonucleotide; CD160 exon 3; Set C
cauuagagggagccagugu

SEQ ID NO: 61894 - RNA, 16 nt, Artificial Sequence
  Synthetic Oligonucleotide; CD160 exon 3; Set C
auuagagggagccagu

SEQ ID NO: 61895 - RNA, 18 nt, Artificial Sequence
  Synthetic Oligonucleotide; CD160 exon 3; Set C
cauuagagggagccagug

SEQ ID NO: 61896 - RNA, 17 nt, Artificial Sequence
  Synthetic Oligonucleotide; CD160 exon 3; Set C
cauuagagggagccagu

SEQ ID NO: 61897 - RNA, 15 nt, Artificial Sequence
  Synthetic Oligonucleotide; CD160 exon 3; Set C
auuagagggagccag

SEQ ID NO: 61898 - RNA, 16 nt, Artificial Sequence
  Synthetic Oligonucleotide; CD160 exon 3; Set C
cauuagagggagccag

SEQ ID NO: 61899 - RNA, 15 nt, Artificial Sequence
  Synthetic Oligonucleotide; CD160 exon 3; Set C
cauuagagggagcca

SEQ ID NO: 61900 - RNA, 32 nt, Artificial Sequence
  Synthetic Oligonucleotide; CD160 exon 3; Set C
uaccuaggacauuagagggagccagugucuuc

SEQ ID NO: 61901 - RNA, 15 nt, Artificial Sequence
  Synthetic Oligonucleotide; CD160 exon 3; Set C
acauuagagggagcc

SEQ ID NO: 61902 - RNA, 33 nt, Artificial Sequence
  Synthetic Oligonucleotide; CD160 exon 3; Set C
guaccuaggacauuagagggagccagugucuuc

SEQ ID NO: 61903 - RNA, 34 nt, Artificial Sequence
  Synthetic Oligonucleotide; CD160 exon 3; Set C
aguaccuaggacauuagagggagccagugucuuc

SEQ ID NO: 61904 - RNA, 27 nt, Artificial Sequence
  Synthetic Oligonucleotide; CD160 exon 3; Set C
uaccuaggacauuagagggagccagug

SEQ ID NO: 61905 - RNA, 26 nt, Artificial Sequence
  Synthetic Oligonucleotide; CD160 exon 3; Set C
uaccuaggacauuagagggagccagu

SEQ ID NO: 61906 - RNA, 24 nt, Artificial Sequence
  Synthetic Oligonucleotide; CD160 exon 3; Set A
uaccuaggacauuagagggagcca

SEQ ID NO: 61907 - RNA, 23 nt, Artificial Sequence
  Synthetic Oligonucleotide; CD160 exon 3; Set A
uaccuaggacauuagagggagcc

SEQ ID NO: 61908 - RNA, 25 nt, Artificial Sequence
  Synthetic Oligonucleotide; CD160 exon 3; Set C
guaccuaggacauuagagggagcca

SEQ ID NO: 61909 - RNA, 24 nt, Artificial Sequence
  Synthetic Oligonucleotide; CD160 exon 3; Set A
guaccuaggacauuagagggagcc

SEQ ID NO: 61910 - RNA, 22 nt, Artificial Sequence
  Synthetic Oligonucleotide; CD160 exon 3; Set A
uaccuaggacauuagagggagc

SEQ ID NO: 61911 - RNA, 26 nt, Artificial Sequence
  Synthetic Oligonucleotide; CD160 exon 3; Set C
aguaccuaggacauuagagggagcca

SEQ ID NO: 61912 - RNA, 25 nt, Artificial Sequence
  Synthetic Oligonucleotide; CD160 exon 3; Set A
aguaccuaggacauuagagggagcc

SEQ ID NO: 61913 - RNA, 23 nt, Artificial Sequence
  Synthetic Oligonucleotide; CD160 exon 3; Set A
guaccuaggacauuagagggagc

SEQ ID NO: 61914 - RNA, 24 nt, Artificial Sequence
  Synthetic Oligonucleotide; CD160 exon 3; Set A
aguaccuaggacauuagagggagc

SEQ ID NO: 61915 - RNA, 16 nt, Artificial Sequence
  Synthetic Oligonucleotide; CD160 exon 3; Set C
uaccuaggacauuaga

SEQ ID NO: 61916 - RNA, 15 nt, Artificial Sequence
  Synthetic Oligonucleotide; CD160 exon 3; Set C
uaccuaggacauuag

SEQ ID NO: 61917 - RNA, 17 nt, Artificial Sequence
  Synthetic Oligonucleotide; CD160 exon 3; Set C
guaccuaggacauuaga

SEQ ID NO: 61918 - RNA, 16 nt, Artificial Sequence
  Synthetic Oligonucleotide; CD160 exon 3; Set C
guaccuaggacauuag

SEQ ID NO: 61919 - RNA, 18 nt, Artificial Sequence
  Synthetic Oligonucleotide; CD160 exon 3; Set C
aguaccuaggacauuaga

SEQ ID NO: 61920 - RNA, 15 nt, Artificial Sequence
  Synthetic Oligonucleotide; CD160 exon 3; Set C
guaccuaggacauua

SEQ ID NO: 61921 - RNA, 17 nt, Artificial Sequence
  Synthetic Oligonucleotide; CD160 exon 3; Set C
aguaccuaggacauuag

SEQ ID NO: 61922 - RNA, 23 nt, Artificial Sequence
  Synthetic Oligonucleotide; CD160 exon 3; Set A
uccacaguaccuaggacauuaga

SEQ ID NO: 61923 - RNA, 22 nt, Artificial Sequence
  Synthetic Oligonucleotide; CD160 exon 3; Set A
uccacaguaccuaggacauuag

SEQ ID NO: 61924 - RNA, 40 nt, Artificial Sequence
  Synthetic Oligonucleotide; CD160 exon 3; Set C
uaaaaguccuccacaguaccuaggacauuagagggagcca

SEQ ID NO: 61925 - RNA, 21 nt, Artificial Sequence
  Synthetic Oligonucleotide; CD160 exon 3; Set A
uccacaguaccuaggacauua

SEQ ID NO: 61926 - RNA, 39 nt, Artificial Sequence
  Synthetic Oligonucleotide; CD160 exon 3; Set C
uaaaaguccuccacaguaccuaggacauuagagggagcc

SEQ ID NO: 61927 - RNA, 20 nt, Artificial Sequence
  Synthetic Oligonucleotide; CD160 exon 3; Set C
uccacaguaccuaggacauu

SEQ ID NO: 61928 - RNA, 38 nt, Artificial Sequence
  Synthetic Oligonucleotide; CD160 exon 3; Set C
uaaaaguccuccacaguaccuaggacauuagagggagc

SEQ ID NO: 61929 - RNA, 19 nt, Artificial Sequence
  Synthetic Oligonucleotide; CD160 exon 3; Set C
uccacaguaccuaggacau

SEQ ID NO: 61930 - RNA, 32 nt, Artificial Sequence
  Synthetic Oligonucleotide; CD160 exon 3; Set A
uaaaaguccuccacaguaccuaggacauuaga

SEQ ID NO: 61931 - RNA, 31 nt, Artificial Sequence
  Synthetic Oligonucleotide; CD160 exon 3; Set A
uaaaaguccuccacaguaccuaggacauuag

SEQ ID NO: 61932 - RNA, 30 nt, Artificial Sequence
  Synthetic Oligonucleotide; CD160 exon 3; Set A
uaaaaguccuccacaguaccuaggacauua

SEQ ID NO: 61933 - RNA, 29 nt, Artificial Sequence
  Synthetic Oligonucleotide; CD160 exon 3; Set A
uaaaaguccuccacaguaccuaggacauu

SEQ ID NO: 61934 - RNA, 28 nt, Artificial Sequence
  Synthetic Oligonucleotide; CD160 exon 3; Set A
uaaaaguccuccacaguaccuaggacau

SEQ ID NO: 61935 - RNA, 36 nt, Artificial Sequence
  Synthetic Oligonucleotide; CD160 exon 3; Set C
cugcucauaaaaguccuccacaguaccuaggacauu

SEQ ID NO: 61936 - RNA, 37 nt, Artificial Sequence
  Synthetic Oligonucleotide; CD160 exon 3; Set C
acugcucauaaaaguccuccacaguaccuaggacauu

SEQ ID NO: 61937 - RNA, 38 nt, Artificial Sequence
  Synthetic Oligonucleotide; CD160 exon 3; Set C
uacugcucauaaaaguccuccacaguaccuaggacauu

SEQ ID NO: 61938 - RNA, 40 nt, Artificial Sequence
  Synthetic Oligonucleotide; CD160 exon 3; Set C
auacugcucauaaaaguccuccacaguaccuaggacauua

SEQ ID NO: 61939 - RNA, 39 nt, Artificial Sequence
  Synthetic Oligonucleotide; CD160 exon 3; Set C
auacugcucauaaaaguccuccacaguaccuaggacauu

SEQ ID NO: 61940 - RNA, 19 nt, Artificial Sequence
  Synthetic Oligonucleotide; CD160 exon 3; Set C
uaaaaguccuccacaguac

SEQ ID NO: 61941 - RNA, 18 nt, Artificial Sequence
  Synthetic Oligonucleotide; CD160 exon 3; Set C
uaaaaguccuccacagua

SEQ ID NO: 61942 - RNA, 17 nt, Artificial Sequence
  Synthetic Oligonucleotide; CD160 exon 3; Set C
uaaaaguccuccacagu

SEQ ID NO: 61943 - RNA, 37 nt, Artificial Sequence
  Synthetic Oligonucleotide; CD160 exon 3; Set A
aaaaugagauacugcucauaaaaguccuccacaguac

SEQ ID NO: 61944 - RNA, 21 nt, Artificial Sequence
  Synthetic Oligonucleotide; CD160 exon 3; Set C
aaaaugagauacugcucauaa

SEQ ID NO: 61945 - RNA, 19 nt, Artificial Sequence
  Synthetic Oligonucleotide; CD160 exon 3; Set C
gauucaaaaugagauacug

SEQ ID NO: 61946 - RNA, 18 nt, Artificial Sequence
  Synthetic Oligonucleotide; CD160 exon 3; Set C
gauucaaaaugagauacu

SEQ ID NO: 61947 - RNA, 17 nt, Artificial Sequence
  Synthetic Oligonucleotide; CD160 exon 3; Set C
gauucaaaaugagauac

SEQ ID NO: 61948 - RNA, 16 nt, Artificial Sequence
  Synthetic Oligonucleotide; CD160 exon 3; Set C
gauucaaaaugagaua

SEQ ID NO: 61949 - RNA, 37 nt, Artificial Sequence
  Synthetic Oligonucleotide; CD160 exon 3; Set A
gugggugcaaggauucaaaaugagauacugcucauaa

SEQ ID NO: 61950 - RNA, 23 nt, Artificial Sequence
  Synthetic Oligonucleotide; CD160 exon 3; Set C
caaggauucaaaaugagauacug

SEQ ID NO: 61951 - RNA, 38 nt, Artificial Sequence
  Synthetic Oligonucleotide; CD160 exon 3; Set A
agugggugcaaggauucaaaaugagauacugcucauaa

SEQ ID NO: 61952 - RNA, 22 nt, Artificial Sequence
  Synthetic Oligonucleotide; CD160 exon 3; Set C
caaggauucaaaaugagauacu

SEQ ID NO: 61953 - RNA, 24 nt, Artificial Sequence
  Synthetic Oligonucleotide; CD160 exon 3; Set C
gcaaggauucaaaaugagauacug

SEQ ID NO: 61954 - RNA, 21 nt, Artificial Sequence
  Synthetic Oligonucleotide; CD160 exon 3; Set C
caaggauucaaaaugagauac

SEQ ID NO: 61955 - RNA, 23 nt, Artificial Sequence
  Synthetic Oligonucleotide; CD160 exon 3; Set C
gcaaggauucaaaaugagauacu

SEQ ID NO: 61956 - RNA, 20 nt, Artificial Sequence
  Synthetic Oligonucleotide; CD160 exon 3; Set C
caaggauucaaaaugagaua

SEQ ID NO: 61957 - RNA, 22 nt, Artificial Sequence
  Synthetic Oligonucleotide; CD160 exon 3; Set C
gcaaggauucaaaaugagauac

SEQ ID NO: 61958 - RNA, 21 nt, Artificial Sequence
  Synthetic Oligonucleotide; CD160 exon 3; Set C
gcaaggauucaaaaugagaua

SEQ ID NO: 61959 - RNA, 29 nt, Artificial Sequence
  Synthetic Oligonucleotide; CD160 exon 3; Set A
ugggugcaaggauucaaaaugagauacug

SEQ ID NO: 61960 - RNA, 28 nt, Artificial Sequence
  Synthetic Oligonucleotide; CD160 exon 3; Set A
ugggugcaaggauucaaaaugagauacu

SEQ ID NO: 61961 - RNA, 30 nt, Artificial Sequence
  Synthetic Oligonucleotide; CD160 exon 3; Set A
gugggugcaaggauucaaaaugagauacug

SEQ ID NO: 61962 - RNA, 27 nt, Artificial Sequence
  Synthetic Oligonucleotide; CD160 exon 3; Set C
ugggugcaaggauucaaaaugagauac

SEQ ID NO: 61963 - RNA, 29 nt, Artificial Sequence
  Synthetic Oligonucleotide; CD160 exon 3; Set A
gugggugcaaggauucaaaaugagauacu

SEQ ID NO: 61964 - RNA, 31 nt, Artificial Sequence
  Synthetic Oligonucleotide; CD160 exon 3; Set A
agugggugcaaggauucaaaaugagauacug

SEQ ID NO: 61965 - RNA, 26 nt, Artificial Sequence
  Synthetic Oligonucleotide; CD160 exon 3; Set C
ugggugcaaggauucaaaaugagaua

SEQ ID NO: 61966 - RNA, 28 nt, Artificial Sequence
  Synthetic Oligonucleotide; CD160 exon 3; Set A
gugggugcaaggauucaaaaugagauac

SEQ ID NO: 61967 - RNA, 30 nt, Artificial Sequence
  Synthetic Oligonucleotide; CD160 exon 3; Set A
agugggugcaaggauucaaaaugagauacu

SEQ ID NO: 61968 - RNA, 27 nt, Artificial Sequence
  Synthetic Oligonucleotide; CD160 exon 3; Set A
gugggugcaaggauucaaaaugagaua

SEQ ID NO: 61969 - RNA, 29 nt, Artificial Sequence
  Synthetic Oligonucleotide; CD160 exon 3; Set A
agugggugcaaggauucaaaaugagauac

SEQ ID NO: 61970 - RNA, 28 nt, Artificial Sequence
  Synthetic Oligonucleotide; CD160 exon 3; Set A
agugggugcaaggauucaaaaugagaua

SEQ ID NO: 61971 - RNA, 40 nt, Artificial Sequence
  Synthetic Oligonucleotide; CD160 exon 3; Set C
ccuacccaacccagugggugcaaggauucaaaaugagaua

SEQ ID NO: 61972 - RNA, 25 nt, Artificial Sequence
  Synthetic Oligonucleotide; CD160 exon 3; Set A
aacccagugggugcaaggauucaaa

SEQ ID NO: 61973 - RNA, 20 nt, Artificial Sequence
  Synthetic Oligonucleotide; CD160 exon 3; Set A
aacccagugggugcaaggau

SEQ ID NO: 61974 - RNA, 31 nt, Artificial Sequence
  Synthetic Oligonucleotide; CD160 exon 3; Set C
cuacccaacccagugggugcaaggauucaaa

SEQ ID NO: 61975 - RNA, 27 nt, Artificial Sequence
  Synthetic Oligonucleotide; CD160 exon 3; Set C
ccuacccaacccagugggugcaaggau

SEQ ID NO: 61976 - RNA, 28 nt, Artificial Sequence
  Synthetic Oligonucleotide; CD160 exon 3; Set C
accuacccaacccagugggugcaaggau

SEQ ID NO: 61977 - RNA, 29 nt, Artificial Sequence
  Synthetic Oligonucleotide; CD160 exon 3; Set C
caccuacccaacccagugggugcaaggau

SEQ ID NO: 61978 - RNA, 30 nt, Artificial Sequence
  Synthetic Oligonucleotide; CD160 exon 3; Set C
acaccuacccaacccagugggugcaaggau

SEQ ID NO: 61979 - RNA, 28 nt, Artificial Sequence
  Synthetic Oligonucleotide; CD160 exon 3; Set C
caccuacccaacccagugggugcaagga

SEQ ID NO: 61980 - RNA, 31 nt, Artificial Sequence
  Synthetic Oligonucleotide; CD160 exon 3; Set C
aacaccuacccaacccagugggugcaaggau

SEQ ID NO: 61981 - RNA, 23 nt, Artificial Sequence
  Synthetic Oligonucleotide; CD160 exon 3; Set C
ccuacccaacccagugggugcaa

SEQ ID NO: 61982 - RNA, 29 nt, Artificial Sequence
  Synthetic Oligonucleotide; CD160 exon 3; Set C
acaccuacccaacccagugggugcaagga

SEQ ID NO: 61983 - RNA, 32 nt, Artificial Sequence
  Synthetic Oligonucleotide; CD160 exon 3; Set C
uaacaccuacccaacccagugggugcaaggau

SEQ ID NO: 61984 - RNA, 24 nt, Artificial Sequence
  Synthetic Oligonucleotide; CD160 exon 3; Set C
accuacccaacccagugggugcaa

SEQ ID NO: 61985 - RNA, 28 nt, Artificial Sequence
  Synthetic Oligonucleotide; CD160 exon 3; Set C
acaccuacccaacccagugggugcaagg

SEQ ID NO: 61986 - RNA, 30 nt, Artificial Sequence
  Synthetic Oligonucleotide; CD160 exon 3; Set C
aacaccuacccaacccagugggugcaagga

SEQ ID NO: 61987 - RNA, 33 nt, Artificial Sequence
  Synthetic Oligonucleotide; CD160 exon 3; Set C
guaacaccuacccaacccagugggugcaaggau

SEQ ID NO: 61988 - RNA, 25 nt, Artificial Sequence
  Synthetic Oligonucleotide; CD160 exon 3; Set C
caccuacccaacccagugggugcaa

SEQ ID NO: 61989 - RNA, 29 nt, Artificial Sequence
  Synthetic Oligonucleotide; CD160 exon 3; Set C
aacaccuacccaacccagugggugcaagg

SEQ ID NO: 61990 - RNA, 27 nt, Artificial Sequence
  Synthetic Oligonucleotide; CD160 exon 3; Set C
acaccuacccaacccagugggugcaag

SEQ ID NO: 61991 - RNA, 31 nt, Artificial Sequence
  Synthetic Oligonucleotide; CD160 exon 3; Set C
uaacaccuacccaacccagugggugcaagga

SEQ ID NO: 61992 - RNA, 26 nt, Artificial Sequence
  Synthetic Oligonucleotide; CD160 exon 3; Set C
acaccuacccaacccagugggugcaa

SEQ ID NO: 61993 - RNA, 30 nt, Artificial Sequence
  Synthetic Oligonucleotide; CD160 exon 3; Set C
uaacaccuacccaacccagugggugcaagg

SEQ ID NO: 61994 - RNA, 28 nt, Artificial Sequence
  Synthetic Oligonucleotide; CD160 exon 3; Set C
aacaccuacccaacccagugggugcaag

SEQ ID NO: 61995 - RNA, 32 nt, Artificial Sequence
  Synthetic Oligonucleotide; CD160 exon 3; Set C
guaacaccuacccaacccagugggugcaagga

SEQ ID NO: 61996 - RNA, 27 nt, Artificial Sequence
  Synthetic Oligonucleotide; CD160 exon 3; Set C
aacaccuacccaacccagugggugcaa

SEQ ID NO: 61997 - RNA, 25 nt, Artificial Sequence
  Synthetic Oligonucleotide; CD160 exon 3; Set C
acaccuacccaacccagugggugca

SEQ ID NO: 61998 - RNA, 31 nt, Artificial Sequence
  Synthetic Oligonucleotide; CD160 exon 3; Set C
guaacaccuacccaacccagugggugcaagg

SEQ ID NO: 61999 - RNA, 29 nt, Artificial Sequence
  Synthetic Oligonucleotide; CD160 exon 3; Set C
uaacaccuacccaacccagugggugcaag

SEQ ID NO: 62000 - RNA, 33 nt, Artificial Sequence
  Synthetic Oligonucleotide; CD160 exon 3; Set C
uguaacaccuacccaacccagugggugcaagga

SEQ ID NO: 62001 - RNA, 28 nt, Artificial Sequence
  Synthetic Oligonucleotide; CD160 exon 3; Set C
uaacaccuacccaacccagugggugcaa

SEQ ID NO: 62002 - RNA, 26 nt, Artificial Sequence
  Synthetic Oligonucleotide; CD160 exon 3; Set C
aacaccuacccaacccagugggugca

SEQ ID NO: 62003 - RNA, 32 nt, Artificial Sequence
  Synthetic Oligonucleotide; CD160 exon 3; Set C
uguaacaccuacccaacccagugggugcaagg

SEQ ID NO: 62004 - RNA, 30 nt, Artificial Sequence
  Synthetic Oligonucleotide; CD160 exon 3; Set C
guaacaccuacccaacccagugggugcaag

SEQ ID NO: 62005 - RNA, 34 nt, Artificial Sequence
  Synthetic Oligonucleotide; CD160 exon 3; Set C
uuguaacaccuacccaacccagugggugcaagga

SEQ ID NO: 62006 - RNA, 29 nt, Artificial Sequence
  Synthetic Oligonucleotide; CD160 exon 3; Set C
guaacaccuacccaacccagugggugcaa

SEQ ID NO: 62007 - RNA, 27 nt, Artificial Sequence
  Synthetic Oligonucleotide; CD160 exon 3; Set C
uaacaccuacccaacccagugggugca

SEQ ID NO: 62008 - RNA, 33 nt, Artificial Sequence
  Synthetic Oligonucleotide; CD160 exon 3; Set C
uuguaacaccuacccaacccagugggugcaagg

SEQ ID NO: 62009 - RNA, 31 nt, Artificial Sequence
  Synthetic Oligonucleotide; CD160 exon 3; Set C
uguaacaccuacccaacccagugggugcaag

SEQ ID NO: 62010 - RNA, 16 nt, Artificial Sequence
  Synthetic Oligonucleotide; CD160 exon 3; Set C
ccuacccaacccagug

SEQ ID NO: 62011 - RNA, 30 nt, Artificial Sequence
  Synthetic Oligonucleotide; CD160 exon 3; Set C
uguaacaccuacccaacccagugggugcaa

SEQ ID NO: 62012 - RNA, 28 nt, Artificial Sequence
  Synthetic Oligonucleotide; CD160 exon 3; Set C
guaacaccuacccaacccagugggugca

SEQ ID NO: 62013 - RNA, 32 nt, Artificial Sequence
  Synthetic Oligonucleotide; CD160 exon 3; Set C
uuguaacaccuacccaacccagugggugcaag

SEQ ID NO: 62014 - RNA, 15 nt, Artificial Sequence
  Synthetic Oligonucleotide; CD160 exon 3; Set C
ccuacccaacccagu

SEQ ID NO: 62015 - RNA, 17 nt, Artificial Sequence
  Synthetic Oligonucleotide; CD160 exon 3; Set C
accuacccaacccagug

SEQ ID NO: 62016 - RNA, 31 nt, Artificial Sequence
  Synthetic Oligonucleotide; CD160 exon 3; Set C
uuguaacaccuacccaacccagugggugcaa

SEQ ID NO: 62017 - RNA, 29 nt, Artificial Sequence
  Synthetic Oligonucleotide; CD160 exon 3; Set C
uguaacaccuacccaacccagugggugca

SEQ ID NO: 62018 - RNA, 16 nt, Artificial Sequence
  Synthetic Oligonucleotide; CD160 exon 3; Set C
accuacccaacccagu

SEQ ID NO: 62019 - RNA, 18 nt, Artificial Sequence
  Synthetic Oligonucleotide; CD160 exon 3; Set A
caccuacccaacccagug

SEQ ID NO: 62020 - RNA, 20 nt, Artificial Sequence
  Synthetic Oligonucleotide; CD160 exon 3; Set A
acaccuacccaacccagugg

SEQ ID NO: 62021 - RNA, 30 nt, Artificial Sequence
  Synthetic Oligonucleotide; CD160 exon 3; Set C
uuguaacaccuacccaacccagugggugca

SEQ ID NO: 62022 - RNA, 17 nt, Artificial Sequence
  Synthetic Oligonucleotide; CD160 exon 3; Set C
caccuacccaacccagu

SEQ ID NO: 62023 - RNA, 19 nt, Artificial Sequence
  Synthetic Oligonucleotide; CD160 exon 3; Set A
acaccuacccaacccagug

SEQ ID NO: 62024 - RNA, 21 nt, Artificial Sequence
  Synthetic Oligonucleotide; CD160 exon 3; Set A
aacaccuacccaacccagugg

SEQ ID NO: 62025 - RNA, 18 nt, Artificial Sequence
  Synthetic Oligonucleotide; CD160 exon 3; Set A
acaccuacccaacccagu

SEQ ID NO: 62026 - RNA, 20 nt, Artificial Sequence
  Synthetic Oligonucleotide; CD160 exon 3; Set A
aacaccuacccaacccagug

SEQ ID NO: 62027 - RNA, 22 nt, Artificial Sequence
  Synthetic Oligonucleotide; CD160 exon 3; Set A
uaacaccuacccaacccagugg

SEQ ID NO: 62028 - RNA, 19 nt, Artificial Sequence
  Synthetic Oligonucleotide; CD160 exon 3; Set A
aacaccuacccaacccagu

SEQ ID NO: 62029 - RNA, 21 nt, Artificial Sequence
  Synthetic Oligonucleotide; CD160 exon 3; Set A
uaacaccuacccaacccagug

SEQ ID NO: 62030 - RNA, 23 nt, Artificial Sequence
  Synthetic Oligonucleotide; CD160 exon 3; Set A
guaacaccuacccaacccagugg

SEQ ID NO: 62031 - RNA, 20 nt, Artificial Sequence
  Synthetic Oligonucleotide; CD160 exon 3; Set A
uaacaccuacccaacccagu

SEQ ID NO: 62032 - RNA, 22 nt, Artificial Sequence
  Synthetic Oligonucleotide; CD160 exon 3; Set A
guaacaccuacccaacccagug

SEQ ID NO: 62033 - RNA, 24 nt, Artificial Sequence
  Synthetic Oligonucleotide; CD160 exon 3; Set A
uguaacaccuacccaacccagugg

SEQ ID NO: 62034 - RNA, 21 nt, Artificial Sequence
  Synthetic Oligonucleotide; CD160 exon 3; Set A
guaacaccuacccaacccagu

SEQ ID NO: 62035 - RNA, 25 nt, Artificial Sequence
  Synthetic Oligonucleotide; CD160 exon 3; Set A
uuguaacaccuacccaacccagugg

SEQ ID NO: 62036 - RNA, 36 nt, Artificial Sequence
  Synthetic Oligonucleotide; CD160 exon 3; Set C
uugaaugggcauuguaacaccuacccaacccagugg

SEQ ID NO: 62037 - RNA, 35 nt, Artificial Sequence
  Synthetic Oligonucleotide; CD160 exon 3; Set C
uugaaugggcauuguaacaccuacccaacccagug

SEQ ID NO: 62038 - RNA, 37 nt, Artificial Sequence
  Synthetic Oligonucleotide; CD160 exon 3; Set C
uuugaaugggcauuguaacaccuacccaacccagugg

SEQ ID NO: 62039 - RNA, 34 nt, Artificial Sequence
  Synthetic Oligonucleotide; CD160 exon 3; Set C
uugaaugggcauuguaacaccuacccaacccagu

SEQ ID NO: 62040 - RNA, 36 nt, Artificial Sequence
  Synthetic Oligonucleotide; CD160 exon 3; Set C
uuugaaugggcauuguaacaccuacccaacccagug

SEQ ID NO: 62041 - RNA, 35 nt, Artificial Sequence
  Synthetic Oligonucleotide; CD160 exon 3; Set C
uuugaaugggcauuguaacaccuacccaacccagu

SEQ ID NO: 62042 - RNA, 37 nt, Artificial Sequence
  Synthetic Oligonucleotide; CD160 exon 3; Set C
uuuugaaugggcauuguaacaccuacccaacccagug

SEQ ID NO: 62043 - RNA, 36 nt, Artificial Sequence
  Synthetic Oligonucleotide; CD160 exon 3; Set C
uuuugaaugggcauuguaacaccuacccaacccagu

SEQ ID NO: 62044 - RNA, 20 nt, Artificial Sequence
  Synthetic Oligonucleotide; CD160 exon 3; Set C
gaaugggcauuguaacaccu

SEQ ID NO: 62045 - RNA, 19 nt, Artificial Sequence
  Synthetic Oligonucleotide; CD160 exon 3; Set C
gaaugggcauuguaacacc

SEQ ID NO: 62046 - RNA, 21 nt, Artificial Sequence
  Synthetic Oligonucleotide; CD160 exon 3; Set C
ugaaugggcauuguaacaccu

SEQ ID NO: 62047 - RNA, 23 nt, Artificial Sequence
  Synthetic Oligonucleotide; CD160 exon 3; Set C
uugaaugggcauuguaacaccua

SEQ ID NO: 62048 - RNA, 18 nt, Artificial Sequence
  Synthetic Oligonucleotide; CD160 exon 3; Set C
gaaugggcauuguaacac

SEQ ID NO: 62049 - RNA, 20 nt, Artificial Sequence
  Synthetic Oligonucleotide; CD160 exon 3; Set C
ugaaugggcauuguaacacc

SEQ ID NO: 62050 - RNA, 24 nt, Artificial Sequence
  Synthetic Oligonucleotide; CD160 exon 3; Set C
uuugaaugggcauuguaacaccua

SEQ ID NO: 62051 - RNA, 17 nt, Artificial Sequence
  Synthetic Oligonucleotide; CD160 exon 3; Set C
gaaugggcauuguaaca

SEQ ID NO: 62052 - RNA, 19 nt, Artificial Sequence
  Synthetic Oligonucleotide; CD160 exon 3; Set C
ugaaugggcauuguaacac

SEQ ID NO: 62053 - RNA, 16 nt, Artificial Sequence
  Synthetic Oligonucleotide; CD160 exon 3; Set C
gaaugggcauuguaac

SEQ ID NO: 62054 - RNA, 18 nt, Artificial Sequence
  Synthetic Oligonucleotide; CD160 exon 3; Set C
ugaaugggcauuguaaca

SEQ ID NO: 62055 - RNA, 24 nt, Artificial Sequence
  Synthetic Oligonucleotide; CD160 exon 3; Set C
uuuugaaugggcauuguaacaccu

SEQ ID NO: 62056 - RNA, 15 nt, Artificial Sequence
  Synthetic Oligonucleotide; CD160 exon 3; Set C
gaaugggcauuguaa

SEQ ID NO: 62057 - RNA, 17 nt, Artificial Sequence
  Synthetic Oligonucleotide; CD160 exon 3; Set C
ugaaugggcauuguaac

SEQ ID NO: 62058 - RNA, 23 nt, Artificial Sequence
  Synthetic Oligonucleotide; CD160 exon 3; Set C
uuuugaaugggcauuguaacacc

SEQ ID NO: 62059 - RNA, 16 nt, Artificial Sequence
  Synthetic Oligonucleotide; CD160 exon 3; Set C
ugaaugggcauuguaa

SEQ ID NO: 62060 - RNA, 22 nt, Artificial Sequence
  Synthetic Oligonucleotide; CD160 exon 3; Set C
uuuugaaugggcauuguaacac

SEQ ID NO: 62061 - RNA, 15 nt, Artificial Sequence
  Synthetic Oligonucleotide; CD160 exon 3; Set C
ugaaugggcauugua

SEQ ID NO: 62062 - RNA, 21 nt, Artificial Sequence
  Synthetic Oligonucleotide; CD160 exon 3; Set C
uuuugaaugggcauuguaaca

SEQ ID NO: 62063 - RNA, 20 nt, Artificial Sequence
  Synthetic Oligonucleotide; CD160 exon 3; Set C
uuuugaaugggcauuguaac

SEQ ID NO: 62064 - RNA, 19 nt, Artificial Sequence
  Synthetic Oligonucleotide; CD160 exon 3; Set C
uuuugaaugggcauuguaa

SEQ ID NO: 62065 - RNA, 18 nt, Artificial Sequence
  Synthetic Oligonucleotide; CD160 exon 3; Set C
uuuugaaugggcauugua

SEQ ID NO: 62066 - RNA, 32 nt, Artificial Sequence
  Synthetic Oligonucleotide; CD160 exon 3; Set A
uugccauuuuugaaugggcauuguaacaccua

SEQ ID NO: 62067 - RNA, 17 nt, Artificial Sequence
  Synthetic Oligonucleotide; CD160 exon 3; Set C
uuuugaaugggcauugu

SEQ ID NO: 62068 - RNA, 33 nt, Artificial Sequence
  Synthetic Oligonucleotide; CD160 exon 3; Set C
uuugccauuuuugaaugggcauuguaacaccua

SEQ ID NO: 62069 - RNA, 16 nt, Artificial Sequence
  Synthetic Oligonucleotide; CD160 exon 3; Set C
uuuugaaugggcauug

SEQ ID NO: 62070 - RNA, 32 nt, Artificial Sequence
  Synthetic Oligonucleotide; CD160 exon 3; Set A
uuugccauuuuugaaugggcauuguaacaccu

SEQ ID NO: 62071 - RNA, 31 nt, Artificial Sequence
  Synthetic Oligonucleotide; CD160 exon 3; Set A
uuugccauuuuugaaugggcauuguaacacc

SEQ ID NO: 62072 - RNA, 30 nt, Artificial Sequence
  Synthetic Oligonucleotide; CD160 exon 3; Set A
uuugccauuuuugaaugggcauuguaacac

SEQ ID NO: 62073 - RNA, 29 nt, Artificial Sequence
  Synthetic Oligonucleotide; CD160 exon 3; Set A
uuugccauuuuugaaugggcauuguaaca

SEQ ID NO: 62074 - RNA, 28 nt, Artificial Sequence
  Synthetic Oligonucleotide; CD160 exon 3; Set A
uuugccauuuuugaaugggcauuguaac

SEQ ID NO: 62075 - RNA, 38 nt, Artificial Sequence
  Synthetic Oligonucleotide; CD160 exon 3; Set C
cuugcuuugccauuuuugaaugggcauuguaacaccua

SEQ ID NO: 62076 - RNA, 27 nt, Artificial Sequence
  Synthetic Oligonucleotide; CD160 exon 3; Set A
uuugccauuuuugaaugggcauuguaa

SEQ ID NO: 62077 - RNA, 37 nt, Artificial Sequence
  Synthetic Oligonucleotide; CD160 exon 3; Set C
cuugcuuugccauuuuugaaugggcauuguaacaccu

SEQ ID NO: 62078 - RNA, 26 nt, Artificial Sequence
  Synthetic Oligonucleotide; CD160 exon 3; Set A
uuugccauuuuugaaugggcauugua

SEQ ID NO: 62079 - RNA, 36 nt, Artificial Sequence
  Synthetic Oligonucleotide; CD160 exon 3; Set C
cuugcuuugccauuuuugaaugggcauuguaacacc

SEQ ID NO: 62080 - RNA, 25 nt, Artificial Sequence
  Synthetic Oligonucleotide; CD160 exon 3; Set A
uuugccauuuuugaaugggcauugu

SEQ ID NO: 62081 - RNA, 35 nt, Artificial Sequence
  Synthetic Oligonucleotide; CD160 exon 3; Set C
cuugcuuugccauuuuugaaugggcauuguaacac

SEQ ID NO: 62082 - RNA, 24 nt, Artificial Sequence
  Synthetic Oligonucleotide; CD160 exon 3; Set C
uuugccauuuuugaaugggcauug

SEQ ID NO: 62083 - RNA, 34 nt, Artificial Sequence
  Synthetic Oligonucleotide; CD160 exon 3; Set C
cuugcuuugccauuuuugaaugggcauuguaaca

SEQ ID NO: 62084 - RNA, 33 nt, Artificial Sequence
  Synthetic Oligonucleotide; CD160 exon 3; Set A
cuugcuuugccauuuuugaaugggcauuguaac

SEQ ID NO: 62085 - RNA, 32 nt, Artificial Sequence
  Synthetic Oligonucleotide; CD160 exon 3; Set A
cuugcuuugccauuuuugaaugggcauuguaa

SEQ ID NO: 62086 - RNA, 31 nt, Artificial Sequence
  Synthetic Oligonucleotide; CD160 exon 3; Set A
cuugcuuugccauuuuugaaugggcauugua

SEQ ID NO: 62087 - RNA, 30 nt, Artificial Sequence
  Synthetic Oligonucleotide; CD160 exon 3; Set A
cuugcuuugccauuuuugaaugggcauugu

SEQ ID NO: 62088 - RNA, 29 nt, Artificial Sequence
  Synthetic Oligonucleotide; CD160 exon 3; Set A
cuugcuuugccauuuuugaaugggcauug

SEQ ID NO: 62089 - RNA, 15 nt, Artificial Sequence
  Synthetic Oligonucleotide; CD160 exon 3; Set C
uugccauuuuugaau

SEQ ID NO: 62090 - RNA, 15 nt, Artificial Sequence
  Synthetic Oligonucleotide; CD160 exon 3; Set C
uuugccauuuuugaa

SEQ ID NO: 62091 - RNA, 20 nt, Artificial Sequence
  Synthetic Oligonucleotide; CD160 exon 3; Set C
cuugcuuugccauuuuugaa

SEQ ID NO: 62092 - RNA, 19 nt, Artificial Sequence
  Synthetic Oligonucleotide; CD160 exon 3; Set C
cuugcuuugccauuuuuga

SEQ ID NO: 62093 - RNA, 18 nt, Artificial Sequence
  Synthetic Oligonucleotide; CD160 exon 3; Set C
cuugcuuugccauuuuug

SEQ ID NO: 62094 - RNA, 17 nt, Artificial Sequence
  Synthetic Oligonucleotide; CD160 exon 3; Set C
cuugcuuugccauuuuu

SEQ ID NO: 62095 - RNA, 32 nt, Artificial Sequence
  Synthetic Oligonucleotide; CD160 exon 3; Set A
guugaacuucugagcuugcuuugccauuuuug

SEQ ID NO: 62096 - RNA, 31 nt, Artificial Sequence
  Synthetic Oligonucleotide; CD160 exon 3; Set A
guugaacuucugagcuugcuuugccauuuuu

SEQ ID NO: 62097 - RNA, 36 nt, Artificial Sequence
  Synthetic Oligonucleotide; CD160 exon 3; Set C
ccugguugaacuucugagcuugcuuugccauuuuug

SEQ ID NO: 62098 - RNA, 35 nt, Artificial Sequence
  Synthetic Oligonucleotide; CD160 exon 3; Set C
ccugguugaacuucugagcuugcuuugccauuuuu

SEQ ID NO: 62099 - RNA, 37 nt, Artificial Sequence
  Synthetic Oligonucleotide; CD160 exon 3; Set C
accugguugaacuucugagcuugcuuugccauuuuug

SEQ ID NO: 62100 - RNA, 36 nt, Artificial Sequence
  Synthetic Oligonucleotide; CD160 exon 3; Set C
accugguugaacuucugagcuugcuuugccauuuuu

SEQ ID NO: 62101 - RNA, 38 nt, Artificial Sequence
  Synthetic Oligonucleotide; CD160 exon 3; Set C
aaccugguugaacuucugagcuugcuuugccauuuuug

SEQ ID NO: 62102 - RNA, 37 nt, Artificial Sequence
  Synthetic Oligonucleotide; CD160 exon 3; Set C
aaccugguugaacuucugagcuugcuuugccauuuuu

SEQ ID NO: 62103 - RNA, 39 nt, Artificial Sequence
  Synthetic Oligonucleotide; CD160 exon 3; Set C
aaaccugguugaacuucugagcuugcuuugccauuuuug

SEQ ID NO: 62104 - RNA, 38 nt, Artificial Sequence
  Synthetic Oligonucleotide; CD160 exon 3; Set C
aaaccugguugaacuucugagcuugcuuugccauuuuu

SEQ ID NO: 62105 - RNA, 40 nt, Artificial Sequence
  Synthetic Oligonucleotide; CD160 exon 3; Set C
caaaccugguugaacuucugagcuugcuuugccauuuuug

SEQ ID NO: 62106 - RNA, 39 nt, Artificial Sequence
  Synthetic Oligonucleotide; CD160 exon 3; Set C
caaaccugguugaacuucugagcuugcuuugccauuuuu

SEQ ID NO: 62107 - RNA, 23 nt, Artificial Sequence
  Synthetic Oligonucleotide; CD160 exon 3; Set C
guugaacuucugagcuugcuuug

SEQ ID NO: 62108 - RNA, 40 nt, Artificial Sequence
  Synthetic Oligonucleotide; CD160 exon 3; Set C
ucaaaccugguugaacuucugagcuugcuuugccauuuuu

SEQ ID NO: 62109 - RNA, 27 nt, Artificial Sequence
  Synthetic Oligonucleotide; CD160 exon 3; Set A
ccugguugaacuucugagcuugcuuug

SEQ ID NO: 62110 - RNA, 28 nt, Artificial Sequence
  Synthetic Oligonucleotide; CD160 exon 3; Set A
accugguugaacuucugagcuugcuuug

SEQ ID NO: 62111 - RNA, 29 nt, Artificial Sequence
  Synthetic Oligonucleotide; CD160 exon 3; Set A
aaccugguugaacuucugagcuugcuuug

SEQ ID NO: 62112 - RNA, 17 nt, Artificial Sequence
  Synthetic Oligonucleotide; CD160 exon 3; Set C
guugaacuucugagcuu

SEQ ID NO: 62113 - RNA, 27 nt, Artificial Sequence
  Synthetic Oligonucleotide; CD160 exon 3; Set A
accugguugaacuucugagcuugcuuu

SEQ ID NO: 62114 - RNA, 30 nt, Artificial Sequence
  Synthetic Oligonucleotide; CD160 exon 3; Set A
aaaccugguugaacuucugagcuugcuuug

SEQ ID NO: 62115 - RNA, 28 nt, Artificial Sequence
  Synthetic Oligonucleotide; CD160 exon 3; Set A
aaccugguugaacuucugagcuugcuuu

SEQ ID NO: 62116 - RNA, 31 nt, Artificial Sequence
  Synthetic Oligonucleotide; CD160 exon 3; Set A
caaaccugguugaacuucugagcuugcuuug

SEQ ID NO: 62117 - RNA, 29 nt, Artificial Sequence
  Synthetic Oligonucleotide; CD160 exon 3; Set A
aaaccugguugaacuucugagcuugcuuu

SEQ ID NO: 62118 - RNA, 32 nt, Artificial Sequence
  Synthetic Oligonucleotide; CD160 exon 3; Set A
ucaaaccugguugaacuucugagcuugcuuug

SEQ ID NO: 62119 - RNA, 30 nt, Artificial Sequence
  Synthetic Oligonucleotide; CD160 exon 3; Set A
caaaccugguugaacuucugagcuugcuuu

SEQ ID NO: 62120 - RNA, 33 nt, Artificial Sequence
  Synthetic Oligonucleotide; CD160 exon 3; Set A
cucaaaccugguugaacuucugagcuugcuuug

SEQ ID NO: 62121 - RNA, 21 nt, Artificial Sequence
  Synthetic Oligonucleotide; CD160 exon 3; Set C
ccugguugaacuucugagcuu

SEQ ID NO: 62122 - RNA, 31 nt, Artificial Sequence
  Synthetic Oligonucleotide; CD160 exon 3; Set A
ucaaaccugguugaacuucugagcuugcuuu

SEQ ID NO: 62123 - RNA, 22 nt, Artificial Sequence
  Synthetic Oligonucleotide; CD160 exon 3; Set A
accugguugaacuucugagcuu

SEQ ID NO: 62124 - RNA, 32 nt, Artificial Sequence
  Synthetic Oligonucleotide; CD160 exon 3; Set A
cucaaaccugguugaacuucugagcuugcuuu

SEQ ID NO: 62125 - RNA, 35 nt, Artificial Sequence
  Synthetic Oligonucleotide; CD160 exon 3; Set C
gucucaaaccugguugaacuucugagcuugcuuug

SEQ ID NO: 62126 - RNA, 23 nt, Artificial Sequence
  Synthetic Oligonucleotide; CD160 exon 3; Set A
aaccugguugaacuucugagcuu

SEQ ID NO: 62127 - RNA, 33 nt, Artificial Sequence
  Synthetic Oligonucleotide; CD160 exon 3; Set C
ucucaaaccugguugaacuucugagcuugcuuu

SEQ ID NO: 62128 - RNA, 36 nt, Artificial Sequence
  Synthetic Oligonucleotide; CD160 exon 3; Set C
ugucucaaaccugguugaacuucugagcuugcuuug

SEQ ID NO: 62129 - RNA, 24 nt, Artificial Sequence
  Synthetic Oligonucleotide; CD160 exon 3; Set C
aaaccugguugaacuucugagcuu

SEQ ID NO: 62130 - RNA, 34 nt, Artificial Sequence
  Synthetic Oligonucleotide; CD160 exon 3; Set C
gucucaaaccugguugaacuucugagcuugcuuu

SEQ ID NO: 62131 - RNA, 25 nt, Artificial Sequence
  Synthetic Oligonucleotide; CD160 exon 3; Set A
caaaccugguugaacuucugagcuu

SEQ ID NO: 62132 - RNA, 35 nt, Artificial Sequence
  Synthetic Oligonucleotide; CD160 exon 3; Set C
ugucucaaaccugguugaacuucugagcuugcuuu

SEQ ID NO: 62133 - RNA, 26 nt, Artificial Sequence
  Synthetic Oligonucleotide; CD160 exon 3; Set A
ucaaaccugguugaacuucugagcuu

SEQ ID NO: 62134 - RNA, 27 nt, Artificial Sequence
  Synthetic Oligonucleotide; CD160 exon 3; Set A
cucaaaccugguugaacuucugagcuu

SEQ ID NO: 62135 - RNA, 29 nt, Artificial Sequence
  Synthetic Oligonucleotide; CD160 exon 3; Set A
gucucaaaccugguugaacuucugagcuu

SEQ ID NO: 62136 - RNA, 39 nt, Artificial Sequence
  Synthetic Oligonucleotide; CD160 exon 3; Set C
uuacugucucaaaccugguugaacuucugagcuugcuuu

SEQ ID NO: 62137 - RNA, 30 nt, Artificial Sequence
  Synthetic Oligonucleotide; CD160 exon 3; Set A
ugucucaaaccugguugaacuucugagcuu

SEQ ID NO: 62138 - RNA, 40 nt, Artificial Sequence
  Synthetic Oligonucleotide; CD160 exon 3; Set C
auuacugucucaaaccugguugaacuucugagcuugcuuu

SEQ ID NO: 62139 - RNA, 32 nt, Artificial Sequence
  Synthetic Oligonucleotide; CD160 exon 3; Set B
gaaaucucaauauuacugucucaaaccugguu

SEQ ID NO: 62140 - RNA, 33 nt, Artificial Sequence
  Synthetic Oligonucleotide; CD160 exon 3; Set B
ggaaaucucaauauuacugucucaaaccugguu

SEQ ID NO: 62141 - RNA, 34 nt, Artificial Sequence
  Synthetic Oligonucleotide; CD160 exon 3; Set B
uggaaaucucaauauuacugucucaaaccugguu

SEQ ID NO: 62142 - RNA, 35 nt, Artificial Sequence
  Synthetic Oligonucleotide; CD160 exon 3; Set B
cuggaaaucucaauauuacugucucaaaccugguu

SEQ ID NO: 62143 - RNA, 36 nt, Artificial Sequence
  Synthetic Oligonucleotide; CD160 exon 3; Set B
ccuggaaaucucaauauuacugucucaaaccugguu

SEQ ID NO: 62144 - RNA, 28 nt, Artificial Sequence
  Synthetic Oligonucleotide; CD160 exon 3; Set C
gaaaucucaauauuacugucucaaaccu

SEQ ID NO: 62145 - RNA, 27 nt, Artificial Sequence
  Synthetic Oligonucleotide; CD160 exon 3; Set C
gaaaucucaauauuacugucucaaacc

SEQ ID NO: 62146 - RNA, 37 nt, Artificial Sequence
  Synthetic Oligonucleotide; CD160 exon 3; Set B
accuggaaaucucaauauuacugucucaaaccugguu

SEQ ID NO: 62147 - RNA, 29 nt, Artificial Sequence
  Synthetic Oligonucleotide; CD160 exon 3; Set C
ggaaaucucaauauuacugucucaaaccu

SEQ ID NO: 62148 - RNA, 28 nt, Artificial Sequence
  Synthetic Oligonucleotide; CD160 exon 3; Set C
ggaaaucucaauauuacugucucaaacc

SEQ ID NO: 62149 - RNA, 26 nt, Artificial Sequence
  Synthetic Oligonucleotide; CD160 exon 3; Set C
gaaaucucaauauuacugucucaaac

SEQ ID NO: 62150 - RNA, 38 nt, Artificial Sequence
  Synthetic Oligonucleotide; CD160 exon 3; Set C
caccuggaaaucucaauauuacugucucaaaccugguu

SEQ ID NO: 62151 - RNA, 30 nt, Artificial Sequence
  Synthetic Oligonucleotide; CD160 exon 3; Set C
uggaaaucucaauauuacugucucaaaccu

SEQ ID NO: 62152 - RNA, 29 nt, Artificial Sequence
  Synthetic Oligonucleotide; CD160 exon 3; Set C
uggaaaucucaauauuacugucucaaacc

SEQ ID NO: 62153 - RNA, 27 nt, Artificial Sequence
  Synthetic Oligonucleotide; CD160 exon 3; Set C
ggaaaucucaauauuacugucucaaac

SEQ ID NO: 62154 - RNA, 25 nt, Artificial Sequence
  Synthetic Oligonucleotide; CD160 exon 3; Set C
gaaaucucaauauuacugucucaaa

SEQ ID NO: 62155 - RNA, 31 nt, Artificial Sequence
  Synthetic Oligonucleotide; CD160 exon 3; Set B
cuggaaaucucaauauuacugucucaaaccu

SEQ ID NO: 62156 - RNA, 30 nt, Artificial Sequence
  Synthetic Oligonucleotide; CD160 exon 3; Set C
cuggaaaucucaauauuacugucucaaacc

SEQ ID NO: 62157 - RNA, 28 nt, Artificial Sequence
  Synthetic Oligonucleotide; CD160 exon 3; Set C
uggaaaucucaauauuacugucucaaac

SEQ ID NO: 62158 - RNA, 26 nt, Artificial Sequence
  Synthetic Oligonucleotide; CD160 exon 3; Set C
ggaaaucucaauauuacugucucaaa

SEQ ID NO: 62159 - RNA, 24 nt, Artificial Sequence
  Synthetic Oligonucleotide; CD160 exon 3; Set C
gaaaucucaauauuacugucucaa

SEQ ID NO: 62160 - RNA, 31 nt, Artificial Sequence
  Synthetic Oligonucleotide; CD160 exon 3; Set B
ccuggaaaucucaauauuacugucucaaacc

SEQ ID NO: 62161 - RNA, 29 nt, Artificial Sequence
  Synthetic Oligonucleotide; CD160 exon 3; Set C
cuggaaaucucaauauuacugucucaaac

SEQ ID NO: 62162 - RNA, 27 nt, Artificial Sequence
  Synthetic Oligonucleotide; CD160 exon 3; Set C
uggaaaucucaauauuacugucucaaa

SEQ ID NO: 62163 - RNA, 23 nt, Artificial Sequence
  Synthetic Oligonucleotide; CD160 exon 3; Set C
gaaaucucaauauuacugucuca

SEQ ID NO: 62164 - RNA, 25 nt, Artificial Sequence
  Synthetic Oligonucleotide; CD160 exon 3; Set C
ggaaaucucaauauuacugucucaa

SEQ ID NO: 62165 - RNA, 32 nt, Artificial Sequence
  Synthetic Oligonucleotide; CD160 exon 3; Set B
accuggaaaucucaauauuacugucucaaacc

SEQ ID NO: 62166 - RNA, 30 nt, Artificial Sequence
  Synthetic Oligonucleotide; CD160 exon 3; Set C
ccuggaaaucucaauauuacugucucaaac

SEQ ID NO: 62167 - RNA, 28 nt, Artificial Sequence
  Synthetic Oligonucleotide; CD160 exon 3; Set C
cuggaaaucucaauauuacugucucaaa

SEQ ID NO: 62168 - RNA, 24 nt, Artificial Sequence
  Synthetic Oligonucleotide; CD160 exon 3; Set C
ggaaaucucaauauuacugucuca

SEQ ID NO: 62169 - RNA, 22 nt, Artificial Sequence
  Synthetic Oligonucleotide; CD160 exon 3; Set C
gaaaucucaauauuacugucuc

SEQ ID NO: 62170 - RNA, 34 nt, Artificial Sequence
  Synthetic Oligonucleotide; CD160 exon 3; Set B
caccuggaaaucucaauauuacugucucaaaccu

SEQ ID NO: 62171 - RNA, 26 nt, Artificial Sequence
  Synthetic Oligonucleotide; CD160 exon 3; Set C
uggaaaucucaauauuacugucucaa

SEQ ID NO: 62172 - RNA, 33 nt, Artificial Sequence
  Synthetic Oligonucleotide; CD160 exon 3; Set B
caccuggaaaucucaauauuacugucucaaacc

SEQ ID NO: 62173 - RNA, 31 nt, Artificial Sequence
  Synthetic Oligonucleotide; CD160 exon 3; Set B
accuggaaaucucaauauuacugucucaaac

SEQ ID NO: 62174 - RNA, 21 nt, Artificial Sequence
  Synthetic Oligonucleotide; CD160 exon 3; Set C
gaaaucucaauauuacugucu

SEQ ID NO: 62175 - RNA, 29 nt, Artificial Sequence
  Synthetic Oligonucleotide; CD160 exon 3; Set C
ccuggaaaucucaauauuacugucucaaa

SEQ ID NO: 62176 - RNA, 25 nt, Artificial Sequence
  Synthetic Oligonucleotide; CD160 exon 3; Set C
uggaaaucucaauauuacugucuca

SEQ ID NO: 62177 - RNA, 23 nt, Artificial Sequence
  Synthetic Oligonucleotide; CD160 exon 3; Set C
ggaaaucucaauauuacugucuc

SEQ ID NO: 62178 - RNA, 35 nt, Artificial Sequence
  Synthetic Oligonucleotide; CD160 exon 3; Set B
gcaccuggaaaucucaauauuacugucucaaaccu

SEQ ID NO: 62179 - RNA, 32 nt, Artificial Sequence
  Synthetic Oligonucleotide; CD160 exon 3; Set B
caccuggaaaucucaauauuacugucucaaac

SEQ ID NO: 62180 - RNA, 22 nt, Artificial Sequence
  Synthetic Oligonucleotide; CD160 exon 3; Set C
ggaaaucucaauauuacugucu

SEQ ID NO: 62181 - RNA, 30 nt, Artificial Sequence
  Synthetic Oligonucleotide; CD160 exon 3; Set C
accuggaaaucucaauauuacugucucaaa

SEQ ID NO: 62182 - RNA, 26 nt, Artificial Sequence
  Synthetic Oligonucleotide; CD160 exon 3; Set C
cuggaaaucucaauauuacugucuca

SEQ ID NO: 62183 - RNA, 24 nt, Artificial Sequence
  Synthetic Oligonucleotide; CD160 exon 3; Set C
uggaaaucucaauauuacugucuc

SEQ ID NO: 62184 - RNA, 20 nt, Artificial Sequence
  Synthetic Oligonucleotide; CD160 exon 3; Set C
gaaaucucaauauuacuguc

SEQ ID NO: 62185 - RNA, 23 nt, Artificial Sequence
  Synthetic Oligonucleotide; CD160 exon 3; Set C
uggaaaucucaauauuacugucu

SEQ ID NO: 62186 - RNA, 31 nt, Artificial Sequence
  Synthetic Oligonucleotide; CD160 exon 3; Set B
caccuggaaaucucaauauuacugucucaaa

SEQ ID NO: 62187 - RNA, 27 nt, Artificial Sequence
  Synthetic Oligonucleotide; CD160 exon 3; Set C
ccuggaaaucucaauauuacugucuca

SEQ ID NO: 62188 - RNA, 25 nt, Artificial Sequence
  Synthetic Oligonucleotide; CD160 exon 3; Set C
cuggaaaucucaauauuacugucuc

SEQ ID NO: 62189 - RNA, 19 nt, Artificial Sequence
  Synthetic Oligonucleotide; CD160 exon 3; Set C
gaaaucucaauauuacugu

SEQ ID NO: 62190 - RNA, 21 nt, Artificial Sequence
  Synthetic Oligonucleotide; CD160 exon 3; Set C
ggaaaucucaauauuacuguc

SEQ ID NO: 62191 - RNA, 24 nt, Artificial Sequence
  Synthetic Oligonucleotide; CD160 exon 3; Set C
cuggaaaucucaauauuacugucu

SEQ ID NO: 62192 - RNA, 28 nt, Artificial Sequence
  Synthetic Oligonucleotide; CD160 exon 3; Set B
accuggaaaucucaauauuacugucuca

SEQ ID NO: 62193 - RNA, 30 nt, Artificial Sequence
  Synthetic Oligonucleotide; CD160 exon 3; Set B
caccuggaaaucucaauauuacugucucaa

SEQ ID NO: 62194 - RNA, 20 nt, Artificial Sequence
  Synthetic Oligonucleotide; CD160 exon 3; Set C
ggaaaucucaauauuacugu

SEQ ID NO: 62195 - RNA, 22 nt, Artificial Sequence
  Synthetic Oligonucleotide; CD160 exon 3; Set C
uggaaaucucaauauuacuguc

SEQ ID NO: 62196 - RNA, 25 nt, Artificial Sequence
  Synthetic Oligonucleotide; CD160 exon 3; Set C
ccuggaaaucucaauauuacugucu

SEQ ID NO: 62197 - RNA, 29 nt, Artificial Sequence
  Synthetic Oligonucleotide; CD160 exon 3; Set B
caccuggaaaucucaauauuacugucuca

SEQ ID NO: 62198 - RNA, 31 nt, Artificial Sequence
  Synthetic Oligonucleotide; CD160 exon 3; Set B
gcaccuggaaaucucaauauuacugucucaa

SEQ ID NO: 62199 - RNA, 21 nt, Artificial Sequence
  Synthetic Oligonucleotide; CD160 exon 3; Set C
uggaaaucucaauauuacugu

SEQ ID NO: 62200 - RNA, 26 nt, Artificial Sequence
  Synthetic Oligonucleotide; CD160 exon 3; Set C
accuggaaaucucaauauuacugucu

SEQ ID NO: 62201 - RNA, 28 nt, Artificial Sequence
  Synthetic Oligonucleotide; CD160 exon 3; Set B
caccuggaaaucucaauauuacugucuc

SEQ ID NO: 62202 - RNA, 32 nt, Artificial Sequence
  Synthetic Oligonucleotide; CD160 exon 3; Set B
agcaccuggaaaucucaauauuacugucucaa

SEQ ID NO: 62203 - RNA, 27 nt, Artificial Sequence
  Synthetic Oligonucleotide; CD160 exon 3; Set C
caccuggaaaucucaauauuacugucu

SEQ ID NO: 62204 - RNA, 15 nt, Artificial Sequence
  Synthetic Oligonucleotide; CD160 exon 3; Set C
gaaaucucaauauua

SEQ ID NO: 62205 - RNA, 16 nt, Artificial Sequence
  Synthetic Oligonucleotide; CD160 exon 3; Set C
ggaaaucucaauauua

SEQ ID NO: 62206 - RNA, 15 nt, Artificial Sequence
  Synthetic Oligonucleotide; CD160 exon 3; Set C
ggaaaucucaauauu

SEQ ID NO: 62207 - RNA, 17 nt, Artificial Sequence
  Synthetic Oligonucleotide; CD160 exon 3; Set C
uggaaaucucaauauua

SEQ ID NO: 62208 - RNA, 27 nt, Artificial Sequence
  Synthetic Oligonucleotide; CD160 exon 3; Set B
gcaccuggaaaucucaauauuacuguc

SEQ ID NO: 62209 - RNA, 16 nt, Artificial Sequence
  Synthetic Oligonucleotide; CD160 exon 3; Set C
uggaaaucucaauauu

SEQ ID NO: 62210 - RNA, 18 nt, Artificial Sequence
  Synthetic Oligonucleotide; CD160 exon 3; Set C
cuggaaaucucaauauua

SEQ ID NO: 62211 - RNA, 26 nt, Artificial Sequence
  Synthetic Oligonucleotide; CD160 exon 3; Set B
gcaccuggaaaucucaauauuacugu

SEQ ID NO: 62212 - RNA, 28 nt, Artificial Sequence
  Synthetic Oligonucleotide; CD160 exon 3; Set B
agcaccuggaaaucucaauauuacuguc

SEQ ID NO: 62213 - RNA, 17 nt, Artificial Sequence
  Synthetic Oligonucleotide; CD160 exon 3; Set C
cuggaaaucucaauauu

SEQ ID NO: 62214 - RNA, 15 nt, Artificial Sequence
  Synthetic Oligonucleotide; CD160 exon 3; Set C
uggaaaucucaauau

SEQ ID NO: 62215 - RNA, 19 nt, Artificial Sequence
  Synthetic Oligonucleotide; CD160 exon 3; Set C
ccuggaaaucucaauauua

SEQ ID NO: 62216 - RNA, 27 nt, Artificial Sequence
  Synthetic Oligonucleotide; CD160 exon 3; Set B
agcaccuggaaaucucaauauuacugu

SEQ ID NO: 62217 - RNA, 29 nt, Artificial Sequence
  Synthetic Oligonucleotide; CD160 exon 3; Set B
cagcaccuggaaaucucaauauuacuguc

SEQ ID NO: 62218 - RNA, 18 nt, Artificial Sequence
  Synthetic Oligonucleotide; CD160 exon 3; Set C
ccuggaaaucucaauauu

SEQ ID NO: 62219 - RNA, 16 nt, Artificial Sequence
  Synthetic Oligonucleotide; CD160 exon 3; Set C
cuggaaaucucaauau

SEQ ID NO: 62220 - RNA, 40 nt, Artificial Sequence
  Synthetic Oligonucleotide; CD160 exon 3; Set B
gaaagucagcaccuggaaaucucaauauuacugucucaaa

SEQ ID NO: 62221 - RNA, 20 nt, Artificial Sequence
  Synthetic Oligonucleotide; CD160 exon 3; Set C
accuggaaaucucaauauua

SEQ ID NO: 62222 - RNA, 28 nt, Artificial Sequence
  Synthetic Oligonucleotide; CD160 exon 3; Set B
cagcaccuggaaaucucaauauuacugu

SEQ ID NO: 62223 - RNA, 19 nt, Artificial Sequence
  Synthetic Oligonucleotide; CD160 exon 3; Set C
accuggaaaucucaauauu

SEQ ID NO: 62224 - RNA, 17 nt, Artificial Sequence
  Synthetic Oligonucleotide; CD160 exon 3; Set C
ccuggaaaucucaauau

SEQ ID NO: 62225 - RNA, 15 nt, Artificial Sequence
  Synthetic Oligonucleotide; CD160 exon 3; Set C
cuggaaaucucaaua

SEQ ID NO: 62226 - RNA, 21 nt, Artificial Sequence
  Synthetic Oligonucleotide; CD160 exon 3; Set C
caccuggaaaucucaauauua

SEQ ID NO: 62227 - RNA, 39 nt, Artificial Sequence
  Synthetic Oligonucleotide; CD160 exon 3; Set B
gaaagucagcaccuggaaaucucaauauuacugucucaa

SEQ ID NO: 62228 - RNA, 20 nt, Artificial Sequence
  Synthetic Oligonucleotide; CD160 exon 3; Set C
caccuggaaaucucaauauu

SEQ ID NO: 62229 - RNA, 18 nt, Artificial Sequence
  Synthetic Oligonucleotide; CD160 exon 3; Set C
accuggaaaucucaauau

SEQ ID NO: 62230 - RNA, 16 nt, Artificial Sequence
  Synthetic Oligonucleotide; CD160 exon 3; Set C
ccuggaaaucucaaua

SEQ ID NO: 62231 - RNA, 38 nt, Artificial Sequence
  Synthetic Oligonucleotide; CD160 exon 3; Set B
gaaagucagcaccuggaaaucucaauauuacugucuca

SEQ ID NO: 62232 - RNA, 40 nt, Artificial Sequence
  Synthetic Oligonucleotide; CD160 exon 3; Set C
ggaaagucagcaccuggaaaucucaauauuacugucucaa

SEQ ID NO: 62233 - RNA, 19 nt, Artificial Sequence
  Synthetic Oligonucleotide; CD160 exon 3; Set C
caccuggaaaucucaauau

SEQ ID NO: 62234 - RNA, 17 nt, Artificial Sequence
  Synthetic Oligonucleotide; CD160 exon 3; Set C
accuggaaaucucaaua

SEQ ID NO: 62235 - RNA, 15 nt, Artificial Sequence
  Synthetic Oligonucleotide; CD160 exon 3; Set C
ccuggaaaucucaau

SEQ ID NO: 62236 - RNA, 39 nt, Artificial Sequence
  Synthetic Oligonucleotide; CD160 exon 3; Set C
ggaaagucagcaccuggaaaucucaauauuacugucuca

SEQ ID NO: 62237 - RNA, 37 nt, Artificial Sequence
  Synthetic Oligonucleotide; CD160 exon 3; Set B
gaaagucagcaccuggaaaucucaauauuacugucuc

SEQ ID NO: 62238 - RNA, 33 nt, Artificial Sequence
  Synthetic Oligonucleotide; CD160 exon 3; Set B
aagucagcaccuggaaaucucaauauuacuguc

SEQ ID NO: 62239 - RNA, 18 nt, Artificial Sequence
  Synthetic Oligonucleotide; CD160 exon 3; Set C
caccuggaaaucucaaua

SEQ ID NO: 62240 - RNA, 16 nt, Artificial Sequence
  Synthetic Oligonucleotide; CD160 exon 3; Set C
accuggaaaucucaau

SEQ ID NO: 62241 - RNA, 36 nt, Artificial Sequence
  Synthetic Oligonucleotide; CD160 exon 3; Set B
gaaagucagcaccuggaaaucucaauauuacugucu

SEQ ID NO: 62242 - RNA, 40 nt, Artificial Sequence
  Synthetic Oligonucleotide; CD160 exon 3; Set C
gggaaagucagcaccuggaaaucucaauauuacugucuca

SEQ ID NO: 62243 - RNA, 38 nt, Artificial Sequence
  Synthetic Oligonucleotide; CD160 exon 3; Set C
ggaaagucagcaccuggaaaucucaauauuacugucuc

SEQ ID NO: 62244 - RNA, 32 nt, Artificial Sequence
  Synthetic Oligonucleotide; CD160 exon 3; Set B
aagucagcaccuggaaaucucaauauuacugu

SEQ ID NO: 62245 - RNA, 34 nt, Artificial Sequence
  Synthetic Oligonucleotide; CD160 exon 3; Set B
aaagucagcaccuggaaaucucaauauuacuguc

SEQ ID NO: 62246 - RNA, 17 nt, Artificial Sequence
  Synthetic Oligonucleotide; CD160 exon 3; Set C
caccuggaaaucucaau

SEQ ID NO: 62247 - RNA, 37 nt, Artificial Sequence
  Synthetic Oligonucleotide; CD160 exon 3; Set B
ggaaagucagcaccuggaaaucucaauauuacugucu

SEQ ID NO: 62248 - RNA, 15 nt, Artificial Sequence
  Synthetic Oligonucleotide; CD160 exon 3; Set C
accuggaaaucucaa

SEQ ID NO: 62249 - RNA, 39 nt, Artificial Sequence
  Synthetic Oligonucleotide; CD160 exon 3; Set C
gggaaagucagcaccuggaaaucucaauauuacugucuc

SEQ ID NO: 62250 - RNA, 33 nt, Artificial Sequence
  Synthetic Oligonucleotide; CD160 exon 3; Set B
aaagucagcaccuggaaaucucaauauuacugu

SEQ ID NO: 62251 - RNA, 38 nt, Artificial Sequence
  Synthetic Oligonucleotide; CD160 exon 3; Set C
gggaaagucagcaccuggaaaucucaauauuacugucu

SEQ ID NO: 62252 - RNA, 16 nt, Artificial Sequence
  Synthetic Oligonucleotide; CD160 exon 3; Set C
caccuggaaaucucaa

SEQ ID NO: 62253 - RNA, 40 nt, Artificial Sequence
  Synthetic Oligonucleotide; CD160 exon 3; Set C
ggggaaagucagcaccuggaaaucucaauauuacugucuc

SEQ ID NO: 62254 - RNA, 39 nt, Artificial Sequence
  Synthetic Oligonucleotide; CD160 exon 3; Set C
ggggaaagucagcaccuggaaaucucaauauuacugucu

SEQ ID NO: 62255 - RNA, 15 nt, Artificial Sequence
  Synthetic Oligonucleotide; CD160 exon 3; Set C
caccuggaaaucuca

SEQ ID NO: 62256 - RNA, 35 nt, Artificial Sequence
  Synthetic Oligonucleotide; CD160 exon 3; Set B
ggaaagucagcaccuggaaaucucaauauuacugu

SEQ ID NO: 62257 - RNA, 40 nt, Artificial Sequence
  Synthetic Oligonucleotide; CD160 exon 3; Set C
cggggaaagucagcaccuggaaaucucaauauuacugucu

SEQ ID NO: 62258 - RNA, 36 nt, Artificial Sequence
  Synthetic Oligonucleotide; CD160 exon 3; Set B
gggaaagucagcaccuggaaaucucaauauuacugu

SEQ ID NO: 62259 - RNA, 30 nt, Artificial Sequence
  Synthetic Oligonucleotide; CD160 exon 3; Set B
gaaagucagcaccuggaaaucucaauauua

SEQ ID NO: 62260 - RNA, 29 nt, Artificial Sequence
  Synthetic Oligonucleotide; CD160 exon 3; Set B
gaaagucagcaccuggaaaucucaauauu

SEQ ID NO: 62261 - RNA, 31 nt, Artificial Sequence
  Synthetic Oligonucleotide; CD160 exon 3; Set B
ggaaagucagcaccuggaaaucucaauauua

SEQ ID NO: 62262 - RNA, 30 nt, Artificial Sequence
  Synthetic Oligonucleotide; CD160 exon 3; Set B
ggaaagucagcaccuggaaaucucaauauu

SEQ ID NO: 62263 - RNA, 28 nt, Artificial Sequence
  Synthetic Oligonucleotide; CD160 exon 3; Set B
gaaagucagcaccuggaaaucucaauau

SEQ ID NO: 62264 - RNA, 32 nt, Artificial Sequence
  Synthetic Oligonucleotide; CD160 exon 3; Set B
gggaaagucagcaccuggaaaucucaauauua

SEQ ID NO: 62265 - RNA, 40 nt, Artificial Sequence
  Synthetic Oligonucleotide; CD160 exon 3; Set C
ggcggggaaagucagcaccuggaaaucucaauauuacugu

SEQ ID NO: 62266 - RNA, 31 nt, Artificial Sequence
  Synthetic Oligonucleotide; CD160 exon 3; Set B
gggaaagucagcaccuggaaaucucaauauu

SEQ ID NO: 62267 - RNA, 29 nt, Artificial Sequence
  Synthetic Oligonucleotide; CD160 exon 3; Set B
ggaaagucagcaccuggaaaucucaauau

SEQ ID NO: 62268 - RNA, 27 nt, Artificial Sequence
  Synthetic Oligonucleotide; CD160 exon 3; Set B
gaaagucagcaccuggaaaucucaaua

SEQ ID NO: 62269 - RNA, 33 nt, Artificial Sequence
  Synthetic Oligonucleotide; CD160 exon 3; Set B
ggggaaagucagcaccuggaaaucucaauauua

SEQ ID NO: 62270 - RNA, 32 nt, Artificial Sequence
  Synthetic Oligonucleotide; CD160 exon 3; Set B
ggggaaagucagcaccuggaaaucucaauauu

SEQ ID NO: 62271 - RNA, 30 nt, Artificial Sequence
  Synthetic Oligonucleotide; CD160 exon 3; Set B
gggaaagucagcaccuggaaaucucaauau

SEQ ID NO: 62272 - RNA, 28 nt, Artificial Sequence
  Synthetic Oligonucleotide; CD160 exon 3; Set B
ggaaagucagcaccuggaaaucucaaua

SEQ ID NO: 62273 - RNA, 26 nt, Artificial Sequence
  Synthetic Oligonucleotide; CD160 exon 3; Set C
gaaagucagcaccuggaaaucucaau

SEQ ID NO: 62274 - RNA, 34 nt, Artificial Sequence
  Synthetic Oligonucleotide; CD160 exon 3; Set B
cggggaaagucagcaccuggaaaucucaauauua

SEQ ID NO: 62275 - RNA, 33 nt, Artificial Sequence
  Synthetic Oligonucleotide; CD160 exon 3; Set B
cggggaaagucagcaccuggaaaucucaauauu

SEQ ID NO: 62276 - RNA, 31 nt, Artificial Sequence
  Synthetic Oligonucleotide; CD160 exon 3; Set B
ggggaaagucagcaccuggaaaucucaauau

SEQ ID NO: 62277 - RNA, 29 nt, Artificial Sequence
  Synthetic Oligonucleotide; CD160 exon 3; Set B
gggaaagucagcaccuggaaaucucaaua

SEQ ID NO: 62278 - RNA, 27 nt, Artificial Sequence
  Synthetic Oligonucleotide; CD160 exon 3; Set B
ggaaagucagcaccuggaaaucucaau

SEQ ID NO: 62279 - RNA, 25 nt, Artificial Sequence
  Synthetic Oligonucleotide; CD160 exon 3; Set C
gaaagucagcaccuggaaaucucaa

SEQ ID NO: 62280 - RNA, 34 nt, Artificial Sequence
  Synthetic Oligonucleotide; CD160 exon 3; Set C
gcggggaaagucagcaccuggaaaucucaauauu

SEQ ID NO: 62281 - RNA, 32 nt, Artificial Sequence
  Synthetic Oligonucleotide; CD160 exon 3; Set B
cggggaaagucagcaccuggaaaucucaauau

SEQ ID NO: 62282 - RNA, 30 nt, Artificial Sequence
  Synthetic Oligonucleotide; CD160 exon 3; Set B
ggggaaagucagcaccuggaaaucucaaua

SEQ ID NO: 62283 - RNA, 28 nt, Artificial Sequence
  Synthetic Oligonucleotide; CD160 exon 3; Set B
gggaaagucagcaccuggaaaucucaau

SEQ ID NO: 62284 - RNA, 26 nt, Artificial Sequence
  Synthetic Oligonucleotide; CD160 exon 3; Set B
ggaaagucagcaccuggaaaucucaa

SEQ ID NO: 62285 - RNA, 24 nt, Artificial Sequence
  Synthetic Oligonucleotide; CD160 exon 3; Set B
gaaagucagcaccuggaaaucuca

SEQ ID NO: 62286 - RNA, 33 nt, Artificial Sequence
  Synthetic Oligonucleotide; CD160 exon 3; Set C
gcggggaaagucagcaccuggaaaucucaauau

SEQ ID NO: 62287 - RNA, 23 nt, Artificial Sequence
  Synthetic Oligonucleotide; CD160 exon 3; Set C
gaaagucagcaccuggaaaucuc

SEQ ID NO: 62288 - RNA, 31 nt, Artificial Sequence
  Synthetic Oligonucleotide; CD160 exon 3; Set B
cggggaaagucagcaccuggaaaucucaaua

SEQ ID NO: 62289 - RNA, 29 nt, Artificial Sequence
  Synthetic Oligonucleotide; CD160 exon 3; Set B
ggggaaagucagcaccuggaaaucucaau

SEQ ID NO: 62290 - RNA, 27 nt, Artificial Sequence
  Synthetic Oligonucleotide; CD160 exon 3; Set B
gggaaagucagcaccuggaaaucucaa

SEQ ID NO: 62291 - RNA, 25 nt, Artificial Sequence
  Synthetic Oligonucleotide; CD160 exon 3; Set B
ggaaagucagcaccuggaaaucuca

SEQ ID NO: 62292 - RNA, 24 nt, Artificial Sequence
  Synthetic Oligonucleotide; CD160 exon 3; Set B
ggaaagucagcaccuggaaaucuc

SEQ ID NO: 62293 - RNA, 32 nt, Artificial Sequence
  Synthetic Oligonucleotide; CD160 exon 3; Set C
gcggggaaagucagcaccuggaaaucucaaua

SEQ ID NO: 62294 - RNA, 30 nt, Artificial Sequence
  Synthetic Oligonucleotide; CD160 exon 3; Set B
cggggaaagucagcaccuggaaaucucaau

SEQ ID NO: 62295 - RNA, 22 nt, Artificial Sequence
  Synthetic Oligonucleotide; CD160 exon 3; Set C
gaaagucagcaccuggaaaucu

SEQ ID NO: 62296 - RNA, 38 nt, Artificial Sequence
  Synthetic Oligonucleotide; CD160 exon 3; Set C
cuggcggggaaagucagcaccuggaaaucucaauauua

SEQ ID NO: 62297 - RNA, 26 nt, Artificial Sequence
  Synthetic Oligonucleotide; CD160 exon 3; Set B
gggaaagucagcaccuggaaaucuca

SEQ ID NO: 62298 - RNA, 28 nt, Artificial Sequence
  Synthetic Oligonucleotide; CD160 exon 3; Set B
ggggaaagucagcaccuggaaaucucaa

SEQ ID NO: 62299 - RNA, 25 nt, Artificial Sequence
  Synthetic Oligonucleotide; CD160 exon 3; Set B
gggaaagucagcaccuggaaaucuc

SEQ ID NO: 62300 - RNA, 31 nt, Artificial Sequence
  Synthetic Oligonucleotide; CD160 exon 3; Set C
gcggggaaagucagcaccuggaaaucucaau

SEQ ID NO: 62301 - RNA, 23 nt, Artificial Sequence
  Synthetic Oligonucleotide; CD160 exon 3; Set C
ggaaagucagcaccuggaaaucu

SEQ ID NO: 62302 - RNA, 27 nt, Artificial Sequence
  Synthetic Oligonucleotide; CD160 exon 3; Set B
ggggaaagucagcaccuggaaaucuca

SEQ ID NO: 62303 - RNA, 29 nt, Artificial Sequence
  Synthetic Oligonucleotide; CD160 exon 3; Set B
cggggaaagucagcaccuggaaaucucaa

SEQ ID NO: 62304 - RNA, 21 nt, Artificial Sequence
  Synthetic Oligonucleotide; CD160 exon 3; Set C
gaaagucagcaccuggaaauc

SEQ ID NO: 62305 - RNA, 17 nt, Artificial Sequence
  Synthetic Oligonucleotide; CD160 exon 3; Set C
aagucagcaccuggaaa

SEQ ID NO: 62306 - RNA, 15 nt, Artificial Sequence
  Synthetic Oligonucleotide; CD160 exon 3; Set C
agucagcaccuggaa

SEQ ID NO: 62307 - RNA, 26 nt, Artificial Sequence
  Synthetic Oligonucleotide; CD160 exon 3; Set B
ggggaaagucagcaccuggaaaucuc

SEQ ID NO: 62308 - RNA, 24 nt, Artificial Sequence
  Synthetic Oligonucleotide; CD160 exon 3; Set B
gggaaagucagcaccuggaaaucu

SEQ ID NO: 62309 - RNA, 28 nt, Artificial Sequence
  Synthetic Oligonucleotide; CD160 exon 3; Set C
cggggaaagucagcaccuggaaaucuca

SEQ ID NO: 62310 - RNA, 22 nt, Artificial Sequence
  Synthetic Oligonucleotide; CD160 exon 3; Set C
ggaaagucagcaccuggaaauc

SEQ ID NO: 62311 - RNA, 20 nt, Artificial Sequence
  Synthetic Oligonucleotide; CD160 exon 3; Set C
gaaagucagcaccuggaaau

SEQ ID NO: 62312 - RNA, 18 nt, Artificial Sequence
  Synthetic Oligonucleotide; CD160 exon 3; Set C
aaagucagcaccuggaaa

SEQ ID NO: 62313 - RNA, 27 nt, Artificial Sequence
  Synthetic Oligonucleotide; CD160 exon 3; Set B
cggggaaagucagcaccuggaaaucuc

SEQ ID NO: 62314 - RNA, 25 nt, Artificial Sequence
  Synthetic Oligonucleotide; CD160 exon 3; Set B
ggggaaagucagcaccuggaaaucu

SEQ ID NO: 62315 - RNA, 23 nt, Artificial Sequence
  Synthetic Oligonucleotide; CD160 exon 3; Set B
gggaaagucagcaccuggaaauc

SEQ ID NO: 62316 - RNA, 21 nt, Artificial Sequence
  Synthetic Oligonucleotide; CD160 exon 3; Set C
ggaaagucagcaccuggaaau

SEQ ID NO: 62317 - RNA, 28 nt, Artificial Sequence
  Synthetic Oligonucleotide; CD160 exon 3; Set C
gcggggaaagucagcaccuggaaaucuc

SEQ ID NO: 62318 - RNA, 26 nt, Artificial Sequence
  Synthetic Oligonucleotide; CD160 exon 3; Set B
cggggaaagucagcaccuggaaaucu

SEQ ID NO: 62319 - RNA, 24 nt, Artificial Sequence
  Synthetic Oligonucleotide; CD160 exon 3; Set B
ggggaaagucagcaccuggaaauc

SEQ ID NO: 62320 - RNA, 22 nt, Artificial Sequence
  Synthetic Oligonucleotide; CD160 exon 3; Set C
gggaaagucagcaccuggaaau

SEQ ID NO: 62321 - RNA, 20 nt, Artificial Sequence
  Synthetic Oligonucleotide; CD160 exon 3; Set C
ggaaagucagcaccuggaaa

SEQ ID NO: 62322 - RNA, 33 nt, Artificial Sequence
  Synthetic Oligonucleotide; CD160 exon 3; Set C
cuggcggggaaagucagcaccuggaaaucucaa

SEQ ID NO: 62323 - RNA, 25 nt, Artificial Sequence
  Synthetic Oligonucleotide; CD160 exon 3; Set B
cggggaaagucagcaccuggaaauc

SEQ ID NO: 62324 - RNA, 21 nt, Artificial Sequence
  Synthetic Oligonucleotide; CD160 exon 3; Set C
gggaaagucagcaccuggaaa

SEQ ID NO: 62325 - RNA, 32 nt, Artificial Sequence
  Synthetic Oligonucleotide; CD160 exon 3; Set C
cuggcggggaaagucagcaccuggaaaucuca

SEQ ID NO: 62326 - RNA, 30 nt, Artificial Sequence
  Synthetic Oligonucleotide; CD160 exon 3; Set C
cuggcggggaaagucagcaccuggaaaucu

SEQ ID NO: 62327 - RNA, 29 nt, Artificial Sequence
  Synthetic Oligonucleotide; CD160 exon 3; Set C
cuggcggggaaagucagcaccuggaaauc

SEQ ID NO: 62328 - RNA, 25 nt, Artificial Sequence
  Synthetic Oligonucleotide; CD160 exon 3; Set C
ggcggggaaagucagcaccuggaaa

SEQ ID NO: 62329 - RNA, 28 nt, Artificial Sequence
  Synthetic Oligonucleotide; CD160 exon 3; Set C
cuggcggggaaagucagcaccuggaaau

SEQ ID NO: 62330 - RNA, 26 nt, Artificial Sequence
  Synthetic Oligonucleotide; CD160 exon 3; Set C
uggcggggaaagucagcaccuggaaa

SEQ ID NO: 62331 - RNA, 27 nt, Artificial Sequence
  Synthetic Oligonucleotide; CD160 exon 3; Set C
cuggcggggaaagucagcaccuggaaa

SEQ ID NO: 62332 - RNA, 40 nt, Artificial Sequence
  Synthetic Oligonucleotide; CD160 exon 3; Set C
cuucagugacuggcggggaaagucagcaccuggaaaucuc

SEQ ID NO: 62333 - RNA, 17 nt, Artificial Sequence
  Synthetic Oligonucleotide; CD160 exon 3; Set B
ggcggggaaagucagca

SEQ ID NO: 62334 - RNA, 34 nt, Artificial Sequence
  Synthetic Oligonucleotide; CD160 exon 3; Set C
ucagugacuggcggggaaagucagcaccuggaaa

SEQ ID NO: 62335 - RNA, 16 nt, Artificial Sequence
  Synthetic Oligonucleotide; CD160 exon 3; Set C
ggcggggaaagucagc

SEQ ID NO: 62336 - RNA, 18 nt, Artificial Sequence
  Synthetic Oligonucleotide; CD160 exon 3; Set B
uggcggggaaagucagca

SEQ ID NO: 62337 - RNA, 35 nt, Artificial Sequence
  Synthetic Oligonucleotide; CD160 exon 3; Set C
uucagugacuggcggggaaagucagcaccuggaaa

SEQ ID NO: 62338 - RNA, 15 nt, Artificial Sequence
  Synthetic Oligonucleotide; CD160 exon 3; Set C
ggcggggaaagucag

SEQ ID NO: 62339 - RNA, 17 nt, Artificial Sequence
  Synthetic Oligonucleotide; CD160 exon 3; Set C
uggcggggaaagucagc

SEQ ID NO: 62340 - RNA, 19 nt, Artificial Sequence
  Synthetic Oligonucleotide; CD160 exon 3; Set B
cuggcggggaaagucagca

SEQ ID NO: 62341 - RNA, 16 nt, Artificial Sequence
  Synthetic Oligonucleotide; CD160 exon 3; Set C
uggcggggaaagucag

SEQ ID NO: 62342 - RNA, 18 nt, Artificial Sequence
  Synthetic Oligonucleotide; CD160 exon 3; Set B
cuggcggggaaagucagc

SEQ ID NO: 62343 - RNA, 15 nt, Artificial Sequence
  Synthetic Oligonucleotide; CD160 exon 3; Set C
uggcggggaaaguca

SEQ ID NO: 62344 - RNA, 17 nt, Artificial Sequence
  Synthetic Oligonucleotide; CD160 exon 3; Set C
cuggcggggaaagucag

SEQ ID NO: 62345 - RNA, 16 nt, Artificial Sequence
  Synthetic Oligonucleotide; CD160 exon 3; Set C
cuggcggggaaaguca

SEQ ID NO: 62346 - RNA, 15 nt, Artificial Sequence
  Synthetic Oligonucleotide; CD160 exon 3; Set C
cuggcggggaaaguc

SEQ ID NO: 62347 - RNA, 26 nt, Artificial Sequence
  Synthetic Oligonucleotide; CD160 exon 3; Set C
ucagugacuggcggggaaagucagca

SEQ ID NO: 62348 - RNA, 25 nt, Artificial Sequence
  Synthetic Oligonucleotide; CD160 exon 3; Set C
ucagugacuggcggggaaagucagc

SEQ ID NO: 62349 - RNA, 27 nt, Artificial Sequence
  Synthetic Oligonucleotide; CD160 exon 3; Set C
uucagugacuggcggggaaagucagca

SEQ ID NO: 62350 - RNA, 24 nt, Artificial Sequence
  Synthetic Oligonucleotide; CD160 exon 3; Set B
ucagugacuggcggggaaagucag

SEQ ID NO: 62351 - RNA, 26 nt, Artificial Sequence
  Synthetic Oligonucleotide; CD160 exon 3; Set C
uucagugacuggcggggaaagucagc

SEQ ID NO: 62352 - RNA, 23 nt, Artificial Sequence
  Synthetic Oligonucleotide; CD160 exon 3; Set B
ucagugacuggcggggaaaguca

SEQ ID NO: 62353 - RNA, 25 nt, Artificial Sequence
  Synthetic Oligonucleotide; CD160 exon 3; Set B
uucagugacuggcggggaaagucag

SEQ ID NO: 62354 - RNA, 22 nt, Artificial Sequence
  Synthetic Oligonucleotide; CD160 exon 3; Set B
ucagugacuggcggggaaaguc

SEQ ID NO: 62355 - RNA, 24 nt, Artificial Sequence
  Synthetic Oligonucleotide; CD160 exon 3; Set B
uucagugacuggcggggaaaguca

SEQ ID NO: 62356 - RNA, 23 nt, Artificial Sequence
  Synthetic Oligonucleotide; CD160 exon 3; Set B
uucagugacuggcggggaaaguc

SEQ ID NO: 62357 - RNA, 21 nt, Artificial Sequence
  Synthetic Oligonucleotide; CD160 exon 3; Set B
ucagugacuggcggggaaagu

SEQ ID NO: 62358 - RNA, 22 nt, Artificial Sequence
  Synthetic Oligonucleotide; CD160 exon 3; Set B
uucagugacuggcggggaaagu

SEQ ID NO: 62359 - RNA, 21 nt, Artificial Sequence
  Synthetic Oligonucleotide; CD160 exon 3; Set B
uucagugacuggcggggaaag

SEQ ID NO: 62360 - RNA, 20 nt, Artificial Sequence
  Synthetic Oligonucleotide; CD160 exon 3; Set B
uucagugacuggcggggaaa

SEQ ID NO: 62361 - RNA, 15 nt, Artificial Sequence
  Synthetic Oligonucleotide; CD160 exon 3; Set C
guucaggucccacuu

SEQ ID NO: 62362 - RNA, 31 nt, Artificial Sequence
  Synthetic Oligonucleotide; CD160 exon 3; Set C
ccagugucuuccccagagauccacacaguuc

SEQ ID NO: 62363 - RNA, 32 nt, Artificial Sequence
  Synthetic Oligonucleotide; CD160 exon 3; Set C
gccagugucuuccccagagauccacacaguuc

SEQ ID NO: 62364 - RNA, 33 nt, Artificial Sequence
  Synthetic Oligonucleotide; CD160 exon 3; Set C
agccagugucuuccccagagauccacacaguuc

SEQ ID NO: 62365 - RNA, 40 nt, Artificial Sequence
  Synthetic Oligonucleotide; CD160 exon 3; Set C
agagggagccagugucuuccccagagauccacacaguuca

SEQ ID NO: 62366 - RNA, 39 nt, Artificial Sequence
  Synthetic Oligonucleotide; CD160 exon 3; Set C
agagggagccagugucuuccccagagauccacacaguuc

SEQ ID NO: 62367 - RNA, 38 nt, Artificial Sequence
  Synthetic Oligonucleotide; CD160 exon 3; Set C
agagggagccagugucuuccccagagauccacacaguu

SEQ ID NO: 62368 - RNA, 39 nt, Artificial Sequence
  Synthetic Oligonucleotide; CD160 exon 3; Set C
uagagggagccagugucuuccccagagauccacacaguu

SEQ ID NO: 62369 - RNA, 40 nt, Artificial Sequence
  Synthetic Oligonucleotide; CD160 exon 3; Set C
uuagagggagccagugucuuccccagagauccacacaguu

SEQ ID NO: 62370 - RNA, 18 nt, Artificial Sequence
  Synthetic Oligonucleotide; CD160 exon 3; Set A
gagggagccagugucuuc

SEQ ID NO: 62371 - RNA, 15 nt, Artificial Sequence
  Synthetic Oligonucleotide; CD160 exon 3; Set C
agagggagccagugu

SEQ ID NO: 62372 - RNA, 24 nt, Artificial Sequence
  Synthetic Oligonucleotide; CD160 exon 3; Set A
acauuagagggagccagugucuuc

SEQ ID NO: 62373 - RNA, 20 nt, Artificial Sequence
  Synthetic Oligonucleotide; CD160 exon 3; Set A
acauuagagggagccagugu

SEQ ID NO: 62374 - RNA, 19 nt, Artificial Sequence
  Synthetic Oligonucleotide; CD160 exon 3; Set C
acauuagagggagccagug

SEQ ID NO: 62375 - RNA, 30 nt, Artificial Sequence
  Synthetic Oligonucleotide; CD160 exon 3; Set C
ccuaggacauuagagggagccagugucuuc

SEQ ID NO: 62376 - RNA, 18 nt, Artificial Sequence
  Synthetic Oligonucleotide; CD160 exon 3; Set C
acauuagagggagccagu

SEQ ID NO: 62377 - RNA, 31 nt, Artificial Sequence
  Synthetic Oligonucleotide; CD160 exon 3; Set C
accuaggacauuagagggagccagugucuuc

SEQ ID NO: 62378 - RNA, 17 nt, Artificial Sequence
  Synthetic Oligonucleotide; CD160 exon 3; Set C
acauuagagggagccag

SEQ ID NO: 62379 - RNA, 16 nt, Artificial Sequence
  Synthetic Oligonucleotide; CD160 exon 3; Set C
acauuagagggagcca

SEQ ID NO: 62380 - RNA, 28 nt, Artificial Sequence
  Synthetic Oligonucleotide; CD160 exon 3; Set C
uaccuaggacauuagagggagccagugu

SEQ ID NO: 62381 - RNA, 29 nt, Artificial Sequence
  Synthetic Oligonucleotide; CD160 exon 3; Set C
guaccuaggacauuagagggagccagugu

SEQ ID NO: 62382 - RNA, 20 nt, Artificial Sequence
  Synthetic Oligonucleotide; CD160 exon 3; Set A
cuaggacauuagagggagcc

SEQ ID NO: 62383 - RNA, 22 nt, Artificial Sequence
  Synthetic Oligonucleotide; CD160 exon 3; Set A
ccuaggacauuagagggagcca

SEQ ID NO: 62384 - RNA, 28 nt, Artificial Sequence
  Synthetic Oligonucleotide; CD160 exon 3; Set C
guaccuaggacauuagagggagccagug

SEQ ID NO: 62385 - RNA, 30 nt, Artificial Sequence
  Synthetic Oligonucleotide; CD160 exon 3; Set C
aguaccuaggacauuagagggagccagugu

SEQ ID NO: 62386 - RNA, 21 nt, Artificial Sequence
  Synthetic Oligonucleotide; CD160 exon 3; Set A
ccuaggacauuagagggagcc

SEQ ID NO: 62387 - RNA, 39 nt, Artificial Sequence
  Synthetic Oligonucleotide; CD160 exon 3; Set C
uccacaguaccuaggacauuagagggagccagugucuuc

SEQ ID NO: 62388 - RNA, 23 nt, Artificial Sequence
  Synthetic Oligonucleotide; CD160 exon 3; Set A
accuaggacauuagagggagcca

SEQ ID NO: 62389 - RNA, 27 nt, Artificial Sequence
  Synthetic Oligonucleotide; CD160 exon 3; Set C
guaccuaggacauuagagggagccagu

SEQ ID NO: 62390 - RNA, 29 nt, Artificial Sequence
  Synthetic Oligonucleotide; CD160 exon 3; Set C
aguaccuaggacauuagagggagccagug

SEQ ID NO: 62391 - RNA, 25 nt, Artificial Sequence
  Synthetic Oligonucleotide; CD160 exon 3; Set A
uaccuaggacauuagagggagccag

SEQ ID NO: 62392 - RNA, 22 nt, Artificial Sequence
  Synthetic Oligonucleotide; CD160 exon 3; Set A
accuaggacauuagagggagcc

SEQ ID NO: 62393 - RNA, 20 nt, Artificial Sequence
  Synthetic Oligonucleotide; CD160 exon 3; Set A
ccuaggacauuagagggagc

SEQ ID NO: 62394 - RNA, 28 nt, Artificial Sequence
  Synthetic Oligonucleotide; CD160 exon 3; Set C
aguaccuaggacauuagagggagccagu

SEQ ID NO: 62395 - RNA, 26 nt, Artificial Sequence
  Synthetic Oligonucleotide; CD160 exon 3; Set A
guaccuaggacauuagagggagccag

SEQ ID NO: 62396 - RNA, 21 nt, Artificial Sequence
  Synthetic Oligonucleotide; CD160 exon 3; Set A
accuaggacauuagagggagc

SEQ ID NO: 62397 - RNA, 27 nt, Artificial Sequence
  Synthetic Oligonucleotide; CD160 exon 3; Set A
aguaccuaggacauuagagggagccag

SEQ ID NO: 62398 - RNA, 35 nt, Artificial Sequence
  Synthetic Oligonucleotide; CD160 exon 3; Set C
uccacaguaccuaggacauuagagggagccagugu

SEQ ID NO: 62399 - RNA, 21 nt, Artificial Sequence
  Synthetic Oligonucleotide; CD160 exon 3; Set C
uaccuaggacauuagagggag

SEQ ID NO: 62400 - RNA, 34 nt, Artificial Sequence
  Synthetic Oligonucleotide; CD160 exon 3; Set C
uccacaguaccuaggacauuagagggagccagug

SEQ ID NO: 62401 - RNA, 22 nt, Artificial Sequence
  Synthetic Oligonucleotide; CD160 exon 3; Set A
guaccuaggacauuagagggag

SEQ ID NO: 62402 - RNA, 33 nt, Artificial Sequence
  Synthetic Oligonucleotide; CD160 exon 3; Set C
uccacaguaccuaggacauuagagggagccagu

SEQ ID NO: 62403 - RNA, 23 nt, Artificial Sequence
  Synthetic Oligonucleotide; CD160 exon 3; Set A
aguaccuaggacauuagagggag

SEQ ID NO: 62404 - RNA, 32 nt, Artificial Sequence
  Synthetic Oligonucleotide; CD160 exon 3; Set C
uccacaguaccuaggacauuagagggagccag

SEQ ID NO: 62405 - RNA, 15 nt, Artificial Sequence
  Synthetic Oligonucleotide; CD160 exon 3; Set C
accuaggacauuaga

SEQ ID NO: 62406 - RNA, 31 nt, Artificial Sequence
  Synthetic Oligonucleotide; CD160 exon 3; Set C
uccacaguaccuaggacauuagagggagcca

SEQ ID NO: 62407 - RNA, 17 nt, Artificial Sequence
  Synthetic Oligonucleotide; CD160 exon 3; Set C
uaccuaggacauuagag

SEQ ID NO: 62408 - RNA, 30 nt, Artificial Sequence
  Synthetic Oligonucleotide; CD160 exon 3; Set C
uccacaguaccuaggacauuagagggagcc

SEQ ID NO: 62409 - RNA, 18 nt, Artificial Sequence
  Synthetic Oligonucleotide; CD160 exon 3; Set C
guaccuaggacauuagag

SEQ ID NO: 62410 - RNA, 29 nt, Artificial Sequence
  Synthetic Oligonucleotide; CD160 exon 3; Set C
uccacaguaccuaggacauuagagggagc

SEQ ID NO: 62411 - RNA, 19 nt, Artificial Sequence
  Synthetic Oligonucleotide; CD160 exon 3; Set C
aguaccuaggacauuagag

SEQ ID NO: 62412 - RNA, 28 nt, Artificial Sequence
  Synthetic Oligonucleotide; CD160 exon 3; Set C
uccacaguaccuaggacauuagagggag

SEQ ID NO: 62413 - RNA, 24 nt, Artificial Sequence
  Synthetic Oligonucleotide; CD160 exon 3; Set A
uccacaguaccuaggacauuagag

SEQ ID NO: 62414 - RNA, 37 nt, Artificial Sequence
  Synthetic Oligonucleotide; CD160 exon 3; Set C
uaaaaguccuccacaguaccuaggacauuagagggag

SEQ ID NO: 62415 - RNA, 18 nt, Artificial Sequence
  Synthetic Oligonucleotide; CD160 exon 3; Set C
uccacaguaccuaggaca

SEQ ID NO: 62416 - RNA, 33 nt, Artificial Sequence
  Synthetic Oligonucleotide; CD160 exon 3; Set A
uaaaaguccuccacaguaccuaggacauuagag

SEQ ID NO: 62417 - RNA, 27 nt, Artificial Sequence
  Synthetic Oligonucleotide; CD160 exon 3; Set A
uaaaaguccuccacaguaccuaggaca

SEQ ID NO: 62418 - RNA, 39 nt, Artificial Sequence
  Synthetic Oligonucleotide; CD160 exon 3; Set C
cugcucauaaaaguccuccacaguaccuaggacauuaga

SEQ ID NO: 62419 - RNA, 38 nt, Artificial Sequence
  Synthetic Oligonucleotide; CD160 exon 3; Set C
cugcucauaaaaguccuccacaguaccuaggacauuag

SEQ ID NO: 62420 - RNA, 40 nt, Artificial Sequence
  Synthetic Oligonucleotide; CD160 exon 3; Set C
acugcucauaaaaguccuccacaguaccuaggacauuaga

SEQ ID NO: 62421 - RNA, 37 nt, Artificial Sequence
  Synthetic Oligonucleotide; CD160 exon 3; Set C
cugcucauaaaaguccuccacaguaccuaggacauua

SEQ ID NO: 62422 - RNA, 39 nt, Artificial Sequence
  Synthetic Oligonucleotide; CD160 exon 3; Set C
acugcucauaaaaguccuccacaguaccuaggacauuag

SEQ ID NO: 62423 - RNA, 38 nt, Artificial Sequence
  Synthetic Oligonucleotide; CD160 exon 3; Set C
acugcucauaaaaguccuccacaguaccuaggacauua

SEQ ID NO: 62424 - RNA, 40 nt, Artificial Sequence
  Synthetic Oligonucleotide; CD160 exon 3; Set C
uacugcucauaaaaguccuccacaguaccuaggacauuag

SEQ ID NO: 62425 - RNA, 22 nt, Artificial Sequence
  Synthetic Oligonucleotide; CD160 exon 3; Set C
uaaaaguccuccacaguaccua

SEQ ID NO: 62426 - RNA, 35 nt, Artificial Sequence
  Synthetic Oligonucleotide; CD160 exon 3; Set C
cugcucauaaaaguccuccacaguaccuaggacau

SEQ ID NO: 62427 - RNA, 39 nt, Artificial Sequence
  Synthetic Oligonucleotide; CD160 exon 3; Set C
uacugcucauaaaaguccuccacaguaccuaggacauua

SEQ ID NO: 62428 - RNA, 21 nt, Artificial Sequence
  Synthetic Oligonucleotide; CD160 exon 3; Set C
uaaaaguccuccacaguaccu

SEQ ID NO: 62429 - RNA, 36 nt, Artificial Sequence
  Synthetic Oligonucleotide; CD160 exon 3; Set C
acugcucauaaaaguccuccacaguaccuaggacau

SEQ ID NO: 62430 - RNA, 34 nt, Artificial Sequence
  Synthetic Oligonucleotide; CD160 exon 3; Set C
cugcucauaaaaguccuccacaguaccuaggaca

SEQ ID NO: 62431 - RNA, 20 nt, Artificial Sequence
  Synthetic Oligonucleotide; CD160 exon 3; Set C
uaaaaguccuccacaguacc

SEQ ID NO: 62432 - RNA, 37 nt, Artificial Sequence
  Synthetic Oligonucleotide; CD160 exon 3; Set C
uacugcucauaaaaguccuccacaguaccuaggacau

SEQ ID NO: 62433 - RNA, 35 nt, Artificial Sequence
  Synthetic Oligonucleotide; CD160 exon 3; Set C
acugcucauaaaaguccuccacaguaccuaggaca

SEQ ID NO: 62434 - RNA, 40 nt, Artificial Sequence
  Synthetic Oligonucleotide; CD160 exon 3; Set C
gauacugcucauaaaaguccuccacaguaccuaggacauu

SEQ ID NO: 62435 - RNA, 38 nt, Artificial Sequence
  Synthetic Oligonucleotide; CD160 exon 3; Set C
auacugcucauaaaaguccuccacaguaccuaggacau

SEQ ID NO: 62436 - RNA, 36 nt, Artificial Sequence
  Synthetic Oligonucleotide; CD160 exon 3; Set C
uacugcucauaaaaguccuccacaguaccuaggaca

SEQ ID NO: 62437 - RNA, 37 nt, Artificial Sequence
  Synthetic Oligonucleotide; CD160 exon 3; Set C
auacugcucauaaaaguccuccacaguaccuaggaca

SEQ ID NO: 62438 - RNA, 26 nt, Artificial Sequence
  Synthetic Oligonucleotide; CD160 exon 3; Set A
cugcucauaaaaguccuccacaguac

SEQ ID NO: 62439 - RNA, 27 nt, Artificial Sequence
  Synthetic Oligonucleotide; CD160 exon 3; Set A
acugcucauaaaaguccuccacaguac

SEQ ID NO: 62440 - RNA, 25 nt, Artificial Sequence
  Synthetic Oligonucleotide; CD160 exon 3; Set A
cugcucauaaaaguccuccacagua

SEQ ID NO: 62441 - RNA, 28 nt, Artificial Sequence
  Synthetic Oligonucleotide; CD160 exon 3; Set A
uacugcucauaaaaguccuccacaguac

SEQ ID NO: 62442 - RNA, 26 nt, Artificial Sequence
  Synthetic Oligonucleotide; CD160 exon 3; Set A
acugcucauaaaaguccuccacagua

SEQ ID NO: 62443 - RNA, 24 nt, Artificial Sequence
  Synthetic Oligonucleotide; CD160 exon 3; Set A
cugcucauaaaaguccuccacagu

SEQ ID NO: 62444 - RNA, 29 nt, Artificial Sequence
  Synthetic Oligonucleotide; CD160 exon 3; Set A
auacugcucauaaaaguccuccacaguac

SEQ ID NO: 62445 - RNA, 27 nt, Artificial Sequence
  Synthetic Oligonucleotide; CD160 exon 3; Set A
uacugcucauaaaaguccuccacagua

SEQ ID NO: 62446 - RNA, 25 nt, Artificial Sequence
  Synthetic Oligonucleotide; CD160 exon 3; Set A
acugcucauaaaaguccuccacagu

SEQ ID NO: 62447 - RNA, 28 nt, Artificial Sequence
  Synthetic Oligonucleotide; CD160 exon 3; Set A
auacugcucauaaaaguccuccacagua

SEQ ID NO: 62448 - RNA, 26 nt, Artificial Sequence
  Synthetic Oligonucleotide; CD160 exon 3; Set A
uacugcucauaaaaguccuccacagu

SEQ ID NO: 62449 - RNA, 27 nt, Artificial Sequence
  Synthetic Oligonucleotide; CD160 exon 3; Set A
auacugcucauaaaaguccuccacagu

SEQ ID NO: 62450 - RNA, 39 nt, Artificial Sequence
  Synthetic Oligonucleotide; CD160 exon 3; Set A
aaaaugagauacugcucauaaaaguccuccacaguaccu

SEQ ID NO: 62451 - RNA, 38 nt, Artificial Sequence
  Synthetic Oligonucleotide; CD160 exon 3; Set A
aaaaugagauacugcucauaaaaguccuccacaguacc

SEQ ID NO: 62452 - RNA, 36 nt, Artificial Sequence
  Synthetic Oligonucleotide; CD160 exon 3; Set A
aaaaugagauacugcucauaaaaguccuccacagua

SEQ ID NO: 62453 - RNA, 35 nt, Artificial Sequence
  Synthetic Oligonucleotide; CD160 exon 3; Set A
aaaaugagauacugcucauaaaaguccuccacagu

SEQ ID NO: 62454 - RNA, 40 nt, Artificial Sequence
  Synthetic Oligonucleotide; CD160 exon 3; Set A
gauucaaaaugagauacugcucauaaaaguccuccacagu

SEQ ID NO: 62455 - RNA, 26 nt, Artificial Sequence
  Synthetic Oligonucleotide; CD160 exon 3; Set C
gauucaaaaugagauacugcucauaa

SEQ ID NO: 62456 - RNA, 27 nt, Artificial Sequence
  Synthetic Oligonucleotide; CD160 exon 3; Set C
ggauucaaaaugagauacugcucauaa

SEQ ID NO: 62457 - RNA, 28 nt, Artificial Sequence
  Synthetic Oligonucleotide; CD160 exon 3; Set C
aggauucaaaaugagauacugcucauaa

SEQ ID NO: 62458 - RNA, 29 nt, Artificial Sequence
  Synthetic Oligonucleotide; CD160 exon 3; Set C
aaggauucaaaaugagauacugcucauaa

SEQ ID NO: 62459 - RNA, 30 nt, Artificial Sequence
  Synthetic Oligonucleotide; CD160 exon 3; Set C
caaggauucaaaaugagauacugcucauaa

SEQ ID NO: 62460 - RNA, 31 nt, Artificial Sequence
  Synthetic Oligonucleotide; CD160 exon 3; Set A
gcaaggauucaaaaugagauacugcucauaa

SEQ ID NO: 62461 - RNA, 20 nt, Artificial Sequence
  Synthetic Oligonucleotide; CD160 exon 3; Set C
ggauucaaaaugagauacug

SEQ ID NO: 62462 - RNA, 19 nt, Artificial Sequence
  Synthetic Oligonucleotide; CD160 exon 3; Set C
ggauucaaaaugagauacu

SEQ ID NO: 62463 - RNA, 21 nt, Artificial Sequence
  Synthetic Oligonucleotide; CD160 exon 3; Set C
aggauucaaaaugagauacug

SEQ ID NO: 62464 - RNA, 36 nt, Artificial Sequence
  Synthetic Oligonucleotide; CD160 exon 3; Set A
ugggugcaaggauucaaaaugagauacugcucauaa

SEQ ID NO: 62465 - RNA, 18 nt, Artificial Sequence
  Synthetic Oligonucleotide; CD160 exon 3; Set C
ggauucaaaaugagauac

SEQ ID NO: 62466 - RNA, 20 nt, Artificial Sequence
  Synthetic Oligonucleotide; CD160 exon 3; Set C
aggauucaaaaugagauacu

SEQ ID NO: 62467 - RNA, 22 nt, Artificial Sequence
  Synthetic Oligonucleotide; CD160 exon 3; Set C
aaggauucaaaaugagauacug

SEQ ID NO: 62468 - RNA, 17 nt, Artificial Sequence
  Synthetic Oligonucleotide; CD160 exon 3; Set C
ggauucaaaaugagaua

SEQ ID NO: 62469 - RNA, 19 nt, Artificial Sequence
  Synthetic Oligonucleotide; CD160 exon 3; Set C
aggauucaaaaugagauac

SEQ ID NO: 62470 - RNA, 21 nt, Artificial Sequence
  Synthetic Oligonucleotide; CD160 exon 3; Set C
aaggauucaaaaugagauacu

SEQ ID NO: 62471 - RNA, 15 nt, Artificial Sequence
  Synthetic Oligonucleotide; CD160 exon 3; Set C
gauucaaaaugagau

SEQ ID NO: 62472 - RNA, 18 nt, Artificial Sequence
  Synthetic Oligonucleotide; CD160 exon 3; Set C
aggauucaaaaugagaua

SEQ ID NO: 62473 - RNA, 20 nt, Artificial Sequence
  Synthetic Oligonucleotide; CD160 exon 3; Set C
aaggauucaaaaugagauac

SEQ ID NO: 62474 - RNA, 19 nt, Artificial Sequence
  Synthetic Oligonucleotide; CD160 exon 3; Set C
aaggauucaaaaugagaua

SEQ ID NO: 62475 - RNA, 19 nt, Artificial Sequence
  Synthetic Oligonucleotide; CD160 exon 3; Set C
caaggauucaaaaugagau

SEQ ID NO: 62476 - RNA, 20 nt, Artificial Sequence
  Synthetic Oligonucleotide; CD160 exon 3; Set C
gcaaggauucaaaaugagau

SEQ ID NO: 62477 - RNA, 25 nt, Artificial Sequence
  Synthetic Oligonucleotide; CD160 exon 3; Set C
ugggugcaaggauucaaaaugagau

SEQ ID NO: 62478 - RNA, 26 nt, Artificial Sequence
  Synthetic Oligonucleotide; CD160 exon 3; Set A
gugggugcaaggauucaaaaugagau

SEQ ID NO: 62479 - RNA, 27 nt, Artificial Sequence
  Synthetic Oligonucleotide; CD160 exon 3; Set A
agugggugcaaggauucaaaaugagau

SEQ ID NO: 62480 - RNA, 36 nt, Artificial Sequence
  Synthetic Oligonucleotide; CD160 exon 3; Set A
aacccagugggugcaaggauucaaaaugagauacug

SEQ ID NO: 62481 - RNA, 35 nt, Artificial Sequence
  Synthetic Oligonucleotide; CD160 exon 3; Set A
aacccagugggugcaaggauucaaaaugagauacu

SEQ ID NO: 62482 - RNA, 34 nt, Artificial Sequence
  Synthetic Oligonucleotide; CD160 exon 3; Set A
aacccagugggugcaaggauucaaaaugagauac

SEQ ID NO: 62483 - RNA, 33 nt, Artificial Sequence
  Synthetic Oligonucleotide; CD160 exon 3; Set A
aacccagugggugcaaggauucaaaaugagaua

SEQ ID NO: 62484 - RNA, 18 nt, Artificial Sequence
  Synthetic Oligonucleotide; CD160 exon 3; Set C
gugggugcaaggauucaa

SEQ ID NO: 62485 - RNA, 21 nt, Artificial Sequence
  Synthetic Oligonucleotide; CD160 exon 3; Set C
cagugggugcaaggauucaaa

SEQ ID NO: 62486 - RNA, 19 nt, Artificial Sequence
  Synthetic Oligonucleotide; CD160 exon 3; Set C
agugggugcaaggauucaa

SEQ ID NO: 62487 - RNA, 40 nt, Artificial Sequence
  Synthetic Oligonucleotide; CD160 exon 3; Set C
cuacccaacccagugggugcaaggauucaaaaugagauac

SEQ ID NO: 62488 - RNA, 39 nt, Artificial Sequence
  Synthetic Oligonucleotide; CD160 exon 3; Set C
cuacccaacccagugggugcaaggauucaaaaugagaua

SEQ ID NO: 62489 - RNA, 15 nt, Artificial Sequence
  Synthetic Oligonucleotide; CD160 exon 3; Set C
gugggugcaaggauu

SEQ ID NO: 62490 - RNA, 24 nt, Artificial Sequence
  Synthetic Oligonucleotide; CD160 exon 3; Set A
acccagugggugcaaggauucaaa

SEQ ID NO: 62491 - RNA, 16 nt, Artificial Sequence
  Synthetic Oligonucleotide; CD160 exon 3; Set C
agugggugcaaggauu

SEQ ID NO: 62492 - RNA, 39 nt, Artificial Sequence
  Synthetic Oligonucleotide; CD160 exon 3; Set C
ccuacccaacccagugggugcaaggauucaaaaugagau

SEQ ID NO: 62493 - RNA, 40 nt, Artificial Sequence
  Synthetic Oligonucleotide; CD160 exon 3; Set C
accuacccaacccagugggugcaaggauucaaaaugagau

SEQ ID NO: 62494 - RNA, 19 nt, Artificial Sequence
  Synthetic Oligonucleotide; CD160 exon 3; Set A
aacccagugggugcaagga

SEQ ID NO: 62495 - RNA, 18 nt, Artificial Sequence
  Synthetic Oligonucleotide; CD160 exon 3; Set C
aacccagugggugcaagg

SEQ ID NO: 62496 - RNA, 17 nt, Artificial Sequence
  Synthetic Oligonucleotide; CD160 exon 3; Set C
aacccagugggugcaag

SEQ ID NO: 62497 - RNA, 16 nt, Artificial Sequence
  Synthetic Oligonucleotide; CD160 exon 3; Set C
aacccagugggugcaa

SEQ ID NO: 62498 - RNA, 15 nt, Artificial Sequence
  Synthetic Oligonucleotide; CD160 exon 3; Set C
aacccagugggugca

SEQ ID NO: 62499 - RNA, 26 nt, Artificial Sequence
  Synthetic Oligonucleotide; CD160 exon 3; Set C
cuacccaacccagugggugcaaggau

SEQ ID NO: 62500 - RNA, 26 nt, Artificial Sequence
  Synthetic Oligonucleotide; CD160 exon 3; Set C
ccuacccaacccagugggugcaagga

SEQ ID NO: 62501 - RNA, 25 nt, Artificial Sequence
  Synthetic Oligonucleotide; CD160 exon 3; Set C
ccuacccaacccagugggugcaagg

SEQ ID NO: 62502 - RNA, 27 nt, Artificial Sequence
  Synthetic Oligonucleotide; CD160 exon 3; Set C
accuacccaacccagugggugcaagga

SEQ ID NO: 62503 - RNA, 26 nt, Artificial Sequence
  Synthetic Oligonucleotide; CD160 exon 3; Set C
accuacccaacccagugggugcaagg

SEQ ID NO: 62504 - RNA, 24 nt, Artificial Sequence
  Synthetic Oligonucleotide; CD160 exon 3; Set C
ccuacccaacccagugggugcaag

SEQ ID NO: 62505 - RNA, 27 nt, Artificial Sequence
  Synthetic Oligonucleotide; CD160 exon 3; Set C
caccuacccaacccagugggugcaagg

SEQ ID NO: 62506 - RNA, 25 nt, Artificial Sequence
  Synthetic Oligonucleotide; CD160 exon 3; Set C
accuacccaacccagugggugcaag

SEQ ID NO: 62507 - RNA, 39 nt, Artificial Sequence
  Synthetic Oligonucleotide; CD160 exon 3; Set C
uuguaacaccuacccaacccagugggugcaaggauucaa

SEQ ID NO: 62508 - RNA, 22 nt, Artificial Sequence
  Synthetic Oligonucleotide; CD160 exon 3; Set C
ccuacccaacccagugggugca

SEQ ID NO: 62509 - RNA, 26 nt, Artificial Sequence
  Synthetic Oligonucleotide; CD160 exon 3; Set C
caccuacccaacccagugggugcaag

SEQ ID NO: 62510 - RNA, 23 nt, Artificial Sequence
  Synthetic Oligonucleotide; CD160 exon 3; Set C
accuacccaacccagugggugca

SEQ ID NO: 62511 - RNA, 35 nt, Artificial Sequence
  Synthetic Oligonucleotide; CD160 exon 3; Set C
uguaacaccuacccaacccagugggugcaaggauu

SEQ ID NO: 62512 - RNA, 24 nt, Artificial Sequence
  Synthetic Oligonucleotide; CD160 exon 3; Set C
caccuacccaacccagugggugca

SEQ ID NO: 62513 - RNA, 36 nt, Artificial Sequence
  Synthetic Oligonucleotide; CD160 exon 3; Set C
uuguaacaccuacccaacccagugggugcaaggauu

SEQ ID NO: 62514 - RNA, 15 nt, Artificial Sequence
  Synthetic Oligonucleotide; CD160 exon 3; Set C
cuacccaacccagug

SEQ ID NO: 62515 - RNA, 17 nt, Artificial Sequence
  Synthetic Oligonucleotide; CD160 exon 3; Set C
ccuacccaacccagugg

SEQ ID NO: 62516 - RNA, 18 nt, Artificial Sequence
  Synthetic Oligonucleotide; CD160 exon 3; Set A
accuacccaacccagugg

SEQ ID NO: 62517 - RNA, 19 nt, Artificial Sequence
  Synthetic Oligonucleotide; CD160 exon 3; Set A
caccuacccaacccagugg

SEQ ID NO: 62518 - RNA, 40 nt, Artificial Sequence
  Synthetic Oligonucleotide; CD160 exon 3; Set C
gaaugggcauuguaacaccuacccaacccagugggugcaa

SEQ ID NO: 62519 - RNA, 39 nt, Artificial Sequence
  Synthetic Oligonucleotide; CD160 exon 3; Set C
gaaugggcauuguaacaccuacccaacccagugggugca

SEQ ID NO: 62520 - RNA, 15 nt, Artificial Sequence
  Synthetic Oligonucleotide; CD160 exon 3; Set C
uaacaccuacccaac

SEQ ID NO: 62521 - RNA, 40 nt, Artificial Sequence
  Synthetic Oligonucleotide; CD160 exon 3; Set C
ugaaugggcauuguaacaccuacccaacccagugggugca

SEQ ID NO: 62522 - RNA, 16 nt, Artificial Sequence
  Synthetic Oligonucleotide; CD160 exon 3; Set C
guaacaccuacccaac

SEQ ID NO: 62523 - RNA, 17 nt, Artificial Sequence
  Synthetic Oligonucleotide; CD160 exon 3; Set C
uguaacaccuacccaac

SEQ ID NO: 62524 - RNA, 18 nt, Artificial Sequence
  Synthetic Oligonucleotide; CD160 exon 3; Set C
uuguaacaccuacccaac

SEQ ID NO: 62525 - RNA, 32 nt, Artificial Sequence
  Synthetic Oligonucleotide; CD160 exon 3; Set C
aaugggcauuguaacaccuacccaacccagug

SEQ ID NO: 62526 - RNA, 34 nt, Artificial Sequence
  Synthetic Oligonucleotide; CD160 exon 3; Set C
gaaugggcauuguaacaccuacccaacccagugg

SEQ ID NO: 62527 - RNA, 31 nt, Artificial Sequence
  Synthetic Oligonucleotide; CD160 exon 3; Set C
aaugggcauuguaacaccuacccaacccagu

SEQ ID NO: 62528 - RNA, 33 nt, Artificial Sequence
  Synthetic Oligonucleotide; CD160 exon 3; Set C
gaaugggcauuguaacaccuacccaacccagug

SEQ ID NO: 62529 - RNA, 35 nt, Artificial Sequence
  Synthetic Oligonucleotide; CD160 exon 3; Set C
ugaaugggcauuguaacaccuacccaacccagugg

SEQ ID NO: 62530 - RNA, 32 nt, Artificial Sequence
  Synthetic Oligonucleotide; CD160 exon 3; Set C
gaaugggcauuguaacaccuacccaacccagu

SEQ ID NO: 62531 - RNA, 34 nt, Artificial Sequence
  Synthetic Oligonucleotide; CD160 exon 3; Set C
ugaaugggcauuguaacaccuacccaacccagug

SEQ ID NO: 62532 - RNA, 33 nt, Artificial Sequence
  Synthetic Oligonucleotide; CD160 exon 3; Set C
ugaaugggcauuguaacaccuacccaacccagu

SEQ ID NO: 62533 - RNA, 38 nt, Artificial Sequence
  Synthetic Oligonucleotide; CD160 exon 3; Set C
uuuugaaugggcauuguaacaccuacccaacccagugg

SEQ ID NO: 62534 - RNA, 38 nt, Artificial Sequence
  Synthetic Oligonucleotide; CD160 exon 3; Set C
uuuuugaaugggcauuguaacaccuacccaacccagug

SEQ ID NO: 62535 - RNA, 37 nt, Artificial Sequence
  Synthetic Oligonucleotide; CD160 exon 3; Set C
uuuuugaaugggcauuguaacaccuacccaacccagu

SEQ ID NO: 62536 - RNA, 29 nt, Artificial Sequence
  Synthetic Oligonucleotide; CD160 exon 3; Set A
uugaaugggcauuguaacaccuacccaac

SEQ ID NO: 62537 - RNA, 30 nt, Artificial Sequence
  Synthetic Oligonucleotide; CD160 exon 3; Set A
uuugaaugggcauuguaacaccuacccaac

SEQ ID NO: 62538 - RNA, 31 nt, Artificial Sequence
  Synthetic Oligonucleotide; CD160 exon 3; Set A
uuuugaaugggcauuguaacaccuacccaac

SEQ ID NO: 62539 - RNA, 20 nt, Artificial Sequence
  Synthetic Oligonucleotide; CD160 exon 3; Set C
aaugggcauuguaacaccua

SEQ ID NO: 62540 - RNA, 19 nt, Artificial Sequence
  Synthetic Oligonucleotide; CD160 exon 3; Set C
aaugggcauuguaacaccu

SEQ ID NO: 62541 - RNA, 21 nt, Artificial Sequence
  Synthetic Oligonucleotide; CD160 exon 3; Set C
gaaugggcauuguaacaccua

SEQ ID NO: 62542 - RNA, 18 nt, Artificial Sequence
  Synthetic Oligonucleotide; CD160 exon 3; Set C
aaugggcauuguaacacc

SEQ ID NO: 62543 - RNA, 22 nt, Artificial Sequence
  Synthetic Oligonucleotide; CD160 exon 3; Set C
ugaaugggcauuguaacaccua

SEQ ID NO: 62544 - RNA, 17 nt, Artificial Sequence
  Synthetic Oligonucleotide; CD160 exon 3; Set C
aaugggcauuguaacac

SEQ ID NO: 62545 - RNA, 16 nt, Artificial Sequence
  Synthetic Oligonucleotide; CD160 exon 3; Set C
aaugggcauuguaaca

SEQ ID NO: 62546 - RNA, 15 nt, Artificial Sequence
  Synthetic Oligonucleotide; CD160 exon 3; Set C
aaugggcauuguaac

SEQ ID NO: 62547 - RNA, 25 nt, Artificial Sequence
  Synthetic Oligonucleotide; CD160 exon 3; Set A
uuuugaaugggcauuguaacaccua

SEQ ID NO: 62548 - RNA, 26 nt, Artificial Sequence
  Synthetic Oligonucleotide; CD160 exon 3; Set A
uuuuugaaugggcauuguaacaccua

SEQ ID NO: 62549 - RNA, 38 nt, Artificial Sequence
  Synthetic Oligonucleotide; CD160 exon 3; Set C
uugccauuuuugaaugggcauuguaacaccuacccaac

SEQ ID NO: 62550 - RNA, 25 nt, Artificial Sequence
  Synthetic Oligonucleotide; CD160 exon 3; Set C
uuuuugaaugggcauuguaacaccu

SEQ ID NO: 62551 - RNA, 39 nt, Artificial Sequence
  Synthetic Oligonucleotide; CD160 exon 3; Set C
uuugccauuuuugaaugggcauuguaacaccuacccaac

SEQ ID NO: 62552 - RNA, 24 nt, Artificial Sequence
  Synthetic Oligonucleotide; CD160 exon 3; Set C
uuuuugaaugggcauuguaacacc

SEQ ID NO: 62553 - RNA, 23 nt, Artificial Sequence
  Synthetic Oligonucleotide; CD160 exon 3; Set C
uuuuugaaugggcauuguaacac

SEQ ID NO: 62554 - RNA, 22 nt, Artificial Sequence
  Synthetic Oligonucleotide; CD160 exon 3; Set C
uuuuugaaugggcauuguaaca

SEQ ID NO: 62555 - RNA, 21 nt, Artificial Sequence
  Synthetic Oligonucleotide; CD160 exon 3; Set C
uuuuugaaugggcauuguaac

SEQ ID NO: 62556 - RNA, 20 nt, Artificial Sequence
  Synthetic Oligonucleotide; CD160 exon 3; Set C
uuuuugaaugggcauuguaa

SEQ ID NO: 62557 - RNA, 19 nt, Artificial Sequence
  Synthetic Oligonucleotide; CD160 exon 3; Set C
uuuuugaaugggcauugua

SEQ ID NO: 62558 - RNA, 18 nt, Artificial Sequence
  Synthetic Oligonucleotide; CD160 exon 3; Set C
uuuuugaaugggcauugu

SEQ ID NO: 62559 - RNA, 17 nt, Artificial Sequence
  Synthetic Oligonucleotide; CD160 exon 3; Set C
uuuuugaaugggcauug

SEQ ID NO: 62560 - RNA, 38 nt, Artificial Sequence
  Synthetic Oligonucleotide; CD160 exon 3; Set C
gcuugcuuugccauuuuugaaugggcauuguaacaccu

SEQ ID NO: 62561 - RNA, 37 nt, Artificial Sequence
  Synthetic Oligonucleotide; CD160 exon 3; Set C
gcuugcuuugccauuuuugaaugggcauuguaacacc

SEQ ID NO: 62562 - RNA, 35 nt, Artificial Sequence
  Synthetic Oligonucleotide; CD160 exon 3; Set C
gcuugcuuugccauuuuugaaugggcauuguaaca

SEQ ID NO: 62563 - RNA, 40 nt, Artificial Sequence
  Synthetic Oligonucleotide; CD160 exon 3; Set C
ugagcuugcuuugccauuuuugaaugggcauuguaacacc

SEQ ID NO: 62564 - RNA, 39 nt, Artificial Sequence
  Synthetic Oligonucleotide; CD160 exon 3; Set C
ugagcuugcuuugccauuuuugaaugggcauuguaacac

SEQ ID NO: 62565 - RNA, 38 nt, Artificial Sequence
  Synthetic Oligonucleotide; CD160 exon 3; Set C
ugagcuugcuuugccauuuuugaaugggcauuguaaca

SEQ ID NO: 62566 - RNA, 37 nt, Artificial Sequence
  Synthetic Oligonucleotide; CD160 exon 3; Set C
ugagcuugcuuugccauuuuugaaugggcauuguaac

SEQ ID NO: 62567 - RNA, 36 nt, Artificial Sequence
  Synthetic Oligonucleotide; CD160 exon 3; Set C
ugagcuugcuuugccauuuuugaaugggcauuguaa

SEQ ID NO: 62568 - RNA, 35 nt, Artificial Sequence
  Synthetic Oligonucleotide; CD160 exon 3; Set C
ugagcuugcuuugccauuuuugaaugggcauugua

SEQ ID NO: 62569 - RNA, 34 nt, Artificial Sequence
  Synthetic Oligonucleotide; CD160 exon 3; Set C
ugagcuugcuuugccauuuuugaaugggcauugu

SEQ ID NO: 62570 - RNA, 16 nt, Artificial Sequence
  Synthetic Oligonucleotide; CD160 exon 3; Set C
uuugccauuuuugaau

SEQ ID NO: 62571 - RNA, 21 nt, Artificial Sequence
  Synthetic Oligonucleotide; CD160 exon 3; Set C
cuugcuuugccauuuuugaau

SEQ ID NO: 62572 - RNA, 16 nt, Artificial Sequence
  Synthetic Oligonucleotide; CD160 exon 3; Set C
cuugcuuugccauuuu

SEQ ID NO: 62573 - RNA, 22 nt, Artificial Sequence
  Synthetic Oligonucleotide; CD160 exon 3; Set C
ugagcuugcuuugccauuuuug

SEQ ID NO: 62574 - RNA, 21 nt, Artificial Sequence
  Synthetic Oligonucleotide; CD160 exon 3; Set C
ugagcuugcuuugccauuuuu

SEQ ID NO: 62575 - RNA, 35 nt, Artificial Sequence
  Synthetic Oligonucleotide; CD160 exon 3; Set A
guugaacuucugagcuugcuuugccauuuuugaau

SEQ ID NO: 62576 - RNA, 34 nt, Artificial Sequence
  Synthetic Oligonucleotide; CD160 exon 3; Set A
guugaacuucugagcuugcuuugccauuuuugaa

SEQ ID NO: 62577 - RNA, 33 nt, Artificial Sequence
  Synthetic Oligonucleotide; CD160 exon 3; Set C
guugaacuucugagcuugcuuugccauuuuuga

SEQ ID NO: 62578 - RNA, 39 nt, Artificial Sequence
  Synthetic Oligonucleotide; CD160 exon 3; Set C
ccugguugaacuucugagcuugcuuugccauuuuugaau

SEQ ID NO: 62579 - RNA, 30 nt, Artificial Sequence
  Synthetic Oligonucleotide; CD160 exon 3; Set A
guugaacuucugagcuugcuuugccauuuu

SEQ ID NO: 62580 - RNA, 38 nt, Artificial Sequence
  Synthetic Oligonucleotide; CD160 exon 3; Set C
ccugguugaacuucugagcuugcuuugccauuuuugaa

SEQ ID NO: 62581 - RNA, 40 nt, Artificial Sequence
  Synthetic Oligonucleotide; CD160 exon 3; Set C
accugguugaacuucugagcuugcuuugccauuuuugaau

SEQ ID NO: 62582 - RNA, 39 nt, Artificial Sequence
  Synthetic Oligonucleotide; CD160 exon 3; Set C
accugguugaacuucugagcuugcuuugccauuuuugaa

SEQ ID NO: 62583 - RNA, 37 nt, Artificial Sequence
  Synthetic Oligonucleotide; CD160 exon 3; Set C
ccugguugaacuucugagcuugcuuugccauuuuuga

SEQ ID NO: 62584 - RNA, 40 nt, Artificial Sequence
  Synthetic Oligonucleotide; CD160 exon 3; Set C
aaccugguugaacuucugagcuugcuuugccauuuuugaa

SEQ ID NO: 62585 - RNA, 38 nt, Artificial Sequence
  Synthetic Oligonucleotide; CD160 exon 3; Set C
accugguugaacuucugagcuugcuuugccauuuuuga

SEQ ID NO: 62586 - RNA, 39 nt, Artificial Sequence
  Synthetic Oligonucleotide; CD160 exon 3; Set C
aaccugguugaacuucugagcuugcuuugccauuuuuga

SEQ ID NO: 62587 - RNA, 34 nt, Artificial Sequence
  Synthetic Oligonucleotide; CD160 exon 3; Set C
ccugguugaacuucugagcuugcuuugccauuuu

SEQ ID NO: 62588 - RNA, 40 nt, Artificial Sequence
  Synthetic Oligonucleotide; CD160 exon 3; Set C
aaaccugguugaacuucugagcuugcuuugccauuuuuga

SEQ ID NO: 62589 - RNA, 35 nt, Artificial Sequence
  Synthetic Oligonucleotide; CD160 exon 3; Set C
accugguugaacuucugagcuugcuuugccauuuu

SEQ ID NO: 62590 - RNA, 36 nt, Artificial Sequence
  Synthetic Oligonucleotide; CD160 exon 3; Set C
aaccugguugaacuucugagcuugcuuugccauuuu

SEQ ID NO: 62591 - RNA, 34 nt, Artificial Sequence
  Synthetic Oligonucleotide; CD160 exon 3; Set C
accugguugaacuucugagcuugcuuugccauuu

SEQ ID NO: 62592 - RNA, 37 nt, Artificial Sequence
  Synthetic Oligonucleotide; CD160 exon 3; Set C
aaaccugguugaacuucugagcuugcuuugccauuuu

SEQ ID NO: 62593 - RNA, 35 nt, Artificial Sequence
  Synthetic Oligonucleotide; CD160 exon 3; Set C
aaccugguugaacuucugagcuugcuuugccauuu

SEQ ID NO: 62594 - RNA, 22 nt, Artificial Sequence
  Synthetic Oligonucleotide; CD160 exon 3; Set C
guugaacuucugagcuugcuuu

SEQ ID NO: 62595 - RNA, 38 nt, Artificial Sequence
  Synthetic Oligonucleotide; CD160 exon 3; Set C
caaaccugguugaacuucugagcuugcuuugccauuuu

SEQ ID NO: 62596 - RNA, 36 nt, Artificial Sequence
  Synthetic Oligonucleotide; CD160 exon 3; Set C
aaaccugguugaacuucugagcuugcuuugccauuu

SEQ ID NO: 62597 - RNA, 39 nt, Artificial Sequence
  Synthetic Oligonucleotide; CD160 exon 3; Set C
ucaaaccugguugaacuucugagcuugcuuugccauuuu

SEQ ID NO: 62598 - RNA, 40 nt, Artificial Sequence
  Synthetic Oligonucleotide; CD160 exon 3; Set C
cucaaaccugguugaacuucugagcuugcuuugccauuuu

SEQ ID NO: 62599 - RNA, 38 nt, Artificial Sequence
  Synthetic Oligonucleotide; CD160 exon 3; Set C
ucaaaccugguugaacuucugagcuugcuuugccauuu

SEQ ID NO: 62600 - RNA, 39 nt, Artificial Sequence
  Synthetic Oligonucleotide; CD160 exon 3; Set C
cucaaaccugguugaacuucugagcuugcuuugccauuu

SEQ ID NO: 62601 - RNA, 26 nt, Artificial Sequence
  Synthetic Oligonucleotide; CD160 exon 3; Set A
ccugguugaacuucugagcuugcuuu

SEQ ID NO: 62602 - RNA, 40 nt, Artificial Sequence
  Synthetic Oligonucleotide; CD160 exon 3; Set C
ucucaaaccugguugaacuucugagcuugcuuugccauuu

SEQ ID NO: 62603 - RNA, 26 nt, Artificial Sequence
  Synthetic Oligonucleotide; CD160 exon 3; Set A
cucaaaccugguugaacuucugagcu

SEQ ID NO: 62604 - RNA, 27 nt, Artificial Sequence
  Synthetic Oligonucleotide; CD160 exon 3; Set A
ucucaaaccugguugaacuucugagcu

SEQ ID NO: 62605 - RNA, 24 nt, Artificial Sequence
  Synthetic Oligonucleotide; CD160 exon 3; Set C
ucucaaaccugguugaacuucuga

SEQ ID NO: 62606 - RNA, 33 nt, Artificial Sequence
  Synthetic Oligonucleotide; CD160 exon 3; Set C
uuacugucucaaaccugguugaacuucugagcu

SEQ ID NO: 62607 - RNA, 34 nt, Artificial Sequence
  Synthetic Oligonucleotide; CD160 exon 3; Set A
auuacugucucaaaccugguugaacuucugagcu

SEQ ID NO: 62608 - RNA, 32 nt, Artificial Sequence
  Synthetic Oligonucleotide; CD160 exon 3; Set A
uuacugucucaaaccugguugaacuucugagc

SEQ ID NO: 62609 - RNA, 35 nt, Artificial Sequence
  Synthetic Oligonucleotide; CD160 exon 3; Set C
uauuacugucucaaaccugguugaacuucugagcu

SEQ ID NO: 62610 - RNA, 33 nt, Artificial Sequence
  Synthetic Oligonucleotide; CD160 exon 3; Set A
auuacugucucaaaccugguugaacuucugagc

SEQ ID NO: 62611 - RNA, 30 nt, Artificial Sequence
  Synthetic Oligonucleotide; CD160 exon 3; Set B
uuacugucucaaaccugguugaacuucuga

SEQ ID NO: 62612 - RNA, 36 nt, Artificial Sequence
  Synthetic Oligonucleotide; CD160 exon 3; Set C
auauuacugucucaaaccugguugaacuucugagcu

SEQ ID NO: 62613 - RNA, 34 nt, Artificial Sequence
  Synthetic Oligonucleotide; CD160 exon 3; Set A
uauuacugucucaaaccugguugaacuucugagc

SEQ ID NO: 62614 - RNA, 32 nt, Artificial Sequence
  Synthetic Oligonucleotide; CD160 exon 3; Set A
auuacugucucaaaccugguugaacuucugag

SEQ ID NO: 62615 - RNA, 31 nt, Artificial Sequence
  Synthetic Oligonucleotide; CD160 exon 3; Set B
auuacugucucaaaccugguugaacuucuga

SEQ ID NO: 62616 - RNA, 37 nt, Artificial Sequence
  Synthetic Oligonucleotide; CD160 exon 3; Set A
aauauuacugucucaaaccugguugaacuucugagcu

SEQ ID NO: 62617 - RNA, 35 nt, Artificial Sequence
  Synthetic Oligonucleotide; CD160 exon 3; Set A
auauuacugucucaaaccugguugaacuucugagc

SEQ ID NO: 62618 - RNA, 33 nt, Artificial Sequence
  Synthetic Oligonucleotide; CD160 exon 3; Set A
uauuacugucucaaaccugguugaacuucugag

SEQ ID NO: 62619 - RNA, 32 nt, Artificial Sequence
  Synthetic Oligonucleotide; CD160 exon 3; Set B
uauuacugucucaaaccugguugaacuucuga

SEQ ID NO: 62620 - RNA, 38 nt, Artificial Sequence
  Synthetic Oligonucleotide; CD160 exon 3; Set C
caauauuacugucucaaaccugguugaacuucugagcu

SEQ ID NO: 62621 - RNA, 36 nt, Artificial Sequence
  Synthetic Oligonucleotide; CD160 exon 3; Set A
aauauuacugucucaaaccugguugaacuucugagc

SEQ ID NO: 62622 - RNA, 34 nt, Artificial Sequence
  Synthetic Oligonucleotide; CD160 exon 3; Set A
auauuacugucucaaaccugguugaacuucugag

SEQ ID NO: 62623 - RNA, 33 nt, Artificial Sequence
  Synthetic Oligonucleotide; CD160 exon 3; Set B
auauuacugucucaaaccugguugaacuucuga

SEQ ID NO: 62624 - RNA, 39 nt, Artificial Sequence
  Synthetic Oligonucleotide; CD160 exon 3; Set C
ucaauauuacugucucaaaccugguugaacuucugagcu

SEQ ID NO: 62625 - RNA, 37 nt, Artificial Sequence
  Synthetic Oligonucleotide; CD160 exon 3; Set A
caauauuacugucucaaaccugguugaacuucugagc

SEQ ID NO: 62626 - RNA, 35 nt, Artificial Sequence
  Synthetic Oligonucleotide; CD160 exon 3; Set A
aauauuacugucucaaaccugguugaacuucugag

SEQ ID NO: 62627 - RNA, 34 nt, Artificial Sequence
  Synthetic Oligonucleotide; CD160 exon 3; Set B
aauauuacugucucaaaccugguugaacuucuga

SEQ ID NO: 62628 - RNA, 40 nt, Artificial Sequence
  Synthetic Oligonucleotide; CD160 exon 3; Set C
cucaauauuacugucucaaaccugguugaacuucugagcu

SEQ ID NO: 62629 - RNA, 38 nt, Artificial Sequence
  Synthetic Oligonucleotide; CD160 exon 3; Set C
ucaauauuacugucucaaaccugguugaacuucugagc

SEQ ID NO: 62630 - RNA, 36 nt, Artificial Sequence
  Synthetic Oligonucleotide; CD160 exon 3; Set A
caauauuacugucucaaaccugguugaacuucugag

SEQ ID NO: 62631 - RNA, 35 nt, Artificial Sequence
  Synthetic Oligonucleotide; CD160 exon 3; Set B
caauauuacugucucaaaccugguugaacuucuga

SEQ ID NO: 62632 - RNA, 39 nt, Artificial Sequence
  Synthetic Oligonucleotide; CD160 exon 3; Set C
cucaauauuacugucucaaaccugguugaacuucugagc

SEQ ID NO: 62633 - RNA, 37 nt, Artificial Sequence
  Synthetic Oligonucleotide; CD160 exon 3; Set A
ucaauauuacugucucaaaccugguugaacuucugag

SEQ ID NO: 62634 - RNA, 36 nt, Artificial Sequence
  Synthetic Oligonucleotide; CD160 exon 3; Set B
ucaauauuacugucucaaaccugguugaacuucuga

SEQ ID NO: 62635 - RNA, 40 nt, Artificial Sequence
  Synthetic Oligonucleotide; CD160 exon 3; Set C
ucucaauauuacugucucaaaccugguugaacuucugagc

SEQ ID NO: 62636 - RNA, 38 nt, Artificial Sequence
  Synthetic Oligonucleotide; CD160 exon 3; Set A
cucaauauuacugucucaaaccugguugaacuucugag

SEQ ID NO: 62637 - RNA, 17 nt, Artificial Sequence
  Synthetic Oligonucleotide; CD160 exon 3; Set C
cugucucaaaccugguu

SEQ ID NO: 62638 - RNA, 37 nt, Artificial Sequence
  Synthetic Oligonucleotide; CD160 exon 3; Set B
cucaauauuacugucucaaaccugguugaacuucuga

SEQ ID NO: 62639 - RNA, 39 nt, Artificial Sequence
  Synthetic Oligonucleotide; CD160 exon 3; Set A
ucucaauauuacugucucaaaccugguugaacuucugag

SEQ ID NO: 62640 - RNA, 18 nt, Artificial Sequence
  Synthetic Oligonucleotide; CD160 exon 3; Set C
acugucucaaaccugguu

SEQ ID NO: 62641 - RNA, 38 nt, Artificial Sequence
  Synthetic Oligonucleotide; CD160 exon 3; Set B
ucucaauauuacugucucaaaccugguugaacuucuga

SEQ ID NO: 62642 - RNA, 40 nt, Artificial Sequence
  Synthetic Oligonucleotide; CD160 exon 3; Set A
aucucaauauuacugucucaaaccugguugaacuucugag

SEQ ID NO: 62643 - RNA, 19 nt, Artificial Sequence
  Synthetic Oligonucleotide; CD160 exon 3; Set C
uacugucucaaaccugguu

SEQ ID NO: 62644 - RNA, 39 nt, Artificial Sequence
  Synthetic Oligonucleotide; CD160 exon 3; Set B
aucucaauauuacugucucaaaccugguugaacuucuga

SEQ ID NO: 62645 - RNA, 40 nt, Artificial Sequence
  Synthetic Oligonucleotide; CD160 exon 3; Set B
aaucucaauauuacugucucaaaccugguugaacuucuga

SEQ ID NO: 62646 - RNA, 19 nt, Artificial Sequence
  Synthetic Oligonucleotide; CD160 exon 3; Set C
uuacugucucaaaccuggu

SEQ ID NO: 62647 - RNA, 18 nt, Artificial Sequence
  Synthetic Oligonucleotide; CD160 exon 3; Set C
uuacugucucaaaccugg

SEQ ID NO: 62648 - RNA, 20 nt, Artificial Sequence
  Synthetic Oligonucleotide; CD160 exon 3; Set C
auuacugucucaaaccuggu

SEQ ID NO: 62649 - RNA, 15 nt, Artificial Sequence
  Synthetic Oligonucleotide; CD160 exon 3; Set C
uacugucucaaaccu

SEQ ID NO: 62650 - RNA, 19 nt, Artificial Sequence
  Synthetic Oligonucleotide; CD160 exon 3; Set C
auuacugucucaaaccugg

SEQ ID NO: 62651 - RNA, 17 nt, Artificial Sequence
  Synthetic Oligonucleotide; CD160 exon 3; Set C
uuacugucucaaaccug

SEQ ID NO: 62652 - RNA, 21 nt, Artificial Sequence
  Synthetic Oligonucleotide; CD160 exon 3; Set C
uauuacugucucaaaccuggu

SEQ ID NO: 62653 - RNA, 18 nt, Artificial Sequence
  Synthetic Oligonucleotide; CD160 exon 3; Set C
auuacugucucaaaccug

SEQ ID NO: 62654 - RNA, 20 nt, Artificial Sequence
  Synthetic Oligonucleotide; CD160 exon 3; Set C
uauuacugucucaaaccugg

SEQ ID NO: 62655 - RNA, 22 nt, Artificial Sequence
  Synthetic Oligonucleotide; CD160 exon 3; Set C
auauuacugucucaaaccuggu

SEQ ID NO: 62656 - RNA, 19 nt, Artificial Sequence
  Synthetic Oligonucleotide; CD160 exon 3; Set C
uauuacugucucaaaccug

SEQ ID NO: 62657 - RNA, 21 nt, Artificial Sequence
  Synthetic Oligonucleotide; CD160 exon 3; Set C
auauuacugucucaaaccugg

SEQ ID NO: 62658 - RNA, 23 nt, Artificial Sequence
  Synthetic Oligonucleotide; CD160 exon 3; Set C
aauauuacugucucaaaccuggu

SEQ ID NO: 62659 - RNA, 20 nt, Artificial Sequence
  Synthetic Oligonucleotide; CD160 exon 3; Set C
auauuacugucucaaaccug

SEQ ID NO: 62660 - RNA, 22 nt, Artificial Sequence
  Synthetic Oligonucleotide; CD160 exon 3; Set C
aauauuacugucucaaaccugg

SEQ ID NO: 62661 - RNA, 24 nt, Artificial Sequence
  Synthetic Oligonucleotide; CD160 exon 3; Set C
caauauuacugucucaaaccuggu

SEQ ID NO: 62662 - RNA, 21 nt, Artificial Sequence
  Synthetic Oligonucleotide; CD160 exon 3; Set C
aauauuacugucucaaaccug

SEQ ID NO: 62663 - RNA, 23 nt, Artificial Sequence
  Synthetic Oligonucleotide; CD160 exon 3; Set C
caauauuacugucucaaaccugg

SEQ ID NO: 62664 - RNA, 25 nt, Artificial Sequence
  Synthetic Oligonucleotide; CD160 exon 3; Set C
ucaauauuacugucucaaaccuggu

SEQ ID NO: 62665 - RNA, 24 nt, Artificial Sequence
  Synthetic Oligonucleotide; CD160 exon 3; Set C
ucaauauuacugucucaaaccugg

SEQ ID NO: 62666 - RNA, 22 nt, Artificial Sequence
  Synthetic Oligonucleotide; CD160 exon 3; Set C
caauauuacugucucaaaccug

SEQ ID NO: 62667 - RNA, 26 nt, Artificial Sequence
  Synthetic Oligonucleotide; CD160 exon 3; Set C
cucaauauuacugucucaaaccuggu

SEQ ID NO: 62668 - RNA, 25 nt, Artificial Sequence
  Synthetic Oligonucleotide; CD160 exon 3; Set C
cucaauauuacugucucaaaccugg

SEQ ID NO: 62669 - RNA, 23 nt, Artificial Sequence
  Synthetic Oligonucleotide; CD160 exon 3; Set C
ucaauauuacugucucaaaccug

SEQ ID NO: 62670 - RNA, 27 nt, Artificial Sequence
  Synthetic Oligonucleotide; CD160 exon 3; Set B
ucucaauauuacugucucaaaccuggu

SEQ ID NO: 62671 - RNA, 24 nt, Artificial Sequence
  Synthetic Oligonucleotide; CD160 exon 3; Set C
cucaauauuacugucucaaaccug

SEQ ID NO: 62672 - RNA, 26 nt, Artificial Sequence
  Synthetic Oligonucleotide; CD160 exon 3; Set C
ucucaauauuacugucucaaaccugg

SEQ ID NO: 62673 - RNA, 28 nt, Artificial Sequence
  Synthetic Oligonucleotide; CD160 exon 3; Set B
aucucaauauuacugucucaaaccuggu

SEQ ID NO: 62674 - RNA, 25 nt, Artificial Sequence
  Synthetic Oligonucleotide; CD160 exon 3; Set C
ucucaauauuacugucucaaaccug

SEQ ID NO: 62675 - RNA, 27 nt, Artificial Sequence
  Synthetic Oligonucleotide; CD160 exon 3; Set C
aucucaauauuacugucucaaaccugg

SEQ ID NO: 62676 - RNA, 29 nt, Artificial Sequence
  Synthetic Oligonucleotide; CD160 exon 3; Set C
aaucucaauauuacugucucaaaccuggu

SEQ ID NO: 62677 - RNA, 26 nt, Artificial Sequence
  Synthetic Oligonucleotide; CD160 exon 3; Set C
aucucaauauuacugucucaaaccug

SEQ ID NO: 62678 - RNA, 28 nt, Artificial Sequence
  Synthetic Oligonucleotide; CD160 exon 3; Set C
aaucucaauauuacugucucaaaccugg

SEQ ID NO: 62679 - RNA, 30 nt, Artificial Sequence
  Synthetic Oligonucleotide; CD160 exon 3; Set C
aaaucucaauauuacugucucaaaccuggu

SEQ ID NO: 62680 - RNA, 27 nt, Artificial Sequence
  Synthetic Oligonucleotide; CD160 exon 3; Set C
aaucucaauauuacugucucaaaccug

SEQ ID NO: 62681 - RNA, 29 nt, Artificial Sequence
  Synthetic Oligonucleotide; CD160 exon 3; Set C
aaaucucaauauuacugucucaaaccugg

SEQ ID NO: 62682 - RNA, 28 nt, Artificial Sequence
  Synthetic Oligonucleotide; CD160 exon 3; Set C
aaaucucaauauuacugucucaaaccug

SEQ ID NO: 62683 - RNA, 32 nt, Artificial Sequence
  Synthetic Oligonucleotide; CD160 exon 3; Set B
ccuggaaaucucaauauuacugucucaaaccu

SEQ ID NO: 62684 - RNA, 33 nt, Artificial Sequence
  Synthetic Oligonucleotide; CD160 exon 3; Set B
accuggaaaucucaauauuacugucucaaaccu

SEQ ID NO: 62685 - RNA, 27 nt, Artificial Sequence
  Synthetic Oligonucleotide; CD160 exon 3; Set C
cuggaaaucucaauauuacugucucaa

SEQ ID NO: 62686 - RNA, 15 nt, Artificial Sequence
  Synthetic Oligonucleotide; CD160 exon 3; Set C
aucucaauauuacug

SEQ ID NO: 62687 - RNA, 28 nt, Artificial Sequence
  Synthetic Oligonucleotide; CD160 exon 3; Set C
ccuggaaaucucaauauuacugucucaa

SEQ ID NO: 62688 - RNA, 16 nt, Artificial Sequence
  Synthetic Oligonucleotide; CD160 exon 3; Set C
aaucucaauauuacug

SEQ ID NO: 62689 - RNA, 29 nt, Artificial Sequence
  Synthetic Oligonucleotide; CD160 exon 3; Set C
accuggaaaucucaauauuacugucucaa

SEQ ID NO: 62690 - RNA, 15 nt, Artificial Sequence
  Synthetic Oligonucleotide; CD160 exon 3; Set C
aaucucaauauuacu

SEQ ID NO: 62691 - RNA, 17 nt, Artificial Sequence
  Synthetic Oligonucleotide; CD160 exon 3; Set C
aaaucucaauauuacug

SEQ ID NO: 62692 - RNA, 26 nt, Artificial Sequence
  Synthetic Oligonucleotide; CD160 exon 3; Set C
ccuggaaaucucaauauuacugucuc

SEQ ID NO: 62693 - RNA, 16 nt, Artificial Sequence
  Synthetic Oligonucleotide; CD160 exon 3; Set C
aaaucucaauauuacu

SEQ ID NO: 62694 - RNA, 40 nt, Artificial Sequence
  Synthetic Oligonucleotide; CD160 exon 3; Set C
gucagcaccuggaaaucucaauauuacugucucaaaccug

SEQ ID NO: 62695 - RNA, 27 nt, Artificial Sequence
  Synthetic Oligonucleotide; CD160 exon 3; Set C
accuggaaaucucaauauuacugucuc

SEQ ID NO: 62696 - RNA, 23 nt, Artificial Sequence
  Synthetic Oligonucleotide; CD160 exon 3; Set C
cuggaaaucucaauauuacuguc

SEQ ID NO: 62697 - RNA, 15 nt, Artificial Sequence
  Synthetic Oligonucleotide; CD160 exon 3; Set C
aaaucucaauauuac

SEQ ID NO: 62698 - RNA, 22 nt, Artificial Sequence
  Synthetic Oligonucleotide; CD160 exon 3; Set C
cuggaaaucucaauauuacugu

SEQ ID NO: 62699 - RNA, 24 nt, Artificial Sequence
  Synthetic Oligonucleotide; CD160 exon 3; Set C
ccuggaaaucucaauauuacuguc

SEQ ID NO: 62700 - RNA, 23 nt, Artificial Sequence
  Synthetic Oligonucleotide; CD160 exon 3; Set C
ccuggaaaucucaauauuacugu

SEQ ID NO: 62701 - RNA, 25 nt, Artificial Sequence
  Synthetic Oligonucleotide; CD160 exon 3; Set C
accuggaaaucucaauauuacuguc

SEQ ID NO: 62702 - RNA, 24 nt, Artificial Sequence
  Synthetic Oligonucleotide; CD160 exon 3; Set C
accuggaaaucucaauauuacugu

SEQ ID NO: 62703 - RNA, 26 nt, Artificial Sequence
  Synthetic Oligonucleotide; CD160 exon 3; Set C
caccuggaaaucucaauauuacuguc

SEQ ID NO: 62704 - RNA, 25 nt, Artificial Sequence
  Synthetic Oligonucleotide; CD160 exon 3; Set C
caccuggaaaucucaauauuacugu

SEQ ID NO: 62705 - RNA, 26 nt, Artificial Sequence
  Synthetic Oligonucleotide; CD160 exon 3; Set C
cagcaccuggaaaucucaauauuacu

SEQ ID NO: 62706 - RNA, 28 nt, Artificial Sequence
  Synthetic Oligonucleotide; CD160 exon 3; Set B
ucagcaccuggaaaucucaauauuacug

SEQ ID NO: 62707 - RNA, 27 nt, Artificial Sequence
  Synthetic Oligonucleotide; CD160 exon 3; Set B
ucagcaccuggaaaucucaauauuacu

SEQ ID NO: 62708 - RNA, 25 nt, Artificial Sequence
  Synthetic Oligonucleotide; CD160 exon 3; Set C
cagcaccuggaaaucucaauauuac

SEQ ID NO: 62709 - RNA, 29 nt, Artificial Sequence
  Synthetic Oligonucleotide; CD160 exon 3; Set B
gucagcaccuggaaaucucaauauuacug

SEQ ID NO: 62710 - RNA, 28 nt, Artificial Sequence
  Synthetic Oligonucleotide; CD160 exon 3; Set B
gucagcaccuggaaaucucaauauuacu

SEQ ID NO: 62711 - RNA, 26 nt, Artificial Sequence
  Synthetic Oligonucleotide; CD160 exon 3; Set C
ucagcaccuggaaaucucaauauuac

SEQ ID NO: 62712 - RNA, 30 nt, Artificial Sequence
  Synthetic Oligonucleotide; CD160 exon 3; Set B
agucagcaccuggaaaucucaauauuacug

SEQ ID NO: 62713 - RNA, 35 nt, Artificial Sequence
  Synthetic Oligonucleotide; CD160 exon 3; Set B
gaaagucagcaccuggaaaucucaauauuacuguc

SEQ ID NO: 62714 - RNA, 27 nt, Artificial Sequence
  Synthetic Oligonucleotide; CD160 exon 3; Set B
gucagcaccuggaaaucucaauauuac

SEQ ID NO: 62715 - RNA, 29 nt, Artificial Sequence
  Synthetic Oligonucleotide; CD160 exon 3; Set B
agucagcaccuggaaaucucaauauuacu

SEQ ID NO: 62716 - RNA, 31 nt, Artificial Sequence
  Synthetic Oligonucleotide; CD160 exon 3; Set B
aagucagcaccuggaaaucucaauauuacug

SEQ ID NO: 62717 - RNA, 34 nt, Artificial Sequence
  Synthetic Oligonucleotide; CD160 exon 3; Set B
gaaagucagcaccuggaaaucucaauauuacugu

SEQ ID NO: 62718 - RNA, 36 nt, Artificial Sequence
  Synthetic Oligonucleotide; CD160 exon 3; Set B
ggaaagucagcaccuggaaaucucaauauuacuguc

SEQ ID NO: 62719 - RNA, 28 nt, Artificial Sequence
  Synthetic Oligonucleotide; CD160 exon 3; Set B
agucagcaccuggaaaucucaauauuac

SEQ ID NO: 62720 - RNA, 30 nt, Artificial Sequence
  Synthetic Oligonucleotide; CD160 exon 3; Set B
aagucagcaccuggaaaucucaauauuacu

SEQ ID NO: 62721 - RNA, 32 nt, Artificial Sequence
  Synthetic Oligonucleotide; CD160 exon 3; Set B
aaagucagcaccuggaaaucucaauauuacug

SEQ ID NO: 62722 - RNA, 37 nt, Artificial Sequence
  Synthetic Oligonucleotide; CD160 exon 3; Set C
gggaaagucagcaccuggaaaucucaauauuacuguc

SEQ ID NO: 62723 - RNA, 31 nt, Artificial Sequence
  Synthetic Oligonucleotide; CD160 exon 3; Set B
aaagucagcaccuggaaaucucaauauuacu

SEQ ID NO: 62724 - RNA, 29 nt, Artificial Sequence
  Synthetic Oligonucleotide; CD160 exon 3; Set B
aagucagcaccuggaaaucucaauauuac

SEQ ID NO: 62725 - RNA, 38 nt, Artificial Sequence
  Synthetic Oligonucleotide; CD160 exon 3; Set C
ggggaaagucagcaccuggaaaucucaauauuacuguc

SEQ ID NO: 62726 - RNA, 30 nt, Artificial Sequence
  Synthetic Oligonucleotide; CD160 exon 3; Set B
aaagucagcaccuggaaaucucaauauuac

SEQ ID NO: 62727 - RNA, 37 nt, Artificial Sequence
  Synthetic Oligonucleotide; CD160 exon 3; Set C
ggggaaagucagcaccuggaaaucucaauauuacugu

SEQ ID NO: 62728 - RNA, 39 nt, Artificial Sequence
  Synthetic Oligonucleotide; CD160 exon 3; Set C
cggggaaagucagcaccuggaaaucucaauauuacuguc

SEQ ID NO: 62729 - RNA, 38 nt, Artificial Sequence
  Synthetic Oligonucleotide; CD160 exon 3; Set C
cggggaaagucagcaccuggaaaucucaauauuacugu

SEQ ID NO: 62730 - RNA, 40 nt, Artificial Sequence
  Synthetic Oligonucleotide; CD160 exon 3; Set C
gcggggaaagucagcaccuggaaaucucaauauuacuguc

SEQ ID NO: 62731 - RNA, 39 nt, Artificial Sequence
  Synthetic Oligonucleotide; CD160 exon 3; Set C
gcggggaaagucagcaccuggaaaucucaauauuacugu

SEQ ID NO: 62732 - RNA, 38 nt, Artificial Sequence
  Synthetic Oligonucleotide; CD160 exon 3; Set C
ggcggggaaagucagcaccuggaaaucucaauauuacu

SEQ ID NO: 62733 - RNA, 35 nt, Artificial Sequence
  Synthetic Oligonucleotide; CD160 exon 3; Set C
gcggggaaagucagcaccuggaaaucucaauauua

SEQ ID NO: 62734 - RNA, 39 nt, Artificial Sequence
  Synthetic Oligonucleotide; CD160 exon 3; Set C
uggcggggaaagucagcaccuggaaaucucaauauuacu

SEQ ID NO: 62735 - RNA, 37 nt, Artificial Sequence
  Synthetic Oligonucleotide; CD160 exon 3; Set C
ggcggggaaagucagcaccuggaaaucucaauauuac

SEQ ID NO: 62736 - RNA, 38 nt, Artificial Sequence
  Synthetic Oligonucleotide; CD160 exon 3; Set C
uggcggggaaagucagcaccuggaaaucucaauauuac

SEQ ID NO: 62737 - RNA, 30 nt, Artificial Sequence
  Synthetic Oligonucleotide; CD160 exon 3; Set C
gcggggaaagucagcaccuggaaaucucaa

SEQ ID NO: 62738 - RNA, 16 nt, Artificial Sequence
  Synthetic Oligonucleotide; CD160 exon 3; Set C
aagucagcaccuggaa

SEQ ID NO: 62739 - RNA, 29 nt, Artificial Sequence
  Synthetic Oligonucleotide; CD160 exon 3; Set C
gcggggaaagucagcaccuggaaaucuca

SEQ ID NO: 62740 - RNA, 19 nt, Artificial Sequence
  Synthetic Oligonucleotide; CD160 exon 3; Set C
gaaagucagcaccuggaaa

SEQ ID NO: 62741 - RNA, 17 nt, Artificial Sequence
  Synthetic Oligonucleotide; CD160 exon 3; Set C
aaagucagcaccuggaa

SEQ ID NO: 62742 - RNA, 15 nt, Artificial Sequence
  Synthetic Oligonucleotide; CD160 exon 3; Set C
aagucagcaccugga

SEQ ID NO: 62743 - RNA, 16 nt, Artificial Sequence
  Synthetic Oligonucleotide; CD160 exon 3; Set C
aaagucagcaccugga

SEQ ID NO: 62744 - RNA, 27 nt, Artificial Sequence
  Synthetic Oligonucleotide; CD160 exon 3; Set C
gcggggaaagucagcaccuggaaaucu

SEQ ID NO: 62745 - RNA, 23 nt, Artificial Sequence
  Synthetic Oligonucleotide; CD160 exon 3; Set B
ggggaaagucagcaccuggaaau

SEQ ID NO: 62746 - RNA, 15 nt, Artificial Sequence
  Synthetic Oligonucleotide; CD160 exon 3; Set C
aaagucagcaccugg

SEQ ID NO: 62747 - RNA, 26 nt, Artificial Sequence
  Synthetic Oligonucleotide; CD160 exon 3; Set B
gcggggaaagucagcaccuggaaauc

SEQ ID NO: 62748 - RNA, 24 nt, Artificial Sequence
  Synthetic Oligonucleotide; CD160 exon 3; Set B
cggggaaagucagcaccuggaaau

SEQ ID NO: 62749 - RNA, 22 nt, Artificial Sequence
  Synthetic Oligonucleotide; CD160 exon 3; Set B
ggggaaagucagcaccuggaaa

SEQ ID NO: 62750 - RNA, 25 nt, Artificial Sequence
  Synthetic Oligonucleotide; CD160 exon 3; Set B
gcggggaaagucagcaccuggaaau

SEQ ID NO: 62751 - RNA, 23 nt, Artificial Sequence
  Synthetic Oligonucleotide; CD160 exon 3; Set B
cggggaaagucagcaccuggaaa

SEQ ID NO: 62752 - RNA, 24 nt, Artificial Sequence
  Synthetic Oligonucleotide; CD160 exon 3; Set B
gcggggaaagucagcaccuggaaa

SEQ ID NO: 62753 - RNA, 24 nt, Artificial Sequence
  Synthetic Oligonucleotide; CD160 exon 3; Set C
ggcggggaaagucagcaccuggaa

SEQ ID NO: 62754 - RNA, 25 nt, Artificial Sequence
  Synthetic Oligonucleotide; CD160 exon 3; Set C
uggcggggaaagucagcaccuggaa

SEQ ID NO: 62755 - RNA, 23 nt, Artificial Sequence
  Synthetic Oligonucleotide; CD160 exon 3; Set C
ggcggggaaagucagcaccugga

SEQ ID NO: 62756 - RNA, 26 nt, Artificial Sequence
  Synthetic Oligonucleotide; CD160 exon 3; Set C
cuggcggggaaagucagcaccuggaa

SEQ ID NO: 62757 - RNA, 24 nt, Artificial Sequence
  Synthetic Oligonucleotide; CD160 exon 3; Set C
uggcggggaaagucagcaccugga

SEQ ID NO: 62758 - RNA, 22 nt, Artificial Sequence
  Synthetic Oligonucleotide; CD160 exon 3; Set C
ggcggggaaagucagcaccugg

SEQ ID NO: 62759 - RNA, 25 nt, Artificial Sequence
  Synthetic Oligonucleotide; CD160 exon 3; Set C
cuggcggggaaagucagcaccugga

SEQ ID NO: 62760 - RNA, 23 nt, Artificial Sequence
  Synthetic Oligonucleotide; CD160 exon 3; Set C
uggcggggaaagucagcaccugg

SEQ ID NO: 62761 - RNA, 21 nt, Artificial Sequence
  Synthetic Oligonucleotide; CD160 exon 3; Set B
ggcggggaaagucagcaccug

SEQ ID NO: 62762 - RNA, 24 nt, Artificial Sequence
  Synthetic Oligonucleotide; CD160 exon 3; Set C
cuggcggggaaagucagcaccugg

SEQ ID NO: 62763 - RNA, 22 nt, Artificial Sequence
  Synthetic Oligonucleotide; CD160 exon 3; Set B
uggcggggaaagucagcaccug

SEQ ID NO: 62764 - RNA, 20 nt, Artificial Sequence
  Synthetic Oligonucleotide; CD160 exon 3; Set B
ggcggggaaagucagcaccu

SEQ ID NO: 62765 - RNA, 15 nt, Artificial Sequence
  Synthetic Oligonucleotide; CD160 exon 3; Set C
cggggaaagucagca

SEQ ID NO: 62766 - RNA, 21 nt, Artificial Sequence
  Synthetic Oligonucleotide; CD160 exon 3; Set B
uggcggggaaagucagcaccu

SEQ ID NO: 62767 - RNA, 19 nt, Artificial Sequence
  Synthetic Oligonucleotide; CD160 exon 3; Set B
ggcggggaaagucagcacc

SEQ ID NO: 62768 - RNA, 16 nt, Artificial Sequence
  Synthetic Oligonucleotide; CD160 exon 3; Set C
gcggggaaagucagca

SEQ ID NO: 62769 - RNA, 18 nt, Artificial Sequence
  Synthetic Oligonucleotide; CD160 exon 3; Set B
ggcggggaaagucagcac

SEQ ID NO: 62770 - RNA, 20 nt, Artificial Sequence
  Synthetic Oligonucleotide; CD160 exon 3; Set B
uggcggggaaagucagcacc

SEQ ID NO: 62771 - RNA, 39 nt, Artificial Sequence
  Synthetic Oligonucleotide; CD160 exon 3; Set C
cuucagugacuggcggggaaagucagcaccuggaaaucu

SEQ ID NO: 62772 - RNA, 15 nt, Artificial Sequence
  Synthetic Oligonucleotide; CD160 exon 3; Set C
gcggggaaagucagc

SEQ ID NO: 62773 - RNA, 19 nt, Artificial Sequence
  Synthetic Oligonucleotide; CD160 exon 3; Set B
uggcggggaaagucagcac

SEQ ID NO: 62774 - RNA, 40 nt, Artificial Sequence
  Synthetic Oligonucleotide; CD160 exon 3; Set C
gcuucagugacuggcggggaaagucagcaccuggaaaucu

SEQ ID NO: 62775 - RNA, 38 nt, Artificial Sequence
  Synthetic Oligonucleotide; CD160 exon 3; Set C
cuucagugacuggcggggaaagucagcaccuggaaauc

SEQ ID NO: 62776 - RNA, 20 nt, Artificial Sequence
  Synthetic Oligonucleotide; CD160 exon 3; Set B
cuggcggggaaagucagcac

SEQ ID NO: 62777 - RNA, 39 nt, Artificial Sequence
  Synthetic Oligonucleotide; CD160 exon 3; Set C
gcuucagugacuggcggggaaagucagcaccuggaaauc

SEQ ID NO: 62778 - RNA, 37 nt, Artificial Sequence
  Synthetic Oligonucleotide; CD160 exon 3; Set C
cuucagugacuggcggggaaagucagcaccuggaaau

SEQ ID NO: 62779 - RNA, 33 nt, Artificial Sequence
  Synthetic Oligonucleotide; CD160 exon 3; Set C
ucagugacuggcggggaaagucagcaccuggaa

SEQ ID NO: 62780 - RNA, 40 nt, Artificial Sequence
  Synthetic Oligonucleotide; CD160 exon 3; Set C
ugcuucagugacuggcggggaaagucagcaccuggaaauc

SEQ ID NO: 62781 - RNA, 38 nt, Artificial Sequence
  Synthetic Oligonucleotide; CD160 exon 3; Set C
gcuucagugacuggcggggaaagucagcaccuggaaau

SEQ ID NO: 62782 - RNA, 36 nt, Artificial Sequence
  Synthetic Oligonucleotide; CD160 exon 3; Set C
cuucagugacuggcggggaaagucagcaccuggaaa

SEQ ID NO: 62783 - RNA, 34 nt, Artificial Sequence
  Synthetic Oligonucleotide; CD160 exon 3; Set C
uucagugacuggcggggaaagucagcaccuggaa

SEQ ID NO: 62784 - RNA, 32 nt, Artificial Sequence
  Synthetic Oligonucleotide; CD160 exon 3; Set C
ucagugacuggcggggaaagucagcaccugga

SEQ ID NO: 62785 - RNA, 39 nt, Artificial Sequence
  Synthetic Oligonucleotide; CD160 exon 3; Set C
ugcuucagugacuggcggggaaagucagcaccuggaaau

SEQ ID NO: 62786 - RNA, 37 nt, Artificial Sequence
  Synthetic Oligonucleotide; CD160 exon 3; Set C
gcuucagugacuggcggggaaagucagcaccuggaaa

SEQ ID NO: 62787 - RNA, 33 nt, Artificial Sequence
  Synthetic Oligonucleotide; CD160 exon 3; Set C
uucagugacuggcggggaaagucagcaccugga

SEQ ID NO: 62788 - RNA, 31 nt, Artificial Sequence
  Synthetic Oligonucleotide; CD160 exon 3; Set C
ucagugacuggcggggaaagucagcaccugg

SEQ ID NO: 62789 - RNA, 38 nt, Artificial Sequence
  Synthetic Oligonucleotide; CD160 exon 3; Set C
ugcuucagugacuggcggggaaagucagcaccuggaaa

SEQ ID NO: 62790 - RNA, 32 nt, Artificial Sequence
  Synthetic Oligonucleotide; CD160 exon 3; Set C
uucagugacuggcggggaaagucagcaccugg

SEQ ID NO: 62791 - RNA, 30 nt, Artificial Sequence
  Synthetic Oligonucleotide; CD160 exon 3; Set C
ucagugacuggcggggaaagucagcaccug

SEQ ID NO: 62792 - RNA, 31 nt, Artificial Sequence
  Synthetic Oligonucleotide; CD160 exon 3; Set C
uucagugacuggcggggaaagucagcaccug

SEQ ID NO: 62793 - RNA, 29 nt, Artificial Sequence
  Synthetic Oligonucleotide; CD160 exon 3; Set C
ucagugacuggcggggaaagucagcaccu

SEQ ID NO: 62794 - RNA, 30 nt, Artificial Sequence
  Synthetic Oligonucleotide; CD160 exon 3; Set C
uucagugacuggcggggaaagucagcaccu

SEQ ID NO: 62795 - RNA, 27 nt, Artificial Sequence
  Synthetic Oligonucleotide; CD160 exon 3; Set C
ucagugacuggcggggaaagucagcac

SEQ ID NO: 62796 - RNA, 29 nt, Artificial Sequence
  Synthetic Oligonucleotide; CD160 exon 3; Set C
uucagugacuggcggggaaagucagcacc

SEQ ID NO: 62797 - RNA, 28 nt, Artificial Sequence
  Synthetic Oligonucleotide; CD160 exon 3; Set C
uucagugacuggcggggaaagucagcac

SEQ ID NO: 62798 - RNA, 25 nt, Artificial Sequence
  Synthetic Oligonucleotide; CD160 exon 3; Set B
cuucagugacuggcggggaaaguca

SEQ ID NO: 62799 - RNA, 24 nt, Artificial Sequence
  Synthetic Oligonucleotide; CD160 exon 3; Set B
cuucagugacuggcggggaaaguc

SEQ ID NO: 62800 - RNA, 26 nt, Artificial Sequence
  Synthetic Oligonucleotide; CD160 exon 3; Set C
gcuucagugacuggcggggaaaguca

SEQ ID NO: 62801 - RNA, 20 nt, Artificial Sequence
  Synthetic Oligonucleotide; CD160 exon 3; Set B
ucagugacuggcggggaaag

SEQ ID NO: 62802 - RNA, 25 nt, Artificial Sequence
  Synthetic Oligonucleotide; CD160 exon 3; Set C
gcuucagugacuggcggggaaaguc

SEQ ID NO: 62803 - RNA, 27 nt, Artificial Sequence
  Synthetic Oligonucleotide; CD160 exon 3; Set C
ugcuucagugacuggcggggaaaguca

SEQ ID NO: 62804 - RNA, 19 nt, Artificial Sequence
  Synthetic Oligonucleotide; CD160 exon 3; Set B
ucagugacuggcggggaaa

SEQ ID NO: 62805 - RNA, 26 nt, Artificial Sequence
  Synthetic Oligonucleotide; CD160 exon 3; Set C
ugcuucagugacuggcggggaaaguc

SEQ ID NO: 62806 - RNA, 24 nt, Artificial Sequence
  Synthetic Oligonucleotide; CD160 exon 3; Set C
gcuucagugacuggcggggaaagu

SEQ ID NO: 62807 - RNA, 25 nt, Artificial Sequence
  Synthetic Oligonucleotide; CD160 exon 3; Set C
ugcuucagugacuggcggggaaagu

SEQ ID NO: 62808 - RNA, 18 nt, Artificial Sequence
  Synthetic Oligonucleotide; CD160 exon 3; Set B
uucagugacuggcgggga

SEQ ID NO: 62809 - RNA, 15 nt, Artificial Sequence
  Synthetic Oligonucleotide; CD160 exon 3; Set C
uucaggucccacuuu

SEQ ID NO: 62810 - RNA, 16 nt, Artificial Sequence
  Synthetic Oligonucleotide; CD160 exon 3; Set C
aguucaggucccacuu

SEQ ID NO: 62811 - RNA, 17 nt, Artificial Sequence
  Synthetic Oligonucleotide; CD160 exon 3; Set C
caguucaggucccacuu

SEQ ID NO: 62812 - RNA, 15 nt, Artificial Sequence
  Synthetic Oligonucleotide; CD160 exon 3; Set C
aguucaggucccacu

SEQ ID NO: 62813 - RNA, 18 nt, Artificial Sequence
  Synthetic Oligonucleotide; CD160 exon 3; Set C
acaguucaggucccacuu

SEQ ID NO: 62814 - RNA, 19 nt, Artificial Sequence
  Synthetic Oligonucleotide; CD160 exon 3; Set A
cacaguucaggucccacuu

SEQ ID NO: 62815 - RNA, 17 nt, Artificial Sequence
  Synthetic Oligonucleotide; CD160 exon 3; Set C
acaguucaggucccacu

SEQ ID NO: 62816 - RNA, 20 nt, Artificial Sequence
  Synthetic Oligonucleotide; CD160 exon 3; Set A
acacaguucaggucccacuu

SEQ ID NO: 62817 - RNA, 18 nt, Artificial Sequence
  Synthetic Oligonucleotide; CD160 exon 3; Set A
cacaguucaggucccacu

SEQ ID NO: 62818 - RNA, 19 nt, Artificial Sequence
  Synthetic Oligonucleotide; CD160 exon 3; Set A
acacaguucaggucccacu

SEQ ID NO: 62819 - RNA, 25 nt, Artificial Sequence
  Synthetic Oligonucleotide; CD160 exon 3; Set C
gauccacacaguucaggucccacuu

SEQ ID NO: 62820 - RNA, 24 nt, Artificial Sequence
  Synthetic Oligonucleotide; CD160 exon 3; Set C
gauccacacaguucaggucccacu

SEQ ID NO: 62821 - RNA, 34 nt, Artificial Sequence
  Synthetic Oligonucleotide; CD160 exon 3; Set C
uuccccagagauccacacaguucaggucccacuu

SEQ ID NO: 62822 - RNA, 15 nt, Artificial Sequence
  Synthetic Oligonucleotide; CD160 exon 3; Set C
gauccacacaguuca

SEQ ID NO: 62823 - RNA, 33 nt, Artificial Sequence
  Synthetic Oligonucleotide; CD160 exon 3; Set C
uuccccagagauccacacaguucaggucccacu

SEQ ID NO: 62824 - RNA, 38 nt, Artificial Sequence
  Synthetic Oligonucleotide; CD160 exon 3; Set C
ugucuuccccagagauccacacaguucaggucccacuu

SEQ ID NO: 62825 - RNA, 39 nt, Artificial Sequence
  Synthetic Oligonucleotide; CD160 exon 3; Set C
gugucuuccccagagauccacacaguucaggucccacuu

SEQ ID NO: 62826 - RNA, 37 nt, Artificial Sequence
  Synthetic Oligonucleotide; CD160 exon 3; Set C
ugucuuccccagagauccacacaguucaggucccacu

SEQ ID NO: 62827 - RNA, 40 nt, Artificial Sequence
  Synthetic Oligonucleotide; CD160 exon 3; Set C
agugucuuccccagagauccacacaguucaggucccacuu

SEQ ID NO: 62828 - RNA, 38 nt, Artificial Sequence
  Synthetic Oligonucleotide; CD160 exon 3; Set C
gugucuuccccagagauccacacaguucaggucccacu

SEQ ID NO: 62829 - RNA, 39 nt, Artificial Sequence
  Synthetic Oligonucleotide; CD160 exon 3; Set C
agugucuuccccagagauccacacaguucaggucccacu

SEQ ID NO: 62830 - RNA, 40 nt, Artificial Sequence
  Synthetic Oligonucleotide; CD160 exon 3; Set C
cagugucuuccccagagauccacacaguucaggucccacu

SEQ ID NO: 62831 - RNA, 24 nt, Artificial Sequence
  Synthetic Oligonucleotide; CD160 exon 3; Set A
uuccccagagauccacacaguuca

SEQ ID NO: 62832 - RNA, 23 nt, Artificial Sequence
  Synthetic Oligonucleotide; CD160 exon 3; Set A
uuccccagagauccacacaguuc

SEQ ID NO: 62833 - RNA, 22 nt, Artificial Sequence
  Synthetic Oligonucleotide; CD160 exon 3; Set A
uuccccagagauccacacaguu

SEQ ID NO: 62834 - RNA, 28 nt, Artificial Sequence
  Synthetic Oligonucleotide; CD160 exon 3; Set C
ugucuuccccagagauccacacaguuca

SEQ ID NO: 62835 - RNA, 27 nt, Artificial Sequence
  Synthetic Oligonucleotide; CD160 exon 3; Set C
ugucuuccccagagauccacacaguuc

SEQ ID NO: 62836 - RNA, 29 nt, Artificial Sequence
  Synthetic Oligonucleotide; CD160 exon 3; Set C
gugucuuccccagagauccacacaguuca

SEQ ID NO: 62837 - RNA, 28 nt, Artificial Sequence
  Synthetic Oligonucleotide; CD160 exon 3; Set C
gugucuuccccagagauccacacaguuc

SEQ ID NO: 62838 - RNA, 26 nt, Artificial Sequence
  Synthetic Oligonucleotide; CD160 exon 3; Set C
ugucuuccccagagauccacacaguu

SEQ ID NO: 62839 - RNA, 30 nt, Artificial Sequence
  Synthetic Oligonucleotide; CD160 exon 3; Set C
agugucuuccccagagauccacacaguuca

SEQ ID NO: 62840 - RNA, 29 nt, Artificial Sequence
  Synthetic Oligonucleotide; CD160 exon 3; Set C
agugucuuccccagagauccacacaguuc

SEQ ID NO: 62841 - RNA, 27 nt, Artificial Sequence
  Synthetic Oligonucleotide; CD160 exon 3; Set C
gugucuuccccagagauccacacaguu

SEQ ID NO: 62842 - RNA, 31 nt, Artificial Sequence
  Synthetic Oligonucleotide; CD160 exon 3; Set C
cagugucuuccccagagauccacacaguuca

SEQ ID NO: 62843 - RNA, 30 nt, Artificial Sequence
  Synthetic Oligonucleotide; CD160 exon 3; Set C
cagugucuuccccagagauccacacaguuc

SEQ ID NO: 62844 - RNA, 28 nt, Artificial Sequence
  Synthetic Oligonucleotide; CD160 exon 3; Set C
agugucuuccccagagauccacacaguu

SEQ ID NO: 62845 - RNA, 32 nt, Artificial Sequence
  Synthetic Oligonucleotide; CD160 exon 3; Set C
ccagugucuuccccagagauccacacaguuca

SEQ ID NO: 62846 - RNA, 29 nt, Artificial Sequence
  Synthetic Oligonucleotide; CD160 exon 3; Set C
cagugucuuccccagagauccacacaguu

SEQ ID NO: 62847 - RNA, 33 nt, Artificial Sequence
  Synthetic Oligonucleotide; CD160 exon 3; Set C
gccagugucuuccccagagauccacacaguuca

SEQ ID NO: 62848 - RNA, 30 nt, Artificial Sequence
  Synthetic Oligonucleotide; CD160 exon 3; Set C
ccagugucuuccccagagauccacacaguu

SEQ ID NO: 62849 - RNA, 34 nt, Artificial Sequence
  Synthetic Oligonucleotide; CD160 exon 3; Set C
agccagugucuuccccagagauccacacaguuca

SEQ ID NO: 62850 - RNA, 31 nt, Artificial Sequence
  Synthetic Oligonucleotide; CD160 exon 3; Set C
gccagugucuuccccagagauccacacaguu

SEQ ID NO: 62851 - RNA, 35 nt, Artificial Sequence
  Synthetic Oligonucleotide; CD160 exon 3; Set C
gagccagugucuuccccagagauccacacaguuca

SEQ ID NO: 62852 - RNA, 34 nt, Artificial Sequence
  Synthetic Oligonucleotide; CD160 exon 3; Set C
gagccagugucuuccccagagauccacacaguuc

SEQ ID NO: 62853 - RNA, 32 nt, Artificial Sequence
  Synthetic Oligonucleotide; CD160 exon 3; Set C
agccagugucuuccccagagauccacacaguu

SEQ ID NO: 62854 - RNA, 33 nt, Artificial Sequence
  Synthetic Oligonucleotide; CD160 exon 3; Set C
gagccagugucuuccccagagauccacacaguu

SEQ ID NO: 62855 - RNA, 39 nt, Artificial Sequence
  Synthetic Oligonucleotide; CD160 exon 3; Set C
gagggagccagugucuuccccagagauccacacaguuca

SEQ ID NO: 62856 - RNA, 38 nt, Artificial Sequence
  Synthetic Oligonucleotide; CD160 exon 3; Set C
gagggagccagugucuuccccagagauccacacaguuc

SEQ ID NO: 62857 - RNA, 37 nt, Artificial Sequence
  Synthetic Oligonucleotide; CD160 exon 3; Set C
gagggagccagugucuuccccagagauccacacaguu

SEQ ID NO: 62858 - RNA, 37 nt, Artificial Sequence
  Synthetic Oligonucleotide; CD160 exon 3; Set C
agagggagccagugucuuccccagagauccacacagu

SEQ ID NO: 62859 - RNA, 38 nt, Artificial Sequence
  Synthetic Oligonucleotide; CD160 exon 3; Set C
uagagggagccagugucuuccccagagauccacacagu

SEQ ID NO: 62860 - RNA, 39 nt, Artificial Sequence
  Synthetic Oligonucleotide; CD160 exon 3; Set C
uuagagggagccagugucuuccccagagauccacacagu

SEQ ID NO: 62861 - RNA, 40 nt, Artificial Sequence
  Synthetic Oligonucleotide; CD160 exon 3; Set C
auuagagggagccagugucuuccccagagauccacacagu

SEQ ID NO: 62862 - RNA, 34 nt, Artificial Sequence
  Synthetic Oligonucleotide; CD160 exon 3; Set C
agagggagccagugucuuccccagagauccacac

SEQ ID NO: 62863 - RNA, 33 nt, Artificial Sequence
  Synthetic Oligonucleotide; CD160 exon 3; Set C
agagggagccagugucuuccccagagauccaca

SEQ ID NO: 62864 - RNA, 35 nt, Artificial Sequence
  Synthetic Oligonucleotide; CD160 exon 3; Set C
uagagggagccagugucuuccccagagauccacac

SEQ ID NO: 62865 - RNA, 37 nt, Artificial Sequence
  Synthetic Oligonucleotide; CD160 exon 3; Set C
uuagagggagccagugucuuccccagagauccacaca

SEQ ID NO: 62866 - RNA, 39 nt, Artificial Sequence
  Synthetic Oligonucleotide; CD160 exon 3; Set C
auuagagggagccagugucuuccccagagauccacacag

SEQ ID NO: 62867 - RNA, 34 nt, Artificial Sequence
  Synthetic Oligonucleotide; CD160 exon 3; Set C
uagagggagccagugucuuccccagagauccaca

SEQ ID NO: 62868 - RNA, 36 nt, Artificial Sequence
  Synthetic Oligonucleotide; CD160 exon 3; Set C
uuagagggagccagugucuuccccagagauccacac

SEQ ID NO: 62869 - RNA, 38 nt, Artificial Sequence
  Synthetic Oligonucleotide; CD160 exon 3; Set C
auuagagggagccagugucuuccccagagauccacaca

SEQ ID NO: 62870 - RNA, 35 nt, Artificial Sequence
  Synthetic Oligonucleotide; CD160 exon 3; Set C
uuagagggagccagugucuuccccagagauccaca

SEQ ID NO: 62871 - RNA, 37 nt, Artificial Sequence
  Synthetic Oligonucleotide; CD160 exon 3; Set C
auuagagggagccagugucuuccccagagauccacac

SEQ ID NO: 62872 - RNA, 39 nt, Artificial Sequence
  Synthetic Oligonucleotide; CD160 exon 3; Set C
cauuagagggagccagugucuuccccagagauccacaca

SEQ ID NO: 62873 - RNA, 36 nt, Artificial Sequence
  Synthetic Oligonucleotide; CD160 exon 3; Set C
auuagagggagccagugucuuccccagagauccaca

SEQ ID NO: 62874 - RNA, 38 nt, Artificial Sequence
  Synthetic Oligonucleotide; CD160 exon 3; Set C
cauuagagggagccagugucuuccccagagauccacac

SEQ ID NO: 62875 - RNA, 37 nt, Artificial Sequence
  Synthetic Oligonucleotide; CD160 exon 3; Set C
cauuagagggagccagugucuuccccagagauccaca

SEQ ID NO: 62876 - RNA, 38 nt, Artificial Sequence
  Synthetic Oligonucleotide; CD160 exon 3; Set C
acauuagagggagccagugucuuccccagagauccaca

SEQ ID NO: 62877 - RNA, 28 nt, Artificial Sequence
  Synthetic Oligonucleotide; CD160 exon 3; Set C
agagggagccagugucuuccccagagau

SEQ ID NO: 62878 - RNA, 29 nt, Artificial Sequence
  Synthetic Oligonucleotide; CD160 exon 3; Set C
uagagggagccagugucuuccccagagau

SEQ ID NO: 62879 - RNA, 30 nt, Artificial Sequence
  Synthetic Oligonucleotide; CD160 exon 3; Set C
uuagagggagccagugucuuccccagagau

SEQ ID NO: 62880 - RNA, 31 nt, Artificial Sequence
  Synthetic Oligonucleotide; CD160 exon 3; Set C
auuagagggagccagugucuuccccagagau

SEQ ID NO: 62881 - RNA, 32 nt, Artificial Sequence
  Synthetic Oligonucleotide; CD160 exon 3; Set C
cauuagagggagccagugucuuccccagagau

SEQ ID NO: 62882 - RNA, 33 nt, Artificial Sequence
  Synthetic Oligonucleotide; CD160 exon 3; Set C
acauuagagggagccagugucuuccccagagau

SEQ ID NO: 62883 - RNA, 28 nt, Artificial Sequence
  Synthetic Oligonucleotide; CD160 exon 3; Set A
uaggacauuagagggagccagugucuuc

SEQ ID NO: 62884 - RNA, 29 nt, Artificial Sequence
  Synthetic Oligonucleotide; CD160 exon 3; Set C
cuaggacauuagagggagccagugucuuc

SEQ ID NO: 62885 - RNA, 24 nt, Artificial Sequence
  Synthetic Oligonucleotide; CD160 exon 3; Set A
uaggacauuagagggagccagugu

SEQ ID NO: 62886 - RNA, 23 nt, Artificial Sequence
  Synthetic Oligonucleotide; CD160 exon 3; Set A
uaggacauuagagggagccagug

SEQ ID NO: 62887 - RNA, 25 nt, Artificial Sequence
  Synthetic Oligonucleotide; CD160 exon 3; Set A
cuaggacauuagagggagccagugu

SEQ ID NO: 62888 - RNA, 24 nt, Artificial Sequence
  Synthetic Oligonucleotide; CD160 exon 3; Set A
cuaggacauuagagggagccagug

SEQ ID NO: 62889 - RNA, 22 nt, Artificial Sequence
  Synthetic Oligonucleotide; CD160 exon 3; Set A
uaggacauuagagggagccagu

SEQ ID NO: 62890 - RNA, 26 nt, Artificial Sequence
  Synthetic Oligonucleotide; CD160 exon 3; Set C
ccuaggacauuagagggagccagugu

SEQ ID NO: 62891 - RNA, 35 nt, Artificial Sequence
  Synthetic Oligonucleotide; CD160 exon 3; Set C
caguaccuaggacauuagagggagccagugucuuc

SEQ ID NO: 62892 - RNA, 25 nt, Artificial Sequence
  Synthetic Oligonucleotide; CD160 exon 3; Set A
ccuaggacauuagagggagccagug

SEQ ID NO: 62893 - RNA, 23 nt, Artificial Sequence
  Synthetic Oligonucleotide; CD160 exon 3; Set A
cuaggacauuagagggagccagu

SEQ ID NO: 62894 - RNA, 21 nt, Artificial Sequence
  Synthetic Oligonucleotide; CD160 exon 3; Set A
uaggacauuagagggagccag

SEQ ID NO: 62895 - RNA, 27 nt, Artificial Sequence
  Synthetic Oligonucleotide; CD160 exon 3; Set C
accuaggacauuagagggagccagugu

SEQ ID NO: 62896 - RNA, 20 nt, Artificial Sequence
  Synthetic Oligonucleotide; CD160 exon 3; Set A
uaggacauuagagggagcca

SEQ ID NO: 62897 - RNA, 24 nt, Artificial Sequence
  Synthetic Oligonucleotide; CD160 exon 3; Set A
ccuaggacauuagagggagccagu

SEQ ID NO: 62898 - RNA, 26 nt, Artificial Sequence
  Synthetic Oligonucleotide; CD160 exon 3; Set A
accuaggacauuagagggagccagug

SEQ ID NO: 62899 - RNA, 22 nt, Artificial Sequence
  Synthetic Oligonucleotide; CD160 exon 3; Set A
cuaggacauuagagggagccag

SEQ ID NO: 62900 - RNA, 19 nt, Artificial Sequence
  Synthetic Oligonucleotide; CD160 exon 3; Set C
uaggacauuagagggagcc

SEQ ID NO: 62901 - RNA, 21 nt, Artificial Sequence
  Synthetic Oligonucleotide; CD160 exon 3; Set A
cuaggacauuagagggagcca

SEQ ID NO: 62902 - RNA, 25 nt, Artificial Sequence
  Synthetic Oligonucleotide; CD160 exon 3; Set A
accuaggacauuagagggagccagu

SEQ ID NO: 62903 - RNA, 23 nt, Artificial Sequence
  Synthetic Oligonucleotide; CD160 exon 3; Set A
ccuaggacauuagagggagccag

SEQ ID NO: 62904 - RNA, 18 nt, Artificial Sequence
  Synthetic Oligonucleotide; CD160 exon 3; Set C
uaggacauuagagggagc

SEQ ID NO: 62905 - RNA, 24 nt, Artificial Sequence
  Synthetic Oligonucleotide; CD160 exon 3; Set A
accuaggacauuagagggagccag

SEQ ID NO: 62906 - RNA, 19 nt, Artificial Sequence
  Synthetic Oligonucleotide; CD160 exon 3; Set C
cuaggacauuagagggagc

SEQ ID NO: 62907 - RNA, 17 nt, Artificial Sequence
  Synthetic Oligonucleotide; CD160 exon 3; Set C
uaggacauuagagggag

SEQ ID NO: 62908 - RNA, 18 nt, Artificial Sequence
  Synthetic Oligonucleotide; CD160 exon 3; Set C
cuaggacauuagagggag

SEQ ID NO: 62909 - RNA, 19 nt, Artificial Sequence
  Synthetic Oligonucleotide; CD160 exon 3; Set C
ccuaggacauuagagggag

SEQ ID NO: 62910 - RNA, 20 nt, Artificial Sequence
  Synthetic Oligonucleotide; CD160 exon 3; Set C
accuaggacauuagagggag

SEQ ID NO: 62911 - RNA, 26 nt, Artificial Sequence
  Synthetic Oligonucleotide; CD160 exon 3; Set A
caguaccuaggacauuagagggagcc

SEQ ID NO: 62912 - RNA, 15 nt, Artificial Sequence
  Synthetic Oligonucleotide; CD160 exon 3; Set C
ccuaggacauuagag

SEQ ID NO: 62913 - RNA, 19 nt, Artificial Sequence
  Synthetic Oligonucleotide; CD160 exon 3; Set C
uaccuaggacauuagaggg

SEQ ID NO: 62914 - RNA, 16 nt, Artificial Sequence
  Synthetic Oligonucleotide; CD160 exon 3; Set C
accuaggacauuagag

SEQ ID NO: 62915 - RNA, 18 nt, Artificial Sequence
  Synthetic Oligonucleotide; CD160 exon 3; Set C
uaccuaggacauuagagg

SEQ ID NO: 62916 - RNA, 20 nt, Artificial Sequence
  Synthetic Oligonucleotide; CD160 exon 3; Set C
guaccuaggacauuagaggg

SEQ ID NO: 62917 - RNA, 29 nt, Artificial Sequence
  Synthetic Oligonucleotide; CD160 exon 3; Set C
ccacaguaccuaggacauuagagggagcc

SEQ ID NO: 62918 - RNA, 19 nt, Artificial Sequence
  Synthetic Oligonucleotide; CD160 exon 3; Set C
guaccuaggacauuagagg

SEQ ID NO: 62919 - RNA, 21 nt, Artificial Sequence
  Synthetic Oligonucleotide; CD160 exon 3; Set C
aguaccuaggacauuagaggg

SEQ ID NO: 62920 - RNA, 20 nt, Artificial Sequence
  Synthetic Oligonucleotide; CD160 exon 3; Set C
aguaccuaggacauuagagg

SEQ ID NO: 62921 - RNA, 19 nt, Artificial Sequence
  Synthetic Oligonucleotide; CD160 exon 3; Set C
caguaccuaggacauuaga

SEQ ID NO: 62922 - RNA, 18 nt, Artificial Sequence
  Synthetic Oligonucleotide; CD160 exon 3; Set C
caguaccuaggacauuag

SEQ ID NO: 62923 - RNA, 20 nt, Artificial Sequence
  Synthetic Oligonucleotide; CD160 exon 3; Set C
acaguaccuaggacauuaga

SEQ ID NO: 62924 - RNA, 17 nt, Artificial Sequence
  Synthetic Oligonucleotide; CD160 exon 3; Set C
caguaccuaggacauua

SEQ ID NO: 62925 - RNA, 19 nt, Artificial Sequence
  Synthetic Oligonucleotide; CD160 exon 3; Set C
acaguaccuaggacauuag

SEQ ID NO: 62926 - RNA, 21 nt, Artificial Sequence
  Synthetic Oligonucleotide; CD160 exon 3; Set C
cacaguaccuaggacauuaga

SEQ ID NO: 62927 - RNA, 16 nt, Artificial Sequence
  Synthetic Oligonucleotide; CD160 exon 3; Set C
caguaccuaggacauu

SEQ ID NO: 62928 - RNA, 18 nt, Artificial Sequence
  Synthetic Oligonucleotide; CD160 exon 3; Set C
acaguaccuaggacauua

SEQ ID NO: 62929 - RNA, 20 nt, Artificial Sequence
  Synthetic Oligonucleotide; CD160 exon 3; Set C
cacaguaccuaggacauuag

SEQ ID NO: 62930 - RNA, 22 nt, Artificial Sequence
  Synthetic Oligonucleotide; CD160 exon 3; Set A
ccacaguaccuaggacauuaga

SEQ ID NO: 62931 - RNA, 17 nt, Artificial Sequence
  Synthetic Oligonucleotide; CD160 exon 3; Set C
acaguaccuaggacauu

SEQ ID NO: 62932 - RNA, 15 nt, Artificial Sequence
  Synthetic Oligonucleotide; CD160 exon 3; Set C
caguaccuaggacau

SEQ ID NO: 62933 - RNA, 19 nt, Artificial Sequence
  Synthetic Oligonucleotide; CD160 exon 3; Set C
cacaguaccuaggacauua

SEQ ID NO: 62934 - RNA, 21 nt, Artificial Sequence
  Synthetic Oligonucleotide; CD160 exon 3; Set C
ccacaguaccuaggacauuag

SEQ ID NO: 62935 - RNA, 18 nt, Artificial Sequence
  Synthetic Oligonucleotide; CD160 exon 3; Set C
cacaguaccuaggacauu

SEQ ID NO: 62936 - RNA, 16 nt, Artificial Sequence
  Synthetic Oligonucleotide; CD160 exon 3; Set C
acaguaccuaggacau

SEQ ID NO: 62937 - RNA, 20 nt, Artificial Sequence
  Synthetic Oligonucleotide; CD160 exon 3; Set C
ccacaguaccuaggacauua

SEQ ID NO: 62938 - RNA, 38 nt, Artificial Sequence
  Synthetic Oligonucleotide; CD160 exon 3; Set C
aaaaguccuccacaguaccuaggacauuagagggagcc

SEQ ID NO: 62939 - RNA, 19 nt, Artificial Sequence
  Synthetic Oligonucleotide; CD160 exon 3; Set C
ccacaguaccuaggacauu

SEQ ID NO: 62940 - RNA, 17 nt, Artificial Sequence
  Synthetic Oligonucleotide; CD160 exon 3; Set C
cacaguaccuaggacau

SEQ ID NO: 62941 - RNA, 18 nt, Artificial Sequence
  Synthetic Oligonucleotide; CD160 exon 3; Set C
ccacaguaccuaggacau

SEQ ID NO: 62942 - RNA, 29 nt, Artificial Sequence
  Synthetic Oligonucleotide; CD160 exon 3; Set A
aaguccuccacaguaccuaggacauuaga

SEQ ID NO: 62943 - RNA, 28 nt, Artificial Sequence
  Synthetic Oligonucleotide; CD160 exon 3; Set A
aaguccuccacaguaccuaggacauuag

SEQ ID NO: 62944 - RNA, 30 nt, Artificial Sequence
  Synthetic Oligonucleotide; CD160 exon 3; Set A
aaaguccuccacaguaccuaggacauuaga

SEQ ID NO: 62945 - RNA, 34 nt, Artificial Sequence
  Synthetic Oligonucleotide; CD160 exon 3; Set A
uaaaaguccuccacaguaccuaggacauuagagg

SEQ ID NO: 62946 - RNA, 27 nt, Artificial Sequence
  Synthetic Oligonucleotide; CD160 exon 3; Set A
aaguccuccacaguaccuaggacauua

SEQ ID NO: 62947 - RNA, 29 nt, Artificial Sequence
  Synthetic Oligonucleotide; CD160 exon 3; Set A
aaaguccuccacaguaccuaggacauuag

SEQ ID NO: 62948 - RNA, 31 nt, Artificial Sequence
  Synthetic Oligonucleotide; CD160 exon 3; Set A
aaaaguccuccacaguaccuaggacauuaga

SEQ ID NO: 62949 - RNA, 26 nt, Artificial Sequence
  Synthetic Oligonucleotide; CD160 exon 3; Set A
aaguccuccacaguaccuaggacauu

SEQ ID NO: 62950 - RNA, 28 nt, Artificial Sequence
  Synthetic Oligonucleotide; CD160 exon 3; Set A
aaaguccuccacaguaccuaggacauua

SEQ ID NO: 62951 - RNA, 30 nt, Artificial Sequence
  Synthetic Oligonucleotide; CD160 exon 3; Set A
aaaaguccuccacaguaccuaggacauuag

SEQ ID NO: 62952 - RNA, 27 nt, Artificial Sequence
  Synthetic Oligonucleotide; CD160 exon 3; Set A
aaaguccuccacaguaccuaggacauu

SEQ ID NO: 62953 - RNA, 25 nt, Artificial Sequence
  Synthetic Oligonucleotide; CD160 exon 3; Set A
aaguccuccacaguaccuaggacau

SEQ ID NO: 62954 - RNA, 29 nt, Artificial Sequence
  Synthetic Oligonucleotide; CD160 exon 3; Set A
aaaaguccuccacaguaccuaggacauua

SEQ ID NO: 62955 - RNA, 28 nt, Artificial Sequence
  Synthetic Oligonucleotide; CD160 exon 3; Set A
aaaaguccuccacaguaccuaggacauu

SEQ ID NO: 62956 - RNA, 26 nt, Artificial Sequence
  Synthetic Oligonucleotide; CD160 exon 3; Set A
aaaguccuccacaguaccuaggacau

SEQ ID NO: 62957 - RNA, 27 nt, Artificial Sequence
  Synthetic Oligonucleotide; CD160 exon 3; Set A
aaaaguccuccacaguaccuaggacau

SEQ ID NO: 62958 - RNA, 30 nt, Artificial Sequence
  Synthetic Oligonucleotide; CD160 exon 3; Set A
auaaaaguccuccacaguaccuaggacauu

SEQ ID NO: 62959 - RNA, 40 nt, Artificial Sequence
  Synthetic Oligonucleotide; CD160 exon 3; Set C
cugcucauaaaaguccuccacaguaccuaggacauuagag

SEQ ID NO: 62960 - RNA, 23 nt, Artificial Sequence
  Synthetic Oligonucleotide; CD160 exon 3; Set C
uaaaaguccuccacaguaccuag

SEQ ID NO: 62961 - RNA, 18 nt, Artificial Sequence
  Synthetic Oligonucleotide; CD160 exon 3; Set C
aaaaguccuccacaguac

SEQ ID NO: 62962 - RNA, 39 nt, Artificial Sequence
  Synthetic Oligonucleotide; CD160 exon 3; Set C
gauacugcucauaaaaguccuccacaguaccuaggacau

SEQ ID NO: 62963 - RNA, 38 nt, Artificial Sequence
  Synthetic Oligonucleotide; CD160 exon 3; Set C
gauacugcucauaaaaguccuccacaguaccuaggaca

SEQ ID NO: 62964 - RNA, 29 nt, Artificial Sequence
  Synthetic Oligonucleotide; CD160 exon 3; Set A
cugcucauaaaaguccuccacaguaccua

SEQ ID NO: 62965 - RNA, 31 nt, Artificial Sequence
  Synthetic Oligonucleotide; CD160 exon 3; Set A
acugcucauaaaaguccuccacaguaccuag

SEQ ID NO: 62966 - RNA, 28 nt, Artificial Sequence
  Synthetic Oligonucleotide; CD160 exon 3; Set A
cugcucauaaaaguccuccacaguaccu

SEQ ID NO: 62967 - RNA, 30 nt, Artificial Sequence
  Synthetic Oligonucleotide; CD160 exon 3; Set A
acugcucauaaaaguccuccacaguaccua

SEQ ID NO: 62968 - RNA, 32 nt, Artificial Sequence
  Synthetic Oligonucleotide; CD160 exon 3; Set A
uacugcucauaaaaguccuccacaguaccuag

SEQ ID NO: 62969 - RNA, 29 nt, Artificial Sequence
  Synthetic Oligonucleotide; CD160 exon 3; Set A
acugcucauaaaaguccuccacaguaccu

SEQ ID NO: 62970 - RNA, 27 nt, Artificial Sequence
  Synthetic Oligonucleotide; CD160 exon 3; Set A
cugcucauaaaaguccuccacaguacc

SEQ ID NO: 62971 - RNA, 31 nt, Artificial Sequence
  Synthetic Oligonucleotide; CD160 exon 3; Set A
uacugcucauaaaaguccuccacaguaccua

SEQ ID NO: 62972 - RNA, 33 nt, Artificial Sequence
  Synthetic Oligonucleotide; CD160 exon 3; Set A
auacugcucauaaaaguccuccacaguaccuag

SEQ ID NO: 62973 - RNA, 30 nt, Artificial Sequence
  Synthetic Oligonucleotide; CD160 exon 3; Set A
uacugcucauaaaaguccuccacaguaccu

SEQ ID NO: 62974 - RNA, 28 nt, Artificial Sequence
  Synthetic Oligonucleotide; CD160 exon 3; Set A
acugcucauaaaaguccuccacaguacc

SEQ ID NO: 62975 - RNA, 32 nt, Artificial Sequence
  Synthetic Oligonucleotide; CD160 exon 3; Set A
auacugcucauaaaaguccuccacaguaccua

SEQ ID NO: 62976 - RNA, 31 nt, Artificial Sequence
  Synthetic Oligonucleotide; CD160 exon 3; Set A
auacugcucauaaaaguccuccacaguaccu

SEQ ID NO: 62977 - RNA, 29 nt, Artificial Sequence
  Synthetic Oligonucleotide; CD160 exon 3; Set A
uacugcucauaaaaguccuccacaguacc

SEQ ID NO: 62978 - RNA, 30 nt, Artificial Sequence
  Synthetic Oligonucleotide; CD160 exon 3; Set A
auacugcucauaaaaguccuccacaguacc

SEQ ID NO: 62979 - RNA, 30 nt, Artificial Sequence
  Synthetic Oligonucleotide; CD160 exon 3; Set A
gauacugcucauaaaaguccuccacaguac

SEQ ID NO: 62980 - RNA, 29 nt, Artificial Sequence
  Synthetic Oligonucleotide; CD160 exon 3; Set A
gauacugcucauaaaaguccuccacagua

SEQ ID NO: 62981 - RNA, 28 nt, Artificial Sequence
  Synthetic Oligonucleotide; CD160 exon 3; Set A
gauacugcucauaaaaguccuccacagu

SEQ ID NO: 62982 - RNA, 19 nt, Artificial Sequence
  Synthetic Oligonucleotide; CD160 exon 3; Set C
cugcucauaaaaguccucc

SEQ ID NO: 62983 - RNA, 20 nt, Artificial Sequence
  Synthetic Oligonucleotide; CD160 exon 3; Set C
acugcucauaaaaguccucc

SEQ ID NO: 62984 - RNA, 40 nt, Artificial Sequence
  Synthetic Oligonucleotide; CD160 exon 3; Set A
aaaaugagauacugcucauaaaaguccuccacaguaccua

SEQ ID NO: 62985 - RNA, 21 nt, Artificial Sequence
  Synthetic Oligonucleotide; CD160 exon 3; Set C
uacugcucauaaaaguccucc

SEQ ID NO: 62986 - RNA, 22 nt, Artificial Sequence
  Synthetic Oligonucleotide; CD160 exon 3; Set C
auacugcucauaaaaguccucc

SEQ ID NO: 62987 - RNA, 30 nt, Artificial Sequence
  Synthetic Oligonucleotide; CD160 exon 3; Set C
aaaaugagauacugcucauaaaaguccucc

SEQ ID NO: 62988 - RNA, 35 nt, Artificial Sequence
  Synthetic Oligonucleotide; CD160 exon 3; Set A
gauucaaaaugagauacugcucauaaaaguccucc

SEQ ID NO: 62989 - RNA, 36 nt, Artificial Sequence
  Synthetic Oligonucleotide; CD160 exon 3; Set A
ggauucaaaaugagauacugcucauaaaaguccucc

SEQ ID NO: 62990 - RNA, 37 nt, Artificial Sequence
  Synthetic Oligonucleotide; CD160 exon 3; Set A
aggauucaaaaugagauacugcucauaaaaguccucc

SEQ ID NO: 62991 - RNA, 38 nt, Artificial Sequence
  Synthetic Oligonucleotide; CD160 exon 3; Set A
aaggauucaaaaugagauacugcucauaaaaguccucc

SEQ ID NO: 62992 - RNA, 39 nt, Artificial Sequence
  Synthetic Oligonucleotide; CD160 exon 3; Set A
caaggauucaaaaugagauacugcucauaaaaguccucc

SEQ ID NO: 62993 - RNA, 40 nt, Artificial Sequence
  Synthetic Oligonucleotide; CD160 exon 3; Set A
gcaaggauucaaaaugagauacugcucauaaaaguccucc

SEQ ID NO: 62994 - RNA, 15 nt, Artificial Sequence
  Synthetic Oligonucleotide; CD160 exon 3; Set C
caaaaugagauacug

SEQ ID NO: 62995 - RNA, 17 nt, Artificial Sequence
  Synthetic Oligonucleotide; CD160 exon 3; Set C
uucaaaaugagauacug

SEQ ID NO: 62996 - RNA, 32 nt, Artificial Sequence
  Synthetic Oligonucleotide; CD160 exon 3; Set A
ugcaaggauucaaaaugagauacugcucauaa

SEQ ID NO: 62997 - RNA, 16 nt, Artificial Sequence
  Synthetic Oligonucleotide; CD160 exon 3; Set C
uucaaaaugagauacu

SEQ ID NO: 62998 - RNA, 18 nt, Artificial Sequence
  Synthetic Oligonucleotide; CD160 exon 3; Set C
auucaaaaugagauacug

SEQ ID NO: 62999 - RNA, 15 nt, Artificial Sequence
  Synthetic Oligonucleotide; CD160 exon 3; Set C
uucaaaaugagauac

SEQ ID NO: 63000 - RNA, 17 nt, Artificial Sequence
  Synthetic Oligonucleotide; CD160 exon 3; Set C
auucaaaaugagauacu

SEQ ID NO: 63001 - RNA, 16 nt, Artificial Sequence
  Synthetic Oligonucleotide; CD160 exon 3; Set C
auucaaaaugagauac

SEQ ID NO: 63002 - RNA, 40 nt, Artificial Sequence
  Synthetic Oligonucleotide; CD160 exon 3; Set A
gugggugcaaggauucaaaaugagauacugcucauaaaag

SEQ ID NO: 63003 - RNA, 15 nt, Artificial Sequence
  Synthetic Oligonucleotide; CD160 exon 3; Set C
auucaaaaugagaua

SEQ ID NO: 63004 - RNA, 39 nt, Artificial Sequence
  Synthetic Oligonucleotide; CD160 exon 3; Set A
gugggugcaaggauucaaaaugagauacugcucauaaaa

SEQ ID NO: 63005 - RNA, 38 nt, Artificial Sequence
  Synthetic Oligonucleotide; CD160 exon 3; Set A
gugggugcaaggauucaaaaugagauacugcucauaaa

SEQ ID NO: 63006 - RNA, 40 nt, Artificial Sequence
  Synthetic Oligonucleotide; CD160 exon 3; Set A
agugggugcaaggauucaaaaugagauacugcucauaaaa

SEQ ID NO: 63007 - RNA, 39 nt, Artificial Sequence
  Synthetic Oligonucleotide; CD160 exon 3; Set A
agugggugcaaggauucaaaaugagauacugcucauaaa

SEQ ID NO: 63008 - RNA, 16 nt, Artificial Sequence
  Synthetic Oligonucleotide; CD160 exon 3; Set C
ggauucaaaaugagau

SEQ ID NO: 63009 - RNA, 39 nt, Artificial Sequence
  Synthetic Oligonucleotide; CD160 exon 3; Set C
cagugggugcaaggauucaaaaugagauacugcucauaa

SEQ ID NO: 63010 - RNA, 25 nt, Artificial Sequence
  Synthetic Oligonucleotide; CD160 exon 3; Set C
ugcaaggauucaaaaugagauacug

SEQ ID NO: 63011 - RNA, 17 nt, Artificial Sequence
  Synthetic Oligonucleotide; CD160 exon 3; Set C
aggauucaaaaugagau

SEQ ID NO: 63012 - RNA, 24 nt, Artificial Sequence
  Synthetic Oligonucleotide; CD160 exon 3; Set C
ugcaaggauucaaaaugagauacu

SEQ ID NO: 63013 - RNA, 18 nt, Artificial Sequence
  Synthetic Oligonucleotide; CD160 exon 3; Set C
aaggauucaaaaugagau

SEQ ID NO: 63014 - RNA, 23 nt, Artificial Sequence
  Synthetic Oligonucleotide; CD160 exon 3; Set C
ugcaaggauucaaaaugagauac

SEQ ID NO: 63015 - RNA, 22 nt, Artificial Sequence
  Synthetic Oligonucleotide; CD160 exon 3; Set C
ugcaaggauucaaaaugagaua

SEQ ID NO: 63016 - RNA, 32 nt, Artificial Sequence
  Synthetic Oligonucleotide; CD160 exon 3; Set A
cagugggugcaaggauucaaaaugagauacug

SEQ ID NO: 63017 - RNA, 31 nt, Artificial Sequence
  Synthetic Oligonucleotide; CD160 exon 3; Set A
cagugggugcaaggauucaaaaugagauacu

SEQ ID NO: 63018 - RNA, 30 nt, Artificial Sequence
  Synthetic Oligonucleotide; CD160 exon 3; Set A
cagugggugcaaggauucaaaaugagauac

SEQ ID NO: 63019 - RNA, 29 nt, Artificial Sequence
  Synthetic Oligonucleotide; CD160 exon 3; Set A
cagugggugcaaggauucaaaaugagaua

SEQ ID NO: 63020 - RNA, 35 nt, Artificial Sequence
  Synthetic Oligonucleotide; CD160 exon 3; Set C
acccagugggugcaaggauucaaaaugagauacug

SEQ ID NO: 63021 - RNA, 34 nt, Artificial Sequence
  Synthetic Oligonucleotide; CD160 exon 3; Set C
acccagugggugcaaggauucaaaaugagauacu

SEQ ID NO: 63022 - RNA, 33 nt, Artificial Sequence
  Synthetic Oligonucleotide; CD160 exon 3; Set A
acccagugggugcaaggauucaaaaugagauac

SEQ ID NO: 63023 - RNA, 32 nt, Artificial Sequence
  Synthetic Oligonucleotide; CD160 exon 3; Set A
acccagugggugcaaggauucaaaaugagaua

SEQ ID NO: 63024 - RNA, 32 nt, Artificial Sequence
  Synthetic Oligonucleotide; CD160 exon 3; Set A
aacccagugggugcaaggauucaaaaugagau

SEQ ID NO: 63025 - RNA, 17 nt, Artificial Sequence
  Synthetic Oligonucleotide; CD160 exon 3; Set C
ugggugcaaggauucaa

SEQ ID NO: 63026 - RNA, 16 nt, Artificial Sequence
  Synthetic Oligonucleotide; CD160 exon 3; Set C
ugggugcaaggauuca

SEQ ID NO: 63027 - RNA, 15 nt, Artificial Sequence
  Synthetic Oligonucleotide; CD160 exon 3; Set C
ugggugcaaggauuc

SEQ ID NO: 63028 - RNA, 17 nt, Artificial Sequence
  Synthetic Oligonucleotide; CD160 exon 3; Set C
gugggugcaaggauuca

SEQ ID NO: 63029 - RNA, 16 nt, Artificial Sequence
  Synthetic Oligonucleotide; CD160 exon 3; Set C
gugggugcaaggauuc

SEQ ID NO: 63030 - RNA, 18 nt, Artificial Sequence
  Synthetic Oligonucleotide; CD160 exon 3; Set C
agugggugcaaggauuca

SEQ ID NO: 63031 - RNA, 17 nt, Artificial Sequence
  Synthetic Oligonucleotide; CD160 exon 3; Set C
agugggugcaaggauuc

SEQ ID NO: 63032 - RNA, 38 nt, Artificial Sequence
  Synthetic Oligonucleotide; CD160 exon 3; Set C
cuacccaacccagugggugcaaggauucaaaaugagau

SEQ ID NO: 63033 - RNA, 16 nt, Artificial Sequence
  Synthetic Oligonucleotide; CD160 exon 3; Set C
cagugggugcaaggau

SEQ ID NO: 63034 - RNA, 24 nt, Artificial Sequence
  Synthetic Oligonucleotide; CD160 exon 3; Set A
aacccagugggugcaaggauucaa

SEQ ID NO: 63035 - RNA, 15 nt, Artificial Sequence
  Synthetic Oligonucleotide; CD160 exon 3; Set C
cagugggugcaagga

SEQ ID NO: 63036 - RNA, 19 nt, Artificial Sequence
  Synthetic Oligonucleotide; CD160 exon 3; Set A
acccagugggugcaaggau

SEQ ID NO: 63037 - RNA, 21 nt, Artificial Sequence
  Synthetic Oligonucleotide; CD160 exon 3; Set A
aacccagugggugcaaggauu

SEQ ID NO: 63038 - RNA, 18 nt, Artificial Sequence
  Synthetic Oligonucleotide; CD160 exon 3; Set A
acccagugggugcaagga

SEQ ID NO: 63039 - RNA, 17 nt, Artificial Sequence
  Synthetic Oligonucleotide; CD160 exon 3; Set A
acccagugggugcaagg

SEQ ID NO: 63040 - RNA, 16 nt, Artificial Sequence
  Synthetic Oligonucleotide; CD160 exon 3; Set C
acccagugggugcaag

SEQ ID NO: 63041 - RNA, 15 nt, Artificial Sequence
  Synthetic Oligonucleotide; CD160 exon 3; Set C
acccagugggugcaa

SEQ ID NO: 63042 - RNA, 31 nt, Artificial Sequence
  Synthetic Oligonucleotide; CD160 exon 3; Set C
ccuacccaacccagugggugcaaggauucaa

SEQ ID NO: 63043 - RNA, 32 nt, Artificial Sequence
  Synthetic Oligonucleotide; CD160 exon 3; Set C
accuacccaacccagugggugcaaggauucaa

SEQ ID NO: 63044 - RNA, 30 nt, Artificial Sequence
  Synthetic Oligonucleotide; CD160 exon 3; Set C
ccuacccaacccagugggugcaaggauuca

SEQ ID NO: 63045 - RNA, 33 nt, Artificial Sequence
  Synthetic Oligonucleotide; CD160 exon 3; Set C
caccuacccaacccagugggugcaaggauucaa

SEQ ID NO: 63046 - RNA, 29 nt, Artificial Sequence
  Synthetic Oligonucleotide; CD160 exon 3; Set C
ccuacccaacccagugggugcaaggauuc

SEQ ID NO: 63047 - RNA, 31 nt, Artificial Sequence
  Synthetic Oligonucleotide; CD160 exon 3; Set C
accuacccaacccagugggugcaaggauuca

SEQ ID NO: 63048 - RNA, 28 nt, Artificial Sequence
  Synthetic Oligonucleotide; CD160 exon 3; Set C
ccuacccaacccagugggugcaaggauu

SEQ ID NO: 63049 - RNA, 34 nt, Artificial Sequence
  Synthetic Oligonucleotide; CD160 exon 3; Set C
acaccuacccaacccagugggugcaaggauucaa

SEQ ID NO: 63050 - RNA, 30 nt, Artificial Sequence
  Synthetic Oligonucleotide; CD160 exon 3; Set C
accuacccaacccagugggugcaaggauuc

SEQ ID NO: 63051 - RNA, 32 nt, Artificial Sequence
  Synthetic Oligonucleotide; CD160 exon 3; Set C
caccuacccaacccagugggugcaaggauuca

SEQ ID NO: 63052 - RNA, 25 nt, Artificial Sequence
  Synthetic Oligonucleotide; CD160 exon 3; Set C
cuacccaacccagugggugcaagga

SEQ ID NO: 63053 - RNA, 29 nt, Artificial Sequence
  Synthetic Oligonucleotide; CD160 exon 3; Set C
accuacccaacccagugggugcaaggauu

SEQ ID NO: 63054 - RNA, 35 nt, Artificial Sequence
  Synthetic Oligonucleotide; CD160 exon 3; Set C
aacaccuacccaacccagugggugcaaggauucaa

SEQ ID NO: 63055 - RNA, 31 nt, Artificial Sequence
  Synthetic Oligonucleotide; CD160 exon 3; Set C
caccuacccaacccagugggugcaaggauuc

SEQ ID NO: 63056 - RNA, 33 nt, Artificial Sequence
  Synthetic Oligonucleotide; CD160 exon 3; Set C
acaccuacccaacccagugggugcaaggauuca

SEQ ID NO: 63057 - RNA, 24 nt, Artificial Sequence
  Synthetic Oligonucleotide; CD160 exon 3; Set C
cuacccaacccagugggugcaagg

SEQ ID NO: 63058 - RNA, 30 nt, Artificial Sequence
  Synthetic Oligonucleotide; CD160 exon 3; Set C
caccuacccaacccagugggugcaaggauu

SEQ ID NO: 63059 - RNA, 36 nt, Artificial Sequence
  Synthetic Oligonucleotide; CD160 exon 3; Set C
uaacaccuacccaacccagugggugcaaggauucaa

SEQ ID NO: 63060 - RNA, 32 nt, Artificial Sequence
  Synthetic Oligonucleotide; CD160 exon 3; Set C
acaccuacccaacccagugggugcaaggauuc

SEQ ID NO: 63061 - RNA, 34 nt, Artificial Sequence
  Synthetic Oligonucleotide; CD160 exon 3; Set C
aacaccuacccaacccagugggugcaaggauuca

SEQ ID NO: 63062 - RNA, 23 nt, Artificial Sequence
  Synthetic Oligonucleotide; CD160 exon 3; Set A
cuacccaacccagugggugcaag

SEQ ID NO: 63063 - RNA, 31 nt, Artificial Sequence
  Synthetic Oligonucleotide; CD160 exon 3; Set C
acaccuacccaacccagugggugcaaggauu

SEQ ID NO: 63064 - RNA, 37 nt, Artificial Sequence
  Synthetic Oligonucleotide; CD160 exon 3; Set C
guaacaccuacccaacccagugggugcaaggauucaa

SEQ ID NO: 63065 - RNA, 33 nt, Artificial Sequence
  Synthetic Oligonucleotide; CD160 exon 3; Set C
aacaccuacccaacccagugggugcaaggauuc

SEQ ID NO: 63066 - RNA, 35 nt, Artificial Sequence
  Synthetic Oligonucleotide; CD160 exon 3; Set C
uaacaccuacccaacccagugggugcaaggauuca

SEQ ID NO: 63067 - RNA, 22 nt, Artificial Sequence
  Synthetic Oligonucleotide; CD160 exon 3; Set C
cuacccaacccagugggugcaa

SEQ ID NO: 63068 - RNA, 32 nt, Artificial Sequence
  Synthetic Oligonucleotide; CD160 exon 3; Set C
aacaccuacccaacccagugggugcaaggauu

SEQ ID NO: 63069 - RNA, 38 nt, Artificial Sequence
  Synthetic Oligonucleotide; CD160 exon 3; Set C
uguaacaccuacccaacccagugggugcaaggauucaa

SEQ ID NO: 63070 - RNA, 34 nt, Artificial Sequence
  Synthetic Oligonucleotide; CD160 exon 3; Set C
uaacaccuacccaacccagugggugcaaggauuc

SEQ ID NO: 63071 - RNA, 36 nt, Artificial Sequence
  Synthetic Oligonucleotide; CD160 exon 3; Set C
guaacaccuacccaacccagugggugcaaggauuca

SEQ ID NO: 63072 - RNA, 21 nt, Artificial Sequence
  Synthetic Oligonucleotide; CD160 exon 3; Set C
cuacccaacccagugggugca

SEQ ID NO: 63073 - RNA, 33 nt, Artificial Sequence
  Synthetic Oligonucleotide; CD160 exon 3; Set C
uaacaccuacccaacccagugggugcaaggauu

SEQ ID NO: 63074 - RNA, 35 nt, Artificial Sequence
  Synthetic Oligonucleotide; CD160 exon 3; Set C
guaacaccuacccaacccagugggugcaaggauuc

SEQ ID NO: 63075 - RNA, 37 nt, Artificial Sequence
  Synthetic Oligonucleotide; CD160 exon 3; Set C
uguaacaccuacccaacccagugggugcaaggauuca

SEQ ID NO: 63076 - RNA, 34 nt, Artificial Sequence
  Synthetic Oligonucleotide; CD160 exon 3; Set C
guaacaccuacccaacccagugggugcaaggauu

SEQ ID NO: 63077 - RNA, 36 nt, Artificial Sequence
  Synthetic Oligonucleotide; CD160 exon 3; Set C
uguaacaccuacccaacccagugggugcaaggauuc

SEQ ID NO: 63078 - RNA, 38 nt, Artificial Sequence
  Synthetic Oligonucleotide; CD160 exon 3; Set C
uuguaacaccuacccaacccagugggugcaaggauuca

SEQ ID NO: 63079 - RNA, 37 nt, Artificial Sequence
  Synthetic Oligonucleotide; CD160 exon 3; Set C
uuguaacaccuacccaacccagugggugcaaggauuc

SEQ ID NO: 63080 - RNA, 22 nt, Artificial Sequence
  Synthetic Oligonucleotide; CD160 exon 3; Set C
accuacccaacccagugggugc

SEQ ID NO: 63081 - RNA, 23 nt, Artificial Sequence
  Synthetic Oligonucleotide; CD160 exon 3; Set C
caccuacccaacccagugggugc

SEQ ID NO: 63082 - RNA, 36 nt, Artificial Sequence
  Synthetic Oligonucleotide; CD160 exon 3; Set C
auuguaacaccuacccaacccagugggugcaaggau

SEQ ID NO: 63083 - RNA, 16 nt, Artificial Sequence
  Synthetic Oligonucleotide; CD160 exon 3; Set C
cuacccaacccagugg

SEQ ID NO: 63084 - RNA, 24 nt, Artificial Sequence
  Synthetic Oligonucleotide; CD160 exon 3; Set C
acaccuacccaacccagugggugc

SEQ ID NO: 63085 - RNA, 37 nt, Artificial Sequence
  Synthetic Oligonucleotide; CD160 exon 3; Set C
cauuguaacaccuacccaacccagugggugcaaggau

SEQ ID NO: 63086 - RNA, 25 nt, Artificial Sequence
  Synthetic Oligonucleotide; CD160 exon 3; Set C
aacaccuacccaacccagugggugc

SEQ ID NO: 63087 - RNA, 26 nt, Artificial Sequence
  Synthetic Oligonucleotide; CD160 exon 3; Set C
uaacaccuacccaacccagugggugc

SEQ ID NO: 63088 - RNA, 27 nt, Artificial Sequence
  Synthetic Oligonucleotide; CD160 exon 3; Set C
guaacaccuacccaacccagugggugc

SEQ ID NO: 63089 - RNA, 32 nt, Artificial Sequence
  Synthetic Oligonucleotide; CD160 exon 3; Set C
auuguaacaccuacccaacccagugggugcaa

SEQ ID NO: 63090 - RNA, 28 nt, Artificial Sequence
  Synthetic Oligonucleotide; CD160 exon 3; Set C
uguaacaccuacccaacccagugggugc

SEQ ID NO: 63091 - RNA, 29 nt, Artificial Sequence
  Synthetic Oligonucleotide; CD160 exon 3; Set C
uuguaacaccuacccaacccagugggugc

SEQ ID NO: 63092 - RNA, 16 nt, Artificial Sequence
  Synthetic Oligonucleotide; CD160 exon 3; Set C
caccuacccaacccag

SEQ ID NO: 63093 - RNA, 17 nt, Artificial Sequence
  Synthetic Oligonucleotide; CD160 exon 3; Set C
acaccuacccaacccag

SEQ ID NO: 63094 - RNA, 18 nt, Artificial Sequence
  Synthetic Oligonucleotide; CD160 exon 3; Set C
aacaccuacccaacccag

SEQ ID NO: 63095 - RNA, 19 nt, Artificial Sequence
  Synthetic Oligonucleotide; CD160 exon 3; Set C
uaacaccuacccaacccag

SEQ ID NO: 63096 - RNA, 26 nt, Artificial Sequence
  Synthetic Oligonucleotide; CD160 exon 3; Set A
auuguaacaccuacccaacccagugg

SEQ ID NO: 63097 - RNA, 40 nt, Artificial Sequence
  Synthetic Oligonucleotide; CD160 exon 3; Set C
aaugggcauuguaacaccuacccaacccagugggugcaag

SEQ ID NO: 63098 - RNA, 20 nt, Artificial Sequence
  Synthetic Oligonucleotide; CD160 exon 3; Set A
guaacaccuacccaacccag

SEQ ID NO: 63099 - RNA, 25 nt, Artificial Sequence
  Synthetic Oligonucleotide; CD160 exon 3; Set A
auuguaacaccuacccaacccagug

SEQ ID NO: 63100 - RNA, 39 nt, Artificial Sequence
  Synthetic Oligonucleotide; CD160 exon 3; Set C
aaugggcauuguaacaccuacccaacccagugggugcaa

SEQ ID NO: 63101 - RNA, 21 nt, Artificial Sequence
  Synthetic Oligonucleotide; CD160 exon 3; Set A
uguaacaccuacccaacccag

SEQ ID NO: 63102 - RNA, 24 nt, Artificial Sequence
  Synthetic Oligonucleotide; CD160 exon 3; Set A
auuguaacaccuacccaacccagu

SEQ ID NO: 63103 - RNA, 26 nt, Artificial Sequence
  Synthetic Oligonucleotide; CD160 exon 3; Set A
cauuguaacaccuacccaacccagug

SEQ ID NO: 63104 - RNA, 38 nt, Artificial Sequence
  Synthetic Oligonucleotide; CD160 exon 3; Set C
aaugggcauuguaacaccuacccaacccagugggugca

SEQ ID NO: 63105 - RNA, 22 nt, Artificial Sequence
  Synthetic Oligonucleotide; CD160 exon 3; Set A
uuguaacaccuacccaacccag

SEQ ID NO: 63106 - RNA, 16 nt, Artificial Sequence
  Synthetic Oligonucleotide; CD160 exon 3; Set C
uaacaccuacccaacc

SEQ ID NO: 63107 - RNA, 25 nt, Artificial Sequence
  Synthetic Oligonucleotide; CD160 exon 3; Set A
cauuguaacaccuacccaacccagu

SEQ ID NO: 63108 - RNA, 17 nt, Artificial Sequence
  Synthetic Oligonucleotide; CD160 exon 3; Set C
guaacaccuacccaacc

SEQ ID NO: 63109 - RNA, 18 nt, Artificial Sequence
  Synthetic Oligonucleotide; CD160 exon 3; Set C
uguaacaccuacccaacc

SEQ ID NO: 63110 - RNA, 19 nt, Artificial Sequence
  Synthetic Oligonucleotide; CD160 exon 3; Set C
uuguaacaccuacccaacc

SEQ ID NO: 63111 - RNA, 40 nt, Artificial Sequence
  Synthetic Oligonucleotide; CD160 exon 3; Set C
uugaaugggcauuguaacaccuacccaacccagugggugc

SEQ ID NO: 63112 - RNA, 33 nt, Artificial Sequence
  Synthetic Oligonucleotide; CD160 exon 3; Set C
aaugggcauuguaacaccuacccaacccagugg

SEQ ID NO: 63113 - RNA, 39 nt, Artificial Sequence
  Synthetic Oligonucleotide; CD160 exon 3; Set C
uuuuugaaugggcauuguaacaccuacccaacccagugg

SEQ ID NO: 63114 - RNA, 33 nt, Artificial Sequence
  Synthetic Oligonucleotide; CD160 exon 3; Set C
uugaaugggcauuguaacaccuacccaacccag

SEQ ID NO: 63115 - RNA, 26 nt, Artificial Sequence
  Synthetic Oligonucleotide; CD160 exon 3; Set A
aaugggcauuguaacaccuacccaac

SEQ ID NO: 63116 - RNA, 34 nt, Artificial Sequence
  Synthetic Oligonucleotide; CD160 exon 3; Set C
uuugaaugggcauuguaacaccuacccaacccag

SEQ ID NO: 63117 - RNA, 27 nt, Artificial Sequence
  Synthetic Oligonucleotide; CD160 exon 3; Set A
gaaugggcauuguaacaccuacccaac

SEQ ID NO: 63118 - RNA, 28 nt, Artificial Sequence
  Synthetic Oligonucleotide; CD160 exon 3; Set A
ugaaugggcauuguaacaccuacccaac

SEQ ID NO: 63119 - RNA, 30 nt, Artificial Sequence
  Synthetic Oligonucleotide; CD160 exon 3; Set C
uugaaugggcauuguaacaccuacccaacc

SEQ ID NO: 63120 - RNA, 31 nt, Artificial Sequence
  Synthetic Oligonucleotide; CD160 exon 3; Set C
uuugaaugggcauuguaacaccuacccaacc

SEQ ID NO: 63121 - RNA, 32 nt, Artificial Sequence
  Synthetic Oligonucleotide; CD160 exon 3; Set A
uuuuugaaugggcauuguaacaccuacccaac

SEQ ID NO: 63122 - RNA, 39 nt, Artificial Sequence
  Synthetic Oligonucleotide; CD160 exon 3; Set C
uugccauuuuugaaugggcauuguaacaccuacccaacc

SEQ ID NO: 63123 - RNA, 39 nt, Artificial Sequence
  Synthetic Oligonucleotide; CD160 exon 3; Set C
gcuugcuuugccauuuuugaaugggcauuguaacaccua

SEQ ID NO: 63124 - RNA, 39 nt, Artificial Sequence
  Synthetic Oligonucleotide; CD160 exon 3; Set C
agcuugcuuugccauuuuugaaugggcauuguaacaccu

SEQ ID NO: 63125 - RNA, 36 nt, Artificial Sequence
  Synthetic Oligonucleotide; CD160 exon 3; Set C
gcuugcuuugccauuuuugaaugggcauuguaacac

SEQ ID NO: 63126 - RNA, 38 nt, Artificial Sequence
  Synthetic Oligonucleotide; CD160 exon 3; Set C
agcuugcuuugccauuuuugaaugggcauuguaacacc

SEQ ID NO: 63127 - RNA, 40 nt, Artificial Sequence
  Synthetic Oligonucleotide; CD160 exon 3; Set C
gagcuugcuuugccauuuuugaaugggcauuguaacaccu

SEQ ID NO: 63128 - RNA, 22 nt, Artificial Sequence
  Synthetic Oligonucleotide; CD160 exon 3; Set C
uugccauuuuugaaugggcauu

SEQ ID NO: 63129 - RNA, 37 nt, Artificial Sequence
  Synthetic Oligonucleotide; CD160 exon 3; Set C
agcuugcuuugccauuuuugaaugggcauuguaacac

SEQ ID NO: 63130 - RNA, 39 nt, Artificial Sequence
  Synthetic Oligonucleotide; CD160 exon 3; Set C
gagcuugcuuugccauuuuugaaugggcauuguaacacc

SEQ ID NO: 63131 - RNA, 23 nt, Artificial Sequence
  Synthetic Oligonucleotide; CD160 exon 3; Set C
uuugccauuuuugaaugggcauu

SEQ ID NO: 63132 - RNA, 34 nt, Artificial Sequence
  Synthetic Oligonucleotide; CD160 exon 3; Set C
gcuugcuuugccauuuuugaaugggcauuguaac

SEQ ID NO: 63133 - RNA, 36 nt, Artificial Sequence
  Synthetic Oligonucleotide; CD160 exon 3; Set C
agcuugcuuugccauuuuugaaugggcauuguaaca

SEQ ID NO: 63134 - RNA, 38 nt, Artificial Sequence
  Synthetic Oligonucleotide; CD160 exon 3; Set C
gagcuugcuuugccauuuuugaaugggcauuguaacac

SEQ ID NO: 63135 - RNA, 33 nt, Artificial Sequence
  Synthetic Oligonucleotide; CD160 exon 3; Set C
gcuugcuuugccauuuuugaaugggcauuguaa

SEQ ID NO: 63136 - RNA, 35 nt, Artificial Sequence
  Synthetic Oligonucleotide; CD160 exon 3; Set C
agcuugcuuugccauuuuugaaugggcauuguaac

SEQ ID NO: 63137 - RNA, 37 nt, Artificial Sequence
  Synthetic Oligonucleotide; CD160 exon 3; Set C
gagcuugcuuugccauuuuugaaugggcauuguaaca

SEQ ID NO: 63138 - RNA, 32 nt, Artificial Sequence
  Synthetic Oligonucleotide; CD160 exon 3; Set C
gcuugcuuugccauuuuugaaugggcauugua

SEQ ID NO: 63139 - RNA, 34 nt, Artificial Sequence
  Synthetic Oligonucleotide; CD160 exon 3; Set C
agcuugcuuugccauuuuugaaugggcauuguaa

SEQ ID NO: 63140 - RNA, 36 nt, Artificial Sequence
  Synthetic Oligonucleotide; CD160 exon 3; Set C
gagcuugcuuugccauuuuugaaugggcauuguaac

SEQ ID NO: 63141 - RNA, 31 nt, Artificial Sequence
  Synthetic Oligonucleotide; CD160 exon 3; Set C
gcuugcuuugccauuuuugaaugggcauugu

SEQ ID NO: 63142 - RNA, 33 nt, Artificial Sequence
  Synthetic Oligonucleotide; CD160 exon 3; Set C
agcuugcuuugccauuuuugaaugggcauugua

SEQ ID NO: 63143 - RNA, 35 nt, Artificial Sequence
  Synthetic Oligonucleotide; CD160 exon 3; Set C
gagcuugcuuugccauuuuugaaugggcauuguaa

SEQ ID NO: 63144 - RNA, 30 nt, Artificial Sequence
  Synthetic Oligonucleotide; CD160 exon 3; Set A
gcuugcuuugccauuuuugaaugggcauug

SEQ ID NO: 63145 - RNA, 32 nt, Artificial Sequence
  Synthetic Oligonucleotide; CD160 exon 3; Set C
agcuugcuuugccauuuuugaaugggcauugu

SEQ ID NO: 63146 - RNA, 34 nt, Artificial Sequence
  Synthetic Oligonucleotide; CD160 exon 3; Set C
gagcuugcuuugccauuuuugaaugggcauugua

SEQ ID NO: 63147 - RNA, 28 nt, Artificial Sequence
  Synthetic Oligonucleotide; CD160 exon 3; Set A
cuugcuuugccauuuuugaaugggcauu

SEQ ID NO: 63148 - RNA, 31 nt, Artificial Sequence
  Synthetic Oligonucleotide; CD160 exon 3; Set A
agcuugcuuugccauuuuugaaugggcauug

SEQ ID NO: 63149 - RNA, 33 nt, Artificial Sequence
  Synthetic Oligonucleotide; CD160 exon 3; Set C
gagcuugcuuugccauuuuugaaugggcauugu

SEQ ID NO: 63150 - RNA, 32 nt, Artificial Sequence
  Synthetic Oligonucleotide; CD160 exon 3; Set C
gagcuugcuuugccauuuuugaaugggcauug

SEQ ID NO: 63151 - RNA, 33 nt, Artificial Sequence
  Synthetic Oligonucleotide; CD160 exon 3; Set C
ugagcuugcuuugccauuuuugaaugggcauug

SEQ ID NO: 63152 - RNA, 21 nt, Artificial Sequence
  Synthetic Oligonucleotide; CD160 exon 3; Set C
gcuugcuuugccauuuuugaa

SEQ ID NO: 63153 - RNA, 20 nt, Artificial Sequence
  Synthetic Oligonucleotide; CD160 exon 3; Set C
gcuugcuuugccauuuuuga

SEQ ID NO: 63154 - RNA, 19 nt, Artificial Sequence
  Synthetic Oligonucleotide; CD160 exon 3; Set C
gcuugcuuugccauuuuug

SEQ ID NO: 63155 - RNA, 18 nt, Artificial Sequence
  Synthetic Oligonucleotide; CD160 exon 3; Set C
gcuugcuuugccauuuuu

SEQ ID NO: 63156 - RNA, 20 nt, Artificial Sequence
  Synthetic Oligonucleotide; CD160 exon 3; Set C
agcuugcuuugccauuuuug

SEQ ID NO: 63157 - RNA, 24 nt, Artificial Sequence
  Synthetic Oligonucleotide; CD160 exon 3; Set A
ugagcuugcuuugccauuuuugaa

SEQ ID NO: 63158 - RNA, 19 nt, Artificial Sequence
  Synthetic Oligonucleotide; CD160 exon 3; Set C
agcuugcuuugccauuuuu

SEQ ID NO: 63159 - RNA, 21 nt, Artificial Sequence
  Synthetic Oligonucleotide; CD160 exon 3; Set C
gagcuugcuuugccauuuuug

SEQ ID NO: 63160 - RNA, 17 nt, Artificial Sequence
  Synthetic Oligonucleotide; CD160 exon 3; Set C
gcuugcuuugccauuuu

SEQ ID NO: 63161 - RNA, 23 nt, Artificial Sequence
  Synthetic Oligonucleotide; CD160 exon 3; Set A
ugagcuugcuuugccauuuuuga

SEQ ID NO: 63162 - RNA, 15 nt, Artificial Sequence
  Synthetic Oligonucleotide; CD160 exon 3; Set C
cuugcuuugccauuu

SEQ ID NO: 63163 - RNA, 20 nt, Artificial Sequence
  Synthetic Oligonucleotide; CD160 exon 3; Set C
gagcuugcuuugccauuuuu

SEQ ID NO: 63164 - RNA, 20 nt, Artificial Sequence
  Synthetic Oligonucleotide; CD160 exon 3; Set C
ugagcuugcuuugccauuuu

SEQ ID NO: 63165 - RNA, 29 nt, Artificial Sequence
  Synthetic Oligonucleotide; CD160 exon 3; Set A
guugaacuucugagcuugcuuugccauuu

SEQ ID NO: 63166 - RNA, 33 nt, Artificial Sequence
  Synthetic Oligonucleotide; CD160 exon 3; Set C
ccugguugaacuucugagcuugcuuugccauuu

SEQ ID NO: 63167 - RNA, 37 nt, Artificial Sequence
  Synthetic Oligonucleotide; CD160 exon 3; Set C
caaaccugguugaacuucugagcuugcuuugccauuu

SEQ ID NO: 63168 - RNA, 16 nt, Artificial Sequence
  Synthetic Oligonucleotide; CD160 exon 3; Set C
guugaacuucugagcu

SEQ ID NO: 63169 - RNA, 15 nt, Artificial Sequence
  Synthetic Oligonucleotide; CD160 exon 3; Set C
guugaacuucugagc

SEQ ID NO: 63170 - RNA, 20 nt, Artificial Sequence
  Synthetic Oligonucleotide; CD160 exon 3; Set C
ccugguugaacuucugagcu

SEQ ID NO: 63171 - RNA, 21 nt, Artificial Sequence
  Synthetic Oligonucleotide; CD160 exon 3; Set A
accugguugaacuucugagcu

SEQ ID NO: 63172 - RNA, 19 nt, Artificial Sequence
  Synthetic Oligonucleotide; CD160 exon 3; Set C
ccugguugaacuucugagc

SEQ ID NO: 63173 - RNA, 22 nt, Artificial Sequence
  Synthetic Oligonucleotide; CD160 exon 3; Set C
aaccugguugaacuucugagcu

SEQ ID NO: 63174 - RNA, 20 nt, Artificial Sequence
  Synthetic Oligonucleotide; CD160 exon 3; Set C
accugguugaacuucugagc

SEQ ID NO: 63175 - RNA, 37 nt, Artificial Sequence
  Synthetic Oligonucleotide; CD160 exon 3; Set C
cugucucaaaccugguugaacuucugagcuugcuuug

SEQ ID NO: 63176 - RNA, 17 nt, Artificial Sequence
  Synthetic Oligonucleotide; CD160 exon 3; Set C
ccugguugaacuucuga

SEQ ID NO: 63177 - RNA, 23 nt, Artificial Sequence
  Synthetic Oligonucleotide; CD160 exon 3; Set C
aaaccugguugaacuucugagcu

SEQ ID NO: 63178 - RNA, 21 nt, Artificial Sequence
  Synthetic Oligonucleotide; CD160 exon 3; Set C
aaccugguugaacuucugagc

SEQ ID NO: 63179 - RNA, 19 nt, Artificial Sequence
  Synthetic Oligonucleotide; CD160 exon 3; Set C
accugguugaacuucugag

SEQ ID NO: 63180 - RNA, 38 nt, Artificial Sequence
  Synthetic Oligonucleotide; CD160 exon 3; Set C
acugucucaaaccugguugaacuucugagcuugcuuug

SEQ ID NO: 63181 - RNA, 36 nt, Artificial Sequence
  Synthetic Oligonucleotide; CD160 exon 3; Set C
cugucucaaaccugguugaacuucugagcuugcuuu

SEQ ID NO: 63182 - RNA, 18 nt, Artificial Sequence
  Synthetic Oligonucleotide; CD160 exon 3; Set C
accugguugaacuucuga

SEQ ID NO: 63183 - RNA, 24 nt, Artificial Sequence
  Synthetic Oligonucleotide; CD160 exon 3; Set A
caaaccugguugaacuucugagcu

SEQ ID NO: 63184 - RNA, 22 nt, Artificial Sequence
  Synthetic Oligonucleotide; CD160 exon 3; Set C
aaaccugguugaacuucugagc

SEQ ID NO: 63185 - RNA, 20 nt, Artificial Sequence
  Synthetic Oligonucleotide; CD160 exon 3; Set C
aaccugguugaacuucugag

SEQ ID NO: 63186 - RNA, 39 nt, Artificial Sequence
  Synthetic Oligonucleotide; CD160 exon 3; Set C
uacugucucaaaccugguugaacuucugagcuugcuuug

SEQ ID NO: 63187 - RNA, 37 nt, Artificial Sequence
  Synthetic Oligonucleotide; CD160 exon 3; Set C
acugucucaaaccugguugaacuucugagcuugcuuu

SEQ ID NO: 63188 - RNA, 19 nt, Artificial Sequence
  Synthetic Oligonucleotide; CD160 exon 3; Set C
aaccugguugaacuucuga

SEQ ID NO: 63189 - RNA, 25 nt, Artificial Sequence
  Synthetic Oligonucleotide; CD160 exon 3; Set A
ucaaaccugguugaacuucugagcu

SEQ ID NO: 63190 - RNA, 23 nt, Artificial Sequence
  Synthetic Oligonucleotide; CD160 exon 3; Set C
caaaccugguugaacuucugagc

SEQ ID NO: 63191 - RNA, 21 nt, Artificial Sequence
  Synthetic Oligonucleotide; CD160 exon 3; Set C
aaaccugguugaacuucugag

SEQ ID NO: 63192 - RNA, 38 nt, Artificial Sequence
  Synthetic Oligonucleotide; CD160 exon 3; Set C
uacugucucaaaccugguugaacuucugagcuugcuuu

SEQ ID NO: 63193 - RNA, 20 nt, Artificial Sequence
  Synthetic Oligonucleotide; CD160 exon 3; Set C
aaaccugguugaacuucuga

SEQ ID NO: 63194 - RNA, 24 nt, Artificial Sequence
  Synthetic Oligonucleotide; CD160 exon 3; Set A
ucaaaccugguugaacuucugagc

SEQ ID NO: 63195 - RNA, 22 nt, Artificial Sequence
  Synthetic Oligonucleotide; CD160 exon 3; Set C
caaaccugguugaacuucugag

SEQ ID NO: 63196 - RNA, 21 nt, Artificial Sequence
  Synthetic Oligonucleotide; CD160 exon 3; Set C
caaaccugguugaacuucuga

SEQ ID NO: 63197 - RNA, 25 nt, Artificial Sequence
  Synthetic Oligonucleotide; CD160 exon 3; Set A
cucaaaccugguugaacuucugagc

SEQ ID NO: 63198 - RNA, 23 nt, Artificial Sequence
  Synthetic Oligonucleotide; CD160 exon 3; Set C
ucaaaccugguugaacuucugag

SEQ ID NO: 63199 - RNA, 22 nt, Artificial Sequence
  Synthetic Oligonucleotide; CD160 exon 3; Set C
ucaaaccugguugaacuucuga

SEQ ID NO: 63200 - RNA, 28 nt, Artificial Sequence
  Synthetic Oligonucleotide; CD160 exon 3; Set A
gucucaaaccugguugaacuucugagcu

SEQ ID NO: 63201 - RNA, 26 nt, Artificial Sequence
  Synthetic Oligonucleotide; CD160 exon 3; Set A
ucucaaaccugguugaacuucugagc

SEQ ID NO: 63202 - RNA, 24 nt, Artificial Sequence
  Synthetic Oligonucleotide; CD160 exon 3; Set C
cucaaaccugguugaacuucugag

SEQ ID NO: 63203 - RNA, 31 nt, Artificial Sequence
  Synthetic Oligonucleotide; CD160 exon 3; Set A
cugucucaaaccugguugaacuucugagcuu

SEQ ID NO: 63204 - RNA, 23 nt, Artificial Sequence
  Synthetic Oligonucleotide; CD160 exon 3; Set C
cucaaaccugguugaacuucuga

SEQ ID NO: 63205 - RNA, 29 nt, Artificial Sequence
  Synthetic Oligonucleotide; CD160 exon 3; Set A
ugucucaaaccugguugaacuucugagcu

SEQ ID NO: 63206 - RNA, 27 nt, Artificial Sequence
  Synthetic Oligonucleotide; CD160 exon 3; Set A
gucucaaaccugguugaacuucugagc

SEQ ID NO: 63207 - RNA, 25 nt, Artificial Sequence
  Synthetic Oligonucleotide; CD160 exon 3; Set C
ucucaaaccugguugaacuucugag

SEQ ID NO: 63208 - RNA, 32 nt, Artificial Sequence
  Synthetic Oligonucleotide; CD160 exon 3; Set A
acugucucaaaccugguugaacuucugagcuu

SEQ ID NO: 63209 - RNA, 28 nt, Artificial Sequence
  Synthetic Oligonucleotide; CD160 exon 3; Set A
ugucucaaaccugguugaacuucugagc

SEQ ID NO: 63210 - RNA, 26 nt, Artificial Sequence
  Synthetic Oligonucleotide; CD160 exon 3; Set A
gucucaaaccugguugaacuucugag

SEQ ID NO: 63211 - RNA, 33 nt, Artificial Sequence
  Synthetic Oligonucleotide; CD160 exon 3; Set C
uacugucucaaaccugguugaacuucugagcuu

SEQ ID NO: 63212 - RNA, 25 nt, Artificial Sequence
  Synthetic Oligonucleotide; CD160 exon 3; Set B
gucucaaaccugguugaacuucuga

SEQ ID NO: 63213 - RNA, 27 nt, Artificial Sequence
  Synthetic Oligonucleotide; CD160 exon 3; Set A
ugucucaaaccugguugaacuucugag

SEQ ID NO: 63214 - RNA, 26 nt, Artificial Sequence
  Synthetic Oligonucleotide; CD160 exon 3; Set B
ugucucaaaccugguugaacuucuga

SEQ ID NO: 63215 - RNA, 31 nt, Artificial Sequence
  Synthetic Oligonucleotide; CD160 exon 3; Set A
uuacugucucaaaccugguugaacuucugag

SEQ ID NO: 63216 - RNA, 15 nt, Artificial Sequence
  Synthetic Oligonucleotide; CD160 exon 3; Set C
ugucucaaaccuggu

SEQ ID NO: 63217 - RNA, 38 nt, Artificial Sequence
  Synthetic Oligonucleotide; CD160 exon 3; Set C
gcaccuggaaaucucaauauuacugucucaaaccuggu

SEQ ID NO: 63218 - RNA, 37 nt, Artificial Sequence
  Synthetic Oligonucleotide; CD160 exon 3; Set C
gcaccuggaaaucucaauauuacugucucaaaccugg

SEQ ID NO: 63219 - RNA, 39 nt, Artificial Sequence
  Synthetic Oligonucleotide; CD160 exon 3; Set C
agcaccuggaaaucucaauauuacugucucaaaccuggu

SEQ ID NO: 63220 - RNA, 38 nt, Artificial Sequence
  Synthetic Oligonucleotide; CD160 exon 3; Set C
agcaccuggaaaucucaauauuacugucucaaaccugg

SEQ ID NO: 63221 - RNA, 36 nt, Artificial Sequence
  Synthetic Oligonucleotide; CD160 exon 3; Set B
gcaccuggaaaucucaauauuacugucucaaaccug

SEQ ID NO: 63222 - RNA, 40 nt, Artificial Sequence
  Synthetic Oligonucleotide; CD160 exon 3; Set C
cagcaccuggaaaucucaauauuacugucucaaaccuggu

SEQ ID NO: 63223 - RNA, 39 nt, Artificial Sequence
  Synthetic Oligonucleotide; CD160 exon 3; Set C
cagcaccuggaaaucucaauauuacugucucaaaccugg

SEQ ID NO: 63224 - RNA, 37 nt, Artificial Sequence
  Synthetic Oligonucleotide; CD160 exon 3; Set B
agcaccuggaaaucucaauauuacugucucaaaccug

SEQ ID NO: 63225 - RNA, 40 nt, Artificial Sequence
  Synthetic Oligonucleotide; CD160 exon 3; Set C
ucagcaccuggaaaucucaauauuacugucucaaaccugg

SEQ ID NO: 63226 - RNA, 38 nt, Artificial Sequence
  Synthetic Oligonucleotide; CD160 exon 3; Set C
cagcaccuggaaaucucaauauuacugucucaaaccug

SEQ ID NO: 63227 - RNA, 39 nt, Artificial Sequence
  Synthetic Oligonucleotide; CD160 exon 3; Set C
ucagcaccuggaaaucucaauauuacugucucaaaccug

SEQ ID NO: 63228 - RNA, 18 nt, Artificial Sequence
  Synthetic Oligonucleotide; CD160 exon 3; Set C
gaaaucucaauauuacug

SEQ ID NO: 63229 - RNA, 17 nt, Artificial Sequence
  Synthetic Oligonucleotide; CD160 exon 3; Set C
gaaaucucaauauuacu

SEQ ID NO: 63230 - RNA, 19 nt, Artificial Sequence
  Synthetic Oligonucleotide; CD160 exon 3; Set C
ggaaaucucaauauuacug

SEQ ID NO: 63231 - RNA, 16 nt, Artificial Sequence
  Synthetic Oligonucleotide; CD160 exon 3; Set C
gaaaucucaauauuac

SEQ ID NO: 63232 - RNA, 18 nt, Artificial Sequence
  Synthetic Oligonucleotide; CD160 exon 3; Set C
ggaaaucucaauauuacu

SEQ ID NO: 63233 - RNA, 20 nt, Artificial Sequence
  Synthetic Oligonucleotide; CD160 exon 3; Set C
uggaaaucucaauauuacug

SEQ ID NO: 63234 - RNA, 17 nt, Artificial Sequence
  Synthetic Oligonucleotide; CD160 exon 3; Set C
ggaaaucucaauauuac

SEQ ID NO: 63235 - RNA, 19 nt, Artificial Sequence
  Synthetic Oligonucleotide; CD160 exon 3; Set C
uggaaaucucaauauuacu

SEQ ID NO: 63236 - RNA, 18 nt, Artificial Sequence
  Synthetic Oligonucleotide; CD160 exon 3; Set C
uggaaaucucaauauuac

SEQ ID NO: 63237 - RNA, 23 nt, Artificial Sequence
  Synthetic Oligonucleotide; CD160 exon 3; Set C
caccuggaaaucucaauauuacu

SEQ ID NO: 63238 - RNA, 25 nt, Artificial Sequence
  Synthetic Oligonucleotide; CD160 exon 3; Set C
gcaccuggaaaucucaauauuacug

SEQ ID NO: 63239 - RNA, 24 nt, Artificial Sequence
  Synthetic Oligonucleotide; CD160 exon 3; Set C
gcaccuggaaaucucaauauuacu

SEQ ID NO: 63240 - RNA, 22 nt, Artificial Sequence
  Synthetic Oligonucleotide; CD160 exon 3; Set C
caccuggaaaucucaauauuac

SEQ ID NO: 63241 - RNA, 26 nt, Artificial Sequence
  Synthetic Oligonucleotide; CD160 exon 3; Set C
agcaccuggaaaucucaauauuacug

SEQ ID NO: 63242 - RNA, 25 nt, Artificial Sequence
  Synthetic Oligonucleotide; CD160 exon 3; Set C
agcaccuggaaaucucaauauuacu

SEQ ID NO: 63243 - RNA, 23 nt, Artificial Sequence
  Synthetic Oligonucleotide; CD160 exon 3; Set C
gcaccuggaaaucucaauauuac

SEQ ID NO: 63244 - RNA, 27 nt, Artificial Sequence
  Synthetic Oligonucleotide; CD160 exon 3; Set B
cagcaccuggaaaucucaauauuacug

SEQ ID NO: 63245 - RNA, 24 nt, Artificial Sequence
  Synthetic Oligonucleotide; CD160 exon 3; Set C
agcaccuggaaaucucaauauuac

SEQ ID NO: 63246 - RNA, 32 nt, Artificial Sequence
  Synthetic Oligonucleotide; CD160 exon 3; Set B
gaaagucagcaccuggaaaucucaauauuacu

SEQ ID NO: 63247 - RNA, 34 nt, Artificial Sequence
  Synthetic Oligonucleotide; CD160 exon 3; Set B
ggaaagucagcaccuggaaaucucaauauuacug

SEQ ID NO: 63248 - RNA, 33 nt, Artificial Sequence
  Synthetic Oligonucleotide; CD160 exon 3; Set B
ggaaagucagcaccuggaaaucucaauauuacu

SEQ ID NO: 63249 - RNA, 31 nt, Artificial Sequence
  Synthetic Oligonucleotide; CD160 exon 3; Set B
gaaagucagcaccuggaaaucucaauauuac

SEQ ID NO: 63250 - RNA, 35 nt, Artificial Sequence
  Synthetic Oligonucleotide; CD160 exon 3; Set B
gggaaagucagcaccuggaaaucucaauauuacug

SEQ ID NO: 63251 - RNA, 34 nt, Artificial Sequence
  Synthetic Oligonucleotide; CD160 exon 3; Set B
gggaaagucagcaccuggaaaucucaauauuacu

SEQ ID NO: 63252 - RNA, 32 nt, Artificial Sequence
  Synthetic Oligonucleotide; CD160 exon 3; Set B
ggaaagucagcaccuggaaaucucaauauuac

SEQ ID NO: 63253 - RNA, 33 nt, Artificial Sequence
  Synthetic Oligonucleotide; CD160 exon 3; Set B
gggaaagucagcaccuggaaaucucaauauuac

SEQ ID NO: 63254 - RNA, 39 nt, Artificial Sequence
  Synthetic Oligonucleotide; CD160 exon 3; Set C
ggcggggaaagucagcaccuggaaaucucaauauuacug

SEQ ID NO: 63255 - RNA, 40 nt, Artificial Sequence
  Synthetic Oligonucleotide; CD160 exon 3; Set C
uggcggggaaagucagcaccuggaaaucucaauauuacug

SEQ ID NO: 63256 - RNA, 40 nt, Artificial Sequence
  Synthetic Oligonucleotide; CD160 exon 3; Set C
cuggcggggaaagucagcaccuggaaaucucaauauuacu

SEQ ID NO: 63257 - RNA, 39 nt, Artificial Sequence
  Synthetic Oligonucleotide; CD160 exon 3; Set C
cuggcggggaaagucagcaccuggaaaucucaauauuac

SEQ ID NO: 63258 - RNA, 18 nt, Artificial Sequence
  Synthetic Oligonucleotide; CD160 exon 3; Set C
gaaagucagcaccuggaa

SEQ ID NO: 63259 - RNA, 19 nt, Artificial Sequence
  Synthetic Oligonucleotide; CD160 exon 3; Set C
ggaaagucagcaccuggaa

SEQ ID NO: 63260 - RNA, 17 nt, Artificial Sequence
  Synthetic Oligonucleotide; CD160 exon 3; Set C
gaaagucagcaccugga

SEQ ID NO: 63261 - RNA, 20 nt, Artificial Sequence
  Synthetic Oligonucleotide; CD160 exon 3; Set B
gggaaagucagcaccuggaa

SEQ ID NO: 63262 - RNA, 18 nt, Artificial Sequence
  Synthetic Oligonucleotide; CD160 exon 3; Set C
ggaaagucagcaccugga

SEQ ID NO: 63263 - RNA, 16 nt, Artificial Sequence
  Synthetic Oligonucleotide; CD160 exon 3; Set C
gaaagucagcaccugg

SEQ ID NO: 63264 - RNA, 21 nt, Artificial Sequence
  Synthetic Oligonucleotide; CD160 exon 3; Set B
ggggaaagucagcaccuggaa

SEQ ID NO: 63265 - RNA, 19 nt, Artificial Sequence
  Synthetic Oligonucleotide; CD160 exon 3; Set B
gggaaagucagcaccugga

SEQ ID NO: 63266 - RNA, 17 nt, Artificial Sequence
  Synthetic Oligonucleotide; CD160 exon 3; Set C
ggaaagucagcaccugg

SEQ ID NO: 63267 - RNA, 15 nt, Artificial Sequence
  Synthetic Oligonucleotide; CD160 exon 3; Set C
gaaagucagcaccug

SEQ ID NO: 63268 - RNA, 22 nt, Artificial Sequence
  Synthetic Oligonucleotide; CD160 exon 3; Set B
cggggaaagucagcaccuggaa

SEQ ID NO: 63269 - RNA, 20 nt, Artificial Sequence
  Synthetic Oligonucleotide; CD160 exon 3; Set B
ggggaaagucagcaccugga

SEQ ID NO: 63270 - RNA, 18 nt, Artificial Sequence
  Synthetic Oligonucleotide; CD160 exon 3; Set C
gggaaagucagcaccugg

SEQ ID NO: 63271 - RNA, 16 nt, Artificial Sequence
  Synthetic Oligonucleotide; CD160 exon 3; Set C
ggaaagucagcaccug

SEQ ID NO: 63272 - RNA, 23 nt, Artificial Sequence
  Synthetic Oligonucleotide; CD160 exon 3; Set C
gcggggaaagucagcaccuggaa

SEQ ID NO: 63273 - RNA, 21 nt, Artificial Sequence
  Synthetic Oligonucleotide; CD160 exon 3; Set B
cggggaaagucagcaccugga

SEQ ID NO: 63274 - RNA, 19 nt, Artificial Sequence
  Synthetic Oligonucleotide; CD160 exon 3; Set B
ggggaaagucagcaccugg

SEQ ID NO: 63275 - RNA, 17 nt, Artificial Sequence
  Synthetic Oligonucleotide; CD160 exon 3; Set C
gggaaagucagcaccug

SEQ ID NO: 63276 - RNA, 15 nt, Artificial Sequence
  Synthetic Oligonucleotide; CD160 exon 3; Set C
ggaaagucagcaccu

SEQ ID NO: 63277 - RNA, 22 nt, Artificial Sequence
  Synthetic Oligonucleotide; CD160 exon 3; Set C
gcggggaaagucagcaccugga

SEQ ID NO: 63278 - RNA, 20 nt, Artificial Sequence
  Synthetic Oligonucleotide; CD160 exon 3; Set B
cggggaaagucagcaccugg

SEQ ID NO: 63279 - RNA, 18 nt, Artificial Sequence
  Synthetic Oligonucleotide; CD160 exon 3; Set C
ggggaaagucagcaccug

SEQ ID NO: 63280 - RNA, 16 nt, Artificial Sequence
  Synthetic Oligonucleotide; CD160 exon 3; Set C
gggaaagucagcaccu

SEQ ID NO: 63281 - RNA, 21 nt, Artificial Sequence
  Synthetic Oligonucleotide; CD160 exon 3; Set B
gcggggaaagucagcaccugg

SEQ ID NO: 63282 - RNA, 19 nt, Artificial Sequence
  Synthetic Oligonucleotide; CD160 exon 3; Set B
cggggaaagucagcaccug

SEQ ID NO: 63283 - RNA, 17 nt, Artificial Sequence
  Synthetic Oligonucleotide; CD160 exon 3; Set C
ggggaaagucagcaccu

SEQ ID NO: 63284 - RNA, 15 nt, Artificial Sequence
  Synthetic Oligonucleotide; CD160 exon 3; Set C
gggaaagucagcacc

SEQ ID NO: 63285 - RNA, 18 nt, Artificial Sequence
  Synthetic Oligonucleotide; CD160 exon 3; Set B
cggggaaagucagcaccu

SEQ ID NO: 63286 - RNA, 16 nt, Artificial Sequence
  Synthetic Oligonucleotide; CD160 exon 3; Set C
ggggaaagucagcacc

SEQ ID NO: 63287 - RNA, 15 nt, Artificial Sequence
  Synthetic Oligonucleotide; CD160 exon 3; Set C
ggggaaagucagcac

SEQ ID NO: 63288 - RNA, 17 nt, Artificial Sequence
  Synthetic Oligonucleotide; CD160 exon 3; Set C
cggggaaagucagcacc

SEQ ID NO: 63289 - RNA, 16 nt, Artificial Sequence
  Synthetic Oligonucleotide; CD160 exon 3; Set C
cggggaaagucagcac

SEQ ID NO: 63290 - RNA, 17 nt, Artificial Sequence
  Synthetic Oligonucleotide; CD160 exon 3; Set C
gcggggaaagucagcac

SEQ ID NO: 63291 - RNA, 23 nt, Artificial Sequence
  Synthetic Oligonucleotide; CD160 exon 3; Set C
cuggcggggaaagucagcaccug

SEQ ID NO: 63292 - RNA, 22 nt, Artificial Sequence
  Synthetic Oligonucleotide; CD160 exon 3; Set C
cuggcggggaaagucagcaccu

SEQ ID NO: 63293 - RNA, 21 nt, Artificial Sequence
  Synthetic Oligonucleotide; CD160 exon 3; Set B
cuggcggggaaagucagcacc

SEQ ID NO: 63294 - RNA, 35 nt, Artificial Sequence
  Synthetic Oligonucleotide; CD160 exon 3; Set C
cuucagugacuggcggggaaagucagcaccuggaa

SEQ ID NO: 63295 - RNA, 36 nt, Artificial Sequence
  Synthetic Oligonucleotide; CD160 exon 3; Set C
gcuucagugacuggcggggaaagucagcaccuggaa

SEQ ID NO: 63296 - RNA, 34 nt, Artificial Sequence
  Synthetic Oligonucleotide; CD160 exon 3; Set C
cuucagugacuggcggggaaagucagcaccugga

SEQ ID NO: 63297 - RNA, 37 nt, Artificial Sequence
  Synthetic Oligonucleotide; CD160 exon 3; Set C
ugcuucagugacuggcggggaaagucagcaccuggaa

SEQ ID NO: 63298 - RNA, 35 nt, Artificial Sequence
  Synthetic Oligonucleotide; CD160 exon 3; Set C
gcuucagugacuggcggggaaagucagcaccugga

SEQ ID NO: 63299 - RNA, 33 nt, Artificial Sequence
  Synthetic Oligonucleotide; CD160 exon 3; Set C
cuucagugacuggcggggaaagucagcaccugg

SEQ ID NO: 63300 - RNA, 36 nt, Artificial Sequence
  Synthetic Oligonucleotide; CD160 exon 3; Set C
ugcuucagugacuggcggggaaagucagcaccugga

SEQ ID NO: 63301 - RNA, 34 nt, Artificial Sequence
  Synthetic Oligonucleotide; CD160 exon 3; Set C
gcuucagugacuggcggggaaagucagcaccugg

SEQ ID NO: 63302 - RNA, 28 nt, Artificial Sequence
  Synthetic Oligonucleotide; CD160 exon 3; Set C
ucagugacuggcggggaaagucagcacc

SEQ ID NO: 63303 - RNA, 35 nt, Artificial Sequence
  Synthetic Oligonucleotide; CD160 exon 3; Set C
ugcuucagugacuggcggggaaagucagcaccugg

SEQ ID NO: 63304 - RNA, 29 nt, Artificial Sequence
  Synthetic Oligonucleotide; CD160 exon 3; Set C
cuucagugacuggcggggaaagucagcac

SEQ ID NO: 63305 - RNA, 28 nt, Artificial Sequence
  Synthetic Oligonucleotide; CD160 exon 3; Set C
cuucagugacuggcggggaaagucagca

SEQ ID NO: 63306 - RNA, 30 nt, Artificial Sequence
  Synthetic Oligonucleotide; CD160 exon 3; Set C
gcuucagugacuggcggggaaagucagcac

SEQ ID NO: 63307 - RNA, 27 nt, Artificial Sequence
  Synthetic Oligonucleotide; CD160 exon 3; Set C
cuucagugacuggcggggaaagucagc

SEQ ID NO: 63308 - RNA, 29 nt, Artificial Sequence
  Synthetic Oligonucleotide; CD160 exon 3; Set C
gcuucagugacuggcggggaaagucagca

SEQ ID NO: 63309 - RNA, 31 nt, Artificial Sequence
  Synthetic Oligonucleotide; CD160 exon 3; Set C
ugcuucagugacuggcggggaaagucagcac

SEQ ID NO: 63310 - RNA, 26 nt, Artificial Sequence
  Synthetic Oligonucleotide; CD160 exon 3; Set B
cuucagugacuggcggggaaagucag

SEQ ID NO: 63311 - RNA, 28 nt, Artificial Sequence
  Synthetic Oligonucleotide; CD160 exon 3; Set C
gcuucagugacuggcggggaaagucagc

SEQ ID NO: 63312 - RNA, 30 nt, Artificial Sequence
  Synthetic Oligonucleotide; CD160 exon 3; Set C
ugcuucagugacuggcggggaaagucagca

SEQ ID NO: 63313 - RNA, 27 nt, Artificial Sequence
  Synthetic Oligonucleotide; CD160 exon 3; Set C
gcuucagugacuggcggggaaagucag

SEQ ID NO: 63314 - RNA, 29 nt, Artificial Sequence
  Synthetic Oligonucleotide; CD160 exon 3; Set C
ugcuucagugacuggcggggaaagucagc

SEQ ID NO: 63315 - RNA, 28 nt, Artificial Sequence
  Synthetic Oligonucleotide; CD160 exon 3; Set C
ugcuucagugacuggcggggaaagucag

SEQ ID NO: 63316 - RNA, 23 nt, Artificial Sequence
  Synthetic Oligonucleotide; CD160 exon 3; Set B
cuucagugacuggcggggaaagu

SEQ ID NO: 63317 - RNA, 22 nt, Artificial Sequence
  Synthetic Oligonucleotide; CD160 exon 3; Set B
cuucagugacuggcggggaaag

SEQ ID NO: 63318 - RNA, 18 nt, Artificial Sequence
  Synthetic Oligonucleotide; CD160 exon 3; Set B
ucagugacuggcggggaa

SEQ ID NO: 63319 - RNA, 21 nt, Artificial Sequence
  Synthetic Oligonucleotide; CD160 exon 3; Set B
cuucagugacuggcggggaaa

SEQ ID NO: 63320 - RNA, 23 nt, Artificial Sequence
  Synthetic Oligonucleotide; CD160 exon 3; Set B
gcuucagugacuggcggggaaag

SEQ ID NO: 63321 - RNA, 17 nt, Artificial Sequence
  Synthetic Oligonucleotide; CD160 exon 3; Set B
ucagugacuggcgggga

SEQ ID NO: 63322 - RNA, 19 nt, Artificial Sequence
  Synthetic Oligonucleotide; CD160 exon 3; Set B
uucagugacuggcggggaa

SEQ ID NO: 63323 - RNA, 22 nt, Artificial Sequence
  Synthetic Oligonucleotide; CD160 exon 3; Set B
gcuucagugacuggcggggaaa

SEQ ID NO: 63324 - RNA, 24 nt, Artificial Sequence
  Synthetic Oligonucleotide; CD160 exon 3; Set B
ugcuucagugacuggcggggaaag

SEQ ID NO: 63325 - RNA, 16 nt, Artificial Sequence
  Synthetic Oligonucleotide; CD160 exon 3; Set B
ucagugacuggcgggg

SEQ ID NO: 63326 - RNA, 23 nt, Artificial Sequence
  Synthetic Oligonucleotide; CD160 exon 3; Set B
ugcuucagugacuggcggggaaa

SEQ ID NO: 63327 - RNA, 17 nt, Artificial Sequence
  Synthetic Oligonucleotide; CD160 exon 3; Set B
uucagugacuggcgggg

SEQ ID NO: 63328 - RNA, 15 nt, Artificial Sequence
  Synthetic Oligonucleotide; CD160 exon 3; Set C
ucagugacuggcggg

SEQ ID NO: 63329 - RNA, 16 nt, Artificial Sequence
  Synthetic Oligonucleotide; CD160 exon 3; Set C
uucagugacuggcggg

SEQ ID NO: 63330 - RNA, 15 nt, Artificial Sequence
  Synthetic Oligonucleotide; CD160 exon 3; Set C
uucagugacuggcgg

SEQ ID NO: 63331 - RNA, 15 nt, Artificial Sequence
  Synthetic Oligonucleotide; CD160 exon 3; Set C
gcuucagugacuggc

SEQ ID NO: 63332 - RNA, 16 nt, Artificial Sequence
  Synthetic Oligonucleotide; CD160 exon 3; Set C
ugcuucagugacuggc

SEQ ID NO: 63333 - RNA, 15 nt, Artificial Sequence
  Synthetic Oligonucleotide; CD160 exon 3; Set C
ugcuucagugacugg

SEQ ID NO: 63334 - RNA, 15 nt, Artificial Sequence
  Synthetic Oligonucleotide; CD244 exon 5; Set C
uugggacuggucucu

SEQ ID NO: 63335 - RNA, 16 nt, Artificial Sequence
  Synthetic Oligonucleotide; CD244 exon 5; Set C
gggacuggucucugag

SEQ ID NO: 63336 - RNA, 15 nt, Artificial Sequence
  Synthetic Oligonucleotide; CD244 exon 5; Set C
gggacuggucucuga

SEQ ID NO: 63337 - RNA, 17 nt, Artificial Sequence
  Synthetic Oligonucleotide; CD244 exon 5; Set C
ugggacuggucucugag

SEQ ID NO: 63338 - RNA, 16 nt, Artificial Sequence
  Synthetic Oligonucleotide; CD244 exon 5; Set C
ugggacuggucucuga

SEQ ID NO: 63339 - RNA, 15 nt, Artificial Sequence
  Synthetic Oligonucleotide; CD244 exon 5; Set C
ugggacuggucucug

SEQ ID NO: 63340 - RNA, 17 nt, Artificial Sequence
  Synthetic Oligonucleotide; CD244 exon 5; Set C
uugggacuggucucuga

SEQ ID NO: 63341 - RNA, 16 nt, Artificial Sequence
  Synthetic Oligonucleotide; CD244 exon 5; Set C
uugggacuggucucug

SEQ ID NO: 63342 - RNA, 19 nt, Artificial Sequence
  Synthetic Oligonucleotide; CD244 exon 5; Set A
uuccuugggacuggucucu

SEQ ID NO: 63343 - RNA, 37 nt, Artificial Sequence
  Synthetic Oligonucleotide; CD244 exon 5; Set A
cguaaauugucaaaaauuccuugggacuggucucuga

SEQ ID NO: 63344 - RNA, 36 nt, Artificial Sequence
  Synthetic Oligonucleotide; CD244 exon 5; Set A
cguaaauugucaaaaauuccuugggacuggucucug

SEQ ID NO: 63345 - RNA, 38 nt, Artificial Sequence
  Synthetic Oligonucleotide; CD244 exon 5; Set A
ucguaaauugucaaaaauuccuugggacuggucucuga

SEQ ID NO: 63346 - RNA, 35 nt, Artificial Sequence
  Synthetic Oligonucleotide; CD244 exon 5; Set A
cguaaauugucaaaaauuccuugggacuggucucu

SEQ ID NO: 63347 - RNA, 37 nt, Artificial Sequence
  Synthetic Oligonucleotide; CD244 exon 5; Set A
ucguaaauugucaaaaauuccuugggacuggucucug

SEQ ID NO: 63348 - RNA, 36 nt, Artificial Sequence
  Synthetic Oligonucleotide; CD244 exon 5; Set A
ucguaaauugucaaaaauuccuugggacuggucucu

SEQ ID NO: 63349 - RNA, 34 nt, Artificial Sequence
  Synthetic Oligonucleotide; CD244 exon 5; Set A
cguaaauugucaaaaauuccuugggacuggucuc

SEQ ID NO: 63350 - RNA, 35 nt, Artificial Sequence
  Synthetic Oligonucleotide; CD244 exon 5; Set A
ucguaaauugucaaaaauuccuugggacuggucuc

SEQ ID NO: 63351 - RNA, 33 nt, Artificial Sequence
  Synthetic Oligonucleotide; CD244 exon 5; Set A
cguaaauugucaaaaauuccuugggacuggucu

SEQ ID NO: 63352 - RNA, 34 nt, Artificial Sequence
  Synthetic Oligonucleotide; CD244 exon 5; Set A
ucguaaauugucaaaaauuccuugggacuggucu

SEQ ID NO: 63353 - RNA, 32 nt, Artificial Sequence
  Synthetic Oligonucleotide; CD244 exon 5; Set A
cguaaauugucaaaaauuccuugggacugguc

SEQ ID NO: 63354 - RNA, 31 nt, Artificial Sequence
  Synthetic Oligonucleotide; CD244 exon 5; Set A
cguaaauugucaaaaauuccuugggacuggu

SEQ ID NO: 63355 - RNA, 33 nt, Artificial Sequence
  Synthetic Oligonucleotide; CD244 exon 5; Set A
ucguaaauugucaaaaauuccuugggacugguc

SEQ ID NO: 63356 - RNA, 30 nt, Artificial Sequence
  Synthetic Oligonucleotide; CD244 exon 5; Set C
cguaaauugucaaaaauuccuugggacugg

SEQ ID NO: 63357 - RNA, 32 nt, Artificial Sequence
  Synthetic Oligonucleotide; CD244 exon 5; Set A
ucguaaauugucaaaaauuccuugggacuggu

SEQ ID NO: 63358 - RNA, 31 nt, Artificial Sequence
  Synthetic Oligonucleotide; CD244 exon 5; Set A
ucguaaauugucaaaaauuccuugggacugg

SEQ ID NO: 63359 - RNA, 25 nt, Artificial Sequence
  Synthetic Oligonucleotide; CD244 exon 5; Set C
cguaaauugucaaaaauuccuuggg

SEQ ID NO: 63360 - RNA, 26 nt, Artificial Sequence
  Synthetic Oligonucleotide; CD244 exon 5; Set C
ucguaaauugucaaaaauuccuuggg

SEQ ID NO: 63361 - RNA, 24 nt, Artificial Sequence
  Synthetic Oligonucleotide; CD244 exon 5; Set C
cguaaauugucaaaaauuccuugg

SEQ ID NO: 63362 - RNA, 25 nt, Artificial Sequence
  Synthetic Oligonucleotide; CD244 exon 5; Set C
ucguaaauugucaaaaauuccuugg

SEQ ID NO: 63363 - RNA, 23 nt, Artificial Sequence
  Synthetic Oligonucleotide; CD244 exon 5; Set C
cguaaauugucaaaaauuccuug

SEQ ID NO: 63364 - RNA, 24 nt, Artificial Sequence
  Synthetic Oligonucleotide; CD244 exon 5; Set C
ucguaaauugucaaaaauuccuug

SEQ ID NO: 63365 - RNA, 25 nt, Artificial Sequence
  Synthetic Oligonucleotide; CD244 exon 5; Set A
guuuucagauccuugacaucuucgu

SEQ ID NO: 63366 - RNA, 15 nt, Artificial Sequence
  Synthetic Oligonucleotide; CD244 exon 5; Set C
uuucuccugguuuuc

SEQ ID NO: 63367 - RNA, 26 nt, Artificial Sequence
  Synthetic Oligonucleotide; CD244 exon 5; Set A
gacauacgugauuucuccugguuuuc

SEQ ID NO: 63368 - RNA, 25 nt, Artificial Sequence
  Synthetic Oligonucleotide; CD244 exon 5; Set A
gacauacgugauuucuccugguuuu

SEQ ID NO: 63369 - RNA, 27 nt, Artificial Sequence
  Synthetic Oligonucleotide; CD244 exon 5; Set A
ugacauacgugauuucuccugguuuuc

SEQ ID NO: 63370 - RNA, 24 nt, Artificial Sequence
  Synthetic Oligonucleotide; CD244 exon 5; Set A
gacauacgugauuucuccugguuu

SEQ ID NO: 63371 - RNA, 26 nt, Artificial Sequence
  Synthetic Oligonucleotide; CD244 exon 5; Set A
ugacauacgugauuucuccugguuuu

SEQ ID NO: 63372 - RNA, 25 nt, Artificial Sequence
  Synthetic Oligonucleotide; CD244 exon 5; Set A
ugacauacgugauuucuccugguuu

SEQ ID NO: 63373 - RNA, 23 nt, Artificial Sequence
  Synthetic Oligonucleotide; CD244 exon 5; Set A
gacauacgugauuucuccugguu

SEQ ID NO: 63374 - RNA, 24 nt, Artificial Sequence
  Synthetic Oligonucleotide; CD244 exon 5; Set A
ugacauacgugauuucuccugguu

SEQ ID NO: 63375 - RNA, 18 nt, Artificial Sequence
  Synthetic Oligonucleotide; CD244 exon 5; Set A
gggacuggucucugaggg

SEQ ID NO: 63376 - RNA, 17 nt, Artificial Sequence
  Synthetic Oligonucleotide; CD244 exon 5; Set C
gggacuggucucugagg

SEQ ID NO: 63377 - RNA, 19 nt, Artificial Sequence
  Synthetic Oligonucleotide; CD244 exon 5; Set A
ugggacuggucucugaggg

SEQ ID NO: 63378 - RNA, 18 nt, Artificial Sequence
  Synthetic Oligonucleotide; CD244 exon 5; Set A
ugggacuggucucugagg

SEQ ID NO: 63379 - RNA, 20 nt, Artificial Sequence
  Synthetic Oligonucleotide; CD244 exon 5; Set A
uugggacuggucucugaggg

SEQ ID NO: 63380 - RNA, 19 nt, Artificial Sequence
  Synthetic Oligonucleotide; CD244 exon 5; Set A
uugggacuggucucugagg

SEQ ID NO: 63381 - RNA, 18 nt, Artificial Sequence
  Synthetic Oligonucleotide; CD244 exon 5; Set C
uugggacuggucucugag

SEQ ID NO: 63382 - RNA, 18 nt, Artificial Sequence
  Synthetic Oligonucleotide; CD244 exon 5; Set C
cuugggacuggucucuga

SEQ ID NO: 63383 - RNA, 17 nt, Artificial Sequence
  Synthetic Oligonucleotide; CD244 exon 5; Set C
cuugggacuggucucug

SEQ ID NO: 63384 - RNA, 19 nt, Artificial Sequence
  Synthetic Oligonucleotide; CD244 exon 5; Set A
ccuugggacuggucucuga

SEQ ID NO: 63385 - RNA, 16 nt, Artificial Sequence
  Synthetic Oligonucleotide; CD244 exon 5; Set C
cuugggacuggucucu

SEQ ID NO: 63386 - RNA, 18 nt, Artificial Sequence
  Synthetic Oligonucleotide; CD244 exon 5; Set C
ccuugggacuggucucug

SEQ ID NO: 63387 - RNA, 20 nt, Artificial Sequence
  Synthetic Oligonucleotide; CD244 exon 5; Set A
uccuugggacuggucucuga

SEQ ID NO: 63388 - RNA, 17 nt, Artificial Sequence
  Synthetic Oligonucleotide; CD244 exon 5; Set C
ccuugggacuggucucu

SEQ ID NO: 63389 - RNA, 15 nt, Artificial Sequence
  Synthetic Oligonucleotide; CD244 exon 5; Set C
cuugggacuggucuc

SEQ ID NO: 63390 - RNA, 19 nt, Artificial Sequence
  Synthetic Oligonucleotide; CD244 exon 5; Set A
uccuugggacuggucucug

SEQ ID NO: 63391 - RNA, 21 nt, Artificial Sequence
  Synthetic Oligonucleotide; CD244 exon 5; Set A
uuccuugggacuggucucuga

SEQ ID NO: 63392 - RNA, 18 nt, Artificial Sequence
  Synthetic Oligonucleotide; CD244 exon 5; Set A
uccuugggacuggucucu

SEQ ID NO: 63393 - RNA, 16 nt, Artificial Sequence
  Synthetic Oligonucleotide; CD244 exon 5; Set C
ccuugggacuggucuc

SEQ ID NO: 63394 - RNA, 20 nt, Artificial Sequence
  Synthetic Oligonucleotide; CD244 exon 5; Set A
uuccuugggacuggucucug

SEQ ID NO: 63395 - RNA, 17 nt, Artificial Sequence
  Synthetic Oligonucleotide; CD244 exon 5; Set C
uccuugggacuggucuc

SEQ ID NO: 63396 - RNA, 15 nt, Artificial Sequence
  Synthetic Oligonucleotide; CD244 exon 5; Set C
ccuugggacuggucu

SEQ ID NO: 63397 - RNA, 18 nt, Artificial Sequence
  Synthetic Oligonucleotide; CD244 exon 5; Set C
uuccuugggacuggucuc

SEQ ID NO: 63398 - RNA, 16 nt, Artificial Sequence
  Synthetic Oligonucleotide; CD244 exon 5; Set C
uccuugggacuggucu

SEQ ID NO: 63399 - RNA, 17 nt, Artificial Sequence
  Synthetic Oligonucleotide; CD244 exon 5; Set C
uuccuugggacuggucu

SEQ ID NO: 63400 - RNA, 15 nt, Artificial Sequence
  Synthetic Oligonucleotide; CD244 exon 5; Set C
uccuugggacugguc

SEQ ID NO: 63401 - RNA, 16 nt, Artificial Sequence
  Synthetic Oligonucleotide; CD244 exon 5; Set C
uuccuugggacugguc

SEQ ID NO: 63402 - RNA, 15 nt, Artificial Sequence
  Synthetic Oligonucleotide; CD244 exon 5; Set C
uuccuugggacuggu

SEQ ID NO: 63403 - RNA, 33 nt, Artificial Sequence
  Synthetic Oligonucleotide; CD244 exon 5; Set A
aauugucaaaaauuccuugggacuggucucuga

SEQ ID NO: 63404 - RNA, 32 nt, Artificial Sequence
  Synthetic Oligonucleotide; CD244 exon 5; Set A
aauugucaaaaauuccuugggacuggucucug

SEQ ID NO: 63405 - RNA, 40 nt, Artificial Sequence
  Synthetic Oligonucleotide; CD244 exon 5; Set C
cguaaauugucaaaaauuccuugggacuggucucugaggg

SEQ ID NO: 63406 - RNA, 31 nt, Artificial Sequence
  Synthetic Oligonucleotide; CD244 exon 5; Set A
aauugucaaaaauuccuugggacuggucucu

SEQ ID NO: 63407 - RNA, 39 nt, Artificial Sequence
  Synthetic Oligonucleotide; CD244 exon 5; Set A
cguaaauugucaaaaauuccuugggacuggucucugagg

SEQ ID NO: 63408 - RNA, 30 nt, Artificial Sequence
  Synthetic Oligonucleotide; CD244 exon 5; Set A
aauugucaaaaauuccuugggacuggucuc

SEQ ID NO: 63409 - RNA, 38 nt, Artificial Sequence
  Synthetic Oligonucleotide; CD244 exon 5; Set A
cguaaauugucaaaaauuccuugggacuggucucugag

SEQ ID NO: 63410 - RNA, 40 nt, Artificial Sequence
  Synthetic Oligonucleotide; CD244 exon 5; Set C
ucguaaauugucaaaaauuccuugggacuggucucugagg

SEQ ID NO: 63411 - RNA, 29 nt, Artificial Sequence
  Synthetic Oligonucleotide; CD244 exon 5; Set A
aauugucaaaaauuccuugggacuggucu

SEQ ID NO: 63412 - RNA, 39 nt, Artificial Sequence
  Synthetic Oligonucleotide; CD244 exon 5; Set A
ucguaaauugucaaaaauuccuugggacuggucucugag

SEQ ID NO: 63413 - RNA, 27 nt, Artificial Sequence
  Synthetic Oligonucleotide; CD244 exon 5; Set C
aauugucaaaaauuccuugggacuggu

SEQ ID NO: 63414 - RNA, 26 nt, Artificial Sequence
  Synthetic Oligonucleotide; CD244 exon 5; Set C
aauugucaaaaauuccuugggacugg

SEQ ID NO: 63415 - RNA, 21 nt, Artificial Sequence
  Synthetic Oligonucleotide; CD244 exon 5; Set C
aauugucaaaaauuccuuggg

SEQ ID NO: 63416 - RNA, 20 nt, Artificial Sequence
  Synthetic Oligonucleotide; CD244 exon 5; Set C
aauugucaaaaauuccuugg

SEQ ID NO: 63417 - RNA, 19 nt, Artificial Sequence
  Synthetic Oligonucleotide; CD244 exon 5; Set C
aauugucaaaaauuccuug

SEQ ID NO: 63418 - RNA, 26 nt, Artificial Sequence
  Synthetic Oligonucleotide; CD244 exon 5; Set C
cguaaauugucaaaaauuccuuggga

SEQ ID NO: 63419 - RNA, 27 nt, Artificial Sequence
  Synthetic Oligonucleotide; CD244 exon 5; Set C
ucguaaauugucaaaaauuccuuggga

SEQ ID NO: 63420 - RNA, 22 nt, Artificial Sequence
  Synthetic Oligonucleotide; CD244 exon 5; Set C
cguaaauugucaaaaauuccuu

SEQ ID NO: 63421 - RNA, 23 nt, Artificial Sequence
  Synthetic Oligonucleotide; CD244 exon 5; Set C
ucguaaauugucaaaaauuccuu

SEQ ID NO: 63422 - RNA, 21 nt, Artificial Sequence
  Synthetic Oligonucleotide; CD244 exon 5; Set C
cguaaauugucaaaaauuccu

SEQ ID NO: 63423 - RNA, 22 nt, Artificial Sequence
  Synthetic Oligonucleotide; CD244 exon 5; Set C
ucguaaauugucaaaaauuccu

SEQ ID NO: 63424 - RNA, 20 nt, Artificial Sequence
  Synthetic Oligonucleotide; CD244 exon 5; Set C
cguaaauugucaaaaauucc

SEQ ID NO: 63425 - RNA, 19 nt, Artificial Sequence
  Synthetic Oligonucleotide; CD244 exon 5; Set C
cguaaauugucaaaaauuc

SEQ ID NO: 63426 - RNA, 21 nt, Artificial Sequence
  Synthetic Oligonucleotide; CD244 exon 5; Set C
ucguaaauugucaaaaauucc

SEQ ID NO: 63427 - RNA, 20 nt, Artificial Sequence
  Synthetic Oligonucleotide; CD244 exon 5; Set C
ucguaaauugucaaaaauuc

SEQ ID NO: 63428 - RNA, 27 nt, Artificial Sequence
  Synthetic Oligonucleotide; CD244 exon 5; Set C
uuucagauccuugacaucuucguaaau

SEQ ID NO: 63429 - RNA, 28 nt, Artificial Sequence
  Synthetic Oligonucleotide; CD244 exon 5; Set C
uuuucagauccuugacaucuucguaaau

SEQ ID NO: 63430 - RNA, 29 nt, Artificial Sequence
  Synthetic Oligonucleotide; CD244 exon 5; Set A
guuuucagauccuugacaucuucguaaau

SEQ ID NO: 63431 - RNA, 22 nt, Artificial Sequence
  Synthetic Oligonucleotide; CD244 exon 5; Set C
uucagauccuugacaucuucgu

SEQ ID NO: 63432 - RNA, 23 nt, Artificial Sequence
  Synthetic Oligonucleotide; CD244 exon 5; Set C
uuucagauccuugacaucuucgu

SEQ ID NO: 63433 - RNA, 21 nt, Artificial Sequence
  Synthetic Oligonucleotide; CD244 exon 5; Set C
uucagauccuugacaucuucg

SEQ ID NO: 63434 - RNA, 24 nt, Artificial Sequence
  Synthetic Oligonucleotide; CD244 exon 5; Set C
uuuucagauccuugacaucuucgu

SEQ ID NO: 63435 - RNA, 22 nt, Artificial Sequence
  Synthetic Oligonucleotide; CD244 exon 5; Set C
uuucagauccuugacaucuucg

SEQ ID NO: 63436 - RNA, 23 nt, Artificial Sequence
  Synthetic Oligonucleotide; CD244 exon 5; Set C
uuuucagauccuugacaucuucg

SEQ ID NO: 63437 - RNA, 24 nt, Artificial Sequence
  Synthetic Oligonucleotide; CD244 exon 5; Set C
guuuucagauccuugacaucuucg

SEQ ID NO: 63438 - RNA, 38 nt, Artificial Sequence
  Synthetic Oligonucleotide; CD244 exon 5; Set C
uuucuccugguuuucagauccuugacaucuucguaaau

SEQ ID NO: 63439 - RNA, 33 nt, Artificial Sequence
  Synthetic Oligonucleotide; CD244 exon 5; Set C
uucuccugguuuucagauccuugacaucuucgu

SEQ ID NO: 63440 - RNA, 34 nt, Artificial Sequence
  Synthetic Oligonucleotide; CD244 exon 5; Set C
uuucuccugguuuucagauccuugacaucuucgu

SEQ ID NO: 63441 - RNA, 32 nt, Artificial Sequence
  Synthetic Oligonucleotide; CD244 exon 5; Set C
uucuccugguuuucagauccuugacaucuucg

SEQ ID NO: 63442 - RNA, 33 nt, Artificial Sequence
  Synthetic Oligonucleotide; CD244 exon 5; Set C
uuucuccugguuuucagauccuugacaucuucg

SEQ ID NO: 63443 - RNA, 21 nt, Artificial Sequence
  Synthetic Oligonucleotide; CD244 exon 5; Set C
uucuccugguuuucagauccu

SEQ ID NO: 63444 - RNA, 22 nt, Artificial Sequence
  Synthetic Oligonucleotide; CD244 exon 5; Set C
uuucuccugguuuucagauccu

SEQ ID NO: 63445 - RNA, 34 nt, Artificial Sequence
  Synthetic Oligonucleotide; CD244 exon 5; Set C
ugacauacgugauuucuccugguuuucagauccu

SEQ ID NO: 63446 - RNA, 15 nt, Artificial Sequence
  Synthetic Oligonucleotide; CD244 exon 5; Set C
gacauacgugauuuc

SEQ ID NO: 63447 - RNA, 17 nt, Artificial Sequence
  Synthetic Oligonucleotide; CD244 exon 5; Set C
ugacauacgugauuucu

SEQ ID NO: 63448 - RNA, 16 nt, Artificial Sequence
  Synthetic Oligonucleotide; CD244 exon 5; Set C
ugacauacgugauuuc

SEQ ID NO: 63449 - RNA, 15 nt, Artificial Sequence
  Synthetic Oligonucleotide; CD244 exon 5; Set C
ugacauacgugauuu

SEQ ID NO: 63450 - RNA, 34 nt, Artificial Sequence
  Synthetic Oligonucleotide; CD244 exon 5; Set C
agaccccagccuccgggaugacauacgugauuuc

SEQ ID NO: 63451 - RNA, 33 nt, Artificial Sequence
  Synthetic Oligonucleotide; CD244 exon 5; Set C
agaccccagccuccgggaugacauacgugauuu

SEQ ID NO: 63452 - RNA, 35 nt, Artificial Sequence
  Synthetic Oligonucleotide; CD244 exon 5; Set C
gagaccccagccuccgggaugacauacgugauuuc

SEQ ID NO: 63453 - RNA, 34 nt, Artificial Sequence
  Synthetic Oligonucleotide; CD244 exon 5; Set C
gagaccccagccuccgggaugacauacgugauuu

SEQ ID NO: 63454 - RNA, 22 nt, Artificial Sequence
  Synthetic Oligonucleotide; CD244 exon 5; Set C
agaccccagccuccgggaugac

SEQ ID NO: 63455 - RNA, 21 nt, Artificial Sequence
  Synthetic Oligonucleotide; CD244 exon 5; Set C
agaccccagccuccgggauga

SEQ ID NO: 63456 - RNA, 23 nt, Artificial Sequence
  Synthetic Oligonucleotide; CD244 exon 5; Set C
gagaccccagccuccgggaugac

SEQ ID NO: 63457 - RNA, 22 nt, Artificial Sequence
  Synthetic Oligonucleotide; CD244 exon 5; Set C
gagaccccagccuccgggauga

SEQ ID NO: 63458 - RNA, 24 nt, Artificial Sequence
  Synthetic Oligonucleotide; CD244 exon 5; Set C
uggucucugagggaggaagaaaac

SEQ ID NO: 63459 - RNA, 23 nt, Artificial Sequence
  Synthetic Oligonucleotide; CD244 exon 5; Set C
uggucucugagggaggaagaaaa

SEQ ID NO: 63460 - RNA, 22 nt, Artificial Sequence
  Synthetic Oligonucleotide; CD244 exon 5; Set C
uggucucugagggaggaagaaa

SEQ ID NO: 63461 - RNA, 29 nt, Artificial Sequence
  Synthetic Oligonucleotide; CD244 exon 5; Set A
gggacuggucucugagggaggaagaaaac

SEQ ID NO: 63462 - RNA, 28 nt, Artificial Sequence
  Synthetic Oligonucleotide; CD244 exon 5; Set A
gggacuggucucugagggaggaagaaaa

SEQ ID NO: 63463 - RNA, 30 nt, Artificial Sequence
  Synthetic Oligonucleotide; CD244 exon 5; Set A
ugggacuggucucugagggaggaagaaaac

SEQ ID NO: 63464 - RNA, 27 nt, Artificial Sequence
  Synthetic Oligonucleotide; CD244 exon 5; Set A
gggacuggucucugagggaggaagaaa

SEQ ID NO: 63465 - RNA, 29 nt, Artificial Sequence
  Synthetic Oligonucleotide; CD244 exon 5; Set A
ugggacuggucucugagggaggaagaaaa

SEQ ID NO: 63466 - RNA, 31 nt, Artificial Sequence
  Synthetic Oligonucleotide; CD244 exon 5; Set A
uugggacuggucucugagggaggaagaaaac

SEQ ID NO: 63467 - RNA, 28 nt, Artificial Sequence
  Synthetic Oligonucleotide; CD244 exon 5; Set A
ugggacuggucucugagggaggaagaaa

SEQ ID NO: 63468 - RNA, 30 nt, Artificial Sequence
  Synthetic Oligonucleotide; CD244 exon 5; Set A
uugggacuggucucugagggaggaagaaaa

SEQ ID NO: 63469 - RNA, 29 nt, Artificial Sequence
  Synthetic Oligonucleotide; CD244 exon 5; Set A
uugggacuggucucugagggaggaagaaa

SEQ ID NO: 63470 - RNA, 35 nt, Artificial Sequence
  Synthetic Oligonucleotide; CD244 exon 5; Set C
uuccuugggacuggucucugagggaggaagaaaac

SEQ ID NO: 63471 - RNA, 34 nt, Artificial Sequence
  Synthetic Oligonucleotide; CD244 exon 5; Set C
uuccuugggacuggucucugagggaggaagaaaa

SEQ ID NO: 63472 - RNA, 33 nt, Artificial Sequence
  Synthetic Oligonucleotide; CD244 exon 5; Set C
uuccuugggacuggucucugagggaggaagaaa

SEQ ID NO: 63473 - RNA, 17 nt, Artificial Sequence
  Synthetic Oligonucleotide; CD244 exon 5; Set C
ggacuggucucugaggg

SEQ ID NO: 63474 - RNA, 16 nt, Artificial Sequence
  Synthetic Oligonucleotide; CD244 exon 5; Set C
ggacuggucucugagg

SEQ ID NO: 63475 - RNA, 15 nt, Artificial Sequence
  Synthetic Oligonucleotide; CD244 exon 5; Set C
ggacuggucucugag

SEQ ID NO: 63476 - RNA, 21 nt, Artificial Sequence
  Synthetic Oligonucleotide; CD244 exon 5; Set A
cuugggacuggucucugaggg

SEQ ID NO: 63477 - RNA, 20 nt, Artificial Sequence
  Synthetic Oligonucleotide; CD244 exon 5; Set A
cuugggacuggucucugagg

SEQ ID NO: 63478 - RNA, 22 nt, Artificial Sequence
  Synthetic Oligonucleotide; CD244 exon 5; Set A
ccuugggacuggucucugaggg

SEQ ID NO: 63479 - RNA, 19 nt, Artificial Sequence
  Synthetic Oligonucleotide; CD244 exon 5; Set C
cuugggacuggucucugag

SEQ ID NO: 63480 - RNA, 21 nt, Artificial Sequence
  Synthetic Oligonucleotide; CD244 exon 5; Set A
ccuugggacuggucucugagg

SEQ ID NO: 63481 - RNA, 23 nt, Artificial Sequence
  Synthetic Oligonucleotide; CD244 exon 5; Set A
uccuugggacuggucucugaggg

SEQ ID NO: 63482 - RNA, 20 nt, Artificial Sequence
  Synthetic Oligonucleotide; CD244 exon 5; Set A
ccuugggacuggucucugag

SEQ ID NO: 63483 - RNA, 22 nt, Artificial Sequence
  Synthetic Oligonucleotide; CD244 exon 5; Set A
uccuugggacuggucucugagg

SEQ ID NO: 63484 - RNA, 24 nt, Artificial Sequence
  Synthetic Oligonucleotide; CD244 exon 5; Set A
uuccuugggacuggucucugaggg

SEQ ID NO: 63485 - RNA, 21 nt, Artificial Sequence
  Synthetic Oligonucleotide; CD244 exon 5; Set A
uccuugggacuggucucugag

SEQ ID NO: 63486 - RNA, 23 nt, Artificial Sequence
  Synthetic Oligonucleotide; CD244 exon 5; Set A
uuccuugggacuggucucugagg

SEQ ID NO: 63487 - RNA, 22 nt, Artificial Sequence
  Synthetic Oligonucleotide; CD244 exon 5; Set A
uuccuugggacuggucucugag

SEQ ID NO: 63488 - RNA, 23 nt, Artificial Sequence
  Synthetic Oligonucleotide; CD244 exon 5; Set A
aauuccuugggacuggucucuga

SEQ ID NO: 63489 - RNA, 22 nt, Artificial Sequence
  Synthetic Oligonucleotide; CD244 exon 5; Set A
aauuccuugggacuggucucug

SEQ ID NO: 63490 - RNA, 24 nt, Artificial Sequence
  Synthetic Oligonucleotide; CD244 exon 5; Set A
aaauuccuugggacuggucucuga

SEQ ID NO: 63491 - RNA, 21 nt, Artificial Sequence
  Synthetic Oligonucleotide; CD244 exon 5; Set A
aauuccuugggacuggucucu

SEQ ID NO: 63492 - RNA, 23 nt, Artificial Sequence
  Synthetic Oligonucleotide; CD244 exon 5; Set C
aaauuccuugggacuggucucug

SEQ ID NO: 63493 - RNA, 22 nt, Artificial Sequence
  Synthetic Oligonucleotide; CD244 exon 5; Set C
aaauuccuugggacuggucucu

SEQ ID NO: 63494 - RNA, 20 nt, Artificial Sequence
  Synthetic Oligonucleotide; CD244 exon 5; Set C
aauuccuugggacuggucuc

SEQ ID NO: 63495 - RNA, 21 nt, Artificial Sequence
  Synthetic Oligonucleotide; CD244 exon 5; Set C
aaauuccuugggacuggucuc

SEQ ID NO: 63496 - RNA, 17 nt, Artificial Sequence
  Synthetic Oligonucleotide; CD244 exon 5; Set C
aauuccuugggacuggu

SEQ ID NO: 63497 - RNA, 16 nt, Artificial Sequence
  Synthetic Oligonucleotide; CD244 exon 5; Set C
aauuccuugggacugg

SEQ ID NO: 63498 - RNA, 18 nt, Artificial Sequence
  Synthetic Oligonucleotide; CD244 exon 5; Set C
aaauuccuugggacuggu

SEQ ID NO: 63499 - RNA, 36 nt, Artificial Sequence
  Synthetic Oligonucleotide; CD244 exon 5; Set A
aauugucaaaaauuccuugggacuggucucugaggg

SEQ ID NO: 63500 - RNA, 17 nt, Artificial Sequence
  Synthetic Oligonucleotide; CD244 exon 5; Set C
aaauuccuugggacugg

SEQ ID NO: 63501 - RNA, 35 nt, Artificial Sequence
  Synthetic Oligonucleotide; CD244 exon 5; Set A
aauugucaaaaauuccuugggacuggucucugagg

SEQ ID NO: 63502 - RNA, 34 nt, Artificial Sequence
  Synthetic Oligonucleotide; CD244 exon 5; Set A
aauugucaaaaauuccuugggacuggucucugag

SEQ ID NO: 63503 - RNA, 28 nt, Artificial Sequence
  Synthetic Oligonucleotide; CD244 exon 5; Set C
aauugucaaaaauuccuugggacugguc

SEQ ID NO: 63504 - RNA, 19 nt, Artificial Sequence
  Synthetic Oligonucleotide; CD244 exon 5; Set C
uugucaaaaauuccuuggg

SEQ ID NO: 63505 - RNA, 20 nt, Artificial Sequence
  Synthetic Oligonucleotide; CD244 exon 5; Set C
auugucaaaaauuccuuggg

SEQ ID NO: 63506 - RNA, 22 nt, Artificial Sequence
  Synthetic Oligonucleotide; CD244 exon 5; Set C
aauugucaaaaauuccuuggga

SEQ ID NO: 63507 - RNA, 29 nt, Artificial Sequence
  Synthetic Oligonucleotide; CD244 exon 5; Set C
cguaaauugucaaaaauuccuugggacug

SEQ ID NO: 63508 - RNA, 22 nt, Artificial Sequence
  Synthetic Oligonucleotide; CD244 exon 5; Set C
aaauugucaaaaauuccuuggg

SEQ ID NO: 63509 - RNA, 30 nt, Artificial Sequence
  Synthetic Oligonucleotide; CD244 exon 5; Set C
ucguaaauugucaaaaauuccuugggacug

SEQ ID NO: 63510 - RNA, 23 nt, Artificial Sequence
  Synthetic Oligonucleotide; CD244 exon 5; Set C
uaaauugucaaaaauuccuuggg

SEQ ID NO: 63511 - RNA, 29 nt, Artificial Sequence
  Synthetic Oligonucleotide; CD244 exon 5; Set C
ucguaaauugucaaaaauuccuugggacu

SEQ ID NO: 63512 - RNA, 24 nt, Artificial Sequence
  Synthetic Oligonucleotide; CD244 exon 5; Set C
guaaauugucaaaaauuccuuggg

SEQ ID NO: 63513 - RNA, 22 nt, Artificial Sequence
  Synthetic Oligonucleotide; CD244 exon 5; Set C
uaaauugucaaaaauuccuugg

SEQ ID NO: 63514 - RNA, 18 nt, Artificial Sequence
  Synthetic Oligonucleotide; CD244 exon 5; Set C
aauugucaaaaauuccuu

SEQ ID NO: 63515 - RNA, 23 nt, Artificial Sequence
  Synthetic Oligonucleotide; CD244 exon 5; Set C
guaaauugucaaaaauuccuugg

SEQ ID NO: 63516 - RNA, 17 nt, Artificial Sequence
  Synthetic Oligonucleotide; CD244 exon 5; Set C
aauugucaaaaauuccu

SEQ ID NO: 63517 - RNA, 15 nt, Artificial Sequence
  Synthetic Oligonucleotide; CD244 exon 5; Set C
aauugucaaaaauuc

SEQ ID NO: 63518 - RNA, 37 nt, Artificial Sequence
  Synthetic Oligonucleotide; CD244 exon 5; Set A
ccuugacaucuucguaaauugucaaaaauuccuuggg

SEQ ID NO: 63519 - RNA, 36 nt, Artificial Sequence
  Synthetic Oligonucleotide; CD244 exon 5; Set A
ccuugacaucuucguaaauugucaaaaauuccuugg

SEQ ID NO: 63520 - RNA, 35 nt, Artificial Sequence
  Synthetic Oligonucleotide; CD244 exon 5; Set A
ccuugacaucuucguaaauugucaaaaauuccuug

SEQ ID NO: 63521 - RNA, 40 nt, Artificial Sequence
  Synthetic Oligonucleotide; CD244 exon 5; Set A
uucagauccuugacaucuucguaaauugucaaaaauuccu

SEQ ID NO: 63522 - RNA, 39 nt, Artificial Sequence
  Synthetic Oligonucleotide; CD244 exon 5; Set A
uucagauccuugacaucuucguaaauugucaaaaauucc

SEQ ID NO: 63523 - RNA, 38 nt, Artificial Sequence
  Synthetic Oligonucleotide; CD244 exon 5; Set A
uucagauccuugacaucuucguaaauugucaaaaauuc

SEQ ID NO: 63524 - RNA, 40 nt, Artificial Sequence
  Synthetic Oligonucleotide; CD244 exon 5; Set A
uuucagauccuugacaucuucguaaauugucaaaaauucc

SEQ ID NO: 63525 - RNA, 39 nt, Artificial Sequence
  Synthetic Oligonucleotide; CD244 exon 5; Set A
uuucagauccuugacaucuucguaaauugucaaaaauuc

SEQ ID NO: 63526 - RNA, 40 nt, Artificial Sequence
  Synthetic Oligonucleotide; CD244 exon 5; Set A
uuuucagauccuugacaucuucguaaauugucaaaaauuc

SEQ ID NO: 63527 - RNA, 15 nt, Artificial Sequence
  Synthetic Oligonucleotide; CD244 exon 5; Set C
ccuugacaucuucgu

SEQ ID NO: 63528 - RNA, 26 nt, Artificial Sequence
  Synthetic Oligonucleotide; CD244 exon 5; Set C
uucagauccuugacaucuucguaaau

SEQ ID NO: 63529 - RNA, 37 nt, Artificial Sequence
  Synthetic Oligonucleotide; CD244 exon 5; Set C
uucuccugguuuucagauccuugacaucuucguaaau

SEQ ID NO: 63530 - RNA, 32 nt, Artificial Sequence
  Synthetic Oligonucleotide; CD244 exon 5; Set C
ucuccugguuuucagauccuugacaucuucgu

SEQ ID NO: 63531 - RNA, 31 nt, Artificial Sequence
  Synthetic Oligonucleotide; CD244 exon 5; Set C
ucuccugguuuucagauccuugacaucuucg

SEQ ID NO: 63532 - RNA, 20 nt, Artificial Sequence
  Synthetic Oligonucleotide; CD244 exon 5; Set C
ucuccugguuuucagauccu

SEQ ID NO: 63533 - RNA, 33 nt, Artificial Sequence
  Synthetic Oligonucleotide; CD244 exon 5; Set C
gacauacgugauuucuccugguuuucagauccu

SEQ ID NO: 63534 - RNA, 16 nt, Artificial Sequence
  Synthetic Oligonucleotide; CD244 exon 5; Set C
gacauacgugauuucu

SEQ ID NO: 63535 - RNA, 35 nt, Artificial Sequence
  Synthetic Oligonucleotide; CD244 exon 5; Set C
agaccccagccuccgggaugacauacgugauuucu

SEQ ID NO: 63536 - RNA, 36 nt, Artificial Sequence
  Synthetic Oligonucleotide; CD244 exon 5; Set C
gagaccccagccuccgggaugacauacgugauuucu

SEQ ID NO: 63537 - RNA, 36 nt, Artificial Sequence
  Synthetic Oligonucleotide; CD244 exon 5; Set C
aagccagcugagagagaccccagccuccgggaugac

SEQ ID NO: 63538 - RNA, 37 nt, Artificial Sequence
  Synthetic Oligonucleotide; CD244 exon 5; Set C
caagccagcugagagagaccccagccuccgggaugac

SEQ ID NO: 63539 - RNA, 40 nt, Artificial Sequence
  Synthetic Oligonucleotide; CD244 exon 5; Set C
uuccaagccagcugagagagaccccagccuccgggaugac

SEQ ID NO: 63540 - RNA, 40 nt, Artificial Sequence
  Synthetic Oligonucleotide; CD244 exon 5; Set C
uuuccaagccagcugagagagaccccagccuccgggauga

SEQ ID NO: 63541 - RNA, 16 nt, Artificial Sequence
  Synthetic Oligonucleotide; CD244 exon 5; Set C
agccagcugagagaga

SEQ ID NO: 63542 - RNA, 17 nt, Artificial Sequence
  Synthetic Oligonucleotide; CD244 exon 5; Set C
aagccagcugagagaga

SEQ ID NO: 63543 - RNA, 18 nt, Artificial Sequence
  Synthetic Oligonucleotide; CD244 exon 5; Set C
caagccagcugagagaga

SEQ ID NO: 63544 - RNA, 19 nt, Artificial Sequence
  Synthetic Oligonucleotide; CD244 exon 5; Set B
ccaagccagcugagagaga

SEQ ID NO: 63545 - RNA, 17 nt, Artificial Sequence
  Synthetic Oligonucleotide; CD244 exon 5; Set C
caagccagcugagagag

SEQ ID NO: 63546 - RNA, 20 nt, Artificial Sequence
  Synthetic Oligonucleotide; CD244 exon 5; Set B
uccaagccagcugagagaga

SEQ ID NO: 63547 - RNA, 21 nt, Artificial Sequence
  Synthetic Oligonucleotide; CD244 exon 5; Set B
uuccaagccagcugagagaga

SEQ ID NO: 63548 - RNA, 22 nt, Artificial Sequence
  Synthetic Oligonucleotide; CD244 exon 5; Set B
uuuccaagccagcugagagaga

SEQ ID NO: 63549 - RNA, 20 nt, Artificial Sequence
  Synthetic Oligonucleotide; CD244 exon 5; Set C
uuccaagccagcugagagag

SEQ ID NO: 63550 - RNA, 23 nt, Artificial Sequence
  Synthetic Oligonucleotide; CD244 exon 5; Set B
uuuuccaagccagcugagagaga

SEQ ID NO: 63551 - RNA, 21 nt, Artificial Sequence
  Synthetic Oligonucleotide; CD244 exon 5; Set C
uuuccaagccagcugagagag

SEQ ID NO: 63552 - RNA, 22 nt, Artificial Sequence
  Synthetic Oligonucleotide; CD244 exon 5; Set B
uuuuccaagccagcugagagag

SEQ ID NO: 63553 - RNA, 24 nt, Artificial Sequence
  Synthetic Oligonucleotide; LAG exon 2; Set C
ggauuguggggcugcaggggagcu

SEQ ID NO: 63554 - RNA, 23 nt, Artificial Sequence
  Synthetic Oligonucleotide; LAG exon 2; Set C
ggauuguggggcugcaggggagc

SEQ ID NO: 63555 - RNA, 25 nt, Artificial Sequence
  Synthetic Oligonucleotide; LAG exon 2; Set C
gggauuguggggcugcaggggagcu

SEQ ID NO: 63556 - RNA, 24 nt, Artificial Sequence
  Synthetic Oligonucleotide; LAG exon 2; Set C
gggauuguggggcugcaggggagc

SEQ ID NO: 63557 - RNA, 15 nt, Artificial Sequence
  Synthetic Oligonucleotide; LAG exon 2; Set C
gggauuguggggcug

SEQ ID NO: 63558 - RNA, 16 nt, Artificial Sequence
  Synthetic Oligonucleotide; LAG exon 2; Set A
ggggauuguggggcug

SEQ ID NO: 63559 - RNA, 15 nt, Artificial Sequence
  Synthetic Oligonucleotide; LAG exon 2; Set C
ggggauuguggggcu

SEQ ID NO: 63560 - RNA, 17 nt, Artificial Sequence
  Synthetic Oligonucleotide; LAG exon 2; Set A
gggggauuguggggcug

SEQ ID NO: 63561 - RNA, 16 nt, Artificial Sequence
  Synthetic Oligonucleotide; LAG exon 2; Set A
gggggauuguggggcu

SEQ ID NO: 63562 - RNA, 18 nt, Artificial Sequence
  Synthetic Oligonucleotide; LAG exon 2; Set A
agggggauuguggggcug

SEQ ID NO: 63563 - RNA, 15 nt, Artificial Sequence
  Synthetic Oligonucleotide; LAG exon 2; Set A
gggggauuguggggc

SEQ ID NO: 63564 - RNA, 17 nt, Artificial Sequence
  Synthetic Oligonucleotide; LAG exon 2; Set A
agggggauuguggggcu

SEQ ID NO: 63565 - RNA, 19 nt, Artificial Sequence
  Synthetic Oligonucleotide; LAG exon 2; Set A
gagggggauuguggggcug

SEQ ID NO: 63566 - RNA, 16 nt, Artificial Sequence
  Synthetic Oligonucleotide; LAG exon 2; Set A
agggggauuguggggc

SEQ ID NO: 63567 - RNA, 18 nt, Artificial Sequence
  Synthetic Oligonucleotide; LAG exon 2; Set A
gagggggauuguggggcu

SEQ ID NO: 63568 - RNA, 20 nt, Artificial Sequence
  Synthetic Oligonucleotide; LAG exon 2; Set C
ggagggggauuguggggcug

SEQ ID NO: 63569 - RNA, 17 nt, Artificial Sequence
  Synthetic Oligonucleotide; LAG exon 2; Set A
gagggggauuguggggc

SEQ ID NO: 63570 - RNA, 19 nt, Artificial Sequence
  Synthetic Oligonucleotide; LAG exon 2; Set C
ggagggggauuguggggcu

SEQ ID NO: 63571 - RNA, 21 nt, Artificial Sequence
  Synthetic Oligonucleotide; LAG exon 2; Set C
uggagggggauuguggggcug

SEQ ID NO: 63572 - RNA, 15 nt, Artificial Sequence
  Synthetic Oligonucleotide; LAG exon 2; Set C
agggggauugugggg

SEQ ID NO: 63573 - RNA, 20 nt, Artificial Sequence
  Synthetic Oligonucleotide; LAG exon 2; Set C
uggagggggauuguggggcu

SEQ ID NO: 63574 - RNA, 18 nt, Artificial Sequence
  Synthetic Oligonucleotide; LAG exon 2; Set A
ggagggggauuguggggc

SEQ ID NO: 63575 - RNA, 16 nt, Artificial Sequence
  Synthetic Oligonucleotide; LAG exon 2; Set C
gagggggauugugggg

SEQ ID NO: 63576 - RNA, 19 nt, Artificial Sequence
  Synthetic Oligonucleotide; LAG exon 2; Set A
uggagggggauuguggggc

SEQ ID NO: 63577 - RNA, 15 nt, Artificial Sequence
  Synthetic Oligonucleotide; LAG exon 2; Set C
gagggggauuguggg

SEQ ID NO: 63578 - RNA, 17 nt, Artificial Sequence
  Synthetic Oligonucleotide; LAG exon 2; Set A
ggagggggauugugggg

SEQ ID NO: 63579 - RNA, 18 nt, Artificial Sequence
  Synthetic Oligonucleotide; LAG exon 2; Set A
uggagggggauugugggg

SEQ ID NO: 63580 - RNA, 17 nt, Artificial Sequence
  Synthetic Oligonucleotide; LAG exon 2; Set A
uggagggggauuguggg

SEQ ID NO: 63581 - RNA, 15 nt, Artificial Sequence
  Synthetic Oligonucleotide; LAG exon 2; Set C
uggagggggauugug

SEQ ID NO: 63582 - RNA, 18 nt, Artificial Sequence
  Synthetic Oligonucleotide; LAG exon 2; Set C
ugagugcuggauucggag

SEQ ID NO: 63583 - RNA, 19 nt, Artificial Sequence
  Synthetic Oligonucleotide; LAG exon 2; Set C
uugagugcuggauucggag

SEQ ID NO: 63584 - RNA, 21 nt, Artificial Sequence
  Synthetic Oligonucleotide; LAG exon 2; Set B
guugagugcuggauucggagg

SEQ ID NO: 63585 - RNA, 20 nt, Artificial Sequence
  Synthetic Oligonucleotide; LAG exon 2; Set C
guugagugcuggauucggag

SEQ ID NO: 63586 - RNA, 18 nt, Artificial Sequence
  Synthetic Oligonucleotide; LAG exon 2; Set C
uugagugcuggauucgga

SEQ ID NO: 63587 - RNA, 22 nt, Artificial Sequence
  Synthetic Oligonucleotide; LAG exon 2; Set B
gguugagugcuggauucggagg

SEQ ID NO: 63588 - RNA, 19 nt, Artificial Sequence
  Synthetic Oligonucleotide; LAG exon 2; Set B
guugagugcuggauucgga

SEQ ID NO: 63589 - RNA, 21 nt, Artificial Sequence
  Synthetic Oligonucleotide; LAG exon 2; Set B
gguugagugcuggauucggag

SEQ ID NO: 63590 - RNA, 20 nt, Artificial Sequence
  Synthetic Oligonucleotide; LAG exon 2; Set B
gguugagugcuggauucgga

SEQ ID NO: 63591 - RNA, 35 nt, Artificial Sequence
  Synthetic Oligonucleotide; LAG exon 2; Set C
aaaagagaggccaaggggagggggcgugagccgag

SEQ ID NO: 63592 - RNA, 29 nt, Artificial Sequence
  Synthetic Oligonucleotide; LAG exon 2; Set C
aaaagagaggccaaggggagggggcguga

SEQ ID NO: 63593 - RNA, 28 nt, Artificial Sequence
  Synthetic Oligonucleotide; LAG exon 2; Set C
aaaagagaggccaaggggagggggcgug

SEQ ID NO: 63594 - RNA, 19 nt, Artificial Sequence
  Synthetic Oligonucleotide; LAG exon 2; Set C
aaagagaggccaaggggag

SEQ ID NO: 63595 - RNA, 20 nt, Artificial Sequence
  Synthetic Oligonucleotide; LAG exon 2; Set C
aaaagagaggccaaggggag

SEQ ID NO: 63596 - RNA, 19 nt, Artificial Sequence
  Synthetic Oligonucleotide; LAG exon 2; Set C
aaaagagaggccaagggga

SEQ ID NO: 63597 - RNA, 29 nt, Artificial Sequence
  Synthetic Oligonucleotide; LAG exon 2; Set A
uaggugagcaaaagagaggccaaggggag

SEQ ID NO: 63598 - RNA, 28 nt, Artificial Sequence
  Synthetic Oligonucleotide; LAG exon 2; Set A
uaggugagcaaaagagaggccaagggga

SEQ ID NO: 63599 - RNA, 16 nt, Artificial Sequence
  Synthetic Oligonucleotide; LAG exon 2; Set C
uaggugagcaaaagag

SEQ ID NO: 63600 - RNA, 15 nt, Artificial Sequence
  Synthetic Oligonucleotide; LAG exon 2; Set C
uaggugagcaaaaga

SEQ ID NO: 63601 - RNA, 26 nt, Artificial Sequence
  Synthetic Oligonucleotide; LAG exon 2; Set C
uggggcugcaggggagcugggcagga

SEQ ID NO: 63602 - RNA, 27 nt, Artificial Sequence
  Synthetic Oligonucleotide; LAG exon 2; Set C
guggggcugcaggggagcugggcagga

SEQ ID NO: 63603 - RNA, 28 nt, Artificial Sequence
  Synthetic Oligonucleotide; LAG exon 2; Set C
uguggggcugcaggggagcugggcagga

SEQ ID NO: 63604 - RNA, 26 nt, Artificial Sequence
  Synthetic Oligonucleotide; LAG exon 2; Set C
guggggcugcaggggagcugggcagg

SEQ ID NO: 63605 - RNA, 29 nt, Artificial Sequence
  Synthetic Oligonucleotide; LAG exon 2; Set C
uuguggggcugcaggggagcugggcagga

SEQ ID NO: 63606 - RNA, 27 nt, Artificial Sequence
  Synthetic Oligonucleotide; LAG exon 2; Set C
uguggggcugcaggggagcugggcagg

SEQ ID NO: 63607 - RNA, 15 nt, Artificial Sequence
  Synthetic Oligonucleotide; LAG exon 2; Set A
gcugcaggggagcug

SEQ ID NO: 63608 - RNA, 30 nt, Artificial Sequence
  Synthetic Oligonucleotide; LAG exon 2; Set C
auuguggggcugcaggggagcugggcagga

SEQ ID NO: 63609 - RNA, 28 nt, Artificial Sequence
  Synthetic Oligonucleotide; LAG exon 2; Set C
uuguggggcugcaggggagcugggcagg

SEQ ID NO: 63610 - RNA, 16 nt, Artificial Sequence
  Synthetic Oligonucleotide; LAG exon 2; Set A
ggcugcaggggagcug

SEQ ID NO: 63611 - RNA, 31 nt, Artificial Sequence
  Synthetic Oligonucleotide; LAG exon 2; Set C
gauuguggggcugcaggggagcugggcagga

SEQ ID NO: 63612 - RNA, 29 nt, Artificial Sequence
  Synthetic Oligonucleotide; LAG exon 2; Set C
auuguggggcugcaggggagcugggcagg

SEQ ID NO: 63613 - RNA, 15 nt, Artificial Sequence
  Synthetic Oligonucleotide; LAG exon 2; Set A
ggcugcaggggagcu

SEQ ID NO: 63614 - RNA, 17 nt, Artificial Sequence
  Synthetic Oligonucleotide; LAG exon 2; Set A
gggcugcaggggagcug

SEQ ID NO: 63615 - RNA, 32 nt, Artificial Sequence
  Synthetic Oligonucleotide; LAG exon 2; Set C
ggauuguggggcugcaggggagcugggcagga

SEQ ID NO: 63616 - RNA, 30 nt, Artificial Sequence
  Synthetic Oligonucleotide; LAG exon 2; Set C
gauuguggggcugcaggggagcugggcagg

SEQ ID NO: 63617 - RNA, 16 nt, Artificial Sequence
  Synthetic Oligonucleotide; LAG exon 2; Set A
gggcugcaggggagcu

SEQ ID NO: 63618 - RNA, 18 nt, Artificial Sequence
  Synthetic Oligonucleotide; LAG exon 2; Set C
ggggcugcaggggagcug

SEQ ID NO: 63619 - RNA, 33 nt, Artificial Sequence
  Synthetic Oligonucleotide; LAG exon 2; Set C
gggauuguggggcugcaggggagcugggcagga

SEQ ID NO: 63620 - RNA, 15 nt, Artificial Sequence
  Synthetic Oligonucleotide; LAG exon 2; Set A
gggcugcaggggagc

SEQ ID NO: 63621 - RNA, 31 nt, Artificial Sequence
  Synthetic Oligonucleotide; LAG exon 2; Set C
ggauuguggggcugcaggggagcugggcagg

SEQ ID NO: 63622 - RNA, 17 nt, Artificial Sequence
  Synthetic Oligonucleotide; LAG exon 2; Set C
ggggcugcaggggagcu

SEQ ID NO: 63623 - RNA, 19 nt, Artificial Sequence
  Synthetic Oligonucleotide; LAG exon 2; Set C
uggggcugcaggggagcug

SEQ ID NO: 63624 - RNA, 34 nt, Artificial Sequence
  Synthetic Oligonucleotide; LAG exon 2; Set C
ggggauuguggggcugcaggggagcugggcagga

SEQ ID NO: 63625 - RNA, 16 nt, Artificial Sequence
  Synthetic Oligonucleotide; LAG exon 2; Set A
ggggcugcaggggagc

SEQ ID NO: 63626 - RNA, 32 nt, Artificial Sequence
  Synthetic Oligonucleotide; LAG exon 2; Set C
gggauuguggggcugcaggggagcugggcagg

SEQ ID NO: 63627 - RNA, 18 nt, Artificial Sequence
  Synthetic Oligonucleotide; LAG exon 2; Set C
uggggcugcaggggagcu

SEQ ID NO: 63628 - RNA, 20 nt, Artificial Sequence
  Synthetic Oligonucleotide; LAG exon 2; Set C
guggggcugcaggggagcug

SEQ ID NO: 63629 - RNA, 35 nt, Artificial Sequence
  Synthetic Oligonucleotide; LAG exon 2; Set C
gggggauuguggggcugcaggggagcugggcagga

SEQ ID NO: 63630 - RNA, 17 nt, Artificial Sequence
  Synthetic Oligonucleotide; LAG exon 2; Set A
uggggcugcaggggagc

SEQ ID NO: 63631 - RNA, 33 nt, Artificial Sequence
  Synthetic Oligonucleotide; LAG exon 2; Set C
ggggauuguggggcugcaggggagcugggcagg

SEQ ID NO: 63632 - RNA, 19 nt, Artificial Sequence
  Synthetic Oligonucleotide; LAG exon 2; Set C
guggggcugcaggggagcu

SEQ ID NO: 63633 - RNA, 21 nt, Artificial Sequence
  Synthetic Oligonucleotide; LAG exon 2; Set C
uguggggcugcaggggagcug

SEQ ID NO: 63634 - RNA, 18 nt, Artificial Sequence
  Synthetic Oligonucleotide; LAG exon 2; Set C
guggggcugcaggggagc

SEQ ID NO: 63635 - RNA, 36 nt, Artificial Sequence
  Synthetic Oligonucleotide; LAG exon 2; Set C
agggggauuguggggcugcaggggagcugggcagga

SEQ ID NO: 63636 - RNA, 34 nt, Artificial Sequence
  Synthetic Oligonucleotide; LAG exon 2; Set C
gggggauuguggggcugcaggggagcugggcagg

SEQ ID NO: 63637 - RNA, 20 nt, Artificial Sequence
  Synthetic Oligonucleotide; LAG exon 2; Set C
uguggggcugcaggggagcu

SEQ ID NO: 63638 - RNA, 22 nt, Artificial Sequence
  Synthetic Oligonucleotide; LAG exon 2; Set C
uuguggggcugcaggggagcug

SEQ ID NO: 63639 - RNA, 19 nt, Artificial Sequence
  Synthetic Oligonucleotide; LAG exon 2; Set C
uguggggcugcaggggagc

SEQ ID NO: 63640 - RNA, 37 nt, Artificial Sequence
  Synthetic Oligonucleotide; LAG exon 2; Set C
gagggggauuguggggcugcaggggagcugggcagga

SEQ ID NO: 63641 - RNA, 35 nt, Artificial Sequence
  Synthetic Oligonucleotide; LAG exon 2; Set C
agggggauuguggggcugcaggggagcugggcagg

SEQ ID NO: 63642 - RNA, 21 nt, Artificial Sequence
  Synthetic Oligonucleotide; LAG exon 2; Set C
uuguggggcugcaggggagcu

SEQ ID NO: 63643 - RNA, 23 nt, Artificial Sequence
  Synthetic Oligonucleotide; LAG exon 2; Set C
auuguggggcugcaggggagcug

SEQ ID NO: 63644 - RNA, 20 nt, Artificial Sequence
  Synthetic Oligonucleotide; LAG exon 2; Set C
uuguggggcugcaggggagc

SEQ ID NO: 63645 - RNA, 38 nt, Artificial Sequence
  Synthetic Oligonucleotide; LAG exon 2; Set C
ggagggggauuguggggcugcaggggagcugggcagga

SEQ ID NO: 63646 - RNA, 36 nt, Artificial Sequence
  Synthetic Oligonucleotide; LAG exon 2; Set C
gagggggauuguggggcugcaggggagcugggcagg

SEQ ID NO: 63647 - RNA, 22 nt, Artificial Sequence
  Synthetic Oligonucleotide; LAG exon 2; Set C
auuguggggcugcaggggagcu

SEQ ID NO: 63648 - RNA, 24 nt, Artificial Sequence
  Synthetic Oligonucleotide; LAG exon 2; Set C
gauuguggggcugcaggggagcug

SEQ ID NO: 63649 - RNA, 21 nt, Artificial Sequence
  Synthetic Oligonucleotide; LAG exon 2; Set C
auuguggggcugcaggggagc

SEQ ID NO: 63650 - RNA, 39 nt, Artificial Sequence
  Synthetic Oligonucleotide; LAG exon 2; Set C
uggagggggauuguggggcugcaggggagcugggcagga

SEQ ID NO: 63651 - RNA, 37 nt, Artificial Sequence
  Synthetic Oligonucleotide; LAG exon 2; Set C
ggagggggauuguggggcugcaggggagcugggcagg

SEQ ID NO: 63652 - RNA, 23 nt, Artificial Sequence
  Synthetic Oligonucleotide; LAG exon 2; Set C
gauuguggggcugcaggggagcu

SEQ ID NO: 63653 - RNA, 25 nt, Artificial Sequence
  Synthetic Oligonucleotide; LAG exon 2; Set C
ggauuguggggcugcaggggagcug

SEQ ID NO: 63654 - RNA, 22 nt, Artificial Sequence
  Synthetic Oligonucleotide; LAG exon 2; Set C
gauuguggggcugcaggggagc

SEQ ID NO: 63655 - RNA, 38 nt, Artificial Sequence
  Synthetic Oligonucleotide; LAG exon 2; Set C
uggagggggauuguggggcugcaggggagcugggcagg

SEQ ID NO: 63656 - RNA, 26 nt, Artificial Sequence
  Synthetic Oligonucleotide; LAG exon 2; Set C
gggauuguggggcugcaggggagcug

SEQ ID NO: 63657 - RNA, 27 nt, Artificial Sequence
  Synthetic Oligonucleotide; LAG exon 2; Set C
ggggauuguggggcugcaggggagcug

SEQ ID NO: 63658 - RNA, 26 nt, Artificial Sequence
  Synthetic Oligonucleotide; LAG exon 2; Set C
ggggauuguggggcugcaggggagcu

SEQ ID NO: 63659 - RNA, 28 nt, Artificial Sequence
  Synthetic Oligonucleotide; LAG exon 2; Set C
gggggauuguggggcugcaggggagcug

SEQ ID NO: 63660 - RNA, 25 nt, Artificial Sequence
  Synthetic Oligonucleotide; LAG exon 2; Set C
ggggauuguggggcugcaggggagc

SEQ ID NO: 63661 - RNA, 27 nt, Artificial Sequence
  Synthetic Oligonucleotide; LAG exon 2; Set C
gggggauuguggggcugcaggggagcu

SEQ ID NO: 63662 - RNA, 29 nt, Artificial Sequence
  Synthetic Oligonucleotide; LAG exon 2; Set C
agggggauuguggggcugcaggggagcug

SEQ ID NO: 63663 - RNA, 26 nt, Artificial Sequence
  Synthetic Oligonucleotide; LAG exon 2; Set C
gggggauuguggggcugcaggggagc

SEQ ID NO: 63664 - RNA, 28 nt, Artificial Sequence
  Synthetic Oligonucleotide; LAG exon 2; Set C
agggggauuguggggcugcaggggagcu

SEQ ID NO: 63665 - RNA, 30 nt, Artificial Sequence
  Synthetic Oligonucleotide; LAG exon 2; Set C
gagggggauuguggggcugcaggggagcug

SEQ ID NO: 63666 - RNA, 27 nt, Artificial Sequence
  Synthetic Oligonucleotide; LAG exon 2; Set C
agggggauuguggggcugcaggggagc

SEQ ID NO: 63667 - RNA, 29 nt, Artificial Sequence
  Synthetic Oligonucleotide; LAG exon 2; Set C
gagggggauuguggggcugcaggggagcu

SEQ ID NO: 63668 - RNA, 31 nt, Artificial Sequence
  Synthetic Oligonucleotide; LAG exon 2; Set C
ggagggggauuguggggcugcaggggagcug

SEQ ID NO: 63669 - RNA, 28 nt, Artificial Sequence
  Synthetic Oligonucleotide; LAG exon 2; Set C
gagggggauuguggggcugcaggggagc

SEQ ID NO: 63670 - RNA, 30 nt, Artificial Sequence
  Synthetic Oligonucleotide; LAG exon 2; Set C
ggagggggauuguggggcugcaggggagcu

SEQ ID NO: 63671 - RNA, 32 nt, Artificial Sequence
  Synthetic Oligonucleotide; LAG exon 2; Set C
uggagggggauuguggggcugcaggggagcug

SEQ ID NO: 63672 - RNA, 29 nt, Artificial Sequence
  Synthetic Oligonucleotide; LAG exon 2; Set C
ggagggggauuguggggcugcaggggagc

SEQ ID NO: 63673 - RNA, 31 nt, Artificial Sequence
  Synthetic Oligonucleotide; LAG exon 2; Set C
uggagggggauuguggggcugcaggggagcu

SEQ ID NO: 63674 - RNA, 30 nt, Artificial Sequence
  Synthetic Oligonucleotide; LAG exon 2; Set C
uggagggggauuguggggcugcaggggagc

SEQ ID NO: 63675 - RNA, 39 nt, Artificial Sequence
  Synthetic Oligonucleotide; LAG exon 2; Set C
gagauccuggagggggauuguggggcugcaggggagcug

SEQ ID NO: 63676 - RNA, 38 nt, Artificial Sequence
  Synthetic Oligonucleotide; LAG exon 2; Set C
gagauccuggagggggauuguggggcugcaggggagcu

SEQ ID NO: 63677 - RNA, 40 nt, Artificial Sequence
  Synthetic Oligonucleotide; LAG exon 2; Set C
ugagauccuggagggggauuguggggcugcaggggagcug

SEQ ID NO: 63678 - RNA, 37 nt, Artificial Sequence
  Synthetic Oligonucleotide; LAG exon 2; Set C
gagauccuggagggggauuguggggcugcaggggagc

SEQ ID NO: 63679 - RNA, 39 nt, Artificial Sequence
  Synthetic Oligonucleotide; LAG exon 2; Set C
ugagauccuggagggggauuguggggcugcaggggagcu

SEQ ID NO: 63680 - RNA, 38 nt, Artificial Sequence
  Synthetic Oligonucleotide; LAG exon 2; Set C
ugagauccuggagggggauuguggggcugcaggggagc

SEQ ID NO: 63681 - RNA, 40 nt, Artificial Sequence
  Synthetic Oligonucleotide; LAG exon 2; Set C
cugagauccuggagggggauuguggggcugcaggggagcu

SEQ ID NO: 63682 - RNA, 39 nt, Artificial Sequence
  Synthetic Oligonucleotide; LAG exon 2; Set C
cugagauccuggagggggauuguggggcugcaggggagc

SEQ ID NO: 63683 - RNA, 40 nt, Artificial Sequence
  Synthetic Oligonucleotide; LAG exon 2; Set C
gcugagauccuggagggggauuguggggcugcaggggagc

SEQ ID NO: 63684 - RNA, 16 nt, Artificial Sequence
  Synthetic Oligonucleotide; LAG exon 2; Set C
ggagggggauuguggg

SEQ ID NO: 63685 - RNA, 15 nt, Artificial Sequence
  Synthetic Oligonucleotide; LAG exon 2; Set C
ggagggggauugugg

SEQ ID NO: 63686 - RNA, 16 nt, Artificial Sequence
  Synthetic Oligonucleotide; LAG exon 2; Set C
uggagggggauugugg

SEQ ID NO: 63687 - RNA, 28 nt, Artificial Sequence
  Synthetic Oligonucleotide; LAG exon 2; Set C
gagauccuggagggggauuguggggcug

SEQ ID NO: 63688 - RNA, 27 nt, Artificial Sequence
  Synthetic Oligonucleotide; LAG exon 2; Set C
gagauccuggagggggauuguggggcu

SEQ ID NO: 63689 - RNA, 29 nt, Artificial Sequence
  Synthetic Oligonucleotide; LAG exon 2; Set C
ugagauccuggagggggauuguggggcug

SEQ ID NO: 63690 - RNA, 28 nt, Artificial Sequence
  Synthetic Oligonucleotide; LAG exon 2; Set C
ugagauccuggagggggauuguggggcu

SEQ ID NO: 63691 - RNA, 26 nt, Artificial Sequence
  Synthetic Oligonucleotide; LAG exon 2; Set C
gagauccuggagggggauuguggggc

SEQ ID NO: 63692 - RNA, 30 nt, Artificial Sequence
  Synthetic Oligonucleotide; LAG exon 2; Set C
cugagauccuggagggggauuguggggcug

SEQ ID NO: 63693 - RNA, 27 nt, Artificial Sequence
  Synthetic Oligonucleotide; LAG exon 2; Set C
ugagauccuggagggggauuguggggc

SEQ ID NO: 63694 - RNA, 29 nt, Artificial Sequence
  Synthetic Oligonucleotide; LAG exon 2; Set C
cugagauccuggagggggauuguggggcu

SEQ ID NO: 63695 - RNA, 31 nt, Artificial Sequence
  Synthetic Oligonucleotide; LAG exon 2; Set C
gcugagauccuggagggggauuguggggcug

SEQ ID NO: 63696 - RNA, 25 nt, Artificial Sequence
  Synthetic Oligonucleotide; LAG exon 2; Set C
gagauccuggagggggauugugggg

SEQ ID NO: 63697 - RNA, 28 nt, Artificial Sequence
  Synthetic Oligonucleotide; LAG exon 2; Set C
cugagauccuggagggggauuguggggc

SEQ ID NO: 63698 - RNA, 30 nt, Artificial Sequence
  Synthetic Oligonucleotide; LAG exon 2; Set C
gcugagauccuggagggggauuguggggcu

SEQ ID NO: 63699 - RNA, 26 nt, Artificial Sequence
  Synthetic Oligonucleotide; LAG exon 2; Set C
ugagauccuggagggggauugugggg

SEQ ID NO: 63700 - RNA, 24 nt, Artificial Sequence
  Synthetic Oligonucleotide; LAG exon 2; Set C
gagauccuggagggggauuguggg

SEQ ID NO: 63701 - RNA, 29 nt, Artificial Sequence
  Synthetic Oligonucleotide; LAG exon 2; Set C
gcugagauccuggagggggauuguggggc

SEQ ID NO: 63702 - RNA, 25 nt, Artificial Sequence
  Synthetic Oligonucleotide; LAG exon 2; Set C
ugagauccuggagggggauuguggg

SEQ ID NO: 63703 - RNA, 23 nt, Artificial Sequence
  Synthetic Oligonucleotide; LAG exon 2; Set A
gagauccuggagggggauugugg

SEQ ID NO: 63704 - RNA, 27 nt, Artificial Sequence
  Synthetic Oligonucleotide; LAG exon 2; Set C
cugagauccuggagggggauugugggg

SEQ ID NO: 63705 - RNA, 22 nt, Artificial Sequence
  Synthetic Oligonucleotide; LAG exon 2; Set A
gagauccuggagggggauugug

SEQ ID NO: 63706 - RNA, 24 nt, Artificial Sequence
  Synthetic Oligonucleotide; LAG exon 2; Set A
ugagauccuggagggggauugugg

SEQ ID NO: 63707 - RNA, 26 nt, Artificial Sequence
  Synthetic Oligonucleotide; LAG exon 2; Set C
cugagauccuggagggggauuguggg

SEQ ID NO: 63708 - RNA, 28 nt, Artificial Sequence
  Synthetic Oligonucleotide; LAG exon 2; Set C
gcugagauccuggagggggauugugggg

SEQ ID NO: 63709 - RNA, 21 nt, Artificial Sequence
  Synthetic Oligonucleotide; LAG exon 2; Set A
gagauccuggagggggauugu

SEQ ID NO: 63710 - RNA, 23 nt, Artificial Sequence
  Synthetic Oligonucleotide; LAG exon 2; Set A
ugagauccuggagggggauugug

SEQ ID NO: 63711 - RNA, 25 nt, Artificial Sequence
  Synthetic Oligonucleotide; LAG exon 2; Set C
cugagauccuggagggggauugugg

SEQ ID NO: 63712 - RNA, 27 nt, Artificial Sequence
  Synthetic Oligonucleotide; LAG exon 2; Set C
gcugagauccuggagggggauuguggg

SEQ ID NO: 63713 - RNA, 22 nt, Artificial Sequence
  Synthetic Oligonucleotide; LAG exon 2; Set A
ugagauccuggagggggauugu

SEQ ID NO: 63714 - RNA, 20 nt, Artificial Sequence
  Synthetic Oligonucleotide; LAG exon 2; Set A
gagauccuggagggggauug

SEQ ID NO: 63715 - RNA, 24 nt, Artificial Sequence
  Synthetic Oligonucleotide; LAG exon 2; Set A
cugagauccuggagggggauugug

SEQ ID NO: 63716 - RNA, 26 nt, Artificial Sequence
  Synthetic Oligonucleotide; LAG exon 2; Set C
gcugagauccuggagggggauugugg

SEQ ID NO: 63717 - RNA, 21 nt, Artificial Sequence
  Synthetic Oligonucleotide; LAG exon 2; Set A
ugagauccuggagggggauug

SEQ ID NO: 63718 - RNA, 23 nt, Artificial Sequence
  Synthetic Oligonucleotide; LAG exon 2; Set A
cugagauccuggagggggauugu

SEQ ID NO: 63719 - RNA, 19 nt, Artificial Sequence
  Synthetic Oligonucleotide; LAG exon 2; Set A
gagauccuggagggggauu

SEQ ID NO: 63720 - RNA, 25 nt, Artificial Sequence
  Synthetic Oligonucleotide; LAG exon 2; Set C
gcugagauccuggagggggauugug

SEQ ID NO: 63721 - RNA, 22 nt, Artificial Sequence
  Synthetic Oligonucleotide; LAG exon 2; Set A
cugagauccuggagggggauug

SEQ ID NO: 63722 - RNA, 24 nt, Artificial Sequence
  Synthetic Oligonucleotide; LAG exon 2; Set C
gcugagauccuggagggggauugu

SEQ ID NO: 63723 - RNA, 20 nt, Artificial Sequence
  Synthetic Oligonucleotide; LAG exon 2; Set A
ugagauccuggagggggauu

SEQ ID NO: 63724 - RNA, 18 nt, Artificial Sequence
  Synthetic Oligonucleotide; LAG exon 2; Set A
gagauccuggagggggau

SEQ ID NO: 63725 - RNA, 38 nt, Artificial Sequence
  Synthetic Oligonucleotide; LAG exon 2; Set C
gcagaaggcugagauccuggagggggauuguggggcug

SEQ ID NO: 63726 - RNA, 23 nt, Artificial Sequence
  Synthetic Oligonucleotide; LAG exon 2; Set A
gcugagauccuggagggggauug

SEQ ID NO: 63727 - RNA, 21 nt, Artificial Sequence
  Synthetic Oligonucleotide; LAG exon 2; Set A
cugagauccuggagggggauu

SEQ ID NO: 63728 - RNA, 19 nt, Artificial Sequence
  Synthetic Oligonucleotide; LAG exon 2; Set A
ugagauccuggagggggau

SEQ ID NO: 63729 - RNA, 17 nt, Artificial Sequence
  Synthetic Oligonucleotide; LAG exon 2; Set A
gagauccuggaggggga

SEQ ID NO: 63730 - RNA, 37 nt, Artificial Sequence
  Synthetic Oligonucleotide; LAG exon 2; Set C
gcagaaggcugagauccuggagggggauuguggggcu

SEQ ID NO: 63731 - RNA, 39 nt, Artificial Sequence
  Synthetic Oligonucleotide; LAG exon 2; Set C
cgcagaaggcugagauccuggagggggauuguggggcug

SEQ ID NO: 63732 - RNA, 22 nt, Artificial Sequence
  Synthetic Oligonucleotide; LAG exon 2; Set A
gcugagauccuggagggggauu

SEQ ID NO: 63733 - RNA, 18 nt, Artificial Sequence
  Synthetic Oligonucleotide; LAG exon 2; Set A
ugagauccuggaggggga

SEQ ID NO: 63734 - RNA, 16 nt, Artificial Sequence
  Synthetic Oligonucleotide; LAG exon 2; Set C
gagauccuggaggggg

SEQ ID NO: 63735 - RNA, 20 nt, Artificial Sequence
  Synthetic Oligonucleotide; LAG exon 2; Set A
cugagauccuggagggggau

SEQ ID NO: 63736 - RNA, 38 nt, Artificial Sequence
  Synthetic Oligonucleotide; LAG exon 2; Set C
cgcagaaggcugagauccuggagggggauuguggggcu

SEQ ID NO: 63737 - RNA, 36 nt, Artificial Sequence
  Synthetic Oligonucleotide; LAG exon 2; Set C
gcagaaggcugagauccuggagggggauuguggggc

SEQ ID NO: 63738 - RNA, 40 nt, Artificial Sequence
  Synthetic Oligonucleotide; LAG exon 2; Set C
ucgcagaaggcugagauccuggagggggauuguggggcug

SEQ ID NO: 63739 - RNA, 17 nt, Artificial Sequence
  Synthetic Oligonucleotide; LAG exon 2; Set C
ugagauccuggaggggg

SEQ ID NO: 63740 - RNA, 19 nt, Artificial Sequence
  Synthetic Oligonucleotide; LAG exon 2; Set A
cugagauccuggaggggga

SEQ ID NO: 63741 - RNA, 21 nt, Artificial Sequence
  Synthetic Oligonucleotide; LAG exon 2; Set A
gcugagauccuggagggggau

SEQ ID NO: 63742 - RNA, 39 nt, Artificial Sequence
  Synthetic Oligonucleotide; LAG exon 2; Set C
ucgcagaaggcugagauccuggagggggauuguggggcu

SEQ ID NO: 63743 - RNA, 37 nt, Artificial Sequence
  Synthetic Oligonucleotide; LAG exon 2; Set C
cgcagaaggcugagauccuggagggggauuguggggc

SEQ ID NO: 63744 - RNA, 15 nt, Artificial Sequence
  Synthetic Oligonucleotide; LAG exon 2; Set C
gagauccuggagggg

SEQ ID NO: 63745 - RNA, 35 nt, Artificial Sequence
  Synthetic Oligonucleotide; LAG exon 2; Set C
gcagaaggcugagauccuggagggggauugugggg

SEQ ID NO: 63746 - RNA, 18 nt, Artificial Sequence
  Synthetic Oligonucleotide; LAG exon 2; Set A
cugagauccuggaggggg

SEQ ID NO: 63747 - RNA, 20 nt, Artificial Sequence
  Synthetic Oligonucleotide; LAG exon 2; Set A
gcugagauccuggaggggga

SEQ ID NO: 63748 - RNA, 40 nt, Artificial Sequence
  Synthetic Oligonucleotide; LAG exon 2; Set C
uucgcagaaggcugagauccuggagggggauuguggggcu

SEQ ID NO: 63749 - RNA, 38 nt, Artificial Sequence
  Synthetic Oligonucleotide; LAG exon 2; Set C
ucgcagaaggcugagauccuggagggggauuguggggc

SEQ ID NO: 63750 - RNA, 16 nt, Artificial Sequence
  Synthetic Oligonucleotide; LAG exon 2; Set C
ugagauccuggagggg

SEQ ID NO: 63751 - RNA, 36 nt, Artificial Sequence
  Synthetic Oligonucleotide; LAG exon 2; Set C
cgcagaaggcugagauccuggagggggauugugggg

SEQ ID NO: 63752 - RNA, 34 nt, Artificial Sequence
  Synthetic Oligonucleotide; LAG exon 2; Set C
gcagaaggcugagauccuggagggggauuguggg

SEQ ID NO: 63753 - RNA, 19 nt, Artificial Sequence
  Synthetic Oligonucleotide; LAG exon 2; Set A
gcugagauccuggaggggg

SEQ ID NO: 63754 - RNA, 39 nt, Artificial Sequence
  Synthetic Oligonucleotide; LAG exon 2; Set C
uucgcagaaggcugagauccuggagggggauuguggggc

SEQ ID NO: 63755 - RNA, 15 nt, Artificial Sequence
  Synthetic Oligonucleotide; LAG exon 2; Set C
ugagauccuggaggg

SEQ ID NO: 63756 - RNA, 17 nt, Artificial Sequence
  Synthetic Oligonucleotide; LAG exon 2; Set C
cugagauccuggagggg

SEQ ID NO: 63757 - RNA, 37 nt, Artificial Sequence
  Synthetic Oligonucleotide; LAG exon 2; Set C
ucgcagaaggcugagauccuggagggggauugugggg

SEQ ID NO: 63758 - RNA, 35 nt, Artificial Sequence
  Synthetic Oligonucleotide; LAG exon 2; Set C
cgcagaaggcugagauccuggagggggauuguggg

SEQ ID NO: 63759 - RNA, 33 nt, Artificial Sequence
  Synthetic Oligonucleotide; LAG exon 2; Set C
gcagaaggcugagauccuggagggggauugugg

SEQ ID NO: 63760 - RNA, 16 nt, Artificial Sequence
  Synthetic Oligonucleotide; LAG exon 2; Set C
cugagauccuggaggg

SEQ ID NO: 63761 - RNA, 32 nt, Artificial Sequence
  Synthetic Oligonucleotide; LAG exon 2; Set C
gcagaaggcugagauccuggagggggauugug

SEQ ID NO: 63762 - RNA, 18 nt, Artificial Sequence
  Synthetic Oligonucleotide; LAG exon 2; Set A
gcugagauccuggagggg

SEQ ID NO: 63763 - RNA, 38 nt, Artificial Sequence
  Synthetic Oligonucleotide; LAG exon 2; Set C
uucgcagaaggcugagauccuggagggggauugugggg

SEQ ID NO: 63764 - RNA, 36 nt, Artificial Sequence
  Synthetic Oligonucleotide; LAG exon 2; Set C
ucgcagaaggcugagauccuggagggggauuguggg

SEQ ID NO: 63765 - RNA, 34 nt, Artificial Sequence
  Synthetic Oligonucleotide; LAG exon 2; Set C
cgcagaaggcugagauccuggagggggauugugg

SEQ ID NO: 63766 - RNA, 31 nt, Artificial Sequence
  Synthetic Oligonucleotide; LAG exon 2; Set C
gcagaaggcugagauccuggagggggauugu

SEQ ID NO: 63767 - RNA, 17 nt, Artificial Sequence
  Synthetic Oligonucleotide; LAG exon 2; Set C
gcugagauccuggaggg

SEQ ID NO: 63768 - RNA, 33 nt, Artificial Sequence
  Synthetic Oligonucleotide; LAG exon 2; Set C
cgcagaaggcugagauccuggagggggauugug

SEQ ID NO: 63769 - RNA, 37 nt, Artificial Sequence
  Synthetic Oligonucleotide; LAG exon 2; Set C
uucgcagaaggcugagauccuggagggggauuguggg

SEQ ID NO: 63770 - RNA, 35 nt, Artificial Sequence
  Synthetic Oligonucleotide; LAG exon 2; Set C
ucgcagaaggcugagauccuggagggggauugugg

SEQ ID NO: 63771 - RNA, 32 nt, Artificial Sequence
  Synthetic Oligonucleotide; LAG exon 2; Set C
cgcagaaggcugagauccuggagggggauugu

SEQ ID NO: 63772 - RNA, 30 nt, Artificial Sequence
  Synthetic Oligonucleotide; LAG exon 2; Set C
gcagaaggcugagauccuggagggggauug

SEQ ID NO: 63773 - RNA, 34 nt, Artificial Sequence
  Synthetic Oligonucleotide; LAG exon 2; Set C
ucgcagaaggcugagauccuggagggggauugug

SEQ ID NO: 63774 - RNA, 16 nt, Artificial Sequence
  Synthetic Oligonucleotide; LAG exon 2; Set C
gcugagauccuggagg

SEQ ID NO: 63775 - RNA, 36 nt, Artificial Sequence
  Synthetic Oligonucleotide; LAG exon 2; Set C
uucgcagaaggcugagauccuggagggggauugugg

SEQ ID NO: 63776 - RNA, 33 nt, Artificial Sequence
  Synthetic Oligonucleotide; LAG exon 2; Set C
ucgcagaaggcugagauccuggagggggauugu

SEQ ID NO: 63777 - RNA, 31 nt, Artificial Sequence
  Synthetic Oligonucleotide; LAG exon 2; Set C
cgcagaaggcugagauccuggagggggauug

SEQ ID NO: 63778 - RNA, 29 nt, Artificial Sequence
  Synthetic Oligonucleotide; LAG exon 2; Set C
gcagaaggcugagauccuggagggggauu

SEQ ID NO: 63779 - RNA, 35 nt, Artificial Sequence
  Synthetic Oligonucleotide; LAG exon 2; Set C
uucgcagaaggcugagauccuggagggggauugug

SEQ ID NO: 63780 - RNA, 34 nt, Artificial Sequence
  Synthetic Oligonucleotide; LAG exon 2; Set C
uucgcagaaggcugagauccuggagggggauugu

SEQ ID NO: 63781 - RNA, 32 nt, Artificial Sequence
  Synthetic Oligonucleotide; LAG exon 2; Set C
ucgcagaaggcugagauccuggagggggauug

SEQ ID NO: 63782 - RNA, 30 nt, Artificial Sequence
  Synthetic Oligonucleotide; LAG exon 2; Set C
cgcagaaggcugagauccuggagggggauu

SEQ ID NO: 63783 - RNA, 28 nt, Artificial Sequence
  Synthetic Oligonucleotide; LAG exon 2; Set C
gcagaaggcugagauccuggagggggau

SEQ ID NO: 63784 - RNA, 33 nt, Artificial Sequence
  Synthetic Oligonucleotide; LAG exon 2; Set C
uucgcagaaggcugagauccuggagggggauug

SEQ ID NO: 63785 - RNA, 31 nt, Artificial Sequence
  Synthetic Oligonucleotide; LAG exon 2; Set C
ucgcagaaggcugagauccuggagggggauu

SEQ ID NO: 63786 - RNA, 29 nt, Artificial Sequence
  Synthetic Oligonucleotide; LAG exon 2; Set C
cgcagaaggcugagauccuggagggggau

SEQ ID NO: 63787 - RNA, 27 nt, Artificial Sequence
  Synthetic Oligonucleotide; LAG exon 2; Set C
gcagaaggcugagauccuggaggggga

SEQ ID NO: 63788 - RNA, 32 nt, Artificial Sequence
  Synthetic Oligonucleotide; LAG exon 2; Set C
uucgcagaaggcugagauccuggagggggauu

SEQ ID NO: 63789 - RNA, 30 nt, Artificial Sequence
  Synthetic Oligonucleotide; LAG exon 2; Set C
ucgcagaaggcugagauccuggagggggau

SEQ ID NO: 63790 - RNA, 28 nt, Artificial Sequence
  Synthetic Oligonucleotide; LAG exon 2; Set C
cgcagaaggcugagauccuggaggggga

SEQ ID NO: 63791 - RNA, 26 nt, Artificial Sequence
  Synthetic Oligonucleotide; LAG exon 2; Set C
gcagaaggcugagauccuggaggggg

SEQ ID NO: 63792 - RNA, 31 nt, Artificial Sequence
  Synthetic Oligonucleotide; LAG exon 2; Set C
uucgcagaaggcugagauccuggagggggau

SEQ ID NO: 63793 - RNA, 29 nt, Artificial Sequence
  Synthetic Oligonucleotide; LAG exon 2; Set C
ucgcagaaggcugagauccuggaggggga

SEQ ID NO: 63794 - RNA, 27 nt, Artificial Sequence
  Synthetic Oligonucleotide; LAG exon 2; Set C
cgcagaaggcugagauccuggaggggg

SEQ ID NO: 63795 - RNA, 25 nt, Artificial Sequence
  Synthetic Oligonucleotide; LAG exon 2; Set C
gcagaaggcugagauccuggagggg

SEQ ID NO: 63796 - RNA, 30 nt, Artificial Sequence
  Synthetic Oligonucleotide; LAG exon 2; Set C
uucgcagaaggcugagauccuggaggggga

SEQ ID NO: 63797 - RNA, 28 nt, Artificial Sequence
  Synthetic Oligonucleotide; LAG exon 2; Set C
ucgcagaaggcugagauccuggaggggg

SEQ ID NO: 63798 - RNA, 24 nt, Artificial Sequence
  Synthetic Oligonucleotide; LAG exon 2; Set A
gcagaaggcugagauccuggaggg

SEQ ID NO: 63799 - RNA, 26 nt, Artificial Sequence
  Synthetic Oligonucleotide; LAG exon 2; Set C
cgcagaaggcugagauccuggagggg

SEQ ID NO: 63800 - RNA, 29 nt, Artificial Sequence
  Synthetic Oligonucleotide; LAG exon 2; Set C
uucgcagaaggcugagauccuggaggggg

SEQ ID NO: 63801 - RNA, 25 nt, Artificial Sequence
  Synthetic Oligonucleotide; LAG exon 2; Set C
cgcagaaggcugagauccuggaggg

SEQ ID NO: 63802 - RNA, 27 nt, Artificial Sequence
  Synthetic Oligonucleotide; LAG exon 2; Set C
ucgcagaaggcugagauccuggagggg

SEQ ID NO: 63803 - RNA, 23 nt, Artificial Sequence
  Synthetic Oligonucleotide; LAG exon 2; Set A
gcagaaggcugagauccuggagg

SEQ ID NO: 63804 - RNA, 26 nt, Artificial Sequence
  Synthetic Oligonucleotide; LAG exon 2; Set C
ucgcagaaggcugagauccuggaggg

SEQ ID NO: 63805 - RNA, 28 nt, Artificial Sequence
  Synthetic Oligonucleotide; LAG exon 2; Set C
uucgcagaaggcugagauccuggagggg

SEQ ID NO: 63806 - RNA, 24 nt, Artificial Sequence
  Synthetic Oligonucleotide; LAG exon 2; Set A
cgcagaaggcugagauccuggagg

SEQ ID NO: 63807 - RNA, 27 nt, Artificial Sequence
  Synthetic Oligonucleotide; LAG exon 2; Set C
uucgcagaaggcugagauccuggaggg

SEQ ID NO: 63808 - RNA, 25 nt, Artificial Sequence
  Synthetic Oligonucleotide; LAG exon 2; Set A
ucgcagaaggcugagauccuggagg

SEQ ID NO: 63809 - RNA, 23 nt, Artificial Sequence
  Synthetic Oligonucleotide; LAG exon 2; Set A
cgcagaaggcugagauccuggag

SEQ ID NO: 63810 - RNA, 26 nt, Artificial Sequence
  Synthetic Oligonucleotide; LAG exon 2; Set C
uucgcagaaggcugagauccuggagg

SEQ ID NO: 63811 - RNA, 24 nt, Artificial Sequence
  Synthetic Oligonucleotide; LAG exon 2; Set A
ucgcagaaggcugagauccuggag

SEQ ID NO: 63812 - RNA, 25 nt, Artificial Sequence
  Synthetic Oligonucleotide; LAG exon 2; Set A
uucgcagaaggcugagauccuggag

SEQ ID NO: 63813 - RNA, 23 nt, Artificial Sequence
  Synthetic Oligonucleotide; LAG exon 2; Set A
ucgcagaaggcugagauccugga

SEQ ID NO: 63814 - RNA, 24 nt, Artificial Sequence
  Synthetic Oligonucleotide; LAG exon 2; Set A
uucgcagaaggcugagauccugga

SEQ ID NO: 63815 - RNA, 23 nt, Artificial Sequence
  Synthetic Oligonucleotide; LAG exon 2; Set A
uucgcagaaggcugagauccugg

SEQ ID NO: 63816 - RNA, 15 nt, Artificial Sequence
  Synthetic Oligonucleotide; LAG exon 2; Set C
ucgcagaaggcugag

SEQ ID NO: 63817 - RNA, 40 nt, Artificial Sequence
  Synthetic Oligonucleotide; LAG exon 2; Set C
ugaccccugcucuucgcagaaggcugagauccuggagggg

SEQ ID NO: 63818 - RNA, 16 nt, Artificial Sequence
  Synthetic Oligonucleotide; LAG exon 2; Set C
uucgcagaaggcugag

SEQ ID NO: 63819 - RNA, 15 nt, Artificial Sequence
  Synthetic Oligonucleotide; LAG exon 2; Set C
uucgcagaaggcuga

SEQ ID NO: 63820 - RNA, 39 nt, Artificial Sequence
  Synthetic Oligonucleotide; LAG exon 2; Set C
ugaccccugcucuucgcagaaggcugagauccuggaggg

SEQ ID NO: 63821 - RNA, 38 nt, Artificial Sequence
  Synthetic Oligonucleotide; LAG exon 2; Set C
ugaccccugcucuucgcagaaggcugagauccuggagg

SEQ ID NO: 63822 - RNA, 17 nt, Artificial Sequence
  Synthetic Oligonucleotide; LAG exon 2; Set C
ucuucgcagaaggcuga

SEQ ID NO: 63823 - RNA, 28 nt, Artificial Sequence
  Synthetic Oligonucleotide; LAG exon 2; Set C
ugaccccugcucuucgcagaaggcugag

SEQ ID NO: 63824 - RNA, 27 nt, Artificial Sequence
  Synthetic Oligonucleotide; LAG exon 2; Set C
ugaccccugcucuucgcagaaggcuga

SEQ ID NO: 63825 - RNA, 18 nt, Artificial Sequence
  Synthetic Oligonucleotide; LAG exon 2; Set A
ugaccccugcucuucgca

SEQ ID NO: 63826 - RNA, 17 nt, Artificial Sequence
  Synthetic Oligonucleotide; LAG exon 2; Set A
ugaccccugcucuucgc

SEQ ID NO: 63827 - RNA, 16 nt, Artificial Sequence
  Synthetic Oligonucleotide; LAG exon 2; Set C
ugaccccugcucuucg

SEQ ID NO: 63828 - RNA, 15 nt, Artificial Sequence
  Synthetic Oligonucleotide; LAG exon 2; Set C
ugaccccugcucuuc

SEQ ID NO: 63829 - RNA, 39 nt, Artificial Sequence
  Synthetic Oligonucleotide; LAG exon 2; Set C
gaugcugccaagugaccccugcucuucgcagaaggcuga

SEQ ID NO: 63830 - RNA, 40 nt, Artificial Sequence
  Synthetic Oligonucleotide; LAG exon 2; Set C
ugaugcugccaagugaccccugcucuucgcagaaggcuga

SEQ ID NO: 63831 - RNA, 27 nt, Artificial Sequence
  Synthetic Oligonucleotide; LAG exon 2; Set C
uuuggggugcauaccugucuggcugau

SEQ ID NO: 63832 - RNA, 28 nt, Artificial Sequence
  Synthetic Oligonucleotide; LAG exon 2; Set C
guuuggggugcauaccugucuggcugau

SEQ ID NO: 63833 - RNA, 26 nt, Artificial Sequence
  Synthetic Oligonucleotide; LAG exon 2; Set C
uuuggggugcauaccugucuggcuga

SEQ ID NO: 63834 - RNA, 29 nt, Artificial Sequence
  Synthetic Oligonucleotide; LAG exon 2; Set C
aguuuggggugcauaccugucuggcugau

SEQ ID NO: 63835 - RNA, 27 nt, Artificial Sequence
  Synthetic Oligonucleotide; LAG exon 2; Set C
guuuggggugcauaccugucuggcuga

SEQ ID NO: 63836 - RNA, 28 nt, Artificial Sequence
  Synthetic Oligonucleotide; LAG exon 2; Set C
aguuuggggugcauaccugucuggcuga

SEQ ID NO: 63837 - RNA, 30 nt, Artificial Sequence
  Synthetic Oligonucleotide; LAG exon 2; Set C
aaguuuggggugcauaccugucuggcugau

SEQ ID NO: 63838 - RNA, 29 nt, Artificial Sequence
  Synthetic Oligonucleotide; LAG exon 2; Set C
aaguuuggggugcauaccugucuggcuga

SEQ ID NO: 63839 - RNA, 20 nt, Artificial Sequence
  Synthetic Oligonucleotide; LAG exon 2; Set B
uuuggggugcauaccugucu

SEQ ID NO: 63840 - RNA, 19 nt, Artificial Sequence
  Synthetic Oligonucleotide; LAG exon 2; Set B
uuuggggugcauaccuguc

SEQ ID NO: 63841 - RNA, 21 nt, Artificial Sequence
  Synthetic Oligonucleotide; LAG exon 2; Set B
guuuggggugcauaccugucu

SEQ ID NO: 63842 - RNA, 18 nt, Artificial Sequence
  Synthetic Oligonucleotide; LAG exon 2; Set C
uuuggggugcauaccugu

SEQ ID NO: 63843 - RNA, 20 nt, Artificial Sequence
  Synthetic Oligonucleotide; LAG exon 2; Set B
guuuggggugcauaccuguc

SEQ ID NO: 63844 - RNA, 22 nt, Artificial Sequence
  Synthetic Oligonucleotide; LAG exon 2; Set B
aguuuggggugcauaccugucu

SEQ ID NO: 63845 - RNA, 19 nt, Artificial Sequence
  Synthetic Oligonucleotide; LAG exon 2; Set B
guuuggggugcauaccugu

SEQ ID NO: 63846 - RNA, 21 nt, Artificial Sequence
  Synthetic Oligonucleotide; LAG exon 2; Set B
aguuuggggugcauaccuguc

SEQ ID NO: 63847 - RNA, 23 nt, Artificial Sequence
  Synthetic Oligonucleotide; LAG exon 2; Set B
aaguuuggggugcauaccugucu

SEQ ID NO: 63848 - RNA, 38 nt, Artificial Sequence
  Synthetic Oligonucleotide; LAG exon 2; Set C
uguugcccaaguuuggggugcauaccugucuggcugau

SEQ ID NO: 63849 - RNA, 20 nt, Artificial Sequence
  Synthetic Oligonucleotide; LAG exon 2; Set B
aguuuggggugcauaccugu

SEQ ID NO: 63850 - RNA, 22 nt, Artificial Sequence
  Synthetic Oligonucleotide; LAG exon 2; Set B
aaguuuggggugcauaccuguc

SEQ ID NO: 63851 - RNA, 21 nt, Artificial Sequence
  Synthetic Oligonucleotide; LAG exon 2; Set B
aaguuuggggugcauaccugu

SEQ ID NO: 63852 - RNA, 15 nt, Artificial Sequence
  Synthetic Oligonucleotide; LAG exon 2; Set C
aguuuggggugcaua

SEQ ID NO: 63853 - RNA, 16 nt, Artificial Sequence
  Synthetic Oligonucleotide; LAG exon 2; Set C
aaguuuggggugcaua

SEQ ID NO: 63854 - RNA, 24 nt, Artificial Sequence
  Synthetic Oligonucleotide; LAG exon 2; Set B
ucggagguccuguugcccaaguuu

SEQ ID NO: 63855 - RNA, 25 nt, Artificial Sequence
  Synthetic Oligonucleotide; LAG exon 2; Set B
uucggagguccuguugcccaaguuu

SEQ ID NO: 63856 - RNA, 24 nt, Artificial Sequence
  Synthetic Oligonucleotide; LAG exon 2; Set B
uucggagguccuguugcccaaguu

SEQ ID NO: 63857 - RNA, 26 nt, Artificial Sequence
  Synthetic Oligonucleotide; LAG exon 2; Set B
auucggagguccuguugcccaaguuu

SEQ ID NO: 63858 - RNA, 25 nt, Artificial Sequence
  Synthetic Oligonucleotide; LAG exon 2; Set B
auucggagguccuguugcccaaguu

SEQ ID NO: 63859 - RNA, 23 nt, Artificial Sequence
  Synthetic Oligonucleotide; LAG exon 2; Set B
uucggagguccuguugcccaagu

SEQ ID NO: 63860 - RNA, 24 nt, Artificial Sequence
  Synthetic Oligonucleotide; LAG exon 2; Set B
auucggagguccuguugcccaagu

SEQ ID NO: 63861 - RNA, 15 nt, Artificial Sequence
  Synthetic Oligonucleotide; LAG exon 2; Set C
ucggagguccuguug

SEQ ID NO: 63862 - RNA, 16 nt, Artificial Sequence
  Synthetic Oligonucleotide; LAG exon 2; Set C
uucggagguccuguug

SEQ ID NO: 63863 - RNA, 15 nt, Artificial Sequence
  Synthetic Oligonucleotide; LAG exon 2; Set C
uucggagguccuguu

SEQ ID NO: 63864 - RNA, 35 nt, Artificial Sequence
  Synthetic Oligonucleotide; LAG exon 2; Set C
gagugcuggauucggagguccuguugcccaaguuu

SEQ ID NO: 63865 - RNA, 17 nt, Artificial Sequence
  Synthetic Oligonucleotide; LAG exon 2; Set C
auucggagguccuguug

SEQ ID NO: 63866 - RNA, 34 nt, Artificial Sequence
  Synthetic Oligonucleotide; LAG exon 2; Set C
gagugcuggauucggagguccuguugcccaaguu

SEQ ID NO: 63867 - RNA, 16 nt, Artificial Sequence
  Synthetic Oligonucleotide; LAG exon 2; Set C
auucggagguccuguu

SEQ ID NO: 63868 - RNA, 36 nt, Artificial Sequence
  Synthetic Oligonucleotide; LAG exon 2; Set C
ugagugcuggauucggagguccuguugcccaaguuu

SEQ ID NO: 63869 - RNA, 35 nt, Artificial Sequence
  Synthetic Oligonucleotide; LAG exon 2; Set C
ugagugcuggauucggagguccuguugcccaaguu

SEQ ID NO: 63870 - RNA, 33 nt, Artificial Sequence
  Synthetic Oligonucleotide; LAG exon 2; Set C
gagugcuggauucggagguccuguugcccaagu

SEQ ID NO: 63871 - RNA, 15 nt, Artificial Sequence
  Synthetic Oligonucleotide; LAG exon 2; Set C
auucggagguccugu

SEQ ID NO: 63872 - RNA, 37 nt, Artificial Sequence
  Synthetic Oligonucleotide; LAG exon 2; Set C
uugagugcuggauucggagguccuguugcccaaguuu

SEQ ID NO: 63873 - RNA, 36 nt, Artificial Sequence
  Synthetic Oligonucleotide; LAG exon 2; Set C
uugagugcuggauucggagguccuguugcccaaguu

SEQ ID NO: 63874 - RNA, 34 nt, Artificial Sequence
  Synthetic Oligonucleotide; LAG exon 2; Set C
ugagugcuggauucggagguccuguugcccaagu

SEQ ID NO: 63875 - RNA, 38 nt, Artificial Sequence
  Synthetic Oligonucleotide; LAG exon 2; Set C
guugagugcuggauucggagguccuguugcccaaguuu

SEQ ID NO: 63876 - RNA, 37 nt, Artificial Sequence
  Synthetic Oligonucleotide; LAG exon 2; Set C
guugagugcuggauucggagguccuguugcccaaguu

SEQ ID NO: 63877 - RNA, 35 nt, Artificial Sequence
  Synthetic Oligonucleotide; LAG exon 2; Set C
uugagugcuggauucggagguccuguugcccaagu

SEQ ID NO: 63878 - RNA, 39 nt, Artificial Sequence
  Synthetic Oligonucleotide; LAG exon 2; Set C
gguugagugcuggauucggagguccuguugcccaaguuu

SEQ ID NO: 63879 - RNA, 33 nt, Artificial Sequence
  Synthetic Oligonucleotide; LAG exon 2; Set C
ugagugcuggauucggagguccuguugcccaag

SEQ ID NO: 63880 - RNA, 36 nt, Artificial Sequence
  Synthetic Oligonucleotide; LAG exon 2; Set C
guugagugcuggauucggagguccuguugcccaagu

SEQ ID NO: 63881 - RNA, 38 nt, Artificial Sequence
  Synthetic Oligonucleotide; LAG exon 2; Set C
gguugagugcuggauucggagguccuguugcccaaguu

SEQ ID NO: 63882 - RNA, 34 nt, Artificial Sequence
  Synthetic Oligonucleotide; LAG exon 2; Set C
uugagugcuggauucggagguccuguugcccaag

SEQ ID NO: 63883 - RNA, 37 nt, Artificial Sequence
  Synthetic Oligonucleotide; LAG exon 2; Set C
gguugagugcuggauucggagguccuguugcccaagu

SEQ ID NO: 63884 - RNA, 35 nt, Artificial Sequence
  Synthetic Oligonucleotide; LAG exon 2; Set C
guugagugcuggauucggagguccuguugcccaag

SEQ ID NO: 63885 - RNA, 36 nt, Artificial Sequence
  Synthetic Oligonucleotide; LAG exon 2; Set C
gguugagugcuggauucggagguccuguugcccaag

SEQ ID NO: 63886 - RNA, 25 nt, Artificial Sequence
  Synthetic Oligonucleotide; LAG exon 2; Set C
gagugcuggauucggagguccuguu

SEQ ID NO: 63887 - RNA, 27 nt, Artificial Sequence
  Synthetic Oligonucleotide; LAG exon 2; Set C
ugagugcuggauucggagguccuguug

SEQ ID NO: 63888 - RNA, 24 nt, Artificial Sequence
  Synthetic Oligonucleotide; LAG exon 2; Set C
gagugcuggauucggagguccugu

SEQ ID NO: 63889 - RNA, 26 nt, Artificial Sequence
  Synthetic Oligonucleotide; LAG exon 2; Set C
ugagugcuggauucggagguccuguu

SEQ ID NO: 63890 - RNA, 28 nt, Artificial Sequence
  Synthetic Oligonucleotide; LAG exon 2; Set C
uugagugcuggauucggagguccuguug

SEQ ID NO: 63891 - RNA, 25 nt, Artificial Sequence
  Synthetic Oligonucleotide; LAG exon 2; Set C
ugagugcuggauucggagguccugu

SEQ ID NO: 63892 - RNA, 27 nt, Artificial Sequence
  Synthetic Oligonucleotide; LAG exon 2; Set C
uugagugcuggauucggagguccuguu

SEQ ID NO: 63893 - RNA, 29 nt, Artificial Sequence
  Synthetic Oligonucleotide; LAG exon 2; Set C
guugagugcuggauucggagguccuguug

SEQ ID NO: 63894 - RNA, 26 nt, Artificial Sequence
  Synthetic Oligonucleotide; LAG exon 2; Set C
uugagugcuggauucggagguccugu

SEQ ID NO: 63895 - RNA, 28 nt, Artificial Sequence
  Synthetic Oligonucleotide; LAG exon 2; Set C
guugagugcuggauucggagguccuguu

SEQ ID NO: 63896 - RNA, 30 nt, Artificial Sequence
  Synthetic Oligonucleotide; LAG exon 2; Set C
gguugagugcuggauucggagguccuguug

SEQ ID NO: 63897 - RNA, 27 nt, Artificial Sequence
  Synthetic Oligonucleotide; LAG exon 2; Set C
guugagugcuggauucggagguccugu

SEQ ID NO: 63898 - RNA, 29 nt, Artificial Sequence
  Synthetic Oligonucleotide; LAG exon 2; Set C
gguugagugcuggauucggagguccuguu

SEQ ID NO: 63899 - RNA, 28 nt, Artificial Sequence
  Synthetic Oligonucleotide; LAG exon 2; Set C
gguugagugcuggauucggagguccugu

SEQ ID NO: 63900 - RNA, 17 nt, Artificial Sequence
  Synthetic Oligonucleotide; LAG exon 2; Set C
agugcuggauucggagg

SEQ ID NO: 63901 - RNA, 16 nt, Artificial Sequence
  Synthetic Oligonucleotide; LAG exon 2; Set C
agugcuggauucggag

SEQ ID NO: 63902 - RNA, 18 nt, Artificial Sequence
  Synthetic Oligonucleotide; LAG exon 2; Set C
gagugcuggauucggagg

SEQ ID NO: 63903 - RNA, 17 nt, Artificial Sequence
  Synthetic Oligonucleotide; LAG exon 2; Set C
gagugcuggauucggag

SEQ ID NO: 63904 - RNA, 15 nt, Artificial Sequence
  Synthetic Oligonucleotide; LAG exon 2; Set C
agugcuggauucgga

SEQ ID NO: 63905 - RNA, 19 nt, Artificial Sequence
  Synthetic Oligonucleotide; LAG exon 2; Set B
ugagugcuggauucggagg

SEQ ID NO: 63906 - RNA, 16 nt, Artificial Sequence
  Synthetic Oligonucleotide; LAG exon 2; Set C
gagugcuggauucgga

SEQ ID NO: 63907 - RNA, 20 nt, Artificial Sequence
  Synthetic Oligonucleotide; LAG exon 2; Set B
uugagugcuggauucggagg

SEQ ID NO: 63908 - RNA, 17 nt, Artificial Sequence
  Synthetic Oligonucleotide; LAG exon 2; Set C
ugagugcuggauucgga

SEQ ID NO: 63909 - RNA, 15 nt, Artificial Sequence
  Synthetic Oligonucleotide; LAG exon 2; Set C
gagugcuggauucgg

SEQ ID NO: 63910 - RNA, 16 nt, Artificial Sequence
  Synthetic Oligonucleotide; LAG exon 2; Set C
ugagugcuggauucgg

SEQ ID NO: 63911 - RNA, 17 nt, Artificial Sequence
  Synthetic Oligonucleotide; LAG exon 2; Set C
uugagugcuggauucgg

SEQ ID NO: 63912 - RNA, 15 nt, Artificial Sequence
  Synthetic Oligonucleotide; LAG exon 2; Set C
ugagugcuggauucg

SEQ ID NO: 63913 - RNA, 18 nt, Artificial Sequence
  Synthetic Oligonucleotide; LAG exon 2; Set C
guugagugcuggauucgg

SEQ ID NO: 63914 - RNA, 16 nt, Artificial Sequence
  Synthetic Oligonucleotide; LAG exon 2; Set C
uugagugcuggauucg

SEQ ID NO: 63915 - RNA, 15 nt, Artificial Sequence
  Synthetic Oligonucleotide; LAG exon 2; Set C
uugagugcuggauuc

SEQ ID NO: 63916 - RNA, 17 nt, Artificial Sequence
  Synthetic Oligonucleotide; LAG exon 2; Set C
guugagugcuggauucg

SEQ ID NO: 63917 - RNA, 19 nt, Artificial Sequence
  Synthetic Oligonucleotide; LAG exon 2; Set B
gguugagugcuggauucgg

SEQ ID NO: 63918 - RNA, 16 nt, Artificial Sequence
  Synthetic Oligonucleotide; LAG exon 2; Set C
guugagugcuggauuc

SEQ ID NO: 63919 - RNA, 18 nt, Artificial Sequence
  Synthetic Oligonucleotide; LAG exon 2; Set C
gguugagugcuggauucg

SEQ ID NO: 63920 - RNA, 15 nt, Artificial Sequence
  Synthetic Oligonucleotide; LAG exon 2; Set C
guugagugcuggauu

SEQ ID NO: 63921 - RNA, 17 nt, Artificial Sequence
  Synthetic Oligonucleotide; LAG exon 2; Set C
gguugagugcuggauuc

SEQ ID NO: 63922 - RNA, 16 nt, Artificial Sequence
  Synthetic Oligonucleotide; LAG exon 2; Set C
gguugagugcuggauu

SEQ ID NO: 63923 - RNA, 19 nt, Artificial Sequence
  Synthetic Oligonucleotide; LAG exon 2; Set C
gagggggcgugagccgaga

SEQ ID NO: 63924 - RNA, 18 nt, Artificial Sequence
  Synthetic Oligonucleotide; LAG exon 2; Set A
gagggggcgugagccgag

SEQ ID NO: 63925 - RNA, 20 nt, Artificial Sequence
  Synthetic Oligonucleotide; LAG exon 2; Set C
ggagggggcgugagccgaga

SEQ ID NO: 63926 - RNA, 19 nt, Artificial Sequence
  Synthetic Oligonucleotide; LAG exon 2; Set C
ggagggggcgugagccgag

SEQ ID NO: 63927 - RNA, 24 nt, Artificial Sequence
  Synthetic Oligonucleotide; LAG exon 2; Set C
caaggggagggggcgugagccgag

SEQ ID NO: 63928 - RNA, 18 nt, Artificial Sequence
  Synthetic Oligonucleotide; LAG exon 2; Set A
caaggggagggggcguga

SEQ ID NO: 63929 - RNA, 31 nt, Artificial Sequence
  Synthetic Oligonucleotide; LAG exon 2; Set C
gagaggccaaggggagggggcgugagccgag

SEQ ID NO: 63930 - RNA, 17 nt, Artificial Sequence
  Synthetic Oligonucleotide; LAG exon 2; Set A
caaggggagggggcgug

SEQ ID NO: 63931 - RNA, 33 nt, Artificial Sequence
  Synthetic Oligonucleotide; LAG exon 2; Set C
agagaggccaaggggagggggcgugagccgaga

SEQ ID NO: 63932 - RNA, 32 nt, Artificial Sequence
  Synthetic Oligonucleotide; LAG exon 2; Set C
agagaggccaaggggagggggcgugagccgag

SEQ ID NO: 63933 - RNA, 34 nt, Artificial Sequence
  Synthetic Oligonucleotide; LAG exon 2; Set C
aagagaggccaaggggagggggcgugagccgaga

SEQ ID NO: 63934 - RNA, 33 nt, Artificial Sequence
  Synthetic Oligonucleotide; LAG exon 2; Set C
aagagaggccaaggggagggggcgugagccgag

SEQ ID NO: 63935 - RNA, 35 nt, Artificial Sequence
  Synthetic Oligonucleotide; LAG exon 2; Set C
aaagagaggccaaggggagggggcgugagccgaga

SEQ ID NO: 63936 - RNA, 34 nt, Artificial Sequence
  Synthetic Oligonucleotide; LAG exon 2; Set C
aaagagaggccaaggggagggggcgugagccgag

SEQ ID NO: 63937 - RNA, 36 nt, Artificial Sequence
  Synthetic Oligonucleotide; LAG exon 2; Set C
aaaagagaggccaaggggagggggcgugagccgaga

SEQ ID NO: 63938 - RNA, 25 nt, Artificial Sequence
  Synthetic Oligonucleotide; LAG exon 2; Set C
gagaggccaaggggagggggcguga

SEQ ID NO: 63939 - RNA, 24 nt, Artificial Sequence
  Synthetic Oligonucleotide; LAG exon 2; Set C
gagaggccaaggggagggggcgug

SEQ ID NO: 63940 - RNA, 26 nt, Artificial Sequence
  Synthetic Oligonucleotide; LAG exon 2; Set C
agagaggccaaggggagggggcguga

SEQ ID NO: 63941 - RNA, 25 nt, Artificial Sequence
  Synthetic Oligonucleotide; LAG exon 2; Set C
agagaggccaaggggagggggcgug

SEQ ID NO: 63942 - RNA, 27 nt, Artificial Sequence
  Synthetic Oligonucleotide; LAG exon 2; Set C
aagagaggccaaggggagggggcguga

SEQ ID NO: 63943 - RNA, 26 nt, Artificial Sequence
  Synthetic Oligonucleotide; LAG exon 2; Set C
aagagaggccaaggggagggggcgug

SEQ ID NO: 63944 - RNA, 28 nt, Artificial Sequence
  Synthetic Oligonucleotide; LAG exon 2; Set C
aaagagaggccaaggggagggggcguga

SEQ ID NO: 63945 - RNA, 27 nt, Artificial Sequence
  Synthetic Oligonucleotide; LAG exon 2; Set C
aaagagaggccaaggggagggggcgug

SEQ ID NO: 63946 - RNA, 27 nt, Artificial Sequence
  Synthetic Oligonucleotide; LAG exon 2; Set C
aaaagagaggccaaggggagggggcgu

SEQ ID NO: 63947 - RNA, 16 nt, Artificial Sequence
  Synthetic Oligonucleotide; LAG exon 2; Set C
gagaggccaaggggag

SEQ ID NO: 63948 - RNA, 17 nt, Artificial Sequence
  Synthetic Oligonucleotide; LAG exon 2; Set C
agagaggccaaggggag

SEQ ID NO: 63949 - RNA, 15 nt, Artificial Sequence
  Synthetic Oligonucleotide; LAG exon 2; Set C
gagaggccaagggga

SEQ ID NO: 63950 - RNA, 18 nt, Artificial Sequence
  Synthetic Oligonucleotide; LAG exon 2; Set C
aagagaggccaaggggag

SEQ ID NO: 63951 - RNA, 16 nt, Artificial Sequence
  Synthetic Oligonucleotide; LAG exon 2; Set C
agagaggccaagggga

SEQ ID NO: 63952 - RNA, 17 nt, Artificial Sequence
  Synthetic Oligonucleotide; LAG exon 2; Set C
aagagaggccaagggga

SEQ ID NO: 63953 - RNA, 18 nt, Artificial Sequence
  Synthetic Oligonucleotide; LAG exon 2; Set C
aaagagaggccaagggga

SEQ ID NO: 63954 - RNA, 38 nt, Artificial Sequence
  Synthetic Oligonucleotide; LAG exon 2; Set C
uaggugagcaaaagagaggccaaggggagggggcguga

SEQ ID NO: 63955 - RNA, 37 nt, Artificial Sequence
  Synthetic Oligonucleotide; LAG exon 2; Set C
uaggugagcaaaagagaggccaaggggagggggcgug

SEQ ID NO: 63956 - RNA, 36 nt, Artificial Sequence
  Synthetic Oligonucleotide; LAG exon 2; Set C
uaggugagcaaaagagaggccaaggggagggggcgu

SEQ ID NO: 63957 - RNA, 15 nt, Artificial Sequence
  Synthetic Oligonucleotide; LAG exon 2; Set C
aaaagagaggccaag

SEQ ID NO: 63958 - RNA, 23 nt, Artificial Sequence
  Synthetic Oligonucleotide; LAG exon 2; Set C
uaggugagcaaaagagaggccaa

SEQ ID NO: 63959 - RNA, 39 nt, Artificial Sequence
  Synthetic Oligonucleotide; LAG exon 2; Set C
gaggcuucacuaggugagcaaaagagaggccaaggggag

SEQ ID NO: 63960 - RNA, 40 nt, Artificial Sequence
  Synthetic Oligonucleotide; LAG exon 2; Set C
agaggcuucacuaggugagcaaaagagaggccaaggggag

SEQ ID NO: 63961 - RNA, 38 nt, Artificial Sequence
  Synthetic Oligonucleotide; LAG exon 2; Set C
gaggcuucacuaggugagcaaaagagaggccaagggga

SEQ ID NO: 63962 - RNA, 18 nt, Artificial Sequence
  Synthetic Oligonucleotide; LAG exon 2; Set C
uaggugagcaaaagagag

SEQ ID NO: 63963 - RNA, 39 nt, Artificial Sequence
  Synthetic Oligonucleotide; LAG exon 2; Set C
agaggcuucacuaggugagcaaaagagaggccaagggga

SEQ ID NO: 63964 - RNA, 17 nt, Artificial Sequence
  Synthetic Oligonucleotide; LAG exon 2; Set C
uaggugagcaaaagaga

SEQ ID NO: 63965 - RNA, 40 nt, Artificial Sequence
  Synthetic Oligonucleotide; LAG exon 2; Set C
gagaggcuucacuaggugagcaaaagagaggccaagggga

SEQ ID NO: 63966 - RNA, 26 nt, Artificial Sequence
  Synthetic Oligonucleotide; LAG exon 2; Set A
gaggcuucacuaggugagcaaaagag

SEQ ID NO: 63967 - RNA, 27 nt, Artificial Sequence
  Synthetic Oligonucleotide; LAG exon 2; Set A
agaggcuucacuaggugagcaaaagag

SEQ ID NO: 63968 - RNA, 25 nt, Artificial Sequence
  Synthetic Oligonucleotide; LAG exon 2; Set A
gaggcuucacuaggugagcaaaaga

SEQ ID NO: 63969 - RNA, 28 nt, Artificial Sequence
  Synthetic Oligonucleotide; LAG exon 2; Set A
gagaggcuucacuaggugagcaaaagag

SEQ ID NO: 63970 - RNA, 26 nt, Artificial Sequence
  Synthetic Oligonucleotide; LAG exon 2; Set A
agaggcuucacuaggugagcaaaaga

SEQ ID NO: 63971 - RNA, 29 nt, Artificial Sequence
  Synthetic Oligonucleotide; LAG exon 2; Set A
ggagaggcuucacuaggugagcaaaagag

SEQ ID NO: 63972 - RNA, 27 nt, Artificial Sequence
  Synthetic Oligonucleotide; LAG exon 2; Set A
gagaggcuucacuaggugagcaaaaga

SEQ ID NO: 63973 - RNA, 25 nt, Artificial Sequence
  Synthetic Oligonucleotide; LAG exon 2; Set A
agaggcuucacuaggugagcaaaag

SEQ ID NO: 63974 - RNA, 22 nt, Artificial Sequence
  Synthetic Oligonucleotide; LAG exon 2; Set A
gaggcuucacuaggugagcaaa

SEQ ID NO: 63975 - RNA, 24 nt, Artificial Sequence
  Synthetic Oligonucleotide; LAG exon 2; Set A
agaggcuucacuaggugagcaaaa

SEQ ID NO: 63976 - RNA, 30 nt, Artificial Sequence
  Synthetic Oligonucleotide; LAG exon 2; Set A
uggagaggcuucacuaggugagcaaaagag

SEQ ID NO: 63977 - RNA, 28 nt, Artificial Sequence
  Synthetic Oligonucleotide; LAG exon 2; Set A
ggagaggcuucacuaggugagcaaaaga

SEQ ID NO: 63978 - RNA, 26 nt, Artificial Sequence
  Synthetic Oligonucleotide; LAG exon 2; Set A
gagaggcuucacuaggugagcaaaag

SEQ ID NO: 63979 - RNA, 23 nt, Artificial Sequence
  Synthetic Oligonucleotide; LAG exon 2; Set A
agaggcuucacuaggugagcaaa

SEQ ID NO: 63980 - RNA, 25 nt, Artificial Sequence
  Synthetic Oligonucleotide; LAG exon 2; Set A
gagaggcuucacuaggugagcaaaa

SEQ ID NO: 63981 - RNA, 29 nt, Artificial Sequence
  Synthetic Oligonucleotide; LAG exon 2; Set A
uggagaggcuucacuaggugagcaaaaga

SEQ ID NO: 63982 - RNA, 27 nt, Artificial Sequence
  Synthetic Oligonucleotide; LAG exon 2; Set A
ggagaggcuucacuaggugagcaaaag

SEQ ID NO: 63983 - RNA, 24 nt, Artificial Sequence
  Synthetic Oligonucleotide; LAG exon 2; Set A
gagaggcuucacuaggugagcaaa

SEQ ID NO: 63984 - RNA, 26 nt, Artificial Sequence
  Synthetic Oligonucleotide; LAG exon 2; Set A
ggagaggcuucacuaggugagcaaaa

SEQ ID NO: 63985 - RNA, 28 nt, Artificial Sequence
  Synthetic Oligonucleotide; LAG exon 2; Set A
uggagaggcuucacuaggugagcaaaag

SEQ ID NO: 63986 - RNA, 25 nt, Artificial Sequence
  Synthetic Oligonucleotide; LAG exon 2; Set A
ggagaggcuucacuaggugagcaaa

SEQ ID NO: 63987 - RNA, 27 nt, Artificial Sequence
  Synthetic Oligonucleotide; LAG exon 2; Set A
uggagaggcuucacuaggugagcaaaa

SEQ ID NO: 63988 - RNA, 26 nt, Artificial Sequence
  Synthetic Oligonucleotide; LAG exon 2; Set A
uggagaggcuucacuaggugagcaaa

SEQ ID NO: 63989 - RNA, 15 nt, Artificial Sequence
  Synthetic Oligonucleotide; LAG exon 2; Set C
gagaggcuucacuag

SEQ ID NO: 63990 - RNA, 16 nt, Artificial Sequence
  Synthetic Oligonucleotide; LAG exon 2; Set C
ggagaggcuucacuag

SEQ ID NO: 63991 - RNA, 17 nt, Artificial Sequence
  Synthetic Oligonucleotide; LAG exon 2; Set C
uggagaggcuucacuag

SEQ ID NO: 63992 - RNA, 21 nt, Artificial Sequence
  Synthetic Oligonucleotide; LAG exon 2; Set C
cugcaggggagcugggcagga

SEQ ID NO: 63993 - RNA, 22 nt, Artificial Sequence
  Synthetic Oligonucleotide; LAG exon 2; Set C
gcugcaggggagcugggcagga

SEQ ID NO: 63994 - RNA, 20 nt, Artificial Sequence
  Synthetic Oligonucleotide; LAG exon 2; Set C
cugcaggggagcugggcagg

SEQ ID NO: 63995 - RNA, 23 nt, Artificial Sequence
  Synthetic Oligonucleotide; LAG exon 2; Set C
ggcugcaggggagcugggcagga

SEQ ID NO: 63996 - RNA, 21 nt, Artificial Sequence
  Synthetic Oligonucleotide; LAG exon 2; Set C
gcugcaggggagcugggcagg

SEQ ID NO: 63997 - RNA, 24 nt, Artificial Sequence
  Synthetic Oligonucleotide; LAG exon 2; Set C
gggcugcaggggagcugggcagga

SEQ ID NO: 63998 - RNA, 22 nt, Artificial Sequence
  Synthetic Oligonucleotide; LAG exon 2; Set C
ggcugcaggggagcugggcagg

SEQ ID NO: 63999 - RNA, 25 nt, Artificial Sequence
  Synthetic Oligonucleotide; LAG exon 2; Set C
ggggcugcaggggagcugggcagga

SEQ ID NO: 64000 - RNA, 23 nt, Artificial Sequence
  Synthetic Oligonucleotide; LAG exon 2; Set C
gggcugcaggggagcugggcagg

SEQ ID NO: 64001 - RNA, 24 nt, Artificial Sequence
  Synthetic Oligonucleotide; LAG exon 2; Set C
ggggcugcaggggagcugggcagg

SEQ ID NO: 64002 - RNA, 25 nt, Artificial Sequence
  Synthetic Oligonucleotide; LAG exon 2; Set C
uggggcugcaggggagcugggcagg

SEQ ID NO: 64003 - RNA, 40 nt, Artificial Sequence
  Synthetic Oligonucleotide; LAG exon 2; Set C
cuucgcagaaggcugagauccuggagggggauuguggggc

SEQ ID NO: 64004 - RNA, 15 nt, Artificial Sequence
  Synthetic Oligonucleotide; LAG exon 2; Set C
cugagauccuggagg

SEQ ID NO: 64005 - RNA, 39 nt, Artificial Sequence
  Synthetic Oligonucleotide; LAG exon 2; Set C
cuucgcagaaggcugagauccuggagggggauugugggg

SEQ ID NO: 64006 - RNA, 40 nt, Artificial Sequence
  Synthetic Oligonucleotide; LAG exon 2; Set C
ucuucgcagaaggcugagauccuggagggggauugugggg

SEQ ID NO: 64007 - RNA, 38 nt, Artificial Sequence
  Synthetic Oligonucleotide; LAG exon 2; Set C
cuucgcagaaggcugagauccuggagggggauuguggg

SEQ ID NO: 64008 - RNA, 39 nt, Artificial Sequence
  Synthetic Oligonucleotide; LAG exon 2; Set C
ucuucgcagaaggcugagauccuggagggggauuguggg

SEQ ID NO: 64009 - RNA, 37 nt, Artificial Sequence
  Synthetic Oligonucleotide; LAG exon 2; Set C
cuucgcagaaggcugagauccuggagggggauugugg

SEQ ID NO: 64010 - RNA, 15 nt, Artificial Sequence
  Synthetic Oligonucleotide; LAG exon 2; Set C
gcugagauccuggag

SEQ ID NO: 64011 - RNA, 36 nt, Artificial Sequence
  Synthetic Oligonucleotide; LAG exon 2; Set C
cuucgcagaaggcugagauccuggagggggauugug

SEQ ID NO: 64012 - RNA, 38 nt, Artificial Sequence
  Synthetic Oligonucleotide; LAG exon 2; Set C
ucuucgcagaaggcugagauccuggagggggauugugg

SEQ ID NO: 64013 - RNA, 35 nt, Artificial Sequence
  Synthetic Oligonucleotide; LAG exon 2; Set C
cuucgcagaaggcugagauccuggagggggauugu

SEQ ID NO: 64014 - RNA, 37 nt, Artificial Sequence
  Synthetic Oligonucleotide; LAG exon 2; Set C
ucuucgcagaaggcugagauccuggagggggauugug

SEQ ID NO: 64015 - RNA, 36 nt, Artificial Sequence
  Synthetic Oligonucleotide; LAG exon 2; Set C
ucuucgcagaaggcugagauccuggagggggauugu

SEQ ID NO: 64016 - RNA, 34 nt, Artificial Sequence
  Synthetic Oligonucleotide; LAG exon 2; Set C
cuucgcagaaggcugagauccuggagggggauug

SEQ ID NO: 64017 - RNA, 35 nt, Artificial Sequence
  Synthetic Oligonucleotide; LAG exon 2; Set C
ucuucgcagaaggcugagauccuggagggggauug

SEQ ID NO: 64018 - RNA, 33 nt, Artificial Sequence
  Synthetic Oligonucleotide; LAG exon 2; Set C
cuucgcagaaggcugagauccuggagggggauu

SEQ ID NO: 64019 - RNA, 34 nt, Artificial Sequence
  Synthetic Oligonucleotide; LAG exon 2; Set C
ucuucgcagaaggcugagauccuggagggggauu

SEQ ID NO: 64020 - RNA, 32 nt, Artificial Sequence
  Synthetic Oligonucleotide; LAG exon 2; Set C
cuucgcagaaggcugagauccuggagggggau

SEQ ID NO: 64021 - RNA, 33 nt, Artificial Sequence
  Synthetic Oligonucleotide; LAG exon 2; Set C
ucuucgcagaaggcugagauccuggagggggau

SEQ ID NO: 64022 - RNA, 31 nt, Artificial Sequence
  Synthetic Oligonucleotide; LAG exon 2; Set C
cuucgcagaaggcugagauccuggaggggga

SEQ ID NO: 64023 - RNA, 40 nt, Artificial Sequence
  Synthetic Oligonucleotide; LAG exon 2; Set C
cugcucuucgcagaaggcugagauccuggagggggauugu

SEQ ID NO: 64024 - RNA, 32 nt, Artificial Sequence
  Synthetic Oligonucleotide; LAG exon 2; Set C
ucuucgcagaaggcugagauccuggaggggga

SEQ ID NO: 64025 - RNA, 30 nt, Artificial Sequence
  Synthetic Oligonucleotide; LAG exon 2; Set C
cuucgcagaaggcugagauccuggaggggg

SEQ ID NO: 64026 - RNA, 22 nt, Artificial Sequence
  Synthetic Oligonucleotide; LAG exon 2; Set A
gcagaaggcugagauccuggag

SEQ ID NO: 64027 - RNA, 39 nt, Artificial Sequence
  Synthetic Oligonucleotide; LAG exon 2; Set C
cugcucuucgcagaaggcugagauccuggagggggauug

SEQ ID NO: 64028 - RNA, 31 nt, Artificial Sequence
  Synthetic Oligonucleotide; LAG exon 2; Set C
ucuucgcagaaggcugagauccuggaggggg

SEQ ID NO: 64029 - RNA, 29 nt, Artificial Sequence
  Synthetic Oligonucleotide; LAG exon 2; Set C
cuucgcagaaggcugagauccuggagggg

SEQ ID NO: 64030 - RNA, 21 nt, Artificial Sequence
  Synthetic Oligonucleotide; LAG exon 2; Set A
gcagaaggcugagauccugga

SEQ ID NO: 64031 - RNA, 38 nt, Artificial Sequence
  Synthetic Oligonucleotide; LAG exon 2; Set C
cugcucuucgcagaaggcugagauccuggagggggauu

SEQ ID NO: 64032 - RNA, 28 nt, Artificial Sequence
  Synthetic Oligonucleotide; LAG exon 2; Set C
cuucgcagaaggcugagauccuggaggg

SEQ ID NO: 64033 - RNA, 30 nt, Artificial Sequence
  Synthetic Oligonucleotide; LAG exon 2; Set C
ucuucgcagaaggcugagauccuggagggg

SEQ ID NO: 64034 - RNA, 22 nt, Artificial Sequence
  Synthetic Oligonucleotide; LAG exon 2; Set A
cgcagaaggcugagauccugga

SEQ ID NO: 64035 - RNA, 20 nt, Artificial Sequence
  Synthetic Oligonucleotide; LAG exon 2; Set A
gcagaaggcugagauccugg

SEQ ID NO: 64036 - RNA, 37 nt, Artificial Sequence
  Synthetic Oligonucleotide; LAG exon 2; Set C
cugcucuucgcagaaggcugagauccuggagggggau

SEQ ID NO: 64037 - RNA, 29 nt, Artificial Sequence
  Synthetic Oligonucleotide; LAG exon 2; Set C
ucuucgcagaaggcugagauccuggaggg

SEQ ID NO: 64038 - RNA, 27 nt, Artificial Sequence
  Synthetic Oligonucleotide; LAG exon 2; Set C
cuucgcagaaggcugagauccuggagg

SEQ ID NO: 64039 - RNA, 21 nt, Artificial Sequence
  Synthetic Oligonucleotide; LAG exon 2; Set A
cgcagaaggcugagauccugg

SEQ ID NO: 64040 - RNA, 28 nt, Artificial Sequence
  Synthetic Oligonucleotide; LAG exon 2; Set C
ucuucgcagaaggcugagauccuggagg

SEQ ID NO: 64041 - RNA, 26 nt, Artificial Sequence
  Synthetic Oligonucleotide; LAG exon 2; Set A
cuucgcagaaggcugagauccuggag

SEQ ID NO: 64042 - RNA, 22 nt, Artificial Sequence
  Synthetic Oligonucleotide; LAG exon 2; Set A
ucgcagaaggcugagauccugg

SEQ ID NO: 64043 - RNA, 27 nt, Artificial Sequence
  Synthetic Oligonucleotide; LAG exon 2; Set A
ucuucgcagaaggcugagauccuggag

SEQ ID NO: 64044 - RNA, 25 nt, Artificial Sequence
  Synthetic Oligonucleotide; LAG exon 2; Set A
cuucgcagaaggcugagauccugga

SEQ ID NO: 64045 - RNA, 26 nt, Artificial Sequence
  Synthetic Oligonucleotide; LAG exon 2; Set C
ucuucgcagaaggcugagauccugga

SEQ ID NO: 64046 - RNA, 24 nt, Artificial Sequence
  Synthetic Oligonucleotide; LAG exon 2; Set A
cuucgcagaaggcugagauccugg

SEQ ID NO: 64047 - RNA, 25 nt, Artificial Sequence
  Synthetic Oligonucleotide; LAG exon 2; Set A
ucuucgcagaaggcugagauccugg

SEQ ID NO: 64048 - RNA, 17 nt, Artificial Sequence
  Synthetic Oligonucleotide; LAG exon 2; Set C
cuucgcagaaggcugag

SEQ ID NO: 64049 - RNA, 16 nt, Artificial Sequence
  Synthetic Oligonucleotide; LAG exon 2; Set C
cuucgcagaaggcuga

SEQ ID NO: 64050 - RNA, 18 nt, Artificial Sequence
  Synthetic Oligonucleotide; LAG exon 2; Set C
ucuucgcagaaggcugag

SEQ ID NO: 64051 - RNA, 37 nt, Artificial Sequence
  Synthetic Oligonucleotide; LAG exon 2; Set C
ugaccccugcucuucgcagaaggcugagauccuggag

SEQ ID NO: 64052 - RNA, 15 nt, Artificial Sequence
  Synthetic Oligonucleotide; LAG exon 2; Set C
cuucgcagaaggcug

SEQ ID NO: 64053 - RNA, 16 nt, Artificial Sequence
  Synthetic Oligonucleotide; LAG exon 2; Set C
ucuucgcagaaggcug

SEQ ID NO: 64054 - RNA, 36 nt, Artificial Sequence
  Synthetic Oligonucleotide; LAG exon 2; Set C
ugaccccugcucuucgcagaaggcugagauccugga

SEQ ID NO: 64055 - RNA, 15 nt, Artificial Sequence
  Synthetic Oligonucleotide; LAG exon 2; Set C
ucuucgcagaaggcu

SEQ ID NO: 64056 - RNA, 35 nt, Artificial Sequence
  Synthetic Oligonucleotide; LAG exon 2; Set C
ugaccccugcucuucgcagaaggcugagauccugg

SEQ ID NO: 64057 - RNA, 21 nt, Artificial Sequence
  Synthetic Oligonucleotide; LAG exon 2; Set A
cugcucuucgcagaaggcuga

SEQ ID NO: 64058 - RNA, 26 nt, Artificial Sequence
  Synthetic Oligonucleotide; LAG exon 2; Set C
ugaccccugcucuucgcagaaggcug

SEQ ID NO: 64059 - RNA, 25 nt, Artificial Sequence
  Synthetic Oligonucleotide; LAG exon 2; Set C
ugaccccugcucuucgcagaaggcu

SEQ ID NO: 64060 - RNA, 39 nt, Artificial Sequence
  Synthetic Oligonucleotide; LAG exon 2; Set C
augcugccaagugaccccugcucuucgcagaaggcugag

SEQ ID NO: 64061 - RNA, 38 nt, Artificial Sequence
  Synthetic Oligonucleotide; LAG exon 2; Set C
augcugccaagugaccccugcucuucgcagaaggcuga

SEQ ID NO: 64062 - RNA, 40 nt, Artificial Sequence
  Synthetic Oligonucleotide; LAG exon 2; Set C
gaugcugccaagugaccccugcucuucgcagaaggcugag

SEQ ID NO: 64063 - RNA, 37 nt, Artificial Sequence
  Synthetic Oligonucleotide; LAG exon 2; Set C
augcugccaagugaccccugcucuucgcagaaggcug

SEQ ID NO: 64064 - RNA, 38 nt, Artificial Sequence
  Synthetic Oligonucleotide; LAG exon 2; Set C
gaugcugccaagugaccccugcucuucgcagaaggcug

SEQ ID NO: 64065 - RNA, 36 nt, Artificial Sequence
  Synthetic Oligonucleotide; LAG exon 2; Set C
augcugccaagugaccccugcucuucgcagaaggcu

SEQ ID NO: 64066 - RNA, 39 nt, Artificial Sequence
  Synthetic Oligonucleotide; LAG exon 2; Set C
ugaugcugccaagugaccccugcucuucgcagaaggcug

SEQ ID NO: 64067 - RNA, 37 nt, Artificial Sequence
  Synthetic Oligonucleotide; LAG exon 2; Set C
gaugcugccaagugaccccugcucuucgcagaaggcu

SEQ ID NO: 64068 - RNA, 38 nt, Artificial Sequence
  Synthetic Oligonucleotide; LAG exon 2; Set C
ugaugcugccaagugaccccugcucuucgcagaaggcu

SEQ ID NO: 64069 - RNA, 29 nt, Artificial Sequence
  Synthetic Oligonucleotide; LAG exon 2; Set C
augcugccaagugaccccugcucuucgca

SEQ ID NO: 64070 - RNA, 30 nt, Artificial Sequence
  Synthetic Oligonucleotide; LAG exon 2; Set C
gaugcugccaagugaccccugcucuucgca

SEQ ID NO: 64071 - RNA, 28 nt, Artificial Sequence
  Synthetic Oligonucleotide; LAG exon 2; Set C
augcugccaagugaccccugcucuucgc

SEQ ID NO: 64072 - RNA, 27 nt, Artificial Sequence
  Synthetic Oligonucleotide; LAG exon 2; Set C
augcugccaagugaccccugcucuucg

SEQ ID NO: 64073 - RNA, 31 nt, Artificial Sequence
  Synthetic Oligonucleotide; LAG exon 2; Set C
ugaugcugccaagugaccccugcucuucgca

SEQ ID NO: 64074 - RNA, 29 nt, Artificial Sequence
  Synthetic Oligonucleotide; LAG exon 2; Set C
gaugcugccaagugaccccugcucuucgc

SEQ ID NO: 64075 - RNA, 26 nt, Artificial Sequence
  Synthetic Oligonucleotide; LAG exon 2; Set C
augcugccaagugaccccugcucuuc

SEQ ID NO: 64076 - RNA, 28 nt, Artificial Sequence
  Synthetic Oligonucleotide; LAG exon 2; Set C
gaugcugccaagugaccccugcucuucg

SEQ ID NO: 64077 - RNA, 30 nt, Artificial Sequence
  Synthetic Oligonucleotide; LAG exon 2; Set C
ugaugcugccaagugaccccugcucuucgc

SEQ ID NO: 64078 - RNA, 27 nt, Artificial Sequence
  Synthetic Oligonucleotide; LAG exon 2; Set C
gaugcugccaagugaccccugcucuuc

SEQ ID NO: 64079 - RNA, 29 nt, Artificial Sequence
  Synthetic Oligonucleotide; LAG exon 2; Set C
ugaugcugccaagugaccccugcucuucg

SEQ ID NO: 64080 - RNA, 28 nt, Artificial Sequence
  Synthetic Oligonucleotide; LAG exon 2; Set C
ugaugcugccaagugaccccugcucuuc

SEQ ID NO: 64081 - RNA, 37 nt, Artificial Sequence
  Synthetic Oligonucleotide; LAG exon 2; Set C
ucuggcugaugcugccaagugaccccugcucuucgca

SEQ ID NO: 64082 - RNA, 38 nt, Artificial Sequence
  Synthetic Oligonucleotide; LAG exon 2; Set C
gucuggcugaugcugccaagugaccccugcucuucgca

SEQ ID NO: 64083 - RNA, 36 nt, Artificial Sequence
  Synthetic Oligonucleotide; LAG exon 2; Set C
ucuggcugaugcugccaagugaccccugcucuucgc

SEQ ID NO: 64084 - RNA, 35 nt, Artificial Sequence
  Synthetic Oligonucleotide; LAG exon 2; Set C
ucuggcugaugcugccaagugaccccugcucuucg

SEQ ID NO: 64085 - RNA, 39 nt, Artificial Sequence
  Synthetic Oligonucleotide; LAG exon 2; Set C
ugucuggcugaugcugccaagugaccccugcucuucgca

SEQ ID NO: 64086 - RNA, 37 nt, Artificial Sequence
  Synthetic Oligonucleotide; LAG exon 2; Set C
gucuggcugaugcugccaagugaccccugcucuucgc

SEQ ID NO: 64087 - RNA, 34 nt, Artificial Sequence
  Synthetic Oligonucleotide; LAG exon 2; Set C
ucuggcugaugcugccaagugaccccugcucuuc

SEQ ID NO: 64088 - RNA, 36 nt, Artificial Sequence
  Synthetic Oligonucleotide; LAG exon 2; Set C
gucuggcugaugcugccaagugaccccugcucuucg

SEQ ID NO: 64089 - RNA, 38 nt, Artificial Sequence
  Synthetic Oligonucleotide; LAG exon 2; Set C
ugucuggcugaugcugccaagugaccccugcucuucgc

SEQ ID NO: 64090 - RNA, 35 nt, Artificial Sequence
  Synthetic Oligonucleotide; LAG exon 2; Set C
gucuggcugaugcugccaagugaccccugcucuuc

SEQ ID NO: 64091 - RNA, 37 nt, Artificial Sequence
  Synthetic Oligonucleotide; LAG exon 2; Set C
ugucuggcugaugcugccaagugaccccugcucuucg

SEQ ID NO: 64092 - RNA, 36 nt, Artificial Sequence
  Synthetic Oligonucleotide; LAG exon 2; Set C
ugucuggcugaugcugccaagugaccccugcucuuc

SEQ ID NO: 64093 - RNA, 15 nt, Artificial Sequence
  Synthetic Oligonucleotide; LAG exon 2; Set C
gaugcugccaaguga

SEQ ID NO: 64094 - RNA, 16 nt, Artificial Sequence
  Synthetic Oligonucleotide; LAG exon 2; Set C
ugaugcugccaaguga

SEQ ID NO: 64095 - RNA, 22 nt, Artificial Sequence
  Synthetic Oligonucleotide; LAG exon 2; Set B
ucuggcugaugcugccaaguga

SEQ ID NO: 64096 - RNA, 23 nt, Artificial Sequence
  Synthetic Oligonucleotide; LAG exon 2; Set B
gucuggcugaugcugccaaguga

SEQ ID NO: 64097 - RNA, 24 nt, Artificial Sequence
  Synthetic Oligonucleotide; LAG exon 2; Set C
ugucuggcugaugcugccaaguga

SEQ ID NO: 64098 - RNA, 29 nt, Artificial Sequence
  Synthetic Oligonucleotide; LAG exon 2; Set C
auaccugucuggcugaugcugccaaguga

SEQ ID NO: 64099 - RNA, 39 nt, Artificial Sequence
  Synthetic Oligonucleotide; LAG exon 2; Set C
uuuggggugcauaccugucuggcugaugcugccaaguga

SEQ ID NO: 64100 - RNA, 40 nt, Artificial Sequence
  Synthetic Oligonucleotide; LAG exon 2; Set C
guuuggggugcauaccugucuggcugaugcugccaaguga

SEQ ID NO: 64101 - RNA, 18 nt, Artificial Sequence
  Synthetic Oligonucleotide; LAG exon 2; Set C
auaccugucuggcugaug

SEQ ID NO: 64102 - RNA, 17 nt, Artificial Sequence
  Synthetic Oligonucleotide; LAG exon 2; Set C
auaccugucuggcugau

SEQ ID NO: 64103 - RNA, 16 nt, Artificial Sequence
  Synthetic Oligonucleotide; LAG exon 2; Set C
auaccugucuggcuga

SEQ ID NO: 64104 - RNA, 25 nt, Artificial Sequence
  Synthetic Oligonucleotide; LAG exon 2; Set C
uggggugcauaccugucuggcugau

SEQ ID NO: 64105 - RNA, 26 nt, Artificial Sequence
  Synthetic Oligonucleotide; LAG exon 2; Set C
uuggggugcauaccugucuggcugau

SEQ ID NO: 64106 - RNA, 28 nt, Artificial Sequence
  Synthetic Oligonucleotide; LAG exon 2; Set C
uuuggggugcauaccugucuggcugaug

SEQ ID NO: 64107 - RNA, 25 nt, Artificial Sequence
  Synthetic Oligonucleotide; LAG exon 2; Set C
uuggggugcauaccugucuggcuga

SEQ ID NO: 64108 - RNA, 29 nt, Artificial Sequence
  Synthetic Oligonucleotide; LAG exon 2; Set C
guuuggggugcauaccugucuggcugaug

SEQ ID NO: 64109 - RNA, 30 nt, Artificial Sequence
  Synthetic Oligonucleotide; LAG exon 2; Set C
aguuuggggugcauaccugucuggcugaug

SEQ ID NO: 64110 - RNA, 31 nt, Artificial Sequence
  Synthetic Oligonucleotide; LAG exon 2; Set C
aaguuuggggugcauaccugucuggcugaug

SEQ ID NO: 64111 - RNA, 19 nt, Artificial Sequence
  Synthetic Oligonucleotide; LAG exon 2; Set B
uuggggugcauaccugucu

SEQ ID NO: 64112 - RNA, 17 nt, Artificial Sequence
  Synthetic Oligonucleotide; LAG exon 2; Set C
uuggggugcauaccugu

SEQ ID NO: 64113 - RNA, 37 nt, Artificial Sequence
  Synthetic Oligonucleotide; LAG exon 2; Set C
uugcccaaguuuggggugcauaccugucuggcugaug

SEQ ID NO: 64114 - RNA, 36 nt, Artificial Sequence
  Synthetic Oligonucleotide; LAG exon 2; Set C
uugcccaaguuuggggugcauaccugucuggcugau

SEQ ID NO: 64115 - RNA, 38 nt, Artificial Sequence
  Synthetic Oligonucleotide; LAG exon 2; Set C
guugcccaaguuuggggugcauaccugucuggcugaug

SEQ ID NO: 64116 - RNA, 37 nt, Artificial Sequence
  Synthetic Oligonucleotide; LAG exon 2; Set C
guugcccaaguuuggggugcauaccugucuggcugau

SEQ ID NO: 64117 - RNA, 35 nt, Artificial Sequence
  Synthetic Oligonucleotide; LAG exon 2; Set C
uugcccaaguuuggggugcauaccugucuggcuga

SEQ ID NO: 64118 - RNA, 39 nt, Artificial Sequence
  Synthetic Oligonucleotide; LAG exon 2; Set C
uguugcccaaguuuggggugcauaccugucuggcugaug

SEQ ID NO: 64119 - RNA, 36 nt, Artificial Sequence
  Synthetic Oligonucleotide; LAG exon 2; Set C
guugcccaaguuuggggugcauaccugucuggcuga

SEQ ID NO: 64120 - RNA, 37 nt, Artificial Sequence
  Synthetic Oligonucleotide; LAG exon 2; Set C
uguugcccaaguuuggggugcauaccugucuggcuga

SEQ ID NO: 64121 - RNA, 29 nt, Artificial Sequence
  Synthetic Oligonucleotide; LAG exon 2; Set C
uugcccaaguuuggggugcauaccugucu

SEQ ID NO: 64122 - RNA, 28 nt, Artificial Sequence
  Synthetic Oligonucleotide; LAG exon 2; Set C
uugcccaaguuuggggugcauaccuguc

SEQ ID NO: 64123 - RNA, 30 nt, Artificial Sequence
  Synthetic Oligonucleotide; LAG exon 2; Set C
guugcccaaguuuggggugcauaccugucu

SEQ ID NO: 64124 - RNA, 27 nt, Artificial Sequence
  Synthetic Oligonucleotide; LAG exon 2; Set C
uugcccaaguuuggggugcauaccugu

SEQ ID NO: 64125 - RNA, 29 nt, Artificial Sequence
  Synthetic Oligonucleotide; LAG exon 2; Set C
guugcccaaguuuggggugcauaccuguc

SEQ ID NO: 64126 - RNA, 31 nt, Artificial Sequence
  Synthetic Oligonucleotide; LAG exon 2; Set C
uguugcccaaguuuggggugcauaccugucu

SEQ ID NO: 64127 - RNA, 28 nt, Artificial Sequence
  Synthetic Oligonucleotide; LAG exon 2; Set C
guugcccaaguuuggggugcauaccugu

SEQ ID NO: 64128 - RNA, 30 nt, Artificial Sequence
  Synthetic Oligonucleotide; LAG exon 2; Set C
uguugcccaaguuuggggugcauaccuguc

SEQ ID NO: 64129 - RNA, 29 nt, Artificial Sequence
  Synthetic Oligonucleotide; LAG exon 2; Set C
uguugcccaaguuuggggugcauaccugu

SEQ ID NO: 64130 - RNA, 22 nt, Artificial Sequence
  Synthetic Oligonucleotide; LAG exon 2; Set B
uugcccaaguuuggggugcaua

SEQ ID NO: 64131 - RNA, 23 nt, Artificial Sequence
  Synthetic Oligonucleotide; LAG exon 2; Set B
guugcccaaguuuggggugcaua

SEQ ID NO: 64132 - RNA, 37 nt, Artificial Sequence
  Synthetic Oligonucleotide; LAG exon 2; Set C
agguccuguugcccaaguuuggggugcauaccugucu

SEQ ID NO: 64133 - RNA, 36 nt, Artificial Sequence
  Synthetic Oligonucleotide; LAG exon 2; Set C
agguccuguugcccaaguuuggggugcauaccuguc

SEQ ID NO: 64134 - RNA, 24 nt, Artificial Sequence
  Synthetic Oligonucleotide; LAG exon 2; Set B
uguugcccaaguuuggggugcaua

SEQ ID NO: 64135 - RNA, 38 nt, Artificial Sequence
  Synthetic Oligonucleotide; LAG exon 2; Set C
gagguccuguugcccaaguuuggggugcauaccugucu

SEQ ID NO: 64136 - RNA, 35 nt, Artificial Sequence
  Synthetic Oligonucleotide; LAG exon 2; Set C
agguccuguugcccaaguuuggggugcauaccugu

SEQ ID NO: 64137 - RNA, 37 nt, Artificial Sequence
  Synthetic Oligonucleotide; LAG exon 2; Set C
gagguccuguugcccaaguuuggggugcauaccuguc

SEQ ID NO: 64138 - RNA, 39 nt, Artificial Sequence
  Synthetic Oligonucleotide; LAG exon 2; Set C
ggagguccuguugcccaaguuuggggugcauaccugucu

SEQ ID NO: 64139 - RNA, 36 nt, Artificial Sequence
  Synthetic Oligonucleotide; LAG exon 2; Set C
gagguccuguugcccaaguuuggggugcauaccugu

SEQ ID NO: 64140 - RNA, 38 nt, Artificial Sequence
  Synthetic Oligonucleotide; LAG exon 2; Set C
ggagguccuguugcccaaguuuggggugcauaccuguc

SEQ ID NO: 64141 - RNA, 40 nt, Artificial Sequence
  Synthetic Oligonucleotide; LAG exon 2; Set C
cggagguccuguugcccaaguuuggggugcauaccugucu

SEQ ID NO: 64142 - RNA, 37 nt, Artificial Sequence
  Synthetic Oligonucleotide; LAG exon 2; Set C
ggagguccuguugcccaaguuuggggugcauaccugu

SEQ ID NO: 64143 - RNA, 39 nt, Artificial Sequence
  Synthetic Oligonucleotide; LAG exon 2; Set C
cggagguccuguugcccaaguuuggggugcauaccuguc

SEQ ID NO: 64144 - RNA, 38 nt, Artificial Sequence
  Synthetic Oligonucleotide; LAG exon 2; Set C
cggagguccuguugcccaaguuuggggugcauaccugu

SEQ ID NO: 64145 - RNA, 40 nt, Artificial Sequence
  Synthetic Oligonucleotide; LAG exon 2; Set C
ucggagguccuguugcccaaguuuggggugcauaccuguc

SEQ ID NO: 64146 - RNA, 39 nt, Artificial Sequence
  Synthetic Oligonucleotide; LAG exon 2; Set C
ucggagguccuguugcccaaguuuggggugcauaccugu

SEQ ID NO: 64147 - RNA, 40 nt, Artificial Sequence
  Synthetic Oligonucleotide; LAG exon 2; Set C
uucggagguccuguugcccaaguuuggggugcauaccugu

SEQ ID NO: 64148 - RNA, 30 nt, Artificial Sequence
  Synthetic Oligonucleotide; LAG exon 2; Set C
agguccuguugcccaaguuuggggugcaua

SEQ ID NO: 64149 - RNA, 31 nt, Artificial Sequence
  Synthetic Oligonucleotide; LAG exon 2; Set C
gagguccuguugcccaaguuuggggugcaua

SEQ ID NO: 64150 - RNA, 15 nt, Artificial Sequence
  Synthetic Oligonucleotide; LAG exon 2; Set C
guugcccaaguuugg

SEQ ID NO: 64151 - RNA, 32 nt, Artificial Sequence
  Synthetic Oligonucleotide; LAG exon 2; Set C
ggagguccuguugcccaaguuuggggugcaua

SEQ ID NO: 64152 - RNA, 16 nt, Artificial Sequence
  Synthetic Oligonucleotide; LAG exon 2; Set C
uguugcccaaguuugg

SEQ ID NO: 64153 - RNA, 33 nt, Artificial Sequence
  Synthetic Oligonucleotide; LAG exon 2; Set C
cggagguccuguugcccaaguuuggggugcaua

SEQ ID NO: 64154 - RNA, 15 nt, Artificial Sequence
  Synthetic Oligonucleotide; LAG exon 2; Set C
uguugcccaaguuug

SEQ ID NO: 64155 - RNA, 34 nt, Artificial Sequence
  Synthetic Oligonucleotide; LAG exon 2; Set C
ucggagguccuguugcccaaguuuggggugcaua

SEQ ID NO: 64156 - RNA, 35 nt, Artificial Sequence
  Synthetic Oligonucleotide; LAG exon 2; Set C
uucggagguccuguugcccaaguuuggggugcaua

SEQ ID NO: 64157 - RNA, 36 nt, Artificial Sequence
  Synthetic Oligonucleotide; LAG exon 2; Set C
auucggagguccuguugcccaaguuuggggugcaua

SEQ ID NO: 64158 - RNA, 23 nt, Artificial Sequence
  Synthetic Oligonucleotide; LAG exon 2; Set B
gagguccuguugcccaaguuugg

SEQ ID NO: 64159 - RNA, 20 nt, Artificial Sequence
  Synthetic Oligonucleotide; LAG exon 2; Set B
agguccuguugcccaaguuu

SEQ ID NO: 64160 - RNA, 24 nt, Artificial Sequence
  Synthetic Oligonucleotide; LAG exon 2; Set B
ggagguccuguugcccaaguuugg

SEQ ID NO: 64161 - RNA, 19 nt, Artificial Sequence
  Synthetic Oligonucleotide; LAG exon 2; Set B
agguccuguugcccaaguu

SEQ ID NO: 64162 - RNA, 21 nt, Artificial Sequence
  Synthetic Oligonucleotide; LAG exon 2; Set B
gagguccuguugcccaaguuu

SEQ ID NO: 64163 - RNA, 23 nt, Artificial Sequence
  Synthetic Oligonucleotide; LAG exon 2; Set B
ggagguccuguugcccaaguuug

SEQ ID NO: 64164 - RNA, 25 nt, Artificial Sequence
  Synthetic Oligonucleotide; LAG exon 2; Set C
cggagguccuguugcccaaguuugg

SEQ ID NO: 64165 - RNA, 20 nt, Artificial Sequence
  Synthetic Oligonucleotide; LAG exon 2; Set B
gagguccuguugcccaaguu

SEQ ID NO: 64166 - RNA, 18 nt, Artificial Sequence
  Synthetic Oligonucleotide; LAG exon 2; Set C
agguccuguugcccaagu

SEQ ID NO: 64167 - RNA, 22 nt, Artificial Sequence
  Synthetic Oligonucleotide; LAG exon 2; Set B
ggagguccuguugcccaaguuu

SEQ ID NO: 64168 - RNA, 26 nt, Artificial Sequence
  Synthetic Oligonucleotide; LAG exon 2; Set C
ucggagguccuguugcccaaguuugg

SEQ ID NO: 64169 - RNA, 24 nt, Artificial Sequence
  Synthetic Oligonucleotide; LAG exon 2; Set B
cggagguccuguugcccaaguuug

SEQ ID NO: 64170 - RNA, 21 nt, Artificial Sequence
  Synthetic Oligonucleotide; LAG exon 2; Set B
ggagguccuguugcccaaguu

SEQ ID NO: 64171 - RNA, 19 nt, Artificial Sequence
  Synthetic Oligonucleotide; LAG exon 2; Set B
gagguccuguugcccaagu

SEQ ID NO: 64172 - RNA, 23 nt, Artificial Sequence
  Synthetic Oligonucleotide; LAG exon 2; Set B
cggagguccuguugcccaaguuu

SEQ ID NO: 64173 - RNA, 17 nt, Artificial Sequence
  Synthetic Oligonucleotide; LAG exon 2; Set C
agguccuguugcccaag

SEQ ID NO: 64174 - RNA, 27 nt, Artificial Sequence
  Synthetic Oligonucleotide; LAG exon 2; Set C
uucggagguccuguugcccaaguuugg

SEQ ID NO: 64175 - RNA, 25 nt, Artificial Sequence
  Synthetic Oligonucleotide; LAG exon 2; Set B
ucggagguccuguugcccaaguuug

SEQ ID NO: 64176 - RNA, 20 nt, Artificial Sequence
  Synthetic Oligonucleotide; LAG exon 2; Set B
ggagguccuguugcccaagu

SEQ ID NO: 64177 - RNA, 22 nt, Artificial Sequence
  Synthetic Oligonucleotide; LAG exon 2; Set B
cggagguccuguugcccaaguu

SEQ ID NO: 64178 - RNA, 18 nt, Artificial Sequence
  Synthetic Oligonucleotide; LAG exon 2; Set C
gagguccuguugcccaag

SEQ ID NO: 64179 - RNA, 28 nt, Artificial Sequence
  Synthetic Oligonucleotide; LAG exon 2; Set C
auucggagguccuguugcccaaguuugg

SEQ ID NO: 64180 - RNA, 26 nt, Artificial Sequence
  Synthetic Oligonucleotide; LAG exon 2; Set B
uucggagguccuguugcccaaguuug

SEQ ID NO: 64181 - RNA, 23 nt, Artificial Sequence
  Synthetic Oligonucleotide; LAG exon 2; Set B
ucggagguccuguugcccaaguu

SEQ ID NO: 64182 - RNA, 21 nt, Artificial Sequence
  Synthetic Oligonucleotide; LAG exon 2; Set B
cggagguccuguugcccaagu

SEQ ID NO: 64183 - RNA, 19 nt, Artificial Sequence
  Synthetic Oligonucleotide; LAG exon 2; Set B
ggagguccuguugcccaag

SEQ ID NO: 64184 - RNA, 27 nt, Artificial Sequence
  Synthetic Oligonucleotide; LAG exon 2; Set B
auucggagguccuguugcccaaguuug

SEQ ID NO: 64185 - RNA, 22 nt, Artificial Sequence
  Synthetic Oligonucleotide; LAG exon 2; Set B
ucggagguccuguugcccaagu

SEQ ID NO: 64186 - RNA, 20 nt, Artificial Sequence
  Synthetic Oligonucleotide; LAG exon 2; Set B
cggagguccuguugcccaag

SEQ ID NO: 64187 - RNA, 21 nt, Artificial Sequence
  Synthetic Oligonucleotide; LAG exon 2; Set B
ucggagguccuguugcccaag

SEQ ID NO: 64188 - RNA, 22 nt, Artificial Sequence
  Synthetic Oligonucleotide; LAG exon 2; Set B
uucggagguccuguugcccaag

SEQ ID NO: 64189 - RNA, 23 nt, Artificial Sequence
  Synthetic Oligonucleotide; LAG exon 2; Set B
auucggagguccuguugcccaag

SEQ ID NO: 64190 - RNA, 37 nt, Artificial Sequence
  Synthetic Oligonucleotide; LAG exon 2; Set C
gagugcuggauucggagguccuguugcccaaguuugg

SEQ ID NO: 64191 - RNA, 34 nt, Artificial Sequence
  Synthetic Oligonucleotide; LAG exon 2; Set C
agugcuggauucggagguccuguugcccaaguuu

SEQ ID NO: 64192 - RNA, 38 nt, Artificial Sequence
  Synthetic Oligonucleotide; LAG exon 2; Set C
ugagugcuggauucggagguccuguugcccaaguuugg

SEQ ID NO: 64193 - RNA, 36 nt, Artificial Sequence
  Synthetic Oligonucleotide; LAG exon 2; Set C
gagugcuggauucggagguccuguugcccaaguuug

SEQ ID NO: 64194 - RNA, 33 nt, Artificial Sequence
  Synthetic Oligonucleotide; LAG exon 2; Set C
agugcuggauucggagguccuguugcccaaguu

SEQ ID NO: 64195 - RNA, 39 nt, Artificial Sequence
  Synthetic Oligonucleotide; LAG exon 2; Set C
uugagugcuggauucggagguccuguugcccaaguuugg

SEQ ID NO: 64196 - RNA, 37 nt, Artificial Sequence
  Synthetic Oligonucleotide; LAG exon 2; Set C
ugagugcuggauucggagguccuguugcccaaguuug

SEQ ID NO: 64197 - RNA, 32 nt, Artificial Sequence
  Synthetic Oligonucleotide; LAG exon 2; Set C
agugcuggauucggagguccuguugcccaagu

SEQ ID NO: 64198 - RNA, 40 nt, Artificial Sequence
  Synthetic Oligonucleotide; LAG exon 2; Set C
guugagugcuggauucggagguccuguugcccaaguuugg

SEQ ID NO: 64199 - RNA, 38 nt, Artificial Sequence
  Synthetic Oligonucleotide; LAG exon 2; Set C
uugagugcuggauucggagguccuguugcccaaguuug

SEQ ID NO: 64200 - RNA, 31 nt, Artificial Sequence
  Synthetic Oligonucleotide; LAG exon 2; Set C
agugcuggauucggagguccuguugcccaag

SEQ ID NO: 64201 - RNA, 39 nt, Artificial Sequence
  Synthetic Oligonucleotide; LAG exon 2; Set C
guugagugcuggauucggagguccuguugcccaaguuug

SEQ ID NO: 64202 - RNA, 32 nt, Artificial Sequence
  Synthetic Oligonucleotide; LAG exon 2; Set C
gagugcuggauucggagguccuguugcccaag

SEQ ID NO: 64203 - RNA, 40 nt, Artificial Sequence
  Synthetic Oligonucleotide; LAG exon 2; Set C
gguugagugcuggauucggagguccuguugcccaaguuug

SEQ ID NO: 64204 - RNA, 21 nt, Artificial Sequence
  Synthetic Oligonucleotide; LAG exon 2; Set B
gcuggauucggagguccuguu

SEQ ID NO: 64205 - RNA, 22 nt, Artificial Sequence
  Synthetic Oligonucleotide; LAG exon 2; Set B
ugcuggauucggagguccuguu

SEQ ID NO: 64206 - RNA, 21 nt, Artificial Sequence
  Synthetic Oligonucleotide; LAG exon 2; Set B
ugcuggauucggagguccugu

SEQ ID NO: 64207 - RNA, 23 nt, Artificial Sequence
  Synthetic Oligonucleotide; LAG exon 2; Set B
gugcuggauucggagguccuguu

SEQ ID NO: 64208 - RNA, 25 nt, Artificial Sequence
  Synthetic Oligonucleotide; LAG exon 2; Set B
agugcuggauucggagguccuguug

SEQ ID NO: 64209 - RNA, 22 nt, Artificial Sequence
  Synthetic Oligonucleotide; LAG exon 2; Set B
gugcuggauucggagguccugu

SEQ ID NO: 64210 - RNA, 24 nt, Artificial Sequence
  Synthetic Oligonucleotide; LAG exon 2; Set B
agugcuggauucggagguccuguu

SEQ ID NO: 64211 - RNA, 26 nt, Artificial Sequence
  Synthetic Oligonucleotide; LAG exon 2; Set C
gagugcuggauucggagguccuguug

SEQ ID NO: 64212 - RNA, 23 nt, Artificial Sequence
  Synthetic Oligonucleotide; LAG exon 2; Set B
agugcuggauucggagguccugu

SEQ ID NO: 64213 - RNA, 15 nt, Artificial Sequence
  Synthetic Oligonucleotide; LAG exon 2; Set C
ugcuggauucggagg

SEQ ID NO: 64214 - RNA, 16 nt, Artificial Sequence
  Synthetic Oligonucleotide; LAG exon 2; Set C
gugcuggauucggagg

SEQ ID NO: 64215 - RNA, 15 nt, Artificial Sequence
  Synthetic Oligonucleotide; LAG exon 2; Set C
gugcuggauucggag

SEQ ID NO: 64216 - RNA, 17 nt, Artificial Sequence
  Synthetic Oligonucleotide; LAG exon 2; Set A
agggggcgugagccgag

SEQ ID NO: 64217 - RNA, 24 nt, Artificial Sequence
  Synthetic Oligonucleotide; LAG exon 2; Set C
aaggggagggggcgugagccgaga

SEQ ID NO: 64218 - RNA, 23 nt, Artificial Sequence
  Synthetic Oligonucleotide; LAG exon 2; Set C
aaggggagggggcgugagccgag

SEQ ID NO: 64219 - RNA, 25 nt, Artificial Sequence
  Synthetic Oligonucleotide; LAG exon 2; Set C
caaggggagggggcgugagccgaga

SEQ ID NO: 64220 - RNA, 29 nt, Artificial Sequence
  Synthetic Oligonucleotide; LAG exon 2; Set C
gaggccaaggggagggggcgugagccgag

SEQ ID NO: 64221 - RNA, 17 nt, Artificial Sequence
  Synthetic Oligonucleotide; LAG exon 2; Set A
aaggggagggggcguga

SEQ ID NO: 64222 - RNA, 30 nt, Artificial Sequence
  Synthetic Oligonucleotide; LAG exon 2; Set C
agaggccaaggggagggggcgugagccgag

SEQ ID NO: 64223 - RNA, 16 nt, Artificial Sequence
  Synthetic Oligonucleotide; LAG exon 2; Set A
aaggggagggggcgug

SEQ ID NO: 64224 - RNA, 32 nt, Artificial Sequence
  Synthetic Oligonucleotide; LAG exon 2; Set C
gagaggccaaggggagggggcgugagccgaga

SEQ ID NO: 64225 - RNA, 15 nt, Artificial Sequence
  Synthetic Oligonucleotide; LAG exon 2; Set A
aaggggagggggcgu

SEQ ID NO: 64226 - RNA, 16 nt, Artificial Sequence
  Synthetic Oligonucleotide; LAG exon 2; Set A
caaggggagggggcgu

SEQ ID NO: 64227 - RNA, 23 nt, Artificial Sequence
  Synthetic Oligonucleotide; LAG exon 2; Set C
gaggccaaggggagggggcguga

SEQ ID NO: 64228 - RNA, 22 nt, Artificial Sequence
  Synthetic Oligonucleotide; LAG exon 2; Set C
gaggccaaggggagggggcgug

SEQ ID NO: 64229 - RNA, 24 nt, Artificial Sequence
  Synthetic Oligonucleotide; LAG exon 2; Set C
agaggccaaggggagggggcguga

SEQ ID NO: 64230 - RNA, 23 nt, Artificial Sequence
  Synthetic Oligonucleotide; LAG exon 2; Set C
agaggccaaggggagggggcgug

SEQ ID NO: 64231 - RNA, 23 nt, Artificial Sequence
  Synthetic Oligonucleotide; LAG exon 2; Set C
gagaggccaaggggagggggcgu

SEQ ID NO: 64232 - RNA, 24 nt, Artificial Sequence
  Synthetic Oligonucleotide; LAG exon 2; Set C
agagaggccaaggggagggggcgu

SEQ ID NO: 64233 - RNA, 25 nt, Artificial Sequence
  Synthetic Oligonucleotide; LAG exon 2; Set C
aagagaggccaaggggagggggcgu

SEQ ID NO: 64234 - RNA, 26 nt, Artificial Sequence
  Synthetic Oligonucleotide; LAG exon 2; Set C
aaagagaggccaaggggagggggcgu

SEQ ID NO: 64235 - RNA, 26 nt, Artificial Sequence
  Synthetic Oligonucleotide; LAG exon 2; Set C
aaaagagaggccaaggggagggggcg

SEQ ID NO: 64236 - RNA, 15 nt, Artificial Sequence
  Synthetic Oligonucleotide; LAG exon 2; Set C
agaggccaaggggag

SEQ ID NO: 64237 - RNA, 17 nt, Artificial Sequence
  Synthetic Oligonucleotide; LAG exon 2; Set A
gagaggccaaggggagg

SEQ ID NO: 64238 - RNA, 18 nt, Artificial Sequence
  Synthetic Oligonucleotide; LAG exon 2; Set A
agagaggccaaggggagg

SEQ ID NO: 64239 - RNA, 19 nt, Artificial Sequence
  Synthetic Oligonucleotide; LAG exon 2; Set C
aagagaggccaaggggagg

SEQ ID NO: 64240 - RNA, 20 nt, Artificial Sequence
  Synthetic Oligonucleotide; LAG exon 2; Set C
aaagagaggccaaggggagg

SEQ ID NO: 64241 - RNA, 21 nt, Artificial Sequence
  Synthetic Oligonucleotide; LAG exon 2; Set C
aaaagagaggccaaggggagg

SEQ ID NO: 64242 - RNA, 35 nt, Artificial Sequence
  Synthetic Oligonucleotide; LAG exon 2; Set C
uaggugagcaaaagagaggccaaggggagggggcg

SEQ ID NO: 64243 - RNA, 30 nt, Artificial Sequence
  Synthetic Oligonucleotide; LAG exon 2; Set C
uaggugagcaaaagagaggccaaggggagg

SEQ ID NO: 64244 - RNA, 24 nt, Artificial Sequence
  Synthetic Oligonucleotide; LAG exon 2; Set C
uaggugagcaaaagagaggccaag

SEQ ID NO: 64245 - RNA, 35 nt, Artificial Sequence
  Synthetic Oligonucleotide; LAG exon 2; Set C
cuucacuaggugagcaaaagagaggccaaggggag

SEQ ID NO: 64246 - RNA, 34 nt, Artificial Sequence
  Synthetic Oligonucleotide; LAG exon 2; Set C
cuucacuaggugagcaaaagagaggccaagggga

SEQ ID NO: 64247 - RNA, 40 nt, Artificial Sequence
  Synthetic Oligonucleotide; LAG exon 2; Set C
gaggcuucacuaggugagcaaaagagaggccaaggggagg

SEQ ID NO: 64248 - RNA, 34 nt, Artificial Sequence
  Synthetic Oligonucleotide; LAG exon 2; Set C
gaggcuucacuaggugagcaaaagagaggccaag

SEQ ID NO: 64249 - RNA, 33 nt, Artificial Sequence
  Synthetic Oligonucleotide; LAG exon 2; Set C
gaggcuucacuaggugagcaaaagagaggccaa

SEQ ID NO: 64250 - RNA, 35 nt, Artificial Sequence
  Synthetic Oligonucleotide; LAG exon 2; Set C
agaggcuucacuaggugagcaaaagagaggccaag

SEQ ID NO: 64251 - RNA, 34 nt, Artificial Sequence
  Synthetic Oligonucleotide; LAG exon 2; Set C
agaggcuucacuaggugagcaaaagagaggccaa

SEQ ID NO: 64252 - RNA, 36 nt, Artificial Sequence
  Synthetic Oligonucleotide; LAG exon 2; Set C
gagaggcuucacuaggugagcaaaagagaggccaag

SEQ ID NO: 64253 - RNA, 35 nt, Artificial Sequence
  Synthetic Oligonucleotide; LAG exon 2; Set C
gagaggcuucacuaggugagcaaaagagaggccaa

SEQ ID NO: 64254 - RNA, 37 nt, Artificial Sequence
  Synthetic Oligonucleotide; LAG exon 2; Set C
ggagaggcuucacuaggugagcaaaagagaggccaag

SEQ ID NO: 64255 - RNA, 22 nt, Artificial Sequence
  Synthetic Oligonucleotide; LAG exon 2; Set C
cuucacuaggugagcaaaagag

SEQ ID NO: 64256 - RNA, 36 nt, Artificial Sequence
  Synthetic Oligonucleotide; LAG exon 2; Set C
ggagaggcuucacuaggugagcaaaagagaggccaa

SEQ ID NO: 64257 - RNA, 38 nt, Artificial Sequence
  Synthetic Oligonucleotide; LAG exon 2; Set C
uggagaggcuucacuaggugagcaaaagagaggccaag

SEQ ID NO: 64258 - RNA, 37 nt, Artificial Sequence
  Synthetic Oligonucleotide; LAG exon 2; Set C
uggagaggcuucacuaggugagcaaaagagaggccaa

SEQ ID NO: 64259 - RNA, 28 nt, Artificial Sequence
  Synthetic Oligonucleotide; LAG exon 2; Set A
gaggcuucacuaggugagcaaaagagag

SEQ ID NO: 64260 - RNA, 29 nt, Artificial Sequence
  Synthetic Oligonucleotide; LAG exon 2; Set A
agaggcuucacuaggugagcaaaagagag

SEQ ID NO: 64261 - RNA, 27 nt, Artificial Sequence
  Synthetic Oligonucleotide; LAG exon 2; Set A
gaggcuucacuaggugagcaaaagaga

SEQ ID NO: 64262 - RNA, 18 nt, Artificial Sequence
  Synthetic Oligonucleotide; LAG exon 2; Set C
cuucacuaggugagcaaa

SEQ ID NO: 64263 - RNA, 30 nt, Artificial Sequence
  Synthetic Oligonucleotide; LAG exon 2; Set A
gagaggcuucacuaggugagcaaaagagag

SEQ ID NO: 64264 - RNA, 28 nt, Artificial Sequence
  Synthetic Oligonucleotide; LAG exon 2; Set A
agaggcuucacuaggugagcaaaagaga

SEQ ID NO: 64265 - RNA, 31 nt, Artificial Sequence
  Synthetic Oligonucleotide; LAG exon 2; Set A
ggagaggcuucacuaggugagcaaaagagag

SEQ ID NO: 64266 - RNA, 29 nt, Artificial Sequence
  Synthetic Oligonucleotide; LAG exon 2; Set A
gagaggcuucacuaggugagcaaaagaga

SEQ ID NO: 64267 - RNA, 24 nt, Artificial Sequence
  Synthetic Oligonucleotide; LAG exon 2; Set A
gaggcuucacuaggugagcaaaag

SEQ ID NO: 64268 - RNA, 32 nt, Artificial Sequence
  Synthetic Oligonucleotide; LAG exon 2; Set A
uggagaggcuucacuaggugagcaaaagagag

SEQ ID NO: 64269 - RNA, 30 nt, Artificial Sequence
  Synthetic Oligonucleotide; LAG exon 2; Set A
ggagaggcuucacuaggugagcaaaagaga

SEQ ID NO: 64270 - RNA, 23 nt, Artificial Sequence
  Synthetic Oligonucleotide; LAG exon 2; Set A
gaggcuucacuaggugagcaaaa

SEQ ID NO: 64271 - RNA, 31 nt, Artificial Sequence
  Synthetic Oligonucleotide; LAG exon 2; Set C
uggagaggcuucacuaggugagcaaaagaga

SEQ ID NO: 64272 - RNA, 34 nt, Artificial Sequence
  Synthetic Oligonucleotide; LAG exon 2; Set C
ggaccucagccccuggcuggagaggcuucacuag

SEQ ID NO: 64273 - RNA, 35 nt, Artificial Sequence
  Synthetic Oligonucleotide; LAG exon 2; Set C
gggaccucagccccuggcuggagaggcuucacuag

SEQ ID NO: 64274 - RNA, 24 nt, Artificial Sequence
  Synthetic Oligonucleotide; LAG exon 2; Set C
ggaccucagccccuggcuggagag

SEQ ID NO: 64275 - RNA, 23 nt, Artificial Sequence
  Synthetic Oligonucleotide; LAG exon 2; Set C
ggaccucagccccuggcuggaga

SEQ ID NO: 64276 - RNA, 25 nt, Artificial Sequence
  Synthetic Oligonucleotide; LAG exon 2; Set C
gggaccucagccccuggcuggagag

SEQ ID NO: 64277 - RNA, 24 nt, Artificial Sequence
  Synthetic Oligonucleotide; LAG exon 2; Set C
gggaccucagccccuggcuggaga

SEQ ID NO: 64278 - RNA, 22 nt, Artificial Sequence
  Synthetic Oligonucleotide; LAG exon 2; Set C
ggaccucagccccuggcuggag

SEQ ID NO: 64279 - RNA, 21 nt, Artificial Sequence
  Synthetic Oligonucleotide; LAG exon 2; Set C
ggaccucagccccuggcugga

SEQ ID NO: 64280 - RNA, 23 nt, Artificial Sequence
  Synthetic Oligonucleotide; LAG exon 2; Set C
gggaccucagccccuggcuggag

SEQ ID NO: 64281 - RNA, 22 nt, Artificial Sequence
  Synthetic Oligonucleotide; LAG exon 2; Set C
gggaccucagccccuggcugga

SEQ ID NO: 64282 - RNA, 21 nt, Artificial Sequence
  Synthetic Oligonucleotide; LAG exon 2; Set C
gggaccucagccccuggcugg

SEQ ID NO: 64283 - RNA, 24 nt, Artificial Sequence
  Synthetic Oligonucleotide; LAG exon 2; Set C
gcugcaggggagcugggcaggagc

SEQ ID NO: 64284 - RNA, 25 nt, Artificial Sequence
  Synthetic Oligonucleotide; LAG exon 2; Set C
ggcugcaggggagcugggcaggagc

SEQ ID NO: 64285 - RNA, 24 nt, Artificial Sequence
  Synthetic Oligonucleotide; LAG exon 2; Set C
ggcugcaggggagcugggcaggag

SEQ ID NO: 64286 - RNA, 26 nt, Artificial Sequence
  Synthetic Oligonucleotide; LAG exon 2; Set C
gggcugcaggggagcugggcaggagc

SEQ ID NO: 64287 - RNA, 25 nt, Artificial Sequence
  Synthetic Oligonucleotide; LAG exon 2; Set C
gggcugcaggggagcugggcaggag

SEQ ID NO: 64288 - RNA, 27 nt, Artificial Sequence
  Synthetic Oligonucleotide; LAG exon 2; Set C
ggggcugcaggggagcugggcaggagc

SEQ ID NO: 64289 - RNA, 26 nt, Artificial Sequence
  Synthetic Oligonucleotide; LAG exon 2; Set C
ggggcugcaggggagcugggcaggag

SEQ ID NO: 64290 - RNA, 28 nt, Artificial Sequence
  Synthetic Oligonucleotide; LAG exon 2; Set C
uggggcugcaggggagcugggcaggagc

SEQ ID NO: 64291 - RNA, 27 nt, Artificial Sequence
  Synthetic Oligonucleotide; LAG exon 2; Set C
uggggcugcaggggagcugggcaggag

SEQ ID NO: 64292 - RNA, 29 nt, Artificial Sequence
  Synthetic Oligonucleotide; LAG exon 2; Set C
guggggcugcaggggagcugggcaggagc

SEQ ID NO: 64293 - RNA, 28 nt, Artificial Sequence
  Synthetic Oligonucleotide; LAG exon 2; Set C
guggggcugcaggggagcugggcaggag

SEQ ID NO: 64294 - RNA, 30 nt, Artificial Sequence
  Synthetic Oligonucleotide; LAG exon 2; Set C
uguggggcugcaggggagcugggcaggagc

SEQ ID NO: 64295 - RNA, 29 nt, Artificial Sequence
  Synthetic Oligonucleotide; LAG exon 2; Set C
uguggggcugcaggggagcugggcaggag

SEQ ID NO: 64296 - RNA, 31 nt, Artificial Sequence
  Synthetic Oligonucleotide; LAG exon 2; Set C
uuguggggcugcaggggagcugggcaggagc

SEQ ID NO: 64297 - RNA, 30 nt, Artificial Sequence
  Synthetic Oligonucleotide; LAG exon 2; Set C
uuguggggcugcaggggagcugggcaggag

SEQ ID NO: 64298 - RNA, 32 nt, Artificial Sequence
  Synthetic Oligonucleotide; LAG exon 2; Set C
auuguggggcugcaggggagcugggcaggagc

SEQ ID NO: 64299 - RNA, 31 nt, Artificial Sequence
  Synthetic Oligonucleotide; LAG exon 2; Set C
auuguggggcugcaggggagcugggcaggag

SEQ ID NO: 64300 - RNA, 33 nt, Artificial Sequence
  Synthetic Oligonucleotide; LAG exon 2; Set C
gauuguggggcugcaggggagcugggcaggagc

SEQ ID NO: 64301 - RNA, 32 nt, Artificial Sequence
  Synthetic Oligonucleotide; LAG exon 2; Set C
gauuguggggcugcaggggagcugggcaggag

SEQ ID NO: 64302 - RNA, 34 nt, Artificial Sequence
  Synthetic Oligonucleotide; LAG exon 2; Set C
ggauuguggggcugcaggggagcugggcaggagc

SEQ ID NO: 64303 - RNA, 33 nt, Artificial Sequence
  Synthetic Oligonucleotide; LAG exon 2; Set C
ggauuguggggcugcaggggagcugggcaggag

SEQ ID NO: 64304 - RNA, 35 nt, Artificial Sequence
  Synthetic Oligonucleotide; LAG exon 2; Set C
gggauuguggggcugcaggggagcugggcaggagc

SEQ ID NO: 64305 - RNA, 34 nt, Artificial Sequence
  Synthetic Oligonucleotide; LAG exon 2; Set C
gggauuguggggcugcaggggagcugggcaggag

SEQ ID NO: 64306 - RNA, 36 nt, Artificial Sequence
  Synthetic Oligonucleotide; LAG exon 2; Set C
ggggauuguggggcugcaggggagcugggcaggagc

SEQ ID NO: 64307 - RNA, 35 nt, Artificial Sequence
  Synthetic Oligonucleotide; LAG exon 2; Set C
ggggauuguggggcugcaggggagcugggcaggag

SEQ ID NO: 64308 - RNA, 37 nt, Artificial Sequence
  Synthetic Oligonucleotide; LAG exon 2; Set C
gggggauuguggggcugcaggggagcugggcaggagc

SEQ ID NO: 64309 - RNA, 36 nt, Artificial Sequence
  Synthetic Oligonucleotide; LAG exon 2; Set C
gggggauuguggggcugcaggggagcugggcaggag

SEQ ID NO: 64310 - RNA, 38 nt, Artificial Sequence
  Synthetic Oligonucleotide; LAG exon 2; Set C
agggggauuguggggcugcaggggagcugggcaggagc

SEQ ID NO: 64311 - RNA, 37 nt, Artificial Sequence
  Synthetic Oligonucleotide; LAG exon 2; Set C
agggggauuguggggcugcaggggagcugggcaggag

SEQ ID NO: 64312 - RNA, 39 nt, Artificial Sequence
  Synthetic Oligonucleotide; LAG exon 2; Set C
gagggggauuguggggcugcaggggagcugggcaggagc

SEQ ID NO: 64313 - RNA, 15 nt, Artificial Sequence
  Synthetic Oligonucleotide; LAG exon 2; Set A
ggggcugcaggggag

SEQ ID NO: 64314 - RNA, 38 nt, Artificial Sequence
  Synthetic Oligonucleotide; LAG exon 2; Set C
gagggggauuguggggcugcaggggagcugggcaggag

SEQ ID NO: 64315 - RNA, 40 nt, Artificial Sequence
  Synthetic Oligonucleotide; LAG exon 2; Set C
ggagggggauuguggggcugcaggggagcugggcaggagc

SEQ ID NO: 64316 - RNA, 16 nt, Artificial Sequence
  Synthetic Oligonucleotide; LAG exon 2; Set A
uggggcugcaggggag

SEQ ID NO: 64317 - RNA, 39 nt, Artificial Sequence
  Synthetic Oligonucleotide; LAG exon 2; Set C
ggagggggauuguggggcugcaggggagcugggcaggag

SEQ ID NO: 64318 - RNA, 17 nt, Artificial Sequence
  Synthetic Oligonucleotide; LAG exon 2; Set A
guggggcugcaggggag

SEQ ID NO: 64319 - RNA, 15 nt, Artificial Sequence
  Synthetic Oligonucleotide; LAG exon 2; Set A
uggggcugcagggga

SEQ ID NO: 64320 - RNA, 40 nt, Artificial Sequence
  Synthetic Oligonucleotide; LAG exon 2; Set C
uggagggggauuguggggcugcaggggagcugggcaggag

SEQ ID NO: 64321 - RNA, 18 nt, Artificial Sequence
  Synthetic Oligonucleotide; LAG exon 2; Set A
uguggggcugcaggggag

SEQ ID NO: 64322 - RNA, 16 nt, Artificial Sequence
  Synthetic Oligonucleotide; LAG exon 2; Set A
guggggcugcagggga

SEQ ID NO: 64323 - RNA, 19 nt, Artificial Sequence
  Synthetic Oligonucleotide; LAG exon 2; Set A
uuguggggcugcaggggag

SEQ ID NO: 64324 - RNA, 17 nt, Artificial Sequence
  Synthetic Oligonucleotide; LAG exon 2; Set A
uguggggcugcagggga

SEQ ID NO: 64325 - RNA, 20 nt, Artificial Sequence
  Synthetic Oligonucleotide; LAG exon 2; Set A
auuguggggcugcaggggag

SEQ ID NO: 64326 - RNA, 18 nt, Artificial Sequence
  Synthetic Oligonucleotide; LAG exon 2; Set A
uuguggggcugcagggga

SEQ ID NO: 64327 - RNA, 21 nt, Artificial Sequence
  Synthetic Oligonucleotide; LAG exon 2; Set C
gauuguggggcugcaggggag

SEQ ID NO: 64328 - RNA, 19 nt, Artificial Sequence
  Synthetic Oligonucleotide; LAG exon 2; Set A
auuguggggcugcagggga

SEQ ID NO: 64329 - RNA, 22 nt, Artificial Sequence
  Synthetic Oligonucleotide; LAG exon 2; Set C
ggauuguggggcugcaggggag

SEQ ID NO: 64330 - RNA, 20 nt, Artificial Sequence
  Synthetic Oligonucleotide; LAG exon 2; Set C
gauuguggggcugcagggga

SEQ ID NO: 64331 - RNA, 23 nt, Artificial Sequence
  Synthetic Oligonucleotide; LAG exon 2; Set C
gggauuguggggcugcaggggag

SEQ ID NO: 64332 - RNA, 21 nt, Artificial Sequence
  Synthetic Oligonucleotide; LAG exon 2; Set C
ggauuguggggcugcagggga

SEQ ID NO: 64333 - RNA, 15 nt, Artificial Sequence
  Synthetic Oligonucleotide; LAG exon 2; Set C
uuguggggcugcagg

SEQ ID NO: 64334 - RNA, 24 nt, Artificial Sequence
  Synthetic Oligonucleotide; LAG exon 2; Set C
ggggauuguggggcugcaggggag

SEQ ID NO: 64335 - RNA, 22 nt, Artificial Sequence
  Synthetic Oligonucleotide; LAG exon 2; Set C
gggauuguggggcugcagggga

SEQ ID NO: 64336 - RNA, 16 nt, Artificial Sequence
  Synthetic Oligonucleotide; LAG exon 2; Set C
auuguggggcugcagg

SEQ ID NO: 64337 - RNA, 25 nt, Artificial Sequence
  Synthetic Oligonucleotide; LAG exon 2; Set C
gggggauuguggggcugcaggggag

SEQ ID NO: 64338 - RNA, 23 nt, Artificial Sequence
  Synthetic Oligonucleotide; LAG exon 2; Set C
ggggauuguggggcugcagggga

SEQ ID NO: 64339 - RNA, 17 nt, Artificial Sequence
  Synthetic Oligonucleotide; LAG exon 2; Set A
gauuguggggcugcagg

SEQ ID NO: 64340 - RNA, 26 nt, Artificial Sequence
  Synthetic Oligonucleotide; LAG exon 2; Set C
agggggauuguggggcugcaggggag

SEQ ID NO: 64341 - RNA, 24 nt, Artificial Sequence
  Synthetic Oligonucleotide; LAG exon 2; Set C
gggggauuguggggcugcagggga

SEQ ID NO: 64342 - RNA, 18 nt, Artificial Sequence
  Synthetic Oligonucleotide; LAG exon 2; Set A
ggauuguggggcugcagg

SEQ ID NO: 64343 - RNA, 27 nt, Artificial Sequence
  Synthetic Oligonucleotide; LAG exon 2; Set C
gagggggauuguggggcugcaggggag

SEQ ID NO: 64344 - RNA, 25 nt, Artificial Sequence
  Synthetic Oligonucleotide; LAG exon 2; Set C
agggggauuguggggcugcagggga

SEQ ID NO: 64345 - RNA, 19 nt, Artificial Sequence
  Synthetic Oligonucleotide; LAG exon 2; Set A
gggauuguggggcugcagg

SEQ ID NO: 64346 - RNA, 28 nt, Artificial Sequence
  Synthetic Oligonucleotide; LAG exon 2; Set C
ggagggggauuguggggcugcaggggag

SEQ ID NO: 64347 - RNA, 26 nt, Artificial Sequence
  Synthetic Oligonucleotide; LAG exon 2; Set C
gagggggauuguggggcugcagggga

SEQ ID NO: 64348 - RNA, 20 nt, Artificial Sequence
  Synthetic Oligonucleotide; LAG exon 2; Set C
ggggauuguggggcugcagg

SEQ ID NO: 64349 - RNA, 29 nt, Artificial Sequence
  Synthetic Oligonucleotide; LAG exon 2; Set C
uggagggggauuguggggcugcaggggag

SEQ ID NO: 64350 - RNA, 27 nt, Artificial Sequence
  Synthetic Oligonucleotide; LAG exon 2; Set C
ggagggggauuguggggcugcagggga

SEQ ID NO: 64351 - RNA, 21 nt, Artificial Sequence
  Synthetic Oligonucleotide; LAG exon 2; Set C
gggggauuguggggcugcagg

SEQ ID NO: 64352 - RNA, 28 nt, Artificial Sequence
  Synthetic Oligonucleotide; LAG exon 2; Set C
uggagggggauuguggggcugcagggga

SEQ ID NO: 64353 - RNA, 22 nt, Artificial Sequence
  Synthetic Oligonucleotide; LAG exon 2; Set C
agggggauuguggggcugcagg

SEQ ID NO: 64354 - RNA, 23 nt, Artificial Sequence
  Synthetic Oligonucleotide; LAG exon 2; Set C
gagggggauuguggggcugcagg

SEQ ID NO: 64355 - RNA, 38 nt, Artificial Sequence
  Synthetic Oligonucleotide; LAG exon 2; Set C
agauccuggagggggauuguggggcugcaggggagcug

SEQ ID NO: 64356 - RNA, 24 nt, Artificial Sequence
  Synthetic Oligonucleotide; LAG exon 2; Set C
ggagggggauuguggggcugcagg

SEQ ID NO: 64357 - RNA, 37 nt, Artificial Sequence
  Synthetic Oligonucleotide; LAG exon 2; Set C
agauccuggagggggauuguggggcugcaggggagcu

SEQ ID NO: 64358 - RNA, 25 nt, Artificial Sequence
  Synthetic Oligonucleotide; LAG exon 2; Set C
uggagggggauuguggggcugcagg

SEQ ID NO: 64359 - RNA, 36 nt, Artificial Sequence
  Synthetic Oligonucleotide; LAG exon 2; Set C
agauccuggagggggauuguggggcugcaggggagc

SEQ ID NO: 64360 - RNA, 36 nt, Artificial Sequence
  Synthetic Oligonucleotide; LAG exon 2; Set C
gagauccuggagggggauuguggggcugcaggggag

SEQ ID NO: 64361 - RNA, 37 nt, Artificial Sequence
  Synthetic Oligonucleotide; LAG exon 2; Set C
ugagauccuggagggggauuguggggcugcaggggag

SEQ ID NO: 64362 - RNA, 35 nt, Artificial Sequence
  Synthetic Oligonucleotide; LAG exon 2; Set C
gagauccuggagggggauuguggggcugcagggga

SEQ ID NO: 64363 - RNA, 38 nt, Artificial Sequence
  Synthetic Oligonucleotide; LAG exon 2; Set C
cugagauccuggagggggauuguggggcugcaggggag

SEQ ID NO: 64364 - RNA, 36 nt, Artificial Sequence
  Synthetic Oligonucleotide; LAG exon 2; Set C
ugagauccuggagggggauuguggggcugcagggga

SEQ ID NO: 64365 - RNA, 39 nt, Artificial Sequence
  Synthetic Oligonucleotide; LAG exon 2; Set C
gcugagauccuggagggggauuguggggcugcaggggag

SEQ ID NO: 64366 - RNA, 37 nt, Artificial Sequence
  Synthetic Oligonucleotide; LAG exon 2; Set C
cugagauccuggagggggauuguggggcugcagggga

SEQ ID NO: 64367 - RNA, 38 nt, Artificial Sequence
  Synthetic Oligonucleotide; LAG exon 2; Set C
gcugagauccuggagggggauuguggggcugcagggga

SEQ ID NO: 64368 - RNA, 33 nt, Artificial Sequence
  Synthetic Oligonucleotide; LAG exon 2; Set C
ugagauccuggagggggauuguggggcugcagg

SEQ ID NO: 64369 - RNA, 27 nt, Artificial Sequence
  Synthetic Oligonucleotide; LAG exon 2; Set C
agauccuggagggggauuguggggcug

SEQ ID NO: 64370 - RNA, 26 nt, Artificial Sequence
  Synthetic Oligonucleotide; LAG exon 2; Set C
agauccuggagggggauuguggggcu

SEQ ID NO: 64371 - RNA, 25 nt, Artificial Sequence
  Synthetic Oligonucleotide; LAG exon 2; Set C
agauccuggagggggauuguggggc

SEQ ID NO: 64372 - RNA, 24 nt, Artificial Sequence
  Synthetic Oligonucleotide; LAG exon 2; Set C
agauccuggagggggauugugggg

SEQ ID NO: 64373 - RNA, 23 nt, Artificial Sequence
  Synthetic Oligonucleotide; LAG exon 2; Set A
agauccuggagggggauuguggg

SEQ ID NO: 64374 - RNA, 22 nt, Artificial Sequence
  Synthetic Oligonucleotide; LAG exon 2; Set A
agauccuggagggggauugugg

SEQ ID NO: 64375 - RNA, 21 nt, Artificial Sequence
  Synthetic Oligonucleotide; LAG exon 2; Set A
agauccuggagggggauugug

SEQ ID NO: 64376 - RNA, 20 nt, Artificial Sequence
  Synthetic Oligonucleotide; LAG exon 2; Set A
agauccuggagggggauugu

SEQ ID NO: 64377 - RNA, 19 nt, Artificial Sequence
  Synthetic Oligonucleotide; LAG exon 2; Set C
agauccuggagggggauug

SEQ ID NO: 64378 - RNA, 18 nt, Artificial Sequence
  Synthetic Oligonucleotide; LAG exon 2; Set C
agauccuggagggggauu

SEQ ID NO: 64379 - RNA, 17 nt, Artificial Sequence
  Synthetic Oligonucleotide; LAG exon 2; Set C
agauccuggagggggau

SEQ ID NO: 64380 - RNA, 16 nt, Artificial Sequence
  Synthetic Oligonucleotide; LAG exon 2; Set C
agauccuggaggggga

SEQ ID NO: 64381 - RNA, 15 nt, Artificial Sequence
  Synthetic Oligonucleotide; LAG exon 2; Set C
agauccuggaggggg

SEQ ID NO: 64382 - RNA, 36 nt, Artificial Sequence
  Synthetic Oligonucleotide; LAG exon 2; Set C
cugcucuucgcagaaggcugagauccuggaggggga

SEQ ID NO: 64383 - RNA, 35 nt, Artificial Sequence
  Synthetic Oligonucleotide; LAG exon 2; Set C
cugcucuucgcagaaggcugagauccuggaggggg

SEQ ID NO: 64384 - RNA, 34 nt, Artificial Sequence
  Synthetic Oligonucleotide; LAG exon 2; Set C
cugcucuucgcagaaggcugagauccuggagggg

SEQ ID NO: 64385 - RNA, 33 nt, Artificial Sequence
  Synthetic Oligonucleotide; LAG exon 2; Set C
cugcucuucgcagaaggcugagauccuggaggg

SEQ ID NO: 64386 - RNA, 32 nt, Artificial Sequence
  Synthetic Oligonucleotide; LAG exon 2; Set C
cugcucuucgcagaaggcugagauccuggagg

SEQ ID NO: 64387 - RNA, 31 nt, Artificial Sequence
  Synthetic Oligonucleotide; LAG exon 2; Set C
cugcucuucgcagaaggcugagauccuggag

SEQ ID NO: 64388 - RNA, 15 nt, Artificial Sequence
  Synthetic Oligonucleotide; LAG exon 2; Set C
cgcagaaggcugaga

SEQ ID NO: 64389 - RNA, 30 nt, Artificial Sequence
  Synthetic Oligonucleotide; LAG exon 2; Set C
cugcucuucgcagaaggcugagauccugga

SEQ ID NO: 64390 - RNA, 16 nt, Artificial Sequence
  Synthetic Oligonucleotide; LAG exon 2; Set C
ucgcagaaggcugaga

SEQ ID NO: 64391 - RNA, 29 nt, Artificial Sequence
  Synthetic Oligonucleotide; LAG exon 2; Set C
cugcucuucgcagaaggcugagauccugg

SEQ ID NO: 64392 - RNA, 17 nt, Artificial Sequence
  Synthetic Oligonucleotide; LAG exon 2; Set C
uucgcagaaggcugaga

SEQ ID NO: 64393 - RNA, 22 nt, Artificial Sequence
  Synthetic Oligonucleotide; LAG exon 2; Set A
cugcucuucgcagaaggcugag

SEQ ID NO: 64394 - RNA, 20 nt, Artificial Sequence
  Synthetic Oligonucleotide; LAG exon 2; Set A
cugcucuucgcagaaggcug

SEQ ID NO: 64395 - RNA, 19 nt, Artificial Sequence
  Synthetic Oligonucleotide; LAG exon 2; Set A
cugcucuucgcagaaggcu

SEQ ID NO: 64396 - RNA, 25 nt, Artificial Sequence
  Synthetic Oligonucleotide; LAG exon 2; Set C
augcugccaagugaccccugcucuu

SEQ ID NO: 64397 - RNA, 26 nt, Artificial Sequence
  Synthetic Oligonucleotide; LAG exon 2; Set C
gaugcugccaagugaccccugcucuu

SEQ ID NO: 64398 - RNA, 24 nt, Artificial Sequence
  Synthetic Oligonucleotide; LAG exon 2; Set C
augcugccaagugaccccugcucu

SEQ ID NO: 64399 - RNA, 27 nt, Artificial Sequence
  Synthetic Oligonucleotide; LAG exon 2; Set C
ugaugcugccaagugaccccugcucuu

SEQ ID NO: 64400 - RNA, 25 nt, Artificial Sequence
  Synthetic Oligonucleotide; LAG exon 2; Set C
gaugcugccaagugaccccugcucu

SEQ ID NO: 64401 - RNA, 26 nt, Artificial Sequence
  Synthetic Oligonucleotide; LAG exon 2; Set C
ugaugcugccaagugaccccugcucu

SEQ ID NO: 64402 - RNA, 33 nt, Artificial Sequence
  Synthetic Oligonucleotide; LAG exon 2; Set C
ucuggcugaugcugccaagugaccccugcucuu

SEQ ID NO: 64403 - RNA, 34 nt, Artificial Sequence
  Synthetic Oligonucleotide; LAG exon 2; Set C
gucuggcugaugcugccaagugaccccugcucuu

SEQ ID NO: 64404 - RNA, 32 nt, Artificial Sequence
  Synthetic Oligonucleotide; LAG exon 2; Set C
ucuggcugaugcugccaagugaccccugcucu

SEQ ID NO: 64405 - RNA, 35 nt, Artificial Sequence
  Synthetic Oligonucleotide; LAG exon 2; Set C
ugucuggcugaugcugccaagugaccccugcucuu

SEQ ID NO: 64406 - RNA, 33 nt, Artificial Sequence
  Synthetic Oligonucleotide; LAG exon 2; Set C
gucuggcugaugcugccaagugaccccugcucu

SEQ ID NO: 64407 - RNA, 34 nt, Artificial Sequence
  Synthetic Oligonucleotide; LAG exon 2; Set C
ugucuggcugaugcugccaagugaccccugcucu

SEQ ID NO: 64408 - RNA, 40 nt, Artificial Sequence
  Synthetic Oligonucleotide; LAG exon 2; Set C
auaccugucuggcugaugcugccaagugaccccugcucuu

SEQ ID NO: 64409 - RNA, 39 nt, Artificial Sequence
  Synthetic Oligonucleotide; LAG exon 2; Set C
auaccugucuggcugaugcugccaagugaccccugcucu

SEQ ID NO: 64410 - RNA, 35 nt, Artificial Sequence
  Synthetic Oligonucleotide; LAG exon 2; Set C
gggugcauaccugucuggcugaugcugccaaguga

SEQ ID NO: 64411 - RNA, 37 nt, Artificial Sequence
  Synthetic Oligonucleotide; LAG exon 2; Set C
uggggugcauaccugucuggcugaugcugccaaguga

SEQ ID NO: 64412 - RNA, 38 nt, Artificial Sequence
  Synthetic Oligonucleotide; LAG exon 2; Set C
uuggggugcauaccugucuggcugaugcugccaaguga

SEQ ID NO: 64413 - RNA, 22 nt, Artificial Sequence
  Synthetic Oligonucleotide; LAG exon 2; Set B
ggugcauaccugucuggcugau

SEQ ID NO: 64414 - RNA, 24 nt, Artificial Sequence
  Synthetic Oligonucleotide; LAG exon 2; Set C
gggugcauaccugucuggcugaug

SEQ ID NO: 64415 - RNA, 23 nt, Artificial Sequence
  Synthetic Oligonucleotide; LAG exon 2; Set C
gggugcauaccugucuggcugau

SEQ ID NO: 64416 - RNA, 21 nt, Artificial Sequence
  Synthetic Oligonucleotide; LAG exon 2; Set B
ggugcauaccugucuggcuga

SEQ ID NO: 64417 - RNA, 22 nt, Artificial Sequence
  Synthetic Oligonucleotide; LAG exon 2; Set C
gggugcauaccugucuggcuga

SEQ ID NO: 64418 - RNA, 26 nt, Artificial Sequence
  Synthetic Oligonucleotide; LAG exon 2; Set C
uggggugcauaccugucuggcugaug

SEQ ID NO: 64419 - RNA, 27 nt, Artificial Sequence
  Synthetic Oligonucleotide; LAG exon 2; Set C
uuggggugcauaccugucuggcugaug

SEQ ID NO: 64420 - RNA, 24 nt, Artificial Sequence
  Synthetic Oligonucleotide; LAG exon 2; Set C
uggggugcauaccugucuggcuga

SEQ ID NO: 64421 - RNA, 15 nt, Artificial Sequence
  Synthetic Oligonucleotide; LAG exon 2; Set C
ggugcauaccugucu

SEQ ID NO: 64422 - RNA, 16 nt, Artificial Sequence
  Synthetic Oligonucleotide; LAG exon 2; Set C
gggugcauaccugucu

SEQ ID NO: 64423 - RNA, 15 nt, Artificial Sequence
  Synthetic Oligonucleotide; LAG exon 2; Set C
gggugcauaccuguc

SEQ ID NO: 64424 - RNA, 18 nt, Artificial Sequence
  Synthetic Oligonucleotide; LAG exon 2; Set B
uggggugcauaccugucu

SEQ ID NO: 64425 - RNA, 17 nt, Artificial Sequence
  Synthetic Oligonucleotide; LAG exon 2; Set C
uggggugcauaccuguc

SEQ ID NO: 64426 - RNA, 16 nt, Artificial Sequence
  Synthetic Oligonucleotide; LAG exon 2; Set C
uggggugcauaccugu

SEQ ID NO: 64427 - RNA, 18 nt, Artificial Sequence
  Synthetic Oligonucleotide; LAG exon 2; Set B
uuggggugcauaccuguc

SEQ ID NO: 64428 - RNA, 17 nt, Artificial Sequence
  Synthetic Oligonucleotide; LAG exon 2; Set C
uugcccaaguuuggggu

SEQ ID NO: 64429 - RNA, 16 nt, Artificial Sequence
  Synthetic Oligonucleotide; LAG exon 2; Set C
uugcccaaguuugggg

SEQ ID NO: 64430 - RNA, 18 nt, Artificial Sequence
  Synthetic Oligonucleotide; LAG exon 2; Set B
guugcccaaguuuggggu

SEQ ID NO: 64431 - RNA, 17 nt, Artificial Sequence
  Synthetic Oligonucleotide; LAG exon 2; Set C
guugcccaaguuugggg

SEQ ID NO: 64432 - RNA, 19 nt, Artificial Sequence
  Synthetic Oligonucleotide; LAG exon 2; Set B
uguugcccaaguuuggggu

SEQ ID NO: 64433 - RNA, 18 nt, Artificial Sequence
  Synthetic Oligonucleotide; LAG exon 2; Set C
uguugcccaaguuugggg

SEQ ID NO: 64434 - RNA, 16 nt, Artificial Sequence
  Synthetic Oligonucleotide; LAG exon 2; Set C
guugcccaaguuuggg

SEQ ID NO: 64435 - RNA, 17 nt, Artificial Sequence
  Synthetic Oligonucleotide; LAG exon 2; Set C
uguugcccaaguuuggg

SEQ ID NO: 64436 - RNA, 25 nt, Artificial Sequence
  Synthetic Oligonucleotide; LAG exon 2; Set C
agguccuguugcccaaguuuggggu

SEQ ID NO: 64437 - RNA, 24 nt, Artificial Sequence
  Synthetic Oligonucleotide; LAG exon 2; Set B
agguccuguugcccaaguuugggg

SEQ ID NO: 64438 - RNA, 26 nt, Artificial Sequence
  Synthetic Oligonucleotide; LAG exon 2; Set C
gagguccuguugcccaaguuuggggu

SEQ ID NO: 64439 - RNA, 25 nt, Artificial Sequence
  Synthetic Oligonucleotide; LAG exon 2; Set C
gagguccuguugcccaaguuugggg

SEQ ID NO: 64440 - RNA, 27 nt, Artificial Sequence
  Synthetic Oligonucleotide; LAG exon 2; Set C
ggagguccuguugcccaaguuuggggu

SEQ ID NO: 64441 - RNA, 22 nt, Artificial Sequence
  Synthetic Oligonucleotide; LAG exon 2; Set B
agguccuguugcccaaguuugg

SEQ ID NO: 64442 - RNA, 26 nt, Artificial Sequence
  Synthetic Oligonucleotide; LAG exon 2; Set C
ggagguccuguugcccaaguuugggg

SEQ ID NO: 64443 - RNA, 28 nt, Artificial Sequence
  Synthetic Oligonucleotide; LAG exon 2; Set C
cggagguccuguugcccaaguuuggggu

SEQ ID NO: 64444 - RNA, 24 nt, Artificial Sequence
  Synthetic Oligonucleotide; LAG exon 2; Set B
gagguccuguugcccaaguuuggg

SEQ ID NO: 64445 - RNA, 21 nt, Artificial Sequence
  Synthetic Oligonucleotide; LAG exon 2; Set B
agguccuguugcccaaguuug

SEQ ID NO: 64446 - RNA, 27 nt, Artificial Sequence
  Synthetic Oligonucleotide; LAG exon 2; Set C
cggagguccuguugcccaaguuugggg

SEQ ID NO: 64447 - RNA, 29 nt, Artificial Sequence
  Synthetic Oligonucleotide; LAG exon 2; Set C
ucggagguccuguugcccaaguuuggggu

SEQ ID NO: 64448 - RNA, 25 nt, Artificial Sequence
  Synthetic Oligonucleotide; LAG exon 2; Set C
ggagguccuguugcccaaguuuggg

SEQ ID NO: 64449 - RNA, 22 nt, Artificial Sequence
  Synthetic Oligonucleotide; LAG exon 2; Set B
gagguccuguugcccaaguuug

SEQ ID NO: 64450 - RNA, 28 nt, Artificial Sequence
  Synthetic Oligonucleotide; LAG exon 2; Set C
ucggagguccuguugcccaaguuugggg

SEQ ID NO: 64451 - RNA, 30 nt, Artificial Sequence
  Synthetic Oligonucleotide; LAG exon 2; Set C
uucggagguccuguugcccaaguuuggggu

SEQ ID NO: 64452 - RNA, 26 nt, Artificial Sequence
  Synthetic Oligonucleotide; LAG exon 2; Set C
cggagguccuguugcccaaguuuggg

SEQ ID NO: 64453 - RNA, 29 nt, Artificial Sequence
  Synthetic Oligonucleotide; LAG exon 2; Set C
uucggagguccuguugcccaaguuugggg

SEQ ID NO: 64454 - RNA, 31 nt, Artificial Sequence
  Synthetic Oligonucleotide; LAG exon 2; Set C
auucggagguccuguugcccaaguuuggggu

SEQ ID NO: 64455 - RNA, 27 nt, Artificial Sequence
  Synthetic Oligonucleotide; LAG exon 2; Set C
ucggagguccuguugcccaaguuuggg

SEQ ID NO: 64456 - RNA, 30 nt, Artificial Sequence
  Synthetic Oligonucleotide; LAG exon 2; Set C
auucggagguccuguugcccaaguuugggg

SEQ ID NO: 64457 - RNA, 28 nt, Artificial Sequence
  Synthetic Oligonucleotide; LAG exon 2; Set C
uucggagguccuguugcccaaguuuggg

SEQ ID NO: 64458 - RNA, 29 nt, Artificial Sequence
  Synthetic Oligonucleotide; LAG exon 2; Set C
auucggagguccuguugcccaaguuuggg

SEQ ID NO: 64459 - RNA, 39 nt, Artificial Sequence
  Synthetic Oligonucleotide; LAG exon 2; Set C
agugcuggauucggagguccuguugcccaaguuuggggu

SEQ ID NO: 64460 - RNA, 38 nt, Artificial Sequence
  Synthetic Oligonucleotide; LAG exon 2; Set C
agugcuggauucggagguccuguugcccaaguuugggg

SEQ ID NO: 64461 - RNA, 40 nt, Artificial Sequence
  Synthetic Oligonucleotide; LAG exon 2; Set C
gagugcuggauucggagguccuguugcccaaguuuggggu

SEQ ID NO: 64462 - RNA, 31 nt, Artificial Sequence
  Synthetic Oligonucleotide; LAG exon 2; Set C
gcuggauucggagguccuguugcccaaguuu

SEQ ID NO: 64463 - RNA, 35 nt, Artificial Sequence
  Synthetic Oligonucleotide; LAG exon 2; Set C
gugcuggauucggagguccuguugcccaaguuugg

SEQ ID NO: 64464 - RNA, 39 nt, Artificial Sequence
  Synthetic Oligonucleotide; LAG exon 2; Set C
gagugcuggauucggagguccuguugcccaaguuugggg

SEQ ID NO: 64465 - RNA, 30 nt, Artificial Sequence
  Synthetic Oligonucleotide; LAG exon 2; Set C
gcuggauucggagguccuguugcccaaguu

SEQ ID NO: 64466 - RNA, 32 nt, Artificial Sequence
  Synthetic Oligonucleotide; LAG exon 2; Set C
ugcuggauucggagguccuguugcccaaguuu

SEQ ID NO: 64467 - RNA, 36 nt, Artificial Sequence
  Synthetic Oligonucleotide; LAG exon 2; Set C
agugcuggauucggagguccuguugcccaaguuugg

SEQ ID NO: 64468 - RNA, 34 nt, Artificial Sequence
  Synthetic Oligonucleotide; LAG exon 2; Set C
gugcuggauucggagguccuguugcccaaguuug

SEQ ID NO: 64469 - RNA, 40 nt, Artificial Sequence
  Synthetic Oligonucleotide; LAG exon 2; Set C
ugagugcuggauucggagguccuguugcccaaguuugggg

SEQ ID NO: 64470 - RNA, 38 nt, Artificial Sequence
  Synthetic Oligonucleotide; LAG exon 2; Set C
gagugcuggauucggagguccuguugcccaaguuuggg

SEQ ID NO: 64471 - RNA, 31 nt, Artificial Sequence
  Synthetic Oligonucleotide; LAG exon 2; Set C
ugcuggauucggagguccuguugcccaaguu

SEQ ID NO: 64472 - RNA, 29 nt, Artificial Sequence
  Synthetic Oligonucleotide; LAG exon 2; Set C
gcuggauucggagguccuguugcccaagu

SEQ ID NO: 64473 - RNA, 33 nt, Artificial Sequence
  Synthetic Oligonucleotide; LAG exon 2; Set C
gugcuggauucggagguccuguugcccaaguuu

SEQ ID NO: 64474 - RNA, 35 nt, Artificial Sequence
  Synthetic Oligonucleotide; LAG exon 2; Set C
agugcuggauucggagguccuguugcccaaguuug

SEQ ID NO: 64475 - RNA, 39 nt, Artificial Sequence
  Synthetic Oligonucleotide; LAG exon 2; Set C
ugagugcuggauucggagguccuguugcccaaguuuggg

SEQ ID NO: 64476 - RNA, 32 nt, Artificial Sequence
  Synthetic Oligonucleotide; LAG exon 2; Set C
gugcuggauucggagguccuguugcccaaguu

SEQ ID NO: 64477 - RNA, 30 nt, Artificial Sequence
  Synthetic Oligonucleotide; LAG exon 2; Set C
ugcuggauucggagguccuguugcccaagu

SEQ ID NO: 64478 - RNA, 28 nt, Artificial Sequence
  Synthetic Oligonucleotide; LAG exon 2; Set C
gcuggauucggagguccuguugcccaag

SEQ ID NO: 64479 - RNA, 40 nt, Artificial Sequence
  Synthetic Oligonucleotide; LAG exon 2; Set C
uugagugcuggauucggagguccuguugcccaaguuuggg

SEQ ID NO: 64480 - RNA, 31 nt, Artificial Sequence
  Synthetic Oligonucleotide; LAG exon 2; Set C
gugcuggauucggagguccuguugcccaagu

SEQ ID NO: 64481 - RNA, 29 nt, Artificial Sequence
  Synthetic Oligonucleotide; LAG exon 2; Set C
ugcuggauucggagguccuguugcccaag

SEQ ID NO: 64482 - RNA, 30 nt, Artificial Sequence
  Synthetic Oligonucleotide; LAG exon 2; Set C
gugcuggauucggagguccuguugcccaag

SEQ ID NO: 64483 - RNA, 22 nt, Artificial Sequence
  Synthetic Oligonucleotide; LAG exon 2; Set B
gcuggauucggagguccuguug

SEQ ID NO: 64484 - RNA, 23 nt, Artificial Sequence
  Synthetic Oligonucleotide; LAG exon 2; Set B
ugcuggauucggagguccuguug

SEQ ID NO: 64485 - RNA, 20 nt, Artificial Sequence
  Synthetic Oligonucleotide; LAG exon 2; Set B
gcuggauucggagguccugu

SEQ ID NO: 64486 - RNA, 24 nt, Artificial Sequence
  Synthetic Oligonucleotide; LAG exon 2; Set B
gugcuggauucggagguccuguug

SEQ ID NO: 64487 - RNA, 23 nt, Artificial Sequence
  Synthetic Oligonucleotide; LAG exon 2; Set C
gagggggcgugagccgagaggca

SEQ ID NO: 64488 - RNA, 24 nt, Artificial Sequence
  Synthetic Oligonucleotide; LAG exon 2; Set C
ggagggggcgugagccgagaggca

SEQ ID NO: 64489 - RNA, 18 nt, Artificial Sequence
  Synthetic Oligonucleotide; LAG exon 2; Set A
agggggcgugagccgaga

SEQ ID NO: 64490 - RNA, 20 nt, Artificial Sequence
  Synthetic Oligonucleotide; LAG exon 2; Set C
gagggggcgugagccgagag

SEQ ID NO: 64491 - RNA, 21 nt, Artificial Sequence
  Synthetic Oligonucleotide; LAG exon 2; Set C
ggagggggcgugagccgagag

SEQ ID NO: 64492 - RNA, 20 nt, Artificial Sequence
  Synthetic Oligonucleotide; LAG exon 2; Set C
gggagggggcgugagccgag

SEQ ID NO: 64493 - RNA, 16 nt, Artificial Sequence
  Synthetic Oligonucleotide; LAG exon 2; Set A
aggggagggggcguga

SEQ ID NO: 64494 - RNA, 30 nt, Artificial Sequence
  Synthetic Oligonucleotide; LAG exon 2; Set C
gaggccaaggggagggggcgugagccgaga

SEQ ID NO: 64495 - RNA, 15 nt, Artificial Sequence
  Synthetic Oligonucleotide; LAG exon 2; Set A
aggggagggggcgug

SEQ ID NO: 64496 - RNA, 31 nt, Artificial Sequence
  Synthetic Oligonucleotide; LAG exon 2; Set C
agaggccaaggggagggggcgugagccgaga

SEQ ID NO: 64497 - RNA, 33 nt, Artificial Sequence
  Synthetic Oligonucleotide; LAG exon 2; Set C
gagaggccaaggggagggggcgugagccgagag

SEQ ID NO: 64498 - RNA, 39 nt, Artificial Sequence
  Synthetic Oligonucleotide; LAG exon 2; Set C
aaagagaggccaaggggagggggcgugagccgagaggca

SEQ ID NO: 64499 - RNA, 34 nt, Artificial Sequence
  Synthetic Oligonucleotide; LAG exon 2; Set C
agagaggccaaggggagggggcgugagccgagag

SEQ ID NO: 64500 - RNA, 40 nt, Artificial Sequence
  Synthetic Oligonucleotide; LAG exon 2; Set C
aaaagagaggccaaggggagggggcgugagccgagaggca

SEQ ID NO: 64501 - RNA, 35 nt, Artificial Sequence
  Synthetic Oligonucleotide; LAG exon 2; Set C
aagagaggccaaggggagggggcgugagccgagag

SEQ ID NO: 64502 - RNA, 36 nt, Artificial Sequence
  Synthetic Oligonucleotide; LAG exon 2; Set C
aaagagaggccaaggggagggggcgugagccgagag

SEQ ID NO: 64503 - RNA, 15 nt, Artificial Sequence
  Synthetic Oligonucleotide; LAG exon 2; Set A
caaggggagggggcg

SEQ ID NO: 64504 - RNA, 37 nt, Artificial Sequence
  Synthetic Oligonucleotide; LAG exon 2; Set C
aaaagagaggccaaggggagggggcgugagccgagag

SEQ ID NO: 64505 - RNA, 21 nt, Artificial Sequence
  Synthetic Oligonucleotide; LAG exon 2; Set C
gaggccaaggggagggggcgu

SEQ ID NO: 64506 - RNA, 22 nt, Artificial Sequence
  Synthetic Oligonucleotide; LAG exon 2; Set C
agaggccaaggggagggggcgu

SEQ ID NO: 64507 - RNA, 22 nt, Artificial Sequence
  Synthetic Oligonucleotide; LAG exon 2; Set C
gagaggccaaggggagggggcg

SEQ ID NO: 64508 - RNA, 23 nt, Artificial Sequence
  Synthetic Oligonucleotide; LAG exon 2; Set C
agagaggccaaggggagggggcg

SEQ ID NO: 64509 - RNA, 24 nt, Artificial Sequence
  Synthetic Oligonucleotide; LAG exon 2; Set C
aagagaggccaaggggagggggcg

SEQ ID NO: 64510 - RNA, 15 nt, Artificial Sequence
  Synthetic Oligonucleotide; LAG exon 2; Set C
gaggccaaggggagg

SEQ ID NO: 64511 - RNA, 25 nt, Artificial Sequence
  Synthetic Oligonucleotide; LAG exon 2; Set C
aaagagaggccaaggggagggggcg

SEQ ID NO: 64512 - RNA, 16 nt, Artificial Sequence
  Synthetic Oligonucleotide; LAG exon 2; Set C
agaggccaaggggagg

SEQ ID NO: 64513 - RNA, 25 nt, Artificial Sequence
  Synthetic Oligonucleotide; LAG exon 2; Set C
aaaagagaggccaaggggagggggc

SEQ ID NO: 64514 - RNA, 15 nt, Artificial Sequence
  Synthetic Oligonucleotide; LAG exon 2; Set C
agagaggccaagggg

SEQ ID NO: 64515 - RNA, 16 nt, Artificial Sequence
  Synthetic Oligonucleotide; LAG exon 2; Set C
aagagaggccaagggg

SEQ ID NO: 64516 - RNA, 17 nt, Artificial Sequence
  Synthetic Oligonucleotide; LAG exon 2; Set C
aaagagaggccaagggg

SEQ ID NO: 64517 - RNA, 18 nt, Artificial Sequence
  Synthetic Oligonucleotide; LAG exon 2; Set C
aaaagagaggccaagggg

SEQ ID NO: 64518 - RNA, 17 nt, Artificial Sequence
  Synthetic Oligonucleotide; LAG exon 2; Set C
aaaagagaggccaaggg

SEQ ID NO: 64519 - RNA, 16 nt, Artificial Sequence
  Synthetic Oligonucleotide; LAG exon 2; Set C
aaaagagaggccaagg

SEQ ID NO: 64520 - RNA, 27 nt, Artificial Sequence
  Synthetic Oligonucleotide; LAG exon 2; Set A
uaggugagcaaaagagaggccaagggg

SEQ ID NO: 64521 - RNA, 26 nt, Artificial Sequence
  Synthetic Oligonucleotide; LAG exon 2; Set A
uaggugagcaaaagagaggccaaggg

SEQ ID NO: 64522 - RNA, 25 nt, Artificial Sequence
  Synthetic Oligonucleotide; LAG exon 2; Set A
uaggugagcaaaagagaggccaagg

SEQ ID NO: 64523 - RNA, 36 nt, Artificial Sequence
  Synthetic Oligonucleotide; LAG exon 2; Set C
cuucacuaggugagcaaaagagaggccaaggggagg

SEQ ID NO: 64524 - RNA, 30 nt, Artificial Sequence
  Synthetic Oligonucleotide; LAG exon 2; Set A
cuucacuaggugagcaaaagagaggccaag

SEQ ID NO: 64525 - RNA, 29 nt, Artificial Sequence
  Synthetic Oligonucleotide; LAG exon 2; Set A
cuucacuaggugagcaaaagagaggccaa

SEQ ID NO: 64526 - RNA, 37 nt, Artificial Sequence
  Synthetic Oligonucleotide; LAG exon 2; Set C
gaggcuucacuaggugagcaaaagagaggccaagggg

SEQ ID NO: 64527 - RNA, 38 nt, Artificial Sequence
  Synthetic Oligonucleotide; LAG exon 2; Set C
agaggcuucacuaggugagcaaaagagaggccaagggg

SEQ ID NO: 64528 - RNA, 39 nt, Artificial Sequence
  Synthetic Oligonucleotide; LAG exon 2; Set C
gagaggcuucacuaggugagcaaaagagaggccaagggg

SEQ ID NO: 64529 - RNA, 40 nt, Artificial Sequence
  Synthetic Oligonucleotide; LAG exon 2; Set C
ggagaggcuucacuaggugagcaaaagagaggccaagggg

SEQ ID NO: 64530 - RNA, 24 nt, Artificial Sequence
  Synthetic Oligonucleotide; LAG exon 2; Set C
cuucacuaggugagcaaaagagag

SEQ ID NO: 64531 - RNA, 23 nt, Artificial Sequence
  Synthetic Oligonucleotide; LAG exon 2; Set C
cuucacuaggugagcaaaagaga

SEQ ID NO: 64532 - RNA, 21 nt, Artificial Sequence
  Synthetic Oligonucleotide; LAG exon 2; Set C
cuucacuaggugagcaaaaga

SEQ ID NO: 64533 - RNA, 20 nt, Artificial Sequence
  Synthetic Oligonucleotide; LAG exon 2; Set C
cuucacuaggugagcaaaag

SEQ ID NO: 64534 - RNA, 19 nt, Artificial Sequence
  Synthetic Oligonucleotide; LAG exon 2; Set C
cuucacuaggugagcaaaa

SEQ ID NO: 64535 - RNA, 29 nt, Artificial Sequence
  Synthetic Oligonucleotide; LAG exon 2; Set C
ggcuggagaggcuucacuaggugagcaaa

SEQ ID NO: 64536 - RNA, 20 nt, Artificial Sequence
  Synthetic Oligonucleotide; LAG exon 2; Set A
ggcuggagaggcuucacuag

SEQ ID NO: 64537 - RNA, 28 nt, Artificial Sequence
  Synthetic Oligonucleotide; LAG exon 2; Set C
ggaccucagccccuggcuggagaggcuu

SEQ ID NO: 64538 - RNA, 29 nt, Artificial Sequence
  Synthetic Oligonucleotide; LAG exon 2; Set C
gggaccucagccccuggcuggagaggcuu

SEQ ID NO: 64539 - RNA, 20 nt, Artificial Sequence
  Synthetic Oligonucleotide; LAG exon 2; Set C
ggaccucagccccuggcugg

SEQ ID NO: 64540 - RNA, 39 nt, Artificial Sequence
  Synthetic Oligonucleotide; LAG exon 2; Set C
gcugggcaggagcccccuccugggcccacaccaccggga

SEQ ID NO: 64541 - RNA, 38 nt, Artificial Sequence
  Synthetic Oligonucleotide; LAG exon 2; Set C
gcugggcaggagcccccuccugggcccacaccaccggg

SEQ ID NO: 64542 - RNA, 40 nt, Artificial Sequence
  Synthetic Oligonucleotide; LAG exon 2; Set C
agcugggcaggagcccccuccugggcccacaccaccggga

SEQ ID NO: 64543 - RNA, 39 nt, Artificial Sequence
  Synthetic Oligonucleotide; LAG exon 2; Set C
agcugggcaggagcccccuccugggcccacaccaccggg

SEQ ID NO: 64544 - RNA, 17 nt, Artificial Sequence
  Synthetic Oligonucleotide; LAG exon 2; Set A
aggggagcugggcagga

SEQ ID NO: 64545 - RNA, 16 nt, Artificial Sequence
  Synthetic Oligonucleotide; LAG exon 2; Set A
aggggagcugggcagg

SEQ ID NO: 64546 - RNA, 23 nt, Artificial Sequence
  Synthetic Oligonucleotide; LAG exon 2; Set C
cugcaggggagcugggcaggagc

SEQ ID NO: 64547 - RNA, 22 nt, Artificial Sequence
  Synthetic Oligonucleotide; LAG exon 2; Set C
cugcaggggagcugggcaggag

SEQ ID NO: 64548 - RNA, 23 nt, Artificial Sequence
  Synthetic Oligonucleotide; LAG exon 2; Set C
gcugcaggggagcugggcaggag

SEQ ID NO: 64549 - RNA, 15 nt, Artificial Sequence
  Synthetic Oligonucleotide; LAG exon 2; Set A
guggggcugcagggg

SEQ ID NO: 64550 - RNA, 16 nt, Artificial Sequence
  Synthetic Oligonucleotide; LAG exon 2; Set A
uguggggcugcagggg

SEQ ID NO: 64551 - RNA, 17 nt, Artificial Sequence
  Synthetic Oligonucleotide; LAG exon 2; Set A
uuguggggcugcagggg

SEQ ID NO: 64552 - RNA, 15 nt, Artificial Sequence
  Synthetic Oligonucleotide; LAG exon 2; Set A
uguggggcugcaggg

SEQ ID NO: 64553 - RNA, 18 nt, Artificial Sequence
  Synthetic Oligonucleotide; LAG exon 2; Set A
auuguggggcugcagggg

SEQ ID NO: 64554 - RNA, 16 nt, Artificial Sequence
  Synthetic Oligonucleotide; LAG exon 2; Set A
uuguggggcugcaggg

SEQ ID NO: 64555 - RNA, 19 nt, Artificial Sequence
  Synthetic Oligonucleotide; LAG exon 2; Set A
gauuguggggcugcagggg

SEQ ID NO: 64556 - RNA, 17 nt, Artificial Sequence
  Synthetic Oligonucleotide; LAG exon 2; Set A
auuguggggcugcaggg

SEQ ID NO: 64557 - RNA, 20 nt, Artificial Sequence
  Synthetic Oligonucleotide; LAG exon 2; Set C
ggauuguggggcugcagggg

SEQ ID NO: 64558 - RNA, 18 nt, Artificial Sequence
  Synthetic Oligonucleotide; LAG exon 2; Set A
gauuguggggcugcaggg

SEQ ID NO: 64559 - RNA, 21 nt, Artificial Sequence
  Synthetic Oligonucleotide; LAG exon 2; Set C
gggauuguggggcugcagggg

SEQ ID NO: 64560 - RNA, 19 nt, Artificial Sequence
  Synthetic Oligonucleotide; LAG exon 2; Set A
ggauuguggggcugcaggg

SEQ ID NO: 64561 - RNA, 22 nt, Artificial Sequence
  Synthetic Oligonucleotide; LAG exon 2; Set C
ggggauuguggggcugcagggg

SEQ ID NO: 64562 - RNA, 20 nt, Artificial Sequence
  Synthetic Oligonucleotide; LAG exon 2; Set C
gggauuguggggcugcaggg

SEQ ID NO: 64563 - RNA, 23 nt, Artificial Sequence
  Synthetic Oligonucleotide; LAG exon 2; Set C
gggggauuguggggcugcagggg

SEQ ID NO: 64564 - RNA, 21 nt, Artificial Sequence
  Synthetic Oligonucleotide; LAG exon 2; Set C
ggggauuguggggcugcaggg

SEQ ID NO: 64565 - RNA, 24 nt, Artificial Sequence
  Synthetic Oligonucleotide; LAG exon 2; Set C
agggggauuguggggcugcagggg

SEQ ID NO: 64566 - RNA, 22 nt, Artificial Sequence
  Synthetic Oligonucleotide; LAG exon 2; Set C
gggggauuguggggcugcaggg

SEQ ID NO: 64567 - RNA, 25 nt, Artificial Sequence
  Synthetic Oligonucleotide; LAG exon 2; Set C
gagggggauuguggggcugcagggg

SEQ ID NO: 64568 - RNA, 23 nt, Artificial Sequence
  Synthetic Oligonucleotide; LAG exon 2; Set C
agggggauuguggggcugcaggg

SEQ ID NO: 64569 - RNA, 26 nt, Artificial Sequence
  Synthetic Oligonucleotide; LAG exon 2; Set C
ggagggggauuguggggcugcagggg

SEQ ID NO: 64570 - RNA, 24 nt, Artificial Sequence
  Synthetic Oligonucleotide; LAG exon 2; Set C
gagggggauuguggggcugcaggg

SEQ ID NO: 64571 - RNA, 27 nt, Artificial Sequence
  Synthetic Oligonucleotide; LAG exon 2; Set C
uggagggggauuguggggcugcagggg

SEQ ID NO: 64572 - RNA, 25 nt, Artificial Sequence
  Synthetic Oligonucleotide; LAG exon 2; Set C
ggagggggauuguggggcugcaggg

SEQ ID NO: 64573 - RNA, 26 nt, Artificial Sequence
  Synthetic Oligonucleotide; LAG exon 2; Set C
uggagggggauuguggggcugcaggg

SEQ ID NO: 64574 - RNA, 34 nt, Artificial Sequence
  Synthetic Oligonucleotide; LAG exon 2; Set C
gagauccuggagggggauuguggggcugcagggg

SEQ ID NO: 64575 - RNA, 35 nt, Artificial Sequence
  Synthetic Oligonucleotide; LAG exon 2; Set C
ugagauccuggagggggauuguggggcugcagggg

SEQ ID NO: 64576 - RNA, 33 nt, Artificial Sequence
  Synthetic Oligonucleotide; LAG exon 2; Set C
gagauccuggagggggauuguggggcugcaggg

SEQ ID NO: 64577 - RNA, 32 nt, Artificial Sequence
  Synthetic Oligonucleotide; LAG exon 2; Set C
gagauccuggagggggauuguggggcugcagg

SEQ ID NO: 64578 - RNA, 36 nt, Artificial Sequence
  Synthetic Oligonucleotide; LAG exon 2; Set C
cugagauccuggagggggauuguggggcugcagggg

SEQ ID NO: 64579 - RNA, 34 nt, Artificial Sequence
  Synthetic Oligonucleotide; LAG exon 2; Set C
ugagauccuggagggggauuguggggcugcaggg

SEQ ID NO: 64580 - RNA, 37 nt, Artificial Sequence
  Synthetic Oligonucleotide; LAG exon 2; Set C
gcugagauccuggagggggauuguggggcugcagggg

SEQ ID NO: 64581 - RNA, 35 nt, Artificial Sequence
  Synthetic Oligonucleotide; LAG exon 2; Set C
cugagauccuggagggggauuguggggcugcaggg

SEQ ID NO: 64582 - RNA, 34 nt, Artificial Sequence
  Synthetic Oligonucleotide; LAG exon 2; Set C
cugagauccuggagggggauuguggggcugcagg

SEQ ID NO: 64583 - RNA, 36 nt, Artificial Sequence
  Synthetic Oligonucleotide; LAG exon 2; Set C
gcugagauccuggagggggauuguggggcugcaggg

SEQ ID NO: 64584 - RNA, 35 nt, Artificial Sequence
  Synthetic Oligonucleotide; LAG exon 2; Set C
gcugagauccuggagggggauuguggggcugcagg

SEQ ID NO: 64585 - RNA, 29 nt, Artificial Sequence
  Synthetic Oligonucleotide; LAG exon 2; Set C
agaaggcugagauccuggagggggauugu

SEQ ID NO: 64586 - RNA, 30 nt, Artificial Sequence
  Synthetic Oligonucleotide; LAG exon 2; Set C
cagaaggcugagauccuggagggggauugu

SEQ ID NO: 64587 - RNA, 18 nt, Artificial Sequence
  Synthetic Oligonucleotide; LAG exon 2; Set C
cuucgcagaaggcugaga

SEQ ID NO: 64588 - RNA, 19 nt, Artificial Sequence
  Synthetic Oligonucleotide; LAG exon 2; Set C
ucuucgcagaaggcugaga

SEQ ID NO: 64589 - RNA, 40 nt, Artificial Sequence
  Synthetic Oligonucleotide; LAG exon 2; Set C
gugaccccugcucuucgcagaaggcugagauccuggaggg

SEQ ID NO: 64590 - RNA, 39 nt, Artificial Sequence
  Synthetic Oligonucleotide; LAG exon 2; Set C
gugaccccugcucuucgcagaaggcugagauccuggagg

SEQ ID NO: 64591 - RNA, 38 nt, Artificial Sequence
  Synthetic Oligonucleotide; LAG exon 2; Set C
gugaccccugcucuucgcagaaggcugagauccuggag

SEQ ID NO: 64592 - RNA, 29 nt, Artificial Sequence
  Synthetic Oligonucleotide; LAG exon 2; Set C
ugaccccugcucuucgcagaaggcugaga

SEQ ID NO: 64593 - RNA, 29 nt, Artificial Sequence
  Synthetic Oligonucleotide; LAG exon 2; Set C
gugaccccugcucuucgcagaaggcugag

SEQ ID NO: 64594 - RNA, 28 nt, Artificial Sequence
  Synthetic Oligonucleotide; LAG exon 2; Set C
gugaccccugcucuucgcagaaggcuga

SEQ ID NO: 64595 - RNA, 30 nt, Artificial Sequence
  Synthetic Oligonucleotide; LAG exon 2; Set C
agugaccccugcucuucgcagaaggcugag

SEQ ID NO: 64596 - RNA, 29 nt, Artificial Sequence
  Synthetic Oligonucleotide; LAG exon 2; Set C
agugaccccugcucuucgcagaaggcuga

SEQ ID NO: 64597 - RNA, 31 nt, Artificial Sequence
  Synthetic Oligonucleotide; LAG exon 2; Set C
aagugaccccugcucuucgcagaaggcugag

SEQ ID NO: 64598 - RNA, 27 nt, Artificial Sequence
  Synthetic Oligonucleotide; LAG exon 2; Set C
gugaccccugcucuucgcagaaggcug

SEQ ID NO: 64599 - RNA, 30 nt, Artificial Sequence
  Synthetic Oligonucleotide; LAG exon 2; Set C
aagugaccccugcucuucgcagaaggcuga

SEQ ID NO: 64600 - RNA, 26 nt, Artificial Sequence
  Synthetic Oligonucleotide; LAG exon 2; Set C
gugaccccugcucuucgcagaaggcu

SEQ ID NO: 64601 - RNA, 40 nt, Artificial Sequence
  Synthetic Oligonucleotide; LAG exon 2; Set C
augcugccaagugaccccugcucuucgcagaaggcugaga

SEQ ID NO: 64602 - RNA, 19 nt, Artificial Sequence
  Synthetic Oligonucleotide; LAG exon 2; Set A
gugaccccugcucuucgca

SEQ ID NO: 64603 - RNA, 18 nt, Artificial Sequence
  Synthetic Oligonucleotide; LAG exon 2; Set A
gugaccccugcucuucgc

SEQ ID NO: 64604 - RNA, 20 nt, Artificial Sequence
  Synthetic Oligonucleotide; LAG exon 2; Set A
agugaccccugcucuucgca

SEQ ID NO: 64605 - RNA, 17 nt, Artificial Sequence
  Synthetic Oligonucleotide; LAG exon 2; Set A
gugaccccugcucuucg

SEQ ID NO: 64606 - RNA, 19 nt, Artificial Sequence
  Synthetic Oligonucleotide; LAG exon 2; Set A
agugaccccugcucuucgc

SEQ ID NO: 64607 - RNA, 21 nt, Artificial Sequence
  Synthetic Oligonucleotide; LAG exon 2; Set A
aagugaccccugcucuucgca

SEQ ID NO: 64608 - RNA, 16 nt, Artificial Sequence
  Synthetic Oligonucleotide; LAG exon 2; Set C
gugaccccugcucuuc

SEQ ID NO: 64609 - RNA, 18 nt, Artificial Sequence
  Synthetic Oligonucleotide; LAG exon 2; Set A
agugaccccugcucuucg

SEQ ID NO: 64610 - RNA, 20 nt, Artificial Sequence
  Synthetic Oligonucleotide; LAG exon 2; Set A
aagugaccccugcucuucgc

SEQ ID NO: 64611 - RNA, 19 nt, Artificial Sequence
  Synthetic Oligonucleotide; LAG exon 2; Set A
aagugaccccugcucuucg

SEQ ID NO: 64612 - RNA, 18 nt, Artificial Sequence
  Synthetic Oligonucleotide; LAG exon 2; Set C
aagugaccccugcucuuc

SEQ ID NO: 64613 - RNA, 20 nt, Artificial Sequence
  Synthetic Oligonucleotide; LAG exon 2; Set B
augcugccaagugaccccug

SEQ ID NO: 64614 - RNA, 21 nt, Artificial Sequence
  Synthetic Oligonucleotide; LAG exon 2; Set B
gaugcugccaagugaccccug

SEQ ID NO: 64615 - RNA, 22 nt, Artificial Sequence
  Synthetic Oligonucleotide; LAG exon 2; Set B
ugaugcugccaagugaccccug

SEQ ID NO: 64616 - RNA, 28 nt, Artificial Sequence
  Synthetic Oligonucleotide; LAG exon 2; Set C
ucuggcugaugcugccaagugaccccug

SEQ ID NO: 64617 - RNA, 29 nt, Artificial Sequence
  Synthetic Oligonucleotide; LAG exon 2; Set C
gucuggcugaugcugccaagugaccccug

SEQ ID NO: 64618 - RNA, 30 nt, Artificial Sequence
  Synthetic Oligonucleotide; LAG exon 2; Set C
ugucuggcugaugcugccaagugaccccug

SEQ ID NO: 64619 - RNA, 35 nt, Artificial Sequence
  Synthetic Oligonucleotide; LAG exon 2; Set C
auaccugucuggcugaugcugccaagugaccccug

SEQ ID NO: 64620 - RNA, 34 nt, Artificial Sequence
  Synthetic Oligonucleotide; LAG exon 2; Set C
ggugcauaccugucuggcugaugcugccaaguga

SEQ ID NO: 64621 - RNA, 36 nt, Artificial Sequence
  Synthetic Oligonucleotide; LAG exon 2; Set C
ggggugcauaccugucuggcugaugcugccaaguga

SEQ ID NO: 64622 - RNA, 39 nt, Artificial Sequence
  Synthetic Oligonucleotide; LAG exon 2; Set C
guuuggggugcauaccugucuggcugaugcugccaagug

SEQ ID NO: 64623 - RNA, 40 nt, Artificial Sequence
  Synthetic Oligonucleotide; LAG exon 2; Set C
aguuuggggugcauaccugucuggcugaugcugccaagug

SEQ ID NO: 64624 - RNA, 23 nt, Artificial Sequence
  Synthetic Oligonucleotide; LAG exon 2; Set B
ggugcauaccugucuggcugaug

SEQ ID NO: 64625 - RNA, 25 nt, Artificial Sequence
  Synthetic Oligonucleotide; LAG exon 2; Set C
ggggugcauaccugucuggcugaug

SEQ ID NO: 64626 - RNA, 24 nt, Artificial Sequence
  Synthetic Oligonucleotide; LAG exon 2; Set C
ggggugcauaccugucuggcugau

SEQ ID NO: 64627 - RNA, 23 nt, Artificial Sequence
  Synthetic Oligonucleotide; LAG exon 2; Set C
ggggugcauaccugucuggcuga

SEQ ID NO: 64628 - RNA, 17 nt, Artificial Sequence
  Synthetic Oligonucleotide; LAG exon 2; Set B
ggggugcauaccugucu

SEQ ID NO: 64629 - RNA, 16 nt, Artificial Sequence
  Synthetic Oligonucleotide; LAG exon 2; Set C
ggggugcauaccuguc

SEQ ID NO: 64630 - RNA, 15 nt, Artificial Sequence
  Synthetic Oligonucleotide; LAG exon 2; Set C
ggggugcauaccugu

SEQ ID NO: 64631 - RNA, 15 nt, Artificial Sequence
  Synthetic Oligonucleotide; LAG exon 2; Set C
uugcccaaguuuggg

SEQ ID NO: 64632 - RNA, 23 nt, Artificial Sequence
  Synthetic Oligonucleotide; LAG exon 2; Set B
agguccuguugcccaaguuuggg

SEQ ID NO: 64633 - RNA, 36 nt, Artificial Sequence
  Synthetic Oligonucleotide; LAG exon 2; Set C
gcuggauucggagguccuguugcccaaguuuggggu

SEQ ID NO: 64634 - RNA, 35 nt, Artificial Sequence
  Synthetic Oligonucleotide; LAG exon 2; Set C
gcuggauucggagguccuguugcccaaguuugggg

SEQ ID NO: 64635 - RNA, 37 nt, Artificial Sequence
  Synthetic Oligonucleotide; LAG exon 2; Set C
ugcuggauucggagguccuguugcccaaguuuggggu

SEQ ID NO: 64636 - RNA, 36 nt, Artificial Sequence
  Synthetic Oligonucleotide; LAG exon 2; Set C
ugcuggauucggagguccuguugcccaaguuugggg

SEQ ID NO: 64637 - RNA, 38 nt, Artificial Sequence
  Synthetic Oligonucleotide; LAG exon 2; Set C
gugcuggauucggagguccuguugcccaaguuuggggu

SEQ ID NO: 64638 - RNA, 33 nt, Artificial Sequence
  Synthetic Oligonucleotide; LAG exon 2; Set C
gcuggauucggagguccuguugcccaaguuugg

SEQ ID NO: 64639 - RNA, 37 nt, Artificial Sequence
  Synthetic Oligonucleotide; LAG exon 2; Set C
gugcuggauucggagguccuguugcccaaguuugggg

SEQ ID NO: 64640 - RNA, 34 nt, Artificial Sequence
  Synthetic Oligonucleotide; LAG exon 2; Set C
ugcuggauucggagguccuguugcccaaguuugg

SEQ ID NO: 64641 - RNA, 32 nt, Artificial Sequence
  Synthetic Oligonucleotide; LAG exon 2; Set C
gcuggauucggagguccuguugcccaaguuug

SEQ ID NO: 64642 - RNA, 36 nt, Artificial Sequence
  Synthetic Oligonucleotide; LAG exon 2; Set C
gugcuggauucggagguccuguugcccaaguuuggg

SEQ ID NO: 64643 - RNA, 33 nt, Artificial Sequence
  Synthetic Oligonucleotide; LAG exon 2; Set C
ugcuggauucggagguccuguugcccaaguuug

SEQ ID NO: 64644 - RNA, 37 nt, Artificial Sequence
  Synthetic Oligonucleotide; LAG exon 2; Set C
agugcuggauucggagguccuguugcccaaguuuggg

SEQ ID NO: 64645 - RNA, 22 nt, Artificial Sequence
  Synthetic Oligonucleotide; LAG exon 3; Set A
ugagaagcuccagggguaggaa

SEQ ID NO: 64646 - RNA, 23 nt, Artificial Sequence
  Synthetic Oligonucleotide; LAG exon 3; Set A
uugagaagcuccagggguaggaa

SEQ ID NO: 64647 - RNA, 33 nt, Artificial Sequence
  Synthetic Oligonucleotide; LAG exon 3; Set C
gagaauggaguugagaagcuccagggguaggaa

SEQ ID NO: 64648 - RNA, 34 nt, Artificial Sequence
  Synthetic Oligonucleotide; LAG exon 3; Set C
agagaauggaguugagaagcuccagggguaggaa

SEQ ID NO: 64649 - RNA, 35 nt, Artificial Sequence
  Synthetic Oligonucleotide; LAG exon 3; Set C
aagagaauggaguugagaagcuccagggguaggaa

SEQ ID NO: 64650 - RNA, 36 nt, Artificial Sequence
  Synthetic Oligonucleotide; LAG exon 3; Set C
aaagagaauggaguugagaagcuccagggguaggaa

SEQ ID NO: 64651 - RNA, 37 nt, Artificial Sequence
  Synthetic Oligonucleotide; LAG exon 3; Set C
gaaagagaauggaguugagaagcuccagggguaggaa

SEQ ID NO: 64652 - RNA, 16 nt, Artificial Sequence
  Synthetic Oligonucleotide; LAG exon 3; Set C
gaauggaguugagaag

SEQ ID NO: 64653 - RNA, 15 nt, Artificial Sequence
  Synthetic Oligonucleotide; LAG exon 3; Set C
gaauggaguugagaa

SEQ ID NO: 64654 - RNA, 17 nt, Artificial Sequence
  Synthetic Oligonucleotide; LAG exon 3; Set C
agaauggaguugagaag

SEQ ID NO: 64655 - RNA, 16 nt, Artificial Sequence
  Synthetic Oligonucleotide; LAG exon 3; Set C
agaauggaguugagaa

SEQ ID NO: 64656 - RNA, 18 nt, Artificial Sequence
  Synthetic Oligonucleotide; LAG exon 3; Set C
gagaauggaguugagaag

SEQ ID NO: 64657 - RNA, 17 nt, Artificial Sequence
  Synthetic Oligonucleotide; LAG exon 3; Set C
gagaauggaguugagaa

SEQ ID NO: 64658 - RNA, 15 nt, Artificial Sequence
  Synthetic Oligonucleotide; LAG exon 3; Set C
agaauggaguugaga

SEQ ID NO: 64659 - RNA, 19 nt, Artificial Sequence
  Synthetic Oligonucleotide; LAG exon 3; Set C
agagaauggaguugagaag

SEQ ID NO: 64660 - RNA, 18 nt, Artificial Sequence
  Synthetic Oligonucleotide; LAG exon 3; Set C
agagaauggaguugagaa

SEQ ID NO: 64661 - RNA, 16 nt, Artificial Sequence
  Synthetic Oligonucleotide; LAG exon 3; Set C
gagaauggaguugaga

SEQ ID NO: 64662 - RNA, 20 nt, Artificial Sequence
  Synthetic Oligonucleotide; LAG exon 3; Set C
aagagaauggaguugagaag

SEQ ID NO: 64663 - RNA, 19 nt, Artificial Sequence
  Synthetic Oligonucleotide; LAG exon 3; Set C
aagagaauggaguugagaa

SEQ ID NO: 64664 - RNA, 17 nt, Artificial Sequence
  Synthetic Oligonucleotide; LAG exon 3; Set C
agagaauggaguugaga

SEQ ID NO: 64665 - RNA, 15 nt, Artificial Sequence
  Synthetic Oligonucleotide; LAG exon 3; Set C
gagaauggaguugag

SEQ ID NO: 64666 - RNA, 21 nt, Artificial Sequence
  Synthetic Oligonucleotide; LAG exon 3; Set C
aaagagaauggaguugagaag

SEQ ID NO: 64667 - RNA, 20 nt, Artificial Sequence
  Synthetic Oligonucleotide; LAG exon 3; Set C
aaagagaauggaguugagaa

SEQ ID NO: 64668 - RNA, 18 nt, Artificial Sequence
  Synthetic Oligonucleotide; LAG exon 3; Set C
aagagaauggaguugaga

SEQ ID NO: 64669 - RNA, 16 nt, Artificial Sequence
  Synthetic Oligonucleotide; LAG exon 3; Set C
agagaauggaguugag

SEQ ID NO: 64670 - RNA, 22 nt, Artificial Sequence
  Synthetic Oligonucleotide; LAG exon 3; Set C
gaaagagaauggaguugagaag

SEQ ID NO: 64671 - RNA, 21 nt, Artificial Sequence
  Synthetic Oligonucleotide; LAG exon 3; Set C
gaaagagaauggaguugagaa

SEQ ID NO: 64672 - RNA, 19 nt, Artificial Sequence
  Synthetic Oligonucleotide; LAG exon 3; Set C
aaagagaauggaguugaga

SEQ ID NO: 64673 - RNA, 17 nt, Artificial Sequence
  Synthetic Oligonucleotide; LAG exon 3; Set C
aagagaauggaguugag

SEQ ID NO: 64674 - RNA, 15 nt, Artificial Sequence
  Synthetic Oligonucleotide; LAG exon 3; Set C
agagaauggaguuga

SEQ ID NO: 64675 - RNA, 23 nt, Artificial Sequence
  Synthetic Oligonucleotide; LAG exon 3; Set C
ggaaagagaauggaguugagaag

SEQ ID NO: 64676 - RNA, 20 nt, Artificial Sequence
  Synthetic Oligonucleotide; LAG exon 3; Set C
gaaagagaauggaguugaga

SEQ ID NO: 64677 - RNA, 22 nt, Artificial Sequence
  Synthetic Oligonucleotide; LAG exon 3; Set C
ggaaagagaauggaguugagaa

SEQ ID NO: 64678 - RNA, 18 nt, Artificial Sequence
  Synthetic Oligonucleotide; LAG exon 3; Set C
aaagagaauggaguugag

SEQ ID NO: 64679 - RNA, 16 nt, Artificial Sequence
  Synthetic Oligonucleotide; LAG exon 3; Set C
aagagaauggaguuga

SEQ ID NO: 64680 - RNA, 24 nt, Artificial Sequence
  Synthetic Oligonucleotide; LAG exon 3; Set C
gggaaagagaauggaguugagaag

SEQ ID NO: 64681 - RNA, 23 nt, Artificial Sequence
  Synthetic Oligonucleotide; LAG exon 3; Set C
gggaaagagaauggaguugagaa

SEQ ID NO: 64682 - RNA, 21 nt, Artificial Sequence
  Synthetic Oligonucleotide; LAG exon 3; Set C
ggaaagagaauggaguugaga

SEQ ID NO: 64683 - RNA, 19 nt, Artificial Sequence
  Synthetic Oligonucleotide; LAG exon 3; Set C
gaaagagaauggaguugag

SEQ ID NO: 64684 - RNA, 17 nt, Artificial Sequence
  Synthetic Oligonucleotide; LAG exon 3; Set C
aaagagaauggaguuga

SEQ ID NO: 64685 - RNA, 15 nt, Artificial Sequence
  Synthetic Oligonucleotide; LAG exon 3; Set C
aagagaauggaguug

SEQ ID NO: 64686 - RNA, 25 nt, Artificial Sequence
  Synthetic Oligonucleotide; LAG exon 3; Set C
cgggaaagagaauggaguugagaag

SEQ ID NO: 64687 - RNA, 22 nt, Artificial Sequence
  Synthetic Oligonucleotide; LAG exon 3; Set C
gggaaagagaauggaguugaga

SEQ ID NO: 64688 - RNA, 24 nt, Artificial Sequence
  Synthetic Oligonucleotide; LAG exon 3; Set C
cgggaaagagaauggaguugagaa

SEQ ID NO: 64689 - RNA, 18 nt, Artificial Sequence
  Synthetic Oligonucleotide; LAG exon 3; Set C
gaaagagaauggaguuga

SEQ ID NO: 64690 - RNA, 16 nt, Artificial Sequence
  Synthetic Oligonucleotide; LAG exon 3; Set C
aaagagaauggaguug

SEQ ID NO: 64691 - RNA, 20 nt, Artificial Sequence
  Synthetic Oligonucleotide; LAG exon 3; Set C
ggaaagagaauggaguugag

SEQ ID NO: 64692 - RNA, 26 nt, Artificial Sequence
  Synthetic Oligonucleotide; LAG exon 3; Set A
gcgggaaagagaauggaguugagaag

SEQ ID NO: 64693 - RNA, 25 nt, Artificial Sequence
  Synthetic Oligonucleotide; LAG exon 3; Set A
gcgggaaagagaauggaguugagaa

SEQ ID NO: 64694 - RNA, 23 nt, Artificial Sequence
  Synthetic Oligonucleotide; LAG exon 3; Set C
cgggaaagagaauggaguugaga

SEQ ID NO: 64695 - RNA, 17 nt, Artificial Sequence
  Synthetic Oligonucleotide; LAG exon 3; Set C
gaaagagaauggaguug

SEQ ID NO: 64696 - RNA, 21 nt, Artificial Sequence
  Synthetic Oligonucleotide; LAG exon 3; Set C
gggaaagagaauggaguugag

SEQ ID NO: 64697 - RNA, 19 nt, Artificial Sequence
  Synthetic Oligonucleotide; LAG exon 3; Set C
ggaaagagaauggaguuga

SEQ ID NO: 64698 - RNA, 27 nt, Artificial Sequence
  Synthetic Oligonucleotide; LAG exon 3; Set A
ggcgggaaagagaauggaguugagaag

SEQ ID NO: 64699 - RNA, 26 nt, Artificial Sequence
  Synthetic Oligonucleotide; LAG exon 3; Set A
ggcgggaaagagaauggaguugagaa

SEQ ID NO: 64700 - RNA, 24 nt, Artificial Sequence
  Synthetic Oligonucleotide; LAG exon 3; Set A
gcgggaaagagaauggaguugaga

SEQ ID NO: 64701 - RNA, 20 nt, Artificial Sequence
  Synthetic Oligonucleotide; LAG exon 3; Set C
gggaaagagaauggaguuga

SEQ ID NO: 64702 - RNA, 18 nt, Artificial Sequence
  Synthetic Oligonucleotide; LAG exon 3; Set C
ggaaagagaauggaguug

SEQ ID NO: 64703 - RNA, 22 nt, Artificial Sequence
  Synthetic Oligonucleotide; LAG exon 3; Set C
cgggaaagagaauggaguugag

SEQ ID NO: 64704 - RNA, 28 nt, Artificial Sequence
  Synthetic Oligonucleotide; LAG exon 3; Set A
gggcgggaaagagaauggaguugagaag

SEQ ID NO: 64705 - RNA, 25 nt, Artificial Sequence
  Synthetic Oligonucleotide; LAG exon 3; Set A
ggcgggaaagagaauggaguugaga

SEQ ID NO: 64706 - RNA, 27 nt, Artificial Sequence
  Synthetic Oligonucleotide; LAG exon 3; Set A
gggcgggaaagagaauggaguugagaa

SEQ ID NO: 64707 - RNA, 19 nt, Artificial Sequence
  Synthetic Oligonucleotide; LAG exon 3; Set C
gggaaagagaauggaguug

SEQ ID NO: 64708 - RNA, 23 nt, Artificial Sequence
  Synthetic Oligonucleotide; LAG exon 3; Set C
gcgggaaagagaauggaguugag

SEQ ID NO: 64709 - RNA, 21 nt, Artificial Sequence
  Synthetic Oligonucleotide; LAG exon 3; Set C
cgggaaagagaauggaguuga

SEQ ID NO: 64710 - RNA, 26 nt, Artificial Sequence
  Synthetic Oligonucleotide; LAG exon 3; Set A
gggcgggaaagagaauggaguugaga

SEQ ID NO: 64711 - RNA, 24 nt, Artificial Sequence
  Synthetic Oligonucleotide; LAG exon 3; Set A
ggcgggaaagagaauggaguugag

SEQ ID NO: 64712 - RNA, 22 nt, Artificial Sequence
  Synthetic Oligonucleotide; LAG exon 3; Set C
gcgggaaagagaauggaguuga

SEQ ID NO: 64713 - RNA, 20 nt, Artificial Sequence
  Synthetic Oligonucleotide; LAG exon 3; Set C
cgggaaagagaauggaguug

SEQ ID NO: 64714 - RNA, 23 nt, Artificial Sequence
  Synthetic Oligonucleotide; LAG exon 3; Set A
ggcgggaaagagaauggaguuga

SEQ ID NO: 64715 - RNA, 21 nt, Artificial Sequence
  Synthetic Oligonucleotide; LAG exon 3; Set C
gcgggaaagagaauggaguug

SEQ ID NO: 64716 - RNA, 25 nt, Artificial Sequence
  Synthetic Oligonucleotide; LAG exon 3; Set A
gggcgggaaagagaauggaguugag

SEQ ID NO: 64717 - RNA, 22 nt, Artificial Sequence
  Synthetic Oligonucleotide; LAG exon 3; Set C
ggcgggaaagagaauggaguug

SEQ ID NO: 64718 - RNA, 24 nt, Artificial Sequence
  Synthetic Oligonucleotide; LAG exon 3; Set A
gggcgggaaagagaauggaguuga

SEQ ID NO: 64719 - RNA, 23 nt, Artificial Sequence
  Synthetic Oligonucleotide; LAG exon 3; Set A
gggcgggaaagagaauggaguug

SEQ ID NO: 64720 - RNA, 15 nt, Artificial Sequence
  Synthetic Oligonucleotide; LAG exon 3; Set C
gggcgggaaagagaa

SEQ ID NO: 64721 - RNA, 16 nt, Artificial Sequence
  Synthetic Oligonucleotide; LAG exon 3; Set C
ugggcgggaaagagaa

SEQ ID NO: 64722 - RNA, 15 nt, Artificial Sequence
  Synthetic Oligonucleotide; LAG exon 3; Set C
ugggcgggaaagaga

SEQ ID NO: 64723 - RNA, 39 nt, Artificial Sequence
  Synthetic Oligonucleotide; LAG exon 3; Set C
gggggcggcagcgggcgggccacugggcgggaaagagaa

SEQ ID NO: 64724 - RNA, 38 nt, Artificial Sequence
  Synthetic Oligonucleotide; LAG exon 3; Set C
gggggcggcagcgggcgggccacugggcgggaaagaga

SEQ ID NO: 64725 - RNA, 37 nt, Artificial Sequence
  Synthetic Oligonucleotide; LAG exon 3; Set C
gggggcggcagcgggcgggccacugggcgggaaagag

SEQ ID NO: 64726 - RNA, 40 nt, Artificial Sequence
  Synthetic Oligonucleotide; LAG exon 3; Set C
gauggccgggggcggcagcgggcgggccacugggcgggaa

SEQ ID NO: 64727 - RNA, 18 nt, Artificial Sequence
  Synthetic Oligonucleotide; LAG exon 3; Set C
aagcuccagggguaggaa

SEQ ID NO: 64728 - RNA, 19 nt, Artificial Sequence
  Synthetic Oligonucleotide; LAG exon 3; Set A
gaagcuccagggguaggaa

SEQ ID NO: 64729 - RNA, 20 nt, Artificial Sequence
  Synthetic Oligonucleotide; LAG exon 3; Set A
agaagcuccagggguaggaa

SEQ ID NO: 64730 - RNA, 21 nt, Artificial Sequence
  Synthetic Oligonucleotide; LAG exon 3; Set A
gagaagcuccagggguaggaa

SEQ ID NO: 64731 - RNA, 31 nt, Artificial Sequence
  Synthetic Oligonucleotide; LAG exon 3; Set C
gaauggaguugagaagcuccagggguaggaa

SEQ ID NO: 64732 - RNA, 32 nt, Artificial Sequence
  Synthetic Oligonucleotide; LAG exon 3; Set C
agaauggaguugagaagcuccagggguaggaa

SEQ ID NO: 64733 - RNA, 38 nt, Artificial Sequence
  Synthetic Oligonucleotide; LAG exon 3; Set C
ggaaagagaauggaguugagaagcuccagggguaggaa

SEQ ID NO: 64734 - RNA, 39 nt, Artificial Sequence
  Synthetic Oligonucleotide; LAG exon 3; Set C
gggaaagagaauggaguugagaagcuccagggguaggaa

SEQ ID NO: 64735 - RNA, 40 nt, Artificial Sequence
  Synthetic Oligonucleotide; LAG exon 3; Set C
cgggaaagagaauggaguugagaagcuccagggguaggaa

SEQ ID NO: 64736 - RNA, 29 nt, Artificial Sequence
  Synthetic Oligonucleotide; LAG exon 3; Set A
ugggcgggaaagagaauggaguugagaag

SEQ ID NO: 64737 - RNA, 28 nt, Artificial Sequence
  Synthetic Oligonucleotide; LAG exon 3; Set A
ugggcgggaaagagaauggaguugagaa

SEQ ID NO: 64738 - RNA, 27 nt, Artificial Sequence
  Synthetic Oligonucleotide; LAG exon 3; Set A
ugggcgggaaagagaauggaguugaga

SEQ ID NO: 64739 - RNA, 26 nt, Artificial Sequence
  Synthetic Oligonucleotide; LAG exon 3; Set A
ugggcgggaaagagaauggaguugag

SEQ ID NO: 64740 - RNA, 25 nt, Artificial Sequence
  Synthetic Oligonucleotide; LAG exon 3; Set A
ugggcgggaaagagaauggaguuga

SEQ ID NO: 64741 - RNA, 24 nt, Artificial Sequence
  Synthetic Oligonucleotide; LAG exon 3; Set A
ugggcgggaaagagaauggaguug

SEQ ID NO: 64742 - RNA, 40 nt, Artificial Sequence
  Synthetic Oligonucleotide; LAG exon 3; Set C
agcgggcgggccacugggcgggaaagagaauggaguugag

SEQ ID NO: 64743 - RNA, 39 nt, Artificial Sequence
  Synthetic Oligonucleotide; LAG exon 3; Set C
agcgggcgggccacugggcgggaaagagaauggaguuga

SEQ ID NO: 64744 - RNA, 38 nt, Artificial Sequence
  Synthetic Oligonucleotide; LAG exon 3; Set C
agcgggcgggccacugggcgggaaagagaauggaguug

SEQ ID NO: 64745 - RNA, 40 nt, Artificial Sequence
  Synthetic Oligonucleotide; LAG exon 3; Set C
cagcgggcgggccacugggcgggaaagagaauggaguuga

SEQ ID NO: 64746 - RNA, 39 nt, Artificial Sequence
  Synthetic Oligonucleotide; LAG exon 3; Set C
cagcgggcgggccacugggcgggaaagagaauggaguug

SEQ ID NO: 64747 - RNA, 30 nt, Artificial Sequence
  Synthetic Oligonucleotide; LAG exon 3; Set C
agcgggcgggccacugggcgggaaagagaa

SEQ ID NO: 64748 - RNA, 29 nt, Artificial Sequence
  Synthetic Oligonucleotide; LAG exon 3; Set C
agcgggcgggccacugggcgggaaagaga

SEQ ID NO: 64749 - RNA, 31 nt, Artificial Sequence
  Synthetic Oligonucleotide; LAG exon 3; Set C
cagcgggcgggccacugggcgggaaagagaa

SEQ ID NO: 64750 - RNA, 28 nt, Artificial Sequence
  Synthetic Oligonucleotide; LAG exon 3; Set C
agcgggcgggccacugggcgggaaagag

SEQ ID NO: 64751 - RNA, 30 nt, Artificial Sequence
  Synthetic Oligonucleotide; LAG exon 3; Set C
cagcgggcgggccacugggcgggaaagaga

SEQ ID NO: 64752 - RNA, 27 nt, Artificial Sequence
  Synthetic Oligonucleotide; LAG exon 3; Set C
agcgggcgggccacugggcgggaaaga

SEQ ID NO: 64753 - RNA, 29 nt, Artificial Sequence
  Synthetic Oligonucleotide; LAG exon 3; Set C
cagcgggcgggccacugggcgggaaagag

SEQ ID NO: 64754 - RNA, 26 nt, Artificial Sequence
  Synthetic Oligonucleotide; LAG exon 3; Set C
agcgggcgggccacugggcgggaaag

SEQ ID NO: 64755 - RNA, 28 nt, Artificial Sequence
  Synthetic Oligonucleotide; LAG exon 3; Set C
cagcgggcgggccacugggcgggaaaga

SEQ ID NO: 64756 - RNA, 25 nt, Artificial Sequence
  Synthetic Oligonucleotide; LAG exon 3; Set C
agcgggcgggccacugggcgggaaa

SEQ ID NO: 64757 - RNA, 27 nt, Artificial Sequence
  Synthetic Oligonucleotide; LAG exon 3; Set C
cagcgggcgggccacugggcgggaaag

SEQ ID NO: 64758 - RNA, 24 nt, Artificial Sequence
  Synthetic Oligonucleotide; LAG exon 3; Set C
agcgggcgggccacugggcgggaa

SEQ ID NO: 64759 - RNA, 26 nt, Artificial Sequence
  Synthetic Oligonucleotide; LAG exon 3; Set C
cagcgggcgggccacugggcgggaaa

SEQ ID NO: 64760 - RNA, 25 nt, Artificial Sequence
  Synthetic Oligonucleotide; LAG exon 3; Set C
cagcgggcgggccacugggcgggaa

SEQ ID NO: 64761 - RNA, 36 nt, Artificial Sequence
  Synthetic Oligonucleotide; LAG exon 3; Set C
gggggcggcagcgggcgggccacugggcgggaaaga

SEQ ID NO: 64762 - RNA, 35 nt, Artificial Sequence
  Synthetic Oligonucleotide; LAG exon 3; Set C
gggggcggcagcgggcgggccacugggcgggaaag

SEQ ID NO: 64763 - RNA, 34 nt, Artificial Sequence
  Synthetic Oligonucleotide; LAG exon 3; Set C
gggggcggcagcgggcgggccacugggcgggaaa

SEQ ID NO: 64764 - RNA, 33 nt, Artificial Sequence
  Synthetic Oligonucleotide; LAG exon 3; Set C
gggggcggcagcgggcgggccacugggcgggaa

SEQ ID NO: 64765 - RNA, 32 nt, Artificial Sequence
  Synthetic Oligonucleotide; LAG exon 3; Set C
gggggcggcagcgggcgggccacugggcggga

SEQ ID NO: 64766 - RNA, 31 nt, Artificial Sequence
  Synthetic Oligonucleotide; LAG exon 3; Set C
gggggcggcagcgggcgggccacugggcggg

SEQ ID NO: 64767 - RNA, 29 nt, Artificial Sequence
  Synthetic Oligonucleotide; LAG exon 3; Set C
gggggcggcagcgggcgggccacugggcg

SEQ ID NO: 64768 - RNA, 39 nt, Artificial Sequence
  Synthetic Oligonucleotide; LAG exon 3; Set C
gauggccgggggcggcagcgggcgggccacugggcggga

SEQ ID NO: 64769 - RNA, 38 nt, Artificial Sequence
  Synthetic Oligonucleotide; LAG exon 3; Set C
gauggccgggggcggcagcgggcgggccacugggcggg

SEQ ID NO: 64770 - RNA, 40 nt, Artificial Sequence
  Synthetic Oligonucleotide; LAG exon 3; Set C
ggauggccgggggcggcagcgggcgggccacugggcggga

SEQ ID NO: 64771 - RNA, 39 nt, Artificial Sequence
  Synthetic Oligonucleotide; LAG exon 3; Set C
ggauggccgggggcggcagcgggcgggccacugggcggg

SEQ ID NO: 64772 - RNA, 37 nt, Artificial Sequence
  Synthetic Oligonucleotide; LAG exon 3; Set C
gauggccgggggcggcagcgggcgggccacugggcgg

SEQ ID NO: 64773 - RNA, 40 nt, Artificial Sequence
  Synthetic Oligonucleotide; LAG exon 3; Set C
gggauggccgggggcggcagcgggcgggccacugggcggg

SEQ ID NO: 64774 - RNA, 36 nt, Artificial Sequence
  Synthetic Oligonucleotide; LAG exon 3; Set C
gauggccgggggcggcagcgggcgggccacugggcg

SEQ ID NO: 64775 - RNA, 38 nt, Artificial Sequence
  Synthetic Oligonucleotide; LAG exon 3; Set C
ggauggccgggggcggcagcgggcgggccacugggcgg

SEQ ID NO: 64776 - RNA, 35 nt, Artificial Sequence
  Synthetic Oligonucleotide; LAG exon 3; Set C
gauggccgggggcggcagcgggcgggccacugggc

SEQ ID NO: 64777 - RNA, 37 nt, Artificial Sequence
  Synthetic Oligonucleotide; LAG exon 3; Set C
ggauggccgggggcggcagcgggcgggccacugggcg

SEQ ID NO: 64778 - RNA, 39 nt, Artificial Sequence
  Synthetic Oligonucleotide; LAG exon 3; Set C
gggauggccgggggcggcagcgggcgggccacugggcgg

SEQ ID NO: 64779 - RNA, 38 nt, Artificial Sequence
  Synthetic Oligonucleotide; LAG exon 3; Set C
gggauggccgggggcggcagcgggcgggccacugggcg

SEQ ID NO: 64780 - RNA, 36 nt, Artificial Sequence
  Synthetic Oligonucleotide; LAG exon 3; Set C
ggauggccgggggcggcagcgggcgggccacugggc

SEQ ID NO: 64781 - RNA, 40 nt, Artificial Sequence
  Synthetic Oligonucleotide; LAG exon 3; Set C
ggggauggccgggggcggcagcgggcgggccacugggcgg

SEQ ID NO: 64782 - RNA, 37 nt, Artificial Sequence
  Synthetic Oligonucleotide; LAG exon 3; Set C
gggauggccgggggcggcagcgggcgggccacugggc

SEQ ID NO: 64783 - RNA, 39 nt, Artificial Sequence
  Synthetic Oligonucleotide; LAG exon 3; Set C
ggggauggccgggggcggcagcgggcgggccacugggcg

SEQ ID NO: 64784 - RNA, 38 nt, Artificial Sequence
  Synthetic Oligonucleotide; LAG exon 3; Set C
ggggauggccgggggcggcagcgggcgggccacugggc

SEQ ID NO: 64785 - RNA, 19 nt, Artificial Sequence
  Synthetic Oligonucleotide; LAG exon 3; Set C
gauggccgggggcggcagc

SEQ ID NO: 64786 - RNA, 20 nt, Artificial Sequence
  Synthetic Oligonucleotide; LAG exon 3; Set C
ggauggccgggggcggcagc

SEQ ID NO: 64787 - RNA, 18 nt, Artificial Sequence
  Synthetic Oligonucleotide; LAG exon 3; Set C
gauggccgggggcggcag

SEQ ID NO: 64788 - RNA, 21 nt, Artificial Sequence
  Synthetic Oligonucleotide; LAG exon 3; Set C
gggauggccgggggcggcagc

SEQ ID NO: 64789 - RNA, 19 nt, Artificial Sequence
  Synthetic Oligonucleotide; LAG exon 3; Set C
ggauggccgggggcggcag

SEQ ID NO: 64790 - RNA, 22 nt, Artificial Sequence
  Synthetic Oligonucleotide; LAG exon 3; Set C
ggggauggccgggggcggcagc

SEQ ID NO: 64791 - RNA, 20 nt, Artificial Sequence
  Synthetic Oligonucleotide; LAG exon 3; Set C
gggauggccgggggcggcag

SEQ ID NO: 64792 - RNA, 21 nt, Artificial Sequence
  Synthetic Oligonucleotide; LAG exon 3; Set C
ggggauggccgggggcggcag

SEQ ID NO: 64793 - RNA, 29 nt, Artificial Sequence
  Synthetic Oligonucleotide; LAG exon 3; Set C
ggggccaggggauggccgggggcggcagc

SEQ ID NO: 64794 - RNA, 30 nt, Artificial Sequence
  Synthetic Oligonucleotide; LAG exon 3; Set C
gggggccaggggauggccgggggcggcagc

SEQ ID NO: 64795 - RNA, 20 nt, Artificial Sequence
  Synthetic Oligonucleotide; LAG exon 3; Set C
ggggccaggggauggccggg

SEQ ID NO: 64796 - RNA, 21 nt, Artificial Sequence
  Synthetic Oligonucleotide; LAG exon 3; Set C
gggggccaggggauggccggg

SEQ ID NO: 64797 - RNA, 37 nt, Artificial Sequence
  Synthetic Oligonucleotide; LAG exon 3; Set C
aguccccgcgcugccggccgcgcucauccagcuggac

SEQ ID NO: 64798 - RNA, 36 nt, Artificial Sequence
  Synthetic Oligonucleotide; LAG exon 3; Set C
aguccccgcgcugccggccgcgcucauccagcugga

SEQ ID NO: 64799 - RNA, 15 nt, Artificial Sequence
  Synthetic Oligonucleotide; LAG exon 3; Set B
cgcggucccugaggu

SEQ ID NO: 64800 - RNA, 16 nt, Artificial Sequence
  Synthetic Oligonucleotide; LAG exon 3; Set B
gcgcggucccugaggu

SEQ ID NO: 64801 - RNA, 17 nt, Artificial Sequence
  Synthetic Oligonucleotide; LAG exon 3; Set C
ggcgcggucccugaggu

SEQ ID NO: 64802 - RNA, 18 nt, Artificial Sequence
  Synthetic Oligonucleotide; LAG exon 3; Set C
gggcgcggucccugaggu

SEQ ID NO: 64803 - RNA, 16 nt, Artificial Sequence
  Synthetic Oligonucleotide; LAG exon 3; Set B
ggcgcggucccugagg

SEQ ID NO: 64804 - RNA, 19 nt, Artificial Sequence
  Synthetic Oligonucleotide; LAG exon 3; Set C
agggcgcggucccugaggu

SEQ ID NO: 64805 - RNA, 17 nt, Artificial Sequence
  Synthetic Oligonucleotide; LAG exon 3; Set C
gggcgcggucccugagg

SEQ ID NO: 64806 - RNA, 20 nt, Artificial Sequence
  Synthetic Oligonucleotide; LAG exon 3; Set C
gagggcgcggucccugaggu

SEQ ID NO: 64807 - RNA, 18 nt, Artificial Sequence
  Synthetic Oligonucleotide; LAG exon 3; Set C
agggcgcggucccugagg

SEQ ID NO: 64808 - RNA, 19 nt, Artificial Sequence
  Synthetic Oligonucleotide; LAG exon 3; Set C
gagggcgcggucccugagg

SEQ ID NO: 64809 - RNA, 19 nt, Artificial Sequence
  Synthetic Oligonucleotide; LAG exon 3; Set C
uugagaagcuccaggggua

SEQ ID NO: 64810 - RNA, 29 nt, Artificial Sequence
  Synthetic Oligonucleotide; LAG exon 3; Set C
gagaauggaguugagaagcuccaggggua

SEQ ID NO: 64811 - RNA, 30 nt, Artificial Sequence
  Synthetic Oligonucleotide; LAG exon 3; Set C
agagaauggaguugagaagcuccaggggua

SEQ ID NO: 64812 - RNA, 31 nt, Artificial Sequence
  Synthetic Oligonucleotide; LAG exon 3; Set A
aagagaauggaguugagaagcuccaggggua

SEQ ID NO: 64813 - RNA, 32 nt, Artificial Sequence
  Synthetic Oligonucleotide; LAG exon 3; Set A
aaagagaauggaguugagaagcuccaggggua

SEQ ID NO: 64814 - RNA, 33 nt, Artificial Sequence
  Synthetic Oligonucleotide; LAG exon 3; Set A
gaaagagaauggaguugagaagcuccaggggua

SEQ ID NO: 64815 - RNA, 15 nt, Artificial Sequence
  Synthetic Oligonucleotide; LAG exon 3; Set C
aaagagaauggaguu

SEQ ID NO: 64816 - RNA, 16 nt, Artificial Sequence
  Synthetic Oligonucleotide; LAG exon 3; Set C
gaaagagaauggaguu

SEQ ID NO: 64817 - RNA, 15 nt, Artificial Sequence
  Synthetic Oligonucleotide; LAG exon 3; Set C
gaaagagaauggagu

SEQ ID NO: 64818 - RNA, 40 nt, Artificial Sequence
  Synthetic Oligonucleotide; LAG exon 3; Set C
gcgggcgggccacugggcgggaaagagaauggaguugaga

SEQ ID NO: 64819 - RNA, 39 nt, Artificial Sequence
  Synthetic Oligonucleotide; LAG exon 3; Set C
gcgggcgggccacugggcgggaaagagaauggaguugag

SEQ ID NO: 64820 - RNA, 38 nt, Artificial Sequence
  Synthetic Oligonucleotide; LAG exon 3; Set C
gcgggcgggccacugggcgggaaagagaauggaguuga

SEQ ID NO: 64821 - RNA, 37 nt, Artificial Sequence
  Synthetic Oligonucleotide; LAG exon 3; Set C
gcgggcgggccacugggcgggaaagagaauggaguug

SEQ ID NO: 64822 - RNA, 29 nt, Artificial Sequence
  Synthetic Oligonucleotide; LAG exon 3; Set C
gcgggcgggccacugggcgggaaagagaa

SEQ ID NO: 64823 - RNA, 28 nt, Artificial Sequence
  Synthetic Oligonucleotide; LAG exon 3; Set C
gcgggcgggccacugggcgggaaagaga

SEQ ID NO: 64824 - RNA, 27 nt, Artificial Sequence
  Synthetic Oligonucleotide; LAG exon 3; Set C
gcgggcgggccacugggcgggaaagag

SEQ ID NO: 64825 - RNA, 26 nt, Artificial Sequence
  Synthetic Oligonucleotide; LAG exon 3; Set C
gcgggcgggccacugggcgggaaaga

SEQ ID NO: 64826 - RNA, 32 nt, Artificial Sequence
  Synthetic Oligonucleotide; LAG exon 3; Set C
gcagcgggcgggccacugggcgggaaagagaa

SEQ ID NO: 64827 - RNA, 25 nt, Artificial Sequence
  Synthetic Oligonucleotide; LAG exon 3; Set C
gcgggcgggccacugggcgggaaag

SEQ ID NO: 64828 - RNA, 31 nt, Artificial Sequence
  Synthetic Oligonucleotide; LAG exon 3; Set C
gcagcgggcgggccacugggcgggaaagaga

SEQ ID NO: 64829 - RNA, 33 nt, Artificial Sequence
  Synthetic Oligonucleotide; LAG exon 3; Set C
ggcagcgggcgggccacugggcgggaaagagaa

SEQ ID NO: 64830 - RNA, 24 nt, Artificial Sequence
  Synthetic Oligonucleotide; LAG exon 3; Set C
gcgggcgggccacugggcgggaaa

SEQ ID NO: 64831 - RNA, 30 nt, Artificial Sequence
  Synthetic Oligonucleotide; LAG exon 3; Set C
gcagcgggcgggccacugggcgggaaagag

SEQ ID NO: 64832 - RNA, 32 nt, Artificial Sequence
  Synthetic Oligonucleotide; LAG exon 3; Set C
ggcagcgggcgggccacugggcgggaaagaga

SEQ ID NO: 64833 - RNA, 23 nt, Artificial Sequence
  Synthetic Oligonucleotide; LAG exon 3; Set C
gcgggcgggccacugggcgggaa

SEQ ID NO: 64834 - RNA, 31 nt, Artificial Sequence
  Synthetic Oligonucleotide; LAG exon 3; Set C
ggcagcgggcgggccacugggcgggaaagag

SEQ ID NO: 64835 - RNA, 22 nt, Artificial Sequence
  Synthetic Oligonucleotide; LAG exon 3; Set C
gcgggcgggccacugggcggga

SEQ ID NO: 64836 - RNA, 23 nt, Artificial Sequence
  Synthetic Oligonucleotide; LAG exon 3; Set C
agcgggcgggccacugggcggga

SEQ ID NO: 64837 - RNA, 22 nt, Artificial Sequence
  Synthetic Oligonucleotide; LAG exon 3; Set C
agcgggcgggccacugggcggg

SEQ ID NO: 64838 - RNA, 24 nt, Artificial Sequence
  Synthetic Oligonucleotide; LAG exon 3; Set C
cagcgggcgggccacugggcggga

SEQ ID NO: 64839 - RNA, 23 nt, Artificial Sequence
  Synthetic Oligonucleotide; LAG exon 3; Set C
cagcgggcgggccacugggcggg

SEQ ID NO: 64840 - RNA, 21 nt, Artificial Sequence
  Synthetic Oligonucleotide; LAG exon 3; Set C
agcgggcgggccacugggcgg

SEQ ID NO: 64841 - RNA, 20 nt, Artificial Sequence
  Synthetic Oligonucleotide; LAG exon 3; Set C
agcgggcgggccacugggcg

SEQ ID NO: 64842 - RNA, 22 nt, Artificial Sequence
  Synthetic Oligonucleotide; LAG exon 3; Set C
cagcgggcgggccacugggcgg

SEQ ID NO: 64843 - RNA, 19 nt, Artificial Sequence
  Synthetic Oligonucleotide; LAG exon 3; Set C
agcgggcgggccacugggc

SEQ ID NO: 64844 - RNA, 21 nt, Artificial Sequence
  Synthetic Oligonucleotide; LAG exon 3; Set C
cagcgggcgggccacugggcg

SEQ ID NO: 64845 - RNA, 20 nt, Artificial Sequence
  Synthetic Oligonucleotide; LAG exon 3; Set C
cagcgggcgggccacugggc

SEQ ID NO: 64846 - RNA, 18 nt, Artificial Sequence
  Synthetic Oligonucleotide; LAG exon 3; Set C
agcgggcgggccacuggg

SEQ ID NO: 64847 - RNA, 30 nt, Artificial Sequence
  Synthetic Oligonucleotide; LAG exon 3; Set C
gggggcggcagcgggcgggccacugggcgg

SEQ ID NO: 64848 - RNA, 28 nt, Artificial Sequence
  Synthetic Oligonucleotide; LAG exon 3; Set C
gggggcggcagcgggcgggccacugggc

SEQ ID NO: 64849 - RNA, 27 nt, Artificial Sequence
  Synthetic Oligonucleotide; LAG exon 3; Set C
gggggcggcagcgggcgggccacuggg

SEQ ID NO: 64850 - RNA, 26 nt, Artificial Sequence
  Synthetic Oligonucleotide; LAG exon 3; Set C
gggggcggcagcgggcgggccacugg

SEQ ID NO: 64851 - RNA, 34 nt, Artificial Sequence
  Synthetic Oligonucleotide; LAG exon 3; Set C
gauggccgggggcggcagcgggcgggccacuggg

SEQ ID NO: 64852 - RNA, 35 nt, Artificial Sequence
  Synthetic Oligonucleotide; LAG exon 3; Set C
ggauggccgggggcggcagcgggcgggccacuggg

SEQ ID NO: 64853 - RNA, 33 nt, Artificial Sequence
  Synthetic Oligonucleotide; LAG exon 3; Set C
gauggccgggggcggcagcgggcgggccacugg

SEQ ID NO: 64854 - RNA, 36 nt, Artificial Sequence
  Synthetic Oligonucleotide; LAG exon 3; Set C
gggauggccgggggcggcagcgggcgggccacuggg

SEQ ID NO: 64855 - RNA, 34 nt, Artificial Sequence
  Synthetic Oligonucleotide; LAG exon 3; Set C
ggauggccgggggcggcagcgggcgggccacugg

SEQ ID NO: 64856 - RNA, 37 nt, Artificial Sequence
  Synthetic Oligonucleotide; LAG exon 3; Set C
ggggauggccgggggcggcagcgggcgggccacuggg

SEQ ID NO: 64857 - RNA, 35 nt, Artificial Sequence
  Synthetic Oligonucleotide; LAG exon 3; Set C
gggauggccgggggcggcagcgggcgggccacugg

SEQ ID NO: 64858 - RNA, 36 nt, Artificial Sequence
  Synthetic Oligonucleotide; LAG exon 3; Set C
ggggauggccgggggcggcagcgggcgggccacugg

SEQ ID NO: 64859 - RNA, 20 nt, Artificial Sequence
  Synthetic Oligonucleotide; LAG exon 3; Set C
gauggccgggggcggcagcg

SEQ ID NO: 64860 - RNA, 21 nt, Artificial Sequence
  Synthetic Oligonucleotide; LAG exon 3; Set C
ggauggccgggggcggcagcg

SEQ ID NO: 64861 - RNA, 22 nt, Artificial Sequence
  Synthetic Oligonucleotide; LAG exon 3; Set C
gggauggccgggggcggcagcg

SEQ ID NO: 64862 - RNA, 23 nt, Artificial Sequence
  Synthetic Oligonucleotide; LAG exon 3; Set C
ggggauggccgggggcggcagcg

SEQ ID NO: 64863 - RNA, 30 nt, Artificial Sequence
  Synthetic Oligonucleotide; LAG exon 3; Set C
ggggccaggggauggccgggggcggcagcg

SEQ ID NO: 64864 - RNA, 31 nt, Artificial Sequence
  Synthetic Oligonucleotide; LAG exon 3; Set C
gggggccaggggauggccgggggcggcagcg

SEQ ID NO: 64865 - RNA, 28 nt, Artificial Sequence
  Synthetic Oligonucleotide; LAG exon 3; Set C
ggggccaggggauggccgggggcggcag

SEQ ID NO: 64866 - RNA, 29 nt, Artificial Sequence
  Synthetic Oligonucleotide; LAG exon 3; Set C
gggggccaggggauggccgggggcggcag

SEQ ID NO: 64867 - RNA, 15 nt, Artificial Sequence
  Synthetic Oligonucleotide; LAG exon 3; Set A
caggggauggccggg

SEQ ID NO: 64868 - RNA, 40 nt, Artificial Sequence
  Synthetic Oligonucleotide; LAG exon 3; Set C
ggugagggccgggggccaggggauggccgggggcggcagc

SEQ ID NO: 64869 - RNA, 31 nt, Artificial Sequence
  Synthetic Oligonucleotide; LAG exon 3; Set C
ggugagggccgggggccaggggauggccggg

SEQ ID NO: 64870 - RNA, 24 nt, Artificial Sequence
  Synthetic Oligonucleotide; LAG exon 3; Set C
ggugagggccgggggccaggggau

SEQ ID NO: 64871 - RNA, 23 nt, Artificial Sequence
  Synthetic Oligonucleotide; LAG exon 3; Set C
ggugagggccgggggccagggga

SEQ ID NO: 64872 - RNA, 22 nt, Artificial Sequence
  Synthetic Oligonucleotide; LAG exon 3; Set C
ggugagggccgggggccagggg

SEQ ID NO: 64873 - RNA, 21 nt, Artificial Sequence
  Synthetic Oligonucleotide; LAG exon 3; Set C
ggugagggccgggggccaggg

SEQ ID NO: 64874 - RNA, 36 nt, Artificial Sequence
  Synthetic Oligonucleotide; LAG exon 3; Set C
agggcgccgccgggugagggccgggggccaggggau

SEQ ID NO: 64875 - RNA, 35 nt, Artificial Sequence
  Synthetic Oligonucleotide; LAG exon 3; Set C
agggcgccgccgggugagggccgggggccagggga

SEQ ID NO: 64876 - RNA, 34 nt, Artificial Sequence
  Synthetic Oligonucleotide; LAG exon 3; Set C
agggcgccgccgggugagggccgggggccagggg

SEQ ID NO: 64877 - RNA, 33 nt, Artificial Sequence
  Synthetic Oligonucleotide; LAG exon 3; Set C
agggcgccgccgggugagggccgggggccaggg

SEQ ID NO: 64878 - RNA, 17 nt, Artificial Sequence
  Synthetic Oligonucleotide; LAG exon 3; Set C
gacgcggggcugcaggg

SEQ ID NO: 64879 - RNA, 18 nt, Artificial Sequence
  Synthetic Oligonucleotide; LAG exon 3; Set C
ggacgcggggcugcaggg

SEQ ID NO: 64880 - RNA, 16 nt, Artificial Sequence
  Synthetic Oligonucleotide; LAG exon 3; Set A
gacgcggggcugcagg

SEQ ID NO: 64881 - RNA, 17 nt, Artificial Sequence
  Synthetic Oligonucleotide; LAG exon 3; Set C
ggacgcggggcugcagg

SEQ ID NO: 64882 - RNA, 19 nt, Artificial Sequence
  Synthetic Oligonucleotide; LAG exon 3; Set C
uggacgcggggcugcaggg

SEQ ID NO: 64883 - RNA, 18 nt, Artificial Sequence
  Synthetic Oligonucleotide; LAG exon 3; Set C
uggacgcggggcugcagg

SEQ ID NO: 64884 - RNA, 32 nt, Artificial Sequence
  Synthetic Oligonucleotide; LAG exon 3; Set C
gcgcucauccagcuggacgcggggcugcaggg

SEQ ID NO: 64885 - RNA, 18 nt, Artificial Sequence
  Synthetic Oligonucleotide; LAG exon 3; Set A
gcgcucauccagcuggac

SEQ ID NO: 64886 - RNA, 17 nt, Artificial Sequence
  Synthetic Oligonucleotide; LAG exon 3; Set A
gcgcucauccagcugga

SEQ ID NO: 64887 - RNA, 16 nt, Artificial Sequence
  Synthetic Oligonucleotide; LAG exon 3; Set A
gcgcucauccagcugg

SEQ ID NO: 64888 - RNA, 36 nt, Artificial Sequence
  Synthetic Oligonucleotide; LAG exon 3; Set C
guccccgcgcugccggccgcgcucauccagcuggac

SEQ ID NO: 64889 - RNA, 35 nt, Artificial Sequence
  Synthetic Oligonucleotide; LAG exon 3; Set C
guccccgcgcugccggccgcgcucauccagcugga

SEQ ID NO: 64890 - RNA, 34 nt, Artificial Sequence
  Synthetic Oligonucleotide; LAG exon 3; Set C
guccccgcgcugccggccgcgcucauccagcugg

SEQ ID NO: 64891 - RNA, 38 nt, Artificial Sequence
  Synthetic Oligonucleotide; LAG exon 3; Set C
aaguccccgcgcugccggccgcgcucauccagcuggac

SEQ ID NO: 64892 - RNA, 37 nt, Artificial Sequence
  Synthetic Oligonucleotide; LAG exon 3; Set C
aaguccccgcgcugccggccgcgcucauccagcugga

SEQ ID NO: 64893 - RNA, 35 nt, Artificial Sequence
  Synthetic Oligonucleotide; LAG exon 3; Set C
aguccccgcgcugccggccgcgcucauccagcugg

SEQ ID NO: 64894 - RNA, 39 nt, Artificial Sequence
  Synthetic Oligonucleotide; LAG exon 3; Set C
gaaguccccgcgcugccggccgcgcucauccagcuggac

SEQ ID NO: 64895 - RNA, 38 nt, Artificial Sequence
  Synthetic Oligonucleotide; LAG exon 3; Set C
gaaguccccgcgcugccggccgcgcucauccagcugga

SEQ ID NO: 64896 - RNA, 36 nt, Artificial Sequence
  Synthetic Oligonucleotide; LAG exon 3; Set C
aaguccccgcgcugccggccgcgcucauccagcugg

SEQ ID NO: 64897 - RNA, 37 nt, Artificial Sequence
  Synthetic Oligonucleotide; LAG exon 3; Set C
gaaguccccgcgcugccggccgcgcucauccagcugg

SEQ ID NO: 64898 - RNA, 16 nt, Artificial Sequence
  Synthetic Oligonucleotide; LAG exon 3; Set C
agccauagcgagaagu

SEQ ID NO: 64899 - RNA, 17 nt, Artificial Sequence
  Synthetic Oligonucleotide; LAG exon 3; Set C
cagccauagcgagaagu

SEQ ID NO: 64900 - RNA, 30 nt, Artificial Sequence
  Synthetic Oligonucleotide; LAG exon 3; Set C
gagggcgcggucccugaggugcaccgcggc

SEQ ID NO: 64901 - RNA, 15 nt, Artificial Sequence
  Synthetic Oligonucleotide; LAG exon 3; Set B
gcgcggucccugagg

SEQ ID NO: 64902 - RNA, 23 nt, Artificial Sequence
  Synthetic Oligonucleotide; LAG exon 3; Set C
ucgucccgccccacauacucgag

SEQ ID NO: 64903 - RNA, 24 nt, Artificial Sequence
  Synthetic Oligonucleotide; LAG exon 3; Set C
aucgucccgccccacauacucgag

SEQ ID NO: 64904 - RNA, 15 nt, Artificial Sequence
  Synthetic Oligonucleotide; LAG exon 3; Set C
gaagcuccaggggua

SEQ ID NO: 64905 - RNA, 24 nt, Artificial Sequence
  Synthetic Oligonucleotide; LAG exon 3; Set A
guugagaagcuccagggguaggaa

SEQ ID NO: 64906 - RNA, 16 nt, Artificial Sequence
  Synthetic Oligonucleotide; LAG exon 3; Set C
agaagcuccaggggua

SEQ ID NO: 64907 - RNA, 25 nt, Artificial Sequence
  Synthetic Oligonucleotide; LAG exon 3; Set A
aguugagaagcuccagggguaggaa

SEQ ID NO: 64908 - RNA, 17 nt, Artificial Sequence
  Synthetic Oligonucleotide; LAG exon 3; Set C
gagaagcuccaggggua

SEQ ID NO: 64909 - RNA, 18 nt, Artificial Sequence
  Synthetic Oligonucleotide; LAG exon 3; Set C
ugagaagcuccaggggua

SEQ ID NO: 64910 - RNA, 17 nt, Artificial Sequence
  Synthetic Oligonucleotide; LAG exon 3; Set C
ugagaagcuccaggggu

SEQ ID NO: 64911 - RNA, 18 nt, Artificial Sequence
  Synthetic Oligonucleotide; LAG exon 3; Set C
uugagaagcuccaggggu

SEQ ID NO: 64912 - RNA, 27 nt, Artificial Sequence
  Synthetic Oligonucleotide; LAG exon 3; Set A
gaauggaguugagaagcuccaggggua

SEQ ID NO: 64913 - RNA, 28 nt, Artificial Sequence
  Synthetic Oligonucleotide; LAG exon 3; Set A
agaauggaguugagaagcuccaggggua

SEQ ID NO: 64914 - RNA, 27 nt, Artificial Sequence
  Synthetic Oligonucleotide; LAG exon 3; Set A
agaauggaguugagaagcuccaggggu

SEQ ID NO: 64915 - RNA, 28 nt, Artificial Sequence
  Synthetic Oligonucleotide; LAG exon 3; Set A
gagaauggaguugagaagcuccaggggu

SEQ ID NO: 64916 - RNA, 29 nt, Artificial Sequence
  Synthetic Oligonucleotide; LAG exon 3; Set A
agagaauggaguugagaagcuccaggggu

SEQ ID NO: 64917 - RNA, 30 nt, Artificial Sequence
  Synthetic Oligonucleotide; LAG exon 3; Set A
aagagaauggaguugagaagcuccaggggu

SEQ ID NO: 64918 - RNA, 31 nt, Artificial Sequence
  Synthetic Oligonucleotide; LAG exon 3; Set A
aaagagaauggaguugagaagcuccaggggu

SEQ ID NO: 64919 - RNA, 34 nt, Artificial Sequence
  Synthetic Oligonucleotide; LAG exon 3; Set C
ggaaagagaauggaguugagaagcuccaggggua

SEQ ID NO: 64920 - RNA, 32 nt, Artificial Sequence
  Synthetic Oligonucleotide; LAG exon 3; Set A
gaaagagaauggaguugagaagcuccaggggu

SEQ ID NO: 64921 - RNA, 35 nt, Artificial Sequence
  Synthetic Oligonucleotide; LAG exon 3; Set C
gggaaagagaauggaguugagaagcuccaggggua

SEQ ID NO: 64922 - RNA, 33 nt, Artificial Sequence
  Synthetic Oligonucleotide; LAG exon 3; Set C
ggaaagagaauggaguugagaagcuccaggggu

SEQ ID NO: 64923 - RNA, 36 nt, Artificial Sequence
  Synthetic Oligonucleotide; LAG exon 3; Set C
cgggaaagagaauggaguugagaagcuccaggggua

SEQ ID NO: 64924 - RNA, 34 nt, Artificial Sequence
  Synthetic Oligonucleotide; LAG exon 3; Set C
gggaaagagaauggaguugagaagcuccaggggu

SEQ ID NO: 64925 - RNA, 37 nt, Artificial Sequence
  Synthetic Oligonucleotide; LAG exon 3; Set C
gcgggaaagagaauggaguugagaagcuccaggggua

SEQ ID NO: 64926 - RNA, 38 nt, Artificial Sequence
  Synthetic Oligonucleotide; LAG exon 3; Set C
ggcgggaaagagaauggaguugagaagcuccaggggua

SEQ ID NO: 64927 - RNA, 36 nt, Artificial Sequence
  Synthetic Oligonucleotide; LAG exon 3; Set C
gcgggaaagagaauggaguugagaagcuccaggggu

SEQ ID NO: 64928 - RNA, 39 nt, Artificial Sequence
  Synthetic Oligonucleotide; LAG exon 3; Set C
gggcgggaaagagaauggaguugagaagcuccaggggua

SEQ ID NO: 64929 - RNA, 37 nt, Artificial Sequence
  Synthetic Oligonucleotide; LAG exon 3; Set C
ggcgggaaagagaauggaguugagaagcuccaggggu

SEQ ID NO: 64930 - RNA, 40 nt, Artificial Sequence
  Synthetic Oligonucleotide; LAG exon 3; Set C
ugggcgggaaagagaauggaguugagaagcuccaggggua

SEQ ID NO: 64931 - RNA, 17 nt, Artificial Sequence
  Synthetic Oligonucleotide; LAG exon 3; Set C
ggaaagagaauggaguu

SEQ ID NO: 64932 - RNA, 18 nt, Artificial Sequence
  Synthetic Oligonucleotide; LAG exon 3; Set C
gggaaagagaauggaguu

SEQ ID NO: 64933 - RNA, 16 nt, Artificial Sequence
  Synthetic Oligonucleotide; LAG exon 3; Set C
ggaaagagaauggagu

SEQ ID NO: 64934 - RNA, 19 nt, Artificial Sequence
  Synthetic Oligonucleotide; LAG exon 3; Set C
cgggaaagagaauggaguu

SEQ ID NO: 64935 - RNA, 17 nt, Artificial Sequence
  Synthetic Oligonucleotide; LAG exon 3; Set C
gggaaagagaauggagu

SEQ ID NO: 64936 - RNA, 20 nt, Artificial Sequence
  Synthetic Oligonucleotide; LAG exon 3; Set C
gcgggaaagagaauggaguu

SEQ ID NO: 64937 - RNA, 18 nt, Artificial Sequence
  Synthetic Oligonucleotide; LAG exon 3; Set C
cgggaaagagaauggagu

SEQ ID NO: 64938 - RNA, 21 nt, Artificial Sequence
  Synthetic Oligonucleotide; LAG exon 3; Set C
ggcgggaaagagaauggaguu

SEQ ID NO: 64939 - RNA, 19 nt, Artificial Sequence
  Synthetic Oligonucleotide; LAG exon 3; Set C
gcgggaaagagaauggagu

SEQ ID NO: 64940 - RNA, 22 nt, Artificial Sequence
  Synthetic Oligonucleotide; LAG exon 3; Set A
gggcgggaaagagaauggaguu

SEQ ID NO: 64941 - RNA, 20 nt, Artificial Sequence
  Synthetic Oligonucleotide; LAG exon 3; Set C
ggcgggaaagagaauggagu

SEQ ID NO: 64942 - RNA, 23 nt, Artificial Sequence
  Synthetic Oligonucleotide; LAG exon 3; Set A
ugggcgggaaagagaauggaguu

SEQ ID NO: 64943 - RNA, 21 nt, Artificial Sequence
  Synthetic Oligonucleotide; LAG exon 3; Set A
gggcgggaaagagaauggagu

SEQ ID NO: 64944 - RNA, 22 nt, Artificial Sequence
  Synthetic Oligonucleotide; LAG exon 3; Set A
ugggcgggaaagagaauggagu

SEQ ID NO: 64945 - RNA, 40 nt, Artificial Sequence
  Synthetic Oligonucleotide; LAG exon 3; Set C
gcagcgggcgggccacugggcgggaaagagaauggaguug

SEQ ID NO: 64946 - RNA, 29 nt, Artificial Sequence
  Synthetic Oligonucleotide; LAG exon 3; Set C
gcagcgggcgggccacugggcgggaaaga

SEQ ID NO: 64947 - RNA, 28 nt, Artificial Sequence
  Synthetic Oligonucleotide; LAG exon 3; Set C
gcagcgggcgggccacugggcgggaaag

SEQ ID NO: 64948 - RNA, 30 nt, Artificial Sequence
  Synthetic Oligonucleotide; LAG exon 3; Set C
ggcagcgggcgggccacugggcgggaaaga

SEQ ID NO: 64949 - RNA, 27 nt, Artificial Sequence
  Synthetic Oligonucleotide; LAG exon 3; Set C
gcagcgggcgggccacugggcgggaaa

SEQ ID NO: 64950 - RNA, 29 nt, Artificial Sequence
  Synthetic Oligonucleotide; LAG exon 3; Set C
ggcagcgggcgggccacugggcgggaaag

SEQ ID NO: 64951 - RNA, 21 nt, Artificial Sequence
  Synthetic Oligonucleotide; LAG exon 3; Set C
gcgggcgggccacugggcggg

SEQ ID NO: 64952 - RNA, 26 nt, Artificial Sequence
  Synthetic Oligonucleotide; LAG exon 3; Set C
gcagcgggcgggccacugggcgggaa

SEQ ID NO: 64953 - RNA, 28 nt, Artificial Sequence
  Synthetic Oligonucleotide; LAG exon 3; Set C
ggcagcgggcgggccacugggcgggaaa

SEQ ID NO: 64954 - RNA, 20 nt, Artificial Sequence
  Synthetic Oligonucleotide; LAG exon 3; Set C
gcgggcgggccacugggcgg

SEQ ID NO: 64955 - RNA, 27 nt, Artificial Sequence
  Synthetic Oligonucleotide; LAG exon 3; Set C
ggcagcgggcgggccacugggcgggaa

SEQ ID NO: 64956 - RNA, 25 nt, Artificial Sequence
  Synthetic Oligonucleotide; LAG exon 3; Set C
gcagcgggcgggccacugggcggga

SEQ ID NO: 64957 - RNA, 19 nt, Artificial Sequence
  Synthetic Oligonucleotide; LAG exon 3; Set C
gcgggcgggccacugggcg

SEQ ID NO: 64958 - RNA, 40 nt, Artificial Sequence
  Synthetic Oligonucleotide; LAG exon 3; Set C
cgggggcggcagcgggcgggccacugggcgggaaagagaa

SEQ ID NO: 64959 - RNA, 24 nt, Artificial Sequence
  Synthetic Oligonucleotide; LAG exon 3; Set C
gcagcgggcgggccacugggcggg

SEQ ID NO: 64960 - RNA, 26 nt, Artificial Sequence
  Synthetic Oligonucleotide; LAG exon 3; Set C
ggcagcgggcgggccacugggcggga

SEQ ID NO: 64961 - RNA, 18 nt, Artificial Sequence
  Synthetic Oligonucleotide; LAG exon 3; Set C
gcgggcgggccacugggc

SEQ ID NO: 64962 - RNA, 39 nt, Artificial Sequence
  Synthetic Oligonucleotide; LAG exon 3; Set C
cgggggcggcagcgggcgggccacugggcgggaaagaga

SEQ ID NO: 64963 - RNA, 25 nt, Artificial Sequence
  Synthetic Oligonucleotide; LAG exon 3; Set C
ggcagcgggcgggccacugggcggg

SEQ ID NO: 64964 - RNA, 17 nt, Artificial Sequence
  Synthetic Oligonucleotide; LAG exon 3; Set C
gcgggcgggccacuggg

SEQ ID NO: 64965 - RNA, 38 nt, Artificial Sequence
  Synthetic Oligonucleotide; LAG exon 3; Set C
cgggggcggcagcgggcgggccacugggcgggaaagag

SEQ ID NO: 64966 - RNA, 40 nt, Artificial Sequence
  Synthetic Oligonucleotide; LAG exon 3; Set C
ccgggggcggcagcgggcgggccacugggcgggaaagaga

SEQ ID NO: 64967 - RNA, 37 nt, Artificial Sequence
  Synthetic Oligonucleotide; LAG exon 3; Set C
cgggggcggcagcgggcgggccacugggcgggaaaga

SEQ ID NO: 64968 - RNA, 39 nt, Artificial Sequence
  Synthetic Oligonucleotide; LAG exon 3; Set C
ccgggggcggcagcgggcgggccacugggcgggaaagag

SEQ ID NO: 64969 - RNA, 19 nt, Artificial Sequence
  Synthetic Oligonucleotide; LAG exon 3; Set C
cagcgggcgggccacuggg

SEQ ID NO: 64970 - RNA, 17 nt, Artificial Sequence
  Synthetic Oligonucleotide; LAG exon 3; Set C
agcgggcgggccacugg

SEQ ID NO: 64971 - RNA, 36 nt, Artificial Sequence
  Synthetic Oligonucleotide; LAG exon 3; Set C
cgggggcggcagcgggcgggccacugggcgggaaag

SEQ ID NO: 64972 - RNA, 38 nt, Artificial Sequence
  Synthetic Oligonucleotide; LAG exon 3; Set C
ccgggggcggcagcgggcgggccacugggcgggaaaga

SEQ ID NO: 64973 - RNA, 18 nt, Artificial Sequence
  Synthetic Oligonucleotide; LAG exon 3; Set C
cagcgggcgggccacugg

SEQ ID NO: 64974 - RNA, 35 nt, Artificial Sequence
  Synthetic Oligonucleotide; LAG exon 3; Set C
cgggggcggcagcgggcgggccacugggcgggaaa

SEQ ID NO: 64975 - RNA, 37 nt, Artificial Sequence
  Synthetic Oligonucleotide; LAG exon 3; Set C
ccgggggcggcagcgggcgggccacugggcgggaaag

SEQ ID NO: 64976 - RNA, 34 nt, Artificial Sequence
  Synthetic Oligonucleotide; LAG exon 3; Set C
cgggggcggcagcgggcgggccacugggcgggaa

SEQ ID NO: 64977 - RNA, 36 nt, Artificial Sequence
  Synthetic Oligonucleotide; LAG exon 3; Set C
ccgggggcggcagcgggcgggccacugggcgggaaa

SEQ ID NO: 64978 - RNA, 40 nt, Artificial Sequence
  Synthetic Oligonucleotide; LAG exon 3; Set C
ggccgggggcggcagcgggcgggccacugggcgggaaaga

SEQ ID NO: 64979 - RNA, 35 nt, Artificial Sequence
  Synthetic Oligonucleotide; LAG exon 3; Set C
ccgggggcggcagcgggcgggccacugggcgggaa

SEQ ID NO: 64980 - RNA, 39 nt, Artificial Sequence
  Synthetic Oligonucleotide; LAG exon 3; Set C
ggccgggggcggcagcgggcgggccacugggcgggaaag

SEQ ID NO: 64981 - RNA, 40 nt, Artificial Sequence
  Synthetic Oligonucleotide; LAG exon 3; Set C
uggccgggggcggcagcgggcgggccacugggcgggaaag

SEQ ID NO: 64982 - RNA, 38 nt, Artificial Sequence
  Synthetic Oligonucleotide; LAG exon 3; Set C
ggccgggggcggcagcgggcgggccacugggcgggaaa

SEQ ID NO: 64983 - RNA, 39 nt, Artificial Sequence
  Synthetic Oligonucleotide; LAG exon 3; Set C
uggccgggggcggcagcgggcgggccacugggcgggaaa

SEQ ID NO: 64984 - RNA, 37 nt, Artificial Sequence
  Synthetic Oligonucleotide; LAG exon 3; Set C
ggccgggggcggcagcgggcgggccacugggcgggaa

SEQ ID NO: 64985 - RNA, 40 nt, Artificial Sequence
  Synthetic Oligonucleotide; LAG exon 3; Set C
auggccgggggcggcagcgggcgggccacugggcgggaaa

SEQ ID NO: 64986 - RNA, 38 nt, Artificial Sequence
  Synthetic Oligonucleotide; LAG exon 3; Set C
uggccgggggcggcagcgggcgggccacugggcgggaa

SEQ ID NO: 64987 - RNA, 39 nt, Artificial Sequence
  Synthetic Oligonucleotide; LAG exon 3; Set C
auggccgggggcggcagcgggcgggccacugggcgggaa

SEQ ID NO: 64988 - RNA, 40 nt, Artificial Sequence
  Synthetic Oligonucleotide; LAG exon 3; Set C
aggggauggccgggggcggcagcgggcgggccacugggcg

SEQ ID NO: 64989 - RNA, 18 nt, Artificial Sequence
  Synthetic Oligonucleotide; LAG exon 3; Set C
auggccgggggcggcagc

SEQ ID NO: 64990 - RNA, 17 nt, Artificial Sequence
  Synthetic Oligonucleotide; LAG exon 3; Set C
gauggccgggggcggca

SEQ ID NO: 64991 - RNA, 18 nt, Artificial Sequence
  Synthetic Oligonucleotide; LAG exon 3; Set C
ggauggccgggggcggca

SEQ ID NO: 64992 - RNA, 16 nt, Artificial Sequence
  Synthetic Oligonucleotide; LAG exon 3; Set C
gauggccgggggcggc

SEQ ID NO: 64993 - RNA, 23 nt, Artificial Sequence
  Synthetic Oligonucleotide; LAG exon 3; Set C
aggggauggccgggggcggcagc

SEQ ID NO: 64994 - RNA, 19 nt, Artificial Sequence
  Synthetic Oligonucleotide; LAG exon 3; Set C
gggauggccgggggcggca

SEQ ID NO: 64995 - RNA, 17 nt, Artificial Sequence
  Synthetic Oligonucleotide; LAG exon 3; Set C
ggauggccgggggcggc

SEQ ID NO: 64996 - RNA, 24 nt, Artificial Sequence
  Synthetic Oligonucleotide; LAG exon 3; Set C
caggggauggccgggggcggcagc

SEQ ID NO: 64997 - RNA, 22 nt, Artificial Sequence
  Synthetic Oligonucleotide; LAG exon 3; Set C
aggggauggccgggggcggcag

SEQ ID NO: 64998 - RNA, 20 nt, Artificial Sequence
  Synthetic Oligonucleotide; LAG exon 3; Set C
ggggauggccgggggcggca

SEQ ID NO: 64999 - RNA, 18 nt, Artificial Sequence
  Synthetic Oligonucleotide; LAG exon 3; Set C
gggauggccgggggcggc

SEQ ID NO: 65000 - RNA, 23 nt, Artificial Sequence
  Synthetic Oligonucleotide; LAG exon 3; Set C
caggggauggccgggggcggcag

SEQ ID NO: 65001 - RNA, 19 nt, Artificial Sequence
  Synthetic Oligonucleotide; LAG exon 3; Set C
ggggauggccgggggcggc

SEQ ID NO: 65002 - RNA, 27 nt, Artificial Sequence
  Synthetic Oligonucleotide; LAG exon 3; Set C
ggggccaggggauggccgggggcggca

SEQ ID NO: 65003 - RNA, 28 nt, Artificial Sequence
  Synthetic Oligonucleotide; LAG exon 3; Set C
gggggccaggggauggccgggggcggca

SEQ ID NO: 65004 - RNA, 26 nt, Artificial Sequence
  Synthetic Oligonucleotide; LAG exon 3; Set C
ggggccaggggauggccgggggcggc

SEQ ID NO: 65005 - RNA, 27 nt, Artificial Sequence
  Synthetic Oligonucleotide; LAG exon 3; Set C
gggggccaggggauggccgggggcggc

SEQ ID NO: 65006 - RNA, 16 nt, Artificial Sequence
  Synthetic Oligonucleotide; LAG exon 3; Set A
ccaggggauggccggg

SEQ ID NO: 65007 - RNA, 19 nt, Artificial Sequence
  Synthetic Oligonucleotide; LAG exon 3; Set C
ggggccaggggauggccgg

SEQ ID NO: 65008 - RNA, 20 nt, Artificial Sequence
  Synthetic Oligonucleotide; LAG exon 3; Set C
gggggccaggggauggccgg

SEQ ID NO: 65009 - RNA, 18 nt, Artificial Sequence
  Synthetic Oligonucleotide; LAG exon 3; Set C
ggggccaggggauggccg

SEQ ID NO: 65010 - RNA, 39 nt, Artificial Sequence
  Synthetic Oligonucleotide; LAG exon 3; Set C
ggugagggccgggggccaggggauggccgggggcggcag

SEQ ID NO: 65011 - RNA, 19 nt, Artificial Sequence
  Synthetic Oligonucleotide; LAG exon 3; Set C
gggggccaggggauggccg

SEQ ID NO: 65012 - RNA, 15 nt, Artificial Sequence
  Synthetic Oligonucleotide; LAG exon 3; Set A
ggggccaggggaugg

SEQ ID NO: 65013 - RNA, 17 nt, Artificial Sequence
  Synthetic Oligonucleotide; LAG exon 3; Set C
gggggccaggggauggc

SEQ ID NO: 65014 - RNA, 16 nt, Artificial Sequence
  Synthetic Oligonucleotide; LAG exon 3; Set A
gggggccaggggaugg

SEQ ID NO: 65015 - RNA, 15 nt, Artificial Sequence
  Synthetic Oligonucleotide; LAG exon 3; Set A
gggggccaggggaug

SEQ ID NO: 65016 - RNA, 26 nt, Artificial Sequence
  Synthetic Oligonucleotide; LAG exon 3; Set C
agggcgccgccgggugagggccgggg

SEQ ID NO: 65017 - RNA, 25 nt, Artificial Sequence
  Synthetic Oligonucleotide; LAG exon 3; Set C
agggcgccgccgggugagggccggg

SEQ ID NO: 65018 - RNA, 31 nt, Artificial Sequence
  Synthetic Oligonucleotide; LAG exon 3; Set C
uagcggcggggccugggcccccaggaggagg

SEQ ID NO: 65019 - RNA, 32 nt, Artificial Sequence
  Synthetic Oligonucleotide; LAG exon 3; Set C
guagcggcggggccugggcccccaggaggagg

SEQ ID NO: 65020 - RNA, 33 nt, Artificial Sequence
  Synthetic Oligonucleotide; LAG exon 3; Set C
uguagcggcggggccugggcccccaggaggagg

SEQ ID NO: 65021 - RNA, 23 nt, Artificial Sequence
  Synthetic Oligonucleotide; LAG exon 3; Set C
ggggcagccucccgcugcgcagg

SEQ ID NO: 65022 - RNA, 24 nt, Artificial Sequence
  Synthetic Oligonucleotide; LAG exon 3; Set C
aggggcagccucccgcugcgcagg

SEQ ID NO: 65023 - RNA, 37 nt, Artificial Sequence
  Synthetic Oligonucleotide; LAG exon 3; Set C
gacgcggggcugcaggggcagccucccgcugcgcagg

SEQ ID NO: 65024 - RNA, 38 nt, Artificial Sequence
  Synthetic Oligonucleotide; LAG exon 3; Set C
ggacgcggggcugcaggggcagccucccgcugcgcagg

SEQ ID NO: 65025 - RNA, 39 nt, Artificial Sequence
  Synthetic Oligonucleotide; LAG exon 3; Set C
uggacgcggggcugcaggggcagccucccgcugcgcagg

SEQ ID NO: 65026 - RNA, 31 nt, Artificial Sequence
  Synthetic Oligonucleotide; LAG exon 3; Set C
gcgcucauccagcuggacgcggggcugcagg

SEQ ID NO: 65027 - RNA, 40 nt, Artificial Sequence
  Synthetic Oligonucleotide; LAG exon 3; Set C
ugccggccgcgcucauccagcuggacgcggggcugcaggg

SEQ ID NO: 65028 - RNA, 39 nt, Artificial Sequence
  Synthetic Oligonucleotide; LAG exon 3; Set C
ugccggccgcgcucauccagcuggacgcggggcugcagg

SEQ ID NO: 65029 - RNA, 26 nt, Artificial Sequence
  Synthetic Oligonucleotide; LAG exon 3; Set C
ugccggccgcgcucauccagcuggac

SEQ ID NO: 65030 - RNA, 25 nt, Artificial Sequence
  Synthetic Oligonucleotide; LAG exon 3; Set C
ugccggccgcgcucauccagcugga

SEQ ID NO: 65031 - RNA, 24 nt, Artificial Sequence
  Synthetic Oligonucleotide; LAG exon 3; Set C
ugccggccgcgcucauccagcugg

SEQ ID NO: 65032 - RNA, 22 nt, Artificial Sequence
  Synthetic Oligonucleotide; LAG exon 3; Set C
aguccccgcgcugccggccgcg

SEQ ID NO: 65033 - RNA, 23 nt, Artificial Sequence
  Synthetic Oligonucleotide; LAG exon 3; Set C
aaguccccgcgcugccggccgcg

SEQ ID NO: 65034 - RNA, 24 nt, Artificial Sequence
  Synthetic Oligonucleotide; LAG exon 3; Set C
gaaguccccgcgcugccggccgcg

SEQ ID NO: 65035 - RNA, 15 nt, Artificial Sequence
  Synthetic Oligonucleotide; LAG exon 3; Set A
aaguccccgcgcugc

SEQ ID NO: 65036 - RNA, 16 nt, Artificial Sequence
  Synthetic Oligonucleotide; LAG exon 3; Set A
gaaguccccgcgcugc

SEQ ID NO: 65037 - RNA, 15 nt, Artificial Sequence
  Synthetic Oligonucleotide; LAG exon 3; Set C
gccauagcgagaagu

SEQ ID NO: 65038 - RNA, 17 nt, Artificial Sequence
  Synthetic Oligonucleotide; LAG exon 3; Set C
agccauagcgagaaguc

SEQ ID NO: 65039 - RNA, 18 nt, Artificial Sequence
  Synthetic Oligonucleotide; LAG exon 3; Set C
cagccauagcgagaaguc

SEQ ID NO: 65040 - RNA, 15 nt, Artificial Sequence
  Synthetic Oligonucleotide; LAG exon 3; Set C
agccauagcgagaag

SEQ ID NO: 65041 - RNA, 16 nt, Artificial Sequence
  Synthetic Oligonucleotide; LAG exon 3; Set C
cagccauagcgagaag

SEQ ID NO: 65042 - RNA, 15 nt, Artificial Sequence
  Synthetic Oligonucleotide; LAG exon 3; Set C
cagccauagcgagaa

SEQ ID NO: 65043 - RNA, 23 nt, Artificial Sequence
  Synthetic Oligonucleotide; LAG exon 3; Set C
ugggcgcagccauagcgagaagu

SEQ ID NO: 65044 - RNA, 22 nt, Artificial Sequence
  Synthetic Oligonucleotide; LAG exon 3; Set C
ggucccugaggugcaccgcggc

SEQ ID NO: 65045 - RNA, 23 nt, Artificial Sequence
  Synthetic Oligonucleotide; LAG exon 3; Set C
cggucccugaggugcaccgcggc

SEQ ID NO: 65046 - RNA, 24 nt, Artificial Sequence
  Synthetic Oligonucleotide; LAG exon 3; Set C
gcggucccugaggugcaccgcggc

SEQ ID NO: 65047 - RNA, 25 nt, Artificial Sequence
  Synthetic Oligonucleotide; LAG exon 3; Set C
cgcggucccugaggugcaccgcggc

SEQ ID NO: 65048 - RNA, 26 nt, Artificial Sequence
  Synthetic Oligonucleotide; LAG exon 3; Set C
gcgcggucccugaggugcaccgcggc

SEQ ID NO: 65049 - RNA, 27 nt, Artificial Sequence
  Synthetic Oligonucleotide; LAG exon 3; Set C
ggcgcggucccugaggugcaccgcggc

SEQ ID NO: 65050 - RNA, 28 nt, Artificial Sequence
  Synthetic Oligonucleotide; LAG exon 3; Set C
gggcgcggucccugaggugcaccgcggc

SEQ ID NO: 65051 - RNA, 29 nt, Artificial Sequence
  Synthetic Oligonucleotide; LAG exon 3; Set C
agggcgcggucccugaggugcaccgcggc

SEQ ID NO: 65052 - RNA, 15 nt, Artificial Sequence
  Synthetic Oligonucleotide; LAG exon 3; Set C
cauacucgaggccug

SEQ ID NO: 65053 - RNA, 16 nt, Artificial Sequence
  Synthetic Oligonucleotide; LAG exon 3; Set C
acauacucgaggccug

SEQ ID NO: 65054 - RNA, 22 nt, Artificial Sequence
  Synthetic Oligonucleotide; LAG exon 3; Set C
ucgucccgccccacauacucga

SEQ ID NO: 65055 - RNA, 23 nt, Artificial Sequence
  Synthetic Oligonucleotide; LAG exon 3; Set C
aucgucccgccccacauacucga

SEQ ID NO: 65056 - RNA, 21 nt, Artificial Sequence
  Synthetic Oligonucleotide; LAG exon 3; Set C
ucgucccgccccacauacucg

SEQ ID NO: 65057 - RNA, 22 nt, Artificial Sequence
  Synthetic Oligonucleotide; LAG exon 3; Set C
aucgucccgccccacauacucg

SEQ ID NO: 65058 - RNA, 19 nt, Artificial Sequence
  Synthetic Oligonucleotide; LAG exon 3; Set C
ucgucccgccccacauacu

SEQ ID NO: 65059 - RNA, 20 nt, Artificial Sequence
  Synthetic Oligonucleotide; LAG exon 3; Set C
aucgucccgccccacauacu

SEQ ID NO: 65060 - RNA, 18 nt, Artificial Sequence
  Synthetic Oligonucleotide; LAG exon 3; Set B
ucgucccgccccacauac

SEQ ID NO: 65061 - RNA, 17 nt, Artificial Sequence
  Synthetic Oligonucleotide; LAG exon 3; Set B
ucgucccgccccacaua

SEQ ID NO: 65062 - RNA, 19 nt, Artificial Sequence
  Synthetic Oligonucleotide; LAG exon 3; Set B
aucgucccgccccacauac

SEQ ID NO: 65063 - RNA, 18 nt, Artificial Sequence
  Synthetic Oligonucleotide; LAG exon 3; Set B
aucgucccgccccacaua

SEQ ID NO: 65064 - RNA, 31 nt, Artificial Sequence
  Synthetic Oligonucleotide; LAG exon 3; Set C
ggggacccaccucccagcccuucucccaucg

SEQ ID NO: 65065 - RNA, 32 nt, Artificial Sequence
  Synthetic Oligonucleotide; LAG exon 3; Set C
uggggacccaccucccagcccuucucccaucg

SEQ ID NO: 65066 - RNA, 33 nt, Artificial Sequence
  Synthetic Oligonucleotide; LAG exon 3; Set C
auggggacccaccucccagcccuucucccaucg

SEQ ID NO: 65067 - RNA, 31 nt, Artificial Sequence
  Synthetic Oligonucleotide; LAG exon 3; Set C
uggggacccaccucccagcccuucucccauc

SEQ ID NO: 65068 - RNA, 34 nt, Artificial Sequence
  Synthetic Oligonucleotide; LAG exon 3; Set C
gauggggacccaccucccagcccuucucccaucg

SEQ ID NO: 65069 - RNA, 32 nt, Artificial Sequence
  Synthetic Oligonucleotide; LAG exon 3; Set C
auggggacccaccucccagcccuucucccauc

SEQ ID NO: 65070 - RNA, 35 nt, Artificial Sequence
  Synthetic Oligonucleotide; LAG exon 3; Set C
ggauggggacccaccucccagcccuucucccaucg

SEQ ID NO: 65071 - RNA, 33 nt, Artificial Sequence
  Synthetic Oligonucleotide; LAG exon 3; Set C
gauggggacccaccucccagcccuucucccauc

SEQ ID NO: 65072 - RNA, 34 nt, Artificial Sequence
  Synthetic Oligonucleotide; LAG exon 3; Set C
ggauggggacccaccucccagcccuucucccauc

SEQ ID NO: 65073 - RNA, 25 nt, Artificial Sequence
  Synthetic Oligonucleotide; LAG exon 7; Set A
aggaugaggcauagggucaggacua

SEQ ID NO: 65074 - RNA, 17 nt, Artificial Sequence
  Synthetic Oligonucleotide; LAG exon 7; Set C
aggaugaggcauagggu

SEQ ID NO: 65075 - RNA, 16 nt, Artificial Sequence
  Synthetic Oligonucleotide; LAG exon 7; Set C
aggaugaggcauaggg

SEQ ID NO: 65076 - RNA, 15 nt, Artificial Sequence
  Synthetic Oligonucleotide; LAG exon 7; Set C
aggaugaggcauagg

SEQ ID NO: 65077 - RNA, 31 nt, Artificial Sequence
  Synthetic Oligonucleotide; LAG exon 7; Set A
uauggagaaaguacaggaugaggcauagggu

SEQ ID NO: 65078 - RNA, 30 nt, Artificial Sequence
  Synthetic Oligonucleotide; LAG exon 7; Set A
uauggagaaaguacaggaugaggcauaggg

SEQ ID NO: 65079 - RNA, 29 nt, Artificial Sequence
  Synthetic Oligonucleotide; LAG exon 7; Set A
uauggagaaaguacaggaugaggcauagg

SEQ ID NO: 65080 - RNA, 28 nt, Artificial Sequence
  Synthetic Oligonucleotide; LAG exon 7; Set A
uauggagaaaguacaggaugaggcauag

SEQ ID NO: 65081 - RNA, 27 nt, Artificial Sequence
  Synthetic Oligonucleotide; LAG exon 7; Set A
uauggagaaaguacaggaugaggcaua

SEQ ID NO: 65082 - RNA, 17 nt, Artificial Sequence
  Synthetic Oligonucleotide; LAG exon 7; Set C
ggucaggacuagaaagg

SEQ ID NO: 65083 - RNA, 18 nt, Artificial Sequence
  Synthetic Oligonucleotide; LAG exon 7; Set C
gggucaggacuagaaagg

SEQ ID NO: 65084 - RNA, 19 nt, Artificial Sequence
  Synthetic Oligonucleotide; LAG exon 7; Set C
agggucaggacuagaaagg

SEQ ID NO: 65085 - RNA, 20 nt, Artificial Sequence
  Synthetic Oligonucleotide; LAG exon 7; Set C
uagggucaggacuagaaagg

SEQ ID NO: 65086 - RNA, 21 nt, Artificial Sequence
  Synthetic Oligonucleotide; LAG exon 7; Set C
auagggucaggacuagaaagg

SEQ ID NO: 65087 - RNA, 22 nt, Artificial Sequence
  Synthetic Oligonucleotide; LAG exon 7; Set C
cauagggucaggacuagaaagg

SEQ ID NO: 65088 - RNA, 23 nt, Artificial Sequence
  Synthetic Oligonucleotide; LAG exon 7; Set A
gcauagggucaggacuagaaagg

SEQ ID NO: 65089 - RNA, 24 nt, Artificial Sequence
  Synthetic Oligonucleotide; LAG exon 7; Set A
ggcauagggucaggacuagaaagg

SEQ ID NO: 65090 - RNA, 25 nt, Artificial Sequence
  Synthetic Oligonucleotide; LAG exon 7; Set A
aggcauagggucaggacuagaaagg

SEQ ID NO: 65091 - RNA, 26 nt, Artificial Sequence
  Synthetic Oligonucleotide; LAG exon 7; Set A
gaggcauagggucaggacuagaaagg

SEQ ID NO: 65092 - RNA, 15 nt, Artificial Sequence
  Synthetic Oligonucleotide; LAG exon 7; Set C
auagggucaggacua

SEQ ID NO: 65093 - RNA, 27 nt, Artificial Sequence
  Synthetic Oligonucleotide; LAG exon 7; Set A
ugaggcauagggucaggacuagaaagg

SEQ ID NO: 65094 - RNA, 16 nt, Artificial Sequence
  Synthetic Oligonucleotide; LAG exon 7; Set C
cauagggucaggacua

SEQ ID NO: 65095 - RNA, 17 nt, Artificial Sequence
  Synthetic Oligonucleotide; LAG exon 7; Set C
gcauagggucaggacua

SEQ ID NO: 65096 - RNA, 18 nt, Artificial Sequence
  Synthetic Oligonucleotide; LAG exon 7; Set A
ggcauagggucaggacua

SEQ ID NO: 65097 - RNA, 19 nt, Artificial Sequence
  Synthetic Oligonucleotide; LAG exon 7; Set A
aggcauagggucaggacua

SEQ ID NO: 65098 - RNA, 31 nt, Artificial Sequence
  Synthetic Oligonucleotide; LAG exon 7; Set C
aggaugaggcauagggucaggacuagaaagg

SEQ ID NO: 65099 - RNA, 20 nt, Artificial Sequence
  Synthetic Oligonucleotide; LAG exon 7; Set A
gaggcauagggucaggacua

SEQ ID NO: 65100 - RNA, 21 nt, Artificial Sequence
  Synthetic Oligonucleotide; LAG exon 7; Set A
ugaggcauagggucaggacua

SEQ ID NO: 65101 - RNA, 22 nt, Artificial Sequence
  Synthetic Oligonucleotide; LAG exon 7; Set A
augaggcauagggucaggacua

SEQ ID NO: 65102 - RNA, 23 nt, Artificial Sequence
  Synthetic Oligonucleotide; LAG exon 7; Set A
gaugaggcauagggucaggacua

SEQ ID NO: 65103 - RNA, 24 nt, Artificial Sequence
  Synthetic Oligonucleotide; LAG exon 7; Set A
ggaugaggcauagggucaggacua

SEQ ID NO: 65104 - RNA, 40 nt, Artificial Sequence
  Synthetic Oligonucleotide; LAG exon 7; Set C
agaaaguacaggaugaggcauagggucaggacuagaaagg

SEQ ID NO: 65105 - RNA, 30 nt, Artificial Sequence
  Synthetic Oligonucleotide; LAG exon 7; Set C
aguacaggaugaggcauagggucaggacua

SEQ ID NO: 65106 - RNA, 15 nt, Artificial Sequence
  Synthetic Oligonucleotide; LAG exon 7; Set C
gaugaggcauagggu

SEQ ID NO: 65107 - RNA, 16 nt, Artificial Sequence
  Synthetic Oligonucleotide; LAG exon 7; Set C
ggaugaggcauagggu

SEQ ID NO: 65108 - RNA, 15 nt, Artificial Sequence
  Synthetic Oligonucleotide; LAG exon 7; Set C
ggaugaggcauaggg

SEQ ID NO: 65109 - RNA, 34 nt, Artificial Sequence
  Synthetic Oligonucleotide; LAG exon 7; Set C
agaaaguacaggaugaggcauagggucaggacua

SEQ ID NO: 65110 - RNA, 35 nt, Artificial Sequence
  Synthetic Oligonucleotide; LAG exon 7; Set C
gagaaaguacaggaugaggcauagggucaggacua

SEQ ID NO: 65111 - RNA, 36 nt, Artificial Sequence
  Synthetic Oligonucleotide; LAG exon 7; Set C
ggagaaaguacaggaugaggcauagggucaggacua

SEQ ID NO: 65112 - RNA, 37 nt, Artificial Sequence
  Synthetic Oligonucleotide; LAG exon 7; Set C
uggagaaaguacaggaugaggcauagggucaggacua

SEQ ID NO: 65113 - RNA, 21 nt, Artificial Sequence
  Synthetic Oligonucleotide; LAG exon 7; Set A
guacaggaugaggcauagggu

SEQ ID NO: 65114 - RNA, 38 nt, Artificial Sequence
  Synthetic Oligonucleotide; LAG exon 7; Set C
auggagaaaguacaggaugaggcauagggucaggacua

SEQ ID NO: 65115 - RNA, 20 nt, Artificial Sequence
  Synthetic Oligonucleotide; LAG exon 7; Set A
guacaggaugaggcauaggg

SEQ ID NO: 65116 - RNA, 22 nt, Artificial Sequence
  Synthetic Oligonucleotide; LAG exon 7; Set A
aguacaggaugaggcauagggu

SEQ ID NO: 65117 - RNA, 19 nt, Artificial Sequence
  Synthetic Oligonucleotide; LAG exon 7; Set C
guacaggaugaggcauagg

SEQ ID NO: 65118 - RNA, 39 nt, Artificial Sequence
  Synthetic Oligonucleotide; LAG exon 7; Set C
uauggagaaaguacaggaugaggcauagggucaggacua

SEQ ID NO: 65119 - RNA, 21 nt, Artificial Sequence
  Synthetic Oligonucleotide; LAG exon 7; Set A
aguacaggaugaggcauaggg

SEQ ID NO: 65120 - RNA, 23 nt, Artificial Sequence
  Synthetic Oligonucleotide; LAG exon 7; Set A
aaguacaggaugaggcauagggu

SEQ ID NO: 65121 - RNA, 20 nt, Artificial Sequence
  Synthetic Oligonucleotide; LAG exon 7; Set C
aguacaggaugaggcauagg

SEQ ID NO: 65122 - RNA, 18 nt, Artificial Sequence
  Synthetic Oligonucleotide; LAG exon 7; Set C
guacaggaugaggcauag

SEQ ID NO: 65123 - RNA, 22 nt, Artificial Sequence
  Synthetic Oligonucleotide; LAG exon 7; Set A
aaguacaggaugaggcauaggg

SEQ ID NO: 65124 - RNA, 24 nt, Artificial Sequence
  Synthetic Oligonucleotide; LAG exon 7; Set A
aaaguacaggaugaggcauagggu

SEQ ID NO: 65125 - RNA, 19 nt, Artificial Sequence
  Synthetic Oligonucleotide; LAG exon 7; Set C
aguacaggaugaggcauag

SEQ ID NO: 65126 - RNA, 21 nt, Artificial Sequence
  Synthetic Oligonucleotide; LAG exon 7; Set C
aaguacaggaugaggcauagg

SEQ ID NO: 65127 - RNA, 17 nt, Artificial Sequence
  Synthetic Oligonucleotide; LAG exon 7; Set C
guacaggaugaggcaua

SEQ ID NO: 65128 - RNA, 23 nt, Artificial Sequence
  Synthetic Oligonucleotide; LAG exon 7; Set C
aaaguacaggaugaggcauaggg

SEQ ID NO: 65129 - RNA, 20 nt, Artificial Sequence
  Synthetic Oligonucleotide; LAG exon 7; Set C
aaguacaggaugaggcauag

SEQ ID NO: 65130 - RNA, 22 nt, Artificial Sequence
  Synthetic Oligonucleotide; LAG exon 7; Set C
aaaguacaggaugaggcauagg

SEQ ID NO: 65131 - RNA, 18 nt, Artificial Sequence
  Synthetic Oligonucleotide; LAG exon 7; Set C
aguacaggaugaggcaua

SEQ ID NO: 65132 - RNA, 24 nt, Artificial Sequence
  Synthetic Oligonucleotide; LAG exon 7; Set A
gaaaguacaggaugaggcauaggg

SEQ ID NO: 65133 - RNA, 16 nt, Artificial Sequence
  Synthetic Oligonucleotide; LAG exon 7; Set C
guacaggaugaggcau

SEQ ID NO: 65134 - RNA, 26 nt, Artificial Sequence
  Synthetic Oligonucleotide; LAG exon 7; Set A
agaaaguacaggaugaggcauagggu

SEQ ID NO: 65135 - RNA, 21 nt, Artificial Sequence
  Synthetic Oligonucleotide; LAG exon 7; Set C
aaaguacaggaugaggcauag

SEQ ID NO: 65136 - RNA, 23 nt, Artificial Sequence
  Synthetic Oligonucleotide; LAG exon 7; Set C
gaaaguacaggaugaggcauagg

SEQ ID NO: 65137 - RNA, 19 nt, Artificial Sequence
  Synthetic Oligonucleotide; LAG exon 7; Set C
aaguacaggaugaggcaua

SEQ ID NO: 65138 - RNA, 25 nt, Artificial Sequence
  Synthetic Oligonucleotide; LAG exon 7; Set A
agaaaguacaggaugaggcauaggg

SEQ ID NO: 65139 - RNA, 17 nt, Artificial Sequence
  Synthetic Oligonucleotide; LAG exon 7; Set C
aguacaggaugaggcau

SEQ ID NO: 65140 - RNA, 15 nt, Artificial Sequence
  Synthetic Oligonucleotide; LAG exon 7; Set C
guacaggaugaggca

SEQ ID NO: 65141 - RNA, 27 nt, Artificial Sequence
  Synthetic Oligonucleotide; LAG exon 7; Set A
gagaaaguacaggaugaggcauagggu

SEQ ID NO: 65142 - RNA, 24 nt, Artificial Sequence
  Synthetic Oligonucleotide; LAG exon 7; Set C
agaaaguacaggaugaggcauagg

SEQ ID NO: 65143 - RNA, 22 nt, Artificial Sequence
  Synthetic Oligonucleotide; LAG exon 7; Set C
gaaaguacaggaugaggcauag

SEQ ID NO: 65144 - RNA, 20 nt, Artificial Sequence
  Synthetic Oligonucleotide; LAG exon 7; Set C
aaaguacaggaugaggcaua

SEQ ID NO: 65145 - RNA, 26 nt, Artificial Sequence
  Synthetic Oligonucleotide; LAG exon 7; Set A
gagaaaguacaggaugaggcauaggg

SEQ ID NO: 65146 - RNA, 16 nt, Artificial Sequence
  Synthetic Oligonucleotide; LAG exon 7; Set C
aguacaggaugaggca

SEQ ID NO: 65147 - RNA, 28 nt, Artificial Sequence
  Synthetic Oligonucleotide; LAG exon 7; Set A
ggagaaaguacaggaugaggcauagggu

SEQ ID NO: 65148 - RNA, 23 nt, Artificial Sequence
  Synthetic Oligonucleotide; LAG exon 7; Set C
agaaaguacaggaugaggcauag

SEQ ID NO: 65149 - RNA, 25 nt, Artificial Sequence
  Synthetic Oligonucleotide; LAG exon 7; Set A
gagaaaguacaggaugaggcauagg

SEQ ID NO: 65150 - RNA, 27 nt, Artificial Sequence
  Synthetic Oligonucleotide; LAG exon 7; Set A
ggagaaaguacaggaugaggcauaggg

SEQ ID NO: 65151 - RNA, 15 nt, Artificial Sequence
  Synthetic Oligonucleotide; LAG exon 7; Set C
aguacaggaugaggc

SEQ ID NO: 65152 - RNA, 29 nt, Artificial Sequence
  Synthetic Oligonucleotide; LAG exon 7; Set A
uggagaaaguacaggaugaggcauagggu

SEQ ID NO: 65153 - RNA, 26 nt, Artificial Sequence
  Synthetic Oligonucleotide; LAG exon 7; Set A
ggagaaaguacaggaugaggcauagg

SEQ ID NO: 65154 - RNA, 24 nt, Artificial Sequence
  Synthetic Oligonucleotide; LAG exon 7; Set C
gagaaaguacaggaugaggcauag

SEQ ID NO: 65155 - RNA, 22 nt, Artificial Sequence
  Synthetic Oligonucleotide; LAG exon 7; Set C
agaaaguacaggaugaggcaua

SEQ ID NO: 65156 - RNA, 28 nt, Artificial Sequence
  Synthetic Oligonucleotide; LAG exon 7; Set A
uggagaaaguacaggaugaggcauaggg

SEQ ID NO: 65157 - RNA, 30 nt, Artificial Sequence
  Synthetic Oligonucleotide; LAG exon 7; Set A
auggagaaaguacaggaugaggcauagggu

SEQ ID NO: 65158 - RNA, 25 nt, Artificial Sequence
  Synthetic Oligonucleotide; LAG exon 7; Set A
ggagaaaguacaggaugaggcauag

SEQ ID NO: 65159 - RNA, 27 nt, Artificial Sequence
  Synthetic Oligonucleotide; LAG exon 7; Set A
uggagaaaguacaggaugaggcauagg

SEQ ID NO: 65160 - RNA, 23 nt, Artificial Sequence
  Synthetic Oligonucleotide; LAG exon 7; Set C
gagaaaguacaggaugaggcaua

SEQ ID NO: 65161 - RNA, 29 nt, Artificial Sequence
  Synthetic Oligonucleotide; LAG exon 7; Set A
auggagaaaguacaggaugaggcauaggg

SEQ ID NO: 65162 - RNA, 21 nt, Artificial Sequence
  Synthetic Oligonucleotide; LAG exon 7; Set C
agaaaguacaggaugaggcau

SEQ ID NO: 65163 - RNA, 26 nt, Artificial Sequence
  Synthetic Oligonucleotide; LAG exon 7; Set A
uggagaaaguacaggaugaggcauag

SEQ ID NO: 65164 - RNA, 28 nt, Artificial Sequence
  Synthetic Oligonucleotide; LAG exon 7; Set A
auggagaaaguacaggaugaggcauagg

SEQ ID NO: 65165 - RNA, 24 nt, Artificial Sequence
  Synthetic Oligonucleotide; LAG exon 7; Set A
ggagaaaguacaggaugaggcaua

SEQ ID NO: 65166 - RNA, 22 nt, Artificial Sequence
  Synthetic Oligonucleotide; LAG exon 7; Set C
gagaaaguacaggaugaggcau

SEQ ID NO: 65167 - RNA, 20 nt, Artificial Sequence
  Synthetic Oligonucleotide; LAG exon 7; Set C
agaaaguacaggaugaggca

SEQ ID NO: 65168 - RNA, 27 nt, Artificial Sequence
  Synthetic Oligonucleotide; LAG exon 7; Set A
auggagaaaguacaggaugaggcauag

SEQ ID NO: 65169 - RNA, 25 nt, Artificial Sequence
  Synthetic Oligonucleotide; LAG exon 7; Set A
uggagaaaguacaggaugaggcaua

SEQ ID NO: 65170 - RNA, 23 nt, Artificial Sequence
  Synthetic Oligonucleotide; LAG exon 7; Set A
ggagaaaguacaggaugaggcau

SEQ ID NO: 65171 - RNA, 21 nt, Artificial Sequence
  Synthetic Oligonucleotide; LAG exon 7; Set C
gagaaaguacaggaugaggca

SEQ ID NO: 65172 - RNA, 19 nt, Artificial Sequence
  Synthetic Oligonucleotide; LAG exon 7; Set C
agaaaguacaggaugaggc

SEQ ID NO: 65173 - RNA, 26 nt, Artificial Sequence
  Synthetic Oligonucleotide; LAG exon 7; Set A
auggagaaaguacaggaugaggcaua

SEQ ID NO: 65174 - RNA, 24 nt, Artificial Sequence
  Synthetic Oligonucleotide; LAG exon 7; Set A
uggagaaaguacaggaugaggcau

SEQ ID NO: 65175 - RNA, 22 nt, Artificial Sequence
  Synthetic Oligonucleotide; LAG exon 7; Set A
ggagaaaguacaggaugaggca

SEQ ID NO: 65176 - RNA, 20 nt, Artificial Sequence
  Synthetic Oligonucleotide; LAG exon 7; Set C
gagaaaguacaggaugaggc

SEQ ID NO: 65177 - RNA, 18 nt, Artificial Sequence
  Synthetic Oligonucleotide; LAG exon 7; Set C
agaaaguacaggaugagg

SEQ ID NO: 65178 - RNA, 25 nt, Artificial Sequence
  Synthetic Oligonucleotide; LAG exon 7; Set A
auggagaaaguacaggaugaggcau

SEQ ID NO: 65179 - RNA, 23 nt, Artificial Sequence
  Synthetic Oligonucleotide; LAG exon 7; Set A
uggagaaaguacaggaugaggca

SEQ ID NO: 65180 - RNA, 21 nt, Artificial Sequence
  Synthetic Oligonucleotide; LAG exon 7; Set C
ggagaaaguacaggaugaggc

SEQ ID NO: 65181 - RNA, 17 nt, Artificial Sequence
  Synthetic Oligonucleotide; LAG exon 7; Set C
agaaaguacaggaugag

SEQ ID NO: 65182 - RNA, 19 nt, Artificial Sequence
  Synthetic Oligonucleotide; LAG exon 7; Set C
gagaaaguacaggaugagg

SEQ ID NO: 65183 - RNA, 26 nt, Artificial Sequence
  Synthetic Oligonucleotide; LAG exon 7; Set A
uauggagaaaguacaggaugaggcau

SEQ ID NO: 65184 - RNA, 24 nt, Artificial Sequence
  Synthetic Oligonucleotide; LAG exon 7; Set A
auggagaaaguacaggaugaggca

SEQ ID NO: 65185 - RNA, 22 nt, Artificial Sequence
  Synthetic Oligonucleotide; LAG exon 7; Set C
uggagaaaguacaggaugaggc

SEQ ID NO: 65186 - RNA, 16 nt, Artificial Sequence
  Synthetic Oligonucleotide; LAG exon 7; Set C
agaaaguacaggauga

SEQ ID NO: 65187 - RNA, 18 nt, Artificial Sequence
  Synthetic Oligonucleotide; LAG exon 7; Set C
gagaaaguacaggaugag

SEQ ID NO: 65188 - RNA, 20 nt, Artificial Sequence
  Synthetic Oligonucleotide; LAG exon 7; Set C
ggagaaaguacaggaugagg

SEQ ID NO: 65189 - RNA, 25 nt, Artificial Sequence
  Synthetic Oligonucleotide; LAG exon 7; Set A
uauggagaaaguacaggaugaggca

SEQ ID NO: 65190 - RNA, 23 nt, Artificial Sequence
  Synthetic Oligonucleotide; LAG exon 7; Set C
auggagaaaguacaggaugaggc

SEQ ID NO: 65191 - RNA, 19 nt, Artificial Sequence
  Synthetic Oligonucleotide; LAG exon 7; Set C
ggagaaaguacaggaugag

SEQ ID NO: 65192 - RNA, 17 nt, Artificial Sequence
  Synthetic Oligonucleotide; LAG exon 7; Set C
gagaaaguacaggauga

SEQ ID NO: 65193 - RNA, 21 nt, Artificial Sequence
  Synthetic Oligonucleotide; LAG exon 7; Set C
uggagaaaguacaggaugagg

SEQ ID NO: 65194 - RNA, 24 nt, Artificial Sequence
  Synthetic Oligonucleotide; LAG exon 7; Set A
uauggagaaaguacaggaugaggc

SEQ ID NO: 65195 - RNA, 18 nt, Artificial Sequence
  Synthetic Oligonucleotide; LAG exon 7; Set C
ggagaaaguacaggauga

SEQ ID NO: 65196 - RNA, 20 nt, Artificial Sequence
  Synthetic Oligonucleotide; LAG exon 7; Set C
uggagaaaguacaggaugag

SEQ ID NO: 65197 - RNA, 22 nt, Artificial Sequence
  Synthetic Oligonucleotide; LAG exon 7; Set C
auggagaaaguacaggaugagg

SEQ ID NO: 65198 - RNA, 19 nt, Artificial Sequence
  Synthetic Oligonucleotide; LAG exon 7; Set C
uggagaaaguacaggauga

SEQ ID NO: 65199 - RNA, 21 nt, Artificial Sequence
  Synthetic Oligonucleotide; LAG exon 7; Set C
auggagaaaguacaggaugag

SEQ ID NO: 65200 - RNA, 23 nt, Artificial Sequence
  Synthetic Oligonucleotide; LAG exon 7; Set C
uauggagaaaguacaggaugagg

SEQ ID NO: 65201 - RNA, 22 nt, Artificial Sequence
  Synthetic Oligonucleotide; LAG exon 7; Set C
uauggagaaaguacaggaugag

SEQ ID NO: 65202 - RNA, 20 nt, Artificial Sequence
  Synthetic Oligonucleotide; LAG exon 7; Set C
auggagaaaguacaggauga

SEQ ID NO: 65203 - RNA, 21 nt, Artificial Sequence
  Synthetic Oligonucleotide; LAG exon 7; Set C
uauggagaaaguacaggauga

SEQ ID NO: 65204 - RNA, 15 nt, Artificial Sequence
  Synthetic Oligonucleotide; LAG exon 7; Set C
uggagaaaguacagg

SEQ ID NO: 65205 - RNA, 40 nt, Artificial Sequence
  Synthetic Oligonucleotide; LAG exon 7; Set C
cguugggcaccuauggagaaaguacaggaugaggcauagg

SEQ ID NO: 65206 - RNA, 16 nt, Artificial Sequence
  Synthetic Oligonucleotide; LAG exon 7; Set C
auggagaaaguacagg

SEQ ID NO: 65207 - RNA, 39 nt, Artificial Sequence
  Synthetic Oligonucleotide; LAG exon 7; Set C
cguugggcaccuauggagaaaguacaggaugaggcauag

SEQ ID NO: 65208 - RNA, 17 nt, Artificial Sequence
  Synthetic Oligonucleotide; LAG exon 7; Set C
uauggagaaaguacagg

SEQ ID NO: 65209 - RNA, 40 nt, Artificial Sequence
  Synthetic Oligonucleotide; LAG exon 7; Set C
gcguugggcaccuauggagaaaguacaggaugaggcauag

SEQ ID NO: 65210 - RNA, 38 nt, Artificial Sequence
  Synthetic Oligonucleotide; LAG exon 7; Set C
cguugggcaccuauggagaaaguacaggaugaggcaua

SEQ ID NO: 65211 - RNA, 39 nt, Artificial Sequence
  Synthetic Oligonucleotide; LAG exon 7; Set C
gcguugggcaccuauggagaaaguacaggaugaggcaua

SEQ ID NO: 65212 - RNA, 37 nt, Artificial Sequence
  Synthetic Oligonucleotide; LAG exon 7; Set C
cguugggcaccuauggagaaaguacaggaugaggcau

SEQ ID NO: 65213 - RNA, 40 nt, Artificial Sequence
  Synthetic Oligonucleotide; LAG exon 7; Set C
agcguugggcaccuauggagaaaguacaggaugaggcaua

SEQ ID NO: 65214 - RNA, 38 nt, Artificial Sequence
  Synthetic Oligonucleotide; LAG exon 7; Set C
gcguugggcaccuauggagaaaguacaggaugaggcau

SEQ ID NO: 65215 - RNA, 36 nt, Artificial Sequence
  Synthetic Oligonucleotide; LAG exon 7; Set C
cguugggcaccuauggagaaaguacaggaugaggca

SEQ ID NO: 65216 - RNA, 39 nt, Artificial Sequence
  Synthetic Oligonucleotide; LAG exon 7; Set C
agcguugggcaccuauggagaaaguacaggaugaggcau

SEQ ID NO: 65217 - RNA, 37 nt, Artificial Sequence
  Synthetic Oligonucleotide; LAG exon 7; Set C
gcguugggcaccuauggagaaaguacaggaugaggca

SEQ ID NO: 65218 - RNA, 35 nt, Artificial Sequence
  Synthetic Oligonucleotide; LAG exon 7; Set C
cguugggcaccuauggagaaaguacaggaugaggc

SEQ ID NO: 65219 - RNA, 40 nt, Artificial Sequence
  Synthetic Oligonucleotide; LAG exon 7; Set C
gagcguugggcaccuauggagaaaguacaggaugaggcau

SEQ ID NO: 65220 - RNA, 38 nt, Artificial Sequence
  Synthetic Oligonucleotide; LAG exon 7; Set C
agcguugggcaccuauggagaaaguacaggaugaggca

SEQ ID NO: 65221 - RNA, 36 nt, Artificial Sequence
  Synthetic Oligonucleotide; LAG exon 7; Set C
gcguugggcaccuauggagaaaguacaggaugaggc

SEQ ID NO: 65222 - RNA, 39 nt, Artificial Sequence
  Synthetic Oligonucleotide; LAG exon 7; Set C
gagcguugggcaccuauggagaaaguacaggaugaggca

SEQ ID NO: 65223 - RNA, 37 nt, Artificial Sequence
  Synthetic Oligonucleotide; LAG exon 7; Set C
agcguugggcaccuauggagaaaguacaggaugaggc

SEQ ID NO: 65224 - RNA, 38 nt, Artificial Sequence
  Synthetic Oligonucleotide; LAG exon 7; Set C
gagcguugggcaccuauggagaaaguacaggaugaggc

SEQ ID NO: 65225 - RNA, 28 nt, Artificial Sequence
  Synthetic Oligonucleotide; LAG exon 7; Set A
augaggcauagggucaggacuagaaagg

SEQ ID NO: 65226 - RNA, 29 nt, Artificial Sequence
  Synthetic Oligonucleotide; LAG exon 7; Set A
gaugaggcauagggucaggacuagaaagg

SEQ ID NO: 65227 - RNA, 30 nt, Artificial Sequence
  Synthetic Oligonucleotide; LAG exon 7; Set C
ggaugaggcauagggucaggacuagaaagg

SEQ ID NO: 65228 - RNA, 35 nt, Artificial Sequence
  Synthetic Oligonucleotide; LAG exon 7; Set C
guacaggaugaggcauagggucaggacuagaaagg

SEQ ID NO: 65229 - RNA, 36 nt, Artificial Sequence
  Synthetic Oligonucleotide; LAG exon 7; Set C
aguacaggaugaggcauagggucaggacuagaaagg

SEQ ID NO: 65230 - RNA, 37 nt, Artificial Sequence
  Synthetic Oligonucleotide; LAG exon 7; Set C
aaguacaggaugaggcauagggucaggacuagaaagg

SEQ ID NO: 65231 - RNA, 38 nt, Artificial Sequence
  Synthetic Oligonucleotide; LAG exon 7; Set C
aaaguacaggaugaggcauagggucaggacuagaaagg

SEQ ID NO: 65232 - RNA, 39 nt, Artificial Sequence
  Synthetic Oligonucleotide; LAG exon 7; Set C
gaaaguacaggaugaggcauagggucaggacuagaaagg

SEQ ID NO: 65233 - RNA, 29 nt, Artificial Sequence
  Synthetic Oligonucleotide; LAG exon 7; Set C
guacaggaugaggcauagggucaggacua

SEQ ID NO: 65234 - RNA, 31 nt, Artificial Sequence
  Synthetic Oligonucleotide; LAG exon 7; Set C
aaguacaggaugaggcauagggucaggacua

SEQ ID NO: 65235 - RNA, 32 nt, Artificial Sequence
  Synthetic Oligonucleotide; LAG exon 7; Set C
aaaguacaggaugaggcauagggucaggacua

SEQ ID NO: 65236 - RNA, 33 nt, Artificial Sequence
  Synthetic Oligonucleotide; LAG exon 7; Set C
gaaaguacaggaugaggcauagggucaggacua

SEQ ID NO: 65237 - RNA, 25 nt, Artificial Sequence
  Synthetic Oligonucleotide; LAG exon 7; Set A
gaaaguacaggaugaggcauagggu

SEQ ID NO: 65238 - RNA, 18 nt, Artificial Sequence
  Synthetic Oligonucleotide; LAG exon 7; Set C
aaguacaggaugaggcau

SEQ ID NO: 65239 - RNA, 21 nt, Artificial Sequence
  Synthetic Oligonucleotide; LAG exon 7; Set C
gaaaguacaggaugaggcaua

SEQ ID NO: 65240 - RNA, 19 nt, Artificial Sequence
  Synthetic Oligonucleotide; LAG exon 7; Set C
aaaguacaggaugaggcau

SEQ ID NO: 65241 - RNA, 17 nt, Artificial Sequence
  Synthetic Oligonucleotide; LAG exon 7; Set C
aaguacaggaugaggca

SEQ ID NO: 65242 - RNA, 20 nt, Artificial Sequence
  Synthetic Oligonucleotide; LAG exon 7; Set C
gaaaguacaggaugaggcau

SEQ ID NO: 65243 - RNA, 18 nt, Artificial Sequence
  Synthetic Oligonucleotide; LAG exon 7; Set C
aaaguacaggaugaggca

SEQ ID NO: 65244 - RNA, 16 nt, Artificial Sequence
  Synthetic Oligonucleotide; LAG exon 7; Set C
aaguacaggaugaggc

SEQ ID NO: 65245 - RNA, 19 nt, Artificial Sequence
  Synthetic Oligonucleotide; LAG exon 7; Set C
gaaaguacaggaugaggca

SEQ ID NO: 65246 - RNA, 17 nt, Artificial Sequence
  Synthetic Oligonucleotide; LAG exon 7; Set C
aaaguacaggaugaggc

SEQ ID NO: 65247 - RNA, 15 nt, Artificial Sequence
  Synthetic Oligonucleotide; LAG exon 7; Set C
aaguacaggaugagg

SEQ ID NO: 65248 - RNA, 18 nt, Artificial Sequence
  Synthetic Oligonucleotide; LAG exon 7; Set C
gaaaguacaggaugaggc

SEQ ID NO: 65249 - RNA, 16 nt, Artificial Sequence
  Synthetic Oligonucleotide; LAG exon 7; Set C
aaaguacaggaugagg

SEQ ID NO: 65250 - RNA, 15 nt, Artificial Sequence
  Synthetic Oligonucleotide; LAG exon 7; Set C
aaaguacaggaugag

SEQ ID NO: 65251 - RNA, 17 nt, Artificial Sequence
  Synthetic Oligonucleotide; LAG exon 7; Set C
gaaaguacaggaugagg

SEQ ID NO: 65252 - RNA, 16 nt, Artificial Sequence
  Synthetic Oligonucleotide; LAG exon 7; Set C
gaaaguacaggaugag

SEQ ID NO: 65253 - RNA, 15 nt, Artificial Sequence
  Synthetic Oligonucleotide; LAG exon 7; Set C
gaaaguacaggauga

SEQ ID NO: 65254 - RNA, 15 nt, Artificial Sequence
  Synthetic Oligonucleotide; LAG exon 7; Set C
agaaaguacaggaug

SEQ ID NO: 65255 - RNA, 16 nt, Artificial Sequence
  Synthetic Oligonucleotide; LAG exon 7; Set C
gagaaaguacaggaug

SEQ ID NO: 65256 - RNA, 39 nt, Artificial Sequence
  Synthetic Oligonucleotide; LAG exon 7; Set C
ugggcaccuauggagaaaguacaggaugaggcauagggu

SEQ ID NO: 65257 - RNA, 17 nt, Artificial Sequence
  Synthetic Oligonucleotide; LAG exon 7; Set C
ggagaaaguacaggaug

SEQ ID NO: 65258 - RNA, 15 nt, Artificial Sequence
  Synthetic Oligonucleotide; LAG exon 7; Set C
gagaaaguacaggau

SEQ ID NO: 65259 - RNA, 38 nt, Artificial Sequence
  Synthetic Oligonucleotide; LAG exon 7; Set C
ugggcaccuauggagaaaguacaggaugaggcauaggg

SEQ ID NO: 65260 - RNA, 40 nt, Artificial Sequence
  Synthetic Oligonucleotide; LAG exon 7; Set C
uugggcaccuauggagaaaguacaggaugaggcauagggu

SEQ ID NO: 65261 - RNA, 18 nt, Artificial Sequence
  Synthetic Oligonucleotide; LAG exon 7; Set C
uggagaaaguacaggaug

SEQ ID NO: 65262 - RNA, 16 nt, Artificial Sequence
  Synthetic Oligonucleotide; LAG exon 7; Set C
ggagaaaguacaggau

SEQ ID NO: 65263 - RNA, 37 nt, Artificial Sequence
  Synthetic Oligonucleotide; LAG exon 7; Set C
ugggcaccuauggagaaaguacaggaugaggcauagg

SEQ ID NO: 65264 - RNA, 39 nt, Artificial Sequence
  Synthetic Oligonucleotide; LAG exon 7; Set C
uugggcaccuauggagaaaguacaggaugaggcauaggg

SEQ ID NO: 65265 - RNA, 15 nt, Artificial Sequence
  Synthetic Oligonucleotide; LAG exon 7; Set C
ggagaaaguacagga

SEQ ID NO: 65266 - RNA, 19 nt, Artificial Sequence
  Synthetic Oligonucleotide; LAG exon 7; Set C
auggagaaaguacaggaug

SEQ ID NO: 65267 - RNA, 17 nt, Artificial Sequence
  Synthetic Oligonucleotide; LAG exon 7; Set C
uggagaaaguacaggau

SEQ ID NO: 65268 - RNA, 38 nt, Artificial Sequence
  Synthetic Oligonucleotide; LAG exon 7; Set C
uugggcaccuauggagaaaguacaggaugaggcauagg

SEQ ID NO: 65269 - RNA, 36 nt, Artificial Sequence
  Synthetic Oligonucleotide; LAG exon 7; Set C
ugggcaccuauggagaaaguacaggaugaggcauag

SEQ ID NO: 65270 - RNA, 40 nt, Artificial Sequence
  Synthetic Oligonucleotide; LAG exon 7; Set C
guugggcaccuauggagaaaguacaggaugaggcauaggg

SEQ ID NO: 65271 - RNA, 16 nt, Artificial Sequence
  Synthetic Oligonucleotide; LAG exon 7; Set C
uggagaaaguacagga

SEQ ID NO: 65272 - RNA, 20 nt, Artificial Sequence
  Synthetic Oligonucleotide; LAG exon 7; Set C
uauggagaaaguacaggaug

SEQ ID NO: 65273 - RNA, 18 nt, Artificial Sequence
  Synthetic Oligonucleotide; LAG exon 7; Set C
auggagaaaguacaggau

SEQ ID NO: 65274 - RNA, 37 nt, Artificial Sequence
  Synthetic Oligonucleotide; LAG exon 7; Set C
uugggcaccuauggagaaaguacaggaugaggcauag

SEQ ID NO: 65275 - RNA, 39 nt, Artificial Sequence
  Synthetic Oligonucleotide; LAG exon 7; Set C
guugggcaccuauggagaaaguacaggaugaggcauagg

SEQ ID NO: 65276 - RNA, 35 nt, Artificial Sequence
  Synthetic Oligonucleotide; LAG exon 7; Set C
ugggcaccuauggagaaaguacaggaugaggcaua

SEQ ID NO: 65277 - RNA, 17 nt, Artificial Sequence
  Synthetic Oligonucleotide; LAG exon 7; Set C
auggagaaaguacagga

SEQ ID NO: 65278 - RNA, 19 nt, Artificial Sequence
  Synthetic Oligonucleotide; LAG exon 7; Set C
uauggagaaaguacaggau

SEQ ID NO: 65279 - RNA, 38 nt, Artificial Sequence
  Synthetic Oligonucleotide; LAG exon 7; Set C
guugggcaccuauggagaaaguacaggaugaggcauag

SEQ ID NO: 65280 - RNA, 36 nt, Artificial Sequence
  Synthetic Oligonucleotide; LAG exon 7; Set C
uugggcaccuauggagaaaguacaggaugaggcaua

SEQ ID NO: 65281 - RNA, 34 nt, Artificial Sequence
  Synthetic Oligonucleotide; LAG exon 7; Set C
ugggcaccuauggagaaaguacaggaugaggcau

SEQ ID NO: 65282 - RNA, 18 nt, Artificial Sequence
  Synthetic Oligonucleotide; LAG exon 7; Set C
uauggagaaaguacagga

SEQ ID NO: 65283 - RNA, 37 nt, Artificial Sequence
  Synthetic Oligonucleotide; LAG exon 7; Set C
guugggcaccuauggagaaaguacaggaugaggcaua

SEQ ID NO: 65284 - RNA, 35 nt, Artificial Sequence
  Synthetic Oligonucleotide; LAG exon 7; Set C
uugggcaccuauggagaaaguacaggaugaggcau

SEQ ID NO: 65285 - RNA, 33 nt, Artificial Sequence
  Synthetic Oligonucleotide; LAG exon 7; Set C
ugggcaccuauggagaaaguacaggaugaggca

SEQ ID NO: 65286 - RNA, 36 nt, Artificial Sequence
  Synthetic Oligonucleotide; LAG exon 7; Set C
guugggcaccuauggagaaaguacaggaugaggcau

SEQ ID NO: 65287 - RNA, 34 nt, Artificial Sequence
  Synthetic Oligonucleotide; LAG exon 7; Set C
uugggcaccuauggagaaaguacaggaugaggca

SEQ ID NO: 65288 - RNA, 32 nt, Artificial Sequence
  Synthetic Oligonucleotide; LAG exon 7; Set C
ugggcaccuauggagaaaguacaggaugaggc

SEQ ID NO: 65289 - RNA, 35 nt, Artificial Sequence
  Synthetic Oligonucleotide; LAG exon 7; Set C
guugggcaccuauggagaaaguacaggaugaggca

SEQ ID NO: 65290 - RNA, 33 nt, Artificial Sequence
  Synthetic Oligonucleotide; LAG exon 7; Set C
uugggcaccuauggagaaaguacaggaugaggc

SEQ ID NO: 65291 - RNA, 34 nt, Artificial Sequence
  Synthetic Oligonucleotide; LAG exon 7; Set C
guugggcaccuauggagaaaguacaggaugaggc

SEQ ID NO: 65292 - RNA, 32 nt, Artificial Sequence
  Synthetic Oligonucleotide; LAG exon 7; Set C
uugggcaccuauggagaaaguacaggaugagg

SEQ ID NO: 65293 - RNA, 33 nt, Artificial Sequence
  Synthetic Oligonucleotide; LAG exon 7; Set C
guugggcaccuauggagaaaguacaggaugagg

SEQ ID NO: 65294 - RNA, 34 nt, Artificial Sequence
  Synthetic Oligonucleotide; LAG exon 7; Set C
cguugggcaccuauggagaaaguacaggaugagg

SEQ ID NO: 65295 - RNA, 33 nt, Artificial Sequence
  Synthetic Oligonucleotide; LAG exon 7; Set C
cguugggcaccuauggagaaaguacaggaugag

SEQ ID NO: 65296 - RNA, 35 nt, Artificial Sequence
  Synthetic Oligonucleotide; LAG exon 7; Set C
gcguugggcaccuauggagaaaguacaggaugagg

SEQ ID NO: 65297 - RNA, 34 nt, Artificial Sequence
  Synthetic Oligonucleotide; LAG exon 7; Set C
gcguugggcaccuauggagaaaguacaggaugag

SEQ ID NO: 65298 - RNA, 32 nt, Artificial Sequence
  Synthetic Oligonucleotide; LAG exon 7; Set C
cguugggcaccuauggagaaaguacaggauga

SEQ ID NO: 65299 - RNA, 36 nt, Artificial Sequence
  Synthetic Oligonucleotide; LAG exon 7; Set C
agcguugggcaccuauggagaaaguacaggaugagg

SEQ ID NO: 65300 - RNA, 35 nt, Artificial Sequence
  Synthetic Oligonucleotide; LAG exon 7; Set C
agcguugggcaccuauggagaaaguacaggaugag

SEQ ID NO: 65301 - RNA, 33 nt, Artificial Sequence
  Synthetic Oligonucleotide; LAG exon 7; Set C
gcguugggcaccuauggagaaaguacaggauga

SEQ ID NO: 65302 - RNA, 37 nt, Artificial Sequence
  Synthetic Oligonucleotide; LAG exon 7; Set C
gagcguugggcaccuauggagaaaguacaggaugagg

SEQ ID NO: 65303 - RNA, 31 nt, Artificial Sequence
  Synthetic Oligonucleotide; LAG exon 7; Set C
cguugggcaccuauggagaaaguacaggaug

SEQ ID NO: 65304 - RNA, 26 nt, Artificial Sequence
  Synthetic Oligonucleotide; LAG exon 7; Set A
uugggcaccuauggagaaaguacagg

SEQ ID NO: 65305 - RNA, 34 nt, Artificial Sequence
  Synthetic Oligonucleotide; LAG exon 7; Set C
agcguugggcaccuauggagaaaguacaggauga

SEQ ID NO: 65306 - RNA, 36 nt, Artificial Sequence
  Synthetic Oligonucleotide; LAG exon 7; Set C
gagcguugggcaccuauggagaaaguacaggaugag

SEQ ID NO: 65307 - RNA, 32 nt, Artificial Sequence
  Synthetic Oligonucleotide; LAG exon 7; Set C
gcguugggcaccuauggagaaaguacaggaug

SEQ ID NO: 65308 - RNA, 30 nt, Artificial Sequence
  Synthetic Oligonucleotide; LAG exon 7; Set C
cguugggcaccuauggagaaaguacaggau

SEQ ID NO: 65309 - RNA, 27 nt, Artificial Sequence
  Synthetic Oligonucleotide; LAG exon 7; Set A
guugggcaccuauggagaaaguacagg

SEQ ID NO: 65310 - RNA, 35 nt, Artificial Sequence
  Synthetic Oligonucleotide; LAG exon 7; Set C
gagcguugggcaccuauggagaaaguacaggauga

SEQ ID NO: 65311 - RNA, 29 nt, Artificial Sequence
  Synthetic Oligonucleotide; LAG exon 7; Set C
cguugggcaccuauggagaaaguacagga

SEQ ID NO: 65312 - RNA, 33 nt, Artificial Sequence
  Synthetic Oligonucleotide; LAG exon 7; Set C
agcguugggcaccuauggagaaaguacaggaug

SEQ ID NO: 65313 - RNA, 31 nt, Artificial Sequence
  Synthetic Oligonucleotide; LAG exon 7; Set C
gcguugggcaccuauggagaaaguacaggau

SEQ ID NO: 65314 - RNA, 28 nt, Artificial Sequence
  Synthetic Oligonucleotide; LAG exon 7; Set C
cguugggcaccuauggagaaaguacagg

SEQ ID NO: 65315 - RNA, 30 nt, Artificial Sequence
  Synthetic Oligonucleotide; LAG exon 7; Set C
gcguugggcaccuauggagaaaguacagga

SEQ ID NO: 65316 - RNA, 34 nt, Artificial Sequence
  Synthetic Oligonucleotide; LAG exon 7; Set C
gagcguugggcaccuauggagaaaguacaggaug

SEQ ID NO: 65317 - RNA, 32 nt, Artificial Sequence
  Synthetic Oligonucleotide; LAG exon 7; Set C
agcguugggcaccuauggagaaaguacaggau

SEQ ID NO: 65318 - RNA, 29 nt, Artificial Sequence
  Synthetic Oligonucleotide; LAG exon 7; Set C
gcguugggcaccuauggagaaaguacagg

SEQ ID NO: 65319 - RNA, 31 nt, Artificial Sequence
  Synthetic Oligonucleotide; LAG exon 7; Set C
agcguugggcaccuauggagaaaguacagga

SEQ ID NO: 65320 - RNA, 33 nt, Artificial Sequence
  Synthetic Oligonucleotide; LAG exon 7; Set C
gagcguugggcaccuauggagaaaguacaggau

SEQ ID NO: 65321 - RNA, 30 nt, Artificial Sequence
  Synthetic Oligonucleotide; LAG exon 7; Set C
agcguugggcaccuauggagaaaguacagg

SEQ ID NO: 65322 - RNA, 32 nt, Artificial Sequence
  Synthetic Oligonucleotide; LAG exon 7; Set C
gagcguugggcaccuauggagaaaguacagga

SEQ ID NO: 65323 - RNA, 31 nt, Artificial Sequence
  Synthetic Oligonucleotide; LAG exon 7; Set C
gagcguugggcaccuauggagaaaguacagg

SEQ ID NO: 65324 - RNA, 23 nt, Artificial Sequence
  Synthetic Oligonucleotide; LAG exon 7; Set A
cguugggcaccuauggagaaagu

SEQ ID NO: 65325 - RNA, 24 nt, Artificial Sequence
  Synthetic Oligonucleotide; LAG exon 7; Set A
gcguugggcaccuauggagaaagu

SEQ ID NO: 65326 - RNA, 25 nt, Artificial Sequence
  Synthetic Oligonucleotide; LAG exon 7; Set A
agcguugggcaccuauggagaaagu

SEQ ID NO: 65327 - RNA, 26 nt, Artificial Sequence
  Synthetic Oligonucleotide; LAG exon 7; Set C
gagcguugggcaccuauggagaaagu

SEQ ID NO: 65328 - RNA, 19 nt, Artificial Sequence
  Synthetic Oligonucleotide; LAG exon 7; Set A
cguugggcaccuauggaga

SEQ ID NO: 65329 - RNA, 20 nt, Artificial Sequence
  Synthetic Oligonucleotide; LAG exon 7; Set A
gcguugggcaccuauggaga

SEQ ID NO: 65330 - RNA, 18 nt, Artificial Sequence
  Synthetic Oligonucleotide; LAG exon 7; Set A
cguugggcaccuauggag

SEQ ID NO: 65331 - RNA, 21 nt, Artificial Sequence
  Synthetic Oligonucleotide; LAG exon 7; Set A
agcguugggcaccuauggaga

SEQ ID NO: 65332 - RNA, 19 nt, Artificial Sequence
  Synthetic Oligonucleotide; LAG exon 7; Set A
gcguugggcaccuauggag

SEQ ID NO: 65333 - RNA, 22 nt, Artificial Sequence
  Synthetic Oligonucleotide; LAG exon 7; Set C
gagcguugggcaccuauggaga

SEQ ID NO: 65334 - RNA, 20 nt, Artificial Sequence
  Synthetic Oligonucleotide; LAG exon 7; Set A
agcguugggcaccuauggag

SEQ ID NO: 65335 - RNA, 18 nt, Artificial Sequence
  Synthetic Oligonucleotide; LAG exon 7; Set A
gcguugggcaccuaugga

SEQ ID NO: 65336 - RNA, 19 nt, Artificial Sequence
  Synthetic Oligonucleotide; LAG exon 7; Set A
agcguugggcaccuaugga

SEQ ID NO: 65337 - RNA, 21 nt, Artificial Sequence
  Synthetic Oligonucleotide; LAG exon 7; Set A
gagcguugggcaccuauggag

SEQ ID NO: 65338 - RNA, 20 nt, Artificial Sequence
  Synthetic Oligonucleotide; LAG exon 7; Set A
gagcguugggcaccuaugga

SEQ ID NO: 65339 - RNA, 18 nt, Artificial Sequence
  Synthetic Oligonucleotide; LAG exon 7; Set A
agcguugggcaccuaugg

SEQ ID NO: 65340 - RNA, 19 nt, Artificial Sequence
  Synthetic Oligonucleotide; LAG exon 7; Set A
gagcguugggcaccuaugg

SEQ ID NO: 65341 - RNA, 16 nt, Artificial Sequence
  Synthetic Oligonucleotide; LAG exon 7; Set C
agcguugggcaccuau

SEQ ID NO: 65342 - RNA, 18 nt, Artificial Sequence
  Synthetic Oligonucleotide; LAG exon 7; Set A
gagcguugggcaccuaug

SEQ ID NO: 65343 - RNA, 17 nt, Artificial Sequence
  Synthetic Oligonucleotide; LAG exon 7; Set A
gagcguugggcaccuau

SEQ ID NO: 65344 - RNA, 34 nt, Artificial Sequence
  Synthetic Oligonucleotide; LAG exon 7; Set C
ggggcucucccagagcguugggcaccuauggaga

SEQ ID NO: 65345 - RNA, 18 nt, Artificial Sequence
  Synthetic Oligonucleotide; LAG exon 7; Set C
ggggcucucccagagcgu

SEQ ID NO: 65346 - RNA, 17 nt, Artificial Sequence
  Synthetic Oligonucleotide; LAG exon 7; Set A
ggggcucucccagagcg

SEQ ID NO: 65347 - RNA, 30 nt, Artificial Sequence
  Synthetic Oligonucleotide; LAG exon 7; Set C
gggagggcaccuggggcucucccagagcgu

SEQ ID NO: 65348 - RNA, 31 nt, Artificial Sequence
  Synthetic Oligonucleotide; LAG exon 7; Set C
ugggagggcaccuggggcucucccagagcgu

SEQ ID NO: 65349 - RNA, 30 nt, Artificial Sequence
  Synthetic Oligonucleotide; LAG exon 7; Set C
ugggagggcaccuggggcucucccagagcg

SEQ ID NO: 65350 - RNA, 15 nt, Artificial Sequence
  Synthetic Oligonucleotide; LAG exon 7; Set A
gggagggcaccuggg

SEQ ID NO: 65351 - RNA, 16 nt, Artificial Sequence
  Synthetic Oligonucleotide; LAG exon 7; Set A
ugggagggcaccuggg

SEQ ID NO: 65352 - RNA, 16 nt, Artificial Sequence
  Synthetic Oligonucleotide; LAG exon 7; Set A
agguggccugcuggga

SEQ ID NO: 65353 - RNA, 15 nt, Artificial Sequence
  Synthetic Oligonucleotide; LAG exon 7; Set A
agguggccugcuggg

SEQ ID NO: 65354 - RNA, 17 nt, Artificial Sequence
  Synthetic Oligonucleotide; LAG exon 7; Set A
gagguggccugcuggga

SEQ ID NO: 65355 - RNA, 16 nt, Artificial Sequence
  Synthetic Oligonucleotide; LAG exon 7; Set A
gagguggccugcuggg

SEQ ID NO: 65356 - RNA, 15 nt, Artificial Sequence
  Synthetic Oligonucleotide; LAG exon 7; Set A
gagguggccugcugg

SEQ ID NO: 65357 - RNA, 27 nt, Artificial Sequence
  Synthetic Oligonucleotide; LAG exon 7; Set A
cagagaaaggacaccaaggaugagaaa

SEQ ID NO: 65358 - RNA, 26 nt, Artificial Sequence
  Synthetic Oligonucleotide; LAG exon 7; Set A
cagagaaaggacaccaaggaugagaa

SEQ ID NO: 65359 - RNA, 25 nt, Artificial Sequence
  Synthetic Oligonucleotide; LAG exon 7; Set A
cagagaaaggacaccaaggaugaga

SEQ ID NO: 65360 - RNA, 24 nt, Artificial Sequence
  Synthetic Oligonucleotide; LAG exon 7; Set C
cagagaaaggacaccaaggaugag

SEQ ID NO: 65361 - RNA, 23 nt, Artificial Sequence
  Synthetic Oligonucleotide; LAG exon 7; Set C
cagagaaaggacaccaaggauga

SEQ ID NO: 65362 - RNA, 34 nt, Artificial Sequence
  Synthetic Oligonucleotide; LAG exon 7; Set A
aaaggagcagagaaaggacaccaaggaugagaaa

SEQ ID NO: 65363 - RNA, 33 nt, Artificial Sequence
  Synthetic Oligonucleotide; LAG exon 7; Set A
aaaggagcagagaaaggacaccaaggaugagaa

SEQ ID NO: 65364 - RNA, 35 nt, Artificial Sequence
  Synthetic Oligonucleotide; LAG exon 7; Set A
aaaaggagcagagaaaggacaccaaggaugagaaa

SEQ ID NO: 65365 - RNA, 34 nt, Artificial Sequence
  Synthetic Oligonucleotide; LAG exon 7; Set A
aaaaggagcagagaaaggacaccaaggaugagaa

SEQ ID NO: 65366 - RNA, 32 nt, Artificial Sequence
  Synthetic Oligonucleotide; LAG exon 7; Set A
aaaggagcagagaaaggacaccaaggaugaga

SEQ ID NO: 65367 - RNA, 33 nt, Artificial Sequence
  Synthetic Oligonucleotide; LAG exon 7; Set A
aaaaggagcagagaaaggacaccaaggaugaga

SEQ ID NO: 65368 - RNA, 31 nt, Artificial Sequence
  Synthetic Oligonucleotide; LAG exon 7; Set A
aaaggagcagagaaaggacaccaaggaugag

SEQ ID NO: 65369 - RNA, 32 nt, Artificial Sequence
  Synthetic Oligonucleotide; LAG exon 7; Set A
aaaaggagcagagaaaggacaccaaggaugag

SEQ ID NO: 65370 - RNA, 31 nt, Artificial Sequence
  Synthetic Oligonucleotide; LAG exon 7; Set A
aaaaggagcagagaaaggacaccaaggauga

SEQ ID NO: 65371 - RNA, 18 nt, Artificial Sequence
  Synthetic Oligonucleotide; LAG exon 7; Set C
gggggcgggguugccaug

SEQ ID NO: 65372 - RNA, 27 nt, Artificial Sequence
  Synthetic Oligonucleotide; LAG exon 7; Set C
gagcugcuggggggcgggguugccaug

SEQ ID NO: 65373 - RNA, 28 nt, Artificial Sequence
  Synthetic Oligonucleotide; LAG exon 7; Set C
ggagcugcuggggggcgggguugccaug

SEQ ID NO: 65374 - RNA, 29 nt, Artificial Sequence
  Synthetic Oligonucleotide; LAG exon 7; Set C
gggagcugcuggggggcgggguugccaug

SEQ ID NO: 65375 - RNA, 21 nt, Artificial Sequence
  Synthetic Oligonucleotide; LAG exon 7; Set C
gagcugcuggggggcgggguu

SEQ ID NO: 65376 - RNA, 22 nt, Artificial Sequence
  Synthetic Oligonucleotide; LAG exon 7; Set C
ggagcugcuggggggcgggguu

SEQ ID NO: 65377 - RNA, 20 nt, Artificial Sequence
  Synthetic Oligonucleotide; LAG exon 7; Set C
gagcugcuggggggcggggu

SEQ ID NO: 65378 - RNA, 23 nt, Artificial Sequence
  Synthetic Oligonucleotide; LAG exon 7; Set C
gggagcugcuggggggcgggguu

SEQ ID NO: 65379 - RNA, 21 nt, Artificial Sequence
  Synthetic Oligonucleotide; LAG exon 7; Set C
ggagcugcuggggggcggggu

SEQ ID NO: 65380 - RNA, 19 nt, Artificial Sequence
  Synthetic Oligonucleotide; LAG exon 7; Set C
gagcugcuggggggcgggg

SEQ ID NO: 65381 - RNA, 18 nt, Artificial Sequence
  Synthetic Oligonucleotide; LAG exon 7; Set C
gagcugcuggggggcggg

SEQ ID NO: 65382 - RNA, 22 nt, Artificial Sequence
  Synthetic Oligonucleotide; LAG exon 7; Set C
gggagcugcuggggggcggggu

SEQ ID NO: 65383 - RNA, 20 nt, Artificial Sequence
  Synthetic Oligonucleotide; LAG exon 7; Set C
ggagcugcuggggggcgggg

SEQ ID NO: 65384 - RNA, 19 nt, Artificial Sequence
  Synthetic Oligonucleotide; LAG exon 7; Set C
ggagcugcuggggggcggg

SEQ ID NO: 65385 - RNA, 21 nt, Artificial Sequence
  Synthetic Oligonucleotide; LAG exon 7; Set C
gggagcugcuggggggcgggg

SEQ ID NO: 65386 - RNA, 20 nt, Artificial Sequence
  Synthetic Oligonucleotide; LAG exon 7; Set C
gggagcugcuggggggcggg

SEQ ID NO: 65387 - RNA, 18 nt, Artificial Sequence
  Synthetic Oligonucleotide; LAG exon 7; Set C
agggucaggacuagaaag

SEQ ID NO: 65388 - RNA, 19 nt, Artificial Sequence
  Synthetic Oligonucleotide; LAG exon 7; Set C
uagggucaggacuagaaag

SEQ ID NO: 65389 - RNA, 20 nt, Artificial Sequence
  Synthetic Oligonucleotide; LAG exon 7; Set C
auagggucaggacuagaaag

SEQ ID NO: 65390 - RNA, 21 nt, Artificial Sequence
  Synthetic Oligonucleotide; LAG exon 7; Set C
cauagggucaggacuagaaag

SEQ ID NO: 65391 - RNA, 22 nt, Artificial Sequence
  Synthetic Oligonucleotide; LAG exon 7; Set C
gcauagggucaggacuagaaag

SEQ ID NO: 65392 - RNA, 23 nt, Artificial Sequence
  Synthetic Oligonucleotide; LAG exon 7; Set A
ggcauagggucaggacuagaaag

SEQ ID NO: 65393 - RNA, 30 nt, Artificial Sequence
  Synthetic Oligonucleotide; LAG exon 7; Set A
aggaugaggcauagggucaggacuagaaag

SEQ ID NO: 65394 - RNA, 24 nt, Artificial Sequence
  Synthetic Oligonucleotide; LAG exon 7; Set A
aggaugaggcauagggucaggacu

SEQ ID NO: 65395 - RNA, 31 nt, Artificial Sequence
  Synthetic Oligonucleotide; LAG exon 7; Set C
ugggcaccuauggagaaaguacaggaugagg

SEQ ID NO: 65396 - RNA, 30 nt, Artificial Sequence
  Synthetic Oligonucleotide; LAG exon 7; Set C
ugggcaccuauggagaaaguacaggaugag

SEQ ID NO: 65397 - RNA, 31 nt, Artificial Sequence
  Synthetic Oligonucleotide; LAG exon 7; Set C
uugggcaccuauggagaaaguacaggaugag

SEQ ID NO: 65398 - RNA, 29 nt, Artificial Sequence
  Synthetic Oligonucleotide; LAG exon 7; Set C
ugggcaccuauggagaaaguacaggauga

SEQ ID NO: 65399 - RNA, 30 nt, Artificial Sequence
  Synthetic Oligonucleotide; LAG exon 7; Set C
uugggcaccuauggagaaaguacaggauga

SEQ ID NO: 65400 - RNA, 32 nt, Artificial Sequence
  Synthetic Oligonucleotide; LAG exon 7; Set C
guugggcaccuauggagaaaguacaggaugag

SEQ ID NO: 65401 - RNA, 28 nt, Artificial Sequence
  Synthetic Oligonucleotide; LAG exon 7; Set A
ugggcaccuauggagaaaguacaggaug

SEQ ID NO: 65402 - RNA, 31 nt, Artificial Sequence
  Synthetic Oligonucleotide; LAG exon 7; Set C
guugggcaccuauggagaaaguacaggauga

SEQ ID NO: 65403 - RNA, 29 nt, Artificial Sequence
  Synthetic Oligonucleotide; LAG exon 7; Set A
uugggcaccuauggagaaaguacaggaug

SEQ ID NO: 65404 - RNA, 27 nt, Artificial Sequence
  Synthetic Oligonucleotide; LAG exon 7; Set A
ugggcaccuauggagaaaguacaggau

SEQ ID NO: 65405 - RNA, 40 nt, Artificial Sequence
  Synthetic Oligonucleotide; LAG exon 7; Set C
agagcguugggcaccuauggagaaaguacaggaugaggca

SEQ ID NO: 65406 - RNA, 26 nt, Artificial Sequence
  Synthetic Oligonucleotide; LAG exon 7; Set A
ugggcaccuauggagaaaguacagga

SEQ ID NO: 65407 - RNA, 30 nt, Artificial Sequence
  Synthetic Oligonucleotide; LAG exon 7; Set C
guugggcaccuauggagaaaguacaggaug

SEQ ID NO: 65408 - RNA, 28 nt, Artificial Sequence
  Synthetic Oligonucleotide; LAG exon 7; Set A
uugggcaccuauggagaaaguacaggau

SEQ ID NO: 65409 - RNA, 25 nt, Artificial Sequence
  Synthetic Oligonucleotide; LAG exon 7; Set A
ugggcaccuauggagaaaguacagg

SEQ ID NO: 65410 - RNA, 27 nt, Artificial Sequence
  Synthetic Oligonucleotide; LAG exon 7; Set A
uugggcaccuauggagaaaguacagga

SEQ ID NO: 65411 - RNA, 29 nt, Artificial Sequence
  Synthetic Oligonucleotide; LAG exon 7; Set C
guugggcaccuauggagaaaguacaggau

SEQ ID NO: 65412 - RNA, 28 nt, Artificial Sequence
  Synthetic Oligonucleotide; LAG exon 7; Set C
guugggcaccuauggagaaaguacagga

SEQ ID NO: 65413 - RNA, 20 nt, Artificial Sequence
  Synthetic Oligonucleotide; LAG exon 7; Set C
ugggcaccuauggagaaagu

SEQ ID NO: 65414 - RNA, 22 nt, Artificial Sequence
  Synthetic Oligonucleotide; LAG exon 7; Set A
uugggcaccuauggagaaagua

SEQ ID NO: 65415 - RNA, 21 nt, Artificial Sequence
  Synthetic Oligonucleotide; LAG exon 7; Set C
uugggcaccuauggagaaagu

SEQ ID NO: 65416 - RNA, 23 nt, Artificial Sequence
  Synthetic Oligonucleotide; LAG exon 7; Set A
guugggcaccuauggagaaagua

SEQ ID NO: 65417 - RNA, 22 nt, Artificial Sequence
  Synthetic Oligonucleotide; LAG exon 7; Set A
guugggcaccuauggagaaagu

SEQ ID NO: 65418 - RNA, 24 nt, Artificial Sequence
  Synthetic Oligonucleotide; LAG exon 7; Set A
cguugggcaccuauggagaaagua

SEQ ID NO: 65419 - RNA, 25 nt, Artificial Sequence
  Synthetic Oligonucleotide; LAG exon 7; Set A
gcguugggcaccuauggagaaagua

SEQ ID NO: 65420 - RNA, 16 nt, Artificial Sequence
  Synthetic Oligonucleotide; LAG exon 7; Set C
ugggcaccuauggaga

SEQ ID NO: 65421 - RNA, 26 nt, Artificial Sequence
  Synthetic Oligonucleotide; LAG exon 7; Set A
agcguugggcaccuauggagaaagua

SEQ ID NO: 65422 - RNA, 22 nt, Artificial Sequence
  Synthetic Oligonucleotide; LAG exon 7; Set A
cguugggcaccuauggagaaag

SEQ ID NO: 65423 - RNA, 17 nt, Artificial Sequence
  Synthetic Oligonucleotide; LAG exon 7; Set C
uugggcaccuauggaga

SEQ ID NO: 65424 - RNA, 27 nt, Artificial Sequence
  Synthetic Oligonucleotide; LAG exon 7; Set C
gagcguugggcaccuauggagaaagua

SEQ ID NO: 65425 - RNA, 23 nt, Artificial Sequence
  Synthetic Oligonucleotide; LAG exon 7; Set A
gcguugggcaccuauggagaaag

SEQ ID NO: 65426 - RNA, 21 nt, Artificial Sequence
  Synthetic Oligonucleotide; LAG exon 7; Set A
cguugggcaccuauggagaaa

SEQ ID NO: 65427 - RNA, 18 nt, Artificial Sequence
  Synthetic Oligonucleotide; LAG exon 7; Set A
guugggcaccuauggaga

SEQ ID NO: 65428 - RNA, 16 nt, Artificial Sequence
  Synthetic Oligonucleotide; LAG exon 7; Set C
uugggcaccuauggag

SEQ ID NO: 65429 - RNA, 24 nt, Artificial Sequence
  Synthetic Oligonucleotide; LAG exon 7; Set A
agcguugggcaccuauggagaaag

SEQ ID NO: 65430 - RNA, 22 nt, Artificial Sequence
  Synthetic Oligonucleotide; LAG exon 7; Set A
gcguugggcaccuauggagaaa

SEQ ID NO: 65431 - RNA, 20 nt, Artificial Sequence
  Synthetic Oligonucleotide; LAG exon 7; Set A
cguugggcaccuauggagaa

SEQ ID NO: 65432 - RNA, 15 nt, Artificial Sequence
  Synthetic Oligonucleotide; LAG exon 7; Set C
uugggcaccuaugga

SEQ ID NO: 65433 - RNA, 17 nt, Artificial Sequence
  Synthetic Oligonucleotide; LAG exon 7; Set C
guugggcaccuauggag

SEQ ID NO: 65434 - RNA, 25 nt, Artificial Sequence
  Synthetic Oligonucleotide; LAG exon 7; Set A
gagcguugggcaccuauggagaaag

SEQ ID NO: 65435 - RNA, 23 nt, Artificial Sequence
  Synthetic Oligonucleotide; LAG exon 7; Set A
agcguugggcaccuauggagaaa

SEQ ID NO: 65436 - RNA, 21 nt, Artificial Sequence
  Synthetic Oligonucleotide; LAG exon 7; Set A
gcguugggcaccuauggagaa

SEQ ID NO: 65437 - RNA, 38 nt, Artificial Sequence
  Synthetic Oligonucleotide; LAG exon 7; Set C
ucucccagagcguugggcaccuauggagaaaguacagg

SEQ ID NO: 65438 - RNA, 16 nt, Artificial Sequence
  Synthetic Oligonucleotide; LAG exon 7; Set C
guugggcaccuaugga

SEQ ID NO: 65439 - RNA, 24 nt, Artificial Sequence
  Synthetic Oligonucleotide; LAG exon 7; Set A
gagcguugggcaccuauggagaaa

SEQ ID NO: 65440 - RNA, 22 nt, Artificial Sequence
  Synthetic Oligonucleotide; LAG exon 7; Set A
agcguugggcaccuauggagaa

SEQ ID NO: 65441 - RNA, 39 nt, Artificial Sequence
  Synthetic Oligonucleotide; LAG exon 7; Set C
cucucccagagcguugggcaccuauggagaaaguacagg

SEQ ID NO: 65442 - RNA, 17 nt, Artificial Sequence
  Synthetic Oligonucleotide; LAG exon 7; Set A
cguugggcaccuaugga

SEQ ID NO: 65443 - RNA, 15 nt, Artificial Sequence
  Synthetic Oligonucleotide; LAG exon 7; Set C
guugggcaccuaugg

SEQ ID NO: 65444 - RNA, 23 nt, Artificial Sequence
  Synthetic Oligonucleotide; LAG exon 7; Set A
gagcguugggcaccuauggagaa

SEQ ID NO: 65445 - RNA, 40 nt, Artificial Sequence
  Synthetic Oligonucleotide; LAG exon 7; Set C
gcucucccagagcguugggcaccuauggagaaaguacagg

SEQ ID NO: 65446 - RNA, 16 nt, Artificial Sequence
  Synthetic Oligonucleotide; LAG exon 7; Set C
cguugggcaccuaugg

SEQ ID NO: 65447 - RNA, 17 nt, Artificial Sequence
  Synthetic Oligonucleotide; LAG exon 7; Set A
gcguugggcaccuaugg

SEQ ID NO: 65448 - RNA, 15 nt, Artificial Sequence
  Synthetic Oligonucleotide; LAG exon 7; Set C
cguugggcaccuaug

SEQ ID NO: 65449 - RNA, 16 nt, Artificial Sequence
  Synthetic Oligonucleotide; LAG exon 7; Set C
gcguugggcaccuaug

SEQ ID NO: 65450 - RNA, 15 nt, Artificial Sequence
  Synthetic Oligonucleotide; LAG exon 7; Set C
gcguugggcaccuau

SEQ ID NO: 65451 - RNA, 17 nt, Artificial Sequence
  Synthetic Oligonucleotide; LAG exon 7; Set C
agcguugggcaccuaug

SEQ ID NO: 65452 - RNA, 39 nt, Artificial Sequence
  Synthetic Oligonucleotide; LAG exon 7; Set C
ggggcucucccagagcguugggcaccuauggagaaagua

SEQ ID NO: 65453 - RNA, 38 nt, Artificial Sequence
  Synthetic Oligonucleotide; LAG exon 7; Set C
ggggcucucccagagcguugggcaccuauggagaaagu

SEQ ID NO: 65454 - RNA, 37 nt, Artificial Sequence
  Synthetic Oligonucleotide; LAG exon 7; Set C
ggggcucucccagagcguugggcaccuauggagaaag

SEQ ID NO: 65455 - RNA, 36 nt, Artificial Sequence
  Synthetic Oligonucleotide; LAG exon 7; Set C
ggggcucucccagagcguugggcaccuauggagaaa

SEQ ID NO: 65456 - RNA, 35 nt, Artificial Sequence
  Synthetic Oligonucleotide; LAG exon 7; Set C
ggggcucucccagagcguugggcaccuauggagaa

SEQ ID NO: 65457 - RNA, 33 nt, Artificial Sequence
  Synthetic Oligonucleotide; LAG exon 7; Set C
ggggcucucccagagcguugggcaccuauggag

SEQ ID NO: 65458 - RNA, 32 nt, Artificial Sequence
  Synthetic Oligonucleotide; LAG exon 7; Set C
ggggcucucccagagcguugggcaccuaugga

SEQ ID NO: 65459 - RNA, 31 nt, Artificial Sequence
  Synthetic Oligonucleotide; LAG exon 7; Set C
ggggcucucccagagcguugggcaccuaugg

SEQ ID NO: 65460 - RNA, 30 nt, Artificial Sequence
  Synthetic Oligonucleotide; LAG exon 7; Set C
ggggcucucccagagcguugggcaccuaug

SEQ ID NO: 65461 - RNA, 29 nt, Artificial Sequence
  Synthetic Oligonucleotide; LAG exon 7; Set C
ggggcucucccagagcguugggcaccuau

SEQ ID NO: 65462 - RNA, 21 nt, Artificial Sequence
  Synthetic Oligonucleotide; LAG exon 7; Set C
ggggcucucccagagcguugg

SEQ ID NO: 65463 - RNA, 20 nt, Artificial Sequence
  Synthetic Oligonucleotide; LAG exon 7; Set C
ggggcucucccagagcguug

SEQ ID NO: 65464 - RNA, 39 nt, Artificial Sequence
  Synthetic Oligonucleotide; LAG exon 7; Set C
gagggcaccuggggcucucccagagcguugggcaccuau

SEQ ID NO: 65465 - RNA, 19 nt, Artificial Sequence
  Synthetic Oligonucleotide; LAG exon 7; Set C
ggggcucucccagagcguu

SEQ ID NO: 65466 - RNA, 40 nt, Artificial Sequence
  Synthetic Oligonucleotide; LAG exon 7; Set C
ggagggcaccuggggcucucccagagcguugggcaccuau

SEQ ID NO: 65467 - RNA, 16 nt, Artificial Sequence
  Synthetic Oligonucleotide; LAG exon 7; Set A
ggggcucucccagagc

SEQ ID NO: 65468 - RNA, 15 nt, Artificial Sequence
  Synthetic Oligonucleotide; LAG exon 7; Set C
ggggcucucccagag

SEQ ID NO: 65469 - RNA, 33 nt, Artificial Sequence
  Synthetic Oligonucleotide; LAG exon 7; Set C
gggagggcaccuggggcucucccagagcguugg

SEQ ID NO: 65470 - RNA, 28 nt, Artificial Sequence
  Synthetic Oligonucleotide; LAG exon 7; Set C
gagggcaccuggggcucucccagagcgu

SEQ ID NO: 65471 - RNA, 32 nt, Artificial Sequence
  Synthetic Oligonucleotide; LAG exon 7; Set C
gggagggcaccuggggcucucccagagcguug

SEQ ID NO: 65472 - RNA, 34 nt, Artificial Sequence
  Synthetic Oligonucleotide; LAG exon 7; Set C
ugggagggcaccuggggcucucccagagcguugg

SEQ ID NO: 65473 - RNA, 29 nt, Artificial Sequence
  Synthetic Oligonucleotide; LAG exon 7; Set C
ggagggcaccuggggcucucccagagcgu

SEQ ID NO: 65474 - RNA, 27 nt, Artificial Sequence
  Synthetic Oligonucleotide; LAG exon 7; Set C
gagggcaccuggggcucucccagagcg

SEQ ID NO: 65475 - RNA, 33 nt, Artificial Sequence
  Synthetic Oligonucleotide; LAG exon 7; Set C
ugggagggcaccuggggcucucccagagcguug

SEQ ID NO: 65476 - RNA, 31 nt, Artificial Sequence
  Synthetic Oligonucleotide; LAG exon 7; Set C
gggagggcaccuggggcucucccagagcguu

SEQ ID NO: 65477 - RNA, 28 nt, Artificial Sequence
  Synthetic Oligonucleotide; LAG exon 7; Set C
ggagggcaccuggggcucucccagagcg

SEQ ID NO: 65478 - RNA, 32 nt, Artificial Sequence
  Synthetic Oligonucleotide; LAG exon 7; Set C
ugggagggcaccuggggcucucccagagcguu

SEQ ID NO: 65479 - RNA, 29 nt, Artificial Sequence
  Synthetic Oligonucleotide; LAG exon 7; Set C
gggagggcaccuggggcucucccagagcg

SEQ ID NO: 65480 - RNA, 27 nt, Artificial Sequence
  Synthetic Oligonucleotide; LAG exon 7; Set C
ggagggcaccuggggcucucccagagc

SEQ ID NO: 65481 - RNA, 28 nt, Artificial Sequence
  Synthetic Oligonucleotide; LAG exon 7; Set C
gggagggcaccuggggcucucccagagc

SEQ ID NO: 65482 - RNA, 32 nt, Artificial Sequence
  Synthetic Oligonucleotide; LAG exon 7; Set C
cugggagggcaccuggggcucucccagagcgu

SEQ ID NO: 65483 - RNA, 26 nt, Artificial Sequence
  Synthetic Oligonucleotide; LAG exon 7; Set C
ggagggcaccuggggcucucccagag

SEQ ID NO: 65484 - RNA, 29 nt, Artificial Sequence
  Synthetic Oligonucleotide; LAG exon 7; Set C
ugggagggcaccuggggcucucccagagc

SEQ ID NO: 65485 - RNA, 31 nt, Artificial Sequence
  Synthetic Oligonucleotide; LAG exon 7; Set C
cugggagggcaccuggggcucucccagagcg

SEQ ID NO: 65486 - RNA, 33 nt, Artificial Sequence
  Synthetic Oligonucleotide; LAG exon 7; Set C
gcugggagggcaccuggggcucucccagagcgu

SEQ ID NO: 65487 - RNA, 27 nt, Artificial Sequence
  Synthetic Oligonucleotide; LAG exon 7; Set C
gggagggcaccuggggcucucccagag

SEQ ID NO: 65488 - RNA, 30 nt, Artificial Sequence
  Synthetic Oligonucleotide; LAG exon 7; Set C
cugggagggcaccuggggcucucccagagc

SEQ ID NO: 65489 - RNA, 32 nt, Artificial Sequence
  Synthetic Oligonucleotide; LAG exon 7; Set C
gcugggagggcaccuggggcucucccagagcg

SEQ ID NO: 65490 - RNA, 28 nt, Artificial Sequence
  Synthetic Oligonucleotide; LAG exon 7; Set C
ugggagggcaccuggggcucucccagag

SEQ ID NO: 65491 - RNA, 31 nt, Artificial Sequence
  Synthetic Oligonucleotide; LAG exon 7; Set C
gcugggagggcaccuggggcucucccagagc

SEQ ID NO: 65492 - RNA, 29 nt, Artificial Sequence
  Synthetic Oligonucleotide; LAG exon 7; Set C
cugggagggcaccuggggcucucccagag

SEQ ID NO: 65493 - RNA, 30 nt, Artificial Sequence
  Synthetic Oligonucleotide; LAG exon 7; Set C
gcugggagggcaccuggggcucucccagag

SEQ ID NO: 65494 - RNA, 39 nt, Artificial Sequence
  Synthetic Oligonucleotide; LAG exon 7; Set C
uggccugcugggagggcaccuggggcucucccagagcgu

SEQ ID NO: 65495 - RNA, 40 nt, Artificial Sequence
  Synthetic Oligonucleotide; LAG exon 7; Set C
guggccugcugggagggcaccuggggcucucccagagcgu

SEQ ID NO: 65496 - RNA, 38 nt, Artificial Sequence
  Synthetic Oligonucleotide; LAG exon 7; Set C
uggccugcugggagggcaccuggggcucucccagagcg

SEQ ID NO: 65497 - RNA, 20 nt, Artificial Sequence
  Synthetic Oligonucleotide; LAG exon 7; Set C
gggagggcaccuggggcucu

SEQ ID NO: 65498 - RNA, 39 nt, Artificial Sequence
  Synthetic Oligonucleotide; LAG exon 7; Set C
guggccugcugggagggcaccuggggcucucccagagcg

SEQ ID NO: 65499 - RNA, 37 nt, Artificial Sequence
  Synthetic Oligonucleotide; LAG exon 7; Set C
uggccugcugggagggcaccuggggcucucccagagc

SEQ ID NO: 65500 - RNA, 21 nt, Artificial Sequence
  Synthetic Oligonucleotide; LAG exon 7; Set C
ugggagggcaccuggggcucu

SEQ ID NO: 65501 - RNA, 19 nt, Artificial Sequence
  Synthetic Oligonucleotide; LAG exon 7; Set C
gggagggcaccuggggcuc

SEQ ID NO: 65502 - RNA, 40 nt, Artificial Sequence
  Synthetic Oligonucleotide; LAG exon 7; Set C
gguggccugcugggagggcaccuggggcucucccagagcg

SEQ ID NO: 65503 - RNA, 38 nt, Artificial Sequence
  Synthetic Oligonucleotide; LAG exon 7; Set C
guggccugcugggagggcaccuggggcucucccagagc

SEQ ID NO: 65504 - RNA, 36 nt, Artificial Sequence
  Synthetic Oligonucleotide; LAG exon 7; Set C
uggccugcugggagggcaccuggggcucucccagag

SEQ ID NO: 65505 - RNA, 20 nt, Artificial Sequence
  Synthetic Oligonucleotide; LAG exon 7; Set C
ugggagggcaccuggggcuc

SEQ ID NO: 65506 - RNA, 18 nt, Artificial Sequence
  Synthetic Oligonucleotide; LAG exon 7; Set C
gggagggcaccuggggcu

SEQ ID NO: 65507 - RNA, 39 nt, Artificial Sequence
  Synthetic Oligonucleotide; LAG exon 7; Set C
gguggccugcugggagggcaccuggggcucucccagagc

SEQ ID NO: 65508 - RNA, 37 nt, Artificial Sequence
  Synthetic Oligonucleotide; LAG exon 7; Set C
guggccugcugggagggcaccuggggcucucccagag

SEQ ID NO: 65509 - RNA, 19 nt, Artificial Sequence
  Synthetic Oligonucleotide; LAG exon 7; Set C
ugggagggcaccuggggcu

SEQ ID NO: 65510 - RNA, 40 nt, Artificial Sequence
  Synthetic Oligonucleotide; LAG exon 7; Set C
agguggccugcugggagggcaccuggggcucucccagagc

SEQ ID NO: 65511 - RNA, 38 nt, Artificial Sequence
  Synthetic Oligonucleotide; LAG exon 7; Set C
gguggccugcugggagggcaccuggggcucucccagag

SEQ ID NO: 65512 - RNA, 18 nt, Artificial Sequence
  Synthetic Oligonucleotide; LAG exon 7; Set C
ugggagggcaccuggggc

SEQ ID NO: 65513 - RNA, 39 nt, Artificial Sequence
  Synthetic Oligonucleotide; LAG exon 7; Set C
agguggccugcugggagggcaccuggggcucucccagag

SEQ ID NO: 65514 - RNA, 17 nt, Artificial Sequence
  Synthetic Oligonucleotide; LAG exon 7; Set A
ugggagggcaccugggg

SEQ ID NO: 65515 - RNA, 40 nt, Artificial Sequence
  Synthetic Oligonucleotide; LAG exon 7; Set C
gagguggccugcugggagggcaccuggggcucucccagag

SEQ ID NO: 65516 - RNA, 17 nt, Artificial Sequence
  Synthetic Oligonucleotide; LAG exon 7; Set A
cugggagggcaccuggg

SEQ ID NO: 65517 - RNA, 18 nt, Artificial Sequence
  Synthetic Oligonucleotide; LAG exon 7; Set C
gcugggagggcaccuggg

SEQ ID NO: 65518 - RNA, 24 nt, Artificial Sequence
  Synthetic Oligonucleotide; LAG exon 7; Set C
uggccugcugggagggcaccuggg

SEQ ID NO: 65519 - RNA, 25 nt, Artificial Sequence
  Synthetic Oligonucleotide; LAG exon 7; Set C
guggccugcugggagggcaccuggg

SEQ ID NO: 65520 - RNA, 26 nt, Artificial Sequence
  Synthetic Oligonucleotide; LAG exon 7; Set C
gguggccugcugggagggcaccuggg

SEQ ID NO: 65521 - RNA, 27 nt, Artificial Sequence
  Synthetic Oligonucleotide; LAG exon 7; Set C
agguggccugcugggagggcaccuggg

SEQ ID NO: 65522 - RNA, 28 nt, Artificial Sequence
  Synthetic Oligonucleotide; LAG exon 7; Set C
gagguggccugcugggagggcaccuggg

SEQ ID NO: 65523 - RNA, 15 nt, Artificial Sequence
  Synthetic Oligonucleotide; LAG exon 7; Set A
guggccugcugggag

SEQ ID NO: 65524 - RNA, 16 nt, Artificial Sequence
  Synthetic Oligonucleotide; LAG exon 7; Set A
gguggccugcugggag

SEQ ID NO: 65525 - RNA, 37 nt, Artificial Sequence
  Synthetic Oligonucleotide; LAG exon 7; Set C
aaacagcaggagguggccugcugggagggcaccuggg

SEQ ID NO: 65526 - RNA, 15 nt, Artificial Sequence
  Synthetic Oligonucleotide; LAG exon 7; Set A
gguggccugcuggga

SEQ ID NO: 65527 - RNA, 17 nt, Artificial Sequence
  Synthetic Oligonucleotide; LAG exon 7; Set A
agguggccugcugggag

SEQ ID NO: 65528 - RNA, 38 nt, Artificial Sequence
  Synthetic Oligonucleotide; LAG exon 7; Set C
gaaacagcaggagguggccugcugggagggcaccuggg

SEQ ID NO: 65529 - RNA, 18 nt, Artificial Sequence
  Synthetic Oligonucleotide; LAG exon 7; Set A
gagguggccugcugggag

SEQ ID NO: 65530 - RNA, 39 nt, Artificial Sequence
  Synthetic Oligonucleotide; LAG exon 7; Set C
agaaacagcaggagguggccugcugggagggcaccuggg

SEQ ID NO: 65531 - RNA, 40 nt, Artificial Sequence
  Synthetic Oligonucleotide; LAG exon 7; Set C
gagaaacagcaggagguggccugcugggagggcaccuggg

SEQ ID NO: 65532 - RNA, 27 nt, Artificial Sequence
  Synthetic Oligonucleotide; LAG exon 7; Set C
aaacagcaggagguggccugcugggag

SEQ ID NO: 65533 - RNA, 26 nt, Artificial Sequence
  Synthetic Oligonucleotide; LAG exon 7; Set C
aaacagcaggagguggccugcuggga

SEQ ID NO: 65534 - RNA, 28 nt, Artificial Sequence
  Synthetic Oligonucleotide; LAG exon 7; Set C
gaaacagcaggagguggccugcugggag

SEQ ID NO: 65535 - RNA, 25 nt, Artificial Sequence
  Synthetic Oligonucleotide; LAG exon 7; Set C
aaacagcaggagguggccugcuggg

SEQ ID NO: 65536 - RNA, 27 nt, Artificial Sequence
  Synthetic Oligonucleotide; LAG exon 7; Set C
gaaacagcaggagguggccugcuggga

SEQ ID NO: 65537 - RNA, 29 nt, Artificial Sequence
  Synthetic Oligonucleotide; LAG exon 7; Set C
agaaacagcaggagguggccugcugggag

SEQ ID NO: 65538 - RNA, 26 nt, Artificial Sequence
  Synthetic Oligonucleotide; LAG exon 7; Set C
gaaacagcaggagguggccugcuggg

SEQ ID NO: 65539 - RNA, 24 nt, Artificial Sequence
  Synthetic Oligonucleotide; LAG exon 7; Set C
aaacagcaggagguggccugcugg

SEQ ID NO: 65540 - RNA, 28 nt, Artificial Sequence
  Synthetic Oligonucleotide; LAG exon 7; Set C
agaaacagcaggagguggccugcuggga

SEQ ID NO: 65541 - RNA, 30 nt, Artificial Sequence
  Synthetic Oligonucleotide; LAG exon 7; Set C
gagaaacagcaggagguggccugcugggag

SEQ ID NO: 65542 - RNA, 27 nt, Artificial Sequence
  Synthetic Oligonucleotide; LAG exon 7; Set C
agaaacagcaggagguggccugcuggg

SEQ ID NO: 65543 - RNA, 25 nt, Artificial Sequence
  Synthetic Oligonucleotide; LAG exon 7; Set C
gaaacagcaggagguggccugcugg

SEQ ID NO: 65544 - RNA, 29 nt, Artificial Sequence
  Synthetic Oligonucleotide; LAG exon 7; Set C
gagaaacagcaggagguggccugcuggga

SEQ ID NO: 65545 - RNA, 31 nt, Artificial Sequence
  Synthetic Oligonucleotide; LAG exon 7; Set C
ugagaaacagcaggagguggccugcugggag

SEQ ID NO: 65546 - RNA, 28 nt, Artificial Sequence
  Synthetic Oligonucleotide; LAG exon 7; Set C
gagaaacagcaggagguggccugcuggg

SEQ ID NO: 65547 - RNA, 26 nt, Artificial Sequence
  Synthetic Oligonucleotide; LAG exon 7; Set C
agaaacagcaggagguggccugcugg

SEQ ID NO: 65548 - RNA, 30 nt, Artificial Sequence
  Synthetic Oligonucleotide; LAG exon 7; Set C
ugagaaacagcaggagguggccugcuggga

SEQ ID NO: 65549 - RNA, 29 nt, Artificial Sequence
  Synthetic Oligonucleotide; LAG exon 7; Set C
ugagaaacagcaggagguggccugcuggg

SEQ ID NO: 65550 - RNA, 27 nt, Artificial Sequence
  Synthetic Oligonucleotide; LAG exon 7; Set C
gagaaacagcaggagguggccugcugg

SEQ ID NO: 65551 - RNA, 28 nt, Artificial Sequence
  Synthetic Oligonucleotide; LAG exon 7; Set C
ugagaaacagcaggagguggccugcugg

SEQ ID NO: 65552 - RNA, 16 nt, Artificial Sequence
  Synthetic Oligonucleotide; LAG exon 7; Set C
aaacagcaggaggugg

SEQ ID NO: 65553 - RNA, 15 nt, Artificial Sequence
  Synthetic Oligonucleotide; LAG exon 7; Set C
aaacagcaggaggug

SEQ ID NO: 65554 - RNA, 17 nt, Artificial Sequence
  Synthetic Oligonucleotide; LAG exon 7; Set C
gaaacagcaggaggugg

SEQ ID NO: 65555 - RNA, 16 nt, Artificial Sequence
  Synthetic Oligonucleotide; LAG exon 7; Set C
gaaacagcaggaggug

SEQ ID NO: 65556 - RNA, 18 nt, Artificial Sequence
  Synthetic Oligonucleotide; LAG exon 7; Set C
agaaacagcaggaggugg

SEQ ID NO: 65557 - RNA, 15 nt, Artificial Sequence
  Synthetic Oligonucleotide; LAG exon 7; Set C
gaaacagcaggaggu

SEQ ID NO: 65558 - RNA, 17 nt, Artificial Sequence
  Synthetic Oligonucleotide; LAG exon 7; Set C
agaaacagcaggaggug

SEQ ID NO: 65559 - RNA, 19 nt, Artificial Sequence
  Synthetic Oligonucleotide; LAG exon 7; Set C
gagaaacagcaggaggugg

SEQ ID NO: 65560 - RNA, 16 nt, Artificial Sequence
  Synthetic Oligonucleotide; LAG exon 7; Set C
agaaacagcaggaggu

SEQ ID NO: 65561 - RNA, 18 nt, Artificial Sequence
  Synthetic Oligonucleotide; LAG exon 7; Set C
gagaaacagcaggaggug

SEQ ID NO: 65562 - RNA, 20 nt, Artificial Sequence
  Synthetic Oligonucleotide; LAG exon 7; Set C
ugagaaacagcaggaggugg

SEQ ID NO: 65563 - RNA, 15 nt, Artificial Sequence
  Synthetic Oligonucleotide; LAG exon 7; Set C
agaaacagcaggagg

SEQ ID NO: 65564 - RNA, 17 nt, Artificial Sequence
  Synthetic Oligonucleotide; LAG exon 7; Set C
gagaaacagcaggaggu

SEQ ID NO: 65565 - RNA, 19 nt, Artificial Sequence
  Synthetic Oligonucleotide; LAG exon 7; Set C
ugagaaacagcaggaggug

SEQ ID NO: 65566 - RNA, 16 nt, Artificial Sequence
  Synthetic Oligonucleotide; LAG exon 7; Set C
gagaaacagcaggagg

SEQ ID NO: 65567 - RNA, 18 nt, Artificial Sequence
  Synthetic Oligonucleotide; LAG exon 7; Set C
ugagaaacagcaggaggu

SEQ ID NO: 65568 - RNA, 17 nt, Artificial Sequence
  Synthetic Oligonucleotide; LAG exon 7; Set C
ugagaaacagcaggagg

SEQ ID NO: 65569 - RNA, 16 nt, Artificial Sequence
  Synthetic Oligonucleotide; LAG exon 7; Set C
ugagaaacagcaggag

SEQ ID NO: 65570 - RNA, 40 nt, Artificial Sequence
  Synthetic Oligonucleotide; LAG exon 7; Set C
cagagaaaggacaccaaggaugagaaacagcaggaggugg

SEQ ID NO: 65571 - RNA, 39 nt, Artificial Sequence
  Synthetic Oligonucleotide; LAG exon 7; Set C
cagagaaaggacaccaaggaugagaaacagcaggaggug

SEQ ID NO: 65572 - RNA, 38 nt, Artificial Sequence
  Synthetic Oligonucleotide; LAG exon 7; Set C
cagagaaaggacaccaaggaugagaaacagcaggaggu

SEQ ID NO: 65573 - RNA, 37 nt, Artificial Sequence
  Synthetic Oligonucleotide; LAG exon 7; Set C
cagagaaaggacaccaaggaugagaaacagcaggagg

SEQ ID NO: 65574 - RNA, 36 nt, Artificial Sequence
  Synthetic Oligonucleotide; LAG exon 7; Set C
cagagaaaggacaccaaggaugagaaacagcaggag

SEQ ID NO: 65575 - RNA, 30 nt, Artificial Sequence
  Synthetic Oligonucleotide; LAG exon 7; Set A
aaaggagcagagaaaggacaccaaggauga

SEQ ID NO: 65576 - RNA, 40 nt, Artificial Sequence
  Synthetic Oligonucleotide; LAG exon 7; Set C
cagucaccaaaaggagcagagaaaggacaccaaggaugag

SEQ ID NO: 65577 - RNA, 39 nt, Artificial Sequence
  Synthetic Oligonucleotide; LAG exon 7; Set C
cagucaccaaaaggagcagagaaaggacaccaaggauga

SEQ ID NO: 65578 - RNA, 23 nt, Artificial Sequence
  Synthetic Oligonucleotide; LAG exon 7; Set C
gggguugccaugucccuggcuca

SEQ ID NO: 65579 - RNA, 29 nt, Artificial Sequence
  Synthetic Oligonucleotide; LAG exon 7; Set C
gggggcgggguugccaugucccuggcuca

SEQ ID NO: 65580 - RNA, 38 nt, Artificial Sequence
  Synthetic Oligonucleotide; LAG exon 7; Set C
gagcugcuggggggcgggguugccaugucccuggcuca

SEQ ID NO: 65581 - RNA, 39 nt, Artificial Sequence
  Synthetic Oligonucleotide; LAG exon 7; Set C
ggagcugcuggggggcgggguugccaugucccuggcuca

SEQ ID NO: 65582 - RNA, 40 nt, Artificial Sequence
  Synthetic Oligonucleotide; LAG exon 7; Set C
gggagcugcuggggggcgggguugccaugucccuggcuca

SEQ ID NO: 65583 - RNA, 16 nt, Artificial Sequence
  Synthetic Oligonucleotide; LAG exon 7; Set C
ggucaggacuagaaag

SEQ ID NO: 65584 - RNA, 17 nt, Artificial Sequence
  Synthetic Oligonucleotide; LAG exon 7; Set C
gggucaggacuagaaag

SEQ ID NO: 65585 - RNA, 18 nt, Artificial Sequence
  Synthetic Oligonucleotide; LAG exon 7; Set C
uagggucaggacuagaaa

SEQ ID NO: 65586 - RNA, 19 nt, Artificial Sequence
  Synthetic Oligonucleotide; LAG exon 7; Set C
auagggucaggacuagaaa

SEQ ID NO: 65587 - RNA, 16 nt, Artificial Sequence
  Synthetic Oligonucleotide; LAG exon 7; Set C
uagggucaggacuaga

SEQ ID NO: 65588 - RNA, 20 nt, Artificial Sequence
  Synthetic Oligonucleotide; LAG exon 7; Set C
cauagggucaggacuagaaa

SEQ ID NO: 65589 - RNA, 15 nt, Artificial Sequence
  Synthetic Oligonucleotide; LAG exon 7; Set C
uagggucaggacuag

SEQ ID NO: 65590 - RNA, 17 nt, Artificial Sequence
  Synthetic Oligonucleotide; LAG exon 7; Set C
auagggucaggacuaga

SEQ ID NO: 65591 - RNA, 19 nt, Artificial Sequence
  Synthetic Oligonucleotide; LAG exon 7; Set C
cauagggucaggacuagaa

SEQ ID NO: 65592 - RNA, 21 nt, Artificial Sequence
  Synthetic Oligonucleotide; LAG exon 7; Set C
gcauagggucaggacuagaaa

SEQ ID NO: 65593 - RNA, 24 nt, Artificial Sequence
  Synthetic Oligonucleotide; LAG exon 7; Set A
aggcauagggucaggacuagaaag

SEQ ID NO: 65594 - RNA, 16 nt, Artificial Sequence
  Synthetic Oligonucleotide; LAG exon 7; Set C
auagggucaggacuag

SEQ ID NO: 65595 - RNA, 18 nt, Artificial Sequence
  Synthetic Oligonucleotide; LAG exon 7; Set C
cauagggucaggacuaga

SEQ ID NO: 65596 - RNA, 20 nt, Artificial Sequence
  Synthetic Oligonucleotide; LAG exon 7; Set C
gcauagggucaggacuagaa

SEQ ID NO: 65597 - RNA, 22 nt, Artificial Sequence
  Synthetic Oligonucleotide; LAG exon 7; Set A
ggcauagggucaggacuagaaa

SEQ ID NO: 65598 - RNA, 25 nt, Artificial Sequence
  Synthetic Oligonucleotide; LAG exon 7; Set A
gaggcauagggucaggacuagaaag

SEQ ID NO: 65599 - RNA, 17 nt, Artificial Sequence
  Synthetic Oligonucleotide; LAG exon 7; Set C
cauagggucaggacuag

SEQ ID NO: 65600 - RNA, 19 nt, Artificial Sequence
  Synthetic Oligonucleotide; LAG exon 7; Set A
gcauagggucaggacuaga

SEQ ID NO: 65601 - RNA, 21 nt, Artificial Sequence
  Synthetic Oligonucleotide; LAG exon 7; Set A
ggcauagggucaggacuagaa

SEQ ID NO: 65602 - RNA, 26 nt, Artificial Sequence
  Synthetic Oligonucleotide; LAG exon 7; Set A
ugaggcauagggucaggacuagaaag

SEQ ID NO: 65603 - RNA, 18 nt, Artificial Sequence
  Synthetic Oligonucleotide; LAG exon 7; Set C
gcauagggucaggacuag

SEQ ID NO: 65604 - RNA, 20 nt, Artificial Sequence
  Synthetic Oligonucleotide; LAG exon 7; Set A
ggcauagggucaggacuaga

SEQ ID NO: 65605 - RNA, 27 nt, Artificial Sequence
  Synthetic Oligonucleotide; LAG exon 7; Set A
augaggcauagggucaggacuagaaag

SEQ ID NO: 65606 - RNA, 15 nt, Artificial Sequence
  Synthetic Oligonucleotide; LAG exon 7; Set C
cauagggucaggacu

SEQ ID NO: 65607 - RNA, 19 nt, Artificial Sequence
  Synthetic Oligonucleotide; LAG exon 7; Set A
ggcauagggucaggacuag

SEQ ID NO: 65608 - RNA, 28 nt, Artificial Sequence
  Synthetic Oligonucleotide; LAG exon 7; Set A
gaugaggcauagggucaggacuagaaag

SEQ ID NO: 65609 - RNA, 16 nt, Artificial Sequence
  Synthetic Oligonucleotide; LAG exon 7; Set C
gcauagggucaggacu

SEQ ID NO: 65610 - RNA, 22 nt, Artificial Sequence
  Synthetic Oligonucleotide; LAG exon 7; Set A
gaggcauagggucaggacuaga

SEQ ID NO: 65611 - RNA, 20 nt, Artificial Sequence
  Synthetic Oligonucleotide; LAG exon 7; Set A
aggcauagggucaggacuag

SEQ ID NO: 65612 - RNA, 29 nt, Artificial Sequence
  Synthetic Oligonucleotide; LAG exon 7; Set A
ggaugaggcauagggucaggacuagaaag

SEQ ID NO: 65613 - RNA, 17 nt, Artificial Sequence
  Synthetic Oligonucleotide; LAG exon 7; Set A
ggcauagggucaggacu

SEQ ID NO: 65614 - RNA, 15 nt, Artificial Sequence
  Synthetic Oligonucleotide; LAG exon 7; Set C
gcauagggucaggac

SEQ ID NO: 65615 - RNA, 21 nt, Artificial Sequence
  Synthetic Oligonucleotide; LAG exon 7; Set A
gaggcauagggucaggacuag

SEQ ID NO: 65616 - RNA, 23 nt, Artificial Sequence
  Synthetic Oligonucleotide; LAG exon 7; Set A
ugaggcauagggucaggacuaga

SEQ ID NO: 65617 - RNA, 18 nt, Artificial Sequence
  Synthetic Oligonucleotide; LAG exon 7; Set A
aggcauagggucaggacu

SEQ ID NO: 65618 - RNA, 16 nt, Artificial Sequence
  Synthetic Oligonucleotide; LAG exon 7; Set C
ggcauagggucaggac

SEQ ID NO: 65619 - RNA, 22 nt, Artificial Sequence
  Synthetic Oligonucleotide; LAG exon 7; Set A
ugaggcauagggucaggacuag

SEQ ID NO: 65620 - RNA, 19 nt, Artificial Sequence
  Synthetic Oligonucleotide; LAG exon 7; Set A
gaggcauagggucaggacu

SEQ ID NO: 65621 - RNA, 17 nt, Artificial Sequence
  Synthetic Oligonucleotide; LAG exon 7; Set C
aggcauagggucaggac

SEQ ID NO: 65622 - RNA, 29 nt, Artificial Sequence
  Synthetic Oligonucleotide; LAG exon 7; Set A
aggaugaggcauagggucaggacuagaaa

SEQ ID NO: 65623 - RNA, 20 nt, Artificial Sequence
  Synthetic Oligonucleotide; LAG exon 7; Set A
ugaggcauagggucaggacu

SEQ ID NO: 65624 - RNA, 18 nt, Artificial Sequence
  Synthetic Oligonucleotide; LAG exon 7; Set A
gaggcauagggucaggac

SEQ ID NO: 65625 - RNA, 28 nt, Artificial Sequence
  Synthetic Oligonucleotide; LAG exon 7; Set C
aggaugaggcauagggucaggacuagaa

SEQ ID NO: 65626 - RNA, 21 nt, Artificial Sequence
  Synthetic Oligonucleotide; LAG exon 7; Set A
augaggcauagggucaggacu

SEQ ID NO: 65627 - RNA, 19 nt, Artificial Sequence
  Synthetic Oligonucleotide; LAG exon 7; Set A
ugaggcauagggucaggac

SEQ ID NO: 65628 - RNA, 27 nt, Artificial Sequence
  Synthetic Oligonucleotide; LAG exon 7; Set C
aggaugaggcauagggucaggacuaga

SEQ ID NO: 65629 - RNA, 34 nt, Artificial Sequence
  Synthetic Oligonucleotide; LAG exon 7; Set C
guacaggaugaggcauagggucaggacuagaaag

SEQ ID NO: 65630 - RNA, 22 nt, Artificial Sequence
  Synthetic Oligonucleotide; LAG exon 7; Set A
gaugaggcauagggucaggacu

SEQ ID NO: 65631 - RNA, 26 nt, Artificial Sequence
  Synthetic Oligonucleotide; LAG exon 7; Set A
aggaugaggcauagggucaggacuag

SEQ ID NO: 65632 - RNA, 35 nt, Artificial Sequence
  Synthetic Oligonucleotide; LAG exon 7; Set C
aguacaggaugaggcauagggucaggacuagaaag

SEQ ID NO: 65633 - RNA, 23 nt, Artificial Sequence
  Synthetic Oligonucleotide; LAG exon 7; Set A
ggaugaggcauagggucaggacu

SEQ ID NO: 65634 - RNA, 36 nt, Artificial Sequence
  Synthetic Oligonucleotide; LAG exon 7; Set C
aaguacaggaugaggcauagggucaggacuagaaag

SEQ ID NO: 65635 - RNA, 22 nt, Artificial Sequence
  Synthetic Oligonucleotide; LAG exon 7; Set A
ggaugaggcauagggucaggac

SEQ ID NO: 65636 - RNA, 37 nt, Artificial Sequence
  Synthetic Oligonucleotide; LAG exon 7; Set C
aaaguacaggaugaggcauagggucaggacuagaaag

SEQ ID NO: 65637 - RNA, 23 nt, Artificial Sequence
  Synthetic Oligonucleotide; LAG exon 7; Set A
aggaugaggcauagggucaggac

SEQ ID NO: 65638 - RNA, 38 nt, Artificial Sequence
  Synthetic Oligonucleotide; LAG exon 7; Set C
gaaaguacaggaugaggcauagggucaggacuagaaag

SEQ ID NO: 65639 - RNA, 39 nt, Artificial Sequence
  Synthetic Oligonucleotide; LAG exon 7; Set C
agaaaguacaggaugaggcauagggucaggacuagaaag

SEQ ID NO: 65640 - RNA, 40 nt, Artificial Sequence
  Synthetic Oligonucleotide; LAG exon 7; Set C
gagaaaguacaggaugaggcauagggucaggacuagaaag

SEQ ID NO: 65641 - RNA, 29 nt, Artificial Sequence
  Synthetic Oligonucleotide; LAG exon 7; Set C
aguacaggaugaggcauagggucaggacu

SEQ ID NO: 65642 - RNA, 33 nt, Artificial Sequence
  Synthetic Oligonucleotide; LAG exon 7; Set C
agaaaguacaggaugaggcauagggucaggacu

SEQ ID NO: 65643 - RNA, 37 nt, Artificial Sequence
  Synthetic Oligonucleotide; LAG exon 7; Set C
ggagaaaguacaggaugaggcauagggucaggacuag

SEQ ID NO: 65644 - RNA, 34 nt, Artificial Sequence
  Synthetic Oligonucleotide; LAG exon 7; Set C
gagaaaguacaggaugaggcauagggucaggacu

SEQ ID NO: 65645 - RNA, 32 nt, Artificial Sequence
  Synthetic Oligonucleotide; LAG exon 7; Set C
agaaaguacaggaugaggcauagggucaggac

SEQ ID NO: 65646 - RNA, 38 nt, Artificial Sequence
  Synthetic Oligonucleotide; LAG exon 7; Set C
uggagaaaguacaggaugaggcauagggucaggacuag

SEQ ID NO: 65647 - RNA, 35 nt, Artificial Sequence
  Synthetic Oligonucleotide; LAG exon 7; Set C
ggagaaaguacaggaugaggcauagggucaggacu

SEQ ID NO: 65648 - RNA, 33 nt, Artificial Sequence
  Synthetic Oligonucleotide; LAG exon 7; Set C
gagaaaguacaggaugaggcauagggucaggac

SEQ ID NO: 65649 - RNA, 39 nt, Artificial Sequence
  Synthetic Oligonucleotide; LAG exon 7; Set C
auggagaaaguacaggaugaggcauagggucaggacuag

SEQ ID NO: 65650 - RNA, 36 nt, Artificial Sequence
  Synthetic Oligonucleotide; LAG exon 7; Set C
uggagaaaguacaggaugaggcauagggucaggacu

SEQ ID NO: 65651 - RNA, 34 nt, Artificial Sequence
  Synthetic Oligonucleotide; LAG exon 7; Set C
ggagaaaguacaggaugaggcauagggucaggac

SEQ ID NO: 65652 - RNA, 40 nt, Artificial Sequence
  Synthetic Oligonucleotide; LAG exon 7; Set C
uauggagaaaguacaggaugaggcauagggucaggacuag

SEQ ID NO: 65653 - RNA, 37 nt, Artificial Sequence
  Synthetic Oligonucleotide; LAG exon 7; Set C
auggagaaaguacaggaugaggcauagggucaggacu

SEQ ID NO: 65654 - RNA, 35 nt, Artificial Sequence
  Synthetic Oligonucleotide; LAG exon 7; Set C
uggagaaaguacaggaugaggcauagggucaggac

SEQ ID NO: 65655 - RNA, 38 nt, Artificial Sequence
  Synthetic Oligonucleotide; LAG exon 7; Set C
uauggagaaaguacaggaugaggcauagggucaggacu

SEQ ID NO: 65656 - RNA, 36 nt, Artificial Sequence
  Synthetic Oligonucleotide; LAG exon 7; Set C
auggagaaaguacaggaugaggcauagggucaggac

SEQ ID NO: 65657 - RNA, 37 nt, Artificial Sequence
  Synthetic Oligonucleotide; LAG exon 7; Set C
uauggagaaaguacaggaugaggcauagggucaggac

SEQ ID NO: 65658 - RNA, 39 nt, Artificial Sequence
  Synthetic Oligonucleotide; LAG exon 7; Set C
agagcguugggcaccuauggagaaaguacaggaugaggc

SEQ ID NO: 65659 - RNA, 38 nt, Artificial Sequence
  Synthetic Oligonucleotide; LAG exon 7; Set C
agagcguugggcaccuauggagaaaguacaggaugagg

SEQ ID NO: 65660 - RNA, 37 nt, Artificial Sequence
  Synthetic Oligonucleotide; LAG exon 7; Set C
agagcguugggcaccuauggagaaaguacaggaugag

SEQ ID NO: 65661 - RNA, 36 nt, Artificial Sequence
  Synthetic Oligonucleotide; LAG exon 7; Set C
agagcguugggcaccuauggagaaaguacaggauga

SEQ ID NO: 65662 - RNA, 21 nt, Artificial Sequence
  Synthetic Oligonucleotide; LAG exon 7; Set C
ugggcaccuauggagaaagua

SEQ ID NO: 65663 - RNA, 19 nt, Artificial Sequence
  Synthetic Oligonucleotide; LAG exon 7; Set C
ugggcaccuauggagaaag

SEQ ID NO: 65664 - RNA, 32 nt, Artificial Sequence
  Synthetic Oligonucleotide; LAG exon 7; Set C
agagcguugggcaccuauggagaaaguacagg

SEQ ID NO: 65665 - RNA, 20 nt, Artificial Sequence
  Synthetic Oligonucleotide; LAG exon 7; Set C
uugggcaccuauggagaaag

SEQ ID NO: 65666 - RNA, 18 nt, Artificial Sequence
  Synthetic Oligonucleotide; LAG exon 7; Set C
ugggcaccuauggagaaa

SEQ ID NO: 65667 - RNA, 21 nt, Artificial Sequence
  Synthetic Oligonucleotide; LAG exon 7; Set C
guugggcaccuauggagaaag

SEQ ID NO: 65668 - RNA, 19 nt, Artificial Sequence
  Synthetic Oligonucleotide; LAG exon 7; Set C
uugggcaccuauggagaaa

SEQ ID NO: 65669 - RNA, 17 nt, Artificial Sequence
  Synthetic Oligonucleotide; LAG exon 7; Set C
ugggcaccuauggagaa

SEQ ID NO: 65670 - RNA, 20 nt, Artificial Sequence
  Synthetic Oligonucleotide; LAG exon 7; Set C
guugggcaccuauggagaaa

SEQ ID NO: 65671 - RNA, 18 nt, Artificial Sequence
  Synthetic Oligonucleotide; LAG exon 7; Set C
uugggcaccuauggagaa

SEQ ID NO: 65672 - RNA, 15 nt, Artificial Sequence
  Synthetic Oligonucleotide; LAG exon 7; Set C
ugggcaccuauggag

SEQ ID NO: 65673 - RNA, 19 nt, Artificial Sequence
  Synthetic Oligonucleotide; LAG exon 7; Set A
guugggcaccuauggagaa

SEQ ID NO: 65674 - RNA, 40 nt, Artificial Sequence
  Synthetic Oligonucleotide; LAG exon 7; Set C
ucucccagagcguugggcaccuauggagaaaguacaggau

SEQ ID NO: 65675 - RNA, 27 nt, Artificial Sequence
  Synthetic Oligonucleotide; LAG exon 7; Set A
agagcguugggcaccuauggagaaagu

SEQ ID NO: 65676 - RNA, 39 nt, Artificial Sequence
  Synthetic Oligonucleotide; LAG exon 7; Set C
ucucccagagcguugggcaccuauggagaaaguacagga

SEQ ID NO: 65677 - RNA, 40 nt, Artificial Sequence
  Synthetic Oligonucleotide; LAG exon 7; Set C
cucucccagagcguugggcaccuauggagaaaguacagga

SEQ ID NO: 65678 - RNA, 23 nt, Artificial Sequence
  Synthetic Oligonucleotide; LAG exon 7; Set C
agagcguugggcaccuauggaga

SEQ ID NO: 65679 - RNA, 22 nt, Artificial Sequence
  Synthetic Oligonucleotide; LAG exon 7; Set A
agagcguugggcaccuauggag

SEQ ID NO: 65680 - RNA, 34 nt, Artificial Sequence
  Synthetic Oligonucleotide; LAG exon 7; Set C
ucucccagagcguugggcaccuauggagaaagua

SEQ ID NO: 65681 - RNA, 33 nt, Artificial Sequence
  Synthetic Oligonucleotide; LAG exon 7; Set C
ucucccagagcguugggcaccuauggagaaagu

SEQ ID NO: 65682 - RNA, 35 nt, Artificial Sequence
  Synthetic Oligonucleotide; LAG exon 7; Set C
cucucccagagcguugggcaccuauggagaaagua

SEQ ID NO: 65683 - RNA, 34 nt, Artificial Sequence
  Synthetic Oligonucleotide; LAG exon 7; Set C
cucucccagagcguugggcaccuauggagaaagu

SEQ ID NO: 65684 - RNA, 36 nt, Artificial Sequence
  Synthetic Oligonucleotide; LAG exon 7; Set C
gcucucccagagcguugggcaccuauggagaaagua

SEQ ID NO: 65685 - RNA, 32 nt, Artificial Sequence
  Synthetic Oligonucleotide; LAG exon 7; Set C
ucucccagagcguugggcaccuauggagaaag

SEQ ID NO: 65686 - RNA, 35 nt, Artificial Sequence
  Synthetic Oligonucleotide; LAG exon 7; Set C
gcucucccagagcguugggcaccuauggagaaagu

SEQ ID NO: 65687 - RNA, 37 nt, Artificial Sequence
  Synthetic Oligonucleotide; LAG exon 7; Set C
ggcucucccagagcguugggcaccuauggagaaagua

SEQ ID NO: 65688 - RNA, 33 nt, Artificial Sequence
  Synthetic Oligonucleotide; LAG exon 7; Set C
cucucccagagcguugggcaccuauggagaaag

SEQ ID NO: 65689 - RNA, 36 nt, Artificial Sequence
  Synthetic Oligonucleotide; LAG exon 7; Set C
ggcucucccagagcguugggcaccuauggagaaagu

SEQ ID NO: 65690 - RNA, 38 nt, Artificial Sequence
  Synthetic Oligonucleotide; LAG exon 7; Set C
gggcucucccagagcguugggcaccuauggagaaagua

SEQ ID NO: 65691 - RNA, 29 nt, Artificial Sequence
  Synthetic Oligonucleotide; LAG exon 7; Set C
ucucccagagcguugggcaccuauggaga

SEQ ID NO: 65692 - RNA, 37 nt, Artificial Sequence
  Synthetic Oligonucleotide; LAG exon 7; Set C
gggcucucccagagcguugggcaccuauggagaaagu

SEQ ID NO: 65693 - RNA, 30 nt, Artificial Sequence
  Synthetic Oligonucleotide; LAG exon 7; Set C
cucucccagagcguugggcaccuauggaga

SEQ ID NO: 65694 - RNA, 28 nt, Artificial Sequence
  Synthetic Oligonucleotide; LAG exon 7; Set C
ucucccagagcguugggcaccuauggag

SEQ ID NO: 65695 - RNA, 36 nt, Artificial Sequence
  Synthetic Oligonucleotide; LAG exon 7; Set C
gggcucucccagagcguugggcaccuauggagaaag

SEQ ID NO: 65696 - RNA, 31 nt, Artificial Sequence
  Synthetic Oligonucleotide; LAG exon 7; Set C
gcucucccagagcguugggcaccuauggaga

SEQ ID NO: 65697 - RNA, 27 nt, Artificial Sequence
  Synthetic Oligonucleotide; LAG exon 7; Set C
ucucccagagcguugggcaccuaugga

SEQ ID NO: 65698 - RNA, 29 nt, Artificial Sequence
  Synthetic Oligonucleotide; LAG exon 7; Set C
cucucccagagcguugggcaccuauggag

SEQ ID NO: 65699 - RNA, 32 nt, Artificial Sequence
  Synthetic Oligonucleotide; LAG exon 7; Set C
ggcucucccagagcguugggcaccuauggaga

SEQ ID NO: 65700 - RNA, 28 nt, Artificial Sequence
  Synthetic Oligonucleotide; LAG exon 7; Set C
cucucccagagcguugggcaccuaugga

SEQ ID NO: 65701 - RNA, 30 nt, Artificial Sequence
  Synthetic Oligonucleotide; LAG exon 7; Set C
gcucucccagagcguugggcaccuauggag

SEQ ID NO: 65702 - RNA, 26 nt, Artificial Sequence
  Synthetic Oligonucleotide; LAG exon 7; Set C
ucucccagagcguugggcaccuaugg

SEQ ID NO: 65703 - RNA, 33 nt, Artificial Sequence
  Synthetic Oligonucleotide; LAG exon 7; Set C
gggcucucccagagcguugggcaccuauggaga

SEQ ID NO: 65704 - RNA, 31 nt, Artificial Sequence
  Synthetic Oligonucleotide; LAG exon 7; Set C
ggcucucccagagcguugggcaccuauggag

SEQ ID NO: 65705 - RNA, 29 nt, Artificial Sequence
  Synthetic Oligonucleotide; LAG exon 7; Set C
gcucucccagagcguugggcaccuaugga

SEQ ID NO: 65706 - RNA, 27 nt, Artificial Sequence
  Synthetic Oligonucleotide; LAG exon 7; Set C
cucucccagagcguugggcaccuaugg

SEQ ID NO: 65707 - RNA, 25 nt, Artificial Sequence
  Synthetic Oligonucleotide; LAG exon 7; Set C
ucucccagagcguugggcaccuaug

SEQ ID NO: 65708 - RNA, 24 nt, Artificial Sequence
  Synthetic Oligonucleotide; LAG exon 7; Set C
ucucccagagcguugggcaccuau

SEQ ID NO: 65709 - RNA, 32 nt, Artificial Sequence
  Synthetic Oligonucleotide; LAG exon 7; Set C
gggcucucccagagcguugggcaccuauggag

SEQ ID NO: 65710 - RNA, 30 nt, Artificial Sequence
  Synthetic Oligonucleotide; LAG exon 7; Set C
ggcucucccagagcguugggcaccuaugga

SEQ ID NO: 65711 - RNA, 28 nt, Artificial Sequence
  Synthetic Oligonucleotide; LAG exon 7; Set C
gcucucccagagcguugggcaccuaugg

SEQ ID NO: 65712 - RNA, 26 nt, Artificial Sequence
  Synthetic Oligonucleotide; LAG exon 7; Set C
cucucccagagcguugggcaccuaug

SEQ ID NO: 65713 - RNA, 25 nt, Artificial Sequence
  Synthetic Oligonucleotide; LAG exon 7; Set C
cucucccagagcguugggcaccuau

SEQ ID NO: 65714 - RNA, 31 nt, Artificial Sequence
  Synthetic Oligonucleotide; LAG exon 7; Set C
gggcucucccagagcguugggcaccuaugga

SEQ ID NO: 65715 - RNA, 29 nt, Artificial Sequence
  Synthetic Oligonucleotide; LAG exon 7; Set C
ggcucucccagagcguugggcaccuaugg

SEQ ID NO: 65716 - RNA, 27 nt, Artificial Sequence
  Synthetic Oligonucleotide; LAG exon 7; Set C
gcucucccagagcguugggcaccuaug

SEQ ID NO: 65717 - RNA, 26 nt, Artificial Sequence
  Synthetic Oligonucleotide; LAG exon 7; Set C
gcucucccagagcguugggcaccuau

SEQ ID NO: 65718 - RNA, 30 nt, Artificial Sequence
  Synthetic Oligonucleotide; LAG exon 7; Set C
gggcucucccagagcguugggcaccuaugg

SEQ ID NO: 65719 - RNA, 28 nt, Artificial Sequence
  Synthetic Oligonucleotide; LAG exon 7; Set C
ggcucucccagagcguugggcaccuaug

SEQ ID NO: 65720 - RNA, 27 nt, Artificial Sequence
  Synthetic Oligonucleotide; LAG exon 7; Set C
ggcucucccagagcguugggcaccuau

SEQ ID NO: 65721 - RNA, 29 nt, Artificial Sequence
  Synthetic Oligonucleotide; LAG exon 7; Set C
gggcucucccagagcguugggcaccuaug

SEQ ID NO: 65722 - RNA, 28 nt, Artificial Sequence
  Synthetic Oligonucleotide; LAG exon 7; Set C
gggcucucccagagcguugggcaccuau

SEQ ID NO: 65723 - RNA, 15 nt, Artificial Sequence
  Synthetic Oligonucleotide; LAG exon 7; Set C
ucucccagagcguug

SEQ ID NO: 65724 - RNA, 16 nt, Artificial Sequence
  Synthetic Oligonucleotide; LAG exon 7; Set C
cucucccagagcguug

SEQ ID NO: 65725 - RNA, 18 nt, Artificial Sequence
  Synthetic Oligonucleotide; LAG exon 7; Set A
ggcucucccagagcguug

SEQ ID NO: 65726 - RNA, 20 nt, Artificial Sequence
  Synthetic Oligonucleotide; LAG exon 7; Set C
gggcucucccagagcguugg

SEQ ID NO: 65727 - RNA, 15 nt, Artificial Sequence
  Synthetic Oligonucleotide; LAG exon 7; Set C
gcucucccagagcgu

SEQ ID NO: 65728 - RNA, 19 nt, Artificial Sequence
  Synthetic Oligonucleotide; LAG exon 7; Set A
gggcucucccagagcguug

SEQ ID NO: 65729 - RNA, 16 nt, Artificial Sequence
  Synthetic Oligonucleotide; LAG exon 7; Set A
ggcucucccagagcgu

SEQ ID NO: 65730 - RNA, 40 nt, Artificial Sequence
  Synthetic Oligonucleotide; LAG exon 7; Set C
gagggcaccuggggcucucccagagcguugggcaccuaug

SEQ ID NO: 65731 - RNA, 18 nt, Artificial Sequence
  Synthetic Oligonucleotide; LAG exon 7; Set A
gggcucucccagagcguu

SEQ ID NO: 65732 - RNA, 17 nt, Artificial Sequence
  Synthetic Oligonucleotide; LAG exon 7; Set A
gggcucucccagagcgu

SEQ ID NO: 65733 - RNA, 15 nt, Artificial Sequence
  Synthetic Oligonucleotide; LAG exon 7; Set C
ggcucucccagagcg

SEQ ID NO: 65734 - RNA, 16 nt, Artificial Sequence
  Synthetic Oligonucleotide; LAG exon 7; Set A
gggcucucccagagcg

SEQ ID NO: 65735 - RNA, 15 nt, Artificial Sequence
  Synthetic Oligonucleotide; LAG exon 7; Set A
gggcucucccagagc

SEQ ID NO: 65736 - RNA, 31 nt, Artificial Sequence
  Synthetic Oligonucleotide; LAG exon 7; Set C
gagggcaccuggggcucucccagagcguugg

SEQ ID NO: 65737 - RNA, 30 nt, Artificial Sequence
  Synthetic Oligonucleotide; LAG exon 7; Set C
gagggcaccuggggcucucccagagcguug

SEQ ID NO: 65738 - RNA, 32 nt, Artificial Sequence
  Synthetic Oligonucleotide; LAG exon 7; Set C
ggagggcaccuggggcucucccagagcguugg

SEQ ID NO: 65739 - RNA, 31 nt, Artificial Sequence
  Synthetic Oligonucleotide; LAG exon 7; Set C
ggagggcaccuggggcucucccagagcguug

SEQ ID NO: 65740 - RNA, 29 nt, Artificial Sequence
  Synthetic Oligonucleotide; LAG exon 7; Set C
gagggcaccuggggcucucccagagcguu

SEQ ID NO: 65741 - RNA, 30 nt, Artificial Sequence
  Synthetic Oligonucleotide; LAG exon 7; Set C
ggagggcaccuggggcucucccagagcguu

SEQ ID NO: 65742 - RNA, 35 nt, Artificial Sequence
  Synthetic Oligonucleotide; LAG exon 7; Set C
cugggagggcaccuggggcucucccagagcguugg

SEQ ID NO: 65743 - RNA, 26 nt, Artificial Sequence
  Synthetic Oligonucleotide; LAG exon 7; Set C
gagggcaccuggggcucucccagagc

SEQ ID NO: 65744 - RNA, 34 nt, Artificial Sequence
  Synthetic Oligonucleotide; LAG exon 7; Set C
cugggagggcaccuggggcucucccagagcguug

SEQ ID NO: 65745 - RNA, 36 nt, Artificial Sequence
  Synthetic Oligonucleotide; LAG exon 7; Set C
gcugggagggcaccuggggcucucccagagcguugg

SEQ ID NO: 65746 - RNA, 25 nt, Artificial Sequence
  Synthetic Oligonucleotide; LAG exon 7; Set C
gagggcaccuggggcucucccagag

SEQ ID NO: 65747 - RNA, 35 nt, Artificial Sequence
  Synthetic Oligonucleotide; LAG exon 7; Set C
gcugggagggcaccuggggcucucccagagcguug

SEQ ID NO: 65748 - RNA, 33 nt, Artificial Sequence
  Synthetic Oligonucleotide; LAG exon 7; Set C
cugggagggcaccuggggcucucccagagcguu

SEQ ID NO: 65749 - RNA, 34 nt, Artificial Sequence
  Synthetic Oligonucleotide; LAG exon 7; Set C
gcugggagggcaccuggggcucucccagagcguu

SEQ ID NO: 65750 - RNA, 40 nt, Artificial Sequence
  Synthetic Oligonucleotide; LAG exon 7; Set C
uggccugcugggagggcaccuggggcucucccagagcguu

SEQ ID NO: 65751 - RNA, 18 nt, Artificial Sequence
  Synthetic Oligonucleotide; LAG exon 7; Set C
gagggcaccuggggcucu

SEQ ID NO: 65752 - RNA, 19 nt, Artificial Sequence
  Synthetic Oligonucleotide; LAG exon 7; Set C
ggagggcaccuggggcucu

SEQ ID NO: 65753 - RNA, 17 nt, Artificial Sequence
  Synthetic Oligonucleotide; LAG exon 7; Set A
gagggcaccuggggcuc

SEQ ID NO: 65754 - RNA, 18 nt, Artificial Sequence
  Synthetic Oligonucleotide; LAG exon 7; Set C
ggagggcaccuggggcuc

SEQ ID NO: 65755 - RNA, 16 nt, Artificial Sequence
  Synthetic Oligonucleotide; LAG exon 7; Set A
gagggcaccuggggcu

SEQ ID NO: 65756 - RNA, 17 nt, Artificial Sequence
  Synthetic Oligonucleotide; LAG exon 7; Set C
ggagggcaccuggggcu

SEQ ID NO: 65757 - RNA, 22 nt, Artificial Sequence
  Synthetic Oligonucleotide; LAG exon 7; Set C
cugggagggcaccuggggcucu

SEQ ID NO: 65758 - RNA, 16 nt, Artificial Sequence
  Synthetic Oligonucleotide; LAG exon 7; Set C
ggagggcaccuggggc

SEQ ID NO: 65759 - RNA, 23 nt, Artificial Sequence
  Synthetic Oligonucleotide; LAG exon 7; Set C
gcugggagggcaccuggggcucu

SEQ ID NO: 65760 - RNA, 21 nt, Artificial Sequence
  Synthetic Oligonucleotide; LAG exon 7; Set C
cugggagggcaccuggggcuc

SEQ ID NO: 65761 - RNA, 15 nt, Artificial Sequence
  Synthetic Oligonucleotide; LAG exon 7; Set A
ggagggcaccugggg

SEQ ID NO: 65762 - RNA, 17 nt, Artificial Sequence
  Synthetic Oligonucleotide; LAG exon 7; Set C
gggagggcaccuggggc

SEQ ID NO: 65763 - RNA, 22 nt, Artificial Sequence
  Synthetic Oligonucleotide; LAG exon 7; Set C
gcugggagggcaccuggggcuc

SEQ ID NO: 65764 - RNA, 16 nt, Artificial Sequence
  Synthetic Oligonucleotide; LAG exon 7; Set A
gggagggcaccugggg

SEQ ID NO: 65765 - RNA, 20 nt, Artificial Sequence
  Synthetic Oligonucleotide; LAG exon 7; Set C
cugggagggcaccuggggcu

SEQ ID NO: 65766 - RNA, 19 nt, Artificial Sequence
  Synthetic Oligonucleotide; LAG exon 7; Set C
cugggagggcaccuggggc

SEQ ID NO: 65767 - RNA, 21 nt, Artificial Sequence
  Synthetic Oligonucleotide; LAG exon 7; Set C
gcugggagggcaccuggggcu

SEQ ID NO: 65768 - RNA, 18 nt, Artificial Sequence
  Synthetic Oligonucleotide; LAG exon 7; Set C
cugggagggcaccugggg

SEQ ID NO: 65769 - RNA, 20 nt, Artificial Sequence
  Synthetic Oligonucleotide; LAG exon 7; Set C
gcugggagggcaccuggggc

SEQ ID NO: 65770 - RNA, 19 nt, Artificial Sequence
  Synthetic Oligonucleotide; LAG exon 7; Set C
gcugggagggcaccugggg

SEQ ID NO: 65771 - RNA, 29 nt, Artificial Sequence
  Synthetic Oligonucleotide; LAG exon 7; Set C
uggccugcugggagggcaccuggggcucu

SEQ ID NO: 65772 - RNA, 30 nt, Artificial Sequence
  Synthetic Oligonucleotide; LAG exon 7; Set C
guggccugcugggagggcaccuggggcucu

SEQ ID NO: 65773 - RNA, 28 nt, Artificial Sequence
  Synthetic Oligonucleotide; LAG exon 7; Set C
uggccugcugggagggcaccuggggcuc

SEQ ID NO: 65774 - RNA, 31 nt, Artificial Sequence
  Synthetic Oligonucleotide; LAG exon 7; Set C
gguggccugcugggagggcaccuggggcucu

SEQ ID NO: 65775 - RNA, 29 nt, Artificial Sequence
  Synthetic Oligonucleotide; LAG exon 7; Set C
guggccugcugggagggcaccuggggcuc

SEQ ID NO: 65776 - RNA, 27 nt, Artificial Sequence
  Synthetic Oligonucleotide; LAG exon 7; Set C
uggccugcugggagggcaccuggggcu

SEQ ID NO: 65777 - RNA, 32 nt, Artificial Sequence
  Synthetic Oligonucleotide; LAG exon 7; Set C
agguggccugcugggagggcaccuggggcucu

SEQ ID NO: 65778 - RNA, 30 nt, Artificial Sequence
  Synthetic Oligonucleotide; LAG exon 7; Set C
gguggccugcugggagggcaccuggggcuc

SEQ ID NO: 65779 - RNA, 28 nt, Artificial Sequence
  Synthetic Oligonucleotide; LAG exon 7; Set C
guggccugcugggagggcaccuggggcu

SEQ ID NO: 65780 - RNA, 26 nt, Artificial Sequence
  Synthetic Oligonucleotide; LAG exon 7; Set C
uggccugcugggagggcaccuggggc

SEQ ID NO: 65781 - RNA, 33 nt, Artificial Sequence
  Synthetic Oligonucleotide; LAG exon 7; Set C
gagguggccugcugggagggcaccuggggcucu

SEQ ID NO: 65782 - RNA, 31 nt, Artificial Sequence
  Synthetic Oligonucleotide; LAG exon 7; Set C
agguggccugcugggagggcaccuggggcuc

SEQ ID NO: 65783 - RNA, 25 nt, Artificial Sequence
  Synthetic Oligonucleotide; LAG exon 7; Set C
uggccugcugggagggcaccugggg

SEQ ID NO: 65784 - RNA, 29 nt, Artificial Sequence
  Synthetic Oligonucleotide; LAG exon 7; Set C
gguggccugcugggagggcaccuggggcu

SEQ ID NO: 65785 - RNA, 27 nt, Artificial Sequence
  Synthetic Oligonucleotide; LAG exon 7; Set C
guggccugcugggagggcaccuggggc

SEQ ID NO: 65786 - RNA, 32 nt, Artificial Sequence
  Synthetic Oligonucleotide; LAG exon 7; Set C
gagguggccugcugggagggcaccuggggcuc

SEQ ID NO: 65787 - RNA, 26 nt, Artificial Sequence
  Synthetic Oligonucleotide; LAG exon 7; Set C
guggccugcugggagggcaccugggg

SEQ ID NO: 65788 - RNA, 30 nt, Artificial Sequence
  Synthetic Oligonucleotide; LAG exon 7; Set C
agguggccugcugggagggcaccuggggcu

SEQ ID NO: 65789 - RNA, 28 nt, Artificial Sequence
  Synthetic Oligonucleotide; LAG exon 7; Set C
gguggccugcugggagggcaccuggggc

SEQ ID NO: 65790 - RNA, 27 nt, Artificial Sequence
  Synthetic Oligonucleotide; LAG exon 7; Set C
gguggccugcugggagggcaccugggg

SEQ ID NO: 65791 - RNA, 29 nt, Artificial Sequence
  Synthetic Oligonucleotide; LAG exon 7; Set C
agguggccugcugggagggcaccuggggc

SEQ ID NO: 65792 - RNA, 31 nt, Artificial Sequence
  Synthetic Oligonucleotide; LAG exon 7; Set C
gagguggccugcugggagggcaccuggggcu

SEQ ID NO: 65793 - RNA, 28 nt, Artificial Sequence
  Synthetic Oligonucleotide; LAG exon 7; Set C
agguggccugcugggagggcaccugggg

SEQ ID NO: 65794 - RNA, 30 nt, Artificial Sequence
  Synthetic Oligonucleotide; LAG exon 7; Set C
gagguggccugcugggagggcaccuggggc

SEQ ID NO: 65795 - RNA, 29 nt, Artificial Sequence
  Synthetic Oligonucleotide; LAG exon 7; Set C
gagguggccugcugggagggcaccugggg

SEQ ID NO: 65796 - RNA, 16 nt, Artificial Sequence
  Synthetic Oligonucleotide; LAG exon 7; Set A
uggccugcugggaggg

SEQ ID NO: 65797 - RNA, 15 nt, Artificial Sequence
  Synthetic Oligonucleotide; LAG exon 7; Set A
uggccugcugggagg

SEQ ID NO: 65798 - RNA, 17 nt, Artificial Sequence
  Synthetic Oligonucleotide; LAG exon 7; Set A
guggccugcugggaggg

SEQ ID NO: 65799 - RNA, 40 nt, Artificial Sequence
  Synthetic Oligonucleotide; LAG exon 7; Set C
aaacagcaggagguggccugcugggagggcaccuggggcu

SEQ ID NO: 65800 - RNA, 16 nt, Artificial Sequence
  Synthetic Oligonucleotide; LAG exon 7; Set A
guggccugcugggagg

SEQ ID NO: 65801 - RNA, 18 nt, Artificial Sequence
  Synthetic Oligonucleotide; LAG exon 7; Set C
gguggccugcugggaggg

SEQ ID NO: 65802 - RNA, 39 nt, Artificial Sequence
  Synthetic Oligonucleotide; LAG exon 7; Set C
aaacagcaggagguggccugcugggagggcaccuggggc

SEQ ID NO: 65803 - RNA, 17 nt, Artificial Sequence
  Synthetic Oligonucleotide; LAG exon 7; Set A
gguggccugcugggagg

SEQ ID NO: 65804 - RNA, 19 nt, Artificial Sequence
  Synthetic Oligonucleotide; LAG exon 7; Set C
agguggccugcugggaggg

SEQ ID NO: 65805 - RNA, 38 nt, Artificial Sequence
  Synthetic Oligonucleotide; LAG exon 7; Set C
aaacagcaggagguggccugcugggagggcaccugggg

SEQ ID NO: 65806 - RNA, 40 nt, Artificial Sequence
  Synthetic Oligonucleotide; LAG exon 7; Set C
gaaacagcaggagguggccugcugggagggcaccuggggc

SEQ ID NO: 65807 - RNA, 18 nt, Artificial Sequence
  Synthetic Oligonucleotide; LAG exon 7; Set A
agguggccugcugggagg

SEQ ID NO: 65808 - RNA, 20 nt, Artificial Sequence
  Synthetic Oligonucleotide; LAG exon 7; Set C
gagguggccugcugggaggg

SEQ ID NO: 65809 - RNA, 39 nt, Artificial Sequence
  Synthetic Oligonucleotide; LAG exon 7; Set C
gaaacagcaggagguggccugcugggagggcaccugggg

SEQ ID NO: 65810 - RNA, 19 nt, Artificial Sequence
  Synthetic Oligonucleotide; LAG exon 7; Set A
gagguggccugcugggagg

SEQ ID NO: 65811 - RNA, 40 nt, Artificial Sequence
  Synthetic Oligonucleotide; LAG exon 7; Set C
agaaacagcaggagguggccugcugggagggcaccugggg

SEQ ID NO: 65812 - RNA, 30 nt, Artificial Sequence
  Synthetic Oligonucleotide; LAG exon 7; Set C
gaaacagcaggagguggccugcugggaggg

SEQ ID NO: 65813 - RNA, 29 nt, Artificial Sequence
  Synthetic Oligonucleotide; LAG exon 7; Set C
gaaacagcaggagguggccugcugggagg

SEQ ID NO: 65814 - RNA, 31 nt, Artificial Sequence
  Synthetic Oligonucleotide; LAG exon 7; Set C
agaaacagcaggagguggccugcugggaggg

SEQ ID NO: 65815 - RNA, 30 nt, Artificial Sequence
  Synthetic Oligonucleotide; LAG exon 7; Set C
agaaacagcaggagguggccugcugggagg

SEQ ID NO: 65816 - RNA, 32 nt, Artificial Sequence
  Synthetic Oligonucleotide; LAG exon 7; Set C
gagaaacagcaggagguggccugcugggaggg

SEQ ID NO: 65817 - RNA, 31 nt, Artificial Sequence
  Synthetic Oligonucleotide; LAG exon 7; Set C
gagaaacagcaggagguggccugcugggagg

SEQ ID NO: 65818 - RNA, 33 nt, Artificial Sequence
  Synthetic Oligonucleotide; LAG exon 7; Set C
ugagaaacagcaggagguggccugcugggaggg

SEQ ID NO: 65819 - RNA, 32 nt, Artificial Sequence
  Synthetic Oligonucleotide; LAG exon 7; Set C
ugagaaacagcaggagguggccugcugggagg

SEQ ID NO: 65820 - RNA, 23 nt, Artificial Sequence
  Synthetic Oligonucleotide; LAG exon 7; Set A
aaacagcaggagguggccugcug

SEQ ID NO: 65821 - RNA, 24 nt, Artificial Sequence
  Synthetic Oligonucleotide; LAG exon 7; Set C
gaaacagcaggagguggccugcug

SEQ ID NO: 65822 - RNA, 22 nt, Artificial Sequence
  Synthetic Oligonucleotide; LAG exon 7; Set A
aaacagcaggagguggccugcu

SEQ ID NO: 65823 - RNA, 25 nt, Artificial Sequence
  Synthetic Oligonucleotide; LAG exon 7; Set C
agaaacagcaggagguggccugcug

SEQ ID NO: 65824 - RNA, 23 nt, Artificial Sequence
  Synthetic Oligonucleotide; LAG exon 7; Set C
gaaacagcaggagguggccugcu

SEQ ID NO: 65825 - RNA, 26 nt, Artificial Sequence
  Synthetic Oligonucleotide; LAG exon 7; Set C
gagaaacagcaggagguggccugcug

SEQ ID NO: 65826 - RNA, 24 nt, Artificial Sequence
  Synthetic Oligonucleotide; LAG exon 7; Set C
agaaacagcaggagguggccugcu

SEQ ID NO: 65827 - RNA, 27 nt, Artificial Sequence
  Synthetic Oligonucleotide; LAG exon 7; Set C
ugagaaacagcaggagguggccugcug

SEQ ID NO: 65828 - RNA, 25 nt, Artificial Sequence
  Synthetic Oligonucleotide; LAG exon 7; Set C
gagaaacagcaggagguggccugcu

SEQ ID NO: 65829 - RNA, 26 nt, Artificial Sequence
  Synthetic Oligonucleotide; LAG exon 7; Set C
ugagaaacagcaggagguggccugcu

SEQ ID NO: 65830 - RNA, 15 nt, Artificial Sequence
  Synthetic Oligonucleotide; LAG exon 7; Set C
gagaaacagcaggag

SEQ ID NO: 65831 - RNA, 17 nt, Artificial Sequence
  Synthetic Oligonucleotide; LAG exon 7; Set C
acaccaaggaugagaaa

SEQ ID NO: 65832 - RNA, 16 nt, Artificial Sequence
  Synthetic Oligonucleotide; LAG exon 7; Set C
acaccaaggaugagaa

SEQ ID NO: 65833 - RNA, 18 nt, Artificial Sequence
  Synthetic Oligonucleotide; LAG exon 7; Set C
gacaccaaggaugagaaa

SEQ ID NO: 65834 - RNA, 17 nt, Artificial Sequence
  Synthetic Oligonucleotide; LAG exon 7; Set C
gacaccaaggaugagaa

SEQ ID NO: 65835 - RNA, 19 nt, Artificial Sequence
  Synthetic Oligonucleotide; LAG exon 7; Set C
ggacaccaaggaugagaaa

SEQ ID NO: 65836 - RNA, 15 nt, Artificial Sequence
  Synthetic Oligonucleotide; LAG exon 7; Set C
acaccaaggaugaga

SEQ ID NO: 65837 - RNA, 18 nt, Artificial Sequence
  Synthetic Oligonucleotide; LAG exon 7; Set C
ggacaccaaggaugagaa

SEQ ID NO: 65838 - RNA, 20 nt, Artificial Sequence
  Synthetic Oligonucleotide; LAG exon 7; Set C
aggacaccaaggaugagaaa

SEQ ID NO: 65839 - RNA, 16 nt, Artificial Sequence
  Synthetic Oligonucleotide; LAG exon 7; Set C
gacaccaaggaugaga

SEQ ID NO: 65840 - RNA, 19 nt, Artificial Sequence
  Synthetic Oligonucleotide; LAG exon 7; Set C
aggacaccaaggaugagaa

SEQ ID NO: 65841 - RNA, 21 nt, Artificial Sequence
  Synthetic Oligonucleotide; LAG exon 7; Set C
aaggacaccaaggaugagaaa

SEQ ID NO: 65842 - RNA, 17 nt, Artificial Sequence
  Synthetic Oligonucleotide; LAG exon 7; Set C
ggacaccaaggaugaga

SEQ ID NO: 65843 - RNA, 22 nt, Artificial Sequence
  Synthetic Oligonucleotide; LAG exon 7; Set C
aaaggacaccaaggaugagaaa

SEQ ID NO: 65844 - RNA, 20 nt, Artificial Sequence
  Synthetic Oligonucleotide; LAG exon 7; Set C
aaggacaccaaggaugagaa

SEQ ID NO: 65845 - RNA, 18 nt, Artificial Sequence
  Synthetic Oligonucleotide; LAG exon 7; Set C
aggacaccaaggaugaga

SEQ ID NO: 65846 - RNA, 23 nt, Artificial Sequence
  Synthetic Oligonucleotide; LAG exon 7; Set C
gaaaggacaccaaggaugagaaa

SEQ ID NO: 65847 - RNA, 21 nt, Artificial Sequence
  Synthetic Oligonucleotide; LAG exon 7; Set C
aaaggacaccaaggaugagaa

SEQ ID NO: 65848 - RNA, 19 nt, Artificial Sequence
  Synthetic Oligonucleotide; LAG exon 7; Set C
aaggacaccaaggaugaga

SEQ ID NO: 65849 - RNA, 22 nt, Artificial Sequence
  Synthetic Oligonucleotide; LAG exon 7; Set C
gaaaggacaccaaggaugagaa

SEQ ID NO: 65850 - RNA, 24 nt, Artificial Sequence
  Synthetic Oligonucleotide; LAG exon 7; Set C
agaaaggacaccaaggaugagaaa

SEQ ID NO: 65851 - RNA, 20 nt, Artificial Sequence
  Synthetic Oligonucleotide; LAG exon 7; Set C
aaaggacaccaaggaugaga

SEQ ID NO: 65852 - RNA, 18 nt, Artificial Sequence
  Synthetic Oligonucleotide; LAG exon 7; Set C
aaggacaccaaggaugag

SEQ ID NO: 65853 - RNA, 25 nt, Artificial Sequence
  Synthetic Oligonucleotide; LAG exon 7; Set C
gagaaaggacaccaaggaugagaaa

SEQ ID NO: 65854 - RNA, 23 nt, Artificial Sequence
  Synthetic Oligonucleotide; LAG exon 7; Set C
agaaaggacaccaaggaugagaa

SEQ ID NO: 65855 - RNA, 21 nt, Artificial Sequence
  Synthetic Oligonucleotide; LAG exon 7; Set C
gaaaggacaccaaggaugaga

SEQ ID NO: 65856 - RNA, 19 nt, Artificial Sequence
  Synthetic Oligonucleotide; LAG exon 7; Set C
aaaggacaccaaggaugag

SEQ ID NO: 65857 - RNA, 26 nt, Artificial Sequence
  Synthetic Oligonucleotide; LAG exon 7; Set C
agagaaaggacaccaaggaugagaaa

SEQ ID NO: 65858 - RNA, 24 nt, Artificial Sequence
  Synthetic Oligonucleotide; LAG exon 7; Set C
gagaaaggacaccaaggaugagaa

SEQ ID NO: 65859 - RNA, 22 nt, Artificial Sequence
  Synthetic Oligonucleotide; LAG exon 7; Set C
agaaaggacaccaaggaugaga

SEQ ID NO: 65860 - RNA, 20 nt, Artificial Sequence
  Synthetic Oligonucleotide; LAG exon 7; Set C
gaaaggacaccaaggaugag

SEQ ID NO: 65861 - RNA, 25 nt, Artificial Sequence
  Synthetic Oligonucleotide; LAG exon 7; Set C
agagaaaggacaccaaggaugagaa

SEQ ID NO: 65862 - RNA, 23 nt, Artificial Sequence
  Synthetic Oligonucleotide; LAG exon 7; Set C
gagaaaggacaccaaggaugaga

SEQ ID NO: 65863 - RNA, 21 nt, Artificial Sequence
  Synthetic Oligonucleotide; LAG exon 7; Set C
agaaaggacaccaaggaugag

SEQ ID NO: 65864 - RNA, 24 nt, Artificial Sequence
  Synthetic Oligonucleotide; LAG exon 7; Set C
agagaaaggacaccaaggaugaga

SEQ ID NO: 65865 - RNA, 22 nt, Artificial Sequence
  Synthetic Oligonucleotide; LAG exon 7; Set C
gagaaaggacaccaaggaugag

SEQ ID NO: 65866 - RNA, 20 nt, Artificial Sequence
  Synthetic Oligonucleotide; LAG exon 7; Set C
agaaaggacaccaaggauga

SEQ ID NO: 65867 - RNA, 23 nt, Artificial Sequence
  Synthetic Oligonucleotide; LAG exon 7; Set C
agagaaaggacaccaaggaugag

SEQ ID NO: 65868 - RNA, 21 nt, Artificial Sequence
  Synthetic Oligonucleotide; LAG exon 7; Set C
gagaaaggacaccaaggauga

SEQ ID NO: 65869 - RNA, 22 nt, Artificial Sequence
  Synthetic Oligonucleotide; LAG exon 7; Set C
agagaaaggacaccaaggauga

SEQ ID NO: 65870 - RNA, 18 nt, Artificial Sequence
  Synthetic Oligonucleotide; LAG exon 7; Set C
cagagaaaggacaccaag

SEQ ID NO: 65871 - RNA, 25 nt, Artificial Sequence
  Synthetic Oligonucleotide; LAG exon 7; Set C
aaaggagcagagaaaggacaccaag

SEQ ID NO: 65872 - RNA, 26 nt, Artificial Sequence
  Synthetic Oligonucleotide; LAG exon 7; Set C
aaaaggagcagagaaaggacaccaag

SEQ ID NO: 65873 - RNA, 20 nt, Artificial Sequence
  Synthetic Oligonucleotide; LAG exon 7; Set C
aaaggagcagagaaaggaca

SEQ ID NO: 65874 - RNA, 21 nt, Artificial Sequence
  Synthetic Oligonucleotide; LAG exon 7; Set C
aaaaggagcagagaaaggaca

SEQ ID NO: 65875 - RNA, 19 nt, Artificial Sequence
  Synthetic Oligonucleotide; LAG exon 7; Set C
aaaggagcagagaaaggac

SEQ ID NO: 65876 - RNA, 20 nt, Artificial Sequence
  Synthetic Oligonucleotide; LAG exon 7; Set C
aaaaggagcagagaaaggac

SEQ ID NO: 65877 - RNA, 18 nt, Artificial Sequence
  Synthetic Oligonucleotide; LAG exon 7; Set C
aaaggagcagagaaagga

SEQ ID NO: 65878 - RNA, 19 nt, Artificial Sequence
  Synthetic Oligonucleotide; LAG exon 7; Set C
aaaaggagcagagaaagga

SEQ ID NO: 65879 - RNA, 17 nt, Artificial Sequence
  Synthetic Oligonucleotide; LAG exon 7; Set C
aaaggagcagagaaagg

SEQ ID NO: 65880 - RNA, 18 nt, Artificial Sequence
  Synthetic Oligonucleotide; LAG exon 7; Set C
aaaaggagcagagaaagg

SEQ ID NO: 65881 - RNA, 16 nt, Artificial Sequence
  Synthetic Oligonucleotide; LAG exon 7; Set C
aaaggagcagagaaag

SEQ ID NO: 65882 - RNA, 15 nt, Artificial Sequence
  Synthetic Oligonucleotide; LAG exon 7; Set C
aaaggagcagagaaa

SEQ ID NO: 65883 - RNA, 17 nt, Artificial Sequence
  Synthetic Oligonucleotide; LAG exon 7; Set C
aaaaggagcagagaaag

SEQ ID NO: 65884 - RNA, 16 nt, Artificial Sequence
  Synthetic Oligonucleotide; LAG exon 7; Set C
aaaaggagcagagaaa

SEQ ID NO: 65885 - RNA, 15 nt, Artificial Sequence
  Synthetic Oligonucleotide; LAG exon 7; Set C
aaaaggagcagagaa

SEQ ID NO: 65886 - RNA, 19 nt, Artificial Sequence
  Synthetic Oligonucleotide; LAG exon 7; Set C
cagucaccaaaaggagcag

SEQ ID NO: 65887 - RNA, 27 nt, Artificial Sequence
  Synthetic Oligonucleotide; LAG exon 7; Set A
aaaggcuccagucaccaaaaggagcag

SEQ ID NO: 65888 - RNA, 20 nt, Artificial Sequence
  Synthetic Oligonucleotide; LAG exon 7; Set C
aaaggcuccagucaccaaaa

SEQ ID NO: 65889 - RNA, 19 nt, Artificial Sequence
  Synthetic Oligonucleotide; LAG exon 7; Set C
aaaggcuccagucaccaaa

SEQ ID NO: 65890 - RNA, 16 nt, Artificial Sequence
  Synthetic Oligonucleotide; LAG exon 7; Set C
aaaggugaaagccaaa

SEQ ID NO: 65891 - RNA, 35 nt, Artificial Sequence
  Synthetic Oligonucleotide; LAG exon 7; Set C
guugccaugucccuggcucaccugucuucuccaaa

SEQ ID NO: 65892 - RNA, 36 nt, Artificial Sequence
  Synthetic Oligonucleotide; LAG exon 7; Set C
gguugccaugucccuggcucaccugucuucuccaaa

SEQ ID NO: 65893 - RNA, 37 nt, Artificial Sequence
  Synthetic Oligonucleotide; LAG exon 7; Set C
ggguugccaugucccuggcucaccugucuucuccaaa

SEQ ID NO: 65894 - RNA, 38 nt, Artificial Sequence
  Synthetic Oligonucleotide; LAG exon 7; Set C
gggguugccaugucccuggcucaccugucuucuccaaa

SEQ ID NO: 65895 - RNA, 20 nt, Artificial Sequence
  Synthetic Oligonucleotide; LAG exon 7; Set B
guugccaugucccuggcuca

SEQ ID NO: 65896 - RNA, 21 nt, Artificial Sequence
  Synthetic Oligonucleotide; LAG exon 7; Set C
gguugccaugucccuggcuca

SEQ ID NO: 65897 - RNA, 22 nt, Artificial Sequence
  Synthetic Oligonucleotide; LAG exon 7; Set C
ggguugccaugucccuggcuca

SEQ ID NO: 65898 - RNA, 19 nt, Artificial Sequence
  Synthetic Oligonucleotide; LAG exon 7; Set C
gggggcgggguugccaugu

SEQ ID NO: 65899 - RNA, 29 nt, Artificial Sequence
  Synthetic Oligonucleotide; LAG exon 7; Set C
ggagcugcuggggggcgggguugccaugu

SEQ ID NO: 65900 - RNA, 30 nt, Artificial Sequence
  Synthetic Oligonucleotide; LAG exon 7; Set C
gggagcugcuggggggcgggguugccaugu

SEQ ID NO: 65901 - RNA, 34 nt, Artificial Sequence
  Synthetic Oligonucleotide; LAG exon 7; Set C
agagcgggagcugcuggggggcgggguugccaug

SEQ ID NO: 65902 - RNA, 35 nt, Artificial Sequence
  Synthetic Oligonucleotide; LAG exon 7; Set C
aagagcgggagcugcuggggggcgggguugccaug

SEQ ID NO: 65903 - RNA, 37 nt, Artificial Sequence
  Synthetic Oligonucleotide; LAG exon 7; Set C
ggaagagcgggagcugcuggggggcgggguugccaug

SEQ ID NO: 65904 - RNA, 38 nt, Artificial Sequence
  Synthetic Oligonucleotide; LAG exon 7; Set C
uggaagagcgggagcugcuggggggcgggguugccaug

SEQ ID NO: 65905 - RNA, 28 nt, Artificial Sequence
  Synthetic Oligonucleotide; LAG exon 7; Set C
agagcgggagcugcuggggggcgggguu

SEQ ID NO: 65906 - RNA, 27 nt, Artificial Sequence
  Synthetic Oligonucleotide; LAG exon 7; Set C
agagcgggagcugcuggggggcggggu

SEQ ID NO: 65907 - RNA, 29 nt, Artificial Sequence
  Synthetic Oligonucleotide; LAG exon 7; Set C
aagagcgggagcugcuggggggcgggguu

SEQ ID NO: 65908 - RNA, 26 nt, Artificial Sequence
  Synthetic Oligonucleotide; LAG exon 7; Set C
agagcgggagcugcuggggggcgggg

SEQ ID NO: 65909 - RNA, 28 nt, Artificial Sequence
  Synthetic Oligonucleotide; LAG exon 7; Set C
aagagcgggagcugcuggggggcggggu

SEQ ID NO: 65910 - RNA, 30 nt, Artificial Sequence
  Synthetic Oligonucleotide; LAG exon 7; Set C
gaagagcgggagcugcuggggggcgggguu

SEQ ID NO: 65911 - RNA, 25 nt, Artificial Sequence
  Synthetic Oligonucleotide; LAG exon 7; Set C
agagcgggagcugcuggggggcggg

SEQ ID NO: 65912 - RNA, 27 nt, Artificial Sequence
  Synthetic Oligonucleotide; LAG exon 7; Set C
aagagcgggagcugcuggggggcgggg

SEQ ID NO: 65913 - RNA, 31 nt, Artificial Sequence
  Synthetic Oligonucleotide; LAG exon 7; Set C
ggaagagcgggagcugcuggggggcgggguu

SEQ ID NO: 65914 - RNA, 29 nt, Artificial Sequence
  Synthetic Oligonucleotide; LAG exon 7; Set C
gaagagcgggagcugcuggggggcggggu

SEQ ID NO: 65915 - RNA, 26 nt, Artificial Sequence
  Synthetic Oligonucleotide; LAG exon 7; Set C
aagagcgggagcugcuggggggcggg

SEQ ID NO: 65916 - RNA, 32 nt, Artificial Sequence
  Synthetic Oligonucleotide; LAG exon 7; Set C
uggaagagcgggagcugcuggggggcgggguu

SEQ ID NO: 65917 - RNA, 30 nt, Artificial Sequence
  Synthetic Oligonucleotide; LAG exon 7; Set C
ggaagagcgggagcugcuggggggcggggu

SEQ ID NO: 65918 - RNA, 28 nt, Artificial Sequence
  Synthetic Oligonucleotide; LAG exon 7; Set C
gaagagcgggagcugcuggggggcgggg

SEQ ID NO: 65919 - RNA, 27 nt, Artificial Sequence
  Synthetic Oligonucleotide; LAG exon 7; Set C
gaagagcgggagcugcuggggggcggg

SEQ ID NO: 65920 - RNA, 31 nt, Artificial Sequence
  Synthetic Oligonucleotide; LAG exon 7; Set C
uggaagagcgggagcugcuggggggcggggu

SEQ ID NO: 65921 - RNA, 29 nt, Artificial Sequence
  Synthetic Oligonucleotide; LAG exon 7; Set C
ggaagagcgggagcugcuggggggcgggg

SEQ ID NO: 65922 - RNA, 28 nt, Artificial Sequence
  Synthetic Oligonucleotide; LAG exon 7; Set C
ggaagagcgggagcugcuggggggcggg

SEQ ID NO: 65923 - RNA, 30 nt, Artificial Sequence
  Synthetic Oligonucleotide; LAG exon 7; Set C
uggaagagcgggagcugcuggggggcgggg

SEQ ID NO: 65924 - RNA, 29 nt, Artificial Sequence
  Synthetic Oligonucleotide; LAG exon 7; Set C
uggaagagcgggagcugcuggggggcggg

SEQ ID NO: 65925 - RNA, 19 nt, Artificial Sequence
  Synthetic Oligonucleotide; LAG exon 7; Set B
agagcgggagcugcugggg

SEQ ID NO: 65926 - RNA, 20 nt, Artificial Sequence
  Synthetic Oligonucleotide; LAG exon 7; Set B
aagagcgggagcugcugggg

SEQ ID NO: 65927 - RNA, 21 nt, Artificial Sequence
  Synthetic Oligonucleotide; LAG exon 7; Set C
gaagagcgggagcugcugggg

SEQ ID NO: 65928 - RNA, 22 nt, Artificial Sequence
  Synthetic Oligonucleotide; LAG exon 7; Set C
ggaagagcgggagcugcugggg

SEQ ID NO: 65929 - RNA, 23 nt, Artificial Sequence
  Synthetic Oligonucleotide; LAG exon 7; Set C
uggaagagcgggagcugcugggg

SEQ ID NO: 65930 - RNA, 18 nt, Artificial Sequence
  Synthetic Oligonucleotide; TIGIT exon 3; Set C
ggacaaaacagagaugag

SEQ ID NO: 65931 - RNA, 15 nt, Artificial Sequence
  Synthetic Oligonucleotide; TIGIT exon 3; Set C
gacaaaacagagaug

SEQ ID NO: 65932 - RNA, 17 nt, Artificial Sequence
  Synthetic Oligonucleotide; TIGIT exon 3; Set C
ggacaaaacagagauga

SEQ ID NO: 65933 - RNA, 19 nt, Artificial Sequence
  Synthetic Oligonucleotide; TIGIT exon 3; Set C
aggacaaaacagagaugag

SEQ ID NO: 65934 - RNA, 16 nt, Artificial Sequence
  Synthetic Oligonucleotide; TIGIT exon 3; Set C
ggacaaaacagagaug

SEQ ID NO: 65935 - RNA, 18 nt, Artificial Sequence
  Synthetic Oligonucleotide; TIGIT exon 3; Set C
aggacaaaacagagauga

SEQ ID NO: 65936 - RNA, 20 nt, Artificial Sequence
  Synthetic Oligonucleotide; TIGIT exon 3; Set C
gaggacaaaacagagaugag

SEQ ID NO: 65937 - RNA, 17 nt, Artificial Sequence
  Synthetic Oligonucleotide; TIGIT exon 3; Set C
aggacaaaacagagaug

SEQ ID NO: 65938 - RNA, 15 nt, Artificial Sequence
  Synthetic Oligonucleotide; TIGIT exon 3; Set C
ggacaaaacagagau

SEQ ID NO: 65939 - RNA, 19 nt, Artificial Sequence
  Synthetic Oligonucleotide; TIGIT exon 3; Set C
gaggacaaaacagagauga

SEQ ID NO: 65940 - RNA, 21 nt, Artificial Sequence
  Synthetic Oligonucleotide; TIGIT exon 3; Set C
ggaggacaaaacagagaugag

SEQ ID NO: 65941 - RNA, 18 nt, Artificial Sequence
  Synthetic Oligonucleotide; TIGIT exon 3; Set C
gaggacaaaacagagaug

SEQ ID NO: 65942 - RNA, 16 nt, Artificial Sequence
  Synthetic Oligonucleotide; TIGIT exon 3; Set C
aggacaaaacagagau

SEQ ID NO: 65943 - RNA, 20 nt, Artificial Sequence
  Synthetic Oligonucleotide; TIGIT exon 3; Set C
ggaggacaaaacagagauga

SEQ ID NO: 65944 - RNA, 22 nt, Artificial Sequence
  Synthetic Oligonucleotide; TIGIT exon 3; Set C
gggaggacaaaacagagaugag

SEQ ID NO: 65945 - RNA, 19 nt, Artificial Sequence
  Synthetic Oligonucleotide; TIGIT exon 3; Set C
ggaggacaaaacagagaug

SEQ ID NO: 65946 - RNA, 17 nt, Artificial Sequence
  Synthetic Oligonucleotide; TIGIT exon 3; Set C
gaggacaaaacagagau

SEQ ID NO: 65947 - RNA, 15 nt, Artificial Sequence
  Synthetic Oligonucleotide; TIGIT exon 3; Set C
aggacaaaacagaga

SEQ ID NO: 65948 - RNA, 21 nt, Artificial Sequence
  Synthetic Oligonucleotide; TIGIT exon 3; Set C
gggaggacaaaacagagauga

SEQ ID NO: 65949 - RNA, 23 nt, Artificial Sequence
  Synthetic Oligonucleotide; TIGIT exon 3; Set C
agggaggacaaaacagagaugag

SEQ ID NO: 65950 - RNA, 20 nt, Artificial Sequence
  Synthetic Oligonucleotide; TIGIT exon 3; Set C
gggaggacaaaacagagaug

SEQ ID NO: 65951 - RNA, 16 nt, Artificial Sequence
  Synthetic Oligonucleotide; TIGIT exon 3; Set C
gaggacaaaacagaga

SEQ ID NO: 65952 - RNA, 18 nt, Artificial Sequence
  Synthetic Oligonucleotide; TIGIT exon 3; Set C
ggaggacaaaacagagau

SEQ ID NO: 65953 - RNA, 22 nt, Artificial Sequence
  Synthetic Oligonucleotide; TIGIT exon 3; Set C
agggaggacaaaacagagauga

SEQ ID NO: 65954 - RNA, 24 nt, Artificial Sequence
  Synthetic Oligonucleotide; TIGIT exon 3; Set C
gagggaggacaaaacagagaugag

SEQ ID NO: 65955 - RNA, 21 nt, Artificial Sequence
  Synthetic Oligonucleotide; TIGIT exon 3; Set C
agggaggacaaaacagagaug

SEQ ID NO: 65956 - RNA, 19 nt, Artificial Sequence
  Synthetic Oligonucleotide; TIGIT exon 3; Set C
gggaggacaaaacagagau

SEQ ID NO: 65957 - RNA, 15 nt, Artificial Sequence
  Synthetic Oligonucleotide; TIGIT exon 3; Set C
gaggacaaaacagag

SEQ ID NO: 65958 - RNA, 17 nt, Artificial Sequence
  Synthetic Oligonucleotide; TIGIT exon 3; Set C
ggaggacaaaacagaga

SEQ ID NO: 65959 - RNA, 23 nt, Artificial Sequence
  Synthetic Oligonucleotide; TIGIT exon 3; Set C
gagggaggacaaaacagagauga

SEQ ID NO: 65960 - RNA, 25 nt, Artificial Sequence
  Synthetic Oligonucleotide; TIGIT exon 3; Set C
agagggaggacaaaacagagaugag

SEQ ID NO: 65961 - RNA, 22 nt, Artificial Sequence
  Synthetic Oligonucleotide; TIGIT exon 3; Set C
gagggaggacaaaacagagaug

SEQ ID NO: 65962 - RNA, 20 nt, Artificial Sequence
  Synthetic Oligonucleotide; TIGIT exon 3; Set C
agggaggacaaaacagagau

SEQ ID NO: 65963 - RNA, 18 nt, Artificial Sequence
  Synthetic Oligonucleotide; TIGIT exon 3; Set C
gggaggacaaaacagaga

SEQ ID NO: 65964 - RNA, 16 nt, Artificial Sequence
  Synthetic Oligonucleotide; TIGIT exon 3; Set C
ggaggacaaaacagag

SEQ ID NO: 65965 - RNA, 24 nt, Artificial Sequence
  Synthetic Oligonucleotide; TIGIT exon 3; Set C
agagggaggacaaaacagagauga

SEQ ID NO: 65966 - RNA, 26 nt, Artificial Sequence
  Synthetic Oligonucleotide; TIGIT exon 3; Set C
uagagggaggacaaaacagagaugag

SEQ ID NO: 65967 - RNA, 15 nt, Artificial Sequence
  Synthetic Oligonucleotide; TIGIT exon 3; Set C
ggaggacaaaacaga

SEQ ID NO: 65968 - RNA, 23 nt, Artificial Sequence
  Synthetic Oligonucleotide; TIGIT exon 3; Set C
agagggaggacaaaacagagaug

SEQ ID NO: 65969 - RNA, 21 nt, Artificial Sequence
  Synthetic Oligonucleotide; TIGIT exon 3; Set C
gagggaggacaaaacagagau

SEQ ID NO: 65970 - RNA, 19 nt, Artificial Sequence
  Synthetic Oligonucleotide; TIGIT exon 3; Set C
agggaggacaaaacagaga

SEQ ID NO: 65971 - RNA, 17 nt, Artificial Sequence
  Synthetic Oligonucleotide; TIGIT exon 3; Set C
gggaggacaaaacagag

SEQ ID NO: 65972 - RNA, 25 nt, Artificial Sequence
  Synthetic Oligonucleotide; TIGIT exon 3; Set A
uagagggaggacaaaacagagauga

SEQ ID NO: 65973 - RNA, 16 nt, Artificial Sequence
  Synthetic Oligonucleotide; TIGIT exon 3; Set C
gggaggacaaaacaga

SEQ ID NO: 65974 - RNA, 24 nt, Artificial Sequence
  Synthetic Oligonucleotide; TIGIT exon 3; Set C
uagagggaggacaaaacagagaug

SEQ ID NO: 65975 - RNA, 20 nt, Artificial Sequence
  Synthetic Oligonucleotide; TIGIT exon 3; Set C
gagggaggacaaaacagaga

SEQ ID NO: 65976 - RNA, 22 nt, Artificial Sequence
  Synthetic Oligonucleotide; TIGIT exon 3; Set C
agagggaggacaaaacagagau

SEQ ID NO: 65977 - RNA, 18 nt, Artificial Sequence
  Synthetic Oligonucleotide; TIGIT exon 3; Set C
agggaggacaaaacagag

SEQ ID NO: 65978 - RNA, 17 nt, Artificial Sequence
  Synthetic Oligonucleotide; TIGIT exon 3; Set C
agggaggacaaaacaga

SEQ ID NO: 65979 - RNA, 19 nt, Artificial Sequence
  Synthetic Oligonucleotide; TIGIT exon 3; Set C
gagggaggacaaaacagag

SEQ ID NO: 65980 - RNA, 21 nt, Artificial Sequence
  Synthetic Oligonucleotide; TIGIT exon 3; Set C
agagggaggacaaaacagaga

SEQ ID NO: 65981 - RNA, 23 nt, Artificial Sequence
  Synthetic Oligonucleotide; TIGIT exon 3; Set C
uagagggaggacaaaacagagau

SEQ ID NO: 65982 - RNA, 15 nt, Artificial Sequence
  Synthetic Oligonucleotide; TIGIT exon 3; Set C
gggaggacaaaacag

SEQ ID NO: 65983 - RNA, 18 nt, Artificial Sequence
  Synthetic Oligonucleotide; TIGIT exon 3; Set C
gagggaggacaaaacaga

SEQ ID NO: 65984 - RNA, 20 nt, Artificial Sequence
  Synthetic Oligonucleotide; TIGIT exon 3; Set C
agagggaggacaaaacagag

SEQ ID NO: 65985 - RNA, 22 nt, Artificial Sequence
  Synthetic Oligonucleotide; TIGIT exon 3; Set C
uagagggaggacaaaacagaga

SEQ ID NO: 65986 - RNA, 16 nt, Artificial Sequence
  Synthetic Oligonucleotide; TIGIT exon 3; Set C
agggaggacaaaacag

SEQ ID NO: 65987 - RNA, 19 nt, Artificial Sequence
  Synthetic Oligonucleotide; TIGIT exon 3; Set C
agagggaggacaaaacaga

SEQ ID NO: 65988 - RNA, 21 nt, Artificial Sequence
  Synthetic Oligonucleotide; TIGIT exon 3; Set C
uagagggaggacaaaacagag

SEQ ID NO: 65989 - RNA, 17 nt, Artificial Sequence
  Synthetic Oligonucleotide; TIGIT exon 3; Set C
gagggaggacaaaacag

SEQ ID NO: 65990 - RNA, 15 nt, Artificial Sequence
  Synthetic Oligonucleotide; TIGIT exon 3; Set C
agggaggacaaaaca

SEQ ID NO: 65991 - RNA, 20 nt, Artificial Sequence
  Synthetic Oligonucleotide; TIGIT exon 3; Set C
uagagggaggacaaaacaga

SEQ ID NO: 65992 - RNA, 18 nt, Artificial Sequence
  Synthetic Oligonucleotide; TIGIT exon 3; Set C
agagggaggacaaaacag

SEQ ID NO: 65993 - RNA, 16 nt, Artificial Sequence
  Synthetic Oligonucleotide; TIGIT exon 3; Set C
gagggaggacaaaaca

SEQ ID NO: 65994 - RNA, 19 nt, Artificial Sequence
  Synthetic Oligonucleotide; TIGIT exon 3; Set C
uagagggaggacaaaacag

SEQ ID NO: 65995 - RNA, 15 nt, Artificial Sequence
  Synthetic Oligonucleotide; TIGIT exon 3; Set C
gagggaggacaaaac

SEQ ID NO: 65996 - RNA, 17 nt, Artificial Sequence
  Synthetic Oligonucleotide; TIGIT exon 3; Set C
agagggaggacaaaaca

SEQ ID NO: 65997 - RNA, 16 nt, Artificial Sequence
  Synthetic Oligonucleotide; TIGIT exon 3; Set C
agagggaggacaaaac

SEQ ID NO: 65998 - RNA, 18 nt, Artificial Sequence
  Synthetic Oligonucleotide; TIGIT exon 3; Set C
uagagggaggacaaaaca

SEQ ID NO: 65999 - RNA, 15 nt, Artificial Sequence
  Synthetic Oligonucleotide; TIGIT exon 3; Set C
agagggaggacaaaa

SEQ ID NO: 66000 - RNA, 17 nt, Artificial Sequence
  Synthetic Oligonucleotide; TIGIT exon 3; Set C
uagagggaggacaaaac

SEQ ID NO: 66001 - RNA, 16 nt, Artificial Sequence
  Synthetic Oligonucleotide; TIGIT exon 3; Set C
uagagggaggacaaaa

SEQ ID NO: 66002 - RNA, 15 nt, Artificial Sequence
  Synthetic Oligonucleotide; TIGIT exon 3; Set C
uagagggaggacaaa

SEQ ID NO: 66003 - RNA, 15 nt, Artificial Sequence
  Synthetic Oligonucleotide; TIGIT exon 3; Set C
caauggaaucuggaa

SEQ ID NO: 66004 - RNA, 16 nt, Artificial Sequence
  Synthetic Oligonucleotide; TIGIT exon 3; Set C
gcaauggaaucuggaa

SEQ ID NO: 66005 - RNA, 17 nt, Artificial Sequence
  Synthetic Oligonucleotide; TIGIT exon 3; Set C
agcaauggaaucuggaa

SEQ ID NO: 66006 - RNA, 15 nt, Artificial Sequence
  Synthetic Oligonucleotide; TIGIT exon 3; Set C
gcaauggaaucugga

SEQ ID NO: 66007 - RNA, 16 nt, Artificial Sequence
  Synthetic Oligonucleotide; TIGIT exon 3; Set C
agcaauggaaucugga

SEQ ID NO: 66008 - RNA, 15 nt, Artificial Sequence
  Synthetic Oligonucleotide; TIGIT exon 3; Set C
agcaauggaaucugg

SEQ ID NO: 66009 - RNA, 15 nt, Artificial Sequence
  Synthetic Oligonucleotide; TIGIT exon 3; Set C
aagcaauggaaucug

SEQ ID NO: 66010 - RNA, 38 nt, Artificial Sequence
  Synthetic Oligonucleotide; TIGIT exon 3; Set C
ggacaaaacagagaugaguggcagaagccagaagugaa

SEQ ID NO: 66011 - RNA, 22 nt, Artificial Sequence
  Synthetic Oligonucleotide; TIGIT exon 3; Set C
aaaacagagaugaguggcagaa

SEQ ID NO: 66012 - RNA, 40 nt, Artificial Sequence
  Synthetic Oligonucleotide; TIGIT exon 3; Set C
agggaggacaaaacagagaugaguggcagaagccagaagu

SEQ ID NO: 66013 - RNA, 39 nt, Artificial Sequence
  Synthetic Oligonucleotide; TIGIT exon 3; Set C
agggaggacaaaacagagaugaguggcagaagccagaag

SEQ ID NO: 66014 - RNA, 21 nt, Artificial Sequence
  Synthetic Oligonucleotide; TIGIT exon 3; Set C
aaaacagagaugaguggcaga

SEQ ID NO: 66015 - RNA, 40 nt, Artificial Sequence
  Synthetic Oligonucleotide; TIGIT exon 3; Set C
gagggaggacaaaacagagaugaguggcagaagccagaag

SEQ ID NO: 66016 - RNA, 38 nt, Artificial Sequence
  Synthetic Oligonucleotide; TIGIT exon 3; Set C
agggaggacaaaacagagaugaguggcagaagccagaa

SEQ ID NO: 66017 - RNA, 39 nt, Artificial Sequence
  Synthetic Oligonucleotide; TIGIT exon 3; Set C
gagggaggacaaaacagagaugaguggcagaagccagaa

SEQ ID NO: 66018 - RNA, 26 nt, Artificial Sequence
  Synthetic Oligonucleotide; TIGIT exon 3; Set A
ggacaaaacagagaugaguggcagaa

SEQ ID NO: 66019 - RNA, 40 nt, Artificial Sequence
  Synthetic Oligonucleotide; TIGIT exon 3; Set C
agagggaggacaaaacagagaugaguggcagaagccagaa

SEQ ID NO: 66020 - RNA, 27 nt, Artificial Sequence
  Synthetic Oligonucleotide; TIGIT exon 3; Set A
aggacaaaacagagaugaguggcagaa

SEQ ID NO: 66021 - RNA, 25 nt, Artificial Sequence
  Synthetic Oligonucleotide; TIGIT exon 3; Set A
ggacaaaacagagaugaguggcaga

SEQ ID NO: 66022 - RNA, 28 nt, Artificial Sequence
  Synthetic Oligonucleotide; TIGIT exon 3; Set A
gaggacaaaacagagaugaguggcagaa

SEQ ID NO: 66023 - RNA, 29 nt, Artificial Sequence
  Synthetic Oligonucleotide; TIGIT exon 3; Set A
ggaggacaaaacagagaugaguggcagaa

SEQ ID NO: 66024 - RNA, 27 nt, Artificial Sequence
  Synthetic Oligonucleotide; TIGIT exon 3; Set A
gaggacaaaacagagaugaguggcaga

SEQ ID NO: 66025 - RNA, 30 nt, Artificial Sequence
  Synthetic Oligonucleotide; TIGIT exon 3; Set A
gggaggacaaaacagagaugaguggcagaa

SEQ ID NO: 66026 - RNA, 28 nt, Artificial Sequence
  Synthetic Oligonucleotide; TIGIT exon 3; Set A
ggaggacaaaacagagaugaguggcaga

SEQ ID NO: 66027 - RNA, 31 nt, Artificial Sequence
  Synthetic Oligonucleotide; TIGIT exon 3; Set A
agggaggacaaaacagagaugaguggcagaa

SEQ ID NO: 66028 - RNA, 29 nt, Artificial Sequence
  Synthetic Oligonucleotide; TIGIT exon 3; Set C
gggaggacaaaacagagaugaguggcaga

SEQ ID NO: 66029 - RNA, 15 nt, Artificial Sequence
  Synthetic Oligonucleotide; TIGIT exon 3; Set C
caaaacagagaugag

SEQ ID NO: 66030 - RNA, 32 nt, Artificial Sequence
  Synthetic Oligonucleotide; TIGIT exon 3; Set C
gagggaggacaaaacagagaugaguggcagaa

SEQ ID NO: 66031 - RNA, 30 nt, Artificial Sequence
  Synthetic Oligonucleotide; TIGIT exon 3; Set C
agggaggacaaaacagagaugaguggcaga

SEQ ID NO: 66032 - RNA, 16 nt, Artificial Sequence
  Synthetic Oligonucleotide; TIGIT exon 3; Set C
acaaaacagagaugag

SEQ ID NO: 66033 - RNA, 33 nt, Artificial Sequence
  Synthetic Oligonucleotide; TIGIT exon 3; Set C
agagggaggacaaaacagagaugaguggcagaa

SEQ ID NO: 66034 - RNA, 15 nt, Artificial Sequence
  Synthetic Oligonucleotide; TIGIT exon 3; Set C
acaaaacagagauga

SEQ ID NO: 66035 - RNA, 31 nt, Artificial Sequence
  Synthetic Oligonucleotide; TIGIT exon 3; Set C
gagggaggacaaaacagagaugaguggcaga

SEQ ID NO: 66036 - RNA, 17 nt, Artificial Sequence
  Synthetic Oligonucleotide; TIGIT exon 3; Set C
gacaaaacagagaugag

SEQ ID NO: 66037 - RNA, 34 nt, Artificial Sequence
  Synthetic Oligonucleotide; TIGIT exon 3; Set C
uagagggaggacaaaacagagaugaguggcagaa

SEQ ID NO: 66038 - RNA, 16 nt, Artificial Sequence
  Synthetic Oligonucleotide; TIGIT exon 3; Set C
gacaaaacagagauga

SEQ ID NO: 66039 - RNA, 32 nt, Artificial Sequence
  Synthetic Oligonucleotide; TIGIT exon 3; Set C
agagggaggacaaaacagagaugaguggcaga

SEQ ID NO: 66040 - RNA, 33 nt, Artificial Sequence
  Synthetic Oligonucleotide; TIGIT exon 3; Set C
uagagggaggacaaaacagagaugaguggcaga

SEQ ID NO: 66041 - RNA, 39 nt, Artificial Sequence
  Synthetic Oligonucleotide; TIGIT exon 3; Set C
uggaaucuggaaccuggcaccgugcucagccacuagagg

SEQ ID NO: 66042 - RNA, 38 nt, Artificial Sequence
  Synthetic Oligonucleotide; TIGIT exon 3; Set C
uggaaucuggaaccuggcaccgugcucagccacuagag

SEQ ID NO: 66043 - RNA, 40 nt, Artificial Sequence
  Synthetic Oligonucleotide; TIGIT exon 3; Set C
auggaaucuggaaccuggcaccgugcucagccacuagagg

SEQ ID NO: 66044 - RNA, 39 nt, Artificial Sequence
  Synthetic Oligonucleotide; TIGIT exon 3; Set C
auggaaucuggaaccuggcaccgugcucagccacuagag

SEQ ID NO: 66045 - RNA, 40 nt, Artificial Sequence
  Synthetic Oligonucleotide; TIGIT exon 3; Set C
aauggaaucuggaaccuggcaccgugcucagccacuagag

SEQ ID NO: 66046 - RNA, 38 nt, Artificial Sequence
  Synthetic Oligonucleotide; TIGIT exon 3; Set C
auggaaucuggaaccuggcaccgugcucagccacuaga

SEQ ID NO: 66047 - RNA, 39 nt, Artificial Sequence
  Synthetic Oligonucleotide; TIGIT exon 3; Set C
aauggaaucuggaaccuggcaccgugcucagccacuaga

SEQ ID NO: 66048 - RNA, 40 nt, Artificial Sequence
  Synthetic Oligonucleotide; TIGIT exon 3; Set C
caauggaaucuggaaccuggcaccgugcucagccacuaga

SEQ ID NO: 66049 - RNA, 18 nt, Artificial Sequence
  Synthetic Oligonucleotide; TIGIT exon 3; Set C
aagcaauggaaucuggaa

SEQ ID NO: 66050 - RNA, 17 nt, Artificial Sequence
  Synthetic Oligonucleotide; TIGIT exon 3; Set C
aagcaauggaaucugga

SEQ ID NO: 66051 - RNA, 16 nt, Artificial Sequence
  Synthetic Oligonucleotide; TIGIT exon 3; Set C
aagcaauggaaucugg

SEQ ID NO: 66052 - RNA, 17 nt, Artificial Sequence
  Synthetic Oligonucleotide; TIGIT exon 3; Set C
cuagucaacgcgaccac

SEQ ID NO: 66053 - RNA, 18 nt, Artificial Sequence
  Synthetic Oligonucleotide; TIGIT exon 3; Set C
ucuagucaacgcgaccac

SEQ ID NO: 66054 - RNA, 16 nt, Artificial Sequence
  Synthetic Oligonucleotide; TIGIT exon 3; Set C
cuagucaacgcgacca

SEQ ID NO: 66055 - RNA, 19 nt, Artificial Sequence
  Synthetic Oligonucleotide; TIGIT exon 3; Set C
uucuagucaacgcgaccac

SEQ ID NO: 66056 - RNA, 15 nt, Artificial Sequence
  Synthetic Oligonucleotide; TIGIT exon 3; Set C
cuagucaacgcgacc

SEQ ID NO: 66057 - RNA, 17 nt, Artificial Sequence
  Synthetic Oligonucleotide; TIGIT exon 3; Set C
ucuagucaacgcgacca

SEQ ID NO: 66058 - RNA, 20 nt, Artificial Sequence
  Synthetic Oligonucleotide; TIGIT exon 3; Set C
uuucuagucaacgcgaccac

SEQ ID NO: 66059 - RNA, 16 nt, Artificial Sequence
  Synthetic Oligonucleotide; TIGIT exon 3; Set C
ucuagucaacgcgacc

SEQ ID NO: 66060 - RNA, 18 nt, Artificial Sequence
  Synthetic Oligonucleotide; TIGIT exon 3; Set C
uucuagucaacgcgacca

SEQ ID NO: 66061 - RNA, 17 nt, Artificial Sequence
  Synthetic Oligonucleotide; TIGIT exon 3; Set C
uucuagucaacgcgacc

SEQ ID NO: 66062 - RNA, 19 nt, Artificial Sequence
  Synthetic Oligonucleotide; TIGIT exon 3; Set C
uuucuagucaacgcgacca

SEQ ID NO: 66063 - RNA, 18 nt, Artificial Sequence
  Synthetic Oligonucleotide; TIGIT exon 3; Set C
uuucuagucaacgcgacc

SEQ ID NO: 66064 - RNA, 15 nt, Artificial Sequence
  Synthetic Oligonucleotide; TIGIT exon 3; Set C
gaagccagaagugaa

SEQ ID NO: 66065 - RNA, 16 nt, Artificial Sequence
  Synthetic Oligonucleotide; TIGIT exon 3; Set C
agaagccagaagugaa

SEQ ID NO: 66066 - RNA, 15 nt, Artificial Sequence
  Synthetic Oligonucleotide; TIGIT exon 3; Set C
agaagccagaaguga

SEQ ID NO: 66067 - RNA, 23 nt, Artificial Sequence
  Synthetic Oligonucleotide; TIGIT exon 3; Set A
gaguggcagaagccagaagugaa

SEQ ID NO: 66068 - RNA, 24 nt, Artificial Sequence
  Synthetic Oligonucleotide; TIGIT exon 3; Set A
ugaguggcagaagccagaagugaa

SEQ ID NO: 66069 - RNA, 25 nt, Artificial Sequence
  Synthetic Oligonucleotide; TIGIT exon 3; Set A
augaguggcagaagccagaagugaa

SEQ ID NO: 66070 - RNA, 26 nt, Artificial Sequence
  Synthetic Oligonucleotide; TIGIT exon 3; Set A
gaugaguggcagaagccagaagugaa

SEQ ID NO: 66071 - RNA, 24 nt, Artificial Sequence
  Synthetic Oligonucleotide; TIGIT exon 3; Set A
augaguggcagaagccagaaguga

SEQ ID NO: 66072 - RNA, 27 nt, Artificial Sequence
  Synthetic Oligonucleotide; TIGIT exon 3; Set A
agaugaguggcagaagccagaagugaa

SEQ ID NO: 66073 - RNA, 23 nt, Artificial Sequence
  Synthetic Oligonucleotide; TIGIT exon 3; Set A
augaguggcagaagccagaagug

SEQ ID NO: 66074 - RNA, 25 nt, Artificial Sequence
  Synthetic Oligonucleotide; TIGIT exon 3; Set A
gaugaguggcagaagccagaaguga

SEQ ID NO: 66075 - RNA, 28 nt, Artificial Sequence
  Synthetic Oligonucleotide; TIGIT exon 3; Set A
gagaugaguggcagaagccagaagugaa

SEQ ID NO: 66076 - RNA, 22 nt, Artificial Sequence
  Synthetic Oligonucleotide; TIGIT exon 3; Set A
augaguggcagaagccagaagu

SEQ ID NO: 66077 - RNA, 24 nt, Artificial Sequence
  Synthetic Oligonucleotide; TIGIT exon 3; Set A
gaugaguggcagaagccagaagug

SEQ ID NO: 66078 - RNA, 26 nt, Artificial Sequence
  Synthetic Oligonucleotide; TIGIT exon 3; Set A
agaugaguggcagaagccagaaguga

SEQ ID NO: 66079 - RNA, 29 nt, Artificial Sequence
  Synthetic Oligonucleotide; TIGIT exon 3; Set A
agagaugaguggcagaagccagaagugaa

SEQ ID NO: 66080 - RNA, 21 nt, Artificial Sequence
  Synthetic Oligonucleotide; TIGIT exon 3; Set C
augaguggcagaagccagaag

SEQ ID NO: 66081 - RNA, 23 nt, Artificial Sequence
  Synthetic Oligonucleotide; TIGIT exon 3; Set A
gaugaguggcagaagccagaagu

SEQ ID NO: 66082 - RNA, 25 nt, Artificial Sequence
  Synthetic Oligonucleotide; TIGIT exon 3; Set A
agaugaguggcagaagccagaagug

SEQ ID NO: 66083 - RNA, 27 nt, Artificial Sequence
  Synthetic Oligonucleotide; TIGIT exon 3; Set A
gagaugaguggcagaagccagaaguga

SEQ ID NO: 66084 - RNA, 30 nt, Artificial Sequence
  Synthetic Oligonucleotide; TIGIT exon 3; Set A
cagagaugaguggcagaagccagaagugaa

SEQ ID NO: 66085 - RNA, 22 nt, Artificial Sequence
  Synthetic Oligonucleotide; TIGIT exon 3; Set A
gaugaguggcagaagccagaag

SEQ ID NO: 66086 - RNA, 24 nt, Artificial Sequence
  Synthetic Oligonucleotide; TIGIT exon 3; Set A
agaugaguggcagaagccagaagu

SEQ ID NO: 66087 - RNA, 26 nt, Artificial Sequence
  Synthetic Oligonucleotide; TIGIT exon 3; Set A
gagaugaguggcagaagccagaagug

SEQ ID NO: 66088 - RNA, 28 nt, Artificial Sequence
  Synthetic Oligonucleotide; TIGIT exon 3; Set A
agagaugaguggcagaagccagaaguga

SEQ ID NO: 66089 - RNA, 31 nt, Artificial Sequence
  Synthetic Oligonucleotide; TIGIT exon 3; Set A
acagagaugaguggcagaagccagaagugaa

SEQ ID NO: 66090 - RNA, 23 nt, Artificial Sequence
  Synthetic Oligonucleotide; TIGIT exon 3; Set A
agaugaguggcagaagccagaag

SEQ ID NO: 66091 - RNA, 25 nt, Artificial Sequence
  Synthetic Oligonucleotide; TIGIT exon 3; Set A
gagaugaguggcagaagccagaagu

SEQ ID NO: 66092 - RNA, 27 nt, Artificial Sequence
  Synthetic Oligonucleotide; TIGIT exon 3; Set A
agagaugaguggcagaagccagaagug

SEQ ID NO: 66093 - RNA, 29 nt, Artificial Sequence
  Synthetic Oligonucleotide; TIGIT exon 3; Set A
cagagaugaguggcagaagccagaaguga

SEQ ID NO: 66094 - RNA, 32 nt, Artificial Sequence
  Synthetic Oligonucleotide; TIGIT exon 3; Set A
aacagagaugaguggcagaagccagaagugaa

SEQ ID NO: 66095 - RNA, 24 nt, Artificial Sequence
  Synthetic Oligonucleotide; TIGIT exon 3; Set A
gagaugaguggcagaagccagaag

SEQ ID NO: 66096 - RNA, 26 nt, Artificial Sequence
  Synthetic Oligonucleotide; TIGIT exon 3; Set A
agagaugaguggcagaagccagaagu

SEQ ID NO: 66097 - RNA, 22 nt, Artificial Sequence
  Synthetic Oligonucleotide; TIGIT exon 3; Set A
agaugaguggcagaagccagaa

SEQ ID NO: 66098 - RNA, 28 nt, Artificial Sequence
  Synthetic Oligonucleotide; TIGIT exon 3; Set A
cagagaugaguggcagaagccagaagug

SEQ ID NO: 66099 - RNA, 30 nt, Artificial Sequence
  Synthetic Oligonucleotide; TIGIT exon 3; Set C
acagagaugaguggcagaagccagaaguga

SEQ ID NO: 66100 - RNA, 33 nt, Artificial Sequence
  Synthetic Oligonucleotide; TIGIT exon 3; Set A
aaacagagaugaguggcagaagccagaagugaa

SEQ ID NO: 66101 - RNA, 25 nt, Artificial Sequence
  Synthetic Oligonucleotide; TIGIT exon 3; Set A
agagaugaguggcagaagccagaag

SEQ ID NO: 66102 - RNA, 27 nt, Artificial Sequence
  Synthetic Oligonucleotide; TIGIT exon 3; Set A
cagagaugaguggcagaagccagaagu

SEQ ID NO: 66103 - RNA, 23 nt, Artificial Sequence
  Synthetic Oligonucleotide; TIGIT exon 3; Set A
gagaugaguggcagaagccagaa

SEQ ID NO: 66104 - RNA, 29 nt, Artificial Sequence
  Synthetic Oligonucleotide; TIGIT exon 3; Set A
acagagaugaguggcagaagccagaagug

SEQ ID NO: 66105 - RNA, 31 nt, Artificial Sequence
  Synthetic Oligonucleotide; TIGIT exon 3; Set A
aacagagaugaguggcagaagccagaaguga

SEQ ID NO: 66106 - RNA, 34 nt, Artificial Sequence
  Synthetic Oligonucleotide; TIGIT exon 3; Set A
aaaacagagaugaguggcagaagccagaagugaa

SEQ ID NO: 66107 - RNA, 26 nt, Artificial Sequence
  Synthetic Oligonucleotide; TIGIT exon 3; Set A
cagagaugaguggcagaagccagaag

SEQ ID NO: 66108 - RNA, 28 nt, Artificial Sequence
  Synthetic Oligonucleotide; TIGIT exon 3; Set A
acagagaugaguggcagaagccagaagu

SEQ ID NO: 66109 - RNA, 24 nt, Artificial Sequence
  Synthetic Oligonucleotide; TIGIT exon 3; Set A
agagaugaguggcagaagccagaa

SEQ ID NO: 66110 - RNA, 30 nt, Artificial Sequence
  Synthetic Oligonucleotide; TIGIT exon 3; Set A
aacagagaugaguggcagaagccagaagug

SEQ ID NO: 66111 - RNA, 32 nt, Artificial Sequence
  Synthetic Oligonucleotide; TIGIT exon 3; Set A
aaacagagaugaguggcagaagccagaaguga

SEQ ID NO: 66112 - RNA, 35 nt, Artificial Sequence
  Synthetic Oligonucleotide; TIGIT exon 3; Set A
caaaacagagaugaguggcagaagccagaagugaa

SEQ ID NO: 66113 - RNA, 27 nt, Artificial Sequence
  Synthetic Oligonucleotide; TIGIT exon 3; Set A
acagagaugaguggcagaagccagaag

SEQ ID NO: 66114 - RNA, 29 nt, Artificial Sequence
  Synthetic Oligonucleotide; TIGIT exon 3; Set A
aacagagaugaguggcagaagccagaagu

SEQ ID NO: 66115 - RNA, 25 nt, Artificial Sequence
  Synthetic Oligonucleotide; TIGIT exon 3; Set A
cagagaugaguggcagaagccagaa

SEQ ID NO: 66116 - RNA, 31 nt, Artificial Sequence
  Synthetic Oligonucleotide; TIGIT exon 3; Set A
aaacagagaugaguggcagaagccagaagug

SEQ ID NO: 66117 - RNA, 33 nt, Artificial Sequence
  Synthetic Oligonucleotide; TIGIT exon 3; Set A
aaaacagagaugaguggcagaagccagaaguga

SEQ ID NO: 66118 - RNA, 36 nt, Artificial Sequence
  Synthetic Oligonucleotide; TIGIT exon 3; Set A
acaaaacagagaugaguggcagaagccagaagugaa

SEQ ID NO: 66119 - RNA, 28 nt, Artificial Sequence
  Synthetic Oligonucleotide; TIGIT exon 3; Set A
aacagagaugaguggcagaagccagaag

SEQ ID NO: 66120 - RNA, 30 nt, Artificial Sequence
  Synthetic Oligonucleotide; TIGIT exon 3; Set A
aaacagagaugaguggcagaagccagaagu

SEQ ID NO: 66121 - RNA, 32 nt, Artificial Sequence
  Synthetic Oligonucleotide; TIGIT exon 3; Set A
aaaacagagaugaguggcagaagccagaagug

SEQ ID NO: 66122 - RNA, 34 nt, Artificial Sequence
  Synthetic Oligonucleotide; TIGIT exon 3; Set A
caaaacagagaugaguggcagaagccagaaguga

SEQ ID NO: 66123 - RNA, 37 nt, Artificial Sequence
  Synthetic Oligonucleotide; TIGIT exon 3; Set C
gacaaaacagagaugaguggcagaagccagaagugaa

SEQ ID NO: 66124 - RNA, 29 nt, Artificial Sequence
  Synthetic Oligonucleotide; TIGIT exon 3; Set A
aaacagagaugaguggcagaagccagaag

SEQ ID NO: 66125 - RNA, 31 nt, Artificial Sequence
  Synthetic Oligonucleotide; TIGIT exon 3; Set A
aaaacagagaugaguggcagaagccagaagu

SEQ ID NO: 66126 - RNA, 27 nt, Artificial Sequence
  Synthetic Oligonucleotide; TIGIT exon 3; Set A
aacagagaugaguggcagaagccagaa

SEQ ID NO: 66127 - RNA, 33 nt, Artificial Sequence
  Synthetic Oligonucleotide; TIGIT exon 3; Set A
caaaacagagaugaguggcagaagccagaagug

SEQ ID NO: 66128 - RNA, 35 nt, Artificial Sequence
  Synthetic Oligonucleotide; TIGIT exon 3; Set C
acaaaacagagaugaguggcagaagccagaaguga

SEQ ID NO: 66129 - RNA, 30 nt, Artificial Sequence
  Synthetic Oligonucleotide; TIGIT exon 3; Set A
aaaacagagaugaguggcagaagccagaag

SEQ ID NO: 66130 - RNA, 32 nt, Artificial Sequence
  Synthetic Oligonucleotide; TIGIT exon 3; Set A
caaaacagagaugaguggcagaagccagaagu

SEQ ID NO: 66131 - RNA, 28 nt, Artificial Sequence
  Synthetic Oligonucleotide; TIGIT exon 3; Set A
aaacagagaugaguggcagaagccagaa

SEQ ID NO: 66132 - RNA, 34 nt, Artificial Sequence
  Synthetic Oligonucleotide; TIGIT exon 3; Set A
acaaaacagagaugaguggcagaagccagaagug

SEQ ID NO: 66133 - RNA, 36 nt, Artificial Sequence
  Synthetic Oligonucleotide; TIGIT exon 3; Set C
gacaaaacagagaugaguggcagaagccagaaguga

SEQ ID NO: 66134 - RNA, 39 nt, Artificial Sequence
  Synthetic Oligonucleotide; TIGIT exon 3; Set C
aggacaaaacagagaugaguggcagaagccagaagugaa

SEQ ID NO: 66135 - RNA, 31 nt, Artificial Sequence
  Synthetic Oligonucleotide; TIGIT exon 3; Set A
caaaacagagaugaguggcagaagccagaag

SEQ ID NO: 66136 - RNA, 15 nt, Artificial Sequence
  Synthetic Oligonucleotide; TIGIT exon 3; Set C
agaugaguggcagaa

SEQ ID NO: 66137 - RNA, 33 nt, Artificial Sequence
  Synthetic Oligonucleotide; TIGIT exon 3; Set A
acaaaacagagaugaguggcagaagccagaagu

SEQ ID NO: 66138 - RNA, 29 nt, Artificial Sequence
  Synthetic Oligonucleotide; TIGIT exon 3; Set A
aaaacagagaugaguggcagaagccagaa

SEQ ID NO: 66139 - RNA, 35 nt, Artificial Sequence
  Synthetic Oligonucleotide; TIGIT exon 3; Set A
gacaaaacagagaugaguggcagaagccagaagug

SEQ ID NO: 66140 - RNA, 37 nt, Artificial Sequence
  Synthetic Oligonucleotide; TIGIT exon 3; Set C
ggacaaaacagagaugaguggcagaagccagaaguga

SEQ ID NO: 66141 - RNA, 40 nt, Artificial Sequence
  Synthetic Oligonucleotide; TIGIT exon 3; Set C
gaggacaaaacagagaugaguggcagaagccagaagugaa

SEQ ID NO: 66142 - RNA, 32 nt, Artificial Sequence
  Synthetic Oligonucleotide; TIGIT exon 3; Set A
acaaaacagagaugaguggcagaagccagaag

SEQ ID NO: 66143 - RNA, 16 nt, Artificial Sequence
  Synthetic Oligonucleotide; TIGIT exon 3; Set C
gagaugaguggcagaa

SEQ ID NO: 66144 - RNA, 34 nt, Artificial Sequence
  Synthetic Oligonucleotide; TIGIT exon 3; Set A
gacaaaacagagaugaguggcagaagccagaagu

SEQ ID NO: 66145 - RNA, 36 nt, Artificial Sequence
  Synthetic Oligonucleotide; TIGIT exon 3; Set C
ggacaaaacagagaugaguggcagaagccagaagug

SEQ ID NO: 66146 - RNA, 38 nt, Artificial Sequence
  Synthetic Oligonucleotide; TIGIT exon 3; Set C
aggacaaaacagagaugaguggcagaagccagaaguga

SEQ ID NO: 66147 - RNA, 33 nt, Artificial Sequence
  Synthetic Oligonucleotide; TIGIT exon 3; Set A
gacaaaacagagaugaguggcagaagccagaag

SEQ ID NO: 66148 - RNA, 17 nt, Artificial Sequence
  Synthetic Oligonucleotide; TIGIT exon 3; Set C
agagaugaguggcagaa

SEQ ID NO: 66149 - RNA, 35 nt, Artificial Sequence
  Synthetic Oligonucleotide; TIGIT exon 3; Set C
ggacaaaacagagaugaguggcagaagccagaagu

SEQ ID NO: 66150 - RNA, 15 nt, Artificial Sequence
  Synthetic Oligonucleotide; TIGIT exon 3; Set C
gagaugaguggcaga

SEQ ID NO: 66151 - RNA, 37 nt, Artificial Sequence
  Synthetic Oligonucleotide; TIGIT exon 3; Set C
aggacaaaacagagaugaguggcagaagccagaagug

SEQ ID NO: 66152 - RNA, 31 nt, Artificial Sequence
  Synthetic Oligonucleotide; TIGIT exon 3; Set A
acaaaacagagaugaguggcagaagccagaa

SEQ ID NO: 66153 - RNA, 39 nt, Artificial Sequence
  Synthetic Oligonucleotide; TIGIT exon 3; Set C
gaggacaaaacagagaugaguggcagaagccagaaguga

SEQ ID NO: 66154 - RNA, 34 nt, Artificial Sequence
  Synthetic Oligonucleotide; TIGIT exon 3; Set A
ggacaaaacagagaugaguggcagaagccagaag

SEQ ID NO: 66155 - RNA, 18 nt, Artificial Sequence
  Synthetic Oligonucleotide; TIGIT exon 3; Set C
cagagaugaguggcagaa

SEQ ID NO: 66156 - RNA, 36 nt, Artificial Sequence
  Synthetic Oligonucleotide; TIGIT exon 3; Set C
aggacaaaacagagaugaguggcagaagccagaagu

SEQ ID NO: 66157 - RNA, 16 nt, Artificial Sequence
  Synthetic Oligonucleotide; TIGIT exon 3; Set C
agagaugaguggcaga

SEQ ID NO: 66158 - RNA, 38 nt, Artificial Sequence
  Synthetic Oligonucleotide; TIGIT exon 3; Set C
gaggacaaaacagagaugaguggcagaagccagaagug

SEQ ID NO: 66159 - RNA, 32 nt, Artificial Sequence
  Synthetic Oligonucleotide; TIGIT exon 3; Set A
gacaaaacagagaugaguggcagaagccagaa

SEQ ID NO: 66160 - RNA, 40 nt, Artificial Sequence
  Synthetic Oligonucleotide; TIGIT exon 3; Set C
ggaggacaaaacagagaugaguggcagaagccagaaguga

SEQ ID NO: 66161 - RNA, 35 nt, Artificial Sequence
  Synthetic Oligonucleotide; TIGIT exon 3; Set A
aggacaaaacagagaugaguggcagaagccagaag

SEQ ID NO: 66162 - RNA, 19 nt, Artificial Sequence
  Synthetic Oligonucleotide; TIGIT exon 3; Set C
acagagaugaguggcagaa

SEQ ID NO: 66163 - RNA, 37 nt, Artificial Sequence
  Synthetic Oligonucleotide; TIGIT exon 3; Set C
gaggacaaaacagagaugaguggcagaagccagaagu

SEQ ID NO: 66164 - RNA, 17 nt, Artificial Sequence
  Synthetic Oligonucleotide; TIGIT exon 3; Set C
cagagaugaguggcaga

SEQ ID NO: 66165 - RNA, 33 nt, Artificial Sequence
  Synthetic Oligonucleotide; TIGIT exon 3; Set C
ggacaaaacagagaugaguggcagaagccagaa

SEQ ID NO: 66166 - RNA, 39 nt, Artificial Sequence
  Synthetic Oligonucleotide; TIGIT exon 3; Set C
ggaggacaaaacagagaugaguggcagaagccagaagug

SEQ ID NO: 66167 - RNA, 36 nt, Artificial Sequence
  Synthetic Oligonucleotide; TIGIT exon 3; Set C
gaggacaaaacagagaugaguggcagaagccagaag

SEQ ID NO: 66168 - RNA, 20 nt, Artificial Sequence
  Synthetic Oligonucleotide; TIGIT exon 3; Set C
aacagagaugaguggcagaa

SEQ ID NO: 66169 - RNA, 38 nt, Artificial Sequence
  Synthetic Oligonucleotide; TIGIT exon 3; Set C
ggaggacaaaacagagaugaguggcagaagccagaagu

SEQ ID NO: 66170 - RNA, 18 nt, Artificial Sequence
  Synthetic Oligonucleotide; TIGIT exon 3; Set C
acagagaugaguggcaga

SEQ ID NO: 66171 - RNA, 40 nt, Artificial Sequence
  Synthetic Oligonucleotide; TIGIT exon 3; Set C
gggaggacaaaacagagaugaguggcagaagccagaagug

SEQ ID NO: 66172 - RNA, 34 nt, Artificial Sequence
  Synthetic Oligonucleotide; TIGIT exon 3; Set C
aggacaaaacagagaugaguggcagaagccagaa

SEQ ID NO: 66173 - RNA, 37 nt, Artificial Sequence
  Synthetic Oligonucleotide; TIGIT exon 3; Set C
ggaggacaaaacagagaugaguggcagaagccagaag

SEQ ID NO: 66174 - RNA, 21 nt, Artificial Sequence
  Synthetic Oligonucleotide; TIGIT exon 3; Set C
aaacagagaugaguggcagaa

SEQ ID NO: 66175 - RNA, 39 nt, Artificial Sequence
  Synthetic Oligonucleotide; TIGIT exon 3; Set C
gggaggacaaaacagagaugaguggcagaagccagaagu

SEQ ID NO: 66176 - RNA, 19 nt, Artificial Sequence
  Synthetic Oligonucleotide; TIGIT exon 3; Set C
aacagagaugaguggcaga

SEQ ID NO: 66177 - RNA, 35 nt, Artificial Sequence
  Synthetic Oligonucleotide; TIGIT exon 3; Set C
gaggacaaaacagagaugaguggcagaagccagaa

SEQ ID NO: 66178 - RNA, 38 nt, Artificial Sequence
  Synthetic Oligonucleotide; TIGIT exon 3; Set C
gggaggacaaaacagagaugaguggcagaagccagaag

SEQ ID NO: 66179 - RNA, 20 nt, Artificial Sequence
  Synthetic Oligonucleotide; TIGIT exon 3; Set C
aaacagagaugaguggcaga

SEQ ID NO: 66180 - RNA, 36 nt, Artificial Sequence
  Synthetic Oligonucleotide; TIGIT exon 3; Set C
ggaggacaaaacagagaugaguggcagaagccagaa

SEQ ID NO: 66181 - RNA, 23 nt, Artificial Sequence
  Synthetic Oligonucleotide; TIGIT exon 3; Set C
caaaacagagaugaguggcagaa

SEQ ID NO: 66182 - RNA, 37 nt, Artificial Sequence
  Synthetic Oligonucleotide; TIGIT exon 3; Set C
gggaggacaaaacagagaugaguggcagaagccagaa

SEQ ID NO: 66183 - RNA, 24 nt, Artificial Sequence
  Synthetic Oligonucleotide; TIGIT exon 3; Set C
acaaaacagagaugaguggcagaa

SEQ ID NO: 66184 - RNA, 22 nt, Artificial Sequence
  Synthetic Oligonucleotide; TIGIT exon 3; Set C
caaaacagagaugaguggcaga

SEQ ID NO: 66185 - RNA, 25 nt, Artificial Sequence
  Synthetic Oligonucleotide; TIGIT exon 3; Set C
gacaaaacagagaugaguggcagaa

SEQ ID NO: 66186 - RNA, 23 nt, Artificial Sequence
  Synthetic Oligonucleotide; TIGIT exon 3; Set C
acaaaacagagaugaguggcaga

SEQ ID NO: 66187 - RNA, 24 nt, Artificial Sequence
  Synthetic Oligonucleotide; TIGIT exon 3; Set A
gacaaaacagagaugaguggcaga

SEQ ID NO: 66188 - RNA, 26 nt, Artificial Sequence
  Synthetic Oligonucleotide; TIGIT exon 3; Set A
aggacaaaacagagaugaguggcaga

SEQ ID NO: 66189 - RNA, 40 nt, Artificial Sequence
  Synthetic Oligonucleotide; TIGIT exon 3; Set C
gaaccuggcaccgugcucagccacuagagggaggacaaaa

SEQ ID NO: 66190 - RNA, 39 nt, Artificial Sequence
  Synthetic Oligonucleotide; TIGIT exon 3; Set C
gaaccuggcaccgugcucagccacuagagggaggacaaa

SEQ ID NO: 66191 - RNA, 40 nt, Artificial Sequence
  Synthetic Oligonucleotide; TIGIT exon 3; Set C
ggaaccuggcaccgugcucagccacuagagggaggacaaa

SEQ ID NO: 66192 - RNA, 35 nt, Artificial Sequence
  Synthetic Oligonucleotide; TIGIT exon 3; Set C
gaaccuggcaccgugcucagccacuagagggagga

SEQ ID NO: 66193 - RNA, 36 nt, Artificial Sequence
  Synthetic Oligonucleotide; TIGIT exon 3; Set C
ggaaccuggcaccgugcucagccacuagagggagga

SEQ ID NO: 66194 - RNA, 40 nt, Artificial Sequence
  Synthetic Oligonucleotide; TIGIT exon 3; Set C
cuggaaccuggcaccgugcucagccacuagagggaggaca

SEQ ID NO: 66195 - RNA, 37 nt, Artificial Sequence
  Synthetic Oligonucleotide; TIGIT exon 3; Set C
uggaaccuggcaccgugcucagccacuagagggagga

SEQ ID NO: 66196 - RNA, 39 nt, Artificial Sequence
  Synthetic Oligonucleotide; TIGIT exon 3; Set C
cuggaaccuggcaccgugcucagccacuagagggaggac

SEQ ID NO: 66197 - RNA, 38 nt, Artificial Sequence
  Synthetic Oligonucleotide; TIGIT exon 3; Set C
cuggaaccuggcaccgugcucagccacuagagggagga

SEQ ID NO: 66198 - RNA, 40 nt, Artificial Sequence
  Synthetic Oligonucleotide; TIGIT exon 3; Set C
ucuggaaccuggcaccgugcucagccacuagagggaggac

SEQ ID NO: 66199 - RNA, 39 nt, Artificial Sequence
  Synthetic Oligonucleotide; TIGIT exon 3; Set C
ucuggaaccuggcaccgugcucagccacuagagggagga

SEQ ID NO: 66200 - RNA, 37 nt, Artificial Sequence
  Synthetic Oligonucleotide; TIGIT exon 3; Set C
cuggaaccuggcaccgugcucagccacuagagggagg

SEQ ID NO: 66201 - RNA, 40 nt, Artificial Sequence
  Synthetic Oligonucleotide; TIGIT exon 3; Set C
aucuggaaccuggcaccgugcucagccacuagagggagga

SEQ ID NO: 66202 - RNA, 36 nt, Artificial Sequence
  Synthetic Oligonucleotide; TIGIT exon 3; Set C
cuggaaccuggcaccgugcucagccacuagagggag

SEQ ID NO: 66203 - RNA, 38 nt, Artificial Sequence
  Synthetic Oligonucleotide; TIGIT exon 3; Set C
ucuggaaccuggcaccgugcucagccacuagagggagg

SEQ ID NO: 66204 - RNA, 37 nt, Artificial Sequence
  Synthetic Oligonucleotide; TIGIT exon 3; Set C
ucuggaaccuggcaccgugcucagccacuagagggag

SEQ ID NO: 66205 - RNA, 39 nt, Artificial Sequence
  Synthetic Oligonucleotide; TIGIT exon 3; Set C
aucuggaaccuggcaccgugcucagccacuagagggagg

SEQ ID NO: 66206 - RNA, 35 nt, Artificial Sequence
  Synthetic Oligonucleotide; TIGIT exon 3; Set C
cuggaaccuggcaccgugcucagccacuagaggga

SEQ ID NO: 66207 - RNA, 32 nt, Artificial Sequence
  Synthetic Oligonucleotide; TIGIT exon 3; Set C
uggaaccuggcaccgugcucagccacuagagg

SEQ ID NO: 66208 - RNA, 34 nt, Artificial Sequence
  Synthetic Oligonucleotide; TIGIT exon 3; Set C
cuggaaccuggcaccgugcucagccacuagaggg

SEQ ID NO: 66209 - RNA, 38 nt, Artificial Sequence
  Synthetic Oligonucleotide; TIGIT exon 3; Set C
aucuggaaccuggcaccgugcucagccacuagagggag

SEQ ID NO: 66210 - RNA, 40 nt, Artificial Sequence
  Synthetic Oligonucleotide; TIGIT exon 3; Set C
aaucuggaaccuggcaccgugcucagccacuagagggagg

SEQ ID NO: 66211 - RNA, 36 nt, Artificial Sequence
  Synthetic Oligonucleotide; TIGIT exon 3; Set C
ucuggaaccuggcaccgugcucagccacuagaggga

SEQ ID NO: 66212 - RNA, 31 nt, Artificial Sequence
  Synthetic Oligonucleotide; TIGIT exon 3; Set C
uggaaccuggcaccgugcucagccacuagag

SEQ ID NO: 66213 - RNA, 33 nt, Artificial Sequence
  Synthetic Oligonucleotide; TIGIT exon 3; Set C
cuggaaccuggcaccgugcucagccacuagagg

SEQ ID NO: 66214 - RNA, 35 nt, Artificial Sequence
  Synthetic Oligonucleotide; TIGIT exon 3; Set C
ucuggaaccuggcaccgugcucagccacuagaggg

SEQ ID NO: 66215 - RNA, 39 nt, Artificial Sequence
  Synthetic Oligonucleotide; TIGIT exon 3; Set C
aaucuggaaccuggcaccgugcucagccacuagagggag

SEQ ID NO: 66216 - RNA, 37 nt, Artificial Sequence
  Synthetic Oligonucleotide; TIGIT exon 3; Set C
aucuggaaccuggcaccgugcucagccacuagaggga

SEQ ID NO: 66217 - RNA, 32 nt, Artificial Sequence
  Synthetic Oligonucleotide; TIGIT exon 3; Set C
cuggaaccuggcaccgugcucagccacuagag

SEQ ID NO: 66218 - RNA, 34 nt, Artificial Sequence
  Synthetic Oligonucleotide; TIGIT exon 3; Set C
ucuggaaccuggcaccgugcucagccacuagagg

SEQ ID NO: 66219 - RNA, 36 nt, Artificial Sequence
  Synthetic Oligonucleotide; TIGIT exon 3; Set C
aucuggaaccuggcaccgugcucagccacuagaggg

SEQ ID NO: 66220 - RNA, 40 nt, Artificial Sequence
  Synthetic Oligonucleotide; TIGIT exon 3; Set C
gaaucuggaaccuggcaccgugcucagccacuagagggag

SEQ ID NO: 66221 - RNA, 38 nt, Artificial Sequence
  Synthetic Oligonucleotide; TIGIT exon 3; Set C
aaucuggaaccuggcaccgugcucagccacuagaggga

SEQ ID NO: 66222 - RNA, 33 nt, Artificial Sequence
  Synthetic Oligonucleotide; TIGIT exon 3; Set C
ucuggaaccuggcaccgugcucagccacuagag

SEQ ID NO: 66223 - RNA, 31 nt, Artificial Sequence
  Synthetic Oligonucleotide; TIGIT exon 3; Set C
cuggaaccuggcaccgugcucagccacuaga

SEQ ID NO: 66224 - RNA, 35 nt, Artificial Sequence
  Synthetic Oligonucleotide; TIGIT exon 3; Set C
aucuggaaccuggcaccgugcucagccacuagagg

SEQ ID NO: 66225 - RNA, 37 nt, Artificial Sequence
  Synthetic Oligonucleotide; TIGIT exon 3; Set C
aaucuggaaccuggcaccgugcucagccacuagaggg

SEQ ID NO: 66226 - RNA, 39 nt, Artificial Sequence
  Synthetic Oligonucleotide; TIGIT exon 3; Set C
gaaucuggaaccuggcaccgugcucagccacuagaggga

SEQ ID NO: 66227 - RNA, 34 nt, Artificial Sequence
  Synthetic Oligonucleotide; TIGIT exon 3; Set C
aucuggaaccuggcaccgugcucagccacuagag

SEQ ID NO: 66228 - RNA, 32 nt, Artificial Sequence
  Synthetic Oligonucleotide; TIGIT exon 3; Set C
ucuggaaccuggcaccgugcucagccacuaga

SEQ ID NO: 66229 - RNA, 36 nt, Artificial Sequence
  Synthetic Oligonucleotide; TIGIT exon 3; Set C
aaucuggaaccuggcaccgugcucagccacuagagg

SEQ ID NO: 66230 - RNA, 30 nt, Artificial Sequence
  Synthetic Oligonucleotide; TIGIT exon 3; Set C
cuggaaccuggcaccgugcucagccacuag

SEQ ID NO: 66231 - RNA, 38 nt, Artificial Sequence
  Synthetic Oligonucleotide; TIGIT exon 3; Set C
gaaucuggaaccuggcaccgugcucagccacuagaggg

SEQ ID NO: 66232 - RNA, 40 nt, Artificial Sequence
  Synthetic Oligonucleotide; TIGIT exon 3; Set C
ggaaucuggaaccuggcaccgugcucagccacuagaggga

SEQ ID NO: 66233 - RNA, 35 nt, Artificial Sequence
  Synthetic Oligonucleotide; TIGIT exon 3; Set C
aaucuggaaccuggcaccgugcucagccacuagag

SEQ ID NO: 66234 - RNA, 33 nt, Artificial Sequence
  Synthetic Oligonucleotide; TIGIT exon 3; Set C
aucuggaaccuggcaccgugcucagccacuaga

SEQ ID NO: 66235 - RNA, 37 nt, Artificial Sequence
  Synthetic Oligonucleotide; TIGIT exon 3; Set C
gaaucuggaaccuggcaccgugcucagccacuagagg

SEQ ID NO: 66236 - RNA, 31 nt, Artificial Sequence
  Synthetic Oligonucleotide; TIGIT exon 3; Set C
ucuggaaccuggcaccgugcucagccacuag

SEQ ID NO: 66237 - RNA, 39 nt, Artificial Sequence
  Synthetic Oligonucleotide; TIGIT exon 3; Set C
ggaaucuggaaccuggcaccgugcucagccacuagaggg

SEQ ID NO: 66238 - RNA, 36 nt, Artificial Sequence
  Synthetic Oligonucleotide; TIGIT exon 3; Set C
gaaucuggaaccuggcaccgugcucagccacuagag

SEQ ID NO: 66239 - RNA, 34 nt, Artificial Sequence
  Synthetic Oligonucleotide; TIGIT exon 3; Set C
aaucuggaaccuggcaccgugcucagccacuaga

SEQ ID NO: 66240 - RNA, 38 nt, Artificial Sequence
  Synthetic Oligonucleotide; TIGIT exon 3; Set C
ggaaucuggaaccuggcaccgugcucagccacuagagg

SEQ ID NO: 66241 - RNA, 32 nt, Artificial Sequence
  Synthetic Oligonucleotide; TIGIT exon 3; Set C
aucuggaaccuggcaccgugcucagccacuag

SEQ ID NO: 66242 - RNA, 40 nt, Artificial Sequence
  Synthetic Oligonucleotide; TIGIT exon 3; Set C
uggaaucuggaaccuggcaccgugcucagccacuagaggg

SEQ ID NO: 66243 - RNA, 37 nt, Artificial Sequence
  Synthetic Oligonucleotide; TIGIT exon 3; Set C
ggaaucuggaaccuggcaccgugcucagccacuagag

SEQ ID NO: 66244 - RNA, 35 nt, Artificial Sequence
  Synthetic Oligonucleotide; TIGIT exon 3; Set C
gaaucuggaaccuggcaccgugcucagccacuaga

SEQ ID NO: 66245 - RNA, 33 nt, Artificial Sequence
  Synthetic Oligonucleotide; TIGIT exon 3; Set C
aaucuggaaccuggcaccgugcucagccacuag

SEQ ID NO: 66246 - RNA, 36 nt, Artificial Sequence
  Synthetic Oligonucleotide; TIGIT exon 3; Set C
ggaaucuggaaccuggcaccgugcucagccacuaga

SEQ ID NO: 66247 - RNA, 34 nt, Artificial Sequence
  Synthetic Oligonucleotide; TIGIT exon 3; Set C
gaaucuggaaccuggcaccgugcucagccacuag

SEQ ID NO: 66248 - RNA, 37 nt, Artificial Sequence
  Synthetic Oligonucleotide; TIGIT exon 3; Set C
uggaaucuggaaccuggcaccgugcucagccacuaga

SEQ ID NO: 66249 - RNA, 35 nt, Artificial Sequence
  Synthetic Oligonucleotide; TIGIT exon 3; Set C
ggaaucuggaaccuggcaccgugcucagccacuag

SEQ ID NO: 66250 - RNA, 36 nt, Artificial Sequence
  Synthetic Oligonucleotide; TIGIT exon 3; Set C
uggaaucuggaaccuggcaccgugcucagccacuag

SEQ ID NO: 66251 - RNA, 37 nt, Artificial Sequence
  Synthetic Oligonucleotide; TIGIT exon 3; Set C
auggaaucuggaaccuggcaccgugcucagccacuag

SEQ ID NO: 66252 - RNA, 38 nt, Artificial Sequence
  Synthetic Oligonucleotide; TIGIT exon 3; Set C
aauggaaucuggaaccuggcaccgugcucagccacuag

SEQ ID NO: 66253 - RNA, 39 nt, Artificial Sequence
  Synthetic Oligonucleotide; TIGIT exon 3; Set C
caauggaaucuggaaccuggcaccgugcucagccacuag

SEQ ID NO: 66254 - RNA, 40 nt, Artificial Sequence
  Synthetic Oligonucleotide; TIGIT exon 3; Set C
gcaauggaaucuggaaccuggcaccgugcucagccacuag

SEQ ID NO: 66255 - RNA, 20 nt, Artificial Sequence
  Synthetic Oligonucleotide; TIGIT exon 3; Set A
aaucuggaaccuggcaccgu

SEQ ID NO: 66256 - RNA, 21 nt, Artificial Sequence
  Synthetic Oligonucleotide; TIGIT exon 3; Set A
gaaucuggaaccuggcaccgu

SEQ ID NO: 66257 - RNA, 22 nt, Artificial Sequence
  Synthetic Oligonucleotide; TIGIT exon 3; Set A
ggaaucuggaaccuggcaccgu

SEQ ID NO: 66258 - RNA, 23 nt, Artificial Sequence
  Synthetic Oligonucleotide; TIGIT exon 3; Set A
uggaaucuggaaccuggcaccgu

SEQ ID NO: 66259 - RNA, 24 nt, Artificial Sequence
  Synthetic Oligonucleotide; TIGIT exon 3; Set A
auggaaucuggaaccuggcaccgu

SEQ ID NO: 66260 - RNA, 25 nt, Artificial Sequence
  Synthetic Oligonucleotide; TIGIT exon 3; Set A
aauggaaucuggaaccuggcaccgu

SEQ ID NO: 66261 - RNA, 26 nt, Artificial Sequence
  Synthetic Oligonucleotide; TIGIT exon 3; Set C
caauggaaucuggaaccuggcaccgu

SEQ ID NO: 66262 - RNA, 27 nt, Artificial Sequence
  Synthetic Oligonucleotide; TIGIT exon 3; Set C
gcaauggaaucuggaaccuggcaccgu

SEQ ID NO: 66263 - RNA, 28 nt, Artificial Sequence
  Synthetic Oligonucleotide; TIGIT exon 3; Set C
agcaauggaaucuggaaccuggcaccgu

SEQ ID NO: 66264 - RNA, 15 nt, Artificial Sequence
  Synthetic Oligonucleotide; TIGIT exon 3; Set C
uggaaucuggaaccu

SEQ ID NO: 66265 - RNA, 16 nt, Artificial Sequence
  Synthetic Oligonucleotide; TIGIT exon 3; Set C
auggaaucuggaaccu

SEQ ID NO: 66266 - RNA, 17 nt, Artificial Sequence
  Synthetic Oligonucleotide; TIGIT exon 3; Set C
aauggaaucuggaaccu

SEQ ID NO: 66267 - RNA, 15 nt, Artificial Sequence
  Synthetic Oligonucleotide; TIGIT exon 3; Set C
auggaaucuggaacc

SEQ ID NO: 66268 - RNA, 18 nt, Artificial Sequence
  Synthetic Oligonucleotide; TIGIT exon 3; Set C
caauggaaucuggaaccu

SEQ ID NO: 66269 - RNA, 16 nt, Artificial Sequence
  Synthetic Oligonucleotide; TIGIT exon 3; Set C
aauggaaucuggaacc

SEQ ID NO: 66270 - RNA, 15 nt, Artificial Sequence
  Synthetic Oligonucleotide; TIGIT exon 3; Set C
aauggaaucuggaac

SEQ ID NO: 66271 - RNA, 19 nt, Artificial Sequence
  Synthetic Oligonucleotide; TIGIT exon 3; Set C
gcaauggaaucuggaaccu

SEQ ID NO: 66272 - RNA, 17 nt, Artificial Sequence
  Synthetic Oligonucleotide; TIGIT exon 3; Set C
caauggaaucuggaacc

SEQ ID NO: 66273 - RNA, 16 nt, Artificial Sequence
  Synthetic Oligonucleotide; TIGIT exon 3; Set C
caauggaaucuggaac

SEQ ID NO: 66274 - RNA, 20 nt, Artificial Sequence
  Synthetic Oligonucleotide; TIGIT exon 3; Set C
agcaauggaaucuggaaccu

SEQ ID NO: 66275 - RNA, 18 nt, Artificial Sequence
  Synthetic Oligonucleotide; TIGIT exon 3; Set C
gcaauggaaucuggaacc

SEQ ID NO: 66276 - RNA, 17 nt, Artificial Sequence
  Synthetic Oligonucleotide; TIGIT exon 3; Set C
gcaauggaaucuggaac

SEQ ID NO: 66277 - RNA, 21 nt, Artificial Sequence
  Synthetic Oligonucleotide; TIGIT exon 3; Set C
aagcaauggaaucuggaaccu

SEQ ID NO: 66278 - RNA, 19 nt, Artificial Sequence
  Synthetic Oligonucleotide; TIGIT exon 3; Set C
agcaauggaaucuggaacc

SEQ ID NO: 66279 - RNA, 18 nt, Artificial Sequence
  Synthetic Oligonucleotide; TIGIT exon 3; Set C
agcaauggaaucuggaac

SEQ ID NO: 66280 - RNA, 20 nt, Artificial Sequence
  Synthetic Oligonucleotide; TIGIT exon 3; Set C
aagcaauggaaucuggaacc

SEQ ID NO: 66281 - RNA, 19 nt, Artificial Sequence
  Synthetic Oligonucleotide; TIGIT exon 3; Set C
aagcaauggaaucuggaac

SEQ ID NO: 66282 - RNA, 32 nt, Artificial Sequence
  Synthetic Oligonucleotide; TIGIT exon 3; Set C
gucgcggccauggcuccaagcaauggaaucug

SEQ ID NO: 66283 - RNA, 15 nt, Artificial Sequence
  Synthetic Oligonucleotide; TIGIT exon 3; Set C
agucaacgcgaccac

SEQ ID NO: 66284 - RNA, 16 nt, Artificial Sequence
  Synthetic Oligonucleotide; TIGIT exon 3; Set C
uagucaacgcgaccac

SEQ ID NO: 66285 - RNA, 15 nt, Artificial Sequence
  Synthetic Oligonucleotide; TIGIT exon 3; Set C
uagucaacgcgacca

SEQ ID NO: 66286 - RNA, 25 nt, Artificial Sequence
  Synthetic Oligonucleotide; TIGIT exon 3; Set A
uuaccuuucuagucaacgcgaccac

SEQ ID NO: 66287 - RNA, 24 nt, Artificial Sequence
  Synthetic Oligonucleotide; TIGIT exon 3; Set A
uuaccuuucuagucaacgcgacca

SEQ ID NO: 66288 - RNA, 23 nt, Artificial Sequence
  Synthetic Oligonucleotide; TIGIT exon 3; Set B
uuaccuuucuagucaacgcgacc

SEQ ID NO: 66289 - RNA, 40 nt, Artificial Sequence
  Synthetic Oligonucleotide; TIGIT exon 3; Set C
ugugcagccggagccauuaccuuucuagucaacgcgacca

SEQ ID NO: 66290 - RNA, 39 nt, Artificial Sequence
  Synthetic Oligonucleotide; TIGIT exon 3; Set C
ugugcagccggagccauuaccuuucuagucaacgcgacc

SEQ ID NO: 66291 - RNA, 40 nt, Artificial Sequence
  Synthetic Oligonucleotide; TIGIT exon 3; Set C
gugugcagccggagccauuaccuuucuagucaacgcgacc

SEQ ID NO: 66292 - RNA, 28 nt, Artificial Sequence
  Synthetic Oligonucleotide; TIGIT exon 3; Set C
gugugcagccggagccauuaccuuucua

SEQ ID NO: 66293 - RNA, 29 nt, Artificial Sequence
  Synthetic Oligonucleotide; TIGIT exon 3; Set C
ggugugcagccggagccauuaccuuucua

SEQ ID NO: 66294 - RNA, 28 nt, Artificial Sequence
  Synthetic Oligonucleotide; TIGIT exon 3; Set C
ggugugcagccggagccauuaccuuucu

SEQ ID NO: 66295 - RNA, 22 nt, Artificial Sequence
  Synthetic Oligonucleotide; TIGIT exon 3; Set A
gaguggcagaagccagaaguga

SEQ ID NO: 66296 - RNA, 21 nt, Artificial Sequence
  Synthetic Oligonucleotide; TIGIT exon 3; Set A
gaguggcagaagccagaagug

SEQ ID NO: 66297 - RNA, 23 nt, Artificial Sequence
  Synthetic Oligonucleotide; TIGIT exon 3; Set A
ugaguggcagaagccagaaguga

SEQ ID NO: 66298 - RNA, 20 nt, Artificial Sequence
  Synthetic Oligonucleotide; TIGIT exon 3; Set A
gaguggcagaagccagaagu

SEQ ID NO: 66299 - RNA, 22 nt, Artificial Sequence
  Synthetic Oligonucleotide; TIGIT exon 3; Set A
ugaguggcagaagccagaagug

SEQ ID NO: 66300 - RNA, 19 nt, Artificial Sequence
  Synthetic Oligonucleotide; TIGIT exon 3; Set C
gaguggcagaagccagaag

SEQ ID NO: 66301 - RNA, 21 nt, Artificial Sequence
  Synthetic Oligonucleotide; TIGIT exon 3; Set A
ugaguggcagaagccagaagu

SEQ ID NO: 66302 - RNA, 20 nt, Artificial Sequence
  Synthetic Oligonucleotide; TIGIT exon 3; Set C
ugaguggcagaagccagaag

SEQ ID NO: 66303 - RNA, 18 nt, Artificial Sequence
  Synthetic Oligonucleotide; TIGIT exon 3; Set C
gaguggcagaagccagaa

SEQ ID NO: 66304 - RNA, 19 nt, Artificial Sequence
  Synthetic Oligonucleotide; TIGIT exon 3; Set C
ugaguggcagaagccagaa

SEQ ID NO: 66305 - RNA, 20 nt, Artificial Sequence
  Synthetic Oligonucleotide; TIGIT exon 3; Set C
augaguggcagaagccagaa

SEQ ID NO: 66306 - RNA, 21 nt, Artificial Sequence
  Synthetic Oligonucleotide; TIGIT exon 3; Set A
gaugaguggcagaagccagaa

SEQ ID NO: 66307 - RNA, 26 nt, Artificial Sequence
  Synthetic Oligonucleotide; TIGIT exon 3; Set A
acagagaugaguggcagaagccagaa

SEQ ID NO: 66308 - RNA, 30 nt, Artificial Sequence
  Synthetic Oligonucleotide; TIGIT exon 3; Set A
caaaacagagaugaguggcagaagccagaa

SEQ ID NO: 66309 - RNA, 38 nt, Artificial Sequence
  Synthetic Oligonucleotide; TIGIT exon 3; Set C
gagggaggacaaaacagagaugaguggcagaagccaga

SEQ ID NO: 66310 - RNA, 39 nt, Artificial Sequence
  Synthetic Oligonucleotide; TIGIT exon 3; Set C
agagggaggacaaaacagagaugaguggcagaagccaga

SEQ ID NO: 66311 - RNA, 39 nt, Artificial Sequence
  Synthetic Oligonucleotide; TIGIT exon 3; Set C
cgugcucagccacuagagggaggacaaaacagagaugag

SEQ ID NO: 66312 - RNA, 38 nt, Artificial Sequence
  Synthetic Oligonucleotide; TIGIT exon 3; Set C
cgugcucagccacuagagggaggacaaaacagagauga

SEQ ID NO: 66313 - RNA, 37 nt, Artificial Sequence
  Synthetic Oligonucleotide; TIGIT exon 3; Set C
cgugcucagccacuagagggaggacaaaacagagaug

SEQ ID NO: 66314 - RNA, 36 nt, Artificial Sequence
  Synthetic Oligonucleotide; TIGIT exon 3; Set C
cgugcucagccacuagagggaggacaaaacagagau

SEQ ID NO: 66315 - RNA, 35 nt, Artificial Sequence
  Synthetic Oligonucleotide; TIGIT exon 3; Set C
cgugcucagccacuagagggaggacaaaacagaga

SEQ ID NO: 66316 - RNA, 34 nt, Artificial Sequence
  Synthetic Oligonucleotide; TIGIT exon 3; Set C
cgugcucagccacuagagggaggacaaaacagag

SEQ ID NO: 66317 - RNA, 33 nt, Artificial Sequence
  Synthetic Oligonucleotide; TIGIT exon 3; Set C
cgugcucagccacuagagggaggacaaaacaga

SEQ ID NO: 66318 - RNA, 32 nt, Artificial Sequence
  Synthetic Oligonucleotide; TIGIT exon 3; Set C
cgugcucagccacuagagggaggacaaaacag

SEQ ID NO: 66319 - RNA, 31 nt, Artificial Sequence
  Synthetic Oligonucleotide; TIGIT exon 3; Set C
cgugcucagccacuagagggaggacaaaaca

SEQ ID NO: 66320 - RNA, 30 nt, Artificial Sequence
  Synthetic Oligonucleotide; TIGIT exon 3; Set C
cgugcucagccacuagagggaggacaaaac

SEQ ID NO: 66321 - RNA, 29 nt, Artificial Sequence
  Synthetic Oligonucleotide; TIGIT exon 3; Set C
cgugcucagccacuagagggaggacaaaa

SEQ ID NO: 66322 - RNA, 28 nt, Artificial Sequence
  Synthetic Oligonucleotide; TIGIT exon 3; Set C
cgugcucagccacuagagggaggacaaa

SEQ ID NO: 66323 - RNA, 40 nt, Artificial Sequence
  Synthetic Oligonucleotide; TIGIT exon 3; Set C
ccuggcaccgugcucagccacuagagggaggacaaaacag

SEQ ID NO: 66324 - RNA, 24 nt, Artificial Sequence
  Synthetic Oligonucleotide; TIGIT exon 3; Set C
cgugcucagccacuagagggagga

SEQ ID NO: 66325 - RNA, 38 nt, Artificial Sequence
  Synthetic Oligonucleotide; TIGIT exon 3; Set C
aaccuggcaccgugcucagccacuagagggaggacaaa

SEQ ID NO: 66326 - RNA, 38 nt, Artificial Sequence
  Synthetic Oligonucleotide; TIGIT exon 3; Set C
gaaccuggcaccgugcucagccacuagagggaggacaa

SEQ ID NO: 66327 - RNA, 39 nt, Artificial Sequence
  Synthetic Oligonucleotide; TIGIT exon 3; Set C
ggaaccuggcaccgugcucagccacuagagggaggacaa

SEQ ID NO: 66328 - RNA, 37 nt, Artificial Sequence
  Synthetic Oligonucleotide; TIGIT exon 3; Set C
gaaccuggcaccgugcucagccacuagagggaggaca

SEQ ID NO: 66329 - RNA, 36 nt, Artificial Sequence
  Synthetic Oligonucleotide; TIGIT exon 3; Set C
gaaccuggcaccgugcucagccacuagagggaggac

SEQ ID NO: 66330 - RNA, 40 nt, Artificial Sequence
  Synthetic Oligonucleotide; TIGIT exon 3; Set C
uggaaccuggcaccgugcucagccacuagagggaggacaa

SEQ ID NO: 66331 - RNA, 38 nt, Artificial Sequence
  Synthetic Oligonucleotide; TIGIT exon 3; Set C
ggaaccuggcaccgugcucagccacuagagggaggaca

SEQ ID NO: 66332 - RNA, 37 nt, Artificial Sequence
  Synthetic Oligonucleotide; TIGIT exon 3; Set C
ggaaccuggcaccgugcucagccacuagagggaggac

SEQ ID NO: 66333 - RNA, 39 nt, Artificial Sequence
  Synthetic Oligonucleotide; TIGIT exon 3; Set C
uggaaccuggcaccgugcucagccacuagagggaggaca

SEQ ID NO: 66334 - RNA, 34 nt, Artificial Sequence
  Synthetic Oligonucleotide; TIGIT exon 3; Set C
gaaccuggcaccgugcucagccacuagagggagg

SEQ ID NO: 66335 - RNA, 38 nt, Artificial Sequence
  Synthetic Oligonucleotide; TIGIT exon 3; Set C
uggaaccuggcaccgugcucagccacuagagggaggac

SEQ ID NO: 66336 - RNA, 33 nt, Artificial Sequence
  Synthetic Oligonucleotide; TIGIT exon 3; Set C
gaaccuggcaccgugcucagccacuagagggag

SEQ ID NO: 66337 - RNA, 35 nt, Artificial Sequence
  Synthetic Oligonucleotide; TIGIT exon 3; Set C
ggaaccuggcaccgugcucagccacuagagggagg

SEQ ID NO: 66338 - RNA, 34 nt, Artificial Sequence
  Synthetic Oligonucleotide; TIGIT exon 3; Set C
ggaaccuggcaccgugcucagccacuagagggag

SEQ ID NO: 66339 - RNA, 36 nt, Artificial Sequence
  Synthetic Oligonucleotide; TIGIT exon 3; Set C
uggaaccuggcaccgugcucagccacuagagggagg

SEQ ID NO: 66340 - RNA, 32 nt, Artificial Sequence
  Synthetic Oligonucleotide; TIGIT exon 3; Set C
gaaccuggcaccgugcucagccacuagaggga

SEQ ID NO: 66341 - RNA, 31 nt, Artificial Sequence
  Synthetic Oligonucleotide; TIGIT exon 3; Set C
gaaccuggcaccgugcucagccacuagaggg

SEQ ID NO: 66342 - RNA, 35 nt, Artificial Sequence
  Synthetic Oligonucleotide; TIGIT exon 3; Set C
uggaaccuggcaccgugcucagccacuagagggag

SEQ ID NO: 66343 - RNA, 33 nt, Artificial Sequence
  Synthetic Oligonucleotide; TIGIT exon 3; Set C
ggaaccuggcaccgugcucagccacuagaggga

SEQ ID NO: 66344 - RNA, 30 nt, Artificial Sequence
  Synthetic Oligonucleotide; TIGIT exon 3; Set C
gaaccuggcaccgugcucagccacuagagg

SEQ ID NO: 66345 - RNA, 32 nt, Artificial Sequence
  Synthetic Oligonucleotide; TIGIT exon 3; Set C
ggaaccuggcaccgugcucagccacuagaggg

SEQ ID NO: 66346 - RNA, 34 nt, Artificial Sequence
  Synthetic Oligonucleotide; TIGIT exon 3; Set C
uggaaccuggcaccgugcucagccacuagaggga

SEQ ID NO: 66347 - RNA, 29 nt, Artificial Sequence
  Synthetic Oligonucleotide; TIGIT exon 3; Set C
gaaccuggcaccgugcucagccacuagag

SEQ ID NO: 66348 - RNA, 31 nt, Artificial Sequence
  Synthetic Oligonucleotide; TIGIT exon 3; Set C
ggaaccuggcaccgugcucagccacuagagg

SEQ ID NO: 66349 - RNA, 33 nt, Artificial Sequence
  Synthetic Oligonucleotide; TIGIT exon 3; Set C
uggaaccuggcaccgugcucagccacuagaggg

SEQ ID NO: 66350 - RNA, 30 nt, Artificial Sequence
  Synthetic Oligonucleotide; TIGIT exon 3; Set C
ggaaccuggcaccgugcucagccacuagag

SEQ ID NO: 66351 - RNA, 28 nt, Artificial Sequence
  Synthetic Oligonucleotide; TIGIT exon 3; Set C
gaaccuggcaccgugcucagccacuaga

SEQ ID NO: 66352 - RNA, 29 nt, Artificial Sequence
  Synthetic Oligonucleotide; TIGIT exon 3; Set C
ggaaccuggcaccgugcucagccacuaga

SEQ ID NO: 66353 - RNA, 27 nt, Artificial Sequence
  Synthetic Oligonucleotide; TIGIT exon 3; Set C
gaaccuggcaccgugcucagccacuag

SEQ ID NO: 66354 - RNA, 30 nt, Artificial Sequence
  Synthetic Oligonucleotide; TIGIT exon 3; Set C
uggaaccuggcaccgugcucagccacuaga

SEQ ID NO: 66355 - RNA, 28 nt, Artificial Sequence
  Synthetic Oligonucleotide; TIGIT exon 3; Set C
ggaaccuggcaccgugcucagccacuag

SEQ ID NO: 66356 - RNA, 29 nt, Artificial Sequence
  Synthetic Oligonucleotide; TIGIT exon 3; Set C
uggaaccuggcaccgugcucagccacuag

SEQ ID NO: 66357 - RNA, 15 nt, Artificial Sequence
  Synthetic Oligonucleotide; TIGIT exon 3; Set C
ggaaccuggcaccgu

SEQ ID NO: 66358 - RNA, 16 nt, Artificial Sequence
  Synthetic Oligonucleotide; TIGIT exon 3; Set A
uggaaccuggcaccgu

SEQ ID NO: 66359 - RNA, 17 nt, Artificial Sequence
  Synthetic Oligonucleotide; TIGIT exon 3; Set A
cuggaaccuggcaccgu

SEQ ID NO: 66360 - RNA, 18 nt, Artificial Sequence
  Synthetic Oligonucleotide; TIGIT exon 3; Set A
ucuggaaccuggcaccgu

SEQ ID NO: 66361 - RNA, 19 nt, Artificial Sequence
  Synthetic Oligonucleotide; TIGIT exon 3; Set A
aucuggaaccuggcaccgu

SEQ ID NO: 66362 - RNA, 15 nt, Artificial Sequence
  Synthetic Oligonucleotide; TIGIT exon 3; Set C
aaucuggaaccuggc

SEQ ID NO: 66363 - RNA, 16 nt, Artificial Sequence
  Synthetic Oligonucleotide; TIGIT exon 3; Set C
gaaucuggaaccuggc

SEQ ID NO: 66364 - RNA, 15 nt, Artificial Sequence
  Synthetic Oligonucleotide; TIGIT exon 3; Set C
gaaucuggaaccugg

SEQ ID NO: 66365 - RNA, 17 nt, Artificial Sequence
  Synthetic Oligonucleotide; TIGIT exon 3; Set C
ggaaucuggaaccuggc

SEQ ID NO: 66366 - RNA, 16 nt, Artificial Sequence
  Synthetic Oligonucleotide; TIGIT exon 3; Set C
ggaaucuggaaccugg

SEQ ID NO: 66367 - RNA, 18 nt, Artificial Sequence
  Synthetic Oligonucleotide; TIGIT exon 3; Set C
uggaaucuggaaccuggc

SEQ ID NO: 66368 - RNA, 29 nt, Artificial Sequence
  Synthetic Oligonucleotide; TIGIT exon 3; Set C
aagcaauggaaucuggaaccuggcaccgu

SEQ ID NO: 66369 - RNA, 17 nt, Artificial Sequence
  Synthetic Oligonucleotide; TIGIT exon 3; Set C
uggaaucuggaaccugg

SEQ ID NO: 66370 - RNA, 19 nt, Artificial Sequence
  Synthetic Oligonucleotide; TIGIT exon 3; Set C
auggaaucuggaaccuggc

SEQ ID NO: 66371 - RNA, 18 nt, Artificial Sequence
  Synthetic Oligonucleotide; TIGIT exon 3; Set C
auggaaucuggaaccugg

SEQ ID NO: 66372 - RNA, 20 nt, Artificial Sequence
  Synthetic Oligonucleotide; TIGIT exon 3; Set C
aauggaaucuggaaccuggc

SEQ ID NO: 66373 - RNA, 19 nt, Artificial Sequence
  Synthetic Oligonucleotide; TIGIT exon 3; Set C
aauggaaucuggaaccugg

SEQ ID NO: 66374 - RNA, 21 nt, Artificial Sequence
  Synthetic Oligonucleotide; TIGIT exon 3; Set C
caauggaaucuggaaccuggc

SEQ ID NO: 66375 - RNA, 20 nt, Artificial Sequence
  Synthetic Oligonucleotide; TIGIT exon 3; Set C
caauggaaucuggaaccugg

SEQ ID NO: 66376 - RNA, 22 nt, Artificial Sequence
  Synthetic Oligonucleotide; TIGIT exon 3; Set A
gcaauggaaucuggaaccuggc

SEQ ID NO: 66377 - RNA, 21 nt, Artificial Sequence
  Synthetic Oligonucleotide; TIGIT exon 3; Set C
gcaauggaaucuggaaccugg

SEQ ID NO: 66378 - RNA, 23 nt, Artificial Sequence
  Synthetic Oligonucleotide; TIGIT exon 3; Set A
agcaauggaaucuggaaccuggc

SEQ ID NO: 66379 - RNA, 22 nt, Artificial Sequence
  Synthetic Oligonucleotide; TIGIT exon 3; Set C
agcaauggaaucuggaaccugg

SEQ ID NO: 66380 - RNA, 24 nt, Artificial Sequence
  Synthetic Oligonucleotide; TIGIT exon 3; Set A
aagcaauggaaucuggaaccuggc

SEQ ID NO: 66381 - RNA, 23 nt, Artificial Sequence
  Synthetic Oligonucleotide; TIGIT exon 3; Set C
aagcaauggaaucuggaaccugg

SEQ ID NO: 66382 - RNA, 28 nt, Artificial Sequence
  Synthetic Oligonucleotide; TIGIT exon 3; Set A
ccauggcuccaagcaauggaaucuggaa

SEQ ID NO: 66383 - RNA, 24 nt, Artificial Sequence
  Synthetic Oligonucleotide; TIGIT exon 3; Set A
cauggcuccaagcaauggaaucug

SEQ ID NO: 66384 - RNA, 25 nt, Artificial Sequence
  Synthetic Oligonucleotide; TIGIT exon 3; Set A
ccauggcuccaagcaauggaaucug

SEQ ID NO: 66385 - RNA, 24 nt, Artificial Sequence
  Synthetic Oligonucleotide; TIGIT exon 3; Set A
ccauggcuccaagcaauggaaucu

SEQ ID NO: 66386 - RNA, 23 nt, Artificial Sequence
  Synthetic Oligonucleotide; TIGIT exon 3; Set A
ccauggcuccaagcaauggaauc

SEQ ID NO: 66387 - RNA, 33 nt, Artificial Sequence
  Synthetic Oligonucleotide; TIGIT exon 3; Set C
cgcggccauggcuccaagcaauggaaucuggaa

SEQ ID NO: 66388 - RNA, 34 nt, Artificial Sequence
  Synthetic Oligonucleotide; TIGIT exon 3; Set C
ucgcggccauggcuccaagcaauggaaucuggaa

SEQ ID NO: 66389 - RNA, 32 nt, Artificial Sequence
  Synthetic Oligonucleotide; TIGIT exon 3; Set C
cgcggccauggcuccaagcaauggaaucugga

SEQ ID NO: 66390 - RNA, 35 nt, Artificial Sequence
  Synthetic Oligonucleotide; TIGIT exon 3; Set C
gucgcggccauggcuccaagcaauggaaucuggaa

SEQ ID NO: 66391 - RNA, 33 nt, Artificial Sequence
  Synthetic Oligonucleotide; TIGIT exon 3; Set C
ucgcggccauggcuccaagcaauggaaucugga

SEQ ID NO: 66392 - RNA, 31 nt, Artificial Sequence
  Synthetic Oligonucleotide; TIGIT exon 3; Set C
cgcggccauggcuccaagcaauggaaucugg

SEQ ID NO: 66393 - RNA, 30 nt, Artificial Sequence
  Synthetic Oligonucleotide; TIGIT exon 3; Set C
cgcggccauggcuccaagcaauggaaucug

SEQ ID NO: 66394 - RNA, 34 nt, Artificial Sequence
  Synthetic Oligonucleotide; TIGIT exon 3; Set C
gucgcggccauggcuccaagcaauggaaucugga

SEQ ID NO: 66395 - RNA, 32 nt, Artificial Sequence
  Synthetic Oligonucleotide; TIGIT exon 3; Set C
ucgcggccauggcuccaagcaauggaaucugg

SEQ ID NO: 66396 - RNA, 29 nt, Artificial Sequence
  Synthetic Oligonucleotide; TIGIT exon 3; Set C
cgcggccauggcuccaagcaauggaaucu

SEQ ID NO: 66397 - RNA, 31 nt, Artificial Sequence
  Synthetic Oligonucleotide; TIGIT exon 3; Set C
ucgcggccauggcuccaagcaauggaaucug

SEQ ID NO: 66398 - RNA, 33 nt, Artificial Sequence
  Synthetic Oligonucleotide; TIGIT exon 3; Set C
gucgcggccauggcuccaagcaauggaaucugg

SEQ ID NO: 66399 - RNA, 30 nt, Artificial Sequence
  Synthetic Oligonucleotide; TIGIT exon 3; Set C
ucgcggccauggcuccaagcaauggaaucu

SEQ ID NO: 66400 - RNA, 28 nt, Artificial Sequence
  Synthetic Oligonucleotide; TIGIT exon 3; Set C
cgcggccauggcuccaagcaauggaauc

SEQ ID NO: 66401 - RNA, 27 nt, Artificial Sequence
  Synthetic Oligonucleotide; TIGIT exon 3; Set C
cgcggccauggcuccaagcaauggaau

SEQ ID NO: 66402 - RNA, 31 nt, Artificial Sequence
  Synthetic Oligonucleotide; TIGIT exon 3; Set C
gucgcggccauggcuccaagcaauggaaucu

SEQ ID NO: 66403 - RNA, 29 nt, Artificial Sequence
  Synthetic Oligonucleotide; TIGIT exon 3; Set C
ucgcggccauggcuccaagcaauggaauc

SEQ ID NO: 66404 - RNA, 26 nt, Artificial Sequence
  Synthetic Oligonucleotide; TIGIT exon 3; Set C
cgcggccauggcuccaagcaauggaa

SEQ ID NO: 66405 - RNA, 28 nt, Artificial Sequence
  Synthetic Oligonucleotide; TIGIT exon 3; Set C
ucgcggccauggcuccaagcaauggaau

SEQ ID NO: 66406 - RNA, 30 nt, Artificial Sequence
  Synthetic Oligonucleotide; TIGIT exon 3; Set C
gucgcggccauggcuccaagcaauggaauc

SEQ ID NO: 66407 - RNA, 27 nt, Artificial Sequence
  Synthetic Oligonucleotide; TIGIT exon 3; Set C
ucgcggccauggcuccaagcaauggaa

SEQ ID NO: 66408 - RNA, 25 nt, Artificial Sequence
  Synthetic Oligonucleotide; TIGIT exon 3; Set C
cgcggccauggcuccaagcaaugga

SEQ ID NO: 66409 - RNA, 29 nt, Artificial Sequence
  Synthetic Oligonucleotide; TIGIT exon 3; Set C
gucgcggccauggcuccaagcaauggaau

SEQ ID NO: 66410 - RNA, 28 nt, Artificial Sequence
  Synthetic Oligonucleotide; TIGIT exon 3; Set C
gucgcggccauggcuccaagcaauggaa

SEQ ID NO: 66411 - RNA, 26 nt, Artificial Sequence
  Synthetic Oligonucleotide; TIGIT exon 3; Set C
ucgcggccauggcuccaagcaaugga

SEQ ID NO: 66412 - RNA, 24 nt, Artificial Sequence
  Synthetic Oligonucleotide; TIGIT exon 3; Set C
cgcggccauggcuccaagcaaugg

SEQ ID NO: 66413 - RNA, 27 nt, Artificial Sequence
  Synthetic Oligonucleotide; TIGIT exon 3; Set C
gucgcggccauggcuccaagcaaugga

SEQ ID NO: 66414 - RNA, 23 nt, Artificial Sequence
  Synthetic Oligonucleotide; TIGIT exon 3; Set C
cgcggccauggcuccaagcaaug

SEQ ID NO: 66415 - RNA, 25 nt, Artificial Sequence
  Synthetic Oligonucleotide; TIGIT exon 3; Set C
ucgcggccauggcuccaagcaaugg

SEQ ID NO: 66416 - RNA, 24 nt, Artificial Sequence
  Synthetic Oligonucleotide; TIGIT exon 3; Set C
ucgcggccauggcuccaagcaaug

SEQ ID NO: 66417 - RNA, 26 nt, Artificial Sequence
  Synthetic Oligonucleotide; TIGIT exon 3; Set C
gucgcggccauggcuccaagcaaugg

SEQ ID NO: 66418 - RNA, 22 nt, Artificial Sequence
  Synthetic Oligonucleotide; TIGIT exon 3; Set C
cgcggccauggcuccaagcaau

SEQ ID NO: 66419 - RNA, 25 nt, Artificial Sequence
  Synthetic Oligonucleotide; TIGIT exon 3; Set C
gucgcggccauggcuccaagcaaug

SEQ ID NO: 66420 - RNA, 23 nt, Artificial Sequence
  Synthetic Oligonucleotide; TIGIT exon 3; Set C
ucgcggccauggcuccaagcaau

SEQ ID NO: 66421 - RNA, 24 nt, Artificial Sequence
  Synthetic Oligonucleotide; TIGIT exon 3; Set C
gucgcggccauggcuccaagcaau

SEQ ID NO: 66422 - RNA, 22 nt, Artificial Sequence
  Synthetic Oligonucleotide; TIGIT exon 3; Set C
ucgcggccauggcuccaagcaa

SEQ ID NO: 66423 - RNA, 23 nt, Artificial Sequence
  Synthetic Oligonucleotide; TIGIT exon 3; Set C
gucgcggccauggcuccaagcaa

SEQ ID NO: 66424 - RNA, 40 nt, Artificial Sequence
  Synthetic Oligonucleotide; TIGIT exon 3; Set C
ugaccaccagcgucgcggccauggcuccaagcaauggaau

SEQ ID NO: 66425 - RNA, 39 nt, Artificial Sequence
  Synthetic Oligonucleotide; TIGIT exon 3; Set C
ugaccaccagcgucgcggccauggcuccaagcaauggaa

SEQ ID NO: 66426 - RNA, 40 nt, Artificial Sequence
  Synthetic Oligonucleotide; TIGIT exon 3; Set C
augaccaccagcgucgcggccauggcuccaagcaauggaa

SEQ ID NO: 66427 - RNA, 38 nt, Artificial Sequence
  Synthetic Oligonucleotide; TIGIT exon 3; Set C
ugaccaccagcgucgcggccauggcuccaagcaaugga

SEQ ID NO: 66428 - RNA, 39 nt, Artificial Sequence
  Synthetic Oligonucleotide; TIGIT exon 3; Set C
augaccaccagcgucgcggccauggcuccaagcaaugga

SEQ ID NO: 66429 - RNA, 37 nt, Artificial Sequence
  Synthetic Oligonucleotide; TIGIT exon 3; Set C
ugaccaccagcgucgcggccauggcuccaagcaaugg

SEQ ID NO: 66430 - RNA, 36 nt, Artificial Sequence
  Synthetic Oligonucleotide; TIGIT exon 3; Set C
ugaccaccagcgucgcggccauggcuccaagcaaug

SEQ ID NO: 66431 - RNA, 38 nt, Artificial Sequence
  Synthetic Oligonucleotide; TIGIT exon 3; Set C
augaccaccagcgucgcggccauggcuccaagcaaugg

SEQ ID NO: 66432 - RNA, 37 nt, Artificial Sequence
  Synthetic Oligonucleotide; TIGIT exon 3; Set C
augaccaccagcgucgcggccauggcuccaagcaaug

SEQ ID NO: 66433 - RNA, 35 nt, Artificial Sequence
  Synthetic Oligonucleotide; TIGIT exon 3; Set C
ugaccaccagcgucgcggccauggcuccaagcaau

SEQ ID NO: 66434 - RNA, 36 nt, Artificial Sequence
  Synthetic Oligonucleotide; TIGIT exon 3; Set C
augaccaccagcgucgcggccauggcuccaagcaau

SEQ ID NO: 66435 - RNA, 34 nt, Artificial Sequence
  Synthetic Oligonucleotide; TIGIT exon 3; Set C
ugaccaccagcgucgcggccauggcuccaagcaa

SEQ ID NO: 66436 - RNA, 35 nt, Artificial Sequence
  Synthetic Oligonucleotide; TIGIT exon 3; Set C
augaccaccagcgucgcggccauggcuccaagcaa

SEQ ID NO: 66437 - RNA, 33 nt, Artificial Sequence
  Synthetic Oligonucleotide; TIGIT exon 3; Set C
ugaccaccagcgucgcggccauggcuccaagca

SEQ ID NO: 66438 - RNA, 34 nt, Artificial Sequence
  Synthetic Oligonucleotide; TIGIT exon 3; Set C
augaccaccagcgucgcggccauggcuccaagca

SEQ ID NO: 66439 - RNA, 33 nt, Artificial Sequence
  Synthetic Oligonucleotide; TIGIT exon 3; Set C
augaccaccagcgucgcggccauggcuccaagc

SEQ ID NO: 66440 - RNA, 16 nt, Artificial Sequence
  Synthetic Oligonucleotide; TIGIT exon 3; Set A
ugaccaccagcgucgc

SEQ ID NO: 66441 - RNA, 15 nt, Artificial Sequence
  Synthetic Oligonucleotide; TIGIT exon 3; Set C
ugaccaccagcgucg

SEQ ID NO: 66442 - RNA, 17 nt, Artificial Sequence
  Synthetic Oligonucleotide; TIGIT exon 3; Set A
augaccaccagcgucgc

SEQ ID NO: 66443 - RNA, 16 nt, Artificial Sequence
  Synthetic Oligonucleotide; TIGIT exon 3; Set C
augaccaccagcgucg

SEQ ID NO: 66444 - RNA, 15 nt, Artificial Sequence
  Synthetic Oligonucleotide; TIGIT exon 3; Set C
augaccaccagcguc

SEQ ID NO: 66445 - RNA, 39 nt, Artificial Sequence
  Synthetic Oligonucleotide; TIGIT exon 3; Set C
caccacgaugacugcugugcagaugaccaccagcgucgc

SEQ ID NO: 66446 - RNA, 38 nt, Artificial Sequence
  Synthetic Oligonucleotide; TIGIT exon 3; Set C
caccacgaugacugcugugcagaugaccaccagcgucg

SEQ ID NO: 66447 - RNA, 40 nt, Artificial Sequence
  Synthetic Oligonucleotide; TIGIT exon 3; Set C
ccaccacgaugacugcugugcagaugaccaccagcgucgc

SEQ ID NO: 66448 - RNA, 39 nt, Artificial Sequence
  Synthetic Oligonucleotide; TIGIT exon 3; Set C
ccaccacgaugacugcugugcagaugaccaccagcgucg

SEQ ID NO: 66449 - RNA, 38 nt, Artificial Sequence
  Synthetic Oligonucleotide; TIGIT exon 3; Set C
ccaccacgaugacugcugugcagaugaccaccagcguc

SEQ ID NO: 66450 - RNA, 40 nt, Artificial Sequence
  Synthetic Oligonucleotide; TIGIT exon 3; Set C
accaccacgaugacugcugugcagaugaccaccagcgucg

SEQ ID NO: 66451 - RNA, 39 nt, Artificial Sequence
  Synthetic Oligonucleotide; TIGIT exon 3; Set C
accaccacgaugacugcugugcagaugaccaccagcguc

SEQ ID NO: 66452 - RNA, 26 nt, Artificial Sequence
  Synthetic Oligonucleotide; TIGIT exon 3; Set C
caccacgaugacugcugugcagauga

SEQ ID NO: 66453 - RNA, 25 nt, Artificial Sequence
  Synthetic Oligonucleotide; TIGIT exon 3; Set C
caccacgaugacugcugugcagaug

SEQ ID NO: 66454 - RNA, 27 nt, Artificial Sequence
  Synthetic Oligonucleotide; TIGIT exon 3; Set C
ccaccacgaugacugcugugcagauga

SEQ ID NO: 66455 - RNA, 26 nt, Artificial Sequence
  Synthetic Oligonucleotide; TIGIT exon 3; Set C
ccaccacgaugacugcugugcagaug

SEQ ID NO: 66456 - RNA, 28 nt, Artificial Sequence
  Synthetic Oligonucleotide; TIGIT exon 3; Set C
accaccacgaugacugcugugcagauga

SEQ ID NO: 66457 - RNA, 27 nt, Artificial Sequence
  Synthetic Oligonucleotide; TIGIT exon 3; Set C
accaccacgaugacugcugugcagaug

SEQ ID NO: 66458 - RNA, 38 nt, Artificial Sequence
  Synthetic Oligonucleotide; TIGIT exon 3; Set C
agucaacgcgaccaccacgaugacugcugugcagauga

SEQ ID NO: 66459 - RNA, 37 nt, Artificial Sequence
  Synthetic Oligonucleotide; TIGIT exon 3; Set C
agucaacgcgaccaccacgaugacugcugugcagaug

SEQ ID NO: 66460 - RNA, 39 nt, Artificial Sequence
  Synthetic Oligonucleotide; TIGIT exon 3; Set C
uagucaacgcgaccaccacgaugacugcugugcagauga

SEQ ID NO: 66461 - RNA, 38 nt, Artificial Sequence
  Synthetic Oligonucleotide; TIGIT exon 3; Set C
uagucaacgcgaccaccacgaugacugcugugcagaug

SEQ ID NO: 66462 - RNA, 40 nt, Artificial Sequence
  Synthetic Oligonucleotide; TIGIT exon 3; Set C
cuagucaacgcgaccaccacgaugacugcugugcagauga

SEQ ID NO: 66463 - RNA, 39 nt, Artificial Sequence
  Synthetic Oligonucleotide; TIGIT exon 3; Set C
cuagucaacgcgaccaccacgaugacugcugugcagaug

SEQ ID NO: 66464 - RNA, 40 nt, Artificial Sequence
  Synthetic Oligonucleotide; TIGIT exon 3; Set C
ucuagucaacgcgaccaccacgaugacugcugugcagaug

SEQ ID NO: 66465 - RNA, 26 nt, Artificial Sequence
  Synthetic Oligonucleotide; TIGIT exon 3; Set A
auuaccuuucuagucaacgcgaccac

SEQ ID NO: 66466 - RNA, 27 nt, Artificial Sequence
  Synthetic Oligonucleotide; TIGIT exon 3; Set A
cauuaccuuucuagucaacgcgaccac

SEQ ID NO: 66467 - RNA, 25 nt, Artificial Sequence
  Synthetic Oligonucleotide; TIGIT exon 3; Set A
auuaccuuucuagucaacgcgacca

SEQ ID NO: 66468 - RNA, 24 nt, Artificial Sequence
  Synthetic Oligonucleotide; TIGIT exon 3; Set B
auuaccuuucuagucaacgcgacc

SEQ ID NO: 66469 - RNA, 26 nt, Artificial Sequence
  Synthetic Oligonucleotide; TIGIT exon 3; Set A
cauuaccuuucuagucaacgcgacca

SEQ ID NO: 66470 - RNA, 25 nt, Artificial Sequence
  Synthetic Oligonucleotide; TIGIT exon 3; Set B
cauuaccuuucuagucaacgcgacc

SEQ ID NO: 66471 - RNA, 15 nt, Artificial Sequence
  Synthetic Oligonucleotide; TIGIT exon 3; Set C
auuaccuuucuaguc

SEQ ID NO: 66472 - RNA, 16 nt, Artificial Sequence
  Synthetic Oligonucleotide; TIGIT exon 3; Set C
cauuaccuuucuaguc

SEQ ID NO: 66473 - RNA, 15 nt, Artificial Sequence
  Synthetic Oligonucleotide; TIGIT exon 3; Set C
cauuaccuuucuagu

SEQ ID NO: 66474 - RNA, 30 nt, Artificial Sequence
  Synthetic Oligonucleotide; TIGIT exon 3; Set C
ugugcagccggagccauuaccuuucuaguc

SEQ ID NO: 66475 - RNA, 29 nt, Artificial Sequence
  Synthetic Oligonucleotide; TIGIT exon 3; Set C
ugugcagccggagccauuaccuuucuagu

SEQ ID NO: 66476 - RNA, 31 nt, Artificial Sequence
  Synthetic Oligonucleotide; TIGIT exon 3; Set C
gugugcagccggagccauuaccuuucuaguc

SEQ ID NO: 66477 - RNA, 28 nt, Artificial Sequence
  Synthetic Oligonucleotide; TIGIT exon 3; Set C
ugugcagccggagccauuaccuuucuag

SEQ ID NO: 66478 - RNA, 30 nt, Artificial Sequence
  Synthetic Oligonucleotide; TIGIT exon 3; Set C
gugugcagccggagccauuaccuuucuagu

SEQ ID NO: 66479 - RNA, 32 nt, Artificial Sequence
  Synthetic Oligonucleotide; TIGIT exon 3; Set C
ggugugcagccggagccauuaccuuucuaguc

SEQ ID NO: 66480 - RNA, 27 nt, Artificial Sequence
  Synthetic Oligonucleotide; TIGIT exon 3; Set C
ugugcagccggagccauuaccuuucua

SEQ ID NO: 66481 - RNA, 29 nt, Artificial Sequence
  Synthetic Oligonucleotide; TIGIT exon 3; Set C
gugugcagccggagccauuaccuuucuag

SEQ ID NO: 66482 - RNA, 31 nt, Artificial Sequence
  Synthetic Oligonucleotide; TIGIT exon 3; Set C
ggugugcagccggagccauuaccuuucuagu

SEQ ID NO: 66483 - RNA, 26 nt, Artificial Sequence
  Synthetic Oligonucleotide; TIGIT exon 3; Set C
ugugcagccggagccauuaccuuucu

SEQ ID NO: 66484 - RNA, 30 nt, Artificial Sequence
  Synthetic Oligonucleotide; TIGIT exon 3; Set C
ggugugcagccggagccauuaccuuucuag

SEQ ID NO: 66485 - RNA, 27 nt, Artificial Sequence
  Synthetic Oligonucleotide; TIGIT exon 3; Set C
gugugcagccggagccauuaccuuucu

SEQ ID NO: 66486 - RNA, 25 nt, Artificial Sequence
  Synthetic Oligonucleotide; TIGIT exon 3; Set C
ugugcagccggagccauuaccuuuc

SEQ ID NO: 66487 - RNA, 26 nt, Artificial Sequence
  Synthetic Oligonucleotide; TIGIT exon 3; Set C
gugugcagccggagccauuaccuuuc

SEQ ID NO: 66488 - RNA, 24 nt, Artificial Sequence
  Synthetic Oligonucleotide; TIGIT exon 3; Set C
ugugcagccggagccauuaccuuu

SEQ ID NO: 66489 - RNA, 27 nt, Artificial Sequence
  Synthetic Oligonucleotide; TIGIT exon 3; Set C
ggugugcagccggagccauuaccuuuc

SEQ ID NO: 66490 - RNA, 25 nt, Artificial Sequence
  Synthetic Oligonucleotide; TIGIT exon 3; Set C
gugugcagccggagccauuaccuuu

SEQ ID NO: 66491 - RNA, 26 nt, Artificial Sequence
  Synthetic Oligonucleotide; TIGIT exon 3; Set C
ggugugcagccggagccauuaccuuu

SEQ ID NO: 66492 - RNA, 19 nt, Artificial Sequence
  Synthetic Oligonucleotide; TIGIT exon 3; Set B
ugugcagccggagccauua

SEQ ID NO: 66493 - RNA, 20 nt, Artificial Sequence
  Synthetic Oligonucleotide; TIGIT exon 3; Set B
gugugcagccggagccauua

SEQ ID NO: 66494 - RNA, 21 nt, Artificial Sequence
  Synthetic Oligonucleotide; TIGIT exon 3; Set C
ggugugcagccggagccauua

SEQ ID NO: 66495 - RNA, 40 nt, Artificial Sequence
  Synthetic Oligonucleotide; TIGIT exon 3; Set C
gugcccaugacugcggugugcagccggagccauuaccuuu

SEQ ID NO: 66496 - RNA, 35 nt, Artificial Sequence
  Synthetic Oligonucleotide; TIGIT exon 3; Set C
gugcccaugacugcggugugcagccggagccauua

SEQ ID NO: 66497 - RNA, 36 nt, Artificial Sequence
  Synthetic Oligonucleotide; TIGIT exon 3; Set C
ggugcccaugacugcggugugcagccggagccauua

SEQ ID NO: 66498 - RNA, 37 nt, Artificial Sequence
  Synthetic Oligonucleotide; TIGIT exon 3; Set C
gggugcccaugacugcggugugcagccggagccauua

SEQ ID NO: 66499 - RNA, 38 nt, Artificial Sequence
  Synthetic Oligonucleotide; TIGIT exon 3; Set C
ggggugcccaugacugcggugugcagccggagccauua

SEQ ID NO: 66500 - RNA, 19 nt, Artificial Sequence
  Synthetic Oligonucleotide; TIGIT exon 3; Set B
gugcccaugacugcggugu

SEQ ID NO: 66501 - RNA, 20 nt, Artificial Sequence
  Synthetic Oligonucleotide; TIGIT exon 3; Set C
ggugcccaugacugcggugu

SEQ ID NO: 66502 - RNA, 18 nt, Artificial Sequence
  Synthetic Oligonucleotide; TIGIT exon 3; Set B
gugcccaugacugcggug

SEQ ID NO: 66503 - RNA, 19 nt, Artificial Sequence
  Synthetic Oligonucleotide; TIGIT exon 3; Set B
ggugcccaugacugcggug

SEQ ID NO: 66504 - RNA, 21 nt, Artificial Sequence
  Synthetic Oligonucleotide; TIGIT exon 3; Set C
gggugcccaugacugcggugu

SEQ ID NO: 66505 - RNA, 17 nt, Artificial Sequence
  Synthetic Oligonucleotide; TIGIT exon 3; Set B
gugcccaugacugcggu

SEQ ID NO: 66506 - RNA, 20 nt, Artificial Sequence
  Synthetic Oligonucleotide; TIGIT exon 3; Set C
gggugcccaugacugcggug

SEQ ID NO: 66507 - RNA, 22 nt, Artificial Sequence
  Synthetic Oligonucleotide; TIGIT exon 3; Set C
ggggugcccaugacugcggugu

SEQ ID NO: 66508 - RNA, 18 nt, Artificial Sequence
  Synthetic Oligonucleotide; TIGIT exon 3; Set B
ggugcccaugacugcggu

SEQ ID NO: 66509 - RNA, 21 nt, Artificial Sequence
  Synthetic Oligonucleotide; TIGIT exon 3; Set C
ggggugcccaugacugcggug

SEQ ID NO: 66510 - RNA, 19 nt, Artificial Sequence
  Synthetic Oligonucleotide; TIGIT exon 3; Set C
gggugcccaugacugcggu

SEQ ID NO: 66511 - RNA, 20 nt, Artificial Sequence
  Synthetic Oligonucleotide; TIGIT exon 3; Set C
ggggugcccaugacugcggu

SEQ ID NO: 66512 - RNA, 27 nt, Artificial Sequence
  Synthetic Oligonucleotide; TIGIT exon 3; Set C
acgugggggugcccaugacugcggugu

SEQ ID NO: 66513 - RNA, 26 nt, Artificial Sequence
  Synthetic Oligonucleotide; TIGIT exon 3; Set C
acgugggggugcccaugacugcggug

SEQ ID NO: 66514 - RNA, 28 nt, Artificial Sequence
  Synthetic Oligonucleotide; TIGIT exon 3; Set C
gacgugggggugcccaugacugcggugu

SEQ ID NO: 66515 - RNA, 29 nt, Artificial Sequence
  Synthetic Oligonucleotide; TIGIT exon 3; Set C
agacgugggggugcccaugacugcggugu

SEQ ID NO: 66516 - RNA, 27 nt, Artificial Sequence
  Synthetic Oligonucleotide; TIGIT exon 3; Set C
gacgugggggugcccaugacugcggug

SEQ ID NO: 66517 - RNA, 25 nt, Artificial Sequence
  Synthetic Oligonucleotide; TIGIT exon 3; Set C
acgugggggugcccaugacugcggu

SEQ ID NO: 66518 - RNA, 28 nt, Artificial Sequence
  Synthetic Oligonucleotide; TIGIT exon 3; Set C
agacgugggggugcccaugacugcggug

SEQ ID NO: 66519 - RNA, 26 nt, Artificial Sequence
  Synthetic Oligonucleotide; TIGIT exon 3; Set C
gacgugggggugcccaugacugcggu

SEQ ID NO: 66520 - RNA, 27 nt, Artificial Sequence
  Synthetic Oligonucleotide; TIGIT exon 3; Set C
agacgugggggugcccaugacugcggu

SEQ ID NO: 66521 - RNA, 16 nt, Artificial Sequence
  Synthetic Oligonucleotide; TIGIT exon 3; Set B
acgugggggugcccau

SEQ ID NO: 66522 - RNA, 17 nt, Artificial Sequence
  Synthetic Oligonucleotide; TIGIT exon 3; Set B
gacgugggggugcccau

SEQ ID NO: 66523 - RNA, 18 nt, Artificial Sequence
  Synthetic Oligonucleotide; TIGIT exon 3; Set B
agacgugggggugcccau

SEQ ID NO: 66524 - RNA, 22 nt, Artificial Sequence
  Synthetic Oligonucleotide; TIGIT exon 3; Set A
gagaugaguggcagaagccaga

SEQ ID NO: 66525 - RNA, 23 nt, Artificial Sequence
  Synthetic Oligonucleotide; TIGIT exon 3; Set A
agagaugaguggcagaagccaga

SEQ ID NO: 66526 - RNA, 24 nt, Artificial Sequence
  Synthetic Oligonucleotide; TIGIT exon 3; Set A
cagagaugaguggcagaagccaga

SEQ ID NO: 66527 - RNA, 27 nt, Artificial Sequence
  Synthetic Oligonucleotide; TIGIT exon 3; Set A
aaacagagaugaguggcagaagccaga

SEQ ID NO: 66528 - RNA, 28 nt, Artificial Sequence
  Synthetic Oligonucleotide; TIGIT exon 3; Set A
aaaacagagaugaguggcagaagccaga

SEQ ID NO: 66529 - RNA, 31 nt, Artificial Sequence
  Synthetic Oligonucleotide; TIGIT exon 3; Set A
gacaaaacagagaugaguggcagaagccaga

SEQ ID NO: 66530 - RNA, 32 nt, Artificial Sequence
  Synthetic Oligonucleotide; TIGIT exon 3; Set C
ggacaaaacagagaugaguggcagaagccaga

SEQ ID NO: 66531 - RNA, 33 nt, Artificial Sequence
  Synthetic Oligonucleotide; TIGIT exon 3; Set C
aggacaaaacagagaugaguggcagaagccaga

SEQ ID NO: 66532 - RNA, 34 nt, Artificial Sequence
  Synthetic Oligonucleotide; TIGIT exon 3; Set C
gaggacaaaacagagaugaguggcagaagccaga

SEQ ID NO: 66533 - RNA, 35 nt, Artificial Sequence
  Synthetic Oligonucleotide; TIGIT exon 3; Set C
ggaggacaaaacagagaugaguggcagaagccaga

SEQ ID NO: 66534 - RNA, 36 nt, Artificial Sequence
  Synthetic Oligonucleotide; TIGIT exon 3; Set C
gggaggacaaaacagagaugaguggcagaagccaga

SEQ ID NO: 66535 - RNA, 37 nt, Artificial Sequence
  Synthetic Oligonucleotide; TIGIT exon 3; Set C
agggaggacaaaacagagaugaguggcagaagccaga

SEQ ID NO: 66536 - RNA, 40 nt, Artificial Sequence
  Synthetic Oligonucleotide; TIGIT exon 3; Set C
uagagggaggacaaaacagagaugaguggcagaagccaga

SEQ ID NO: 66537 - RNA, 40 nt, Artificial Sequence
  Synthetic Oligonucleotide; TIGIT exon 3; Set C
ggcaccgugcucagccacuagagggaggacaaaacagaga

SEQ ID NO: 66538 - RNA, 39 nt, Artificial Sequence
  Synthetic Oligonucleotide; TIGIT exon 3; Set C
ggcaccgugcucagccacuagagggaggacaaaacagag

SEQ ID NO: 66539 - RNA, 38 nt, Artificial Sequence
  Synthetic Oligonucleotide; TIGIT exon 3; Set C
ggcaccgugcucagccacuagagggaggacaaaacaga

SEQ ID NO: 66540 - RNA, 40 nt, Artificial Sequence
  Synthetic Oligonucleotide; TIGIT exon 3; Set C
uggcaccgugcucagccacuagagggaggacaaaacagag

SEQ ID NO: 66541 - RNA, 39 nt, Artificial Sequence
  Synthetic Oligonucleotide; TIGIT exon 3; Set C
uggcaccgugcucagccacuagagggaggacaaaacaga

SEQ ID NO: 66542 - RNA, 37 nt, Artificial Sequence
  Synthetic Oligonucleotide; TIGIT exon 3; Set C
ggcaccgugcucagccacuagagggaggacaaaacag

SEQ ID NO: 66543 - RNA, 27 nt, Artificial Sequence
  Synthetic Oligonucleotide; TIGIT exon 3; Set C
cgugcucagccacuagagggaggacaa

SEQ ID NO: 66544 - RNA, 38 nt, Artificial Sequence
  Synthetic Oligonucleotide; TIGIT exon 3; Set C
uggcaccgugcucagccacuagagggaggacaaaacag

SEQ ID NO: 66545 - RNA, 26 nt, Artificial Sequence
  Synthetic Oligonucleotide; TIGIT exon 3; Set C
cgugcucagccacuagagggaggaca

SEQ ID NO: 66546 - RNA, 25 nt, Artificial Sequence
  Synthetic Oligonucleotide; TIGIT exon 3; Set C
cgugcucagccacuagagggaggac

SEQ ID NO: 66547 - RNA, 33 nt, Artificial Sequence
  Synthetic Oligonucleotide; TIGIT exon 3; Set C
ggcaccgugcucagccacuagagggaggacaaa

SEQ ID NO: 66548 - RNA, 23 nt, Artificial Sequence
  Synthetic Oligonucleotide; TIGIT exon 3; Set C
cgugcucagccacuagagggagg

SEQ ID NO: 66549 - RNA, 39 nt, Artificial Sequence
  Synthetic Oligonucleotide; TIGIT exon 3; Set C
ccuggcaccgugcucagccacuagagggaggacaaaaca

SEQ ID NO: 66550 - RNA, 34 nt, Artificial Sequence
  Synthetic Oligonucleotide; TIGIT exon 3; Set C
uggcaccgugcucagccacuagagggaggacaaa

SEQ ID NO: 66551 - RNA, 22 nt, Artificial Sequence
  Synthetic Oligonucleotide; TIGIT exon 3; Set A
cgugcucagccacuagagggag

SEQ ID NO: 66552 - RNA, 38 nt, Artificial Sequence
  Synthetic Oligonucleotide; TIGIT exon 3; Set C
ccuggcaccgugcucagccacuagagggaggacaaaac

SEQ ID NO: 66553 - RNA, 40 nt, Artificial Sequence
  Synthetic Oligonucleotide; TIGIT exon 3; Set C
accuggcaccgugcucagccacuagagggaggacaaaaca

SEQ ID NO: 66554 - RNA, 21 nt, Artificial Sequence
  Synthetic Oligonucleotide; TIGIT exon 3; Set A
cgugcucagccacuagaggga

SEQ ID NO: 66555 - RNA, 37 nt, Artificial Sequence
  Synthetic Oligonucleotide; TIGIT exon 3; Set C
ccuggcaccgugcucagccacuagagggaggacaaaa

SEQ ID NO: 66556 - RNA, 39 nt, Artificial Sequence
  Synthetic Oligonucleotide; TIGIT exon 3; Set C
accuggcaccgugcucagccacuagagggaggacaaaac

SEQ ID NO: 66557 - RNA, 36 nt, Artificial Sequence
  Synthetic Oligonucleotide; TIGIT exon 3; Set C
ccuggcaccgugcucagccacuagagggaggacaaa

SEQ ID NO: 66558 - RNA, 20 nt, Artificial Sequence
  Synthetic Oligonucleotide; TIGIT exon 3; Set A
cgugcucagccacuagaggg

SEQ ID NO: 66559 - RNA, 38 nt, Artificial Sequence
  Synthetic Oligonucleotide; TIGIT exon 3; Set C
accuggcaccgugcucagccacuagagggaggacaaaa

SEQ ID NO: 66560 - RNA, 40 nt, Artificial Sequence
  Synthetic Oligonucleotide; TIGIT exon 3; Set C
aaccuggcaccgugcucagccacuagagggaggacaaaac

SEQ ID NO: 66561 - RNA, 19 nt, Artificial Sequence
  Synthetic Oligonucleotide; TIGIT exon 3; Set A
cgugcucagccacuagagg

SEQ ID NO: 66562 - RNA, 37 nt, Artificial Sequence
  Synthetic Oligonucleotide; TIGIT exon 3; Set C
accuggcaccgugcucagccacuagagggaggacaaa

SEQ ID NO: 66563 - RNA, 39 nt, Artificial Sequence
  Synthetic Oligonucleotide; TIGIT exon 3; Set C
aaccuggcaccgugcucagccacuagagggaggacaaaa

SEQ ID NO: 66564 - RNA, 35 nt, Artificial Sequence
  Synthetic Oligonucleotide; TIGIT exon 3; Set C
ccuggcaccgugcucagccacuagagggaggacaa

SEQ ID NO: 66565 - RNA, 18 nt, Artificial Sequence
  Synthetic Oligonucleotide; TIGIT exon 3; Set A
cgugcucagccacuagag

SEQ ID NO: 66566 - RNA, 36 nt, Artificial Sequence
  Synthetic Oligonucleotide; TIGIT exon 3; Set C
accuggcaccgugcucagccacuagagggaggacaa

SEQ ID NO: 66567 - RNA, 34 nt, Artificial Sequence
  Synthetic Oligonucleotide; TIGIT exon 3; Set C
ccuggcaccgugcucagccacuagagggaggaca

SEQ ID NO: 66568 - RNA, 17 nt, Artificial Sequence
  Synthetic Oligonucleotide; TIGIT exon 3; Set A
cgugcucagccacuaga

SEQ ID NO: 66569 - RNA, 33 nt, Artificial Sequence
  Synthetic Oligonucleotide; TIGIT exon 3; Set C
ccuggcaccgugcucagccacuagagggaggac

SEQ ID NO: 66570 - RNA, 37 nt, Artificial Sequence
  Synthetic Oligonucleotide; TIGIT exon 3; Set C
aaccuggcaccgugcucagccacuagagggaggacaa

SEQ ID NO: 66571 - RNA, 35 nt, Artificial Sequence
  Synthetic Oligonucleotide; TIGIT exon 3; Set C
accuggcaccgugcucagccacuagagggaggaca

SEQ ID NO: 66572 - RNA, 32 nt, Artificial Sequence
  Synthetic Oligonucleotide; TIGIT exon 3; Set C
ccuggcaccgugcucagccacuagagggagga

SEQ ID NO: 66573 - RNA, 16 nt, Artificial Sequence
  Synthetic Oligonucleotide; TIGIT exon 3; Set C
cgugcucagccacuag

SEQ ID NO: 66574 - RNA, 34 nt, Artificial Sequence
  Synthetic Oligonucleotide; TIGIT exon 3; Set C
accuggcaccgugcucagccacuagagggaggac

SEQ ID NO: 66575 - RNA, 36 nt, Artificial Sequence
  Synthetic Oligonucleotide; TIGIT exon 3; Set C
aaccuggcaccgugcucagccacuagagggaggaca

SEQ ID NO: 66576 - RNA, 33 nt, Artificial Sequence
  Synthetic Oligonucleotide; TIGIT exon 3; Set C
accuggcaccgugcucagccacuagagggagga

SEQ ID NO: 66577 - RNA, 31 nt, Artificial Sequence
  Synthetic Oligonucleotide; TIGIT exon 3; Set C
ccuggcaccgugcucagccacuagagggagg

SEQ ID NO: 66578 - RNA, 35 nt, Artificial Sequence
  Synthetic Oligonucleotide; TIGIT exon 3; Set C
aaccuggcaccgugcucagccacuagagggaggac

SEQ ID NO: 66579 - RNA, 34 nt, Artificial Sequence
  Synthetic Oligonucleotide; TIGIT exon 3; Set C
aaccuggcaccgugcucagccacuagagggagga

SEQ ID NO: 66580 - RNA, 30 nt, Artificial Sequence
  Synthetic Oligonucleotide; TIGIT exon 3; Set C
ccuggcaccgugcucagccacuagagggag

SEQ ID NO: 66581 - RNA, 32 nt, Artificial Sequence
  Synthetic Oligonucleotide; TIGIT exon 3; Set C
accuggcaccgugcucagccacuagagggagg

SEQ ID NO: 66582 - RNA, 31 nt, Artificial Sequence
  Synthetic Oligonucleotide; TIGIT exon 3; Set C
accuggcaccgugcucagccacuagagggag

SEQ ID NO: 66583 - RNA, 33 nt, Artificial Sequence
  Synthetic Oligonucleotide; TIGIT exon 3; Set C
aaccuggcaccgugcucagccacuagagggagg

SEQ ID NO: 66584 - RNA, 29 nt, Artificial Sequence
  Synthetic Oligonucleotide; TIGIT exon 3; Set C
ccuggcaccgugcucagccacuagaggga

SEQ ID NO: 66585 - RNA, 28 nt, Artificial Sequence
  Synthetic Oligonucleotide; TIGIT exon 3; Set C
ccuggcaccgugcucagccacuagaggg

SEQ ID NO: 66586 - RNA, 32 nt, Artificial Sequence
  Synthetic Oligonucleotide; TIGIT exon 3; Set C
aaccuggcaccgugcucagccacuagagggag

SEQ ID NO: 66587 - RNA, 30 nt, Artificial Sequence
  Synthetic Oligonucleotide; TIGIT exon 3; Set C
accuggcaccgugcucagccacuagaggga

SEQ ID NO: 66588 - RNA, 27 nt, Artificial Sequence
  Synthetic Oligonucleotide; TIGIT exon 3; Set C
ccuggcaccgugcucagccacuagagg

SEQ ID NO: 66589 - RNA, 29 nt, Artificial Sequence
  Synthetic Oligonucleotide; TIGIT exon 3; Set C
accuggcaccgugcucagccacuagaggg

SEQ ID NO: 66590 - RNA, 31 nt, Artificial Sequence
  Synthetic Oligonucleotide; TIGIT exon 3; Set C
aaccuggcaccgugcucagccacuagaggga

SEQ ID NO: 66591 - RNA, 26 nt, Artificial Sequence
  Synthetic Oligonucleotide; TIGIT exon 3; Set C
ccuggcaccgugcucagccacuagag

SEQ ID NO: 66592 - RNA, 28 nt, Artificial Sequence
  Synthetic Oligonucleotide; TIGIT exon 3; Set C
accuggcaccgugcucagccacuagagg

SEQ ID NO: 66593 - RNA, 30 nt, Artificial Sequence
  Synthetic Oligonucleotide; TIGIT exon 3; Set C
aaccuggcaccgugcucagccacuagaggg

SEQ ID NO: 66594 - RNA, 27 nt, Artificial Sequence
  Synthetic Oligonucleotide; TIGIT exon 3; Set C
accuggcaccgugcucagccacuagag

SEQ ID NO: 66595 - RNA, 25 nt, Artificial Sequence
  Synthetic Oligonucleotide; TIGIT exon 3; Set C
ccuggcaccgugcucagccacuaga

SEQ ID NO: 66596 - RNA, 29 nt, Artificial Sequence
  Synthetic Oligonucleotide; TIGIT exon 3; Set C
aaccuggcaccgugcucagccacuagagg

SEQ ID NO: 66597 - RNA, 28 nt, Artificial Sequence
  Synthetic Oligonucleotide; TIGIT exon 3; Set C
aaccuggcaccgugcucagccacuagag

SEQ ID NO: 66598 - RNA, 26 nt, Artificial Sequence
  Synthetic Oligonucleotide; TIGIT exon 3; Set C
accuggcaccgugcucagccacuaga

SEQ ID NO: 66599 - RNA, 27 nt, Artificial Sequence
  Synthetic Oligonucleotide; TIGIT exon 3; Set C
aaccuggcaccgugcucagccacuaga

SEQ ID NO: 66600 - RNA, 25 nt, Artificial Sequence
  Synthetic Oligonucleotide; TIGIT exon 3; Set C
accuggcaccgugcucagccacuag

SEQ ID NO: 66601 - RNA, 26 nt, Artificial Sequence
  Synthetic Oligonucleotide; TIGIT exon 3; Set C
aaccuggcaccgugcucagccacuag

SEQ ID NO: 66602 - RNA, 15 nt, Artificial Sequence
  Synthetic Oligonucleotide; TIGIT exon 3; Set C
ggaaucuggaaccug

SEQ ID NO: 66603 - RNA, 16 nt, Artificial Sequence
  Synthetic Oligonucleotide; TIGIT exon 3; Set C
uggaaucuggaaccug

SEQ ID NO: 66604 - RNA, 17 nt, Artificial Sequence
  Synthetic Oligonucleotide; TIGIT exon 3; Set C
auggaaucuggaaccug

SEQ ID NO: 66605 - RNA, 18 nt, Artificial Sequence
  Synthetic Oligonucleotide; TIGIT exon 3; Set C
aauggaaucuggaaccug

SEQ ID NO: 66606 - RNA, 19 nt, Artificial Sequence
  Synthetic Oligonucleotide; TIGIT exon 3; Set C
caauggaaucuggaaccug

SEQ ID NO: 66607 - RNA, 20 nt, Artificial Sequence
  Synthetic Oligonucleotide; TIGIT exon 3; Set C
gcaauggaaucuggaaccug

SEQ ID NO: 66608 - RNA, 21 nt, Artificial Sequence
  Synthetic Oligonucleotide; TIGIT exon 3; Set C
agcaauggaaucuggaaccug

SEQ ID NO: 66609 - RNA, 22 nt, Artificial Sequence
  Synthetic Oligonucleotide; TIGIT exon 3; Set C
aagcaauggaaucuggaaccug

SEQ ID NO: 66610 - RNA, 39 nt, Artificial Sequence
  Synthetic Oligonucleotide; TIGIT exon 3; Set C
ccauggcuccaagcaauggaaucuggaaccuggcaccgu

SEQ ID NO: 66611 - RNA, 27 nt, Artificial Sequence
  Synthetic Oligonucleotide; TIGIT exon 3; Set A
cauggcuccaagcaauggaaucuggaa

SEQ ID NO: 66612 - RNA, 26 nt, Artificial Sequence
  Synthetic Oligonucleotide; TIGIT exon 3; Set A
cauggcuccaagcaauggaaucugga

SEQ ID NO: 66613 - RNA, 27 nt, Artificial Sequence
  Synthetic Oligonucleotide; TIGIT exon 3; Set A
ccauggcuccaagcaauggaaucugga

SEQ ID NO: 66614 - RNA, 25 nt, Artificial Sequence
  Synthetic Oligonucleotide; TIGIT exon 3; Set A
cauggcuccaagcaauggaaucugg

SEQ ID NO: 66615 - RNA, 26 nt, Artificial Sequence
  Synthetic Oligonucleotide; TIGIT exon 3; Set A
ccauggcuccaagcaauggaaucugg

SEQ ID NO: 66616 - RNA, 36 nt, Artificial Sequence
  Synthetic Oligonucleotide; TIGIT exon 3; Set C
cgcggccauggcuccaagcaauggaaucuggaaccu

SEQ ID NO: 66617 - RNA, 23 nt, Artificial Sequence
  Synthetic Oligonucleotide; TIGIT exon 3; Set A
cauggcuccaagcaauggaaucu

SEQ ID NO: 66618 - RNA, 37 nt, Artificial Sequence
  Synthetic Oligonucleotide; TIGIT exon 3; Set C
ucgcggccauggcuccaagcaauggaaucuggaaccu

SEQ ID NO: 66619 - RNA, 35 nt, Artificial Sequence
  Synthetic Oligonucleotide; TIGIT exon 3; Set C
cgcggccauggcuccaagcaauggaaucuggaacc

SEQ ID NO: 66620 - RNA, 22 nt, Artificial Sequence
  Synthetic Oligonucleotide; TIGIT exon 3; Set C
cauggcuccaagcaauggaauc

SEQ ID NO: 66621 - RNA, 34 nt, Artificial Sequence
  Synthetic Oligonucleotide; TIGIT exon 3; Set C
cgcggccauggcuccaagcaauggaaucuggaac

SEQ ID NO: 66622 - RNA, 38 nt, Artificial Sequence
  Synthetic Oligonucleotide; TIGIT exon 3; Set C
gucgcggccauggcuccaagcaauggaaucuggaaccu

SEQ ID NO: 66623 - RNA, 36 nt, Artificial Sequence
  Synthetic Oligonucleotide; TIGIT exon 3; Set C
ucgcggccauggcuccaagcaauggaaucuggaacc

SEQ ID NO: 66624 - RNA, 21 nt, Artificial Sequence
  Synthetic Oligonucleotide; TIGIT exon 3; Set C
cauggcuccaagcaauggaau

SEQ ID NO: 66625 - RNA, 35 nt, Artificial Sequence
  Synthetic Oligonucleotide; TIGIT exon 3; Set C
ucgcggccauggcuccaagcaauggaaucuggaac

SEQ ID NO: 66626 - RNA, 37 nt, Artificial Sequence
  Synthetic Oligonucleotide; TIGIT exon 3; Set C
gucgcggccauggcuccaagcaauggaaucuggaacc

SEQ ID NO: 66627 - RNA, 20 nt, Artificial Sequence
  Synthetic Oligonucleotide; TIGIT exon 3; Set C
cauggcuccaagcaauggaa

SEQ ID NO: 66628 - RNA, 22 nt, Artificial Sequence
  Synthetic Oligonucleotide; TIGIT exon 3; Set A
ccauggcuccaagcaauggaau

SEQ ID NO: 66629 - RNA, 36 nt, Artificial Sequence
  Synthetic Oligonucleotide; TIGIT exon 3; Set C
gucgcggccauggcuccaagcaauggaaucuggaac

SEQ ID NO: 66630 - RNA, 21 nt, Artificial Sequence
  Synthetic Oligonucleotide; TIGIT exon 3; Set A
ccauggcuccaagcaauggaa

SEQ ID NO: 66631 - RNA, 19 nt, Artificial Sequence
  Synthetic Oligonucleotide; TIGIT exon 3; Set C
cauggcuccaagcaaugga

SEQ ID NO: 66632 - RNA, 20 nt, Artificial Sequence
  Synthetic Oligonucleotide; TIGIT exon 3; Set A
ccauggcuccaagcaaugga

SEQ ID NO: 66633 - RNA, 18 nt, Artificial Sequence
  Synthetic Oligonucleotide; TIGIT exon 3; Set C
cauggcuccaagcaaugg

SEQ ID NO: 66634 - RNA, 17 nt, Artificial Sequence
  Synthetic Oligonucleotide; TIGIT exon 3; Set C
cauggcuccaagcaaug

SEQ ID NO: 66635 - RNA, 19 nt, Artificial Sequence
  Synthetic Oligonucleotide; TIGIT exon 3; Set C
ccauggcuccaagcaaugg

SEQ ID NO: 66636 - RNA, 18 nt, Artificial Sequence
  Synthetic Oligonucleotide; TIGIT exon 3; Set C
ccauggcuccaagcaaug

SEQ ID NO: 66637 - RNA, 17 nt, Artificial Sequence
  Synthetic Oligonucleotide; TIGIT exon 3; Set C
ccauggcuccaagcaau

SEQ ID NO: 66638 - RNA, 21 nt, Artificial Sequence
  Synthetic Oligonucleotide; TIGIT exon 3; Set C
cgcggccauggcuccaagcaa

SEQ ID NO: 66639 - RNA, 20 nt, Artificial Sequence
  Synthetic Oligonucleotide; TIGIT exon 3; Set C
cgcggccauggcuccaagca

SEQ ID NO: 66640 - RNA, 21 nt, Artificial Sequence
  Synthetic Oligonucleotide; TIGIT exon 3; Set C
ucgcggccauggcuccaagca

SEQ ID NO: 66641 - RNA, 19 nt, Artificial Sequence
  Synthetic Oligonucleotide; TIGIT exon 3; Set C
cgcggccauggcuccaagc

SEQ ID NO: 66642 - RNA, 22 nt, Artificial Sequence
  Synthetic Oligonucleotide; TIGIT exon 3; Set C
gucgcggccauggcuccaagca

SEQ ID NO: 66643 - RNA, 20 nt, Artificial Sequence
  Synthetic Oligonucleotide; TIGIT exon 3; Set C
ucgcggccauggcuccaagc

SEQ ID NO: 66644 - RNA, 21 nt, Artificial Sequence
  Synthetic Oligonucleotide; TIGIT exon 3; Set C
gucgcggccauggcuccaagc

SEQ ID NO: 66645 - RNA, 20 nt, Artificial Sequence
  Synthetic Oligonucleotide; TIGIT exon 3; Set C
gucgcggccauggcuccaag

SEQ ID NO: 66646 - RNA, 32 nt, Artificial Sequence
  Synthetic Oligonucleotide; TIGIT exon 3; Set C
ugaccaccagcgucgcggccauggcuccaagc

SEQ ID NO: 66647 - RNA, 31 nt, Artificial Sequence
  Synthetic Oligonucleotide; TIGIT exon 3; Set C
ugaccaccagcgucgcggccauggcuccaag

SEQ ID NO: 66648 - RNA, 32 nt, Artificial Sequence
  Synthetic Oligonucleotide; TIGIT exon 3; Set C
augaccaccagcgucgcggccauggcuccaag

SEQ ID NO: 66649 - RNA, 22 nt, Artificial Sequence
  Synthetic Oligonucleotide; TIGIT exon 3; Set C
ugaccaccagcgucgcggccau

SEQ ID NO: 66650 - RNA, 21 nt, Artificial Sequence
  Synthetic Oligonucleotide; TIGIT exon 3; Set C
ugaccaccagcgucgcggcca

SEQ ID NO: 66651 - RNA, 23 nt, Artificial Sequence
  Synthetic Oligonucleotide; TIGIT exon 3; Set C
augaccaccagcgucgcggccau

SEQ ID NO: 66652 - RNA, 22 nt, Artificial Sequence
  Synthetic Oligonucleotide; TIGIT exon 3; Set C
augaccaccagcgucgcggcca

SEQ ID NO: 66653 - RNA, 37 nt, Artificial Sequence
  Synthetic Oligonucleotide; TIGIT exon 3; Set C
caccacgaugacugcugugcagaugaccaccagcguc

SEQ ID NO: 66654 - RNA, 37 nt, Artificial Sequence
  Synthetic Oligonucleotide; TIGIT exon 3; Set C
gucaacgcgaccaccacgaugacugcugugcagauga

SEQ ID NO: 66655 - RNA, 36 nt, Artificial Sequence
  Synthetic Oligonucleotide; TIGIT exon 3; Set C
gucaacgcgaccaccacgaugacugcugugcagaug

SEQ ID NO: 66656 - RNA, 18 nt, Artificial Sequence
  Synthetic Oligonucleotide; TIGIT exon 3; Set B
ugugcagccggagccauu

SEQ ID NO: 66657 - RNA, 19 nt, Artificial Sequence
  Synthetic Oligonucleotide; TIGIT exon 3; Set B
gugugcagccggagccauu

SEQ ID NO: 66658 - RNA, 20 nt, Artificial Sequence
  Synthetic Oligonucleotide; TIGIT exon 3; Set C
ggugugcagccggagccauu

SEQ ID NO: 66659 - RNA, 18 nt, Artificial Sequence
  Synthetic Oligonucleotide; TIGIT exon 3; Set B
gugugcagccggagccau

SEQ ID NO: 66660 - RNA, 19 nt, Artificial Sequence
  Synthetic Oligonucleotide; TIGIT exon 3; Set C
ggugugcagccggagccau

SEQ ID NO: 66661 - RNA, 35 nt, Artificial Sequence
  Synthetic Oligonucleotide; TIGIT exon 3; Set C
ggugcccaugacugcggugugcagccggagccauu

SEQ ID NO: 66662 - RNA, 36 nt, Artificial Sequence
  Synthetic Oligonucleotide; TIGIT exon 3; Set C
gggugcccaugacugcggugugcagccggagccauu

SEQ ID NO: 66663 - RNA, 37 nt, Artificial Sequence
  Synthetic Oligonucleotide; TIGIT exon 3; Set C
ggggugcccaugacugcggugugcagccggagccauu

SEQ ID NO: 66664 - RNA, 30 nt, Artificial Sequence
  Synthetic Oligonucleotide; TIM-3 exon 4; Set A
acuuacuguuagauuuauaucagggaggcu

SEQ ID NO: 66665 - RNA, 31 nt, Artificial Sequence
  Synthetic Oligonucleotide; TIM-3 exon 4; Set A
uacuuacuguuagauuuauaucagggaggcu

SEQ ID NO: 66666 - RNA, 32 nt, Artificial Sequence
  Synthetic Oligonucleotide; TIM-3 exon 4; Set A
uuacuuacuguuagauuuauaucagggaggcu

SEQ ID NO: 66667 - RNA, 33 nt, Artificial Sequence
  Synthetic Oligonucleotide; TIM-3 exon 4; Set A
guuacuuacuguuagauuuauaucagggaggcu

SEQ ID NO: 66668 - RNA, 31 nt, Artificial Sequence
  Synthetic Oligonucleotide; TIM-3 exon 4; Set A
uuacuuacuguuagauuuauaucagggaggc

SEQ ID NO: 66669 - RNA, 32 nt, Artificial Sequence
  Synthetic Oligonucleotide; TIM-3 exon 4; Set A
guuacuuacuguuagauuuauaucagggaggc

SEQ ID NO: 66670 - RNA, 15 nt, Artificial Sequence
  Synthetic Oligonucleotide; TIM-3 exon 4; Set C
cuguuagauuuauau

SEQ ID NO: 66671 - RNA, 16 nt, Artificial Sequence
  Synthetic Oligonucleotide; TIM-3 exon 4; Set C
acuguuagauuuauau

SEQ ID NO: 66672 - RNA, 15 nt, Artificial Sequence
  Synthetic Oligonucleotide; TIM-3 exon 4; Set C
acuguuagauuuaua

SEQ ID NO: 66673 - RNA, 17 nt, Artificial Sequence
  Synthetic Oligonucleotide; TIM-3 exon 4; Set C
uacuguuagauuuauau

SEQ ID NO: 66674 - RNA, 16 nt, Artificial Sequence
  Synthetic Oligonucleotide; TIM-3 exon 4; Set C
uacuguuagauuuaua

SEQ ID NO: 66675 - RNA, 18 nt, Artificial Sequence
  Synthetic Oligonucleotide; TIM-3 exon 4; Set C
uuacuguuagauuuauau

SEQ ID NO: 66676 - RNA, 15 nt, Artificial Sequence
  Synthetic Oligonucleotide; TIM-3 exon 4; Set C
uacuguuagauuuau

SEQ ID NO: 66677 - RNA, 17 nt, Artificial Sequence
  Synthetic Oligonucleotide; TIM-3 exon 4; Set C
uuacuguuagauuuaua

SEQ ID NO: 66678 - RNA, 19 nt, Artificial Sequence
  Synthetic Oligonucleotide; TIM-3 exon 4; Set C
cuuacuguuagauuuauau

SEQ ID NO: 66679 - RNA, 16 nt, Artificial Sequence
  Synthetic Oligonucleotide; TIM-3 exon 4; Set C
uuacuguuagauuuau

SEQ ID NO: 66680 - RNA, 18 nt, Artificial Sequence
  Synthetic Oligonucleotide; TIM-3 exon 4; Set C
cuuacuguuagauuuaua

SEQ ID NO: 66681 - RNA, 20 nt, Artificial Sequence
  Synthetic Oligonucleotide; TIM-3 exon 4; Set C
acuuacuguuagauuuauau

SEQ ID NO: 66682 - RNA, 17 nt, Artificial Sequence
  Synthetic Oligonucleotide; TIM-3 exon 4; Set C
cuuacuguuagauuuau

SEQ ID NO: 66683 - RNA, 15 nt, Artificial Sequence
  Synthetic Oligonucleotide; TIM-3 exon 4; Set C
uuacuguuagauuua

SEQ ID NO: 66684 - RNA, 19 nt, Artificial Sequence
  Synthetic Oligonucleotide; TIM-3 exon 4; Set C
acuuacuguuagauuuaua

SEQ ID NO: 66685 - RNA, 21 nt, Artificial Sequence
  Synthetic Oligonucleotide; TIM-3 exon 4; Set C
uacuuacuguuagauuuauau

SEQ ID NO: 66686 - RNA, 18 nt, Artificial Sequence
  Synthetic Oligonucleotide; TIM-3 exon 4; Set C
acuuacuguuagauuuau

SEQ ID NO: 66687 - RNA, 16 nt, Artificial Sequence
  Synthetic Oligonucleotide; TIM-3 exon 4; Set C
cuuacuguuagauuua

SEQ ID NO: 66688 - RNA, 20 nt, Artificial Sequence
  Synthetic Oligonucleotide; TIM-3 exon 4; Set C
uacuuacuguuagauuuaua

SEQ ID NO: 66689 - RNA, 22 nt, Artificial Sequence
  Synthetic Oligonucleotide; TIM-3 exon 4; Set C
uuacuuacuguuagauuuauau

SEQ ID NO: 66690 - RNA, 19 nt, Artificial Sequence
  Synthetic Oligonucleotide; TIM-3 exon 4; Set C
uacuuacuguuagauuuau

SEQ ID NO: 66691 - RNA, 17 nt, Artificial Sequence
  Synthetic Oligonucleotide; TIM-3 exon 4; Set C
acuuacuguuagauuua

SEQ ID NO: 66692 - RNA, 15 nt, Artificial Sequence
  Synthetic Oligonucleotide; TIM-3 exon 4; Set C
cuuacuguuagauuu

SEQ ID NO: 66693 - RNA, 21 nt, Artificial Sequence
  Synthetic Oligonucleotide; TIM-3 exon 4; Set C
uuacuuacuguuagauuuaua

SEQ ID NO: 66694 - RNA, 23 nt, Artificial Sequence
  Synthetic Oligonucleotide; TIM-3 exon 4; Set C
guuacuuacuguuagauuuauau

SEQ ID NO: 66695 - RNA, 20 nt, Artificial Sequence
  Synthetic Oligonucleotide; TIM-3 exon 4; Set C
uuacuuacuguuagauuuau

SEQ ID NO: 66696 - RNA, 18 nt, Artificial Sequence
  Synthetic Oligonucleotide; TIM-3 exon 4; Set C
uacuuacuguuagauuua

SEQ ID NO: 66697 - RNA, 16 nt, Artificial Sequence
  Synthetic Oligonucleotide; TIM-3 exon 4; Set C
acuuacuguuagauuu

SEQ ID NO: 66698 - RNA, 22 nt, Artificial Sequence
  Synthetic Oligonucleotide; TIM-3 exon 4; Set C
guuacuuacuguuagauuuaua

SEQ ID NO: 66699 - RNA, 24 nt, Artificial Sequence
  Synthetic Oligonucleotide; TIM-3 exon 4; Set C
aguuacuuacuguuagauuuauau

SEQ ID NO: 66700 - RNA, 21 nt, Artificial Sequence
  Synthetic Oligonucleotide; TIM-3 exon 4; Set C
guuacuuacuguuagauuuau

SEQ ID NO: 66701 - RNA, 19 nt, Artificial Sequence
  Synthetic Oligonucleotide; TIM-3 exon 4; Set C
uuacuuacuguuagauuua

SEQ ID NO: 66702 - RNA, 17 nt, Artificial Sequence
  Synthetic Oligonucleotide; TIM-3 exon 4; Set C
uacuuacuguuagauuu

SEQ ID NO: 66703 - RNA, 15 nt, Artificial Sequence
  Synthetic Oligonucleotide; TIM-3 exon 4; Set C
acuuacuguuagauu

SEQ ID NO: 66704 - RNA, 23 nt, Artificial Sequence
  Synthetic Oligonucleotide; TIM-3 exon 4; Set C
aguuacuuacuguuagauuuaua

SEQ ID NO: 66705 - RNA, 25 nt, Artificial Sequence
  Synthetic Oligonucleotide; TIM-3 exon 4; Set C
aaguuacuuacuguuagauuuauau

SEQ ID NO: 66706 - RNA, 20 nt, Artificial Sequence
  Synthetic Oligonucleotide; TIM-3 exon 4; Set C
guuacuuacuguuagauuua

SEQ ID NO: 66707 - RNA, 22 nt, Artificial Sequence
  Synthetic Oligonucleotide; TIM-3 exon 4; Set C
aguuacuuacuguuagauuuau

SEQ ID NO: 66708 - RNA, 18 nt, Artificial Sequence
  Synthetic Oligonucleotide; TIM-3 exon 4; Set C
uuacuuacuguuagauuu

SEQ ID NO: 66709 - RNA, 16 nt, Artificial Sequence
  Synthetic Oligonucleotide; TIM-3 exon 4; Set C
uacuuacuguuagauu

SEQ ID NO: 66710 - RNA, 24 nt, Artificial Sequence
  Synthetic Oligonucleotide; TIM-3 exon 4; Set C
aaguuacuuacuguuagauuuaua

SEQ ID NO: 66711 - RNA, 26 nt, Artificial Sequence
  Synthetic Oligonucleotide; TIM-3 exon 4; Set C
aaaguuacuuacuguuagauuuauau

SEQ ID NO: 66712 - RNA, 21 nt, Artificial Sequence
  Synthetic Oligonucleotide; TIM-3 exon 4; Set C
aguuacuuacuguuagauuua

SEQ ID NO: 66713 - RNA, 23 nt, Artificial Sequence
  Synthetic Oligonucleotide; TIM-3 exon 4; Set C
aaguuacuuacuguuagauuuau

SEQ ID NO: 66714 - RNA, 19 nt, Artificial Sequence
  Synthetic Oligonucleotide; TIM-3 exon 4; Set C
guuacuuacuguuagauuu

SEQ ID NO: 66715 - RNA, 17 nt, Artificial Sequence
  Synthetic Oligonucleotide; TIM-3 exon 4; Set C
uuacuuacuguuagauu

SEQ ID NO: 66716 - RNA, 15 nt, Artificial Sequence
  Synthetic Oligonucleotide; TIM-3 exon 4; Set C
uacuuacuguuagau

SEQ ID NO: 66717 - RNA, 25 nt, Artificial Sequence
  Synthetic Oligonucleotide; TIM-3 exon 4; Set C
aaaguuacuuacuguuagauuuaua

SEQ ID NO: 66718 - RNA, 27 nt, Artificial Sequence
  Synthetic Oligonucleotide; TIM-3 exon 4; Set C
aaaaguuacuuacuguuagauuuauau

SEQ ID NO: 66719 - RNA, 22 nt, Artificial Sequence
  Synthetic Oligonucleotide; TIM-3 exon 4; Set C
aaguuacuuacuguuagauuua

SEQ ID NO: 66720 - RNA, 24 nt, Artificial Sequence
  Synthetic Oligonucleotide; TIM-3 exon 4; Set C
aaaguuacuuacuguuagauuuau

SEQ ID NO: 66721 - RNA, 18 nt, Artificial Sequence
  Synthetic Oligonucleotide; TIM-3 exon 4; Set C
guuacuuacuguuagauu

SEQ ID NO: 66722 - RNA, 16 nt, Artificial Sequence
  Synthetic Oligonucleotide; TIM-3 exon 4; Set C
uuacuuacuguuagau

SEQ ID NO: 66723 - RNA, 20 nt, Artificial Sequence
  Synthetic Oligonucleotide; TIM-3 exon 4; Set C
aguuacuuacuguuagauuu

SEQ ID NO: 66724 - RNA, 26 nt, Artificial Sequence
  Synthetic Oligonucleotide; TIM-3 exon 4; Set C
aaaaguuacuuacuguuagauuuaua

SEQ ID NO: 66725 - RNA, 23 nt, Artificial Sequence
  Synthetic Oligonucleotide; TIM-3 exon 4; Set C
aaaguuacuuacuguuagauuua

SEQ ID NO: 66726 - RNA, 25 nt, Artificial Sequence
  Synthetic Oligonucleotide; TIM-3 exon 4; Set C
aaaaguuacuuacuguuagauuuau

SEQ ID NO: 66727 - RNA, 15 nt, Artificial Sequence
  Synthetic Oligonucleotide; TIM-3 exon 4; Set C
uuacuuacuguuaga

SEQ ID NO: 66728 - RNA, 17 nt, Artificial Sequence
  Synthetic Oligonucleotide; TIM-3 exon 4; Set C
guuacuuacuguuagau

SEQ ID NO: 66729 - RNA, 19 nt, Artificial Sequence
  Synthetic Oligonucleotide; TIM-3 exon 4; Set C
aguuacuuacuguuagauu

SEQ ID NO: 66730 - RNA, 21 nt, Artificial Sequence
  Synthetic Oligonucleotide; TIM-3 exon 4; Set C
aaguuacuuacuguuagauuu

SEQ ID NO: 66731 - RNA, 24 nt, Artificial Sequence
  Synthetic Oligonucleotide; TIM-3 exon 4; Set C
aaaaguuacuuacuguuagauuua

SEQ ID NO: 66732 - RNA, 26 nt, Artificial Sequence
  Synthetic Oligonucleotide; TIM-3 exon 4; Set C
aaaaaguuacuuacuguuagauuuau

SEQ ID NO: 66733 - RNA, 16 nt, Artificial Sequence
  Synthetic Oligonucleotide; TIM-3 exon 4; Set C
guuacuuacuguuaga

SEQ ID NO: 66734 - RNA, 18 nt, Artificial Sequence
  Synthetic Oligonucleotide; TIM-3 exon 4; Set C
aguuacuuacuguuagau

SEQ ID NO: 66735 - RNA, 20 nt, Artificial Sequence
  Synthetic Oligonucleotide; TIM-3 exon 4; Set C
aaguuacuuacuguuagauu

SEQ ID NO: 66736 - RNA, 22 nt, Artificial Sequence
  Synthetic Oligonucleotide; TIM-3 exon 4; Set C
aaaguuacuuacuguuagauuu

SEQ ID NO: 66737 - RNA, 25 nt, Artificial Sequence
  Synthetic Oligonucleotide; TIM-3 exon 4; Set C
aaaaaguuacuuacuguuagauuua

SEQ ID NO: 66738 - RNA, 27 nt, Artificial Sequence
  Synthetic Oligonucleotide; TIM-3 exon 4; Set C
aaaaaaguuacuuacuguuagauuuau

SEQ ID NO: 66739 - RNA, 15 nt, Artificial Sequence
  Synthetic Oligonucleotide; TIM-3 exon 4; Set C
guuacuuacuguuag

SEQ ID NO: 66740 - RNA, 17 nt, Artificial Sequence
  Synthetic Oligonucleotide; TIM-3 exon 4; Set C
aguuacuuacuguuaga

SEQ ID NO: 66741 - RNA, 19 nt, Artificial Sequence
  Synthetic Oligonucleotide; TIM-3 exon 4; Set C
aaguuacuuacuguuagau

SEQ ID NO: 66742 - RNA, 21 nt, Artificial Sequence
  Synthetic Oligonucleotide; TIM-3 exon 4; Set C
aaaguuacuuacuguuagauu

SEQ ID NO: 66743 - RNA, 23 nt, Artificial Sequence
  Synthetic Oligonucleotide; TIM-3 exon 4; Set C
aaaaguuacuuacuguuagauuu

SEQ ID NO: 66744 - RNA, 26 nt, Artificial Sequence
  Synthetic Oligonucleotide; TIM-3 exon 4; Set C
aaaaaaguuacuuacuguuagauuua

SEQ ID NO: 66745 - RNA, 16 nt, Artificial Sequence
  Synthetic Oligonucleotide; TIM-3 exon 4; Set C
aguuacuuacuguuag

SEQ ID NO: 66746 - RNA, 18 nt, Artificial Sequence
  Synthetic Oligonucleotide; TIM-3 exon 4; Set C
aaguuacuuacuguuaga

SEQ ID NO: 66747 - RNA, 20 nt, Artificial Sequence
  Synthetic Oligonucleotide; TIM-3 exon 4; Set C
aaaguuacuuacuguuagau

SEQ ID NO: 66748 - RNA, 22 nt, Artificial Sequence
  Synthetic Oligonucleotide; TIM-3 exon 4; Set C
aaaaguuacuuacuguuagauu

SEQ ID NO: 66749 - RNA, 24 nt, Artificial Sequence
  Synthetic Oligonucleotide; TIM-3 exon 4; Set C
aaaaaguuacuuacuguuagauuu

SEQ ID NO: 66750 - RNA, 15 nt, Artificial Sequence
  Synthetic Oligonucleotide; TIM-3 exon 4; Set C
aguuacuuacuguua

SEQ ID NO: 66751 - RNA, 17 nt, Artificial Sequence
  Synthetic Oligonucleotide; TIM-3 exon 4; Set C
aaguuacuuacuguuag

SEQ ID NO: 66752 - RNA, 19 nt, Artificial Sequence
  Synthetic Oligonucleotide; TIM-3 exon 4; Set C
aaaguuacuuacuguuaga

SEQ ID NO: 66753 - RNA, 21 nt, Artificial Sequence
  Synthetic Oligonucleotide; TIM-3 exon 4; Set C
aaaaguuacuuacuguuagau

SEQ ID NO: 66754 - RNA, 23 nt, Artificial Sequence
  Synthetic Oligonucleotide; TIM-3 exon 4; Set C
aaaaaguuacuuacuguuagauu

SEQ ID NO: 66755 - RNA, 16 nt, Artificial Sequence
  Synthetic Oligonucleotide; TIM-3 exon 4; Set C
aaguuacuuacuguua

SEQ ID NO: 66756 - RNA, 18 nt, Artificial Sequence
  Synthetic Oligonucleotide; TIM-3 exon 4; Set C
aaaguuacuuacuguuag

SEQ ID NO: 66757 - RNA, 20 nt, Artificial Sequence
  Synthetic Oligonucleotide; TIM-3 exon 4; Set C
aaaaguuacuuacuguuaga

SEQ ID NO: 66758 - RNA, 22 nt, Artificial Sequence
  Synthetic Oligonucleotide; TIM-3 exon 4; Set C
aaaaaguuacuuacuguuagau

SEQ ID NO: 66759 - RNA, 15 nt, Artificial Sequence
  Synthetic Oligonucleotide; TIM-3 exon 4; Set C
aaguuacuuacuguu

SEQ ID NO: 66760 - RNA, 17 nt, Artificial Sequence
  Synthetic Oligonucleotide; TIM-3 exon 4; Set C
aaaguuacuuacuguua

SEQ ID NO: 66761 - RNA, 19 nt, Artificial Sequence
  Synthetic Oligonucleotide; TIM-3 exon 4; Set C
aaaaguuacuuacuguuag

SEQ ID NO: 66762 - RNA, 21 nt, Artificial Sequence
  Synthetic Oligonucleotide; TIM-3 exon 4; Set C
aaaaaguuacuuacuguuaga

SEQ ID NO: 66763 - RNA, 16 nt, Artificial Sequence
  Synthetic Oligonucleotide; TIM-3 exon 4; Set C
aaaguuacuuacuguu

SEQ ID NO: 66764 - RNA, 18 nt, Artificial Sequence
  Synthetic Oligonucleotide; TIM-3 exon 4; Set C
aaaaguuacuuacuguua

SEQ ID NO: 66765 - RNA, 20 nt, Artificial Sequence
  Synthetic Oligonucleotide; TIM-3 exon 4; Set C
aaaaaguuacuuacuguuag

SEQ ID NO: 66766 - RNA, 36 nt, Artificial Sequence
  Synthetic Oligonucleotide; TIM-3 exon 4; Set C
gcucacaaaaaaaguuacuuacuguuagauuuauau

SEQ ID NO: 66767 - RNA, 17 nt, Artificial Sequence
  Synthetic Oligonucleotide; TIM-3 exon 4; Set C
aaaaguuacuuacuguu

SEQ ID NO: 66768 - RNA, 19 nt, Artificial Sequence
  Synthetic Oligonucleotide; TIM-3 exon 4; Set C
aaaaaguuacuuacuguua

SEQ ID NO: 66769 - RNA, 15 nt, Artificial Sequence
  Synthetic Oligonucleotide; TIM-3 exon 4; Set C
aaaguuacuuacugu

SEQ ID NO: 66770 - RNA, 35 nt, Artificial Sequence
  Synthetic Oligonucleotide; TIM-3 exon 4; Set C
gcucacaaaaaaaguuacuuacuguuagauuuaua

SEQ ID NO: 66771 - RNA, 34 nt, Artificial Sequence
  Synthetic Oligonucleotide; TIM-3 exon 4; Set C
gcucacaaaaaaaguuacuuacuguuagauuuau

SEQ ID NO: 66772 - RNA, 18 nt, Artificial Sequence
  Synthetic Oligonucleotide; TIM-3 exon 4; Set C
aaaaaguuacuuacuguu

SEQ ID NO: 66773 - RNA, 20 nt, Artificial Sequence
  Synthetic Oligonucleotide; TIM-3 exon 4; Set C
aaaaaaguuacuuacuguua

SEQ ID NO: 66774 - RNA, 16 nt, Artificial Sequence
  Synthetic Oligonucleotide; TIM-3 exon 4; Set C
aaaaguuacuuacugu

SEQ ID NO: 66775 - RNA, 33 nt, Artificial Sequence
  Synthetic Oligonucleotide; TIM-3 exon 4; Set C
gcucacaaaaaaaguuacuuacuguuagauuua

SEQ ID NO: 66776 - RNA, 35 nt, Artificial Sequence
  Synthetic Oligonucleotide; TIM-3 exon 4; Set C
agcucacaaaaaaaguuacuuacuguuagauuuau

SEQ ID NO: 66777 - RNA, 19 nt, Artificial Sequence
  Synthetic Oligonucleotide; TIM-3 exon 4; Set C
aaaaaaguuacuuacuguu

SEQ ID NO: 66778 - RNA, 15 nt, Artificial Sequence
  Synthetic Oligonucleotide; TIM-3 exon 4; Set C
aaaaguuacuuacug

SEQ ID NO: 66779 - RNA, 17 nt, Artificial Sequence
  Synthetic Oligonucleotide; TIM-3 exon 4; Set C
aaaaaguuacuuacugu

SEQ ID NO: 66780 - RNA, 36 nt, Artificial Sequence
  Synthetic Oligonucleotide; TIM-3 exon 4; Set C
uagcucacaaaaaaaguuacuuacuguuagauuuau

SEQ ID NO: 66781 - RNA, 34 nt, Artificial Sequence
  Synthetic Oligonucleotide; TIM-3 exon 4; Set C
agcucacaaaaaaaguuacuuacuguuagauuua

SEQ ID NO: 66782 - RNA, 16 nt, Artificial Sequence
  Synthetic Oligonucleotide; TIM-3 exon 4; Set C
aaaaaguuacuuacug

SEQ ID NO: 66783 - RNA, 32 nt, Artificial Sequence
  Synthetic Oligonucleotide; TIM-3 exon 4; Set C
gcucacaaaaaaaguuacuuacuguuagauuu

SEQ ID NO: 66784 - RNA, 35 nt, Artificial Sequence
  Synthetic Oligonucleotide; TIM-3 exon 4; Set C
uagcucacaaaaaaaguuacuuacuguuagauuua

SEQ ID NO: 66785 - RNA, 37 nt, Artificial Sequence
  Synthetic Oligonucleotide; TIM-3 exon 4; Set C
auagcucacaaaaaaaguuacuuacuguuagauuuau

SEQ ID NO: 66786 - RNA, 15 nt, Artificial Sequence
  Synthetic Oligonucleotide; TIM-3 exon 4; Set C
aaaaaguuacuuacu

SEQ ID NO: 66787 - RNA, 31 nt, Artificial Sequence
  Synthetic Oligonucleotide; TIM-3 exon 4; Set C
gcucacaaaaaaaguuacuuacuguuagauu

SEQ ID NO: 66788 - RNA, 33 nt, Artificial Sequence
  Synthetic Oligonucleotide; TIM-3 exon 4; Set C
agcucacaaaaaaaguuacuuacuguuagauuu

SEQ ID NO: 66789 - RNA, 30 nt, Artificial Sequence
  Synthetic Oligonucleotide; TIM-3 exon 4; Set C
gcucacaaaaaaaguuacuuacuguuagau

SEQ ID NO: 66790 - RNA, 34 nt, Artificial Sequence
  Synthetic Oligonucleotide; TIM-3 exon 4; Set C
uagcucacaaaaaaaguuacuuacuguuagauuu

SEQ ID NO: 66791 - RNA, 32 nt, Artificial Sequence
  Synthetic Oligonucleotide; TIM-3 exon 4; Set C
agcucacaaaaaaaguuacuuacuguuagauu

SEQ ID NO: 66792 - RNA, 29 nt, Artificial Sequence
  Synthetic Oligonucleotide; TIM-3 exon 4; Set C
gcucacaaaaaaaguuacuuacuguuaga

SEQ ID NO: 66793 - RNA, 33 nt, Artificial Sequence
  Synthetic Oligonucleotide; TIM-3 exon 4; Set C
uagcucacaaaaaaaguuacuuacuguuagauu

SEQ ID NO: 66794 - RNA, 31 nt, Artificial Sequence
  Synthetic Oligonucleotide; TIM-3 exon 4; Set C
agcucacaaaaaaaguuacuuacuguuagau

SEQ ID NO: 66795 - RNA, 28 nt, Artificial Sequence
  Synthetic Oligonucleotide; TIM-3 exon 4; Set C
gcucacaaaaaaaguuacuuacuguuag

SEQ ID NO: 66796 - RNA, 32 nt, Artificial Sequence
  Synthetic Oligonucleotide; TIM-3 exon 4; Set C
uagcucacaaaaaaaguuacuuacuguuagau

SEQ ID NO: 66797 - RNA, 30 nt, Artificial Sequence
  Synthetic Oligonucleotide; TIM-3 exon 4; Set C
agcucacaaaaaaaguuacuuacuguuaga

SEQ ID NO: 66798 - RNA, 27 nt, Artificial Sequence
  Synthetic Oligonucleotide; TIM-3 exon 4; Set C
gcucacaaaaaaaguuacuuacuguua

SEQ ID NO: 66799 - RNA, 31 nt, Artificial Sequence
  Synthetic Oligonucleotide; TIM-3 exon 4; Set C
uagcucacaaaaaaaguuacuuacuguuaga

SEQ ID NO: 66800 - RNA, 29 nt, Artificial Sequence
  Synthetic Oligonucleotide; TIM-3 exon 4; Set C
agcucacaaaaaaaguuacuuacuguuag

SEQ ID NO: 66801 - RNA, 26 nt, Artificial Sequence
  Synthetic Oligonucleotide; TIM-3 exon 4; Set C
gcucacaaaaaaaguuacuuacuguu

SEQ ID NO: 66802 - RNA, 28 nt, Artificial Sequence
  Synthetic Oligonucleotide; TIM-3 exon 4; Set C
agcucacaaaaaaaguuacuuacuguua

SEQ ID NO: 66803 - RNA, 30 nt, Artificial Sequence
  Synthetic Oligonucleotide; TIM-3 exon 4; Set C
uagcucacaaaaaaaguuacuuacuguuag

SEQ ID NO: 66804 - RNA, 29 nt, Artificial Sequence
  Synthetic Oligonucleotide; TIM-3 exon 4; Set C
uagcucacaaaaaaaguuacuuacuguua

SEQ ID NO: 66805 - RNA, 27 nt, Artificial Sequence
  Synthetic Oligonucleotide; TIM-3 exon 4; Set C
agcucacaaaaaaaguuacuuacuguu

SEQ ID NO: 66806 - RNA, 25 nt, Artificial Sequence
  Synthetic Oligonucleotide; TIM-3 exon 4; Set C
gcucacaaaaaaaguuacuuacugu

SEQ ID NO: 66807 - RNA, 28 nt, Artificial Sequence
  Synthetic Oligonucleotide; TIM-3 exon 4; Set C
uagcucacaaaaaaaguuacuuacuguu

SEQ ID NO: 66808 - RNA, 24 nt, Artificial Sequence
  Synthetic Oligonucleotide; TIM-3 exon 4; Set C
gcucacaaaaaaaguuacuuacug

SEQ ID NO: 66809 - RNA, 26 nt, Artificial Sequence
  Synthetic Oligonucleotide; TIM-3 exon 4; Set C
agcucacaaaaaaaguuacuuacugu

SEQ ID NO: 66810 - RNA, 23 nt, Artificial Sequence
  Synthetic Oligonucleotide; TIM-3 exon 4; Set C
gcucacaaaaaaaguuacuuacu

SEQ ID NO: 66811 - RNA, 27 nt, Artificial Sequence
  Synthetic Oligonucleotide; TIM-3 exon 4; Set C
uagcucacaaaaaaaguuacuuacugu

SEQ ID NO: 66812 - RNA, 25 nt, Artificial Sequence
  Synthetic Oligonucleotide; TIM-3 exon 4; Set C
agcucacaaaaaaaguuacuuacug

SEQ ID NO: 66813 - RNA, 22 nt, Artificial Sequence
  Synthetic Oligonucleotide; TIM-3 exon 4; Set C
gcucacaaaaaaaguuacuuac

SEQ ID NO: 66814 - RNA, 26 nt, Artificial Sequence
  Synthetic Oligonucleotide; TIM-3 exon 4; Set C
uagcucacaaaaaaaguuacuuacug

SEQ ID NO: 66815 - RNA, 24 nt, Artificial Sequence
  Synthetic Oligonucleotide; TIM-3 exon 4; Set C
agcucacaaaaaaaguuacuuacu

SEQ ID NO: 66816 - RNA, 21 nt, Artificial Sequence
  Synthetic Oligonucleotide; TIM-3 exon 4; Set C
gcucacaaaaaaaguuacuua

SEQ ID NO: 66817 - RNA, 25 nt, Artificial Sequence
  Synthetic Oligonucleotide; TIM-3 exon 4; Set C
uagcucacaaaaaaaguuacuuacu

SEQ ID NO: 66818 - RNA, 24 nt, Artificial Sequence
  Synthetic Oligonucleotide; TIM-3 exon 4; Set C
uagcucacaaaaaaaguuacuuac

SEQ ID NO: 66819 - RNA, 23 nt, Artificial Sequence
  Synthetic Oligonucleotide; TIM-3 exon 4; Set C
uagcucacaaaaaaaguuacuua

SEQ ID NO: 66820 - RNA, 18 nt, Artificial Sequence
  Synthetic Oligonucleotide; TIM-3 exon 4; Set C
aaaauagccaauaguaua

SEQ ID NO: 66821 - RNA, 17 nt, Artificial Sequence
  Synthetic Oligonucleotide; TIM-3 exon 4; Set C
aaaauagccaauaguau

SEQ ID NO: 66822 - RNA, 16 nt, Artificial Sequence
  Synthetic Oligonucleotide; TIM-3 exon 4; Set C
aaaauagccaauagua

SEQ ID NO: 66823 - RNA, 15 nt, Artificial Sequence
  Synthetic Oligonucleotide; TIM-3 exon 4; Set C
aaaauagccaauagu

SEQ ID NO: 66824 - RNA, 32 nt, Artificial Sequence
  Synthetic Oligonucleotide; TIM-3 exon 4; Set C
agagagagagaggaaaaauagccaauaguaua

SEQ ID NO: 66825 - RNA, 33 nt, Artificial Sequence
  Synthetic Oligonucleotide; TIM-3 exon 4; Set A
gagagagagagaggaaaaauagccaauaguaua

SEQ ID NO: 66826 - RNA, 34 nt, Artificial Sequence
  Synthetic Oligonucleotide; TIM-3 exon 4; Set A
agagagagagagaggaaaaauagccaauaguaua

SEQ ID NO: 66827 - RNA, 32 nt, Artificial Sequence
  Synthetic Oligonucleotide; TIM-3 exon 4; Set A
gagagagagagaggaaaaauagccaauaguau

SEQ ID NO: 66828 - RNA, 35 nt, Artificial Sequence
  Synthetic Oligonucleotide; TIM-3 exon 4; Set A
gagagagagagagaggaaaaauagccaauaguaua

SEQ ID NO: 66829 - RNA, 33 nt, Artificial Sequence
  Synthetic Oligonucleotide; TIM-3 exon 4; Set A
agagagagagagaggaaaaauagccaauaguau

SEQ ID NO: 66830 - RNA, 34 nt, Artificial Sequence
  Synthetic Oligonucleotide; TIM-3 exon 4; Set A
gagagagagagagaggaaaaauagccaauaguau

SEQ ID NO: 66831 - RNA, 32 nt, Artificial Sequence
  Synthetic Oligonucleotide; TIM-3 exon 4; Set A
agagagagagagaggaaaaauagccaauagua

SEQ ID NO: 66832 - RNA, 33 nt, Artificial Sequence
  Synthetic Oligonucleotide; TIM-3 exon 4; Set A
gagagagagagagaggaaaaauagccaauagua

SEQ ID NO: 66833 - RNA, 32 nt, Artificial Sequence
  Synthetic Oligonucleotide; TIM-3 exon 4; Set A
gagagagagagagaggaaaaauagccaauagu

SEQ ID NO: 66834 - RNA, 31 nt, Artificial Sequence
  Synthetic Oligonucleotide; TIM-3 exon 4; Set C
gagagagagagagaggaaaaauagccaauag

SEQ ID NO: 66835 - RNA, 20 nt, Artificial Sequence
  Synthetic Oligonucleotide; TIM-3 exon 4; Set C
gagagagagagagaggaaaa

SEQ ID NO: 66836 - RNA, 22 nt, Artificial Sequence
  Synthetic Oligonucleotide; TIM-3 exon 4; Set C
auaaaaagagagagagagagag

SEQ ID NO: 66837 - RNA, 15 nt, Artificial Sequence
  Synthetic Oligonucleotide; TIM-3 exon 4; Set C
uauaucagggaggcu

SEQ ID NO: 66838 - RNA, 16 nt, Artificial Sequence
  Synthetic Oligonucleotide; TIM-3 exon 4; Set C
uuauaucagggaggcu

SEQ ID NO: 66839 - RNA, 17 nt, Artificial Sequence
  Synthetic Oligonucleotide; TIM-3 exon 4; Set C
uuuauaucagggaggcu

SEQ ID NO: 66840 - RNA, 15 nt, Artificial Sequence
  Synthetic Oligonucleotide; TIM-3 exon 4; Set C
uuauaucagggaggc

SEQ ID NO: 66841 - RNA, 18 nt, Artificial Sequence
  Synthetic Oligonucleotide; TIM-3 exon 4; Set C
auuuauaucagggaggcu

SEQ ID NO: 66842 - RNA, 16 nt, Artificial Sequence
  Synthetic Oligonucleotide; TIM-3 exon 4; Set C
uuuauaucagggaggc

SEQ ID NO: 66843 - RNA, 19 nt, Artificial Sequence
  Synthetic Oligonucleotide; TIM-3 exon 4; Set C
gauuuauaucagggaggcu

SEQ ID NO: 66844 - RNA, 17 nt, Artificial Sequence
  Synthetic Oligonucleotide; TIM-3 exon 4; Set C
auuuauaucagggaggc

SEQ ID NO: 66845 - RNA, 20 nt, Artificial Sequence
  Synthetic Oligonucleotide; TIM-3 exon 4; Set C
agauuuauaucagggaggcu

SEQ ID NO: 66846 - RNA, 18 nt, Artificial Sequence
  Synthetic Oligonucleotide; TIM-3 exon 4; Set C
gauuuauaucagggaggc

SEQ ID NO: 66847 - RNA, 36 nt, Artificial Sequence
  Synthetic Oligonucleotide; TIM-3 exon 4; Set C
uuacuguuagauuuauaucagggaggcuccccagug

SEQ ID NO: 66848 - RNA, 21 nt, Artificial Sequence
  Synthetic Oligonucleotide; TIM-3 exon 4; Set C
uagauuuauaucagggaggcu

SEQ ID NO: 66849 - RNA, 19 nt, Artificial Sequence
  Synthetic Oligonucleotide; TIM-3 exon 4; Set C
agauuuauaucagggaggc

SEQ ID NO: 66850 - RNA, 37 nt, Artificial Sequence
  Synthetic Oligonucleotide; TIM-3 exon 4; Set C
cuuacuguuagauuuauaucagggaggcuccccagug

SEQ ID NO: 66851 - RNA, 35 nt, Artificial Sequence
  Synthetic Oligonucleotide; TIM-3 exon 4; Set C
uuacuguuagauuuauaucagggaggcuccccagu

SEQ ID NO: 66852 - RNA, 22 nt, Artificial Sequence
  Synthetic Oligonucleotide; TIM-3 exon 4; Set C
uuagauuuauaucagggaggcu

SEQ ID NO: 66853 - RNA, 20 nt, Artificial Sequence
  Synthetic Oligonucleotide; TIM-3 exon 4; Set C
uagauuuauaucagggaggc

SEQ ID NO: 66854 - RNA, 38 nt, Artificial Sequence
  Synthetic Oligonucleotide; TIM-3 exon 4; Set C
acuuacuguuagauuuauaucagggaggcuccccagug

SEQ ID NO: 66855 - RNA, 36 nt, Artificial Sequence
  Synthetic Oligonucleotide; TIM-3 exon 4; Set C
cuuacuguuagauuuauaucagggaggcuccccagu

SEQ ID NO: 66856 - RNA, 23 nt, Artificial Sequence
  Synthetic Oligonucleotide; TIM-3 exon 4; Set C
guuagauuuauaucagggaggcu

SEQ ID NO: 66857 - RNA, 21 nt, Artificial Sequence
  Synthetic Oligonucleotide; TIM-3 exon 4; Set C
uuagauuuauaucagggaggc

SEQ ID NO: 66858 - RNA, 39 nt, Artificial Sequence
  Synthetic Oligonucleotide; TIM-3 exon 4; Set C
uacuuacuguuagauuuauaucagggaggcuccccagug

SEQ ID NO: 66859 - RNA, 37 nt, Artificial Sequence
  Synthetic Oligonucleotide; TIM-3 exon 4; Set C
acuuacuguuagauuuauaucagggaggcuccccagu

SEQ ID NO: 66860 - RNA, 24 nt, Artificial Sequence
  Synthetic Oligonucleotide; TIM-3 exon 4; Set C
uguuagauuuauaucagggaggcu

SEQ ID NO: 66861 - RNA, 22 nt, Artificial Sequence
  Synthetic Oligonucleotide; TIM-3 exon 4; Set C
guuagauuuauaucagggaggc

SEQ ID NO: 66862 - RNA, 40 nt, Artificial Sequence
  Synthetic Oligonucleotide; TIM-3 exon 4; Set C
uuacuuacuguuagauuuauaucagggaggcuccccagug

SEQ ID NO: 66863 - RNA, 38 nt, Artificial Sequence
  Synthetic Oligonucleotide; TIM-3 exon 4; Set C
uacuuacuguuagauuuauaucagggaggcuccccagu

SEQ ID NO: 66864 - RNA, 25 nt, Artificial Sequence
  Synthetic Oligonucleotide; TIM-3 exon 4; Set A
cuguuagauuuauaucagggaggcu

SEQ ID NO: 66865 - RNA, 23 nt, Artificial Sequence
  Synthetic Oligonucleotide; TIM-3 exon 4; Set C
uguuagauuuauaucagggaggc

SEQ ID NO: 66866 - RNA, 39 nt, Artificial Sequence
  Synthetic Oligonucleotide; TIM-3 exon 4; Set C
uuacuuacuguuagauuuauaucagggaggcuccccagu

SEQ ID NO: 66867 - RNA, 26 nt, Artificial Sequence
  Synthetic Oligonucleotide; TIM-3 exon 4; Set A
acuguuagauuuauaucagggaggcu

SEQ ID NO: 66868 - RNA, 24 nt, Artificial Sequence
  Synthetic Oligonucleotide; TIM-3 exon 4; Set C
cuguuagauuuauaucagggaggc

SEQ ID NO: 66869 - RNA, 40 nt, Artificial Sequence
  Synthetic Oligonucleotide; TIM-3 exon 4; Set C
guuacuuacuguuagauuuauaucagggaggcuccccagu

SEQ ID NO: 66870 - RNA, 27 nt, Artificial Sequence
  Synthetic Oligonucleotide; TIM-3 exon 4; Set A
uacuguuagauuuauaucagggaggcu

SEQ ID NO: 66871 - RNA, 25 nt, Artificial Sequence
  Synthetic Oligonucleotide; TIM-3 exon 4; Set A
acuguuagauuuauaucagggaggc

SEQ ID NO: 66872 - RNA, 28 nt, Artificial Sequence
  Synthetic Oligonucleotide; TIM-3 exon 4; Set A
uuacuguuagauuuauaucagggaggcu

SEQ ID NO: 66873 - RNA, 26 nt, Artificial Sequence
  Synthetic Oligonucleotide; TIM-3 exon 4; Set A
uacuguuagauuuauaucagggaggc

SEQ ID NO: 66874 - RNA, 29 nt, Artificial Sequence
  Synthetic Oligonucleotide; TIM-3 exon 4; Set A
cuuacuguuagauuuauaucagggaggcu

SEQ ID NO: 66875 - RNA, 27 nt, Artificial Sequence
  Synthetic Oligonucleotide; TIM-3 exon 4; Set A
uuacuguuagauuuauaucagggaggc

SEQ ID NO: 66876 - RNA, 28 nt, Artificial Sequence
  Synthetic Oligonucleotide; TIM-3 exon 4; Set A
cuuacuguuagauuuauaucagggaggc

SEQ ID NO: 66877 - RNA, 29 nt, Artificial Sequence
  Synthetic Oligonucleotide; TIM-3 exon 4; Set A
acuuacuguuagauuuauaucagggaggc

SEQ ID NO: 66878 - RNA, 15 nt, Artificial Sequence
  Synthetic Oligonucleotide; TIM-3 exon 4; Set C
guuagauuuauauca

SEQ ID NO: 66879 - RNA, 30 nt, Artificial Sequence
  Synthetic Oligonucleotide; TIM-3 exon 4; Set A
uacuuacuguuagauuuauaucagggaggc

SEQ ID NO: 66880 - RNA, 16 nt, Artificial Sequence
  Synthetic Oligonucleotide; TIM-3 exon 4; Set C
uguuagauuuauauca

SEQ ID NO: 66881 - RNA, 17 nt, Artificial Sequence
  Synthetic Oligonucleotide; TIM-3 exon 4; Set C
cuguuagauuuauauca

SEQ ID NO: 66882 - RNA, 15 nt, Artificial Sequence
  Synthetic Oligonucleotide; TIM-3 exon 4; Set C
uguuagauuuauauc

SEQ ID NO: 66883 - RNA, 34 nt, Artificial Sequence
  Synthetic Oligonucleotide; TIM-3 exon 4; Set A
aguuacuuacuguuagauuuauaucagggaggcu

SEQ ID NO: 66884 - RNA, 18 nt, Artificial Sequence
  Synthetic Oligonucleotide; TIM-3 exon 4; Set C
acuguuagauuuauauca

SEQ ID NO: 66885 - RNA, 16 nt, Artificial Sequence
  Synthetic Oligonucleotide; TIM-3 exon 4; Set C
cuguuagauuuauauc

SEQ ID NO: 66886 - RNA, 35 nt, Artificial Sequence
  Synthetic Oligonucleotide; TIM-3 exon 4; Set A
aaguuacuuacuguuagauuuauaucagggaggcu

SEQ ID NO: 66887 - RNA, 33 nt, Artificial Sequence
  Synthetic Oligonucleotide; TIM-3 exon 4; Set A
aguuacuuacuguuagauuuauaucagggaggc

SEQ ID NO: 66888 - RNA, 19 nt, Artificial Sequence
  Synthetic Oligonucleotide; TIM-3 exon 4; Set C
uacuguuagauuuauauca

SEQ ID NO: 66889 - RNA, 17 nt, Artificial Sequence
  Synthetic Oligonucleotide; TIM-3 exon 4; Set C
acuguuagauuuauauc

SEQ ID NO: 66890 - RNA, 36 nt, Artificial Sequence
  Synthetic Oligonucleotide; TIM-3 exon 4; Set A
aaaguuacuuacuguuagauuuauaucagggaggcu

SEQ ID NO: 66891 - RNA, 34 nt, Artificial Sequence
  Synthetic Oligonucleotide; TIM-3 exon 4; Set A
aaguuacuuacuguuagauuuauaucagggaggc

SEQ ID NO: 66892 - RNA, 20 nt, Artificial Sequence
  Synthetic Oligonucleotide; TIM-3 exon 4; Set C
uuacuguuagauuuauauca

SEQ ID NO: 66893 - RNA, 18 nt, Artificial Sequence
  Synthetic Oligonucleotide; TIM-3 exon 4; Set C
uacuguuagauuuauauc

SEQ ID NO: 66894 - RNA, 37 nt, Artificial Sequence
  Synthetic Oligonucleotide; TIM-3 exon 4; Set A
aaaaguuacuuacuguuagauuuauaucagggaggcu

SEQ ID NO: 66895 - RNA, 35 nt, Artificial Sequence
  Synthetic Oligonucleotide; TIM-3 exon 4; Set A
aaaguuacuuacuguuagauuuauaucagggaggc

SEQ ID NO: 66896 - RNA, 21 nt, Artificial Sequence
  Synthetic Oligonucleotide; TIM-3 exon 4; Set C
cuuacuguuagauuuauauca

SEQ ID NO: 66897 - RNA, 19 nt, Artificial Sequence
  Synthetic Oligonucleotide; TIM-3 exon 4; Set C
uuacuguuagauuuauauc

SEQ ID NO: 66898 - RNA, 38 nt, Artificial Sequence
  Synthetic Oligonucleotide; TIM-3 exon 4; Set A
aaaaaguuacuuacuguuagauuuauaucagggaggcu

SEQ ID NO: 66899 - RNA, 36 nt, Artificial Sequence
  Synthetic Oligonucleotide; TIM-3 exon 4; Set A
aaaaguuacuuacuguuagauuuauaucagggaggc

SEQ ID NO: 66900 - RNA, 20 nt, Artificial Sequence
  Synthetic Oligonucleotide; TIM-3 exon 4; Set C
cuuacuguuagauuuauauc

SEQ ID NO: 66901 - RNA, 22 nt, Artificial Sequence
  Synthetic Oligonucleotide; TIM-3 exon 4; Set C
acuuacuguuagauuuauauca

SEQ ID NO: 66902 - RNA, 39 nt, Artificial Sequence
  Synthetic Oligonucleotide; TIM-3 exon 4; Set A
aaaaaaguuacuuacuguuagauuuauaucagggaggcu

SEQ ID NO: 66903 - RNA, 37 nt, Artificial Sequence
  Synthetic Oligonucleotide; TIM-3 exon 4; Set A
aaaaaguuacuuacuguuagauuuauaucagggaggc

SEQ ID NO: 66904 - RNA, 21 nt, Artificial Sequence
  Synthetic Oligonucleotide; TIM-3 exon 4; Set C
acuuacuguuagauuuauauc

SEQ ID NO: 66905 - RNA, 23 nt, Artificial Sequence
  Synthetic Oligonucleotide; TIM-3 exon 4; Set C
uacuuacuguuagauuuauauca

SEQ ID NO: 66906 - RNA, 40 nt, Artificial Sequence
  Synthetic Oligonucleotide; TIM-3 exon 4; Set A
aaaaaaaguuacuuacuguuagauuuauaucagggaggcu

SEQ ID NO: 66907 - RNA, 38 nt, Artificial Sequence
  Synthetic Oligonucleotide; TIM-3 exon 4; Set A
aaaaaaguuacuuacuguuagauuuauaucagggaggc

SEQ ID NO: 66908 - RNA, 22 nt, Artificial Sequence
  Synthetic Oligonucleotide; TIM-3 exon 4; Set C
uacuuacuguuagauuuauauc

SEQ ID NO: 66909 - RNA, 24 nt, Artificial Sequence
  Synthetic Oligonucleotide; TIM-3 exon 4; Set C
uuacuuacuguuagauuuauauca

SEQ ID NO: 66910 - RNA, 39 nt, Artificial Sequence
  Synthetic Oligonucleotide; TIM-3 exon 4; Set A
aaaaaaaguuacuuacuguuagauuuauaucagggaggc

SEQ ID NO: 66911 - RNA, 23 nt, Artificial Sequence
  Synthetic Oligonucleotide; TIM-3 exon 4; Set C
uuacuuacuguuagauuuauauc

SEQ ID NO: 66912 - RNA, 25 nt, Artificial Sequence
  Synthetic Oligonucleotide; TIM-3 exon 4; Set C
guuacuuacuguuagauuuauauca

SEQ ID NO: 66913 - RNA, 24 nt, Artificial Sequence
  Synthetic Oligonucleotide; TIM-3 exon 4; Set C
guuacuuacuguuagauuuauauc

SEQ ID NO: 66914 - RNA, 26 nt, Artificial Sequence
  Synthetic Oligonucleotide; TIM-3 exon 4; Set C
aguuacuuacuguuagauuuauauca

SEQ ID NO: 66915 - RNA, 25 nt, Artificial Sequence
  Synthetic Oligonucleotide; TIM-3 exon 4; Set C
aguuacuuacuguuagauuuauauc

SEQ ID NO: 66916 - RNA, 27 nt, Artificial Sequence
  Synthetic Oligonucleotide; TIM-3 exon 4; Set C
aaguuacuuacuguuagauuuauauca

SEQ ID NO: 66917 - RNA, 26 nt, Artificial Sequence
  Synthetic Oligonucleotide; TIM-3 exon 4; Set C
aaguuacuuacuguuagauuuauauc

SEQ ID NO: 66918 - RNA, 28 nt, Artificial Sequence
  Synthetic Oligonucleotide; TIM-3 exon 4; Set C
aaaguuacuuacuguuagauuuauauca

SEQ ID NO: 66919 - RNA, 27 nt, Artificial Sequence
  Synthetic Oligonucleotide; TIM-3 exon 4; Set C
aaaguuacuuacuguuagauuuauauc

SEQ ID NO: 66920 - RNA, 29 nt, Artificial Sequence
  Synthetic Oligonucleotide; TIM-3 exon 4; Set C
aaaaguuacuuacuguuagauuuauauca

SEQ ID NO: 66921 - RNA, 28 nt, Artificial Sequence
  Synthetic Oligonucleotide; TIM-3 exon 4; Set C
aaaaguuacuuacuguuagauuuauauc

SEQ ID NO: 66922 - RNA, 30 nt, Artificial Sequence
  Synthetic Oligonucleotide; TIM-3 exon 4; Set C
aaaaaguuacuuacuguuagauuuauauca

SEQ ID NO: 66923 - RNA, 29 nt, Artificial Sequence
  Synthetic Oligonucleotide; TIM-3 exon 4; Set C
aaaaaguuacuuacuguuagauuuauauc

SEQ ID NO: 66924 - RNA, 28 nt, Artificial Sequence
  Synthetic Oligonucleotide; TIM-3 exon 4; Set C
aaaaaguuacuuacuguuagauuuauau

SEQ ID NO: 66925 - RNA, 27 nt, Artificial Sequence
  Synthetic Oligonucleotide; TIM-3 exon 4; Set C
aaaaaguuacuuacuguuagauuuaua

SEQ ID NO: 66926 - RNA, 29 nt, Artificial Sequence
  Synthetic Oligonucleotide; TIM-3 exon 4; Set C
aaaaaaguuacuuacuguuagauuuauau

SEQ ID NO: 66927 - RNA, 28 nt, Artificial Sequence
  Synthetic Oligonucleotide; TIM-3 exon 4; Set C
aaaaaaguuacuuacuguuagauuuaua

SEQ ID NO: 66928 - RNA, 30 nt, Artificial Sequence
  Synthetic Oligonucleotide; TIM-3 exon 4; Set C
aaaaaaaguuacuuacuguuagauuuauau

SEQ ID NO: 66929 - RNA, 29 nt, Artificial Sequence
  Synthetic Oligonucleotide; TIM-3 exon 4; Set C
aaaaaaaguuacuuacuguuagauuuaua

SEQ ID NO: 66930 - RNA, 28 nt, Artificial Sequence
  Synthetic Oligonucleotide; TIM-3 exon 4; Set C
aaaaaaaguuacuuacuguuagauuuau

SEQ ID NO: 66931 - RNA, 27 nt, Artificial Sequence
  Synthetic Oligonucleotide; TIM-3 exon 4; Set C
aaaaaaaguuacuuacuguuagauuua

SEQ ID NO: 66932 - RNA, 25 nt, Artificial Sequence
  Synthetic Oligonucleotide; TIM-3 exon 4; Set C
aaaaaaguuacuuacuguuagauuu

SEQ ID NO: 66933 - RNA, 24 nt, Artificial Sequence
  Synthetic Oligonucleotide; TIM-3 exon 4; Set C
aaaaaaguuacuuacuguuagauu

SEQ ID NO: 66934 - RNA, 26 nt, Artificial Sequence
  Synthetic Oligonucleotide; TIM-3 exon 4; Set C
aaaaaaaguuacuuacuguuagauuu

SEQ ID NO: 66935 - RNA, 38 nt, Artificial Sequence
  Synthetic Oligonucleotide; TIM-3 exon 4; Set A
gcucacaaaaaaaguuacuuacuguuagauuuauauca

SEQ ID NO: 66936 - RNA, 23 nt, Artificial Sequence
  Synthetic Oligonucleotide; TIM-3 exon 4; Set C
aaaaaaguuacuuacuguuagau

SEQ ID NO: 66937 - RNA, 25 nt, Artificial Sequence
  Synthetic Oligonucleotide; TIM-3 exon 4; Set C
aaaaaaaguuacuuacuguuagauu

SEQ ID NO: 66938 - RNA, 37 nt, Artificial Sequence
  Synthetic Oligonucleotide; TIM-3 exon 4; Set C
gcucacaaaaaaaguuacuuacuguuagauuuauauc

SEQ ID NO: 66939 - RNA, 39 nt, Artificial Sequence
  Synthetic Oligonucleotide; TIM-3 exon 4; Set A
agcucacaaaaaaaguuacuuacuguuagauuuauauca

SEQ ID NO: 66940 - RNA, 22 nt, Artificial Sequence
  Synthetic Oligonucleotide; TIM-3 exon 4; Set C
aaaaaaguuacuuacuguuaga

SEQ ID NO: 66941 - RNA, 24 nt, Artificial Sequence
  Synthetic Oligonucleotide; TIM-3 exon 4; Set C
aaaaaaaguuacuuacuguuagau

SEQ ID NO: 66942 - RNA, 40 nt, Artificial Sequence
  Synthetic Oligonucleotide; TIM-3 exon 4; Set A
uagcucacaaaaaaaguuacuuacuguuagauuuauauca

SEQ ID NO: 66943 - RNA, 38 nt, Artificial Sequence
  Synthetic Oligonucleotide; TIM-3 exon 4; Set C
agcucacaaaaaaaguuacuuacuguuagauuuauauc

SEQ ID NO: 66944 - RNA, 21 nt, Artificial Sequence
  Synthetic Oligonucleotide; TIM-3 exon 4; Set C
aaaaaaguuacuuacuguuag

SEQ ID NO: 66945 - RNA, 23 nt, Artificial Sequence
  Synthetic Oligonucleotide; TIM-3 exon 4; Set C
aaaaaaaguuacuuacuguuaga

SEQ ID NO: 66946 - RNA, 37 nt, Artificial Sequence
  Synthetic Oligonucleotide; TIM-3 exon 4; Set C
agcucacaaaaaaaguuacuuacuguuagauuuauau

SEQ ID NO: 66947 - RNA, 39 nt, Artificial Sequence
  Synthetic Oligonucleotide; TIM-3 exon 4; Set C
uagcucacaaaaaaaguuacuuacuguuagauuuauauc

SEQ ID NO: 66948 - RNA, 22 nt, Artificial Sequence
  Synthetic Oligonucleotide; TIM-3 exon 4; Set C
aaaaaaaguuacuuacuguuag

SEQ ID NO: 66949 - RNA, 36 nt, Artificial Sequence
  Synthetic Oligonucleotide; TIM-3 exon 4; Set C
agcucacaaaaaaaguuacuuacuguuagauuuaua

SEQ ID NO: 66950 - RNA, 38 nt, Artificial Sequence
  Synthetic Oligonucleotide; TIM-3 exon 4; Set C
uagcucacaaaaaaaguuacuuacuguuagauuuauau

SEQ ID NO: 66951 - RNA, 21 nt, Artificial Sequence
  Synthetic Oligonucleotide; TIM-3 exon 4; Set C
aaaaaaaguuacuuacuguua

SEQ ID NO: 66952 - RNA, 37 nt, Artificial Sequence
  Synthetic Oligonucleotide; TIM-3 exon 4; Set C
uagcucacaaaaaaaguuacuuacuguuagauuuaua

SEQ ID NO: 66953 - RNA, 39 nt, Artificial Sequence
  Synthetic Oligonucleotide; TIM-3 exon 4; Set C
auagcucacaaaaaaaguuacuuacuguuagauuuauau

SEQ ID NO: 66954 - RNA, 20 nt, Artificial Sequence
  Synthetic Oligonucleotide; TIM-3 exon 4; Set C
aaaaaaaguuacuuacuguu

SEQ ID NO: 66955 - RNA, 18 nt, Artificial Sequence
  Synthetic Oligonucleotide; TIM-3 exon 4; Set C
aaaaaaguuacuuacugu

SEQ ID NO: 66956 - RNA, 38 nt, Artificial Sequence
  Synthetic Oligonucleotide; TIM-3 exon 4; Set C
auagcucacaaaaaaaguuacuuacuguuagauuuaua

SEQ ID NO: 66957 - RNA, 17 nt, Artificial Sequence
  Synthetic Oligonucleotide; TIM-3 exon 4; Set C
aaaaaaguuacuuacug

SEQ ID NO: 66958 - RNA, 19 nt, Artificial Sequence
  Synthetic Oligonucleotide; TIM-3 exon 4; Set C
aaaaaaaguuacuuacugu

SEQ ID NO: 66959 - RNA, 36 nt, Artificial Sequence
  Synthetic Oligonucleotide; TIM-3 exon 4; Set C
auagcucacaaaaaaaguuacuuacuguuagauuua

SEQ ID NO: 66960 - RNA, 16 nt, Artificial Sequence
  Synthetic Oligonucleotide; TIM-3 exon 4; Set C
aaaaaaguuacuuacu

SEQ ID NO: 66961 - RNA, 18 nt, Artificial Sequence
  Synthetic Oligonucleotide; TIM-3 exon 4; Set C
aaaaaaaguuacuuacug

SEQ ID NO: 66962 - RNA, 15 nt, Artificial Sequence
  Synthetic Oligonucleotide; TIM-3 exon 4; Set C
aaaaaaguuacuuac

SEQ ID NO: 66963 - RNA, 17 nt, Artificial Sequence
  Synthetic Oligonucleotide; TIM-3 exon 4; Set C
aaaaaaaguuacuuacu

SEQ ID NO: 66964 - RNA, 35 nt, Artificial Sequence
  Synthetic Oligonucleotide; TIM-3 exon 4; Set C
auagcucacaaaaaaaguuacuuacuguuagauuu

SEQ ID NO: 66965 - RNA, 16 nt, Artificial Sequence
  Synthetic Oligonucleotide; TIM-3 exon 4; Set C
aaaaaaaguuacuuac

SEQ ID NO: 66966 - RNA, 34 nt, Artificial Sequence
  Synthetic Oligonucleotide; TIM-3 exon 4; Set C
auagcucacaaaaaaaguuacuuacuguuagauu

SEQ ID NO: 66967 - RNA, 15 nt, Artificial Sequence
  Synthetic Oligonucleotide; TIM-3 exon 4; Set C
aaaaaaaguuacuua

SEQ ID NO: 66968 - RNA, 33 nt, Artificial Sequence
  Synthetic Oligonucleotide; TIM-3 exon 4; Set C
auagcucacaaaaaaaguuacuuacuguuagau

SEQ ID NO: 66969 - RNA, 32 nt, Artificial Sequence
  Synthetic Oligonucleotide; TIM-3 exon 4; Set C
auagcucacaaaaaaaguuacuuacuguuaga

SEQ ID NO: 66970 - RNA, 31 nt, Artificial Sequence
  Synthetic Oligonucleotide; TIM-3 exon 4; Set C
auagcucacaaaaaaaguuacuuacuguuag

SEQ ID NO: 66971 - RNA, 30 nt, Artificial Sequence
  Synthetic Oligonucleotide; TIM-3 exon 4; Set C
auagcucacaaaaaaaguuacuuacuguua

SEQ ID NO: 66972 - RNA, 40 nt, Artificial Sequence
  Synthetic Oligonucleotide; TIM-3 exon 4; Set A
acaacauagcucacaaaaaaaguuacuuacuguuagauuu

SEQ ID NO: 66973 - RNA, 29 nt, Artificial Sequence
  Synthetic Oligonucleotide; TIM-3 exon 4; Set C
auagcucacaaaaaaaguuacuuacuguu

SEQ ID NO: 66974 - RNA, 39 nt, Artificial Sequence
  Synthetic Oligonucleotide; TIM-3 exon 4; Set A
acaacauagcucacaaaaaaaguuacuuacuguuagauu

SEQ ID NO: 66975 - RNA, 28 nt, Artificial Sequence
  Synthetic Oligonucleotide; TIM-3 exon 4; Set C
auagcucacaaaaaaaguuacuuacugu

SEQ ID NO: 66976 - RNA, 40 nt, Artificial Sequence
  Synthetic Oligonucleotide; TIM-3 exon 4; Set A
uacaacauagcucacaaaaaaaguuacuuacuguuagauu

SEQ ID NO: 66977 - RNA, 38 nt, Artificial Sequence
  Synthetic Oligonucleotide; TIM-3 exon 4; Set A
acaacauagcucacaaaaaaaguuacuuacuguuagau

SEQ ID NO: 66978 - RNA, 23 nt, Artificial Sequence
  Synthetic Oligonucleotide; TIM-3 exon 4; Set C
agcucacaaaaaaaguuacuuac

SEQ ID NO: 66979 - RNA, 27 nt, Artificial Sequence
  Synthetic Oligonucleotide; TIM-3 exon 4; Set C
auagcucacaaaaaaaguuacuuacug

SEQ ID NO: 66980 - RNA, 39 nt, Artificial Sequence
  Synthetic Oligonucleotide; TIM-3 exon 4; Set A
uacaacauagcucacaaaaaaaguuacuuacuguuagau

SEQ ID NO: 66981 - RNA, 37 nt, Artificial Sequence
  Synthetic Oligonucleotide; TIM-3 exon 4; Set A
acaacauagcucacaaaaaaaguuacuuacuguuaga

SEQ ID NO: 66982 - RNA, 20 nt, Artificial Sequence
  Synthetic Oligonucleotide; TIM-3 exon 4; Set C
gcucacaaaaaaaguuacuu

SEQ ID NO: 66983 - RNA, 22 nt, Artificial Sequence
  Synthetic Oligonucleotide; TIM-3 exon 4; Set C
agcucacaaaaaaaguuacuua

SEQ ID NO: 66984 - RNA, 26 nt, Artificial Sequence
  Synthetic Oligonucleotide; TIM-3 exon 4; Set C
auagcucacaaaaaaaguuacuuacu

SEQ ID NO: 66985 - RNA, 40 nt, Artificial Sequence
  Synthetic Oligonucleotide; TIM-3 exon 4; Set A
guacaacauagcucacaaaaaaaguuacuuacuguuagau

SEQ ID NO: 66986 - RNA, 38 nt, Artificial Sequence
  Synthetic Oligonucleotide; TIM-3 exon 4; Set A
uacaacauagcucacaaaaaaaguuacuuacuguuaga

SEQ ID NO: 66987 - RNA, 36 nt, Artificial Sequence
  Synthetic Oligonucleotide; TIM-3 exon 4; Set A
acaacauagcucacaaaaaaaguuacuuacuguuag

SEQ ID NO: 66988 - RNA, 19 nt, Artificial Sequence
  Synthetic Oligonucleotide; TIM-3 exon 4; Set C
gcucacaaaaaaaguuacu

SEQ ID NO: 66989 - RNA, 21 nt, Artificial Sequence
  Synthetic Oligonucleotide; TIM-3 exon 4; Set C
agcucacaaaaaaaguuacuu

SEQ ID NO: 66990 - RNA, 35 nt, Artificial Sequence
  Synthetic Oligonucleotide; TIM-3 exon 4; Set A
acaacauagcucacaaaaaaaguuacuuacuguua

SEQ ID NO: 66991 - RNA, 25 nt, Artificial Sequence
  Synthetic Oligonucleotide; TIM-3 exon 4; Set C
auagcucacaaaaaaaguuacuuac

SEQ ID NO: 66992 - RNA, 39 nt, Artificial Sequence
  Synthetic Oligonucleotide; TIM-3 exon 4; Set A
guacaacauagcucacaaaaaaaguuacuuacuguuaga

SEQ ID NO: 66993 - RNA, 37 nt, Artificial Sequence
  Synthetic Oligonucleotide; TIM-3 exon 4; Set A
uacaacauagcucacaaaaaaaguuacuuacuguuag

SEQ ID NO: 66994 - RNA, 18 nt, Artificial Sequence
  Synthetic Oligonucleotide; TIM-3 exon 4; Set C
gcucacaaaaaaaguuac

SEQ ID NO: 66995 - RNA, 22 nt, Artificial Sequence
  Synthetic Oligonucleotide; TIM-3 exon 4; Set C
uagcucacaaaaaaaguuacuu

SEQ ID NO: 66996 - RNA, 20 nt, Artificial Sequence
  Synthetic Oligonucleotide; TIM-3 exon 4; Set C
agcucacaaaaaaaguuacu

SEQ ID NO: 66997 - RNA, 24 nt, Artificial Sequence
  Synthetic Oligonucleotide; TIM-3 exon 4; Set C
auagcucacaaaaaaaguuacuua

SEQ ID NO: 66998 - RNA, 36 nt, Artificial Sequence
  Synthetic Oligonucleotide; TIM-3 exon 4; Set A
uacaacauagcucacaaaaaaaguuacuuacuguua

SEQ ID NO: 66999 - RNA, 34 nt, Artificial Sequence
  Synthetic Oligonucleotide; TIM-3 exon 4; Set C
acaacauagcucacaaaaaaaguuacuuacuguu

SEQ ID NO: 67000 - RNA, 38 nt, Artificial Sequence
  Synthetic Oligonucleotide; TIM-3 exon 4; Set A
guacaacauagcucacaaaaaaaguuacuuacuguuag

SEQ ID NO: 67001 - RNA, 40 nt, Artificial Sequence
  Synthetic Oligonucleotide; TIM-3 exon 4; Set A
aguacaacauagcucacaaaaaaaguuacuuacuguuaga

SEQ ID NO: 67002 - RNA, 17 nt, Artificial Sequence
  Synthetic Oligonucleotide; TIM-3 exon 4; Set C
gcucacaaaaaaaguua

SEQ ID NO: 67003 - RNA, 21 nt, Artificial Sequence
  Synthetic Oligonucleotide; TIM-3 exon 4; Set C
uagcucacaaaaaaaguuacu

SEQ ID NO: 67004 - RNA, 19 nt, Artificial Sequence
  Synthetic Oligonucleotide; TIM-3 exon 4; Set C
agcucacaaaaaaaguuac

SEQ ID NO: 67005 - RNA, 23 nt, Artificial Sequence
  Synthetic Oligonucleotide; TIM-3 exon 4; Set C
auagcucacaaaaaaaguuacuu

SEQ ID NO: 67006 - RNA, 37 nt, Artificial Sequence
  Synthetic Oligonucleotide; TIM-3 exon 4; Set A
guacaacauagcucacaaaaaaaguuacuuacuguua

SEQ ID NO: 67007 - RNA, 35 nt, Artificial Sequence
  Synthetic Oligonucleotide; TIM-3 exon 4; Set A
uacaacauagcucacaaaaaaaguuacuuacuguu

SEQ ID NO: 67008 - RNA, 33 nt, Artificial Sequence
  Synthetic Oligonucleotide; TIM-3 exon 4; Set C
acaacauagcucacaaaaaaaguuacuuacugu

SEQ ID NO: 67009 - RNA, 39 nt, Artificial Sequence
  Synthetic Oligonucleotide; TIM-3 exon 4; Set A
aguacaacauagcucacaaaaaaaguuacuuacuguuag

SEQ ID NO: 67010 - RNA, 16 nt, Artificial Sequence
  Synthetic Oligonucleotide; TIM-3 exon 4; Set C
gcucacaaaaaaaguu

SEQ ID NO: 67011 - RNA, 20 nt, Artificial Sequence
  Synthetic Oligonucleotide; TIM-3 exon 4; Set C
uagcucacaaaaaaaguuac

SEQ ID NO: 67012 - RNA, 18 nt, Artificial Sequence
  Synthetic Oligonucleotide; TIM-3 exon 4; Set C
agcucacaaaaaaaguua

SEQ ID NO: 67013 - RNA, 22 nt, Artificial Sequence
  Synthetic Oligonucleotide; TIM-3 exon 4; Set C
auagcucacaaaaaaaguuacu

SEQ ID NO: 67014 - RNA, 36 nt, Artificial Sequence
  Synthetic Oligonucleotide; TIM-3 exon 4; Set A
guacaacauagcucacaaaaaaaguuacuuacuguu

SEQ ID NO: 67015 - RNA, 38 nt, Artificial Sequence
  Synthetic Oligonucleotide; TIM-3 exon 4; Set A
aguacaacauagcucacaaaaaaaguuacuuacuguua

SEQ ID NO: 67016 - RNA, 34 nt, Artificial Sequence
  Synthetic Oligonucleotide; TIM-3 exon 4; Set A
uacaacauagcucacaaaaaaaguuacuuacugu

SEQ ID NO: 67017 - RNA, 32 nt, Artificial Sequence
  Synthetic Oligonucleotide; TIM-3 exon 4; Set C
acaacauagcucacaaaaaaaguuacuuacug

SEQ ID NO: 67018 - RNA, 19 nt, Artificial Sequence
  Synthetic Oligonucleotide; TIM-3 exon 4; Set C
uagcucacaaaaaaaguua

SEQ ID NO: 67019 - RNA, 17 nt, Artificial Sequence
  Synthetic Oligonucleotide; TIM-3 exon 4; Set C
agcucacaaaaaaaguu

SEQ ID NO: 67020 - RNA, 21 nt, Artificial Sequence
  Synthetic Oligonucleotide; TIM-3 exon 4; Set C
auagcucacaaaaaaaguuac

SEQ ID NO: 67021 - RNA, 37 nt, Artificial Sequence
  Synthetic Oligonucleotide; TIM-3 exon 4; Set A
aguacaacauagcucacaaaaaaaguuacuuacuguu

SEQ ID NO: 67022 - RNA, 35 nt, Artificial Sequence
  Synthetic Oligonucleotide; TIM-3 exon 4; Set A
guacaacauagcucacaaaaaaaguuacuuacugu

SEQ ID NO: 67023 - RNA, 33 nt, Artificial Sequence
  Synthetic Oligonucleotide; TIM-3 exon 4; Set C
uacaacauagcucacaaaaaaaguuacuuacug

SEQ ID NO: 67024 - RNA, 31 nt, Artificial Sequence
  Synthetic Oligonucleotide; TIM-3 exon 4; Set C
acaacauagcucacaaaaaaaguuacuuacu

SEQ ID NO: 67025 - RNA, 15 nt, Artificial Sequence
  Synthetic Oligonucleotide; TIM-3 exon 4; Set C
gcucacaaaaaaagu

SEQ ID NO: 67026 - RNA, 18 nt, Artificial Sequence
  Synthetic Oligonucleotide; TIM-3 exon 4; Set C
uagcucacaaaaaaaguu

SEQ ID NO: 67027 - RNA, 20 nt, Artificial Sequence
  Synthetic Oligonucleotide; TIM-3 exon 4; Set C
auagcucacaaaaaaaguua

SEQ ID NO: 67028 - RNA, 34 nt, Artificial Sequence
  Synthetic Oligonucleotide; TIM-3 exon 4; Set C
guacaacauagcucacaaaaaaaguuacuuacug

SEQ ID NO: 67029 - RNA, 36 nt, Artificial Sequence
  Synthetic Oligonucleotide; TIM-3 exon 4; Set A
aguacaacauagcucacaaaaaaaguuacuuacugu

SEQ ID NO: 67030 - RNA, 32 nt, Artificial Sequence
  Synthetic Oligonucleotide; TIM-3 exon 4; Set C
uacaacauagcucacaaaaaaaguuacuuacu

SEQ ID NO: 67031 - RNA, 30 nt, Artificial Sequence
  Synthetic Oligonucleotide; TIM-3 exon 4; Set C
acaacauagcucacaaaaaaaguuacuuac

SEQ ID NO: 67032 - RNA, 16 nt, Artificial Sequence
  Synthetic Oligonucleotide; TIM-3 exon 4; Set C
agcucacaaaaaaagu

SEQ ID NO: 67033 - RNA, 19 nt, Artificial Sequence
  Synthetic Oligonucleotide; TIM-3 exon 4; Set C
auagcucacaaaaaaaguu

SEQ ID NO: 67034 - RNA, 29 nt, Artificial Sequence
  Synthetic Oligonucleotide; TIM-3 exon 4; Set C
acaacauagcucacaaaaaaaguuacuua

SEQ ID NO: 67035 - RNA, 33 nt, Artificial Sequence
  Synthetic Oligonucleotide; TIM-3 exon 4; Set C
guacaacauagcucacaaaaaaaguuacuuacu

SEQ ID NO: 67036 - RNA, 35 nt, Artificial Sequence
  Synthetic Oligonucleotide; TIM-3 exon 4; Set A
aguacaacauagcucacaaaaaaaguuacuuacug

SEQ ID NO: 67037 - RNA, 31 nt, Artificial Sequence
  Synthetic Oligonucleotide; TIM-3 exon 4; Set C
uacaacauagcucacaaaaaaaguuacuuac

SEQ ID NO: 67038 - RNA, 17 nt, Artificial Sequence
  Synthetic Oligonucleotide; TIM-3 exon 4; Set C
uagcucacaaaaaaagu

SEQ ID NO: 67039 - RNA, 15 nt, Artificial Sequence
  Synthetic Oligonucleotide; TIM-3 exon 4; Set C
agcucacaaaaaaag

SEQ ID NO: 67040 - RNA, 30 nt, Artificial Sequence
  Synthetic Oligonucleotide; TIM-3 exon 4; Set C
uacaacauagcucacaaaaaaaguuacuua

SEQ ID NO: 67041 - RNA, 28 nt, Artificial Sequence
  Synthetic Oligonucleotide; TIM-3 exon 4; Set C
acaacauagcucacaaaaaaaguuacuu

SEQ ID NO: 67042 - RNA, 32 nt, Artificial Sequence
  Synthetic Oligonucleotide; TIM-3 exon 4; Set C
guacaacauagcucacaaaaaaaguuacuuac

SEQ ID NO: 67043 - RNA, 34 nt, Artificial Sequence
  Synthetic Oligonucleotide; TIM-3 exon 4; Set C
aguacaacauagcucacaaaaaaaguuacuuacu

SEQ ID NO: 67044 - RNA, 16 nt, Artificial Sequence
  Synthetic Oligonucleotide; TIM-3 exon 4; Set C
uagcucacaaaaaaag

SEQ ID NO: 67045 - RNA, 18 nt, Artificial Sequence
  Synthetic Oligonucleotide; TIM-3 exon 4; Set C
auagcucacaaaaaaagu

SEQ ID NO: 67046 - RNA, 31 nt, Artificial Sequence
  Synthetic Oligonucleotide; TIM-3 exon 4; Set C
guacaacauagcucacaaaaaaaguuacuua

SEQ ID NO: 67047 - RNA, 29 nt, Artificial Sequence
  Synthetic Oligonucleotide; TIM-3 exon 4; Set C
uacaacauagcucacaaaaaaaguuacuu

SEQ ID NO: 67048 - RNA, 27 nt, Artificial Sequence
  Synthetic Oligonucleotide; TIM-3 exon 4; Set C
acaacauagcucacaaaaaaaguuacu

SEQ ID NO: 67049 - RNA, 33 nt, Artificial Sequence
  Synthetic Oligonucleotide; TIM-3 exon 4; Set C
aguacaacauagcucacaaaaaaaguuacuuac

SEQ ID NO: 67050 - RNA, 15 nt, Artificial Sequence
  Synthetic Oligonucleotide; TIM-3 exon 4; Set C
uagcucacaaaaaaa

SEQ ID NO: 67051 - RNA, 17 nt, Artificial Sequence
  Synthetic Oligonucleotide; TIM-3 exon 4; Set C
auagcucacaaaaaaag

SEQ ID NO: 67052 - RNA, 30 nt, Artificial Sequence
  Synthetic Oligonucleotide; TIM-3 exon 4; Set C
guacaacauagcucacaaaaaaaguuacuu

SEQ ID NO: 67053 - RNA, 32 nt, Artificial Sequence
  Synthetic Oligonucleotide; TIM-3 exon 4; Set C
aguacaacauagcucacaaaaaaaguuacuua

SEQ ID NO: 67054 - RNA, 28 nt, Artificial Sequence
  Synthetic Oligonucleotide; TIM-3 exon 4; Set C
uacaacauagcucacaaaaaaaguuacu

SEQ ID NO: 67055 - RNA, 26 nt, Artificial Sequence
  Synthetic Oligonucleotide; TIM-3 exon 4; Set C
acaacauagcucacaaaaaaaguuac

SEQ ID NO: 67056 - RNA, 16 nt, Artificial Sequence
  Synthetic Oligonucleotide; TIM-3 exon 4; Set C
auagcucacaaaaaaa

SEQ ID NO: 67057 - RNA, 29 nt, Artificial Sequence
  Synthetic Oligonucleotide; TIM-3 exon 4; Set C
guacaacauagcucacaaaaaaaguuacu

SEQ ID NO: 67058 - RNA, 31 nt, Artificial Sequence
  Synthetic Oligonucleotide; TIM-3 exon 4; Set C
aguacaacauagcucacaaaaaaaguuacuu

SEQ ID NO: 67059 - RNA, 27 nt, Artificial Sequence
  Synthetic Oligonucleotide; TIM-3 exon 4; Set C
uacaacauagcucacaaaaaaaguuac

SEQ ID NO: 67060 - RNA, 25 nt, Artificial Sequence
  Synthetic Oligonucleotide; TIM-3 exon 4; Set C
acaacauagcucacaaaaaaaguua

SEQ ID NO: 67061 - RNA, 15 nt, Artificial Sequence
  Synthetic Oligonucleotide; TIM-3 exon 4; Set C
auagcucacaaaaaa

SEQ ID NO: 67062 - RNA, 28 nt, Artificial Sequence
  Synthetic Oligonucleotide; TIM-3 exon 4; Set C
guacaacauagcucacaaaaaaaguuac

SEQ ID NO: 67063 - RNA, 30 nt, Artificial Sequence
  Synthetic Oligonucleotide; TIM-3 exon 4; Set C
aguacaacauagcucacaaaaaaaguuacu

SEQ ID NO: 67064 - RNA, 26 nt, Artificial Sequence
  Synthetic Oligonucleotide; TIM-3 exon 4; Set C
uacaacauagcucacaaaaaaaguua

SEQ ID NO: 67065 - RNA, 27 nt, Artificial Sequence
  Synthetic Oligonucleotide; TIM-3 exon 4; Set C
guacaacauagcucacaaaaaaaguua

SEQ ID NO: 67066 - RNA, 29 nt, Artificial Sequence
  Synthetic Oligonucleotide; TIM-3 exon 4; Set C
aguacaacauagcucacaaaaaaaguuac

SEQ ID NO: 67067 - RNA, 25 nt, Artificial Sequence
  Synthetic Oligonucleotide; TIM-3 exon 4; Set C
uacaacauagcucacaaaaaaaguu

SEQ ID NO: 67068 - RNA, 26 nt, Artificial Sequence
  Synthetic Oligonucleotide; TIM-3 exon 4; Set C
guacaacauagcucacaaaaaaaguu

SEQ ID NO: 67069 - RNA, 28 nt, Artificial Sequence
  Synthetic Oligonucleotide; TIM-3 exon 4; Set C
aguacaacauagcucacaaaaaaaguua

SEQ ID NO: 67070 - RNA, 27 nt, Artificial Sequence
  Synthetic Oligonucleotide; TIM-3 exon 4; Set C
aguacaacauagcucacaaaaaaaguu

SEQ ID NO: 67071 - RNA, 25 nt, Artificial Sequence
  Synthetic Oligonucleotide; TIM-3 exon 4; Set C
guacaacauagcucacaaaaaaagu

SEQ ID NO: 67072 - RNA, 24 nt, Artificial Sequence
  Synthetic Oligonucleotide; TIM-3 exon 4; Set C
guacaacauagcucacaaaaaaag

SEQ ID NO: 67073 - RNA, 26 nt, Artificial Sequence
  Synthetic Oligonucleotide; TIM-3 exon 4; Set C
aguacaacauagcucacaaaaaaagu

SEQ ID NO: 67074 - RNA, 23 nt, Artificial Sequence
  Synthetic Oligonucleotide; TIM-3 exon 4; Set C
guacaacauagcucacaaaaaaa

SEQ ID NO: 67075 - RNA, 25 nt, Artificial Sequence
  Synthetic Oligonucleotide; TIM-3 exon 4; Set C
aguacaacauagcucacaaaaaaag

SEQ ID NO: 67076 - RNA, 22 nt, Artificial Sequence
  Synthetic Oligonucleotide; TIM-3 exon 4; Set C
guacaacauagcucacaaaaaa

SEQ ID NO: 67077 - RNA, 24 nt, Artificial Sequence
  Synthetic Oligonucleotide; TIM-3 exon 4; Set C
aguacaacauagcucacaaaaaaa

SEQ ID NO: 67078 - RNA, 23 nt, Artificial Sequence
  Synthetic Oligonucleotide; TIM-3 exon 4; Set C
aguacaacauagcucacaaaaaa

SEQ ID NO: 67079 - RNA, 25 nt, Artificial Sequence
  Synthetic Oligonucleotide; TIM-3 exon 4; Set C
gagaggaaaaauagccaauaguaua

SEQ ID NO: 67080 - RNA, 26 nt, Artificial Sequence
  Synthetic Oligonucleotide; TIM-3 exon 4; Set C
agagaggaaaaauagccaauaguaua

SEQ ID NO: 67081 - RNA, 24 nt, Artificial Sequence
  Synthetic Oligonucleotide; TIM-3 exon 4; Set C
gagaggaaaaauagccaauaguau

SEQ ID NO: 67082 - RNA, 27 nt, Artificial Sequence
  Synthetic Oligonucleotide; TIM-3 exon 4; Set C
gagagaggaaaaauagccaauaguaua

SEQ ID NO: 67083 - RNA, 25 nt, Artificial Sequence
  Synthetic Oligonucleotide; TIM-3 exon 4; Set C
agagaggaaaaauagccaauaguau

SEQ ID NO: 67084 - RNA, 28 nt, Artificial Sequence
  Synthetic Oligonucleotide; TIM-3 exon 4; Set C
agagagaggaaaaauagccaauaguaua

SEQ ID NO: 67085 - RNA, 26 nt, Artificial Sequence
  Synthetic Oligonucleotide; TIM-3 exon 4; Set C
gagagaggaaaaauagccaauaguau

SEQ ID NO: 67086 - RNA, 24 nt, Artificial Sequence
  Synthetic Oligonucleotide; TIM-3 exon 4; Set C
agagaggaaaaauagccaauagua

SEQ ID NO: 67087 - RNA, 29 nt, Artificial Sequence
  Synthetic Oligonucleotide; TIM-3 exon 4; Set C
gagagagaggaaaaauagccaauaguaua

SEQ ID NO: 67088 - RNA, 27 nt, Artificial Sequence
  Synthetic Oligonucleotide; TIM-3 exon 4; Set C
agagagaggaaaaauagccaauaguau

SEQ ID NO: 67089 - RNA, 25 nt, Artificial Sequence
  Synthetic Oligonucleotide; TIM-3 exon 4; Set C
gagagaggaaaaauagccaauagua

SEQ ID NO: 67090 - RNA, 30 nt, Artificial Sequence
  Synthetic Oligonucleotide; TIM-3 exon 4; Set C
agagagagaggaaaaauagccaauaguaua

SEQ ID NO: 67091 - RNA, 28 nt, Artificial Sequence
  Synthetic Oligonucleotide; TIM-3 exon 4; Set C
gagagagaggaaaaauagccaauaguau

SEQ ID NO: 67092 - RNA, 26 nt, Artificial Sequence
  Synthetic Oligonucleotide; TIM-3 exon 4; Set C
agagagaggaaaaauagccaauagua

SEQ ID NO: 67093 - RNA, 24 nt, Artificial Sequence
  Synthetic Oligonucleotide; TIM-3 exon 4; Set C
gagagaggaaaaauagccaauagu

SEQ ID NO: 67094 - RNA, 31 nt, Artificial Sequence
  Synthetic Oligonucleotide; TIM-3 exon 4; Set C
gagagagagaggaaaaauagccaauaguaua

SEQ ID NO: 67095 - RNA, 29 nt, Artificial Sequence
  Synthetic Oligonucleotide; TIM-3 exon 4; Set C
agagagagaggaaaaauagccaauaguau

SEQ ID NO: 67096 - RNA, 27 nt, Artificial Sequence
  Synthetic Oligonucleotide; TIM-3 exon 4; Set C
gagagagaggaaaaauagccaauagua

SEQ ID NO: 67097 - RNA, 25 nt, Artificial Sequence
  Synthetic Oligonucleotide; TIM-3 exon 4; Set C
agagagaggaaaaauagccaauagu

SEQ ID NO: 67098 - RNA, 23 nt, Artificial Sequence
  Synthetic Oligonucleotide; TIM-3 exon 4; Set C
gagagaggaaaaauagccaauag

SEQ ID NO: 67099 - RNA, 30 nt, Artificial Sequence
  Synthetic Oligonucleotide; TIM-3 exon 4; Set C
gagagagagaggaaaaauagccaauaguau

SEQ ID NO: 67100 - RNA, 28 nt, Artificial Sequence
  Synthetic Oligonucleotide; TIM-3 exon 4; Set C
agagagagaggaaaaauagccaauagua

SEQ ID NO: 67101 - RNA, 26 nt, Artificial Sequence
  Synthetic Oligonucleotide; TIM-3 exon 4; Set C
gagagagaggaaaaauagccaauagu

SEQ ID NO: 67102 - RNA, 24 nt, Artificial Sequence
  Synthetic Oligonucleotide; TIM-3 exon 4; Set C
agagagaggaaaaauagccaauag

SEQ ID NO: 67103 - RNA, 31 nt, Artificial Sequence
  Synthetic Oligonucleotide; TIM-3 exon 4; Set C
agagagagagaggaaaaauagccaauaguau

SEQ ID NO: 67104 - RNA, 29 nt, Artificial Sequence
  Synthetic Oligonucleotide; TIM-3 exon 4; Set C
gagagagagaggaaaaauagccaauagua

SEQ ID NO: 67105 - RNA, 25 nt, Artificial Sequence
  Synthetic Oligonucleotide; TIM-3 exon 4; Set C
gagagagaggaaaaauagccaauag

SEQ ID NO: 67106 - RNA, 27 nt, Artificial Sequence
  Synthetic Oligonucleotide; TIM-3 exon 4; Set C
agagagagaggaaaaauagccaauagu

SEQ ID NO: 67107 - RNA, 23 nt, Artificial Sequence
  Synthetic Oligonucleotide; TIM-3 exon 4; Set C
agagagaggaaaaauagccaaua

SEQ ID NO: 67108 - RNA, 30 nt, Artificial Sequence
  Synthetic Oligonucleotide; TIM-3 exon 4; Set C
agagagagagaggaaaaauagccaauagua

SEQ ID NO: 67109 - RNA, 24 nt, Artificial Sequence
  Synthetic Oligonucleotide; TIM-3 exon 4; Set C
gagagagaggaaaaauagccaaua

SEQ ID NO: 67110 - RNA, 26 nt, Artificial Sequence
  Synthetic Oligonucleotide; TIM-3 exon 4; Set C
agagagagaggaaaaauagccaauag

SEQ ID NO: 67111 - RNA, 28 nt, Artificial Sequence
  Synthetic Oligonucleotide; TIM-3 exon 4; Set C
gagagagagaggaaaaauagccaauagu

SEQ ID NO: 67112 - RNA, 31 nt, Artificial Sequence
  Synthetic Oligonucleotide; TIM-3 exon 4; Set A
gagagagagagaggaaaaauagccaauagua

SEQ ID NO: 67113 - RNA, 25 nt, Artificial Sequence
  Synthetic Oligonucleotide; TIM-3 exon 4; Set C
agagagagaggaaaaauagccaaua

SEQ ID NO: 67114 - RNA, 29 nt, Artificial Sequence
  Synthetic Oligonucleotide; TIM-3 exon 4; Set C
agagagagagaggaaaaauagccaauagu

SEQ ID NO: 67115 - RNA, 27 nt, Artificial Sequence
  Synthetic Oligonucleotide; TIM-3 exon 4; Set C
gagagagagaggaaaaauagccaauag

SEQ ID NO: 67116 - RNA, 23 nt, Artificial Sequence
  Synthetic Oligonucleotide; TIM-3 exon 4; Set C
gagagagaggaaaaauagccaau

SEQ ID NO: 67117 - RNA, 30 nt, Artificial Sequence
  Synthetic Oligonucleotide; TIM-3 exon 4; Set C
gagagagagagaggaaaaauagccaauagu

SEQ ID NO: 67118 - RNA, 28 nt, Artificial Sequence
  Synthetic Oligonucleotide; TIM-3 exon 4; Set C
agagagagagaggaaaaauagccaauag

SEQ ID NO: 67119 - RNA, 26 nt, Artificial Sequence
  Synthetic Oligonucleotide; TIM-3 exon 4; Set C
gagagagagaggaaaaauagccaaua

SEQ ID NO: 67120 - RNA, 24 nt, Artificial Sequence
  Synthetic Oligonucleotide; TIM-3 exon 4; Set C
agagagagaggaaaaauagccaau

SEQ ID NO: 67121 - RNA, 31 nt, Artificial Sequence
  Synthetic Oligonucleotide; TIM-3 exon 4; Set C
agagagagagagaggaaaaauagccaauagu

SEQ ID NO: 67122 - RNA, 29 nt, Artificial Sequence
  Synthetic Oligonucleotide; TIM-3 exon 4; Set C
gagagagagagaggaaaaauagccaauag

SEQ ID NO: 67123 - RNA, 27 nt, Artificial Sequence
  Synthetic Oligonucleotide; TIM-3 exon 4; Set C
agagagagagaggaaaaauagccaaua

SEQ ID NO: 67124 - RNA, 25 nt, Artificial Sequence
  Synthetic Oligonucleotide; TIM-3 exon 4; Set C
gagagagagaggaaaaauagccaau

SEQ ID NO: 67125 - RNA, 30 nt, Artificial Sequence
  Synthetic Oligonucleotide; TIM-3 exon 4; Set C
agagagagagagaggaaaaauagccaauag

SEQ ID NO: 67126 - RNA, 28 nt, Artificial Sequence
  Synthetic Oligonucleotide; TIM-3 exon 4; Set C
gagagagagagaggaaaaauagccaaua

SEQ ID NO: 67127 - RNA, 26 nt, Artificial Sequence
  Synthetic Oligonucleotide; TIM-3 exon 4; Set C
agagagagagaggaaaaauagccaau

SEQ ID NO: 67128 - RNA, 29 nt, Artificial Sequence
  Synthetic Oligonucleotide; TIM-3 exon 4; Set C
agagagagagagaggaaaaauagccaaua

SEQ ID NO: 67129 - RNA, 27 nt, Artificial Sequence
  Synthetic Oligonucleotide; TIM-3 exon 4; Set C
gagagagagagaggaaaaauagccaau

SEQ ID NO: 67130 - RNA, 30 nt, Artificial Sequence
  Synthetic Oligonucleotide; TIM-3 exon 4; Set C
gagagagagagagaggaaaaauagccaaua

SEQ ID NO: 67131 - RNA, 28 nt, Artificial Sequence
  Synthetic Oligonucleotide; TIM-3 exon 4; Set C
agagagagagagaggaaaaauagccaau

SEQ ID NO: 67132 - RNA, 29 nt, Artificial Sequence
  Synthetic Oligonucleotide; TIM-3 exon 4; Set C
gagagagagagagaggaaaaauagccaau

SEQ ID NO: 67133 - RNA, 15 nt, Artificial Sequence
  Synthetic Oligonucleotide; TIM-3 exon 4; Set C
agagagagaggaaaa

SEQ ID NO: 67134 - RNA, 16 nt, Artificial Sequence
  Synthetic Oligonucleotide; TIM-3 exon 4; Set C
gagagagagaggaaaa

SEQ ID NO: 67135 - RNA, 17 nt, Artificial Sequence
  Synthetic Oligonucleotide; TIM-3 exon 4; Set C
agagagagagaggaaaa

SEQ ID NO: 67136 - RNA, 18 nt, Artificial Sequence
  Synthetic Oligonucleotide; TIM-3 exon 4; Set C
gagagagagagaggaaaa

SEQ ID NO: 67137 - RNA, 19 nt, Artificial Sequence
  Synthetic Oligonucleotide; TIM-3 exon 4; Set C
agagagagagagaggaaaa

SEQ ID NO: 67138 - RNA, 40 nt, Artificial Sequence
  Synthetic Oligonucleotide; TIM-3 exon 4; Set A
aaaagagagagagagagagagagaggaaaaauagccaaua

SEQ ID NO: 67139 - RNA, 39 nt, Artificial Sequence
  Synthetic Oligonucleotide; TIM-3 exon 4; Set A
aaaagagagagagagagagagagaggaaaaauagccaau

SEQ ID NO: 67140 - RNA, 40 nt, Artificial Sequence
  Synthetic Oligonucleotide; TIM-3 exon 4; Set A
aaaaagagagagagagagagagagaggaaaaauagccaau

SEQ ID NO: 67141 - RNA, 30 nt, Artificial Sequence
  Synthetic Oligonucleotide; TIM-3 exon 4; Set C
aaaagagagagagagagagagagaggaaaa

SEQ ID NO: 67142 - RNA, 31 nt, Artificial Sequence
  Synthetic Oligonucleotide; TIM-3 exon 4; Set C
aaaaagagagagagagagagagagaggaaaa

SEQ ID NO: 67143 - RNA, 32 nt, Artificial Sequence
  Synthetic Oligonucleotide; TIM-3 exon 4; Set C
uaaaaagagagagagagagagagagaggaaaa

SEQ ID NO: 67144 - RNA, 33 nt, Artificial Sequence
  Synthetic Oligonucleotide; TIM-3 exon 4; Set C
auaaaaagagagagagagagagagagaggaaaa

SEQ ID NO: 67145 - RNA, 23 nt, Artificial Sequence
  Synthetic Oligonucleotide; TIM-3 exon 4; Set C
aaaagagagagagagagagagag

SEQ ID NO: 67146 - RNA, 22 nt, Artificial Sequence
  Synthetic Oligonucleotide; TIM-3 exon 4; Set C
aaaagagagagagagagagaga

SEQ ID NO: 67147 - RNA, 24 nt, Artificial Sequence
  Synthetic Oligonucleotide; TIM-3 exon 4; Set C
aaaaagagagagagagagagagag

SEQ ID NO: 67148 - RNA, 21 nt, Artificial Sequence
  Synthetic Oligonucleotide; TIM-3 exon 4; Set C
aaaagagagagagagagagag

SEQ ID NO: 67149 - RNA, 23 nt, Artificial Sequence
  Synthetic Oligonucleotide; TIM-3 exon 4; Set C
aaaaagagagagagagagagaga

SEQ ID NO: 67150 - RNA, 25 nt, Artificial Sequence
  Synthetic Oligonucleotide; TIM-3 exon 4; Set C
uaaaaagagagagagagagagagag

SEQ ID NO: 67151 - RNA, 20 nt, Artificial Sequence
  Synthetic Oligonucleotide; TIM-3 exon 4; Set C
aaaagagagagagagagaga

SEQ ID NO: 67152 - RNA, 22 nt, Artificial Sequence
  Synthetic Oligonucleotide; TIM-3 exon 4; Set C
aaaaagagagagagagagagag

SEQ ID NO: 67153 - RNA, 24 nt, Artificial Sequence
  Synthetic Oligonucleotide; TIM-3 exon 4; Set C
uaaaaagagagagagagagagaga

SEQ ID NO: 67154 - RNA, 26 nt, Artificial Sequence
  Synthetic Oligonucleotide; TIM-3 exon 4; Set C
auaaaaagagagagagagagagagag

SEQ ID NO: 67155 - RNA, 19 nt, Artificial Sequence
  Synthetic Oligonucleotide; TIM-3 exon 4; Set C
aaaagagagagagagagag

SEQ ID NO: 67156 - RNA, 21 nt, Artificial Sequence
  Synthetic Oligonucleotide; TIM-3 exon 4; Set C
aaaaagagagagagagagaga

SEQ ID NO: 67157 - RNA, 23 nt, Artificial Sequence
  Synthetic Oligonucleotide; TIM-3 exon 4; Set C
uaaaaagagagagagagagagag

SEQ ID NO: 67158 - RNA, 25 nt, Artificial Sequence
  Synthetic Oligonucleotide; TIM-3 exon 4; Set C
auaaaaagagagagagagagagaga

SEQ ID NO: 67159 - RNA, 20 nt, Artificial Sequence
  Synthetic Oligonucleotide; TIM-3 exon 4; Set C
aaaaagagagagagagagag

SEQ ID NO: 67160 - RNA, 18 nt, Artificial Sequence
  Synthetic Oligonucleotide; TIM-3 exon 4; Set C
aaaagagagagagagaga

SEQ ID NO: 67161 - RNA, 22 nt, Artificial Sequence
  Synthetic Oligonucleotide; TIM-3 exon 4; Set C
uaaaaagagagagagagagaga

SEQ ID NO: 67162 - RNA, 24 nt, Artificial Sequence
  Synthetic Oligonucleotide; TIM-3 exon 4; Set C
auaaaaagagagagagagagagag

SEQ ID NO: 67163 - RNA, 21 nt, Artificial Sequence
  Synthetic Oligonucleotide; TIM-3 exon 4; Set C
uaaaaagagagagagagagag

SEQ ID NO: 67164 - RNA, 19 nt, Artificial Sequence
  Synthetic Oligonucleotide; TIM-3 exon 4; Set C
aaaaagagagagagagaga

SEQ ID NO: 67165 - RNA, 17 nt, Artificial Sequence
  Synthetic Oligonucleotide; TIM-3 exon 4; Set C
aaaagagagagagagag

SEQ ID NO: 67166 - RNA, 23 nt, Artificial Sequence
  Synthetic Oligonucleotide; TIM-3 exon 4; Set C
auaaaaagagagagagagagaga

SEQ ID NO: 67167 - RNA, 20 nt, Artificial Sequence
  Synthetic Oligonucleotide; TIM-3 exon 4; Set C
uaaaaagagagagagagaga

SEQ ID NO: 67168 - RNA, 16 nt, Artificial Sequence
  Synthetic Oligonucleotide; TIM-3 exon 4; Set C
aaaagagagagagaga

SEQ ID NO: 67169 - RNA, 18 nt, Artificial Sequence
  Synthetic Oligonucleotide; TIM-3 exon 4; Set C
aaaaagagagagagagag

SEQ ID NO: 67170 - RNA, 15 nt, Artificial Sequence
  Synthetic Oligonucleotide; TIM-3 exon 4; Set C
aaaagagagagagag

SEQ ID NO: 67171 - RNA, 21 nt, Artificial Sequence
  Synthetic Oligonucleotide; TIM-3 exon 4; Set C
auaaaaagagagagagagaga

SEQ ID NO: 67172 - RNA, 17 nt, Artificial Sequence
  Synthetic Oligonucleotide; TIM-3 exon 4; Set C
aaaaagagagagagaga

SEQ ID NO: 67173 - RNA, 19 nt, Artificial Sequence
  Synthetic Oligonucleotide; TIM-3 exon 4; Set C
uaaaaagagagagagagag

SEQ ID NO: 67174 - RNA, 16 nt, Artificial Sequence
  Synthetic Oligonucleotide; TIM-3 exon 4; Set C
aaaaagagagagagag

SEQ ID NO: 67175 - RNA, 18 nt, Artificial Sequence
  Synthetic Oligonucleotide; TIM-3 exon 4; Set C
uaaaaagagagagagaga

SEQ ID NO: 67176 - RNA, 20 nt, Artificial Sequence
  Synthetic Oligonucleotide; TIM-3 exon 4; Set C
auaaaaagagagagagagag

SEQ ID NO: 67177 - RNA, 15 nt, Artificial Sequence
  Synthetic Oligonucleotide; TIM-3 exon 4; Set C
aaaaagagagagaga

SEQ ID NO: 67178 - RNA, 17 nt, Artificial Sequence
  Synthetic Oligonucleotide; TIM-3 exon 4; Set C
uaaaaagagagagagag

SEQ ID NO: 67179 - RNA, 19 nt, Artificial Sequence
  Synthetic Oligonucleotide; TIM-3 exon 4; Set C
auaaaaagagagagagaga

SEQ ID NO: 67180 - RNA, 16 nt, Artificial Sequence
  Synthetic Oligonucleotide; TIM-3 exon 4; Set C
uaaaaagagagagaga

SEQ ID NO: 67181 - RNA, 18 nt, Artificial Sequence
  Synthetic Oligonucleotide; TIM-3 exon 4; Set C
auaaaaagagagagagag

SEQ ID NO: 67182 - RNA, 15 nt, Artificial Sequence
  Synthetic Oligonucleotide; TIM-3 exon 4; Set C
uaaaaagagagagag

SEQ ID NO: 67183 - RNA, 17 nt, Artificial Sequence
  Synthetic Oligonucleotide; TIM-3 exon 4; Set C
auaaaaagagagagaga

SEQ ID NO: 67184 - RNA, 16 nt, Artificial Sequence
  Synthetic Oligonucleotide; TIM-3 exon 4; Set C
auaaaaagagagagag

SEQ ID NO: 67185 - RNA, 23 nt, Artificial Sequence
  Synthetic Oligonucleotide; TIM-3 exon 4; Set A
uauaucagggaggcuccccagug

SEQ ID NO: 67186 - RNA, 24 nt, Artificial Sequence
  Synthetic Oligonucleotide; TIM-3 exon 4; Set A
uuauaucagggaggcuccccagug

SEQ ID NO: 67187 - RNA, 22 nt, Artificial Sequence
  Synthetic Oligonucleotide; TIM-3 exon 4; Set A
uauaucagggaggcuccccagu

SEQ ID NO: 67188 - RNA, 25 nt, Artificial Sequence
  Synthetic Oligonucleotide; TIM-3 exon 4; Set A
uuuauaucagggaggcuccccagug

SEQ ID NO: 67189 - RNA, 23 nt, Artificial Sequence
  Synthetic Oligonucleotide; TIM-3 exon 4; Set A
uuauaucagggaggcuccccagu

SEQ ID NO: 67190 - RNA, 26 nt, Artificial Sequence
  Synthetic Oligonucleotide; TIM-3 exon 4; Set A
auuuauaucagggaggcuccccagug

SEQ ID NO: 67191 - RNA, 24 nt, Artificial Sequence
  Synthetic Oligonucleotide; TIM-3 exon 4; Set A
uuuauaucagggaggcuccccagu

SEQ ID NO: 67192 - RNA, 27 nt, Artificial Sequence
  Synthetic Oligonucleotide; TIM-3 exon 4; Set A
gauuuauaucagggaggcuccccagug

SEQ ID NO: 67193 - RNA, 25 nt, Artificial Sequence
  Synthetic Oligonucleotide; TIM-3 exon 4; Set A
auuuauaucagggaggcuccccagu

SEQ ID NO: 67194 - RNA, 28 nt, Artificial Sequence
  Synthetic Oligonucleotide; TIM-3 exon 4; Set A
agauuuauaucagggaggcuccccagug

SEQ ID NO: 67195 - RNA, 26 nt, Artificial Sequence
  Synthetic Oligonucleotide; TIM-3 exon 4; Set C
gauuuauaucagggaggcuccccagu

SEQ ID NO: 67196 - RNA, 29 nt, Artificial Sequence
  Synthetic Oligonucleotide; TIM-3 exon 4; Set C
uagauuuauaucagggaggcuccccagug

SEQ ID NO: 67197 - RNA, 27 nt, Artificial Sequence
  Synthetic Oligonucleotide; TIM-3 exon 4; Set A
agauuuauaucagggaggcuccccagu

SEQ ID NO: 67198 - RNA, 30 nt, Artificial Sequence
  Synthetic Oligonucleotide; TIM-3 exon 4; Set C
uuagauuuauaucagggaggcuccccagug

SEQ ID NO: 67199 - RNA, 28 nt, Artificial Sequence
  Synthetic Oligonucleotide; TIM-3 exon 4; Set C
uagauuuauaucagggaggcuccccagu

SEQ ID NO: 67200 - RNA, 31 nt, Artificial Sequence
  Synthetic Oligonucleotide; TIM-3 exon 4; Set C
guuagauuuauaucagggaggcuccccagug

SEQ ID NO: 67201 - RNA, 29 nt, Artificial Sequence
  Synthetic Oligonucleotide; TIM-3 exon 4; Set C
uuagauuuauaucagggaggcuccccagu

SEQ ID NO: 67202 - RNA, 32 nt, Artificial Sequence
  Synthetic Oligonucleotide; TIM-3 exon 4; Set C
uguuagauuuauaucagggaggcuccccagug

SEQ ID NO: 67203 - RNA, 30 nt, Artificial Sequence
  Synthetic Oligonucleotide; TIM-3 exon 4; Set C
guuagauuuauaucagggaggcuccccagu

SEQ ID NO: 67204 - RNA, 33 nt, Artificial Sequence
  Synthetic Oligonucleotide; TIM-3 exon 4; Set C
cuguuagauuuauaucagggaggcuccccagug

SEQ ID NO: 67205 - RNA, 31 nt, Artificial Sequence
  Synthetic Oligonucleotide; TIM-3 exon 4; Set C
uguuagauuuauaucagggaggcuccccagu

SEQ ID NO: 67206 - RNA, 34 nt, Artificial Sequence
  Synthetic Oligonucleotide; TIM-3 exon 4; Set C
acuguuagauuuauaucagggaggcuccccagug

SEQ ID NO: 67207 - RNA, 32 nt, Artificial Sequence
  Synthetic Oligonucleotide; TIM-3 exon 4; Set C
cuguuagauuuauaucagggaggcuccccagu

SEQ ID NO: 67208 - RNA, 35 nt, Artificial Sequence
  Synthetic Oligonucleotide; TIM-3 exon 4; Set C
uacuguuagauuuauaucagggaggcuccccagug

SEQ ID NO: 67209 - RNA, 33 nt, Artificial Sequence
  Synthetic Oligonucleotide; TIM-3 exon 4; Set C
acuguuagauuuauaucagggaggcuccccagu

SEQ ID NO: 67210 - RNA, 34 nt, Artificial Sequence
  Synthetic Oligonucleotide; TIM-3 exon 4; Set C
uacuguuagauuuauaucagggaggcuccccagu

SEQ ID NO: 67211 - RNA, 31 nt, Artificial Sequence
  Synthetic Oligonucleotide; TIM-3 exon 4; Set C
aaaaaaguuacuuacuguuagauuuauauca

SEQ ID NO: 67212 - RNA, 30 nt, Artificial Sequence
  Synthetic Oligonucleotide; TIM-3 exon 4; Set C
aaaaaaguuacuuacuguuagauuuauauc

SEQ ID NO: 67213 - RNA, 32 nt, Artificial Sequence
  Synthetic Oligonucleotide; TIM-3 exon 4; Set C
aaaaaaaguuacuuacuguuagauuuauauca

SEQ ID NO: 67214 - RNA, 31 nt, Artificial Sequence
  Synthetic Oligonucleotide; TIM-3 exon 4; Set C
aaaaaaaguuacuuacuguuagauuuauauc

SEQ ID NO: 67215 - RNA, 40 nt, Artificial Sequence
  Synthetic Oligonucleotide; TIM-3 exon 4; Set C
auagcucacaaaaaaaguuacuuacuguuagauuuauauc

SEQ ID NO: 67216 - RNA, 24 nt, Artificial Sequence
  Synthetic Oligonucleotide; TIM-3 exon 4; Set C
acaacauagcucacaaaaaaaguu

SEQ ID NO: 67217 - RNA, 40 nt, Artificial Sequence
  Synthetic Oligonucleotide; TIM-3 exon 4; Set A
aguugaguacaacauagcucacaaaaaaaguuacuuacug

SEQ ID NO: 67218 - RNA, 39 nt, Artificial Sequence
  Synthetic Oligonucleotide; TIM-3 exon 4; Set A
aguugaguacaacauagcucacaaaaaaaguuacuuacu

SEQ ID NO: 67219 - RNA, 23 nt, Artificial Sequence
  Synthetic Oligonucleotide; TIM-3 exon 4; Set C
acaacauagcucacaaaaaaagu

SEQ ID NO: 67220 - RNA, 38 nt, Artificial Sequence
  Synthetic Oligonucleotide; TIM-3 exon 4; Set A
aguugaguacaacauagcucacaaaaaaaguuacuuac

SEQ ID NO: 67221 - RNA, 24 nt, Artificial Sequence
  Synthetic Oligonucleotide; TIM-3 exon 4; Set C
uacaacauagcucacaaaaaaagu

SEQ ID NO: 67222 - RNA, 22 nt, Artificial Sequence
  Synthetic Oligonucleotide; TIM-3 exon 4; Set C
acaacauagcucacaaaaaaag

SEQ ID NO: 67223 - RNA, 37 nt, Artificial Sequence
  Synthetic Oligonucleotide; TIM-3 exon 4; Set A
aguugaguacaacauagcucacaaaaaaaguuacuua

SEQ ID NO: 67224 - RNA, 23 nt, Artificial Sequence
  Synthetic Oligonucleotide; TIM-3 exon 4; Set C
uacaacauagcucacaaaaaaag

SEQ ID NO: 67225 - RNA, 21 nt, Artificial Sequence
  Synthetic Oligonucleotide; TIM-3 exon 4; Set C
acaacauagcucacaaaaaaa

SEQ ID NO: 67226 - RNA, 22 nt, Artificial Sequence
  Synthetic Oligonucleotide; TIM-3 exon 4; Set C
uacaacauagcucacaaaaaaa

SEQ ID NO: 67227 - RNA, 20 nt, Artificial Sequence
  Synthetic Oligonucleotide; TIM-3 exon 4; Set C
acaacauagcucacaaaaaa

SEQ ID NO: 67228 - RNA, 21 nt, Artificial Sequence
  Synthetic Oligonucleotide; TIM-3 exon 4; Set C
uacaacauagcucacaaaaaa

SEQ ID NO: 67229 - RNA, 20 nt, Artificial Sequence
  Synthetic Oligonucleotide; TIM-3 exon 4; Set C
uacaacauagcucacaaaaa

SEQ ID NO: 67230 - RNA, 21 nt, Artificial Sequence
  Synthetic Oligonucleotide; TIM-3 exon 4; Set C
guacaacauagcucacaaaaa

SEQ ID NO: 67231 - RNA, 22 nt, Artificial Sequence
  Synthetic Oligonucleotide; TIM-3 exon 4; Set C
aguacaacauagcucacaaaaa

SEQ ID NO: 67232 - RNA, 20 nt, Artificial Sequence
  Synthetic Oligonucleotide; TIM-3 exon 4; Set C
guacaacauagcucacaaaa

SEQ ID NO: 67233 - RNA, 21 nt, Artificial Sequence
  Synthetic Oligonucleotide; TIM-3 exon 4; Set C
aguacaacauagcucacaaaa

SEQ ID NO: 67234 - RNA, 19 nt, Artificial Sequence
  Synthetic Oligonucleotide; TIM-3 exon 4; Set C
guacaacauagcucacaaa

SEQ ID NO: 67235 - RNA, 20 nt, Artificial Sequence
  Synthetic Oligonucleotide; TIM-3 exon 4; Set C
aguacaacauagcucacaaa

SEQ ID NO: 67236 - RNA, 15 nt, Artificial Sequence
  Synthetic Oligonucleotide; TIM-3 exon 4; Set C
auagccaauaguaua

SEQ ID NO: 67237 - RNA, 16 nt, Artificial Sequence
  Synthetic Oligonucleotide; TIM-3 exon 4; Set C
aauagccaauaguaua

SEQ ID NO: 67238 - RNA, 17 nt, Artificial Sequence
  Synthetic Oligonucleotide; TIM-3 exon 4; Set C
aaauagccaauaguaua

SEQ ID NO: 67239 - RNA, 15 nt, Artificial Sequence
  Synthetic Oligonucleotide; TIM-3 exon 4; Set C
aauagccaauaguau

SEQ ID NO: 67240 - RNA, 16 nt, Artificial Sequence
  Synthetic Oligonucleotide; TIM-3 exon 4; Set C
aaauagccaauaguau

SEQ ID NO: 67241 - RNA, 15 nt, Artificial Sequence
  Synthetic Oligonucleotide; TIM-3 exon 4; Set C
aaauagccaauagua

SEQ ID NO: 67242 - RNA, 23 nt, Artificial Sequence
  Synthetic Oligonucleotide; TIM-3 exon 4; Set C
gagaggaaaaauagccaauagua

SEQ ID NO: 67243 - RNA, 22 nt, Artificial Sequence
  Synthetic Oligonucleotide; TIM-3 exon 4; Set C
gagaggaaaaauagccaauagu

SEQ ID NO: 67244 - RNA, 23 nt, Artificial Sequence
  Synthetic Oligonucleotide; TIM-3 exon 4; Set C
agagaggaaaaauagccaauagu

SEQ ID NO: 67245 - RNA, 21 nt, Artificial Sequence
  Synthetic Oligonucleotide; TIM-3 exon 4; Set C
gagaggaaaaauagccaauag

SEQ ID NO: 67246 - RNA, 22 nt, Artificial Sequence
  Synthetic Oligonucleotide; TIM-3 exon 4; Set C
agagaggaaaaauagccaauag

SEQ ID NO: 67247 - RNA, 20 nt, Artificial Sequence
  Synthetic Oligonucleotide; TIM-3 exon 4; Set C
gagaggaaaaauagccaaua

SEQ ID NO: 67248 - RNA, 21 nt, Artificial Sequence
  Synthetic Oligonucleotide; TIM-3 exon 4; Set C
agagaggaaaaauagccaaua

SEQ ID NO: 67249 - RNA, 19 nt, Artificial Sequence
  Synthetic Oligonucleotide; TIM-3 exon 4; Set C
gagaggaaaaauagccaau

SEQ ID NO: 67250 - RNA, 22 nt, Artificial Sequence
  Synthetic Oligonucleotide; TIM-3 exon 4; Set C
gagagaggaaaaauagccaaua

SEQ ID NO: 67251 - RNA, 20 nt, Artificial Sequence
  Synthetic Oligonucleotide; TIM-3 exon 4; Set C
agagaggaaaaauagccaau

SEQ ID NO: 67252 - RNA, 21 nt, Artificial Sequence
  Synthetic Oligonucleotide; TIM-3 exon 4; Set C
gagagaggaaaaauagccaau

SEQ ID NO: 67253 - RNA, 22 nt, Artificial Sequence
  Synthetic Oligonucleotide; TIM-3 exon 4; Set C
agagagaggaaaaauagccaau

SEQ ID NO: 67254 - RNA, 20 nt, Artificial Sequence
  Synthetic Oligonucleotide; TIM-3 exon 4; Set C
gagagagagagaggaaaaau

SEQ ID NO: 67255 - RNA, 19 nt, Artificial Sequence
  Synthetic Oligonucleotide; TIM-3 exon 4; Set C
gagagagagagaggaaaaa

SEQ ID NO: 67256 - RNA, 21 nt, Artificial Sequence
  Synthetic Oligonucleotide; TIM-3 exon 4; Set C
agagagagagagaggaaaaau

SEQ ID NO: 67257 - RNA, 20 nt, Artificial Sequence
  Synthetic Oligonucleotide; TIM-3 exon 4; Set C
agagagagagagaggaaaaa

SEQ ID NO: 67258 - RNA, 22 nt, Artificial Sequence
  Synthetic Oligonucleotide; TIM-3 exon 4; Set C
gagagagagagagaggaaaaau

SEQ ID NO: 67259 - RNA, 21 nt, Artificial Sequence
  Synthetic Oligonucleotide; TIM-3 exon 4; Set C
gagagagagagagaggaaaaa

SEQ ID NO: 67260 - RNA, 40 nt, Artificial Sequence
  Synthetic Oligonucleotide; TIM-3 exon 4; Set A
gugucugugucucugcuauaaaaagagagagagagagaga

SEQ ID NO: 67261 - RNA, 39 nt, Artificial Sequence
  Synthetic Oligonucleotide; TIM-3 exon 4; Set A
gugucugugucucugcuauaaaaagagagagagagagag

SEQ ID NO: 67262 - RNA, 40 nt, Artificial Sequence
  Synthetic Oligonucleotide; TIM-3 exon 4; Set A
agugucugugucucugcuauaaaaagagagagagagagag

SEQ ID NO: 67263 - RNA, 38 nt, Artificial Sequence
  Synthetic Oligonucleotide; TIM-3 exon 4; Set A
gugucugugucucugcuauaaaaagagagagagagaga

SEQ ID NO: 67264 - RNA, 39 nt, Artificial Sequence
  Synthetic Oligonucleotide; TIM-3 exon 4; Set A
agugucugugucucugcuauaaaaagagagagagagaga

SEQ ID NO: 67265 - RNA, 37 nt, Artificial Sequence
  Synthetic Oligonucleotide; TIM-3 exon 4; Set A
gugucugugucucugcuauaaaaagagagagagagag

SEQ ID NO: 67266 - RNA, 36 nt, Artificial Sequence
  Synthetic Oligonucleotide; TIM-3 exon 4; Set A
gugucugugucucugcuauaaaaagagagagagaga

SEQ ID NO: 67267 - RNA, 38 nt, Artificial Sequence
  Synthetic Oligonucleotide; TIM-3 exon 4; Set A
agugucugugucucugcuauaaaaagagagagagagag

SEQ ID NO: 67268 - RNA, 35 nt, Artificial Sequence
  Synthetic Oligonucleotide; TIM-3 exon 4; Set A
gugucugugucucugcuauaaaaagagagagagag

SEQ ID NO: 67269 - RNA, 37 nt, Artificial Sequence
  Synthetic Oligonucleotide; TIM-3 exon 4; Set A
agugucugugucucugcuauaaaaagagagagagaga

SEQ ID NO: 67270 - RNA, 34 nt, Artificial Sequence
  Synthetic Oligonucleotide; TIM-3 exon 4; Set A
gugucugugucucugcuauaaaaagagagagaga

SEQ ID NO: 67271 - RNA, 36 nt, Artificial Sequence
  Synthetic Oligonucleotide; TIM-3 exon 4; Set A
agugucugugucucugcuauaaaaagagagagagag

SEQ ID NO: 67272 - RNA, 33 nt, Artificial Sequence
  Synthetic Oligonucleotide; TIM-3 exon 4; Set A
gugucugugucucugcuauaaaaagagagagag

SEQ ID NO: 67273 - RNA, 35 nt, Artificial Sequence
  Synthetic Oligonucleotide; TIM-3 exon 4; Set A
agugucugugucucugcuauaaaaagagagagaga

SEQ ID NO: 67274 - RNA, 34 nt, Artificial Sequence
  Synthetic Oligonucleotide; TIM-3 exon 4; Set A
agugucugugucucugcuauaaaaagagagagag

SEQ ID NO: 67275 - RNA, 23 nt, Artificial Sequence
  Synthetic Oligonucleotide; TIM-3 exon 4; Set C
gugucugugucucugcuauaaaa

SEQ ID NO: 67276 - RNA, 24 nt, Artificial Sequence
  Synthetic Oligonucleotide; TIM-3 exon 4; Set C
agugucugugucucugcuauaaaa

SEQ ID NO: 67277 - RNA, 22 nt, Artificial Sequence
  Synthetic Oligonucleotide; TIM-3 exon 4; Set C
gugucugugucucugcuauaaa

SEQ ID NO: 67278 - RNA, 23 nt, Artificial Sequence
  Synthetic Oligonucleotide; TIM-3 exon 4; Set C
agugucugugucucugcuauaaa

SEQ ID NO: 67279 - RNA, 22 nt, Artificial Sequence
  Synthetic Oligonucleotide; TIM-3 exon 4; Set C
agugucugugucucugcuauaa

SEQ ID NO: 67280 - RNA, 31 nt, Artificial Sequence
  Synthetic Oligonucleotide; TIM-3 exon 4; Set C
gcuccccagugucugugucucugcuauaaaa

SEQ ID NO: 67281 - RNA, 32 nt, Artificial Sequence
  Synthetic Oligonucleotide; TIM-3 exon 4; Set C
ggcuccccagugucugugucucugcuauaaaa

SEQ ID NO: 67282 - RNA, 30 nt, Artificial Sequence
  Synthetic Oligonucleotide; TIM-3 exon 4; Set C
gcuccccagugucugugucucugcuauaaa

SEQ ID NO: 67283 - RNA, 31 nt, Artificial Sequence
  Synthetic Oligonucleotide; TIM-3 exon 4; Set C
ggcuccccagugucugugucucugcuauaaa

SEQ ID NO: 67284 - RNA, 40 nt, Artificial Sequence
  Synthetic Oligonucleotide; TIM-3 exon 4; Set C
uaucagggaggcuccccagugucugugucucugcuauaaa

SEQ ID NO: 67285 - RNA, 39 nt, Artificial Sequence
  Synthetic Oligonucleotide; TIM-3 exon 4; Set C
uaucagggaggcuccccagugucugugucucugcuauaa

SEQ ID NO: 67286 - RNA, 40 nt, Artificial Sequence
  Synthetic Oligonucleotide; TIM-3 exon 4; Set C
auaucagggaggcuccccagugucugugucucugcuauaa

SEQ ID NO: 67287 - RNA, 38 nt, Artificial Sequence
  Synthetic Oligonucleotide; TIM-3 exon 4; Set C
uaucagggaggcuccccagugucugugucucugcuaua

SEQ ID NO: 67288 - RNA, 39 nt, Artificial Sequence
  Synthetic Oligonucleotide; TIM-3 exon 4; Set C
auaucagggaggcuccccagugucugugucucugcuaua

SEQ ID NO: 67289 - RNA, 40 nt, Artificial Sequence
  Synthetic Oligonucleotide; TIM-3 exon 4; Set C
uauaucagggaggcuccccagugucugugucucugcuaua

SEQ ID NO: 67290 - RNA, 21 nt, Artificial Sequence
  Synthetic Oligonucleotide; TIM-3 exon 4; Set A
uaucagggaggcuccccagug

SEQ ID NO: 67291 - RNA, 22 nt, Artificial Sequence
  Synthetic Oligonucleotide; TIM-3 exon 4; Set A
auaucagggaggcuccccagug

SEQ ID NO: 67292 - RNA, 20 nt, Artificial Sequence
  Synthetic Oligonucleotide; TIM-3 exon 4; Set A
uaucagggaggcuccccagu

SEQ ID NO: 67293 - RNA, 21 nt, Artificial Sequence
  Synthetic Oligonucleotide; TIM-3 exon 4; Set A
auaucagggaggcuccccagu

SEQ ID NO: 67294 - RNA, 38 nt, Artificial Sequence
  Synthetic Oligonucleotide; TIM-3 exon 4; Set A
cauagcucacaaaaaaaguuacuuacuguuagauuuau

SEQ ID NO: 67295 - RNA, 37 nt, Artificial Sequence
  Synthetic Oligonucleotide; TIM-3 exon 4; Set A
cauagcucacaaaaaaaguuacuuacuguuagauuua

SEQ ID NO: 67296 - RNA, 36 nt, Artificial Sequence
  Synthetic Oligonucleotide; TIM-3 exon 4; Set C
cauagcucacaaaaaaaguuacuuacuguuagauuu

SEQ ID NO: 67297 - RNA, 35 nt, Artificial Sequence
  Synthetic Oligonucleotide; TIM-3 exon 4; Set C
cauagcucacaaaaaaaguuacuuacuguuagauu

SEQ ID NO: 67298 - RNA, 34 nt, Artificial Sequence
  Synthetic Oligonucleotide; TIM-3 exon 4; Set C
cauagcucacaaaaaaaguuacuuacuguuagau

SEQ ID NO: 67299 - RNA, 33 nt, Artificial Sequence
  Synthetic Oligonucleotide; TIM-3 exon 4; Set C
cauagcucacaaaaaaaguuacuuacuguuaga

SEQ ID NO: 67300 - RNA, 32 nt, Artificial Sequence
  Synthetic Oligonucleotide; TIM-3 exon 4; Set C
cauagcucacaaaaaaaguuacuuacuguuag

SEQ ID NO: 67301 - RNA, 31 nt, Artificial Sequence
  Synthetic Oligonucleotide; TIM-3 exon 4; Set C
cauagcucacaaaaaaaguuacuuacuguua

SEQ ID NO: 67302 - RNA, 30 nt, Artificial Sequence
  Synthetic Oligonucleotide; TIM-3 exon 4; Set C
cauagcucacaaaaaaaguuacuuacuguu

SEQ ID NO: 67303 - RNA, 29 nt, Artificial Sequence
  Synthetic Oligonucleotide; TIM-3 exon 4; Set C
cauagcucacaaaaaaaguuacuuacugu

SEQ ID NO: 67304 - RNA, 40 nt, Artificial Sequence
  Synthetic Oligonucleotide; TIM-3 exon 4; Set A
aaguugaguacaacauagcucacaaaaaaaguuacuuacu

SEQ ID NO: 67305 - RNA, 39 nt, Artificial Sequence
  Synthetic Oligonucleotide; TIM-3 exon 4; Set A
aaguugaguacaacauagcucacaaaaaaaguuacuuac

SEQ ID NO: 67306 - RNA, 36 nt, Artificial Sequence
  Synthetic Oligonucleotide; TIM-3 exon 4; Set B
aguugaguacaacauagcucacaaaaaaaguuacuu

SEQ ID NO: 67307 - RNA, 38 nt, Artificial Sequence
  Synthetic Oligonucleotide; TIM-3 exon 4; Set A
aaguugaguacaacauagcucacaaaaaaaguuacuua

SEQ ID NO: 67308 - RNA, 40 nt, Artificial Sequence
  Synthetic Oligonucleotide; TIM-3 exon 4; Set A
caaguugaguacaacauagcucacaaaaaaaguuacuuac

SEQ ID NO: 67309 - RNA, 35 nt, Artificial Sequence
  Synthetic Oligonucleotide; TIM-3 exon 4; Set B
aguugaguacaacauagcucacaaaaaaaguuacu

SEQ ID NO: 67310 - RNA, 37 nt, Artificial Sequence
  Synthetic Oligonucleotide; TIM-3 exon 4; Set B
aaguugaguacaacauagcucacaaaaaaaguuacuu

SEQ ID NO: 67311 - RNA, 39 nt, Artificial Sequence
  Synthetic Oligonucleotide; TIM-3 exon 4; Set A
caaguugaguacaacauagcucacaaaaaaaguuacuua

SEQ ID NO: 67312 - RNA, 19 nt, Artificial Sequence
  Synthetic Oligonucleotide; TIM-3 exon 4; Set C
acaacauagcucacaaaaa

SEQ ID NO: 67313 - RNA, 34 nt, Artificial Sequence
  Synthetic Oligonucleotide; TIM-3 exon 4; Set C
aguugaguacaacauagcucacaaaaaaaguuac

SEQ ID NO: 67314 - RNA, 36 nt, Artificial Sequence
  Synthetic Oligonucleotide; TIM-3 exon 4; Set B
aaguugaguacaacauagcucacaaaaaaaguuacu

SEQ ID NO: 67315 - RNA, 38 nt, Artificial Sequence
  Synthetic Oligonucleotide; TIM-3 exon 4; Set B
caaguugaguacaacauagcucacaaaaaaaguuacuu

SEQ ID NO: 67316 - RNA, 40 nt, Artificial Sequence
  Synthetic Oligonucleotide; TIM-3 exon 4; Set A
ccaaguugaguacaacauagcucacaaaaaaaguuacuua

SEQ ID NO: 67317 - RNA, 18 nt, Artificial Sequence
  Synthetic Oligonucleotide; TIM-3 exon 4; Set C
acaacauagcucacaaaa

SEQ ID NO: 67318 - RNA, 33 nt, Artificial Sequence
  Synthetic Oligonucleotide; TIM-3 exon 4; Set C
aguugaguacaacauagcucacaaaaaaaguua

SEQ ID NO: 67319 - RNA, 35 nt, Artificial Sequence
  Synthetic Oligonucleotide; TIM-3 exon 4; Set C
aaguugaguacaacauagcucacaaaaaaaguuac

SEQ ID NO: 67320 - RNA, 37 nt, Artificial Sequence
  Synthetic Oligonucleotide; TIM-3 exon 4; Set B
caaguugaguacaacauagcucacaaaaaaaguuacu

SEQ ID NO: 67321 - RNA, 39 nt, Artificial Sequence
  Synthetic Oligonucleotide; TIM-3 exon 4; Set B
ccaaguugaguacaacauagcucacaaaaaaaguuacuu

SEQ ID NO: 67322 - RNA, 19 nt, Artificial Sequence
  Synthetic Oligonucleotide; TIM-3 exon 4; Set C
uacaacauagcucacaaaa

SEQ ID NO: 67323 - RNA, 17 nt, Artificial Sequence
  Synthetic Oligonucleotide; TIM-3 exon 4; Set C
acaacauagcucacaaa

SEQ ID NO: 67324 - RNA, 32 nt, Artificial Sequence
  Synthetic Oligonucleotide; TIM-3 exon 4; Set C
aguugaguacaacauagcucacaaaaaaaguu

SEQ ID NO: 67325 - RNA, 34 nt, Artificial Sequence
  Synthetic Oligonucleotide; TIM-3 exon 4; Set C
aaguugaguacaacauagcucacaaaaaaaguua

SEQ ID NO: 67326 - RNA, 36 nt, Artificial Sequence
  Synthetic Oligonucleotide; TIM-3 exon 4; Set B
caaguugaguacaacauagcucacaaaaaaaguuac

SEQ ID NO: 67327 - RNA, 40 nt, Artificial Sequence
  Synthetic Oligonucleotide; TIM-3 exon 4; Set B
uccaaguugaguacaacauagcucacaaaaaaaguuacuu

SEQ ID NO: 67328 - RNA, 38 nt, Artificial Sequence
  Synthetic Oligonucleotide; TIM-3 exon 4; Set B
ccaaguugaguacaacauagcucacaaaaaaaguuacu

SEQ ID NO: 67329 - RNA, 18 nt, Artificial Sequence
  Synthetic Oligonucleotide; TIM-3 exon 4; Set C
uacaacauagcucacaaa

SEQ ID NO: 67330 - RNA, 33 nt, Artificial Sequence
  Synthetic Oligonucleotide; TIM-3 exon 4; Set C
aaguugaguacaacauagcucacaaaaaaaguu

SEQ ID NO: 67331 - RNA, 35 nt, Artificial Sequence
  Synthetic Oligonucleotide; TIM-3 exon 4; Set C
caaguugaguacaacauagcucacaaaaaaaguua

SEQ ID NO: 67332 - RNA, 39 nt, Artificial Sequence
  Synthetic Oligonucleotide; TIM-3 exon 4; Set B
uccaaguugaguacaacauagcucacaaaaaaaguuacu

SEQ ID NO: 67333 - RNA, 37 nt, Artificial Sequence
  Synthetic Oligonucleotide; TIM-3 exon 4; Set B
ccaaguugaguacaacauagcucacaaaaaaaguuac

SEQ ID NO: 67334 - RNA, 31 nt, Artificial Sequence
  Synthetic Oligonucleotide; TIM-3 exon 4; Set C
aguugaguacaacauagcucacaaaaaaagu

SEQ ID NO: 67335 - RNA, 34 nt, Artificial Sequence
  Synthetic Oligonucleotide; TIM-3 exon 4; Set C
caaguugaguacaacauagcucacaaaaaaaguu

SEQ ID NO: 67336 - RNA, 38 nt, Artificial Sequence
  Synthetic Oligonucleotide; TIM-3 exon 4; Set B
uccaaguugaguacaacauagcucacaaaaaaaguuac

SEQ ID NO: 67337 - RNA, 36 nt, Artificial Sequence
  Synthetic Oligonucleotide; TIM-3 exon 4; Set B
ccaaguugaguacaacauagcucacaaaaaaaguua

SEQ ID NO: 67338 - RNA, 30 nt, Artificial Sequence
  Synthetic Oligonucleotide; TIM-3 exon 4; Set C
aguugaguacaacauagcucacaaaaaaag

SEQ ID NO: 67339 - RNA, 32 nt, Artificial Sequence
  Synthetic Oligonucleotide; TIM-3 exon 4; Set C
aaguugaguacaacauagcucacaaaaaaagu

SEQ ID NO: 67340 - RNA, 37 nt, Artificial Sequence
  Synthetic Oligonucleotide; TIM-3 exon 4; Set B
uccaaguugaguacaacauagcucacaaaaaaaguua

SEQ ID NO: 67341 - RNA, 35 nt, Artificial Sequence
  Synthetic Oligonucleotide; TIM-3 exon 4; Set B
ccaaguugaguacaacauagcucacaaaaaaaguu

SEQ ID NO: 67342 - RNA, 29 nt, Artificial Sequence
  Synthetic Oligonucleotide; TIM-3 exon 4; Set C
aguugaguacaacauagcucacaaaaaaa

SEQ ID NO: 67343 - RNA, 31 nt, Artificial Sequence
  Synthetic Oligonucleotide; TIM-3 exon 4; Set C
aaguugaguacaacauagcucacaaaaaaag

SEQ ID NO: 67344 - RNA, 33 nt, Artificial Sequence
  Synthetic Oligonucleotide; TIM-3 exon 4; Set C
caaguugaguacaacauagcucacaaaaaaagu

SEQ ID NO: 67345 - RNA, 36 nt, Artificial Sequence
  Synthetic Oligonucleotide; TIM-3 exon 4; Set B
uccaaguugaguacaacauagcucacaaaaaaaguu

SEQ ID NO: 67346 - RNA, 28 nt, Artificial Sequence
  Synthetic Oligonucleotide; TIM-3 exon 4; Set C
aguugaguacaacauagcucacaaaaaa

SEQ ID NO: 67347 - RNA, 30 nt, Artificial Sequence
  Synthetic Oligonucleotide; TIM-3 exon 4; Set C
aaguugaguacaacauagcucacaaaaaaa

SEQ ID NO: 67348 - RNA, 32 nt, Artificial Sequence
  Synthetic Oligonucleotide; TIM-3 exon 4; Set C
caaguugaguacaacauagcucacaaaaaaag

SEQ ID NO: 67349 - RNA, 34 nt, Artificial Sequence
  Synthetic Oligonucleotide; TIM-3 exon 4; Set B
ccaaguugaguacaacauagcucacaaaaaaagu

SEQ ID NO: 67350 - RNA, 29 nt, Artificial Sequence
  Synthetic Oligonucleotide; TIM-3 exon 4; Set C
aaguugaguacaacauagcucacaaaaaa

SEQ ID NO: 67351 - RNA, 31 nt, Artificial Sequence
  Synthetic Oligonucleotide; TIM-3 exon 4; Set C
caaguugaguacaacauagcucacaaaaaaa

SEQ ID NO: 67352 - RNA, 35 nt, Artificial Sequence
  Synthetic Oligonucleotide; TIM-3 exon 4; Set B
uccaaguugaguacaacauagcucacaaaaaaagu

SEQ ID NO: 67353 - RNA, 33 nt, Artificial Sequence
  Synthetic Oligonucleotide; TIM-3 exon 4; Set C
ccaaguugaguacaacauagcucacaaaaaaag

SEQ ID NO: 67354 - RNA, 30 nt, Artificial Sequence
  Synthetic Oligonucleotide; TIM-3 exon 4; Set C
caaguugaguacaacauagcucacaaaaaa

SEQ ID NO: 67355 - RNA, 34 nt, Artificial Sequence
  Synthetic Oligonucleotide; TIM-3 exon 4; Set B
uccaaguugaguacaacauagcucacaaaaaaag

SEQ ID NO: 67356 - RNA, 32 nt, Artificial Sequence
  Synthetic Oligonucleotide; TIM-3 exon 4; Set C
ccaaguugaguacaacauagcucacaaaaaaa

SEQ ID NO: 67357 - RNA, 33 nt, Artificial Sequence
  Synthetic Oligonucleotide; TIM-3 exon 4; Set B
uccaaguugaguacaacauagcucacaaaaaaa

SEQ ID NO: 67358 - RNA, 31 nt, Artificial Sequence
  Synthetic Oligonucleotide; TIM-3 exon 4; Set C
ccaaguugaguacaacauagcucacaaaaaa

SEQ ID NO: 67359 - RNA, 32 nt, Artificial Sequence
  Synthetic Oligonucleotide; TIM-3 exon 4; Set B
uccaaguugaguacaacauagcucacaaaaaa

SEQ ID NO: 67360 - RNA, 19 nt, Artificial Sequence
  Synthetic Oligonucleotide; TIM-3 exon 4; Set C
aguugaguacaacauagcu

SEQ ID NO: 67361 - RNA, 20 nt, Artificial Sequence
  Synthetic Oligonucleotide; TIM-3 exon 4; Set C
aaguugaguacaacauagcu

SEQ ID NO: 67362 - RNA, 18 nt, Artificial Sequence
  Synthetic Oligonucleotide; TIM-3 exon 4; Set C
aguugaguacaacauagc

SEQ ID NO: 67363 - RNA, 21 nt, Artificial Sequence
  Synthetic Oligonucleotide; TIM-3 exon 4; Set C
caaguugaguacaacauagcu

SEQ ID NO: 67364 - RNA, 17 nt, Artificial Sequence
  Synthetic Oligonucleotide; TIM-3 exon 4; Set C
aguugaguacaacauag

SEQ ID NO: 67365 - RNA, 19 nt, Artificial Sequence
  Synthetic Oligonucleotide; TIM-3 exon 4; Set C
aaguugaguacaacauagc

SEQ ID NO: 67366 - RNA, 22 nt, Artificial Sequence
  Synthetic Oligonucleotide; TIM-3 exon 4; Set C
ccaaguugaguacaacauagcu

SEQ ID NO: 67367 - RNA, 18 nt, Artificial Sequence
  Synthetic Oligonucleotide; TIM-3 exon 4; Set C
aaguugaguacaacauag

SEQ ID NO: 67368 - RNA, 20 nt, Artificial Sequence
  Synthetic Oligonucleotide; TIM-3 exon 4; Set C
caaguugaguacaacauagc

SEQ ID NO: 67369 - RNA, 23 nt, Artificial Sequence
  Synthetic Oligonucleotide; TIM-3 exon 4; Set C
uccaaguugaguacaacauagcu

SEQ ID NO: 67370 - RNA, 19 nt, Artificial Sequence
  Synthetic Oligonucleotide; TIM-3 exon 4; Set C
caaguugaguacaacauag

SEQ ID NO: 67371 - RNA, 21 nt, Artificial Sequence
  Synthetic Oligonucleotide; TIM-3 exon 4; Set C
ccaaguugaguacaacauagc

SEQ ID NO: 67372 - RNA, 20 nt, Artificial Sequence
  Synthetic Oligonucleotide; TIM-3 exon 4; Set C
ccaaguugaguacaacauag

SEQ ID NO: 67373 - RNA, 22 nt, Artificial Sequence
  Synthetic Oligonucleotide; TIM-3 exon 4; Set C
uccaaguugaguacaacauagc

SEQ ID NO: 67374 - RNA, 21 nt, Artificial Sequence
  Synthetic Oligonucleotide; TIM-3 exon 4; Set C
uccaaguugaguacaacauag

SEQ ID NO: 67375 - RNA, 15 nt, Artificial Sequence
  Synthetic Oligonucleotide; TIM-3 exon 4; Set C
agagagaggaaaaau

SEQ ID NO: 67376 - RNA, 17 nt, Artificial Sequence
  Synthetic Oligonucleotide; TIM-3 exon 4; Set C
gagagagaggaaaaaua

SEQ ID NO: 67377 - RNA, 16 nt, Artificial Sequence
  Synthetic Oligonucleotide; TIM-3 exon 4; Set C
gagagagaggaaaaau

SEQ ID NO: 67378 - RNA, 18 nt, Artificial Sequence
  Synthetic Oligonucleotide; TIM-3 exon 4; Set C
agagagagaggaaaaaua

SEQ ID NO: 67379 - RNA, 15 nt, Artificial Sequence
  Synthetic Oligonucleotide; TIM-3 exon 4; Set C
gagagagaggaaaaa

SEQ ID NO: 67380 - RNA, 17 nt, Artificial Sequence
  Synthetic Oligonucleotide; TIM-3 exon 4; Set C
agagagagaggaaaaau

SEQ ID NO: 67381 - RNA, 19 nt, Artificial Sequence
  Synthetic Oligonucleotide; TIM-3 exon 4; Set C
gagagagagaggaaaaaua

SEQ ID NO: 67382 - RNA, 16 nt, Artificial Sequence
  Synthetic Oligonucleotide; TIM-3 exon 4; Set C
agagagagaggaaaaa

SEQ ID NO: 67383 - RNA, 18 nt, Artificial Sequence
  Synthetic Oligonucleotide; TIM-3 exon 4; Set C
gagagagagaggaaaaau

SEQ ID NO: 67384 - RNA, 20 nt, Artificial Sequence
  Synthetic Oligonucleotide; TIM-3 exon 4; Set C
agagagagagaggaaaaaua

SEQ ID NO: 67385 - RNA, 17 nt, Artificial Sequence
  Synthetic Oligonucleotide; TIM-3 exon 4; Set C
gagagagagaggaaaaa

SEQ ID NO: 67386 - RNA, 19 nt, Artificial Sequence
  Synthetic Oligonucleotide; TIM-3 exon 4; Set C
agagagagagaggaaaaau

SEQ ID NO: 67387 - RNA, 21 nt, Artificial Sequence
  Synthetic Oligonucleotide; TIM-3 exon 4; Set C
gagagagagagaggaaaaaua

SEQ ID NO: 67388 - RNA, 18 nt, Artificial Sequence
  Synthetic Oligonucleotide; TIM-3 exon 4; Set C
agagagagagaggaaaaa

SEQ ID NO: 67389 - RNA, 22 nt, Artificial Sequence
  Synthetic Oligonucleotide; TIM-3 exon 4; Set C
agagagagagagaggaaaaaua

SEQ ID NO: 67390 - RNA, 23 nt, Artificial Sequence
  Synthetic Oligonucleotide; TIM-3 exon 4; Set C
gagagagagagagaggaaaaaua

SEQ ID NO: 67391 - RNA, 33 nt, Artificial Sequence
  Synthetic Oligonucleotide; TIM-3 exon 4; Set C
aaaagagagagagagagagagagaggaaaaaua

SEQ ID NO: 67392 - RNA, 32 nt, Artificial Sequence
  Synthetic Oligonucleotide; TIM-3 exon 4; Set C
aaaagagagagagagagagagagaggaaaaau

SEQ ID NO: 67393 - RNA, 34 nt, Artificial Sequence
  Synthetic Oligonucleotide; TIM-3 exon 4; Set C
aaaaagagagagagagagagagagaggaaaaaua

SEQ ID NO: 67394 - RNA, 31 nt, Artificial Sequence
  Synthetic Oligonucleotide; TIM-3 exon 4; Set C
aaaagagagagagagagagagagaggaaaaa

SEQ ID NO: 67395 - RNA, 33 nt, Artificial Sequence
  Synthetic Oligonucleotide; TIM-3 exon 4; Set C
aaaaagagagagagagagagagagaggaaaaau

SEQ ID NO: 67396 - RNA, 35 nt, Artificial Sequence
  Synthetic Oligonucleotide; TIM-3 exon 4; Set C
uaaaaagagagagagagagagagagaggaaaaaua

SEQ ID NO: 67397 - RNA, 32 nt, Artificial Sequence
  Synthetic Oligonucleotide; TIM-3 exon 4; Set C
aaaaagagagagagagagagagagaggaaaaa

SEQ ID NO: 67398 - RNA, 34 nt, Artificial Sequence
  Synthetic Oligonucleotide; TIM-3 exon 4; Set C
uaaaaagagagagagagagagagagaggaaaaau

SEQ ID NO: 67399 - RNA, 36 nt, Artificial Sequence
  Synthetic Oligonucleotide; TIM-3 exon 4; Set C
auaaaaagagagagagagagagagagaggaaaaaua

SEQ ID NO: 67400 - RNA, 33 nt, Artificial Sequence
  Synthetic Oligonucleotide; TIM-3 exon 4; Set C
uaaaaagagagagagagagagagagaggaaaaa

SEQ ID NO: 67401 - RNA, 35 nt, Artificial Sequence
  Synthetic Oligonucleotide; TIM-3 exon 4; Set C
auaaaaagagagagagagagagagagaggaaaaau

SEQ ID NO: 67402 - RNA, 34 nt, Artificial Sequence
  Synthetic Oligonucleotide; TIM-3 exon 4; Set C
auaaaaagagagagagagagagagagaggaaaaa

SEQ ID NO: 67403 - RNA, 21 nt, Artificial Sequence
  Synthetic Oligonucleotide; TIM-3 exon 4; Set C
gugucugugucucugcuauaa

SEQ ID NO: 67404 - RNA, 20 nt, Artificial Sequence
  Synthetic Oligonucleotide; TIM-3 exon 4; Set C
gugucugugucucugcuaua

SEQ ID NO: 67405 - RNA, 21 nt, Artificial Sequence
  Synthetic Oligonucleotide; TIM-3 exon 4; Set C
agugucugugucucugcuaua

SEQ ID NO: 67406 - RNA, 29 nt, Artificial Sequence
  Synthetic Oligonucleotide; TIM-3 exon 4; Set C
gcuccccagugucugugucucugcuauaa

SEQ ID NO: 67407 - RNA, 28 nt, Artificial Sequence
  Synthetic Oligonucleotide; TIM-3 exon 4; Set C
gcuccccagugucugugucucugcuaua

SEQ ID NO: 67408 - RNA, 30 nt, Artificial Sequence
  Synthetic Oligonucleotide; TIM-3 exon 4; Set C
ggcuccccagugucugugucucugcuauaa

SEQ ID NO: 67409 - RNA, 29 nt, Artificial Sequence
  Synthetic Oligonucleotide; TIM-3 exon 4; Set C
ggcuccccagugucugugucucugcuaua

SEQ ID NO: 67410 - RNA, 39 nt, Artificial Sequence
  Synthetic Oligonucleotide; TIM-3 exon 4; Set C
ucagggaggcuccccagugucugugucucugcuauaaaa

SEQ ID NO: 67411 - RNA, 40 nt, Artificial Sequence
  Synthetic Oligonucleotide; TIM-3 exon 4; Set C
aucagggaggcuccccagugucugugucucugcuauaaaa

SEQ ID NO: 67412 - RNA, 38 nt, Artificial Sequence
  Synthetic Oligonucleotide; TIM-3 exon 4; Set C
ucagggaggcuccccagugucugugucucugcuauaaa

SEQ ID NO: 67413 - RNA, 39 nt, Artificial Sequence
  Synthetic Oligonucleotide; TIM-3 exon 4; Set C
aucagggaggcuccccagugucugugucucugcuauaaa

SEQ ID NO: 67414 - RNA, 37 nt, Artificial Sequence
  Synthetic Oligonucleotide; TIM-3 exon 4; Set C
ucagggaggcuccccagugucugugucucugcuauaa

SEQ ID NO: 67415 - RNA, 38 nt, Artificial Sequence
  Synthetic Oligonucleotide; TIM-3 exon 4; Set C
aucagggaggcuccccagugucugugucucugcuauaa

SEQ ID NO: 67416 - RNA, 36 nt, Artificial Sequence
  Synthetic Oligonucleotide; TIM-3 exon 4; Set C
ucagggaggcuccccagugucugugucucugcuaua

SEQ ID NO: 67417 - RNA, 37 nt, Artificial Sequence
  Synthetic Oligonucleotide; TIM-3 exon 4; Set C
aucagggaggcuccccagugucugugucucugcuaua

SEQ ID NO: 67418 - RNA, 19 nt, Artificial Sequence
  Synthetic Oligonucleotide; TIM-3 exon 4; Set A
ucagggaggcuccccagug

SEQ ID NO: 67419 - RNA, 20 nt, Artificial Sequence
  Synthetic Oligonucleotide; TIM-3 exon 4; Set A
aucagggaggcuccccagug

SEQ ID NO: 67420 - RNA, 18 nt, Artificial Sequence
  Synthetic Oligonucleotide; TIM-3 exon 4; Set A
ucagggaggcuccccagu

SEQ ID NO: 67421 - RNA, 19 nt, Artificial Sequence
  Synthetic Oligonucleotide; TIM-3 exon 4; Set A
aucagggaggcuccccagu

SEQ ID NO: 67422 - RNA, 40 nt, Artificial Sequence
  Synthetic Oligonucleotide; TIM-3 exon 4; Set A
cauagcucacaaaaaaaguuacuuacuguuagauuuauau

SEQ ID NO: 67423 - RNA, 39 nt, Artificial Sequence
  Synthetic Oligonucleotide; TIM-3 exon 4; Set A
cauagcucacaaaaaaaguuacuuacuguuagauuuaua

SEQ ID NO: 67424 - RNA, 28 nt, Artificial Sequence
  Synthetic Oligonucleotide; TIM-3 exon 4; Set C
cauagcucacaaaaaaaguuacuuacug

SEQ ID NO: 67425 - RNA, 27 nt, Artificial Sequence
  Synthetic Oligonucleotide; TIM-3 exon 4; Set C
cauagcucacaaaaaaaguuacuuacu

SEQ ID NO: 67426 - RNA, 26 nt, Artificial Sequence
  Synthetic Oligonucleotide; TIM-3 exon 4; Set C
cauagcucacaaaaaaaguuacuuac

SEQ ID NO: 67427 - RNA, 25 nt, Artificial Sequence
  Synthetic Oligonucleotide; TIM-3 exon 4; Set C
cauagcucacaaaaaaaguuacuua

SEQ ID NO: 67428 - RNA, 24 nt, Artificial Sequence
  Synthetic Oligonucleotide; TIM-3 exon 4; Set C
cauagcucacaaaaaaaguuacuu

SEQ ID NO: 67429 - RNA, 23 nt, Artificial Sequence
  Synthetic Oligonucleotide; TIM-3 exon 4; Set C
cauagcucacaaaaaaaguuacu

SEQ ID NO: 67430 - RNA, 22 nt, Artificial Sequence
  Synthetic Oligonucleotide; TIM-3 exon 4; Set C
cauagcucacaaaaaaaguuac

SEQ ID NO: 67431 - RNA, 21 nt, Artificial Sequence
  Synthetic Oligonucleotide; TIM-3 exon 4; Set C
cauagcucacaaaaaaaguua

SEQ ID NO: 67432 - RNA, 20 nt, Artificial Sequence
  Synthetic Oligonucleotide; TIM-3 exon 4; Set C
cauagcucacaaaaaaaguu

SEQ ID NO: 67433 - RNA, 19 nt, Artificial Sequence
  Synthetic Oligonucleotide; TIM-3 exon 4; Set C
cauagcucacaaaaaaagu

SEQ ID NO: 67434 - RNA, 18 nt, Artificial Sequence
  Synthetic Oligonucleotide; TIM-3 exon 4; Set C
cauagcucacaaaaaaag

SEQ ID NO: 67435 - RNA, 17 nt, Artificial Sequence
  Synthetic Oligonucleotide; TIM-3 exon 4; Set C
cauagcucacaaaaaaa

SEQ ID NO: 67436 - RNA, 16 nt, Artificial Sequence
  Synthetic Oligonucleotide; TIM-3 exon 4; Set C
cauagcucacaaaaaa

SEQ ID NO: 67437 - RNA, 27 nt, Artificial Sequence
  Synthetic Oligonucleotide; TIM-3 exon 4; Set C
aguugaguacaacauagcucacaaaaa

SEQ ID NO: 67438 - RNA, 28 nt, Artificial Sequence
  Synthetic Oligonucleotide; TIM-3 exon 4; Set C
aaguugaguacaacauagcucacaaaaa

SEQ ID NO: 67439 - RNA, 26 nt, Artificial Sequence
  Synthetic Oligonucleotide; TIM-3 exon 4; Set C
aguugaguacaacauagcucacaaaa

SEQ ID NO: 67440 - RNA, 29 nt, Artificial Sequence
  Synthetic Oligonucleotide; TIM-3 exon 4; Set C
caaguugaguacaacauagcucacaaaaa

SEQ ID NO: 67441 - RNA, 27 nt, Artificial Sequence
  Synthetic Oligonucleotide; TIM-3 exon 4; Set C
aaguugaguacaacauagcucacaaaa

SEQ ID NO: 67442 - RNA, 25 nt, Artificial Sequence
  Synthetic Oligonucleotide; TIM-3 exon 4; Set C
aguugaguacaacauagcucacaaa

SEQ ID NO: 67443 - RNA, 30 nt, Artificial Sequence
  Synthetic Oligonucleotide; TIM-3 exon 4; Set B
ccaaguugaguacaacauagcucacaaaaa

SEQ ID NO: 67444 - RNA, 28 nt, Artificial Sequence
  Synthetic Oligonucleotide; TIM-3 exon 4; Set C
caaguugaguacaacauagcucacaaaa

SEQ ID NO: 67445 - RNA, 26 nt, Artificial Sequence
  Synthetic Oligonucleotide; TIM-3 exon 4; Set C
aaguugaguacaacauagcucacaaa

SEQ ID NO: 67446 - RNA, 31 nt, Artificial Sequence
  Synthetic Oligonucleotide; TIM-3 exon 4; Set B
uccaaguugaguacaacauagcucacaaaaa

SEQ ID NO: 67447 - RNA, 29 nt, Artificial Sequence
  Synthetic Oligonucleotide; TIM-3 exon 4; Set B
ccaaguugaguacaacauagcucacaaaa

SEQ ID NO: 67448 - RNA, 27 nt, Artificial Sequence
  Synthetic Oligonucleotide; TIM-3 exon 4; Set C
caaguugaguacaacauagcucacaaa

SEQ ID NO: 67449 - RNA, 30 nt, Artificial Sequence
  Synthetic Oligonucleotide; TIM-3 exon 4; Set B
uccaaguugaguacaacauagcucacaaaa

SEQ ID NO: 67450 - RNA, 28 nt, Artificial Sequence
  Synthetic Oligonucleotide; TIM-3 exon 4; Set B
ccaaguugaguacaacauagcucacaaa

SEQ ID NO: 67451 - RNA, 29 nt, Artificial Sequence
  Synthetic Oligonucleotide; TIM-3 exon 4; Set B
uccaaguugaguacaacauagcucacaaa

SEQ ID NO: 67452 - RNA, 16 nt, Artificial Sequence
  Synthetic Oligonucleotide; TIM-3 exon 4; Set C
aguugaguacaacaua

SEQ ID NO: 67453 - RNA, 17 nt, Artificial Sequence
  Synthetic Oligonucleotide; TIM-3 exon 4; Set C
aaguugaguacaacaua

SEQ ID NO: 67454 - RNA, 18 nt, Artificial Sequence
  Synthetic Oligonucleotide; TIM-3 exon 4; Set C
caaguugaguacaacaua

SEQ ID NO: 67455 - RNA, 19 nt, Artificial Sequence
  Synthetic Oligonucleotide; TIM-3 exon 4; Set C
ccaaguugaguacaacaua

SEQ ID NO: 67456 - RNA, 20 nt, Artificial Sequence
  Synthetic Oligonucleotide; TIM-3 exon 4; Set C
uccaaguugaguacaacaua

SEQ ID NO: 67457 - RNA, 15 nt, Artificial Sequence
  Synthetic Oligonucleotide; TIM-3 exon 4; Set C
uccaaguugaguaca

SEQ ID NO: 67458 - RNA, 16 nt, Artificial Sequence
  Synthetic Oligonucleotide; TIM-3 exon 5; Set C
ggagagagaaacaaaa

SEQ ID NO: 67459 - RNA, 17 nt, Artificial Sequence
  Synthetic Oligonucleotide; TIM-3 exon 5; Set C
gggagagagaaacaaaa

SEQ ID NO: 67460 - RNA, 15 nt, Artificial Sequence
  Synthetic Oligonucleotide; TIM-3 exon 5; Set C
ggagagagaaacaaa

SEQ ID NO: 67461 - RNA, 18 nt, Artificial Sequence
  Synthetic Oligonucleotide; TIM-3 exon 5; Set C
agggagagagaaacaaaa

SEQ ID NO: 67462 - RNA, 16 nt, Artificial Sequence
  Synthetic Oligonucleotide; TIM-3 exon 5; Set C
gggagagagaaacaaa

SEQ ID NO: 67463 - RNA, 17 nt, Artificial Sequence
  Synthetic Oligonucleotide; TIM-3 exon 5; Set C
agggagagagaaacaaa

SEQ ID NO: 67464 - RNA, 15 nt, Artificial Sequence
  Synthetic Oligonucleotide; TIM-3 exon 5; Set C
gggagagagaaacaa

SEQ ID NO: 67465 - RNA, 16 nt, Artificial Sequence
  Synthetic Oligonucleotide; TIM-3 exon 5; Set C
agggagagagaaacaa

SEQ ID NO: 67466 - RNA, 15 nt, Artificial Sequence
  Synthetic Oligonucleotide; TIM-3 exon 5; Set C
agggagagagaaaca

SEQ ID NO: 67467 - RNA, 30 nt, Artificial Sequence
  Synthetic Oligonucleotide; TIM-3 exon 5; Set C
auuuguuaucagagggagagagaaacaaaa

SEQ ID NO: 67468 - RNA, 31 nt, Artificial Sequence
  Synthetic Oligonucleotide; TIM-3 exon 5; Set C
aauuuguuaucagagggagagagaaacaaaa

SEQ ID NO: 67469 - RNA, 30 nt, Artificial Sequence
  Synthetic Oligonucleotide; TIM-3 exon 5; Set C
aauuuguuaucagagggagagagaaacaaa

SEQ ID NO: 67470 - RNA, 32 nt, Artificial Sequence
  Synthetic Oligonucleotide; TIM-3 exon 5; Set C
gaauuuguuaucagagggagagagaaacaaaa

SEQ ID NO: 67471 - RNA, 29 nt, Artificial Sequence
  Synthetic Oligonucleotide; TIM-3 exon 5; Set C
aauuuguuaucagagggagagagaaacaa

SEQ ID NO: 67472 - RNA, 33 nt, Artificial Sequence
  Synthetic Oligonucleotide; TIM-3 exon 5; Set C
agaauuuguuaucagagggagagagaaacaaaa

SEQ ID NO: 67473 - RNA, 31 nt, Artificial Sequence
  Synthetic Oligonucleotide; TIM-3 exon 5; Set C
gaauuuguuaucagagggagagagaaacaaa

SEQ ID NO: 67474 - RNA, 28 nt, Artificial Sequence
  Synthetic Oligonucleotide; TIM-3 exon 5; Set C
aauuuguuaucagagggagagagaaaca

SEQ ID NO: 67475 - RNA, 32 nt, Artificial Sequence
  Synthetic Oligonucleotide; TIM-3 exon 5; Set C
agaauuuguuaucagagggagagagaaacaaa

SEQ ID NO: 67476 - RNA, 30 nt, Artificial Sequence
  Synthetic Oligonucleotide; TIM-3 exon 5; Set C
gaauuuguuaucagagggagagagaaacaa

SEQ ID NO: 67477 - RNA, 27 nt, Artificial Sequence
  Synthetic Oligonucleotide; TIM-3 exon 5; Set C
aauuuguuaucagagggagagagaaac

SEQ ID NO: 67478 - RNA, 29 nt, Artificial Sequence
  Synthetic Oligonucleotide; TIM-3 exon 5; Set B
gaauuuguuaucagagggagagagaaaca

SEQ ID NO: 67479 - RNA, 31 nt, Artificial Sequence
  Synthetic Oligonucleotide; TIM-3 exon 5; Set C
agaauuuguuaucagagggagagagaaacaa

SEQ ID NO: 67480 - RNA, 30 nt, Artificial Sequence
  Synthetic Oligonucleotide; TIM-3 exon 5; Set B
agaauuuguuaucagagggagagagaaaca

SEQ ID NO: 67481 - RNA, 28 nt, Artificial Sequence
  Synthetic Oligonucleotide; TIM-3 exon 5; Set C
gaauuuguuaucagagggagagagaaac

SEQ ID NO: 67482 - RNA, 29 nt, Artificial Sequence
  Synthetic Oligonucleotide; TIM-3 exon 5; Set C
agaauuuguuaucagagggagagagaaac

SEQ ID NO: 67483 - RNA, 17 nt, Artificial Sequence
  Synthetic Oligonucleotide; TIM-3 exon 5; Set C
auuuguuaucagaggga

SEQ ID NO: 67484 - RNA, 18 nt, Artificial Sequence
  Synthetic Oligonucleotide; TIM-3 exon 5; Set C
aauuuguuaucagaggga

SEQ ID NO: 67485 - RNA, 15 nt, Artificial Sequence
  Synthetic Oligonucleotide; TIM-3 exon 5; Set C
auuuguuaucagagg

SEQ ID NO: 67486 - RNA, 17 nt, Artificial Sequence
  Synthetic Oligonucleotide; TIM-3 exon 5; Set C
aauuuguuaucagaggg

SEQ ID NO: 67487 - RNA, 19 nt, Artificial Sequence
  Synthetic Oligonucleotide; TIM-3 exon 5; Set C
gaauuuguuaucagaggga

SEQ ID NO: 67488 - RNA, 16 nt, Artificial Sequence
  Synthetic Oligonucleotide; TIM-3 exon 5; Set C
aauuuguuaucagagg

SEQ ID NO: 67489 - RNA, 18 nt, Artificial Sequence
  Synthetic Oligonucleotide; TIM-3 exon 5; Set C
gaauuuguuaucagaggg

SEQ ID NO: 67490 - RNA, 20 nt, Artificial Sequence
  Synthetic Oligonucleotide; TIM-3 exon 5; Set C
agaauuuguuaucagaggga

SEQ ID NO: 67491 - RNA, 17 nt, Artificial Sequence
  Synthetic Oligonucleotide; TIM-3 exon 5; Set C
gaauuuguuaucagagg

SEQ ID NO: 67492 - RNA, 19 nt, Artificial Sequence
  Synthetic Oligonucleotide; TIM-3 exon 5; Set C
agaauuuguuaucagaggg

SEQ ID NO: 67493 - RNA, 21 nt, Artificial Sequence
  Synthetic Oligonucleotide; TIM-3 exon 5; Set C
aagaauuuguuaucagaggga

SEQ ID NO: 67494 - RNA, 18 nt, Artificial Sequence
  Synthetic Oligonucleotide; TIM-3 exon 5; Set C
agaauuuguuaucagagg

SEQ ID NO: 67495 - RNA, 20 nt, Artificial Sequence
  Synthetic Oligonucleotide; TIM-3 exon 5; Set C
aagaauuuguuaucagaggg

SEQ ID NO: 67496 - RNA, 22 nt, Artificial Sequence
  Synthetic Oligonucleotide; TIM-3 exon 5; Set C
gaagaauuuguuaucagaggga

SEQ ID NO: 67497 - RNA, 19 nt, Artificial Sequence
  Synthetic Oligonucleotide; TIM-3 exon 5; Set C
aagaauuuguuaucagagg

SEQ ID NO: 67498 - RNA, 21 nt, Artificial Sequence
  Synthetic Oligonucleotide; TIM-3 exon 5; Set C
gaagaauuuguuaucagaggg

SEQ ID NO: 67499 - RNA, 20 nt, Artificial Sequence
  Synthetic Oligonucleotide; TIM-3 exon 5; Set C
gaagaauuuguuaucagagg

SEQ ID NO: 67500 - RNA, 15 nt, Artificial Sequence
  Synthetic Oligonucleotide; TIM-3 exon 5; Set C
auauuugcuauggaa

SEQ ID NO: 67501 - RNA, 16 nt, Artificial Sequence
  Synthetic Oligonucleotide; TIM-3 exon 5; Set C
gauauuugcuauggaa

SEQ ID NO: 67502 - RNA, 15 nt, Artificial Sequence
  Synthetic Oligonucleotide; TIM-3 exon 5; Set C
gauauuugcuaugga

SEQ ID NO: 67503 - RNA, 17 nt, Artificial Sequence
  Synthetic Oligonucleotide; TIM-3 exon 5; Set C
ggauauuugcuauggaa

SEQ ID NO: 67504 - RNA, 16 nt, Artificial Sequence
  Synthetic Oligonucleotide; TIM-3 exon 5; Set C
ggauauuugcuaugga

SEQ ID NO: 67505 - RNA, 18 nt, Artificial Sequence
  Synthetic Oligonucleotide; TIM-3 exon 5; Set C
uggauauuugcuauggaa

SEQ ID NO: 67506 - RNA, 17 nt, Artificial Sequence
  Synthetic Oligonucleotide; TIM-3 exon 5; Set C
uggauauuugcuaugga

SEQ ID NO: 67507 - RNA, 15 nt, Artificial Sequence
  Synthetic Oligonucleotide; TIM-3 exon 5; Set C
ggauauuugcuaugg

SEQ ID NO: 67508 - RNA, 16 nt, Artificial Sequence
  Synthetic Oligonucleotide; TIM-3 exon 5; Set C
uggauauuugcuaugg

SEQ ID NO: 67509 - RNA, 15 nt, Artificial Sequence
  Synthetic Oligonucleotide; TIM-3 exon 5; Set C
uggauauuugcuaug

SEQ ID NO: 67510 - RNA, 19 nt, Artificial Sequence
  Synthetic Oligonucleotide; TIM-3 exon 5; Set A
gcuccagagucccguaagu

SEQ ID NO: 67511 - RNA, 20 nt, Artificial Sequence
  Synthetic Oligonucleotide; TIM-3 exon 5; Set A
ugcuccagagucccguaagu

SEQ ID NO: 67512 - RNA, 18 nt, Artificial Sequence
  Synthetic Oligonucleotide; TIM-3 exon 5; Set C
gcuccagagucccguaag

SEQ ID NO: 67513 - RNA, 21 nt, Artificial Sequence
  Synthetic Oligonucleotide; TIM-3 exon 5; Set A
uugcuccagagucccguaagu

SEQ ID NO: 67514 - RNA, 19 nt, Artificial Sequence
  Synthetic Oligonucleotide; TIM-3 exon 5; Set C
ugcuccagagucccguaag

SEQ ID NO: 67515 - RNA, 22 nt, Artificial Sequence
  Synthetic Oligonucleotide; TIM-3 exon 5; Set A
guugcuccagagucccguaagu

SEQ ID NO: 67516 - RNA, 20 nt, Artificial Sequence
  Synthetic Oligonucleotide; TIM-3 exon 5; Set A
uugcuccagagucccguaag

SEQ ID NO: 67517 - RNA, 18 nt, Artificial Sequence
  Synthetic Oligonucleotide; TIM-3 exon 5; Set C
ugcuccagagucccguaa

SEQ ID NO: 67518 - RNA, 21 nt, Artificial Sequence
  Synthetic Oligonucleotide; TIM-3 exon 5; Set A
guugcuccagagucccguaag

SEQ ID NO: 67519 - RNA, 23 nt, Artificial Sequence
  Synthetic Oligonucleotide; TIM-3 exon 5; Set A
gguugcuccagagucccguaagu

SEQ ID NO: 67520 - RNA, 19 nt, Artificial Sequence
  Synthetic Oligonucleotide; TIM-3 exon 5; Set A
uugcuccagagucccguaa

SEQ ID NO: 67521 - RNA, 22 nt, Artificial Sequence
  Synthetic Oligonucleotide; TIM-3 exon 5; Set A
gguugcuccagagucccguaag

SEQ ID NO: 67522 - RNA, 24 nt, Artificial Sequence
  Synthetic Oligonucleotide; TIM-3 exon 5; Set A
ugguugcuccagagucccguaagu

SEQ ID NO: 67523 - RNA, 20 nt, Artificial Sequence
  Synthetic Oligonucleotide; TIM-3 exon 5; Set A
guugcuccagagucccguaa

SEQ ID NO: 67524 - RNA, 23 nt, Artificial Sequence
  Synthetic Oligonucleotide; TIM-3 exon 5; Set A
ugguugcuccagagucccguaag

SEQ ID NO: 67525 - RNA, 21 nt, Artificial Sequence
  Synthetic Oligonucleotide; TIM-3 exon 5; Set A
gguugcuccagagucccguaa

SEQ ID NO: 67526 - RNA, 22 nt, Artificial Sequence
  Synthetic Oligonucleotide; TIM-3 exon 5; Set A
ugguugcuccagagucccguaa

SEQ ID NO: 67527 - RNA, 31 nt, Artificial Sequence
  Synthetic Oligonucleotide; TIM-3 exon 5; Set C
auucugaugguugcuccagagucccguaagu

SEQ ID NO: 67528 - RNA, 32 nt, Artificial Sequence
  Synthetic Oligonucleotide; TIM-3 exon 5; Set C
uauucugaugguugcuccagagucccguaagu

SEQ ID NO: 67529 - RNA, 30 nt, Artificial Sequence
  Synthetic Oligonucleotide; TIM-3 exon 5; Set C
auucugaugguugcuccagagucccguaag

SEQ ID NO: 67530 - RNA, 31 nt, Artificial Sequence
  Synthetic Oligonucleotide; TIM-3 exon 5; Set C
uauucugaugguugcuccagagucccguaag

SEQ ID NO: 67531 - RNA, 29 nt, Artificial Sequence
  Synthetic Oligonucleotide; TIM-3 exon 5; Set C
auucugaugguugcuccagagucccguaa

SEQ ID NO: 67532 - RNA, 30 nt, Artificial Sequence
  Synthetic Oligonucleotide; TIM-3 exon 5; Set C
uauucugaugguugcuccagagucccguaa

SEQ ID NO: 67533 - RNA, 38 nt, Artificial Sequence
  Synthetic Oligonucleotide; TIM-3 exon 5; Set C
gaugccuauucugaugguugcuccagagucccguaagu

SEQ ID NO: 67534 - RNA, 39 nt, Artificial Sequence
  Synthetic Oligonucleotide; TIM-3 exon 5; Set C
agaugccuauucugaugguugcuccagagucccguaagu

SEQ ID NO: 67535 - RNA, 37 nt, Artificial Sequence
  Synthetic Oligonucleotide; TIM-3 exon 5; Set C
gaugccuauucugaugguugcuccagagucccguaag

SEQ ID NO: 67536 - RNA, 40 nt, Artificial Sequence
  Synthetic Oligonucleotide; TIM-3 exon 5; Set C
uagaugccuauucugaugguugcuccagagucccguaagu

SEQ ID NO: 67537 - RNA, 38 nt, Artificial Sequence
  Synthetic Oligonucleotide; TIM-3 exon 5; Set C
agaugccuauucugaugguugcuccagagucccguaag

SEQ ID NO: 67538 - RNA, 36 nt, Artificial Sequence
  Synthetic Oligonucleotide; TIM-3 exon 5; Set C
gaugccuauucugaugguugcuccagagucccguaa

SEQ ID NO: 67539 - RNA, 39 nt, Artificial Sequence
  Synthetic Oligonucleotide; TIM-3 exon 5; Set C
uagaugccuauucugaugguugcuccagagucccguaag

SEQ ID NO: 67540 - RNA, 37 nt, Artificial Sequence
  Synthetic Oligonucleotide; TIM-3 exon 5; Set C
agaugccuauucugaugguugcuccagagucccguaa

SEQ ID NO: 67541 - RNA, 40 nt, Artificial Sequence
  Synthetic Oligonucleotide; TIM-3 exon 5; Set C
guagaugccuauucugaugguugcuccagagucccguaag

SEQ ID NO: 67542 - RNA, 38 nt, Artificial Sequence
  Synthetic Oligonucleotide; TIM-3 exon 5; Set C
uagaugccuauucugaugguugcuccagagucccguaa

SEQ ID NO: 67543 - RNA, 22 nt, Artificial Sequence
  Synthetic Oligonucleotide; TIM-3 exon 5; Set C
uauucugaugguugcuccagag

SEQ ID NO: 67544 - RNA, 39 nt, Artificial Sequence
  Synthetic Oligonucleotide; TIM-3 exon 5; Set C
guagaugccuauucugaugguugcuccagagucccguaa

SEQ ID NO: 67545 - RNA, 37 nt, Artificial Sequence
  Synthetic Oligonucleotide; TIM-3 exon 5; Set C
uagaugccuauucugaugguugcuccagagucccgua

SEQ ID NO: 67546 - RNA, 40 nt, Artificial Sequence
  Synthetic Oligonucleotide; TIM-3 exon 5; Set C
uguagaugccuauucugaugguugcuccagagucccguaa

SEQ ID NO: 67547 - RNA, 38 nt, Artificial Sequence
  Synthetic Oligonucleotide; TIM-3 exon 5; Set C
guagaugccuauucugaugguugcuccagagucccgua

SEQ ID NO: 67548 - RNA, 39 nt, Artificial Sequence
  Synthetic Oligonucleotide; TIM-3 exon 5; Set C
uguagaugccuauucugaugguugcuccagagucccgua

SEQ ID NO: 67549 - RNA, 40 nt, Artificial Sequence
  Synthetic Oligonucleotide; TIM-3 exon 5; Set C
auguagaugccuauucugaugguugcuccagagucccgua

SEQ ID NO: 67550 - RNA, 28 nt, Artificial Sequence
  Synthetic Oligonucleotide; TIM-3 exon 5; Set A
gaugccuauucugaugguugcuccagag

SEQ ID NO: 67551 - RNA, 16 nt, Artificial Sequence
  Synthetic Oligonucleotide; TIM-3 exon 5; Set C
uauucugaugguugcu

SEQ ID NO: 67552 - RNA, 29 nt, Artificial Sequence
  Synthetic Oligonucleotide; TIM-3 exon 5; Set A
agaugccuauucugaugguugcuccagag

SEQ ID NO: 67553 - RNA, 15 nt, Artificial Sequence
  Synthetic Oligonucleotide; TIM-3 exon 5; Set C
uauucugaugguugc

SEQ ID NO: 67554 - RNA, 30 nt, Artificial Sequence
  Synthetic Oligonucleotide; TIM-3 exon 5; Set A
uagaugccuauucugaugguugcuccagag

SEQ ID NO: 67555 - RNA, 31 nt, Artificial Sequence
  Synthetic Oligonucleotide; TIM-3 exon 5; Set C
guagaugccuauucugaugguugcuccagag

SEQ ID NO: 67556 - RNA, 32 nt, Artificial Sequence
  Synthetic Oligonucleotide; TIM-3 exon 5; Set C
uguagaugccuauucugaugguugcuccagag

SEQ ID NO: 67557 - RNA, 33 nt, Artificial Sequence
  Synthetic Oligonucleotide; TIM-3 exon 5; Set C
auguagaugccuauucugaugguugcuccagag

SEQ ID NO: 67558 - RNA, 34 nt, Artificial Sequence
  Synthetic Oligonucleotide; TIM-3 exon 5; Set C
gauguagaugccuauucugaugguugcuccagag

SEQ ID NO: 67559 - RNA, 35 nt, Artificial Sequence
  Synthetic Oligonucleotide; TIM-3 exon 5; Set C
cgauguagaugccuauucugaugguugcuccagag

SEQ ID NO: 67560 - RNA, 21 nt, Artificial Sequence
  Synthetic Oligonucleotide; TIM-3 exon 5; Set A
gaugccuauucugaugguugc

SEQ ID NO: 67561 - RNA, 36 nt, Artificial Sequence
  Synthetic Oligonucleotide; TIM-3 exon 5; Set C
ccgauguagaugccuauucugaugguugcuccagag

SEQ ID NO: 67562 - RNA, 20 nt, Artificial Sequence
  Synthetic Oligonucleotide; TIM-3 exon 5; Set C
gaugccuauucugaugguug

SEQ ID NO: 67563 - RNA, 22 nt, Artificial Sequence
  Synthetic Oligonucleotide; TIM-3 exon 5; Set A
agaugccuauucugaugguugc

SEQ ID NO: 67564 - RNA, 24 nt, Artificial Sequence
  Synthetic Oligonucleotide; TIM-3 exon 5; Set A
uagaugccuauucugaugguugcu

SEQ ID NO: 67565 - RNA, 19 nt, Artificial Sequence
  Synthetic Oligonucleotide; TIM-3 exon 5; Set C
gaugccuauucugaugguu

SEQ ID NO: 67566 - RNA, 21 nt, Artificial Sequence
  Synthetic Oligonucleotide; TIM-3 exon 5; Set C
agaugccuauucugaugguug

SEQ ID NO: 67567 - RNA, 23 nt, Artificial Sequence
  Synthetic Oligonucleotide; TIM-3 exon 5; Set A
uagaugccuauucugaugguugc

SEQ ID NO: 67568 - RNA, 25 nt, Artificial Sequence
  Synthetic Oligonucleotide; TIM-3 exon 5; Set A
guagaugccuauucugaugguugcu

SEQ ID NO: 67569 - RNA, 20 nt, Artificial Sequence
  Synthetic Oligonucleotide; TIM-3 exon 5; Set C
agaugccuauucugaugguu

SEQ ID NO: 67570 - RNA, 22 nt, Artificial Sequence
  Synthetic Oligonucleotide; TIM-3 exon 5; Set C
uagaugccuauucugaugguug

SEQ ID NO: 67571 - RNA, 24 nt, Artificial Sequence
  Synthetic Oligonucleotide; TIM-3 exon 5; Set A
guagaugccuauucugaugguugc

SEQ ID NO: 67572 - RNA, 26 nt, Artificial Sequence
  Synthetic Oligonucleotide; TIM-3 exon 5; Set A
uguagaugccuauucugaugguugcu

SEQ ID NO: 67573 - RNA, 21 nt, Artificial Sequence
  Synthetic Oligonucleotide; TIM-3 exon 5; Set C
uagaugccuauucugaugguu

SEQ ID NO: 67574 - RNA, 23 nt, Artificial Sequence
  Synthetic Oligonucleotide; TIM-3 exon 5; Set C
guagaugccuauucugaugguug

SEQ ID NO: 67575 - RNA, 25 nt, Artificial Sequence
  Synthetic Oligonucleotide; TIM-3 exon 5; Set A
uguagaugccuauucugaugguugc

SEQ ID NO: 67576 - RNA, 19 nt, Artificial Sequence
  Synthetic Oligonucleotide; TIM-3 exon 5; Set C
agaugccuauucugauggu

SEQ ID NO: 67577 - RNA, 27 nt, Artificial Sequence
  Synthetic Oligonucleotide; TIM-3 exon 5; Set A
auguagaugccuauucugaugguugcu

SEQ ID NO: 67578 - RNA, 22 nt, Artificial Sequence
  Synthetic Oligonucleotide; TIM-3 exon 5; Set C
guagaugccuauucugaugguu

SEQ ID NO: 67579 - RNA, 24 nt, Artificial Sequence
  Synthetic Oligonucleotide; TIM-3 exon 5; Set A
uguagaugccuauucugaugguug

SEQ ID NO: 67580 - RNA, 26 nt, Artificial Sequence
  Synthetic Oligonucleotide; TIM-3 exon 5; Set A
auguagaugccuauucugaugguugc

SEQ ID NO: 67581 - RNA, 20 nt, Artificial Sequence
  Synthetic Oligonucleotide; TIM-3 exon 5; Set C
uagaugccuauucugauggu

SEQ ID NO: 67582 - RNA, 28 nt, Artificial Sequence
  Synthetic Oligonucleotide; TIM-3 exon 5; Set A
gauguagaugccuauucugaugguugcu

SEQ ID NO: 67583 - RNA, 23 nt, Artificial Sequence
  Synthetic Oligonucleotide; TIM-3 exon 5; Set C
uguagaugccuauucugaugguu

SEQ ID NO: 67584 - RNA, 25 nt, Artificial Sequence
  Synthetic Oligonucleotide; TIM-3 exon 5; Set A
auguagaugccuauucugaugguug

SEQ ID NO: 67585 - RNA, 27 nt, Artificial Sequence
  Synthetic Oligonucleotide; TIM-3 exon 5; Set A
gauguagaugccuauucugaugguugc

SEQ ID NO: 67586 - RNA, 21 nt, Artificial Sequence
  Synthetic Oligonucleotide; TIM-3 exon 5; Set C
guagaugccuauucugauggu

SEQ ID NO: 67587 - RNA, 19 nt, Artificial Sequence
  Synthetic Oligonucleotide; TIM-3 exon 5; Set C
uagaugccuauucugaugg

SEQ ID NO: 67588 - RNA, 29 nt, Artificial Sequence
  Synthetic Oligonucleotide; TIM-3 exon 5; Set A
cgauguagaugccuauucugaugguugcu

SEQ ID NO: 67589 - RNA, 24 nt, Artificial Sequence
  Synthetic Oligonucleotide; TIM-3 exon 5; Set C
auguagaugccuauucugaugguu

SEQ ID NO: 67590 - RNA, 26 nt, Artificial Sequence
  Synthetic Oligonucleotide; TIM-3 exon 5; Set A
gauguagaugccuauucugaugguug

SEQ ID NO: 67591 - RNA, 28 nt, Artificial Sequence
  Synthetic Oligonucleotide; TIM-3 exon 5; Set A
cgauguagaugccuauucugaugguugc

SEQ ID NO: 67592 - RNA, 22 nt, Artificial Sequence
  Synthetic Oligonucleotide; TIM-3 exon 5; Set C
uguagaugccuauucugauggu

SEQ ID NO: 67593 - RNA, 20 nt, Artificial Sequence
  Synthetic Oligonucleotide; TIM-3 exon 5; Set C
guagaugccuauucugaugg

SEQ ID NO: 67594 - RNA, 25 nt, Artificial Sequence
  Synthetic Oligonucleotide; TIM-3 exon 5; Set A
gauguagaugccuauucugaugguu

SEQ ID NO: 67595 - RNA, 27 nt, Artificial Sequence
  Synthetic Oligonucleotide; TIM-3 exon 5; Set A
cgauguagaugccuauucugaugguug

SEQ ID NO: 67596 - RNA, 29 nt, Artificial Sequence
  Synthetic Oligonucleotide; TIM-3 exon 5; Set C
ccgauguagaugccuauucugaugguugc

SEQ ID NO: 67597 - RNA, 23 nt, Artificial Sequence
  Synthetic Oligonucleotide; TIM-3 exon 5; Set C
auguagaugccuauucugauggu

SEQ ID NO: 67598 - RNA, 21 nt, Artificial Sequence
  Synthetic Oligonucleotide; TIM-3 exon 5; Set C
uguagaugccuauucugaugg

SEQ ID NO: 67599 - RNA, 26 nt, Artificial Sequence
  Synthetic Oligonucleotide; TIM-3 exon 5; Set A
cgauguagaugccuauucugaugguu

SEQ ID NO: 67600 - RNA, 28 nt, Artificial Sequence
  Synthetic Oligonucleotide; TIM-3 exon 5; Set A
ccgauguagaugccuauucugaugguug

SEQ ID NO: 67601 - RNA, 24 nt, Artificial Sequence
  Synthetic Oligonucleotide; TIM-3 exon 5; Set A
gauguagaugccuauucugauggu

SEQ ID NO: 67602 - RNA, 22 nt, Artificial Sequence
  Synthetic Oligonucleotide; TIM-3 exon 5; Set C
auguagaugccuauucugaugg

SEQ ID NO: 67603 - RNA, 27 nt, Artificial Sequence
  Synthetic Oligonucleotide; TIM-3 exon 5; Set A
ccgauguagaugccuauucugaugguu

SEQ ID NO: 67604 - RNA, 25 nt, Artificial Sequence
  Synthetic Oligonucleotide; TIM-3 exon 5; Set A
cgauguagaugccuauucugauggu

SEQ ID NO: 67605 - RNA, 23 nt, Artificial Sequence
  Synthetic Oligonucleotide; TIM-3 exon 5; Set C
gauguagaugccuauucugaugg

SEQ ID NO: 67606 - RNA, 26 nt, Artificial Sequence
  Synthetic Oligonucleotide; TIM-3 exon 5; Set A
ccgauguagaugccuauucugauggu

SEQ ID NO: 67607 - RNA, 24 nt, Artificial Sequence
  Synthetic Oligonucleotide; TIM-3 exon 5; Set A
cgauguagaugccuauucugaugg

SEQ ID NO: 67608 - RNA, 15 nt, Artificial Sequence
  Synthetic Oligonucleotide; TIM-3 exon 5; Set C
guagaugccuauucu

SEQ ID NO: 67609 - RNA, 16 nt, Artificial Sequence
  Synthetic Oligonucleotide; TIM-3 exon 5; Set C
uguagaugccuauucu

SEQ ID NO: 67610 - RNA, 17 nt, Artificial Sequence
  Synthetic Oligonucleotide; TIM-3 exon 5; Set C
auguagaugccuauucu

SEQ ID NO: 67611 - RNA, 15 nt, Artificial Sequence
  Synthetic Oligonucleotide; TIM-3 exon 5; Set C
uguagaugccuauuc

SEQ ID NO: 67612 - RNA, 18 nt, Artificial Sequence
  Synthetic Oligonucleotide; TIM-3 exon 5; Set C
gauguagaugccuauucu

SEQ ID NO: 67613 - RNA, 16 nt, Artificial Sequence
  Synthetic Oligonucleotide; TIM-3 exon 5; Set C
auguagaugccuauuc

SEQ ID NO: 67614 - RNA, 15 nt, Artificial Sequence
  Synthetic Oligonucleotide; TIM-3 exon 5; Set C
auguagaugccuauu

SEQ ID NO: 67615 - RNA, 19 nt, Artificial Sequence
  Synthetic Oligonucleotide; TIM-3 exon 5; Set C
cgauguagaugccuauucu

SEQ ID NO: 67616 - RNA, 17 nt, Artificial Sequence
  Synthetic Oligonucleotide; TIM-3 exon 5; Set C
gauguagaugccuauuc

SEQ ID NO: 67617 - RNA, 16 nt, Artificial Sequence
  Synthetic Oligonucleotide; TIM-3 exon 5; Set C
gauguagaugccuauu

SEQ ID NO: 67618 - RNA, 40 nt, Artificial Sequence
  Synthetic Oligonucleotide; TIM-3 exon 5; Set C
gaucccugcuccgauguagaugccuauucugaugguugcu

SEQ ID NO: 67619 - RNA, 18 nt, Artificial Sequence
  Synthetic Oligonucleotide; TIM-3 exon 5; Set C
cgauguagaugccuauuc

SEQ ID NO: 67620 - RNA, 37 nt, Artificial Sequence
  Synthetic Oligonucleotide; TIM-3 exon 5; Set C
aucccugcuccgauguagaugccuauucugaugguug

SEQ ID NO: 67621 - RNA, 39 nt, Artificial Sequence
  Synthetic Oligonucleotide; TIM-3 exon 5; Set C
gaucccugcuccgauguagaugccuauucugaugguugc

SEQ ID NO: 67622 - RNA, 15 nt, Artificial Sequence
  Synthetic Oligonucleotide; TIM-3 exon 5; Set C
gauguagaugccuau

SEQ ID NO: 67623 - RNA, 17 nt, Artificial Sequence
  Synthetic Oligonucleotide; TIM-3 exon 5; Set C
cgauguagaugccuauu

SEQ ID NO: 67624 - RNA, 36 nt, Artificial Sequence
  Synthetic Oligonucleotide; TIM-3 exon 5; Set C
aucccugcuccgauguagaugccuauucugaugguu

SEQ ID NO: 67625 - RNA, 38 nt, Artificial Sequence
  Synthetic Oligonucleotide; TIM-3 exon 5; Set C
gaucccugcuccgauguagaugccuauucugaugguug

SEQ ID NO: 67626 - RNA, 16 nt, Artificial Sequence
  Synthetic Oligonucleotide; TIM-3 exon 5; Set C
cgauguagaugccuau

SEQ ID NO: 67627 - RNA, 18 nt, Artificial Sequence
  Synthetic Oligonucleotide; TIM-3 exon 5; Set C
ccgauguagaugccuauu

SEQ ID NO: 67628 - RNA, 37 nt, Artificial Sequence
  Synthetic Oligonucleotide; TIM-3 exon 5; Set C
gaucccugcuccgauguagaugccuauucugaugguu

SEQ ID NO: 67629 - RNA, 17 nt, Artificial Sequence
  Synthetic Oligonucleotide; TIM-3 exon 5; Set C
ccgauguagaugccuau

SEQ ID NO: 67630 - RNA, 36 nt, Artificial Sequence
  Synthetic Oligonucleotide; TIM-3 exon 5; Set C
gaucccugcuccgauguagaugccuauucugauggu

SEQ ID NO: 67631 - RNA, 35 nt, Artificial Sequence
  Synthetic Oligonucleotide; TIM-3 exon 5; Set C
gaucccugcuccgauguagaugccuauucugaugg

SEQ ID NO: 67632 - RNA, 30 nt, Artificial Sequence
  Synthetic Oligonucleotide; TIM-3 exon 5; Set C
gaucccugcuccgauguagaugccuauucu

SEQ ID NO: 67633 - RNA, 28 nt, Artificial Sequence
  Synthetic Oligonucleotide; TIM-3 exon 5; Set C
gaucccugcuccgauguagaugccuauu

SEQ ID NO: 67634 - RNA, 27 nt, Artificial Sequence
  Synthetic Oligonucleotide; TIM-3 exon 5; Set C
gaucccugcuccgauguagaugccuau

SEQ ID NO: 67635 - RNA, 17 nt, Artificial Sequence
  Synthetic Oligonucleotide; TIM-3 exon 5; Set C
ucccugcuccgauguag

SEQ ID NO: 67636 - RNA, 21 nt, Artificial Sequence
  Synthetic Oligonucleotide; TIM-3 exon 5; Set A
gaucccugcuccgauguagau

SEQ ID NO: 67637 - RNA, 18 nt, Artificial Sequence
  Synthetic Oligonucleotide; TIM-3 exon 5; Set C
aucccugcuccgauguag

SEQ ID NO: 67638 - RNA, 16 nt, Artificial Sequence
  Synthetic Oligonucleotide; TIM-3 exon 5; Set C
ucccugcuccgaugua

SEQ ID NO: 67639 - RNA, 20 nt, Artificial Sequence
  Synthetic Oligonucleotide; TIM-3 exon 5; Set A
gaucccugcuccgauguaga

SEQ ID NO: 67640 - RNA, 19 nt, Artificial Sequence
  Synthetic Oligonucleotide; TIM-3 exon 5; Set A
gaucccugcuccgauguag

SEQ ID NO: 67641 - RNA, 17 nt, Artificial Sequence
  Synthetic Oligonucleotide; TIM-3 exon 5; Set C
aucccugcuccgaugua

SEQ ID NO: 67642 - RNA, 15 nt, Artificial Sequence
  Synthetic Oligonucleotide; TIM-3 exon 5; Set C
ucccugcuccgaugu

SEQ ID NO: 67643 - RNA, 18 nt, Artificial Sequence
  Synthetic Oligonucleotide; TIM-3 exon 5; Set A
gaucccugcuccgaugua

SEQ ID NO: 67644 - RNA, 16 nt, Artificial Sequence
  Synthetic Oligonucleotide; TIM-3 exon 5; Set C
aucccugcuccgaugu

SEQ ID NO: 67645 - RNA, 15 nt, Artificial Sequence
  Synthetic Oligonucleotide; TIM-3 exon 5; Set C
aucccugcuccgaug

SEQ ID NO: 67646 - RNA, 17 nt, Artificial Sequence
  Synthetic Oligonucleotide; TIM-3 exon 5; Set C
gaucccugcuccgaugu

SEQ ID NO: 67647 - RNA, 16 nt, Artificial Sequence
  Synthetic Oligonucleotide; TIM-3 exon 5; Set C
gaucccugcuccgaug

SEQ ID NO: 67648 - RNA, 15 nt, Artificial Sequence
  Synthetic Oligonucleotide; TIM-3 exon 5; Set C
gaucccugcuccgau

SEQ ID NO: 67649 - RNA, 20 nt, Artificial Sequence
  Synthetic Oligonucleotide; TIM-3 exon 5; Set C
caaaaacacuuacauuugaa

SEQ ID NO: 67650 - RNA, 21 nt, Artificial Sequence
  Synthetic Oligonucleotide; TIM-3 exon 5; Set C
acaaaaacacuuacauuugaa

SEQ ID NO: 67651 - RNA, 22 nt, Artificial Sequence
  Synthetic Oligonucleotide; TIM-3 exon 5; Set C
aacaaaaacacuuacauuugaa

SEQ ID NO: 67652 - RNA, 20 nt, Artificial Sequence
  Synthetic Oligonucleotide; TIM-3 exon 5; Set C
acaaaaacacuuacauuuga

SEQ ID NO: 67653 - RNA, 21 nt, Artificial Sequence
  Synthetic Oligonucleotide; TIM-3 exon 5; Set C
aacaaaaacacuuacauuuga

SEQ ID NO: 67654 - RNA, 27 nt, Artificial Sequence
  Synthetic Oligonucleotide; TIM-3 exon 5; Set C
agagaaacaaaaacacuuacauuugaa

SEQ ID NO: 67655 - RNA, 26 nt, Artificial Sequence
  Synthetic Oligonucleotide; TIM-3 exon 5; Set C
agagaaacaaaaacacuuacauuuga

SEQ ID NO: 67656 - RNA, 38 nt, Artificial Sequence
  Synthetic Oligonucleotide; TIM-3 exon 5; Set C
agggagagagaaacaaaaacacuuacauuugaaaauua

SEQ ID NO: 67657 - RNA, 31 nt, Artificial Sequence
  Synthetic Oligonucleotide; TIM-3 exon 5; Set C
ggagagagaaacaaaaacacuuacauuugaa

SEQ ID NO: 67658 - RNA, 32 nt, Artificial Sequence
  Synthetic Oligonucleotide; TIM-3 exon 5; Set C
gggagagagaaacaaaaacacuuacauuugaa

SEQ ID NO: 67659 - RNA, 30 nt, Artificial Sequence
  Synthetic Oligonucleotide; TIM-3 exon 5; Set C
ggagagagaaacaaaaacacuuacauuuga

SEQ ID NO: 67660 - RNA, 33 nt, Artificial Sequence
  Synthetic Oligonucleotide; TIM-3 exon 5; Set C
agggagagagaaacaaaaacacuuacauuugaa

SEQ ID NO: 67661 - RNA, 31 nt, Artificial Sequence
  Synthetic Oligonucleotide; TIM-3 exon 5; Set B
gggagagagaaacaaaaacacuuacauuuga

SEQ ID NO: 67662 - RNA, 32 nt, Artificial Sequence
  Synthetic Oligonucleotide; TIM-3 exon 5; Set B
agggagagagaaacaaaaacacuuacauuuga

SEQ ID NO: 67663 - RNA, 40 nt, Artificial Sequence
  Synthetic Oligonucleotide; TIM-3 exon 5; Set B
uuaucagagggagagagaaacaaaaacacuuacauuugaa

SEQ ID NO: 67664 - RNA, 39 nt, Artificial Sequence
  Synthetic Oligonucleotide; TIM-3 exon 5; Set B
uuaucagagggagagagaaacaaaaacacuuacauuuga

SEQ ID NO: 67665 - RNA, 40 nt, Artificial Sequence
  Synthetic Oligonucleotide; TIM-3 exon 5; Set B
guuaucagagggagagagaaacaaaaacacuuacauuuga

SEQ ID NO: 67666 - RNA, 25 nt, Artificial Sequence
  Synthetic Oligonucleotide; TIM-3 exon 5; Set C
uuaucagagggagagagaaacaaaa

SEQ ID NO: 67667 - RNA, 26 nt, Artificial Sequence
  Synthetic Oligonucleotide; TIM-3 exon 5; Set C
guuaucagagggagagagaaacaaaa

SEQ ID NO: 67668 - RNA, 24 nt, Artificial Sequence
  Synthetic Oligonucleotide; TIM-3 exon 5; Set C
uuaucagagggagagagaaacaaa

SEQ ID NO: 67669 - RNA, 27 nt, Artificial Sequence
  Synthetic Oligonucleotide; TIM-3 exon 5; Set C
uguuaucagagggagagagaaacaaaa

SEQ ID NO: 67670 - RNA, 25 nt, Artificial Sequence
  Synthetic Oligonucleotide; TIM-3 exon 5; Set C
guuaucagagggagagagaaacaaa

SEQ ID NO: 67671 - RNA, 23 nt, Artificial Sequence
  Synthetic Oligonucleotide; TIM-3 exon 5; Set C
uuaucagagggagagagaaacaa

SEQ ID NO: 67672 - RNA, 22 nt, Artificial Sequence
  Synthetic Oligonucleotide; TIM-3 exon 5; Set C
uuaucagagggagagagaaaca

SEQ ID NO: 67673 - RNA, 28 nt, Artificial Sequence
  Synthetic Oligonucleotide; TIM-3 exon 5; Set C
uuguuaucagagggagagagaaacaaaa

SEQ ID NO: 67674 - RNA, 26 nt, Artificial Sequence
  Synthetic Oligonucleotide; TIM-3 exon 5; Set C
uguuaucagagggagagagaaacaaa

SEQ ID NO: 67675 - RNA, 24 nt, Artificial Sequence
  Synthetic Oligonucleotide; TIM-3 exon 5; Set C
guuaucagagggagagagaaacaa

SEQ ID NO: 67676 - RNA, 23 nt, Artificial Sequence
  Synthetic Oligonucleotide; TIM-3 exon 5; Set C
guuaucagagggagagagaaaca

SEQ ID NO: 67677 - RNA, 21 nt, Artificial Sequence
  Synthetic Oligonucleotide; TIM-3 exon 5; Set C
uuaucagagggagagagaaac

SEQ ID NO: 67678 - RNA, 29 nt, Artificial Sequence
  Synthetic Oligonucleotide; TIM-3 exon 5; Set C
uuuguuaucagagggagagagaaacaaaa

SEQ ID NO: 67679 - RNA, 27 nt, Artificial Sequence
  Synthetic Oligonucleotide; TIM-3 exon 5; Set C
uuguuaucagagggagagagaaacaaa

SEQ ID NO: 67680 - RNA, 25 nt, Artificial Sequence
  Synthetic Oligonucleotide; TIM-3 exon 5; Set C
uguuaucagagggagagagaaacaa

SEQ ID NO: 67681 - RNA, 24 nt, Artificial Sequence
  Synthetic Oligonucleotide; TIM-3 exon 5; Set C
uguuaucagagggagagagaaaca

SEQ ID NO: 67682 - RNA, 22 nt, Artificial Sequence
  Synthetic Oligonucleotide; TIM-3 exon 5; Set C
guuaucagagggagagagaaac

SEQ ID NO: 67683 - RNA, 28 nt, Artificial Sequence
  Synthetic Oligonucleotide; TIM-3 exon 5; Set C
uuuguuaucagagggagagagaaacaaa

SEQ ID NO: 67684 - RNA, 26 nt, Artificial Sequence
  Synthetic Oligonucleotide; TIM-3 exon 5; Set C
uuguuaucagagggagagagaaacaa

SEQ ID NO: 67685 - RNA, 25 nt, Artificial Sequence
  Synthetic Oligonucleotide; TIM-3 exon 5; Set C
uuguuaucagagggagagagaaaca

SEQ ID NO: 67686 - RNA, 23 nt, Artificial Sequence
  Synthetic Oligonucleotide; TIM-3 exon 5; Set C
uguuaucagagggagagagaaac

SEQ ID NO: 67687 - RNA, 29 nt, Artificial Sequence
  Synthetic Oligonucleotide; TIM-3 exon 5; Set C
auuuguuaucagagggagagagaaacaaa

SEQ ID NO: 67688 - RNA, 27 nt, Artificial Sequence
  Synthetic Oligonucleotide; TIM-3 exon 5; Set C
uuuguuaucagagggagagagaaacaa

SEQ ID NO: 67689 - RNA, 26 nt, Artificial Sequence
  Synthetic Oligonucleotide; TIM-3 exon 5; Set C
uuuguuaucagagggagagagaaaca

SEQ ID NO: 67690 - RNA, 24 nt, Artificial Sequence
  Synthetic Oligonucleotide; TIM-3 exon 5; Set C
uuguuaucagagggagagagaaac

SEQ ID NO: 67691 - RNA, 28 nt, Artificial Sequence
  Synthetic Oligonucleotide; TIM-3 exon 5; Set C
auuuguuaucagagggagagagaaacaa

SEQ ID NO: 67692 - RNA, 27 nt, Artificial Sequence
  Synthetic Oligonucleotide; TIM-3 exon 5; Set C
auuuguuaucagagggagagagaaaca

SEQ ID NO: 67693 - RNA, 25 nt, Artificial Sequence
  Synthetic Oligonucleotide; TIM-3 exon 5; Set C
uuuguuaucagagggagagagaaac

SEQ ID NO: 67694 - RNA, 26 nt, Artificial Sequence
  Synthetic Oligonucleotide; TIM-3 exon 5; Set C
auuuguuaucagagggagagagaaac

SEQ ID NO: 67695 - RNA, 34 nt, Artificial Sequence
  Synthetic Oligonucleotide; TIM-3 exon 5; Set C
aagaauuuguuaucagagggagagagaaacaaaa

SEQ ID NO: 67696 - RNA, 16 nt, Artificial Sequence
  Synthetic Oligonucleotide; TIM-3 exon 5; Set C
uuaucagagggagaga

SEQ ID NO: 67697 - RNA, 33 nt, Artificial Sequence
  Synthetic Oligonucleotide; TIM-3 exon 5; Set C
aagaauuuguuaucagagggagagagaaacaaa

SEQ ID NO: 67698 - RNA, 35 nt, Artificial Sequence
  Synthetic Oligonucleotide; TIM-3 exon 5; Set C
gaagaauuuguuaucagagggagagagaaacaaaa

SEQ ID NO: 67699 - RNA, 17 nt, Artificial Sequence
  Synthetic Oligonucleotide; TIM-3 exon 5; Set C
guuaucagagggagaga

SEQ ID NO: 67700 - RNA, 32 nt, Artificial Sequence
  Synthetic Oligonucleotide; TIM-3 exon 5; Set C
aagaauuuguuaucagagggagagagaaacaa

SEQ ID NO: 67701 - RNA, 34 nt, Artificial Sequence
  Synthetic Oligonucleotide; TIM-3 exon 5; Set B
gaagaauuuguuaucagagggagagagaaacaaa

SEQ ID NO: 67702 - RNA, 36 nt, Artificial Sequence
  Synthetic Oligonucleotide; TIM-3 exon 5; Set B
ugaagaauuuguuaucagagggagagagaaacaaaa

SEQ ID NO: 67703 - RNA, 18 nt, Artificial Sequence
  Synthetic Oligonucleotide; TIM-3 exon 5; Set C
uguuaucagagggagaga

SEQ ID NO: 67704 - RNA, 20 nt, Artificial Sequence
  Synthetic Oligonucleotide; TIM-3 exon 5; Set C
uuguuaucagagggagagag

SEQ ID NO: 67705 - RNA, 31 nt, Artificial Sequence
  Synthetic Oligonucleotide; TIM-3 exon 5; Set C
aagaauuuguuaucagagggagagagaaaca

SEQ ID NO: 67706 - RNA, 33 nt, Artificial Sequence
  Synthetic Oligonucleotide; TIM-3 exon 5; Set B
gaagaauuuguuaucagagggagagagaaacaa

SEQ ID NO: 67707 - RNA, 35 nt, Artificial Sequence
  Synthetic Oligonucleotide; TIM-3 exon 5; Set B
ugaagaauuuguuaucagagggagagagaaacaaa

SEQ ID NO: 67708 - RNA, 19 nt, Artificial Sequence
  Synthetic Oligonucleotide; TIM-3 exon 5; Set C
uuguuaucagagggagaga

SEQ ID NO: 67709 - RNA, 21 nt, Artificial Sequence
  Synthetic Oligonucleotide; TIM-3 exon 5; Set C
uuuguuaucagagggagagag

SEQ ID NO: 67710 - RNA, 30 nt, Artificial Sequence
  Synthetic Oligonucleotide; TIM-3 exon 5; Set C
aagaauuuguuaucagagggagagagaaac

SEQ ID NO: 67711 - RNA, 32 nt, Artificial Sequence
  Synthetic Oligonucleotide; TIM-3 exon 5; Set B
gaagaauuuguuaucagagggagagagaaaca

SEQ ID NO: 67712 - RNA, 34 nt, Artificial Sequence
  Synthetic Oligonucleotide; TIM-3 exon 5; Set B
ugaagaauuuguuaucagagggagagagaaacaa

SEQ ID NO: 67713 - RNA, 20 nt, Artificial Sequence
  Synthetic Oligonucleotide; TIM-3 exon 5; Set C
uuuguuaucagagggagaga

SEQ ID NO: 67714 - RNA, 22 nt, Artificial Sequence
  Synthetic Oligonucleotide; TIM-3 exon 5; Set C
auuuguuaucagagggagagag

SEQ ID NO: 67715 - RNA, 26 nt, Artificial Sequence
  Synthetic Oligonucleotide; TIM-3 exon 5; Set C
gaauuuguuaucagagggagagagaa

SEQ ID NO: 67716 - RNA, 31 nt, Artificial Sequence
  Synthetic Oligonucleotide; TIM-3 exon 5; Set C
gaagaauuuguuaucagagggagagagaaac

SEQ ID NO: 67717 - RNA, 33 nt, Artificial Sequence
  Synthetic Oligonucleotide; TIM-3 exon 5; Set B
ugaagaauuuguuaucagagggagagagaaaca

SEQ ID NO: 67718 - RNA, 21 nt, Artificial Sequence
  Synthetic Oligonucleotide; TIM-3 exon 5; Set C
auuuguuaucagagggagaga

SEQ ID NO: 67719 - RNA, 23 nt, Artificial Sequence
  Synthetic Oligonucleotide; TIM-3 exon 5; Set C
aauuuguuaucagagggagagag

SEQ ID NO: 67720 - RNA, 27 nt, Artificial Sequence
  Synthetic Oligonucleotide; TIM-3 exon 5; Set C
agaauuuguuaucagagggagagagaa

SEQ ID NO: 67721 - RNA, 32 nt, Artificial Sequence
  Synthetic Oligonucleotide; TIM-3 exon 5; Set B
ugaagaauuuguuaucagagggagagagaaac

SEQ ID NO: 67722 - RNA, 22 nt, Artificial Sequence
  Synthetic Oligonucleotide; TIM-3 exon 5; Set C
aauuuguuaucagagggagaga

SEQ ID NO: 67723 - RNA, 24 nt, Artificial Sequence
  Synthetic Oligonucleotide; TIM-3 exon 5; Set C
gaauuuguuaucagagggagagag

SEQ ID NO: 67724 - RNA, 15 nt, Artificial Sequence
  Synthetic Oligonucleotide; TIM-3 exon 5; Set C
uuguuaucagaggga

SEQ ID NO: 67725 - RNA, 23 nt, Artificial Sequence
  Synthetic Oligonucleotide; TIM-3 exon 5; Set C
gaauuuguuaucagagggagaga

SEQ ID NO: 67726 - RNA, 25 nt, Artificial Sequence
  Synthetic Oligonucleotide; TIM-3 exon 5; Set C
agaauuuguuaucagagggagagag

SEQ ID NO: 67727 - RNA, 16 nt, Artificial Sequence
  Synthetic Oligonucleotide; TIM-3 exon 5; Set C
uuuguuaucagaggga

SEQ ID NO: 67728 - RNA, 24 nt, Artificial Sequence
  Synthetic Oligonucleotide; TIM-3 exon 5; Set C
agaauuuguuaucagagggagaga

SEQ ID NO: 67729 - RNA, 26 nt, Artificial Sequence
  Synthetic Oligonucleotide; TIM-3 exon 5; Set C
aagaauuuguuaucagagggagagag

SEQ ID NO: 67730 - RNA, 15 nt, Artificial Sequence
  Synthetic Oligonucleotide; TIM-3 exon 5; Set C
uuuguuaucagaggg

SEQ ID NO: 67731 - RNA, 25 nt, Artificial Sequence
  Synthetic Oligonucleotide; TIM-3 exon 5; Set C
aagaauuuguuaucagagggagaga

SEQ ID NO: 67732 - RNA, 27 nt, Artificial Sequence
  Synthetic Oligonucleotide; TIM-3 exon 5; Set C
gaagaauuuguuaucagagggagagag

SEQ ID NO: 67733 - RNA, 16 nt, Artificial Sequence
  Synthetic Oligonucleotide; TIM-3 exon 5; Set C
auuuguuaucagaggg

SEQ ID NO: 67734 - RNA, 26 nt, Artificial Sequence
  Synthetic Oligonucleotide; TIM-3 exon 5; Set C
gaagaauuuguuaucagagggagaga

SEQ ID NO: 67735 - RNA, 27 nt, Artificial Sequence
  Synthetic Oligonucleotide; TIM-3 exon 5; Set C
ugaagaauuuguuaucagagggagaga

SEQ ID NO: 67736 - RNA, 23 nt, Artificial Sequence
  Synthetic Oligonucleotide; TIM-3 exon 5; Set C
ugaagaauuuguuaucagaggga

SEQ ID NO: 67737 - RNA, 22 nt, Artificial Sequence
  Synthetic Oligonucleotide; TIM-3 exon 5; Set C
ugaagaauuuguuaucagaggg

SEQ ID NO: 67738 - RNA, 21 nt, Artificial Sequence
  Synthetic Oligonucleotide; TIM-3 exon 5; Set C
ugaagaauuuguuaucagagg

SEQ ID NO: 67739 - RNA, 22 nt, Artificial Sequence
  Synthetic Oligonucleotide; TIM-3 exon 5; Set C
cugaagaauuuguuaucagagg

SEQ ID NO: 67740 - RNA, 15 nt, Artificial Sequence
  Synthetic Oligonucleotide; TIM-3 exon 5; Set C
cugaagaauuuguua

SEQ ID NO: 67741 - RNA, 16 nt, Artificial Sequence
  Synthetic Oligonucleotide; TIM-3 exon 5; Set C
acugaagaauuuguua

SEQ ID NO: 67742 - RNA, 15 nt, Artificial Sequence
  Synthetic Oligonucleotide; TIM-3 exon 5; Set C
acugaagaauuuguu

SEQ ID NO: 67743 - RNA, 17 nt, Artificial Sequence
  Synthetic Oligonucleotide; TIM-3 exon 5; Set C
gcuccagagucccguaa

SEQ ID NO: 67744 - RNA, 16 nt, Artificial Sequence
  Synthetic Oligonucleotide; TIM-3 exon 5; Set C
gcuccagagucccgua

SEQ ID NO: 67745 - RNA, 17 nt, Artificial Sequence
  Synthetic Oligonucleotide; TIM-3 exon 5; Set A
ugcuccagagucccgua

SEQ ID NO: 67746 - RNA, 18 nt, Artificial Sequence
  Synthetic Oligonucleotide; TIM-3 exon 5; Set A
uugcuccagagucccgua

SEQ ID NO: 67747 - RNA, 16 nt, Artificial Sequence
  Synthetic Oligonucleotide; TIM-3 exon 5; Set C
ugcuccagagucccgu

SEQ ID NO: 67748 - RNA, 19 nt, Artificial Sequence
  Synthetic Oligonucleotide; TIM-3 exon 5; Set A
guugcuccagagucccgua

SEQ ID NO: 67749 - RNA, 17 nt, Artificial Sequence
  Synthetic Oligonucleotide; TIM-3 exon 5; Set A
uugcuccagagucccgu

SEQ ID NO: 67750 - RNA, 20 nt, Artificial Sequence
  Synthetic Oligonucleotide; TIM-3 exon 5; Set A
gguugcuccagagucccgua

SEQ ID NO: 67751 - RNA, 18 nt, Artificial Sequence
  Synthetic Oligonucleotide; TIM-3 exon 5; Set A
guugcuccagagucccgu

SEQ ID NO: 67752 - RNA, 21 nt, Artificial Sequence
  Synthetic Oligonucleotide; TIM-3 exon 5; Set A
ugguugcuccagagucccgua

SEQ ID NO: 67753 - RNA, 19 nt, Artificial Sequence
  Synthetic Oligonucleotide; TIM-3 exon 5; Set A
gguugcuccagagucccgu

SEQ ID NO: 67754 - RNA, 20 nt, Artificial Sequence
  Synthetic Oligonucleotide; TIM-3 exon 5; Set A
ugguugcuccagagucccgu

SEQ ID NO: 67755 - RNA, 29 nt, Artificial Sequence
  Synthetic Oligonucleotide; TIM-3 exon 5; Set C
ucugaugguugcuccagagucccguaagu

SEQ ID NO: 67756 - RNA, 28 nt, Artificial Sequence
  Synthetic Oligonucleotide; TIM-3 exon 5; Set C
ucugaugguugcuccagagucccguaag

SEQ ID NO: 67757 - RNA, 30 nt, Artificial Sequence
  Synthetic Oligonucleotide; TIM-3 exon 5; Set C
uucugaugguugcuccagagucccguaagu

SEQ ID NO: 67758 - RNA, 29 nt, Artificial Sequence
  Synthetic Oligonucleotide; TIM-3 exon 5; Set C
uucugaugguugcuccagagucccguaag

SEQ ID NO: 67759 - RNA, 27 nt, Artificial Sequence
  Synthetic Oligonucleotide; TIM-3 exon 5; Set C
ucugaugguugcuccagagucccguaa

SEQ ID NO: 67760 - RNA, 28 nt, Artificial Sequence
  Synthetic Oligonucleotide; TIM-3 exon 5; Set C
uucugaugguugcuccagagucccguaa

SEQ ID NO: 67761 - RNA, 26 nt, Artificial Sequence
  Synthetic Oligonucleotide; TIM-3 exon 5; Set C
ucugaugguugcuccagagucccgua

SEQ ID NO: 67762 - RNA, 33 nt, Artificial Sequence
  Synthetic Oligonucleotide; TIM-3 exon 5; Set C
cuauucugaugguugcuccagagucccguaagu

SEQ ID NO: 67763 - RNA, 27 nt, Artificial Sequence
  Synthetic Oligonucleotide; TIM-3 exon 5; Set C
uucugaugguugcuccagagucccgua

SEQ ID NO: 67764 - RNA, 32 nt, Artificial Sequence
  Synthetic Oligonucleotide; TIM-3 exon 5; Set C
cuauucugaugguugcuccagagucccguaag

SEQ ID NO: 67765 - RNA, 28 nt, Artificial Sequence
  Synthetic Oligonucleotide; TIM-3 exon 5; Set C
auucugaugguugcuccagagucccgua

SEQ ID NO: 67766 - RNA, 31 nt, Artificial Sequence
  Synthetic Oligonucleotide; TIM-3 exon 5; Set C
cuauucugaugguugcuccagagucccguaa

SEQ ID NO: 67767 - RNA, 29 nt, Artificial Sequence
  Synthetic Oligonucleotide; TIM-3 exon 5; Set C
uauucugaugguugcuccagagucccgua

SEQ ID NO: 67768 - RNA, 27 nt, Artificial Sequence
  Synthetic Oligonucleotide; TIM-3 exon 5; Set C
auucugaugguugcuccagagucccgu

SEQ ID NO: 67769 - RNA, 30 nt, Artificial Sequence
  Synthetic Oligonucleotide; TIM-3 exon 5; Set C
cuauucugaugguugcuccagagucccgua

SEQ ID NO: 67770 - RNA, 28 nt, Artificial Sequence
  Synthetic Oligonucleotide; TIM-3 exon 5; Set C
uauucugaugguugcuccagagucccgu

SEQ ID NO: 67771 - RNA, 19 nt, Artificial Sequence
  Synthetic Oligonucleotide; TIM-3 exon 5; Set C
ucugaugguugcuccagag

SEQ ID NO: 67772 - RNA, 20 nt, Artificial Sequence
  Synthetic Oligonucleotide; TIM-3 exon 5; Set C
uucugaugguugcuccagag

SEQ ID NO: 67773 - RNA, 21 nt, Artificial Sequence
  Synthetic Oligonucleotide; TIM-3 exon 5; Set C
auucugaugguugcuccagag

SEQ ID NO: 67774 - RNA, 35 nt, Artificial Sequence
  Synthetic Oligonucleotide; TIM-3 exon 5; Set C
gaugccuauucugaugguugcuccagagucccgua

SEQ ID NO: 67775 - RNA, 36 nt, Artificial Sequence
  Synthetic Oligonucleotide; TIM-3 exon 5; Set C
agaugccuauucugaugguugcuccagagucccgua

SEQ ID NO: 67776 - RNA, 34 nt, Artificial Sequence
  Synthetic Oligonucleotide; TIM-3 exon 5; Set C
gaugccuauucugaugguugcuccagagucccgu

SEQ ID NO: 67777 - RNA, 23 nt, Artificial Sequence
  Synthetic Oligonucleotide; TIM-3 exon 5; Set A
cuauucugaugguugcuccagag

SEQ ID NO: 67778 - RNA, 35 nt, Artificial Sequence
  Synthetic Oligonucleotide; TIM-3 exon 5; Set C
agaugccuauucugaugguugcuccagagucccgu

SEQ ID NO: 67779 - RNA, 21 nt, Artificial Sequence
  Synthetic Oligonucleotide; TIM-3 exon 5; Set C
uauucugaugguugcuccaga

SEQ ID NO: 67780 - RNA, 36 nt, Artificial Sequence
  Synthetic Oligonucleotide; TIM-3 exon 5; Set C
uagaugccuauucugaugguugcuccagagucccgu

SEQ ID NO: 67781 - RNA, 37 nt, Artificial Sequence
  Synthetic Oligonucleotide; TIM-3 exon 5; Set C
guagaugccuauucugaugguugcuccagagucccgu

SEQ ID NO: 67782 - RNA, 35 nt, Artificial Sequence
  Synthetic Oligonucleotide; TIM-3 exon 5; Set C
uagaugccuauucugaugguugcuccagagucccg

SEQ ID NO: 67783 - RNA, 38 nt, Artificial Sequence
  Synthetic Oligonucleotide; TIM-3 exon 5; Set C
uguagaugccuauucugaugguugcuccagagucccgu

SEQ ID NO: 67784 - RNA, 36 nt, Artificial Sequence
  Synthetic Oligonucleotide; TIM-3 exon 5; Set C
guagaugccuauucugaugguugcuccagagucccg

SEQ ID NO: 67785 - RNA, 15 nt, Artificial Sequence
  Synthetic Oligonucleotide; TIM-3 exon 5; Set C
auucugaugguugcu

SEQ ID NO: 67786 - RNA, 39 nt, Artificial Sequence
  Synthetic Oligonucleotide; TIM-3 exon 5; Set C
auguagaugccuauucugaugguugcuccagagucccgu

SEQ ID NO: 67787 - RNA, 37 nt, Artificial Sequence
  Synthetic Oligonucleotide; TIM-3 exon 5; Set C
uguagaugccuauucugaugguugcuccagagucccg

SEQ ID NO: 67788 - RNA, 40 nt, Artificial Sequence
  Synthetic Oligonucleotide; TIM-3 exon 5; Set C
gauguagaugccuauucugaugguugcuccagagucccgu

SEQ ID NO: 67789 - RNA, 38 nt, Artificial Sequence
  Synthetic Oligonucleotide; TIM-3 exon 5; Set C
auguagaugccuauucugaugguugcuccagagucccg

SEQ ID NO: 67790 - RNA, 17 nt, Artificial Sequence
  Synthetic Oligonucleotide; TIM-3 exon 5; Set C
cuauucugaugguugcu

SEQ ID NO: 67791 - RNA, 39 nt, Artificial Sequence
  Synthetic Oligonucleotide; TIM-3 exon 5; Set C
gauguagaugccuauucugaugguugcuccagagucccg

SEQ ID NO: 67792 - RNA, 31 nt, Artificial Sequence
  Synthetic Oligonucleotide; TIM-3 exon 5; Set C
uagaugccuauucugaugguugcuccagagu

SEQ ID NO: 67793 - RNA, 16 nt, Artificial Sequence
  Synthetic Oligonucleotide; TIM-3 exon 5; Set C
cuauucugaugguugc

SEQ ID NO: 67794 - RNA, 32 nt, Artificial Sequence
  Synthetic Oligonucleotide; TIM-3 exon 5; Set C
guagaugccuauucugaugguugcuccagagu

SEQ ID NO: 67795 - RNA, 15 nt, Artificial Sequence
  Synthetic Oligonucleotide; TIM-3 exon 5; Set C
cuauucugaugguug

SEQ ID NO: 67796 - RNA, 29 nt, Artificial Sequence
  Synthetic Oligonucleotide; TIM-3 exon 5; Set C
uagaugccuauucugaugguugcuccaga

SEQ ID NO: 67797 - RNA, 33 nt, Artificial Sequence
  Synthetic Oligonucleotide; TIM-3 exon 5; Set C
uguagaugccuauucugaugguugcuccagagu

SEQ ID NO: 67798 - RNA, 30 nt, Artificial Sequence
  Synthetic Oligonucleotide; TIM-3 exon 5; Set C
guagaugccuauucugaugguugcuccaga

SEQ ID NO: 67799 - RNA, 34 nt, Artificial Sequence
  Synthetic Oligonucleotide; TIM-3 exon 5; Set C
auguagaugccuauucugaugguugcuccagagu

SEQ ID NO: 67800 - RNA, 31 nt, Artificial Sequence
  Synthetic Oligonucleotide; TIM-3 exon 5; Set C
uguagaugccuauucugaugguugcuccaga

SEQ ID NO: 67801 - RNA, 35 nt, Artificial Sequence
  Synthetic Oligonucleotide; TIM-3 exon 5; Set C
gauguagaugccuauucugaugguugcuccagagu

SEQ ID NO: 67802 - RNA, 22 nt, Artificial Sequence
  Synthetic Oligonucleotide; TIM-3 exon 5; Set A
gaugccuauucugaugguugcu

SEQ ID NO: 67803 - RNA, 32 nt, Artificial Sequence
  Synthetic Oligonucleotide; TIM-3 exon 5; Set C
auguagaugccuauucugaugguugcuccaga

SEQ ID NO: 67804 - RNA, 23 nt, Artificial Sequence
  Synthetic Oligonucleotide; TIM-3 exon 5; Set A
agaugccuauucugaugguugcu

SEQ ID NO: 67805 - RNA, 33 nt, Artificial Sequence
  Synthetic Oligonucleotide; TIM-3 exon 5; Set C
gauguagaugccuauucugaugguugcuccaga

SEQ ID NO: 67806 - RNA, 34 nt, Artificial Sequence
  Synthetic Oligonucleotide; TIM-3 exon 5; Set C
cgauguagaugccuauucugaugguugcuccaga

SEQ ID NO: 67807 - RNA, 37 nt, Artificial Sequence
  Synthetic Oligonucleotide; TIM-3 exon 5; Set C
uccgauguagaugccuauucugaugguugcuccagag

SEQ ID NO: 67808 - RNA, 18 nt, Artificial Sequence
  Synthetic Oligonucleotide; TIM-3 exon 5; Set C
gaugccuauucugauggu

SEQ ID NO: 67809 - RNA, 17 nt, Artificial Sequence
  Synthetic Oligonucleotide; TIM-3 exon 5; Set C
gaugccuauucugaugg

SEQ ID NO: 67810 - RNA, 18 nt, Artificial Sequence
  Synthetic Oligonucleotide; TIM-3 exon 5; Set C
agaugccuauucugaugg

SEQ ID NO: 67811 - RNA, 30 nt, Artificial Sequence
  Synthetic Oligonucleotide; TIM-3 exon 5; Set C
ccgauguagaugccuauucugaugguugcu

SEQ ID NO: 67812 - RNA, 31 nt, Artificial Sequence
  Synthetic Oligonucleotide; TIM-3 exon 5; Set C
uccgauguagaugccuauucugaugguugcu

SEQ ID NO: 67813 - RNA, 30 nt, Artificial Sequence
  Synthetic Oligonucleotide; TIM-3 exon 5; Set C
uccgauguagaugccuauucugaugguugc

SEQ ID NO: 67814 - RNA, 29 nt, Artificial Sequence
  Synthetic Oligonucleotide; TIM-3 exon 5; Set A
uccgauguagaugccuauucugaugguug

SEQ ID NO: 67815 - RNA, 28 nt, Artificial Sequence
  Synthetic Oligonucleotide; TIM-3 exon 5; Set A
uccgauguagaugccuauucugaugguu

SEQ ID NO: 67816 - RNA, 27 nt, Artificial Sequence
  Synthetic Oligonucleotide; TIM-3 exon 5; Set A
uccgauguagaugccuauucugauggu

SEQ ID NO: 67817 - RNA, 25 nt, Artificial Sequence
  Synthetic Oligonucleotide; TIM-3 exon 5; Set A
ccgauguagaugccuauucugaugg

SEQ ID NO: 67818 - RNA, 26 nt, Artificial Sequence
  Synthetic Oligonucleotide; TIM-3 exon 5; Set A
uccgauguagaugccuauucugaugg

SEQ ID NO: 67819 - RNA, 36 nt, Artificial Sequence
  Synthetic Oligonucleotide; TIM-3 exon 5; Set C
ccugcuccgauguagaugccuauucugaugguugcu

SEQ ID NO: 67820 - RNA, 35 nt, Artificial Sequence
  Synthetic Oligonucleotide; TIM-3 exon 5; Set C
ccugcuccgauguagaugccuauucugaugguugc

SEQ ID NO: 67821 - RNA, 37 nt, Artificial Sequence
  Synthetic Oligonucleotide; TIM-3 exon 5; Set C
cccugcuccgauguagaugccuauucugaugguugcu

SEQ ID NO: 67822 - RNA, 34 nt, Artificial Sequence
  Synthetic Oligonucleotide; TIM-3 exon 5; Set C
ccugcuccgauguagaugccuauucugaugguug

SEQ ID NO: 67823 - RNA, 36 nt, Artificial Sequence
  Synthetic Oligonucleotide; TIM-3 exon 5; Set C
cccugcuccgauguagaugccuauucugaugguugc

SEQ ID NO: 67824 - RNA, 38 nt, Artificial Sequence
  Synthetic Oligonucleotide; TIM-3 exon 5; Set C
ucccugcuccgauguagaugccuauucugaugguugcu

SEQ ID NO: 67825 - RNA, 33 nt, Artificial Sequence
  Synthetic Oligonucleotide; TIM-3 exon 5; Set C
ccugcuccgauguagaugccuauucugaugguu

SEQ ID NO: 67826 - RNA, 35 nt, Artificial Sequence
  Synthetic Oligonucleotide; TIM-3 exon 5; Set C
cccugcuccgauguagaugccuauucugaugguug

SEQ ID NO: 67827 - RNA, 37 nt, Artificial Sequence
  Synthetic Oligonucleotide; TIM-3 exon 5; Set C
ucccugcuccgauguagaugccuauucugaugguugc

SEQ ID NO: 67828 - RNA, 39 nt, Artificial Sequence
  Synthetic Oligonucleotide; TIM-3 exon 5; Set C
aucccugcuccgauguagaugccuauucugaugguugcu

SEQ ID NO: 67829 - RNA, 34 nt, Artificial Sequence
  Synthetic Oligonucleotide; TIM-3 exon 5; Set C
cccugcuccgauguagaugccuauucugaugguu

SEQ ID NO: 67830 - RNA, 36 nt, Artificial Sequence
  Synthetic Oligonucleotide; TIM-3 exon 5; Set C
ucccugcuccgauguagaugccuauucugaugguug

SEQ ID NO: 67831 - RNA, 38 nt, Artificial Sequence
  Synthetic Oligonucleotide; TIM-3 exon 5; Set C
aucccugcuccgauguagaugccuauucugaugguugc

SEQ ID NO: 67832 - RNA, 32 nt, Artificial Sequence
  Synthetic Oligonucleotide; TIM-3 exon 5; Set C
ccugcuccgauguagaugccuauucugauggu

SEQ ID NO: 67833 - RNA, 20 nt, Artificial Sequence
  Synthetic Oligonucleotide; TIM-3 exon 5; Set C
ccgauguagaugccuauucu

SEQ ID NO: 67834 - RNA, 35 nt, Artificial Sequence
  Synthetic Oligonucleotide; TIM-3 exon 5; Set C
ucccugcuccgauguagaugccuauucugaugguu

SEQ ID NO: 67835 - RNA, 33 nt, Artificial Sequence
  Synthetic Oligonucleotide; TIM-3 exon 5; Set C
cccugcuccgauguagaugccuauucugauggu

SEQ ID NO: 67836 - RNA, 31 nt, Artificial Sequence
  Synthetic Oligonucleotide; TIM-3 exon 5; Set C
ccugcuccgauguagaugccuauucugaugg

SEQ ID NO: 67837 - RNA, 21 nt, Artificial Sequence
  Synthetic Oligonucleotide; TIM-3 exon 5; Set C
uccgauguagaugccuauucu

SEQ ID NO: 67838 - RNA, 19 nt, Artificial Sequence
  Synthetic Oligonucleotide; TIM-3 exon 5; Set C
ccgauguagaugccuauuc

SEQ ID NO: 67839 - RNA, 34 nt, Artificial Sequence
  Synthetic Oligonucleotide; TIM-3 exon 5; Set C
ucccugcuccgauguagaugccuauucugauggu

SEQ ID NO: 67840 - RNA, 32 nt, Artificial Sequence
  Synthetic Oligonucleotide; TIM-3 exon 5; Set C
cccugcuccgauguagaugccuauucugaugg

SEQ ID NO: 67841 - RNA, 20 nt, Artificial Sequence
  Synthetic Oligonucleotide; TIM-3 exon 5; Set C
uccgauguagaugccuauuc

SEQ ID NO: 67842 - RNA, 35 nt, Artificial Sequence
  Synthetic Oligonucleotide; TIM-3 exon 5; Set C
aucccugcuccgauguagaugccuauucugauggu

SEQ ID NO: 67843 - RNA, 33 nt, Artificial Sequence
  Synthetic Oligonucleotide; TIM-3 exon 5; Set C
ucccugcuccgauguagaugccuauucugaugg

SEQ ID NO: 67844 - RNA, 19 nt, Artificial Sequence
  Synthetic Oligonucleotide; TIM-3 exon 5; Set C
uccgauguagaugccuauu

SEQ ID NO: 67845 - RNA, 15 nt, Artificial Sequence
  Synthetic Oligonucleotide; TIM-3 exon 5; Set C
cgauguagaugccua

SEQ ID NO: 67846 - RNA, 18 nt, Artificial Sequence
  Synthetic Oligonucleotide; TIM-3 exon 5; Set C
uccgauguagaugccuau

SEQ ID NO: 67847 - RNA, 34 nt, Artificial Sequence
  Synthetic Oligonucleotide; TIM-3 exon 5; Set C
aucccugcuccgauguagaugccuauucugaugg

SEQ ID NO: 67848 - RNA, 16 nt, Artificial Sequence
  Synthetic Oligonucleotide; TIM-3 exon 5; Set C
ccgauguagaugccua

SEQ ID NO: 67849 - RNA, 17 nt, Artificial Sequence
  Synthetic Oligonucleotide; TIM-3 exon 5; Set C
uccgauguagaugccua

SEQ ID NO: 67850 - RNA, 26 nt, Artificial Sequence
  Synthetic Oligonucleotide; TIM-3 exon 5; Set A
ccugcuccgauguagaugccuauucu

SEQ ID NO: 67851 - RNA, 27 nt, Artificial Sequence
  Synthetic Oligonucleotide; TIM-3 exon 5; Set C
cccugcuccgauguagaugccuauucu

SEQ ID NO: 67852 - RNA, 25 nt, Artificial Sequence
  Synthetic Oligonucleotide; TIM-3 exon 5; Set A
ccugcuccgauguagaugccuauuc

SEQ ID NO: 67853 - RNA, 24 nt, Artificial Sequence
  Synthetic Oligonucleotide; TIM-3 exon 5; Set A
ccugcuccgauguagaugccuauu

SEQ ID NO: 67854 - RNA, 28 nt, Artificial Sequence
  Synthetic Oligonucleotide; TIM-3 exon 5; Set C
ucccugcuccgauguagaugccuauucu

SEQ ID NO: 67855 - RNA, 26 nt, Artificial Sequence
  Synthetic Oligonucleotide; TIM-3 exon 5; Set C
cccugcuccgauguagaugccuauuc

SEQ ID NO: 67856 - RNA, 23 nt, Artificial Sequence
  Synthetic Oligonucleotide; TIM-3 exon 5; Set A
ccugcuccgauguagaugccuau

SEQ ID NO: 67857 - RNA, 25 nt, Artificial Sequence
  Synthetic Oligonucleotide; TIM-3 exon 5; Set A
cccugcuccgauguagaugccuauu

SEQ ID NO: 67858 - RNA, 29 nt, Artificial Sequence
  Synthetic Oligonucleotide; TIM-3 exon 5; Set C
aucccugcuccgauguagaugccuauucu

SEQ ID NO: 67859 - RNA, 27 nt, Artificial Sequence
  Synthetic Oligonucleotide; TIM-3 exon 5; Set C
ucccugcuccgauguagaugccuauuc

SEQ ID NO: 67860 - RNA, 24 nt, Artificial Sequence
  Synthetic Oligonucleotide; TIM-3 exon 5; Set A
cccugcuccgauguagaugccuau

SEQ ID NO: 67861 - RNA, 26 nt, Artificial Sequence
  Synthetic Oligonucleotide; TIM-3 exon 5; Set C
ucccugcuccgauguagaugccuauu

SEQ ID NO: 67862 - RNA, 28 nt, Artificial Sequence
  Synthetic Oligonucleotide; TIM-3 exon 5; Set C
aucccugcuccgauguagaugccuauuc

SEQ ID NO: 67863 - RNA, 25 nt, Artificial Sequence
  Synthetic Oligonucleotide; TIM-3 exon 5; Set C
ucccugcuccgauguagaugccuau

SEQ ID NO: 67864 - RNA, 27 nt, Artificial Sequence
  Synthetic Oligonucleotide; TIM-3 exon 5; Set C
aucccugcuccgauguagaugccuauu

SEQ ID NO: 67865 - RNA, 29 nt, Artificial Sequence
  Synthetic Oligonucleotide; TIM-3 exon 5; Set C
gaucccugcuccgauguagaugccuauuc

SEQ ID NO: 67866 - RNA, 26 nt, Artificial Sequence
  Synthetic Oligonucleotide; TIM-3 exon 5; Set C
aucccugcuccgauguagaugccuau

SEQ ID NO: 67867 - RNA, 24 nt, Artificial Sequence
  Synthetic Oligonucleotide; TIM-3 exon 5; Set C
ucccugcuccgauguagaugccua

SEQ ID NO: 67868 - RNA, 25 nt, Artificial Sequence
  Synthetic Oligonucleotide; TIM-3 exon 5; Set C
aucccugcuccgauguagaugccua

SEQ ID NO: 67869 - RNA, 26 nt, Artificial Sequence
  Synthetic Oligonucleotide; TIM-3 exon 5; Set C
gaucccugcuccgauguagaugccua

SEQ ID NO: 67870 - RNA, 17 nt, Artificial Sequence
  Synthetic Oligonucleotide; TIM-3 exon 5; Set C
ccugcuccgauguagau

SEQ ID NO: 67871 - RNA, 16 nt, Artificial Sequence
  Synthetic Oligonucleotide; TIM-3 exon 5; Set C
ccugcuccgauguaga

SEQ ID NO: 67872 - RNA, 18 nt, Artificial Sequence
  Synthetic Oligonucleotide; TIM-3 exon 5; Set C
cccugcuccgauguagau

SEQ ID NO: 67873 - RNA, 15 nt, Artificial Sequence
  Synthetic Oligonucleotide; TIM-3 exon 5; Set C
ccugcuccgauguag

SEQ ID NO: 67874 - RNA, 17 nt, Artificial Sequence
  Synthetic Oligonucleotide; TIM-3 exon 5; Set C
cccugcuccgauguaga

SEQ ID NO: 67875 - RNA, 19 nt, Artificial Sequence
  Synthetic Oligonucleotide; TIM-3 exon 5; Set A
ucccugcuccgauguagau

SEQ ID NO: 67876 - RNA, 16 nt, Artificial Sequence
  Synthetic Oligonucleotide; TIM-3 exon 5; Set C
cccugcuccgauguag

SEQ ID NO: 67877 - RNA, 18 nt, Artificial Sequence
  Synthetic Oligonucleotide; TIM-3 exon 5; Set A
ucccugcuccgauguaga

SEQ ID NO: 67878 - RNA, 20 nt, Artificial Sequence
  Synthetic Oligonucleotide; TIM-3 exon 5; Set A
aucccugcuccgauguagau

SEQ ID NO: 67879 - RNA, 15 nt, Artificial Sequence
  Synthetic Oligonucleotide; TIM-3 exon 5; Set C
cccugcuccgaugua

SEQ ID NO: 67880 - RNA, 19 nt, Artificial Sequence
  Synthetic Oligonucleotide; TIM-3 exon 5; Set A
aucccugcuccgauguaga

SEQ ID NO: 67881 - RNA, 39 nt, Artificial Sequence
  Synthetic Oligonucleotide; TIM-3 exon 5; Set C
cagcccagcacagaucccugcuccgauguagaugccuau

SEQ ID NO: 67882 - RNA, 31 nt, Artificial Sequence
  Synthetic Oligonucleotide; TIM-3 exon 5; Set C
cagcccagcacagaucccugcuccgauguag

SEQ ID NO: 67883 - RNA, 32 nt, Artificial Sequence
  Synthetic Oligonucleotide; TIM-3 exon 5; Set C
ccagcccagcacagaucccugcuccgauguag

SEQ ID NO: 67884 - RNA, 30 nt, Artificial Sequence
  Synthetic Oligonucleotide; TIM-3 exon 5; Set C
cagcccagcacagaucccugcuccgaugua

SEQ ID NO: 67885 - RNA, 33 nt, Artificial Sequence
  Synthetic Oligonucleotide; TIM-3 exon 5; Set C
gccagcccagcacagaucccugcuccgauguag

SEQ ID NO: 67886 - RNA, 29 nt, Artificial Sequence
  Synthetic Oligonucleotide; TIM-3 exon 5; Set C
cagcccagcacagaucccugcuccgaugu

SEQ ID NO: 67887 - RNA, 34 nt, Artificial Sequence
  Synthetic Oligonucleotide; TIM-3 exon 5; Set C
agccagcccagcacagaucccugcuccgauguag

SEQ ID NO: 67888 - RNA, 28 nt, Artificial Sequence
  Synthetic Oligonucleotide; TIM-3 exon 5; Set C
cagcccagcacagaucccugcuccgaug

SEQ ID NO: 67889 - RNA, 27 nt, Artificial Sequence
  Synthetic Oligonucleotide; TIM-3 exon 5; Set C
cagcccagcacagaucccugcuccgau

SEQ ID NO: 67890 - RNA, 36 nt, Artificial Sequence
  Synthetic Oligonucleotide; TIM-3 exon 5; Set A
gaaaauuaaagcgccgaagauaagagccagagccag

SEQ ID NO: 67891 - RNA, 37 nt, Artificial Sequence
  Synthetic Oligonucleotide; TIM-3 exon 5; Set A
ugaaaauuaaagcgccgaagauaagagccagagccag

SEQ ID NO: 67892 - RNA, 36 nt, Artificial Sequence
  Synthetic Oligonucleotide; TIM-3 exon 5; Set A
ugaaaauuaaagcgccgaagauaagagccagagcca

SEQ ID NO: 67893 - RNA, 35 nt, Artificial Sequence
  Synthetic Oligonucleotide; TIM-3 exon 5; Set A
ugaaaauuaaagcgccgaagauaagagccagagcc

SEQ ID NO: 67894 - RNA, 16 nt, Artificial Sequence
  Synthetic Oligonucleotide; TIM-3 exon 5; Set C
uuaaagcgccgaagau

SEQ ID NO: 67895 - RNA, 23 nt, Artificial Sequence
  Synthetic Oligonucleotide; TIM-3 exon 5; Set C
gaaaauuaaagcgccgaagauaa

SEQ ID NO: 67896 - RNA, 24 nt, Artificial Sequence
  Synthetic Oligonucleotide; TIM-3 exon 5; Set C
ugaaaauuaaagcgccgaagauaa

SEQ ID NO: 67897 - RNA, 22 nt, Artificial Sequence
  Synthetic Oligonucleotide; TIM-3 exon 5; Set C
gaaaauuaaagcgccgaagaua

SEQ ID NO: 67898 - RNA, 21 nt, Artificial Sequence
  Synthetic Oligonucleotide; TIM-3 exon 5; Set C
gaaaauuaaagcgccgaagau

SEQ ID NO: 67899 - RNA, 23 nt, Artificial Sequence
  Synthetic Oligonucleotide; TIM-3 exon 5; Set C
ugaaaauuaaagcgccgaagaua

SEQ ID NO: 67900 - RNA, 22 nt, Artificial Sequence
  Synthetic Oligonucleotide; TIM-3 exon 5; Set C
ugaaaauuaaagcgccgaagau

SEQ ID NO: 67901 - RNA, 20 nt, Artificial Sequence
  Synthetic Oligonucleotide; TIM-3 exon 5; Set C
gaaaauuaaagcgccgaaga

SEQ ID NO: 67902 - RNA, 21 nt, Artificial Sequence
  Synthetic Oligonucleotide; TIM-3 exon 5; Set C
ugaaaauuaaagcgccgaaga

SEQ ID NO: 67903 - RNA, 23 nt, Artificial Sequence
  Synthetic Oligonucleotide; TIM-3 exon 5; Set C
uugaaaauuaaagcgccgaagau

SEQ ID NO: 67904 - RNA, 19 nt, Artificial Sequence
  Synthetic Oligonucleotide; TIM-3 exon 5; Set C
gaaaauuaaagcgccgaag

SEQ ID NO: 67905 - RNA, 22 nt, Artificial Sequence
  Synthetic Oligonucleotide; TIM-3 exon 5; Set C
uugaaaauuaaagcgccgaaga

SEQ ID NO: 67906 - RNA, 24 nt, Artificial Sequence
  Synthetic Oligonucleotide; TIM-3 exon 5; Set C
uuugaaaauuaaagcgccgaagau

SEQ ID NO: 67907 - RNA, 20 nt, Artificial Sequence
  Synthetic Oligonucleotide; TIM-3 exon 5; Set C
ugaaaauuaaagcgccgaag

SEQ ID NO: 67908 - RNA, 18 nt, Artificial Sequence
  Synthetic Oligonucleotide; TIM-3 exon 5; Set C
gaaaauuaaagcgccgaa

SEQ ID NO: 67909 - RNA, 17 nt, Artificial Sequence
  Synthetic Oligonucleotide; TIM-3 exon 5; Set C
gaaaauuaaagcgccga

SEQ ID NO: 67910 - RNA, 23 nt, Artificial Sequence
  Synthetic Oligonucleotide; TIM-3 exon 5; Set C
uuugaaaauuaaagcgccgaaga

SEQ ID NO: 67911 - RNA, 19 nt, Artificial Sequence
  Synthetic Oligonucleotide; TIM-3 exon 5; Set C
ugaaaauuaaagcgccgaa

SEQ ID NO: 67912 - RNA, 18 nt, Artificial Sequence
  Synthetic Oligonucleotide; TIM-3 exon 5; Set C
ugaaaauuaaagcgccga

SEQ ID NO: 67913 - RNA, 19 nt, Artificial Sequence
  Synthetic Oligonucleotide; TIM-3 exon 5; Set C
uugaaaauuaaagcgccga

SEQ ID NO: 67914 - RNA, 36 nt, Artificial Sequence
  Synthetic Oligonucleotide; TIM-3 exon 5; Set C
aaaacacuuacauuugaaaauuaaagcgccgaagau

SEQ ID NO: 67915 - RNA, 37 nt, Artificial Sequence
  Synthetic Oligonucleotide; TIM-3 exon 5; Set C
aaaaacacuuacauuugaaaauuaaagcgccgaagau

SEQ ID NO: 67916 - RNA, 35 nt, Artificial Sequence
  Synthetic Oligonucleotide; TIM-3 exon 5; Set C
aaaacacuuacauuugaaaauuaaagcgccgaaga

SEQ ID NO: 67917 - RNA, 38 nt, Artificial Sequence
  Synthetic Oligonucleotide; TIM-3 exon 5; Set B
caaaaacacuuacauuugaaaauuaaagcgccgaagau

SEQ ID NO: 67918 - RNA, 36 nt, Artificial Sequence
  Synthetic Oligonucleotide; TIM-3 exon 5; Set C
aaaaacacuuacauuugaaaauuaaagcgccgaaga

SEQ ID NO: 67919 - RNA, 34 nt, Artificial Sequence
  Synthetic Oligonucleotide; TIM-3 exon 5; Set C
aaaacacuuacauuugaaaauuaaagcgccgaag

SEQ ID NO: 67920 - RNA, 39 nt, Artificial Sequence
  Synthetic Oligonucleotide; TIM-3 exon 5; Set B
acaaaaacacuuacauuugaaaauuaaagcgccgaagau

SEQ ID NO: 67921 - RNA, 37 nt, Artificial Sequence
  Synthetic Oligonucleotide; TIM-3 exon 5; Set B
caaaaacacuuacauuugaaaauuaaagcgccgaaga

SEQ ID NO: 67922 - RNA, 35 nt, Artificial Sequence
  Synthetic Oligonucleotide; TIM-3 exon 5; Set C
aaaaacacuuacauuugaaaauuaaagcgccgaag

SEQ ID NO: 67923 - RNA, 33 nt, Artificial Sequence
  Synthetic Oligonucleotide; TIM-3 exon 5; Set C
aaaacacuuacauuugaaaauuaaagcgccgaa

SEQ ID NO: 67924 - RNA, 32 nt, Artificial Sequence
  Synthetic Oligonucleotide; TIM-3 exon 5; Set C
aaaacacuuacauuugaaaauuaaagcgccga

SEQ ID NO: 67925 - RNA, 40 nt, Artificial Sequence
  Synthetic Oligonucleotide; TIM-3 exon 5; Set B
aacaaaaacacuuacauuugaaaauuaaagcgccgaagau

SEQ ID NO: 67926 - RNA, 38 nt, Artificial Sequence
  Synthetic Oligonucleotide; TIM-3 exon 5; Set B
acaaaaacacuuacauuugaaaauuaaagcgccgaaga

SEQ ID NO: 67927 - RNA, 36 nt, Artificial Sequence
  Synthetic Oligonucleotide; TIM-3 exon 5; Set C
caaaaacacuuacauuugaaaauuaaagcgccgaag

SEQ ID NO: 67928 - RNA, 34 nt, Artificial Sequence
  Synthetic Oligonucleotide; TIM-3 exon 5; Set C
aaaaacacuuacauuugaaaauuaaagcgccgaa

SEQ ID NO: 67929 - RNA, 33 nt, Artificial Sequence
  Synthetic Oligonucleotide; TIM-3 exon 5; Set C
aaaaacacuuacauuugaaaauuaaagcgccga

SEQ ID NO: 67930 - RNA, 39 nt, Artificial Sequence
  Synthetic Oligonucleotide; TIM-3 exon 5; Set B
aacaaaaacacuuacauuugaaaauuaaagcgccgaaga

SEQ ID NO: 67931 - RNA, 37 nt, Artificial Sequence
  Synthetic Oligonucleotide; TIM-3 exon 5; Set B
acaaaaacacuuacauuugaaaauuaaagcgccgaag

SEQ ID NO: 67932 - RNA, 35 nt, Artificial Sequence
  Synthetic Oligonucleotide; TIM-3 exon 5; Set C
caaaaacacuuacauuugaaaauuaaagcgccgaa

SEQ ID NO: 67933 - RNA, 34 nt, Artificial Sequence
  Synthetic Oligonucleotide; TIM-3 exon 5; Set C
caaaaacacuuacauuugaaaauuaaagcgccga

SEQ ID NO: 67934 - RNA, 38 nt, Artificial Sequence
  Synthetic Oligonucleotide; TIM-3 exon 5; Set C
aacaaaaacacuuacauuugaaaauuaaagcgccgaag

SEQ ID NO: 67935 - RNA, 36 nt, Artificial Sequence
  Synthetic Oligonucleotide; TIM-3 exon 5; Set B
acaaaaacacuuacauuugaaaauuaaagcgccgaa

SEQ ID NO: 67936 - RNA, 35 nt, Artificial Sequence
  Synthetic Oligonucleotide; TIM-3 exon 5; Set B
acaaaaacacuuacauuugaaaauuaaagcgccga

SEQ ID NO: 67937 - RNA, 37 nt, Artificial Sequence
  Synthetic Oligonucleotide; TIM-3 exon 5; Set C
aacaaaaacacuuacauuugaaaauuaaagcgccgaa

SEQ ID NO: 67938 - RNA, 36 nt, Artificial Sequence
  Synthetic Oligonucleotide; TIM-3 exon 5; Set B
aacaaaaacacuuacauuugaaaauuaaagcgccga

SEQ ID NO: 67939 - RNA, 23 nt, Artificial Sequence
  Synthetic Oligonucleotide; TIM-3 exon 5; Set C
aaaacacuuacauuugaaaauua

SEQ ID NO: 67940 - RNA, 24 nt, Artificial Sequence
  Synthetic Oligonucleotide; TIM-3 exon 5; Set C
aaaaacacuuacauuugaaaauua

SEQ ID NO: 67941 - RNA, 25 nt, Artificial Sequence
  Synthetic Oligonucleotide; TIM-3 exon 5; Set C
caaaaacacuuacauuugaaaauua

SEQ ID NO: 67942 - RNA, 27 nt, Artificial Sequence
  Synthetic Oligonucleotide; TIM-3 exon 5; Set C
acaaaaacacuuacauuugaaaauuaa

SEQ ID NO: 67943 - RNA, 29 nt, Artificial Sequence
  Synthetic Oligonucleotide; TIM-3 exon 5; Set C
aacaaaaacacuuacauuugaaaauuaaa

SEQ ID NO: 67944 - RNA, 26 nt, Artificial Sequence
  Synthetic Oligonucleotide; TIM-3 exon 5; Set C
acaaaaacacuuacauuugaaaauua

SEQ ID NO: 67945 - RNA, 28 nt, Artificial Sequence
  Synthetic Oligonucleotide; TIM-3 exon 5; Set C
aacaaaaacacuuacauuugaaaauuaa

SEQ ID NO: 67946 - RNA, 27 nt, Artificial Sequence
  Synthetic Oligonucleotide; TIM-3 exon 5; Set C
aacaaaaacacuuacauuugaaaauua

SEQ ID NO: 67947 - RNA, 18 nt, Artificial Sequence
  Synthetic Oligonucleotide; TIM-3 exon 5; Set C
aaaacacuuacauuugaa

SEQ ID NO: 67948 - RNA, 19 nt, Artificial Sequence
  Synthetic Oligonucleotide; TIM-3 exon 5; Set C
aaaaacacuuacauuugaa

SEQ ID NO: 67949 - RNA, 17 nt, Artificial Sequence
  Synthetic Oligonucleotide; TIM-3 exon 5; Set C
aaaacacuuacauuuga

SEQ ID NO: 67950 - RNA, 18 nt, Artificial Sequence
  Synthetic Oligonucleotide; TIM-3 exon 5; Set C
aaaaacacuuacauuuga

SEQ ID NO: 67951 - RNA, 19 nt, Artificial Sequence
  Synthetic Oligonucleotide; TIM-3 exon 5; Set C
caaaaacacuuacauuuga

SEQ ID NO: 67952 - RNA, 33 nt, Artificial Sequence
  Synthetic Oligonucleotide; TIM-3 exon 5; Set C
agagaaacaaaaacacuuacauuugaaaauuaa

SEQ ID NO: 67953 - RNA, 32 nt, Artificial Sequence
  Synthetic Oligonucleotide; TIM-3 exon 5; Set C
agagaaacaaaaacacuuacauuugaaaauua

SEQ ID NO: 67954 - RNA, 18 nt, Artificial Sequence
  Synthetic Oligonucleotide; TIM-3 exon 5; Set C
caaaaacacuuacauuug

SEQ ID NO: 67955 - RNA, 23 nt, Artificial Sequence
  Synthetic Oligonucleotide; TIM-3 exon 5; Set C
aaacaaaaacacuuacauuugaa

SEQ ID NO: 67956 - RNA, 19 nt, Artificial Sequence
  Synthetic Oligonucleotide; TIM-3 exon 5; Set C
acaaaaacacuuacauuug

SEQ ID NO: 67957 - RNA, 24 nt, Artificial Sequence
  Synthetic Oligonucleotide; TIM-3 exon 5; Set C
gaaacaaaaacacuuacauuugaa

SEQ ID NO: 67958 - RNA, 22 nt, Artificial Sequence
  Synthetic Oligonucleotide; TIM-3 exon 5; Set C
aaacaaaaacacuuacauuuga

SEQ ID NO: 67959 - RNA, 20 nt, Artificial Sequence
  Synthetic Oligonucleotide; TIM-3 exon 5; Set C
aacaaaaacacuuacauuug

SEQ ID NO: 67960 - RNA, 18 nt, Artificial Sequence
  Synthetic Oligonucleotide; TIM-3 exon 5; Set C
acaaaaacacuuacauuu

SEQ ID NO: 67961 - RNA, 38 nt, Artificial Sequence
  Synthetic Oligonucleotide; TIM-3 exon 5; Set C
ggagagagaaacaaaaacacuuacauuugaaaauuaaa

SEQ ID NO: 67962 - RNA, 23 nt, Artificial Sequence
  Synthetic Oligonucleotide; TIM-3 exon 5; Set C
gaaacaaaaacacuuacauuuga

SEQ ID NO: 67963 - RNA, 25 nt, Artificial Sequence
  Synthetic Oligonucleotide; TIM-3 exon 5; Set C
agaaacaaaaacacuuacauuugaa

SEQ ID NO: 67964 - RNA, 19 nt, Artificial Sequence
  Synthetic Oligonucleotide; TIM-3 exon 5; Set C
aacaaaaacacuuacauuu

SEQ ID NO: 67965 - RNA, 37 nt, Artificial Sequence
  Synthetic Oligonucleotide; TIM-3 exon 5; Set C
ggagagagaaacaaaaacacuuacauuugaaaauuaa

SEQ ID NO: 67966 - RNA, 39 nt, Artificial Sequence
  Synthetic Oligonucleotide; TIM-3 exon 5; Set C
gggagagagaaacaaaaacacuuacauuugaaaauuaaa

SEQ ID NO: 67967 - RNA, 26 nt, Artificial Sequence
  Synthetic Oligonucleotide; TIM-3 exon 5; Set C
gagaaacaaaaacacuuacauuugaa

SEQ ID NO: 67968 - RNA, 24 nt, Artificial Sequence
  Synthetic Oligonucleotide; TIM-3 exon 5; Set C
agaaacaaaaacacuuacauuuga

SEQ ID NO: 67969 - RNA, 36 nt, Artificial Sequence
  Synthetic Oligonucleotide; TIM-3 exon 5; Set C
ggagagagaaacaaaaacacuuacauuugaaaauua

SEQ ID NO: 67970 - RNA, 38 nt, Artificial Sequence
  Synthetic Oligonucleotide; TIM-3 exon 5; Set C
gggagagagaaacaaaaacacuuacauuugaaaauuaa

SEQ ID NO: 67971 - RNA, 40 nt, Artificial Sequence
  Synthetic Oligonucleotide; TIM-3 exon 5; Set C
agggagagagaaacaaaaacacuuacauuugaaaauuaaa

SEQ ID NO: 67972 - RNA, 25 nt, Artificial Sequence
  Synthetic Oligonucleotide; TIM-3 exon 5; Set C
gagaaacaaaaacacuuacauuuga

SEQ ID NO: 67973 - RNA, 37 nt, Artificial Sequence
  Synthetic Oligonucleotide; TIM-3 exon 5; Set C
gggagagagaaacaaaaacacuuacauuugaaaauua

SEQ ID NO: 67974 - RNA, 39 nt, Artificial Sequence
  Synthetic Oligonucleotide; TIM-3 exon 5; Set C
agggagagagaaacaaaaacacuuacauuugaaaauuaa

SEQ ID NO: 67975 - RNA, 25 nt, Artificial Sequence
  Synthetic Oligonucleotide; TIM-3 exon 5; Set C
agagaaacaaaaacacuuacauuug

SEQ ID NO: 67976 - RNA, 37 nt, Artificial Sequence
  Synthetic Oligonucleotide; TIM-3 exon 5; Set C
agggagagagaaacaaaaacacuuacauuugaaaauu

SEQ ID NO: 67977 - RNA, 24 nt, Artificial Sequence
  Synthetic Oligonucleotide; TIM-3 exon 5; Set C
agagaaacaaaaacacuuacauuu

SEQ ID NO: 67978 - RNA, 29 nt, Artificial Sequence
  Synthetic Oligonucleotide; TIM-3 exon 5; Set C
ggagagagaaacaaaaacacuuacauuug

SEQ ID NO: 67979 - RNA, 34 nt, Artificial Sequence
  Synthetic Oligonucleotide; TIM-3 exon 5; Set B
gagggagagagaaacaaaaacacuuacauuugaa

SEQ ID NO: 67980 - RNA, 30 nt, Artificial Sequence
  Synthetic Oligonucleotide; TIM-3 exon 5; Set C
gggagagagaaacaaaaacacuuacauuug

SEQ ID NO: 67981 - RNA, 28 nt, Artificial Sequence
  Synthetic Oligonucleotide; TIM-3 exon 5; Set C
ggagagagaaacaaaaacacuuacauuu

SEQ ID NO: 67982 - RNA, 33 nt, Artificial Sequence
  Synthetic Oligonucleotide; TIM-3 exon 5; Set B
gagggagagagaaacaaaaacacuuacauuuga

SEQ ID NO: 67983 - RNA, 35 nt, Artificial Sequence
  Synthetic Oligonucleotide; TIM-3 exon 5; Set B
agagggagagagaaacaaaaacacuuacauuugaa

SEQ ID NO: 67984 - RNA, 31 nt, Artificial Sequence
  Synthetic Oligonucleotide; TIM-3 exon 5; Set C
agggagagagaaacaaaaacacuuacauuug

SEQ ID NO: 67985 - RNA, 29 nt, Artificial Sequence
  Synthetic Oligonucleotide; TIM-3 exon 5; Set C
gggagagagaaacaaaaacacuuacauuu

SEQ ID NO: 67986 - RNA, 34 nt, Artificial Sequence
  Synthetic Oligonucleotide; TIM-3 exon 5; Set B
agagggagagagaaacaaaaacacuuacauuuga

SEQ ID NO: 67987 - RNA, 30 nt, Artificial Sequence
  Synthetic Oligonucleotide; TIM-3 exon 5; Set C
agggagagagaaacaaaaacacuuacauuu

SEQ ID NO: 67988 - RNA, 38 nt, Artificial Sequence
  Synthetic Oligonucleotide; TIM-3 exon 5; Set B
uuaucagagggagagagaaacaaaaacacuuacauuug

SEQ ID NO: 67989 - RNA, 39 nt, Artificial Sequence
  Synthetic Oligonucleotide; TIM-3 exon 5; Set B
guuaucagagggagagagaaacaaaaacacuuacauuug

SEQ ID NO: 67990 - RNA, 37 nt, Artificial Sequence
  Synthetic Oligonucleotide; TIM-3 exon 5; Set B
uuaucagagggagagagaaacaaaaacacuuacauuu

SEQ ID NO: 67991 - RNA, 40 nt, Artificial Sequence
  Synthetic Oligonucleotide; TIM-3 exon 5; Set B
uguuaucagagggagagagaaacaaaaacacuuacauuug

SEQ ID NO: 67992 - RNA, 38 nt, Artificial Sequence
  Synthetic Oligonucleotide; TIM-3 exon 5; Set B
guuaucagagggagagagaaacaaaaacacuuacauuu

SEQ ID NO: 67993 - RNA, 15 nt, Artificial Sequence
  Synthetic Oligonucleotide; TIM-3 exon 5; Set C
gagagagaaacaaaa

SEQ ID NO: 67994 - RNA, 39 nt, Artificial Sequence
  Synthetic Oligonucleotide; TIM-3 exon 5; Set B
uguuaucagagggagagagaaacaaaaacacuuacauuu

SEQ ID NO: 67995 - RNA, 40 nt, Artificial Sequence
  Synthetic Oligonucleotide; TIM-3 exon 5; Set B
uuguuaucagagggagagagaaacaaaaacacuuacauuu

SEQ ID NO: 67996 - RNA, 19 nt, Artificial Sequence
  Synthetic Oligonucleotide; TIM-3 exon 5; Set C
gagggagagagaaacaaaa

SEQ ID NO: 67997 - RNA, 18 nt, Artificial Sequence
  Synthetic Oligonucleotide; TIM-3 exon 5; Set C
gagggagagagaaacaaa

SEQ ID NO: 67998 - RNA, 20 nt, Artificial Sequence
  Synthetic Oligonucleotide; TIM-3 exon 5; Set C
agagggagagagaaacaaaa

SEQ ID NO: 67999 - RNA, 17 nt, Artificial Sequence
  Synthetic Oligonucleotide; TIM-3 exon 5; Set C
gagggagagagaaacaa

SEQ ID NO: 68000 - RNA, 19 nt, Artificial Sequence
  Synthetic Oligonucleotide; TIM-3 exon 5; Set C
agagggagagagaaacaaa

SEQ ID NO: 68001 - RNA, 16 nt, Artificial Sequence
  Synthetic Oligonucleotide; TIM-3 exon 5; Set C
gagggagagagaaaca

SEQ ID NO: 68002 - RNA, 18 nt, Artificial Sequence
  Synthetic Oligonucleotide; TIM-3 exon 5; Set C
agagggagagagaaacaa

SEQ ID NO: 68003 - RNA, 15 nt, Artificial Sequence
  Synthetic Oligonucleotide; TIM-3 exon 5; Set C
gagggagagagaaac

SEQ ID NO: 68004 - RNA, 17 nt, Artificial Sequence
  Synthetic Oligonucleotide; TIM-3 exon 5; Set C
agagggagagagaaaca

SEQ ID NO: 68005 - RNA, 16 nt, Artificial Sequence
  Synthetic Oligonucleotide; TIM-3 exon 5; Set C
agagggagagagaaac

SEQ ID NO: 68006 - RNA, 20 nt, Artificial Sequence
  Synthetic Oligonucleotide; TIM-3 exon 5; Set C
uuaucagagggagagagaaa

SEQ ID NO: 68007 - RNA, 19 nt, Artificial Sequence
  Synthetic Oligonucleotide; TIM-3 exon 5; Set C
uuaucagagggagagagaa

SEQ ID NO: 68008 - RNA, 21 nt, Artificial Sequence
  Synthetic Oligonucleotide; TIM-3 exon 5; Set C
guuaucagagggagagagaaa

SEQ ID NO: 68009 - RNA, 20 nt, Artificial Sequence
  Synthetic Oligonucleotide; TIM-3 exon 5; Set C
guuaucagagggagagagaa

SEQ ID NO: 68010 - RNA, 18 nt, Artificial Sequence
  Synthetic Oligonucleotide; TIM-3 exon 5; Set C
uuaucagagggagagaga

SEQ ID NO: 68011 - RNA, 22 nt, Artificial Sequence
  Synthetic Oligonucleotide; TIM-3 exon 5; Set C
uguuaucagagggagagagaaa

SEQ ID NO: 68012 - RNA, 17 nt, Artificial Sequence
  Synthetic Oligonucleotide; TIM-3 exon 5; Set C
uuaucagagggagagag

SEQ ID NO: 68013 - RNA, 21 nt, Artificial Sequence
  Synthetic Oligonucleotide; TIM-3 exon 5; Set C
uguuaucagagggagagagaa

SEQ ID NO: 68014 - RNA, 19 nt, Artificial Sequence
  Synthetic Oligonucleotide; TIM-3 exon 5; Set C
guuaucagagggagagaga

SEQ ID NO: 68015 - RNA, 23 nt, Artificial Sequence
  Synthetic Oligonucleotide; TIM-3 exon 5; Set C
uuguuaucagagggagagagaaa

SEQ ID NO: 68016 - RNA, 18 nt, Artificial Sequence
  Synthetic Oligonucleotide; TIM-3 exon 5; Set C
guuaucagagggagagag

SEQ ID NO: 68017 - RNA, 22 nt, Artificial Sequence
  Synthetic Oligonucleotide; TIM-3 exon 5; Set C
uuguuaucagagggagagagaa

SEQ ID NO: 68018 - RNA, 20 nt, Artificial Sequence
  Synthetic Oligonucleotide; TIM-3 exon 5; Set C
uguuaucagagggagagaga

SEQ ID NO: 68019 - RNA, 24 nt, Artificial Sequence
  Synthetic Oligonucleotide; TIM-3 exon 5; Set C
uuuguuaucagagggagagagaaa

SEQ ID NO: 68020 - RNA, 19 nt, Artificial Sequence
  Synthetic Oligonucleotide; TIM-3 exon 5; Set C
uguuaucagagggagagag

SEQ ID NO: 68021 - RNA, 23 nt, Artificial Sequence
  Synthetic Oligonucleotide; TIM-3 exon 5; Set C
uuuguuaucagagggagagagaa

SEQ ID NO: 68022 - RNA, 21 nt, Artificial Sequence
  Synthetic Oligonucleotide; TIM-3 exon 5; Set C
uuguuaucagagggagagaga

SEQ ID NO: 68023 - RNA, 25 nt, Artificial Sequence
  Synthetic Oligonucleotide; TIM-3 exon 5; Set C
auuuguuaucagagggagagagaaa

SEQ ID NO: 68024 - RNA, 15 nt, Artificial Sequence
  Synthetic Oligonucleotide; TIM-3 exon 5; Set C
uuaucagagggagag

SEQ ID NO: 68025 - RNA, 24 nt, Artificial Sequence
  Synthetic Oligonucleotide; TIM-3 exon 5; Set C
auuuguuaucagagggagagagaa

SEQ ID NO: 68026 - RNA, 22 nt, Artificial Sequence
  Synthetic Oligonucleotide; TIM-3 exon 5; Set C
uuuguuaucagagggagagaga

SEQ ID NO: 68027 - RNA, 26 nt, Artificial Sequence
  Synthetic Oligonucleotide; TIM-3 exon 5; Set C
aauuuguuaucagagggagagagaaa

SEQ ID NO: 68028 - RNA, 16 nt, Artificial Sequence
  Synthetic Oligonucleotide; TIM-3 exon 5; Set C
guuaucagagggagag

SEQ ID NO: 68029 - RNA, 37 nt, Artificial Sequence
  Synthetic Oligonucleotide; TIM-3 exon 5; Set B
cugaagaauuuguuaucagagggagagagaaacaaaa

SEQ ID NO: 68030 - RNA, 25 nt, Artificial Sequence
  Synthetic Oligonucleotide; TIM-3 exon 5; Set C
aauuuguuaucagagggagagagaa

SEQ ID NO: 68031 - RNA, 23 nt, Artificial Sequence
  Synthetic Oligonucleotide; TIM-3 exon 5; Set C
auuuguuaucagagggagagaga

SEQ ID NO: 68032 - RNA, 27 nt, Artificial Sequence
  Synthetic Oligonucleotide; TIM-3 exon 5; Set C
gaauuuguuaucagagggagagagaaa

SEQ ID NO: 68033 - RNA, 17 nt, Artificial Sequence
  Synthetic Oligonucleotide; TIM-3 exon 5; Set C
uguuaucagagggagag

SEQ ID NO: 68034 - RNA, 15 nt, Artificial Sequence
  Synthetic Oligonucleotide; TIM-3 exon 5; Set C
guuaucagagggaga

SEQ ID NO: 68035 - RNA, 36 nt, Artificial Sequence
  Synthetic Oligonucleotide; TIM-3 exon 5; Set B
cugaagaauuuguuaucagagggagagagaaacaaa

SEQ ID NO: 68036 - RNA, 38 nt, Artificial Sequence
  Synthetic Oligonucleotide; TIM-3 exon 5; Set B
acugaagaauuuguuaucagagggagagagaaacaaaa

SEQ ID NO: 68037 - RNA, 24 nt, Artificial Sequence
  Synthetic Oligonucleotide; TIM-3 exon 5; Set C
aauuuguuaucagagggagagaga

SEQ ID NO: 68038 - RNA, 28 nt, Artificial Sequence
  Synthetic Oligonucleotide; TIM-3 exon 5; Set C
agaauuuguuaucagagggagagagaaa

SEQ ID NO: 68039 - RNA, 18 nt, Artificial Sequence
  Synthetic Oligonucleotide; TIM-3 exon 5; Set C
uuguuaucagagggagag

SEQ ID NO: 68040 - RNA, 16 nt, Artificial Sequence
  Synthetic Oligonucleotide; TIM-3 exon 5; Set C
uguuaucagagggaga

SEQ ID NO: 68041 - RNA, 35 nt, Artificial Sequence
  Synthetic Oligonucleotide; TIM-3 exon 5; Set B
cugaagaauuuguuaucagagggagagagaaacaa

SEQ ID NO: 68042 - RNA, 37 nt, Artificial Sequence
  Synthetic Oligonucleotide; TIM-3 exon 5; Set B
acugaagaauuuguuaucagagggagagagaaacaaa

SEQ ID NO: 68043 - RNA, 25 nt, Artificial Sequence
  Synthetic Oligonucleotide; TIM-3 exon 5; Set C
gaauuuguuaucagagggagagaga

SEQ ID NO: 68044 - RNA, 29 nt, Artificial Sequence
  Synthetic Oligonucleotide; TIM-3 exon 5; Set C
aagaauuuguuaucagagggagagagaaa

SEQ ID NO: 68045 - RNA, 19 nt, Artificial Sequence
  Synthetic Oligonucleotide; TIM-3 exon 5; Set C
uuuguuaucagagggagag

SEQ ID NO: 68046 - RNA, 17 nt, Artificial Sequence
  Synthetic Oligonucleotide; TIM-3 exon 5; Set C
uuguuaucagagggaga

SEQ ID NO: 68047 - RNA, 15 nt, Artificial Sequence
  Synthetic Oligonucleotide; TIM-3 exon 5; Set C
uguuaucagagggag

SEQ ID NO: 68048 - RNA, 34 nt, Artificial Sequence
  Synthetic Oligonucleotide; TIM-3 exon 5; Set B
cugaagaauuuguuaucagagggagagagaaaca

SEQ ID NO: 68049 - RNA, 36 nt, Artificial Sequence
  Synthetic Oligonucleotide; TIM-3 exon 5; Set B
acugaagaauuuguuaucagagggagagagaaacaa

SEQ ID NO: 68050 - RNA, 28 nt, Artificial Sequence
  Synthetic Oligonucleotide; TIM-3 exon 5; Set C
aagaauuuguuaucagagggagagagaa

SEQ ID NO: 68051 - RNA, 26 nt, Artificial Sequence
  Synthetic Oligonucleotide; TIM-3 exon 5; Set C
agaauuuguuaucagagggagagaga

SEQ ID NO: 68052 - RNA, 30 nt, Artificial Sequence
  Synthetic Oligonucleotide; TIM-3 exon 5; Set C
gaagaauuuguuaucagagggagagagaaa

SEQ ID NO: 68053 - RNA, 20 nt, Artificial Sequence
  Synthetic Oligonucleotide; TIM-3 exon 5; Set C
auuuguuaucagagggagag

SEQ ID NO: 68054 - RNA, 18 nt, Artificial Sequence
  Synthetic Oligonucleotide; TIM-3 exon 5; Set C
uuuguuaucagagggaga

SEQ ID NO: 68055 - RNA, 16 nt, Artificial Sequence
  Synthetic Oligonucleotide; TIM-3 exon 5; Set C
uuguuaucagagggag

SEQ ID NO: 68056 - RNA, 33 nt, Artificial Sequence
  Synthetic Oligonucleotide; TIM-3 exon 5; Set B
cugaagaauuuguuaucagagggagagagaaac

SEQ ID NO: 68057 - RNA, 35 nt, Artificial Sequence
  Synthetic Oligonucleotide; TIM-3 exon 5; Set B
acugaagaauuuguuaucagagggagagagaaaca

SEQ ID NO: 68058 - RNA, 29 nt, Artificial Sequence
  Synthetic Oligonucleotide; TIM-3 exon 5; Set C
gaagaauuuguuaucagagggagagagaa

SEQ ID NO: 68059 - RNA, 27 nt, Artificial Sequence
  Synthetic Oligonucleotide; TIM-3 exon 5; Set C
aagaauuuguuaucagagggagagaga

SEQ ID NO: 68060 - RNA, 31 nt, Artificial Sequence
  Synthetic Oligonucleotide; TIM-3 exon 5; Set C
ugaagaauuuguuaucagagggagagagaaa

SEQ ID NO: 68061 - RNA, 21 nt, Artificial Sequence
  Synthetic Oligonucleotide; TIM-3 exon 5; Set C
aauuuguuaucagagggagag

SEQ ID NO: 68062 - RNA, 19 nt, Artificial Sequence
  Synthetic Oligonucleotide; TIM-3 exon 5; Set C
auuuguuaucagagggaga

SEQ ID NO: 68063 - RNA, 17 nt, Artificial Sequence
  Synthetic Oligonucleotide; TIM-3 exon 5; Set C
uuuguuaucagagggag

SEQ ID NO: 68064 - RNA, 34 nt, Artificial Sequence
  Synthetic Oligonucleotide; TIM-3 exon 5; Set B
acugaagaauuuguuaucagagggagagagaaac

SEQ ID NO: 68065 - RNA, 30 nt, Artificial Sequence
  Synthetic Oligonucleotide; TIM-3 exon 5; Set B
ugaagaauuuguuaucagagggagagagaa

SEQ ID NO: 68066 - RNA, 28 nt, Artificial Sequence
  Synthetic Oligonucleotide; TIM-3 exon 5; Set B
gaagaauuuguuaucagagggagagaga

SEQ ID NO: 68067 - RNA, 22 nt, Artificial Sequence
  Synthetic Oligonucleotide; TIM-3 exon 5; Set C
gaauuuguuaucagagggagag

SEQ ID NO: 68068 - RNA, 20 nt, Artificial Sequence
  Synthetic Oligonucleotide; TIM-3 exon 5; Set C
aauuuguuaucagagggaga

SEQ ID NO: 68069 - RNA, 18 nt, Artificial Sequence
  Synthetic Oligonucleotide; TIM-3 exon 5; Set C
auuuguuaucagagggag

SEQ ID NO: 68070 - RNA, 29 nt, Artificial Sequence
  Synthetic Oligonucleotide; TIM-3 exon 5; Set B
ugaagaauuuguuaucagagggagagaga

SEQ ID NO: 68071 - RNA, 23 nt, Artificial Sequence
  Synthetic Oligonucleotide; TIM-3 exon 5; Set C
agaauuuguuaucagagggagag

SEQ ID NO: 68072 - RNA, 21 nt, Artificial Sequence
  Synthetic Oligonucleotide; TIM-3 exon 5; Set C
gaauuuguuaucagagggaga

SEQ ID NO: 68073 - RNA, 19 nt, Artificial Sequence
  Synthetic Oligonucleotide; TIM-3 exon 5; Set C
aauuuguuaucagagggag

SEQ ID NO: 68074 - RNA, 28 nt, Artificial Sequence
  Synthetic Oligonucleotide; TIM-3 exon 5; Set C
ugaagaauuuguuaucagagggagagag

SEQ ID NO: 68075 - RNA, 24 nt, Artificial Sequence
  Synthetic Oligonucleotide; TIM-3 exon 5; Set C
aagaauuuguuaucagagggagag

SEQ ID NO: 68076 - RNA, 22 nt, Artificial Sequence
  Synthetic Oligonucleotide; TIM-3 exon 5; Set C
agaauuuguuaucagagggaga

SEQ ID NO: 68077 - RNA, 20 nt, Artificial Sequence
  Synthetic Oligonucleotide; TIM-3 exon 5; Set C
gaauuuguuaucagagggag

SEQ ID NO: 68078 - RNA, 25 nt, Artificial Sequence
  Synthetic Oligonucleotide; TIM-3 exon 5; Set C
gaagaauuuguuaucagagggagag

SEQ ID NO: 68079 - RNA, 23 nt, Artificial Sequence
  Synthetic Oligonucleotide; TIM-3 exon 5; Set C
aagaauuuguuaucagagggaga

SEQ ID NO: 68080 - RNA, 21 nt, Artificial Sequence
  Synthetic Oligonucleotide; TIM-3 exon 5; Set C
agaauuuguuaucagagggag

SEQ ID NO: 68081 - RNA, 28 nt, Artificial Sequence
  Synthetic Oligonucleotide; TIM-3 exon 5; Set C
cugaagaauuuguuaucagagggagaga

SEQ ID NO: 68082 - RNA, 24 nt, Artificial Sequence
  Synthetic Oligonucleotide; TIM-3 exon 5; Set C
gaagaauuuguuaucagagggaga

SEQ ID NO: 68083 - RNA, 22 nt, Artificial Sequence
  Synthetic Oligonucleotide; TIM-3 exon 5; Set C
aagaauuuguuaucagagggag

SEQ ID NO: 68084 - RNA, 29 nt, Artificial Sequence
  Synthetic Oligonucleotide; TIM-3 exon 5; Set B
acugaagaauuuguuaucagagggagaga

SEQ ID NO: 68085 - RNA, 15 nt, Artificial Sequence
  Synthetic Oligonucleotide; TIM-3 exon 5; Set C
aauuuguuaucagag

SEQ ID NO: 68086 - RNA, 23 nt, Artificial Sequence
  Synthetic Oligonucleotide; TIM-3 exon 5; Set C
gaagaauuuguuaucagagggag

SEQ ID NO: 68087 - RNA, 16 nt, Artificial Sequence
  Synthetic Oligonucleotide; TIM-3 exon 5; Set C
gaauuuguuaucagag

SEQ ID NO: 68088 - RNA, 17 nt, Artificial Sequence
  Synthetic Oligonucleotide; TIM-3 exon 5; Set C
agaauuuguuaucagag

SEQ ID NO: 68089 - RNA, 15 nt, Artificial Sequence
  Synthetic Oligonucleotide; TIM-3 exon 5; Set C
gaauuuguuaucaga

SEQ ID NO: 68090 - RNA, 24 nt, Artificial Sequence
  Synthetic Oligonucleotide; TIM-3 exon 5; Set C
cugaagaauuuguuaucagaggga

SEQ ID NO: 68091 - RNA, 18 nt, Artificial Sequence
  Synthetic Oligonucleotide; TIM-3 exon 5; Set C
aagaauuuguuaucagag

SEQ ID NO: 68092 - RNA, 16 nt, Artificial Sequence
  Synthetic Oligonucleotide; TIM-3 exon 5; Set C
agaauuuguuaucaga

SEQ ID NO: 68093 - RNA, 23 nt, Artificial Sequence
  Synthetic Oligonucleotide; TIM-3 exon 5; Set C
cugaagaauuuguuaucagaggg

SEQ ID NO: 68094 - RNA, 25 nt, Artificial Sequence
  Synthetic Oligonucleotide; TIM-3 exon 5; Set C
acugaagaauuuguuaucagaggga

SEQ ID NO: 68095 - RNA, 19 nt, Artificial Sequence
  Synthetic Oligonucleotide; TIM-3 exon 5; Set C
gaagaauuuguuaucagag

SEQ ID NO: 68096 - RNA, 17 nt, Artificial Sequence
  Synthetic Oligonucleotide; TIM-3 exon 5; Set C
aagaauuuguuaucaga

SEQ ID NO: 68097 - RNA, 24 nt, Artificial Sequence
  Synthetic Oligonucleotide; TIM-3 exon 5; Set C
acugaagaauuuguuaucagaggg

SEQ ID NO: 68098 - RNA, 20 nt, Artificial Sequence
  Synthetic Oligonucleotide; TIM-3 exon 5; Set C
ugaagaauuuguuaucagag

SEQ ID NO: 68099 - RNA, 18 nt, Artificial Sequence
  Synthetic Oligonucleotide; TIM-3 exon 5; Set C
gaagaauuuguuaucaga

SEQ ID NO: 68100 - RNA, 23 nt, Artificial Sequence
  Synthetic Oligonucleotide; TIM-3 exon 5; Set C
acugaagaauuuguuaucagagg

SEQ ID NO: 68101 - RNA, 19 nt, Artificial Sequence
  Synthetic Oligonucleotide; TIM-3 exon 5; Set C
ugaagaauuuguuaucaga

SEQ ID NO: 68102 - RNA, 31 nt, Artificial Sequence
  Synthetic Oligonucleotide; TIM-3 exon 5; Set C
ggaaacacaaacaggauuuaagcagaaaaca

SEQ ID NO: 68103 - RNA, 30 nt, Artificial Sequence
  Synthetic Oligonucleotide; TIM-3 exon 5; Set C
ggaaacacaaacaggauuuaagcagaaaac

SEQ ID NO: 68104 - RNA, 32 nt, Artificial Sequence
  Synthetic Oligonucleotide; TIM-3 exon 5; Set A
uggaaacacaaacaggauuuaagcagaaaaca

SEQ ID NO: 68105 - RNA, 31 nt, Artificial Sequence
  Synthetic Oligonucleotide; TIM-3 exon 5; Set C
uggaaacacaaacaggauuuaagcagaaaac

SEQ ID NO: 68106 - RNA, 33 nt, Artificial Sequence
  Synthetic Oligonucleotide; TIM-3 exon 5; Set A
auggaaacacaaacaggauuuaagcagaaaaca

SEQ ID NO: 68107 - RNA, 32 nt, Artificial Sequence
  Synthetic Oligonucleotide; TIM-3 exon 5; Set C
auggaaacacaaacaggauuuaagcagaaaac

SEQ ID NO: 68108 - RNA, 30 nt, Artificial Sequence
  Synthetic Oligonucleotide; TIM-3 exon 5; Set C
uggaaacacaaacaggauuuaagcagaaaa

SEQ ID NO: 68109 - RNA, 39 nt, Artificial Sequence
  Synthetic Oligonucleotide; TIM-3 exon 5; Set A
uuugcuauggaaacacaaacaggauuuaagcagaaaaca

SEQ ID NO: 68110 - RNA, 38 nt, Artificial Sequence
  Synthetic Oligonucleotide; TIM-3 exon 5; Set A
uuugcuauggaaacacaaacaggauuuaagcagaaaac

SEQ ID NO: 68111 - RNA, 40 nt, Artificial Sequence
  Synthetic Oligonucleotide; TIM-3 exon 5; Set A
auuugcuauggaaacacaaacaggauuuaagcagaaaaca

SEQ ID NO: 68112 - RNA, 39 nt, Artificial Sequence
  Synthetic Oligonucleotide; TIM-3 exon 5; Set A
auuugcuauggaaacacaaacaggauuuaagcagaaaac

SEQ ID NO: 68113 - RNA, 37 nt, Artificial Sequence
  Synthetic Oligonucleotide; TIM-3 exon 5; Set A
uuugcuauggaaacacaaacaggauuuaagcagaaaa

SEQ ID NO: 68114 - RNA, 40 nt, Artificial Sequence
  Synthetic Oligonucleotide; TIM-3 exon 5; Set A
uauuugcuauggaaacacaaacaggauuuaagcagaaaac

SEQ ID NO: 68115 - RNA, 38 nt, Artificial Sequence
  Synthetic Oligonucleotide; TIM-3 exon 5; Set A
auuugcuauggaaacacaaacaggauuuaagcagaaaa

SEQ ID NO: 68116 - RNA, 36 nt, Artificial Sequence
  Synthetic Oligonucleotide; TIM-3 exon 5; Set A
uuugcuauggaaacacaaacaggauuuaagcagaaa

SEQ ID NO: 68117 - RNA, 39 nt, Artificial Sequence
  Synthetic Oligonucleotide; TIM-3 exon 5; Set A
uauuugcuauggaaacacaaacaggauuuaagcagaaaa

SEQ ID NO: 68118 - RNA, 35 nt, Artificial Sequence
  Synthetic Oligonucleotide; TIM-3 exon 5; Set A
uuugcuauggaaacacaaacaggauuuaagcagaa

SEQ ID NO: 68119 - RNA, 37 nt, Artificial Sequence
  Synthetic Oligonucleotide; TIM-3 exon 5; Set A
auuugcuauggaaacacaaacaggauuuaagcagaaa

SEQ ID NO: 68120 - RNA, 40 nt, Artificial Sequence
  Synthetic Oligonucleotide; TIM-3 exon 5; Set A
auauuugcuauggaaacacaaacaggauuuaagcagaaaa

SEQ ID NO: 68121 - RNA, 36 nt, Artificial Sequence
  Synthetic Oligonucleotide; TIM-3 exon 5; Set A
auuugcuauggaaacacaaacaggauuuaagcagaa

SEQ ID NO: 68122 - RNA, 38 nt, Artificial Sequence
  Synthetic Oligonucleotide; TIM-3 exon 5; Set A
uauuugcuauggaaacacaaacaggauuuaagcagaaa

SEQ ID NO: 68123 - RNA, 34 nt, Artificial Sequence
  Synthetic Oligonucleotide; TIM-3 exon 5; Set A
uuugcuauggaaacacaaacaggauuuaagcaga

SEQ ID NO: 68124 - RNA, 39 nt, Artificial Sequence
  Synthetic Oligonucleotide; TIM-3 exon 5; Set A
auauuugcuauggaaacacaaacaggauuuaagcagaaa

SEQ ID NO: 68125 - RNA, 37 nt, Artificial Sequence
  Synthetic Oligonucleotide; TIM-3 exon 5; Set A
uauuugcuauggaaacacaaacaggauuuaagcagaa

SEQ ID NO: 68126 - RNA, 35 nt, Artificial Sequence
  Synthetic Oligonucleotide; TIM-3 exon 5; Set A
auuugcuauggaaacacaaacaggauuuaagcaga

SEQ ID NO: 68127 - RNA, 38 nt, Artificial Sequence
  Synthetic Oligonucleotide; TIM-3 exon 5; Set A
auauuugcuauggaaacacaaacaggauuuaagcagaa

SEQ ID NO: 68128 - RNA, 40 nt, Artificial Sequence
  Synthetic Oligonucleotide; TIM-3 exon 5; Set A
gauauuugcuauggaaacacaaacaggauuuaagcagaaa

SEQ ID NO: 68129 - RNA, 36 nt, Artificial Sequence
  Synthetic Oligonucleotide; TIM-3 exon 5; Set A
uauuugcuauggaaacacaaacaggauuuaagcaga

SEQ ID NO: 68130 - RNA, 39 nt, Artificial Sequence
  Synthetic Oligonucleotide; TIM-3 exon 5; Set A
gauauuugcuauggaaacacaaacaggauuuaagcagaa

SEQ ID NO: 68131 - RNA, 37 nt, Artificial Sequence
  Synthetic Oligonucleotide; TIM-3 exon 5; Set A
auauuugcuauggaaacacaaacaggauuuaagcaga

SEQ ID NO: 68132 - RNA, 40 nt, Artificial Sequence
  Synthetic Oligonucleotide; TIM-3 exon 5; Set A
ggauauuugcuauggaaacacaaacaggauuuaagcagaa

SEQ ID NO: 68133 - RNA, 38 nt, Artificial Sequence
  Synthetic Oligonucleotide; TIM-3 exon 5; Set A
gauauuugcuauggaaacacaaacaggauuuaagcaga

SEQ ID NO: 68134 - RNA, 39 nt, Artificial Sequence
  Synthetic Oligonucleotide; TIM-3 exon 5; Set A
ggauauuugcuauggaaacacaaacaggauuuaagcaga

SEQ ID NO: 68135 - RNA, 40 nt, Artificial Sequence
  Synthetic Oligonucleotide; TIM-3 exon 5; Set A
uggauauuugcuauggaaacacaaacaggauuuaagcaga

SEQ ID NO: 68136 - RNA, 36 nt, Artificial Sequence
  Synthetic Oligonucleotide; TIM-3 exon 5; Set C
guugcuccagagucccguaagucauuggccaaucua

SEQ ID NO: 68137 - RNA, 37 nt, Artificial Sequence
  Synthetic Oligonucleotide; TIM-3 exon 5; Set C
gguugcuccagagucccguaagucauuggccaaucua

SEQ ID NO: 68138 - RNA, 38 nt, Artificial Sequence
  Synthetic Oligonucleotide; TIM-3 exon 5; Set C
ugguugcuccagagucccguaagucauuggccaaucua

SEQ ID NO: 68139 - RNA, 15 nt, Artificial Sequence
  Synthetic Oligonucleotide; TIM-3 exon 5; Set C
cagagucccguaagu

SEQ ID NO: 68140 - RNA, 15 nt, Artificial Sequence
  Synthetic Oligonucleotide; TIM-3 exon 5; Set C
gcuccagagucccgu

SEQ ID NO: 68141 - RNA, 25 nt, Artificial Sequence
  Synthetic Oligonucleotide; TIM-3 exon 5; Set A
augguugcuccagagucccguaagu

SEQ ID NO: 68142 - RNA, 15 nt, Artificial Sequence
  Synthetic Oligonucleotide; TIM-3 exon 5; Set C
ugcuccagagucccg

SEQ ID NO: 68143 - RNA, 24 nt, Artificial Sequence
  Synthetic Oligonucleotide; TIM-3 exon 5; Set A
augguugcuccagagucccguaag

SEQ ID NO: 68144 - RNA, 16 nt, Artificial Sequence
  Synthetic Oligonucleotide; TIM-3 exon 5; Set C
uugcuccagagucccg

SEQ ID NO: 68145 - RNA, 23 nt, Artificial Sequence
  Synthetic Oligonucleotide; TIM-3 exon 5; Set A
augguugcuccagagucccguaa

SEQ ID NO: 68146 - RNA, 17 nt, Artificial Sequence
  Synthetic Oligonucleotide; TIM-3 exon 5; Set C
guugcuccagagucccg

SEQ ID NO: 68147 - RNA, 22 nt, Artificial Sequence
  Synthetic Oligonucleotide; TIM-3 exon 5; Set A
augguugcuccagagucccgua

SEQ ID NO: 68148 - RNA, 18 nt, Artificial Sequence
  Synthetic Oligonucleotide; TIM-3 exon 5; Set A
gguugcuccagagucccg

SEQ ID NO: 68149 - RNA, 19 nt, Artificial Sequence
  Synthetic Oligonucleotide; TIM-3 exon 5; Set A
ugguugcuccagagucccg

SEQ ID NO: 68150 - RNA, 25 nt, Artificial Sequence
  Synthetic Oligonucleotide; TIM-3 exon 5; Set C
ucugaugguugcuccagagucccgu

SEQ ID NO: 68151 - RNA, 15 nt, Artificial Sequence
  Synthetic Oligonucleotide; TIM-3 exon 5; Set C
ugguugcuccagagu

SEQ ID NO: 68152 - RNA, 26 nt, Artificial Sequence
  Synthetic Oligonucleotide; TIM-3 exon 5; Set C
uucugaugguugcuccagagucccgu

SEQ ID NO: 68153 - RNA, 24 nt, Artificial Sequence
  Synthetic Oligonucleotide; TIM-3 exon 5; Set A
ucugaugguugcuccagagucccg

SEQ ID NO: 68154 - RNA, 15 nt, Artificial Sequence
  Synthetic Oligonucleotide; TIM-3 exon 5; Set C
augguugcuccagag

SEQ ID NO: 68155 - RNA, 25 nt, Artificial Sequence
  Synthetic Oligonucleotide; TIM-3 exon 5; Set A
uucugaugguugcuccagagucccg

SEQ ID NO: 68156 - RNA, 26 nt, Artificial Sequence
  Synthetic Oligonucleotide; TIM-3 exon 5; Set A
auucugaugguugcuccagagucccg

SEQ ID NO: 68157 - RNA, 37 nt, Artificial Sequence
  Synthetic Oligonucleotide; TIM-3 exon 5; Set C
augccuauucugaugguugcuccagagucccguaagu

SEQ ID NO: 68158 - RNA, 29 nt, Artificial Sequence
  Synthetic Oligonucleotide; TIM-3 exon 5; Set C
cuauucugaugguugcuccagagucccgu

SEQ ID NO: 68159 - RNA, 27 nt, Artificial Sequence
  Synthetic Oligonucleotide; TIM-3 exon 5; Set C
uauucugaugguugcuccagagucccg

SEQ ID NO: 68160 - RNA, 36 nt, Artificial Sequence
  Synthetic Oligonucleotide; TIM-3 exon 5; Set C
augccuauucugaugguugcuccagagucccguaag

SEQ ID NO: 68161 - RNA, 28 nt, Artificial Sequence
  Synthetic Oligonucleotide; TIM-3 exon 5; Set C
cuauucugaugguugcuccagagucccg

SEQ ID NO: 68162 - RNA, 20 nt, Artificial Sequence
  Synthetic Oligonucleotide; TIM-3 exon 5; Set A
ucugaugguugcuccagagu

SEQ ID NO: 68163 - RNA, 35 nt, Artificial Sequence
  Synthetic Oligonucleotide; TIM-3 exon 5; Set C
augccuauucugaugguugcuccagagucccguaa

SEQ ID NO: 68164 - RNA, 21 nt, Artificial Sequence
  Synthetic Oligonucleotide; TIM-3 exon 5; Set A
uucugaugguugcuccagagu

SEQ ID NO: 68165 - RNA, 18 nt, Artificial Sequence
  Synthetic Oligonucleotide; TIM-3 exon 5; Set C
ucugaugguugcuccaga

SEQ ID NO: 68166 - RNA, 22 nt, Artificial Sequence
  Synthetic Oligonucleotide; TIM-3 exon 5; Set A
auucugaugguugcuccagagu

SEQ ID NO: 68167 - RNA, 19 nt, Artificial Sequence
  Synthetic Oligonucleotide; TIM-3 exon 5; Set C
uucugaugguugcuccaga

SEQ ID NO: 68168 - RNA, 23 nt, Artificial Sequence
  Synthetic Oligonucleotide; TIM-3 exon 5; Set A
uauucugaugguugcuccagagu

SEQ ID NO: 68169 - RNA, 20 nt, Artificial Sequence
  Synthetic Oligonucleotide; TIM-3 exon 5; Set C
auucugaugguugcuccaga

SEQ ID NO: 68170 - RNA, 24 nt, Artificial Sequence
  Synthetic Oligonucleotide; TIM-3 exon 5; Set A
cuauucugaugguugcuccagagu

SEQ ID NO: 68171 - RNA, 33 nt, Artificial Sequence
  Synthetic Oligonucleotide; TIM-3 exon 5; Set C
gaugccuauucugaugguugcuccagagucccg

SEQ ID NO: 68172 - RNA, 22 nt, Artificial Sequence
  Synthetic Oligonucleotide; TIM-3 exon 5; Set A
cuauucugaugguugcuccaga

SEQ ID NO: 68173 - RNA, 34 nt, Artificial Sequence
  Synthetic Oligonucleotide; TIM-3 exon 5; Set C
agaugccuauucugaugguugcuccagagucccg

SEQ ID NO: 68174 - RNA, 20 nt, Artificial Sequence
  Synthetic Oligonucleotide; TIM-3 exon 5; Set C
uauucugaugguugcuccag

SEQ ID NO: 68175 - RNA, 29 nt, Artificial Sequence
  Synthetic Oligonucleotide; TIM-3 exon 5; Set C
gaugccuauucugaugguugcuccagagu

SEQ ID NO: 68176 - RNA, 30 nt, Artificial Sequence
  Synthetic Oligonucleotide; TIM-3 exon 5; Set C
agaugccuauucugaugguugcuccagagu

SEQ ID NO: 68177 - RNA, 27 nt, Artificial Sequence
  Synthetic Oligonucleotide; TIM-3 exon 5; Set C
gaugccuauucugaugguugcuccaga

SEQ ID NO: 68178 - RNA, 28 nt, Artificial Sequence
  Synthetic Oligonucleotide; TIM-3 exon 5; Set C
agaugccuauucugaugguugcuccaga

SEQ ID NO: 68179 - RNA, 40 nt, Artificial Sequence
  Synthetic Oligonucleotide; TIM-3 exon 5; Set C
cgauguagaugccuauucugaugguugcuccagagucccg

SEQ ID NO: 68180 - RNA, 26 nt, Artificial Sequence
  Synthetic Oligonucleotide; TIM-3 exon 5; Set A
gaugccuauucugaugguugcuccag

SEQ ID NO: 68181 - RNA, 27 nt, Artificial Sequence
  Synthetic Oligonucleotide; TIM-3 exon 5; Set A
agaugccuauucugaugguugcuccag

SEQ ID NO: 68182 - RNA, 28 nt, Artificial Sequence
  Synthetic Oligonucleotide; TIM-3 exon 5; Set A
uagaugccuauucugaugguugcuccag

SEQ ID NO: 68183 - RNA, 29 nt, Artificial Sequence
  Synthetic Oligonucleotide; TIM-3 exon 5; Set A
guagaugccuauucugaugguugcuccag

SEQ ID NO: 68184 - RNA, 20 nt, Artificial Sequence
  Synthetic Oligonucleotide; TIM-3 exon 5; Set C
augccuauucugaugguugc

SEQ ID NO: 68185 - RNA, 36 nt, Artificial Sequence
  Synthetic Oligonucleotide; TIM-3 exon 5; Set C
cgauguagaugccuauucugaugguugcuccagagu

SEQ ID NO: 68186 - RNA, 30 nt, Artificial Sequence
  Synthetic Oligonucleotide; TIM-3 exon 5; Set C
uguagaugccuauucugaugguugcuccag

SEQ ID NO: 68187 - RNA, 19 nt, Artificial Sequence
  Synthetic Oligonucleotide; TIM-3 exon 5; Set C
augccuauucugaugguug

SEQ ID NO: 68188 - RNA, 37 nt, Artificial Sequence
  Synthetic Oligonucleotide; TIM-3 exon 5; Set C
ccgauguagaugccuauucugaugguugcuccagagu

SEQ ID NO: 68189 - RNA, 31 nt, Artificial Sequence
  Synthetic Oligonucleotide; TIM-3 exon 5; Set C
auguagaugccuauucugaugguugcuccag

SEQ ID NO: 68190 - RNA, 18 nt, Artificial Sequence
  Synthetic Oligonucleotide; TIM-3 exon 5; Set C
augccuauucugaugguu

SEQ ID NO: 68191 - RNA, 38 nt, Artificial Sequence
  Synthetic Oligonucleotide; TIM-3 exon 5; Set C
uccgauguagaugccuauucugaugguugcuccagagu

SEQ ID NO: 68192 - RNA, 32 nt, Artificial Sequence
  Synthetic Oligonucleotide; TIM-3 exon 5; Set C
gauguagaugccuauucugaugguugcuccag

SEQ ID NO: 68193 - RNA, 35 nt, Artificial Sequence
  Synthetic Oligonucleotide; TIM-3 exon 5; Set C
ccgauguagaugccuauucugaugguugcuccaga

SEQ ID NO: 68194 - RNA, 33 nt, Artificial Sequence
  Synthetic Oligonucleotide; TIM-3 exon 5; Set C
cgauguagaugccuauucugaugguugcuccag

SEQ ID NO: 68195 - RNA, 36 nt, Artificial Sequence
  Synthetic Oligonucleotide; TIM-3 exon 5; Set C
uccgauguagaugccuauucugaugguugcuccaga

SEQ ID NO: 68196 - RNA, 34 nt, Artificial Sequence
  Synthetic Oligonucleotide; TIM-3 exon 5; Set C
ccgauguagaugccuauucugaugguugcuccag

SEQ ID NO: 68197 - RNA, 16 nt, Artificial Sequence
  Synthetic Oligonucleotide; TIM-3 exon 5; Set C
gaugccuauucugaug

SEQ ID NO: 68198 - RNA, 17 nt, Artificial Sequence
  Synthetic Oligonucleotide; TIM-3 exon 5; Set C
agaugccuauucugaug

SEQ ID NO: 68199 - RNA, 18 nt, Artificial Sequence
  Synthetic Oligonucleotide; TIM-3 exon 5; Set C
uagaugccuauucugaug

SEQ ID NO: 68200 - RNA, 19 nt, Artificial Sequence
  Synthetic Oligonucleotide; TIM-3 exon 5; Set C
guagaugccuauucugaug

SEQ ID NO: 68201 - RNA, 20 nt, Artificial Sequence
  Synthetic Oligonucleotide; TIM-3 exon 5; Set C
uguagaugccuauucugaug

SEQ ID NO: 68202 - RNA, 21 nt, Artificial Sequence
  Synthetic Oligonucleotide; TIM-3 exon 5; Set C
auguagaugccuauucugaug

SEQ ID NO: 68203 - RNA, 22 nt, Artificial Sequence
  Synthetic Oligonucleotide; TIM-3 exon 5; Set C
gauguagaugccuauucugaug

SEQ ID NO: 68204 - RNA, 23 nt, Artificial Sequence
  Synthetic Oligonucleotide; TIM-3 exon 5; Set C
cgauguagaugccuauucugaug

SEQ ID NO: 68205 - RNA, 24 nt, Artificial Sequence
  Synthetic Oligonucleotide; TIM-3 exon 5; Set A
ccgauguagaugccuauucugaug

SEQ ID NO: 68206 - RNA, 25 nt, Artificial Sequence
  Synthetic Oligonucleotide; TIM-3 exon 5; Set A
uccgauguagaugccuauucugaug

SEQ ID NO: 68207 - RNA, 32 nt, Artificial Sequence
  Synthetic Oligonucleotide; TIM-3 exon 5; Set C
ucccugcuccgauguagaugccuauucugaug

SEQ ID NO: 68208 - RNA, 33 nt, Artificial Sequence
  Synthetic Oligonucleotide; TIM-3 exon 5; Set C
aucccugcuccgauguagaugccuauucugaug

SEQ ID NO: 68209 - RNA, 34 nt, Artificial Sequence
  Synthetic Oligonucleotide; TIM-3 exon 5; Set C
gaucccugcuccgauguagaugccuauucugaug

SEQ ID NO: 68210 - RNA, 22 nt, Artificial Sequence
  Synthetic Oligonucleotide; TIM-3 exon 5; Set A
ccugcuccgauguagaugccua

SEQ ID NO: 68211 - RNA, 23 nt, Artificial Sequence
  Synthetic Oligonucleotide; TIM-3 exon 5; Set C
cccugcuccgauguagaugccua

SEQ ID NO: 68212 - RNA, 22 nt, Artificial Sequence
  Synthetic Oligonucleotide; TIM-3 exon 5; Set A
gaucccugcuccgauguagaug

SEQ ID NO: 68213 - RNA, 40 nt, Artificial Sequence
  Synthetic Oligonucleotide; TIM-3 exon 5; Set C
cagcccagcacagaucccugcuccgauguagaugccuauu

SEQ ID NO: 68214 - RNA, 23 nt, Artificial Sequence
  Synthetic Oligonucleotide; TIM-3 exon 5; Set A
cacagaucccugcuccgauguag

SEQ ID NO: 68215 - RNA, 40 nt, Artificial Sequence
  Synthetic Oligonucleotide; TIM-3 exon 5; Set C
ccagcccagcacagaucccugcuccgauguagaugccuau

SEQ ID NO: 68216 - RNA, 38 nt, Artificial Sequence
  Synthetic Oligonucleotide; TIM-3 exon 5; Set C
cagcccagcacagaucccugcuccgauguagaugccua

SEQ ID NO: 68217 - RNA, 39 nt, Artificial Sequence
  Synthetic Oligonucleotide; TIM-3 exon 5; Set C
ccagcccagcacagaucccugcuccgauguagaugccua

SEQ ID NO: 68218 - RNA, 40 nt, Artificial Sequence
  Synthetic Oligonucleotide; TIM-3 exon 5; Set C
gccagcccagcacagaucccugcuccgauguagaugccua

SEQ ID NO: 68219 - RNA, 33 nt, Artificial Sequence
  Synthetic Oligonucleotide; TIM-3 exon 5; Set C
cagcccagcacagaucccugcuccgauguagau

SEQ ID NO: 68220 - RNA, 32 nt, Artificial Sequence
  Synthetic Oligonucleotide; TIM-3 exon 5; Set C
cagcccagcacagaucccugcuccgauguaga

SEQ ID NO: 68221 - RNA, 34 nt, Artificial Sequence
  Synthetic Oligonucleotide; TIM-3 exon 5; Set C
ccagcccagcacagaucccugcuccgauguagau

SEQ ID NO: 68222 - RNA, 33 nt, Artificial Sequence
  Synthetic Oligonucleotide; TIM-3 exon 5; Set C
ccagcccagcacagaucccugcuccgauguaga

SEQ ID NO: 68223 - RNA, 35 nt, Artificial Sequence
  Synthetic Oligonucleotide; TIM-3 exon 5; Set C
gccagcccagcacagaucccugcuccgauguagau

SEQ ID NO: 68224 - RNA, 34 nt, Artificial Sequence
  Synthetic Oligonucleotide; TIM-3 exon 5; Set C
gccagcccagcacagaucccugcuccgauguaga

SEQ ID NO: 68225 - RNA, 36 nt, Artificial Sequence
  Synthetic Oligonucleotide; TIM-3 exon 5; Set C
agccagcccagcacagaucccugcuccgauguagau

SEQ ID NO: 68226 - RNA, 31 nt, Artificial Sequence
  Synthetic Oligonucleotide; TIM-3 exon 5; Set C
ccagcccagcacagaucccugcuccgaugua

SEQ ID NO: 68227 - RNA, 35 nt, Artificial Sequence
  Synthetic Oligonucleotide; TIM-3 exon 5; Set C
agccagcccagcacagaucccugcuccgauguaga

SEQ ID NO: 68228 - RNA, 32 nt, Artificial Sequence
  Synthetic Oligonucleotide; TIM-3 exon 5; Set C
gccagcccagcacagaucccugcuccgaugua

SEQ ID NO: 68229 - RNA, 30 nt, Artificial Sequence
  Synthetic Oligonucleotide; TIM-3 exon 5; Set C
ccagcccagcacagaucccugcuccgaugu

SEQ ID NO: 68230 - RNA, 33 nt, Artificial Sequence
  Synthetic Oligonucleotide; TIM-3 exon 5; Set C
agccagcccagcacagaucccugcuccgaugua

SEQ ID NO: 68231 - RNA, 29 nt, Artificial Sequence
  Synthetic Oligonucleotide; TIM-3 exon 5; Set C
ccagcccagcacagaucccugcuccgaug

SEQ ID NO: 68232 - RNA, 31 nt, Artificial Sequence
  Synthetic Oligonucleotide; TIM-3 exon 5; Set C
gccagcccagcacagaucccugcuccgaugu

SEQ ID NO: 68233 - RNA, 28 nt, Artificial Sequence
  Synthetic Oligonucleotide; TIM-3 exon 5; Set C
ccagcccagcacagaucccugcuccgau

SEQ ID NO: 68234 - RNA, 30 nt, Artificial Sequence
  Synthetic Oligonucleotide; TIM-3 exon 5; Set C
gccagcccagcacagaucccugcuccgaug

SEQ ID NO: 68235 - RNA, 32 nt, Artificial Sequence
  Synthetic Oligonucleotide; TIM-3 exon 5; Set C
agccagcccagcacagaucccugcuccgaugu

SEQ ID NO: 68236 - RNA, 26 nt, Artificial Sequence
  Synthetic Oligonucleotide; TIM-3 exon 5; Set C
cagcccagcacagaucccugcuccga

SEQ ID NO: 68237 - RNA, 29 nt, Artificial Sequence
  Synthetic Oligonucleotide; TIM-3 exon 5; Set C
gccagcccagcacagaucccugcuccgau

SEQ ID NO: 68238 - RNA, 31 nt, Artificial Sequence
  Synthetic Oligonucleotide; TIM-3 exon 5; Set C
agccagcccagcacagaucccugcuccgaug

SEQ ID NO: 68239 - RNA, 27 nt, Artificial Sequence
  Synthetic Oligonucleotide; TIM-3 exon 5; Set C
ccagcccagcacagaucccugcuccga

SEQ ID NO: 68240 - RNA, 25 nt, Artificial Sequence
  Synthetic Oligonucleotide; TIM-3 exon 5; Set C
cagcccagcacagaucccugcuccg

SEQ ID NO: 68241 - RNA, 30 nt, Artificial Sequence
  Synthetic Oligonucleotide; TIM-3 exon 5; Set C
agccagcccagcacagaucccugcuccgau

SEQ ID NO: 68242 - RNA, 28 nt, Artificial Sequence
  Synthetic Oligonucleotide; TIM-3 exon 5; Set C
gccagcccagcacagaucccugcuccga

SEQ ID NO: 68243 - RNA, 26 nt, Artificial Sequence
  Synthetic Oligonucleotide; TIM-3 exon 5; Set C
ccagcccagcacagaucccugcuccg

SEQ ID NO: 68244 - RNA, 24 nt, Artificial Sequence
  Synthetic Oligonucleotide; TIM-3 exon 5; Set C
cagcccagcacagaucccugcucc

SEQ ID NO: 68245 - RNA, 29 nt, Artificial Sequence
  Synthetic Oligonucleotide; TIM-3 exon 5; Set C
agccagcccagcacagaucccugcuccga

SEQ ID NO: 68246 - RNA, 27 nt, Artificial Sequence
  Synthetic Oligonucleotide; TIM-3 exon 5; Set C
gccagcccagcacagaucccugcuccg

SEQ ID NO: 68247 - RNA, 28 nt, Artificial Sequence
  Synthetic Oligonucleotide; TIM-3 exon 5; Set C
agccagcccagcacagaucccugcuccg

SEQ ID NO: 68248 - RNA, 18 nt, Artificial Sequence
  Synthetic Oligonucleotide; TIM-3 exon 5; Set A
cagcccagcacagauccc

SEQ ID NO: 68249 - RNA, 17 nt, Artificial Sequence
  Synthetic Oligonucleotide; TIM-3 exon 5; Set A
cagcccagcacagaucc

SEQ ID NO: 68250 - RNA, 16 nt, Artificial Sequence
  Synthetic Oligonucleotide; TIM-3 exon 5; Set C
cagcccagcacagauc

SEQ ID NO: 68251 - RNA, 18 nt, Artificial Sequence
  Synthetic Oligonucleotide; TIM-3 exon 5; Set A
ccagcccagcacagaucc

SEQ ID NO: 68252 - RNA, 15 nt, Artificial Sequence
  Synthetic Oligonucleotide; TIM-3 exon 5; Set C
cagcccagcacagau

SEQ ID NO: 68253 - RNA, 17 nt, Artificial Sequence
  Synthetic Oligonucleotide; TIM-3 exon 5; Set A
ccagcccagcacagauc

SEQ ID NO: 68254 - RNA, 19 nt, Artificial Sequence
  Synthetic Oligonucleotide; TIM-3 exon 5; Set C
gccagcccagcacagaucc

SEQ ID NO: 68255 - RNA, 40 nt, Artificial Sequence
  Synthetic Oligonucleotide; TIM-3 exon 5; Set C
uaagagccagagccagcccagcacagaucccugcuccgau

SEQ ID NO: 68256 - RNA, 16 nt, Artificial Sequence
  Synthetic Oligonucleotide; TIM-3 exon 5; Set A
ccagcccagcacagau

SEQ ID NO: 68257 - RNA, 18 nt, Artificial Sequence
  Synthetic Oligonucleotide; TIM-3 exon 5; Set A
gccagcccagcacagauc

SEQ ID NO: 68258 - RNA, 20 nt, Artificial Sequence
  Synthetic Oligonucleotide; TIM-3 exon 5; Set C
agccagcccagcacagaucc

SEQ ID NO: 68259 - RNA, 17 nt, Artificial Sequence
  Synthetic Oligonucleotide; TIM-3 exon 5; Set A
gccagcccagcacagau

SEQ ID NO: 68260 - RNA, 19 nt, Artificial Sequence
  Synthetic Oligonucleotide; TIM-3 exon 5; Set A
agccagcccagcacagauc

SEQ ID NO: 68261 - RNA, 18 nt, Artificial Sequence
  Synthetic Oligonucleotide; TIM-3 exon 5; Set A
agccagcccagcacagau

SEQ ID NO: 68262 - RNA, 40 nt, Artificial Sequence
  Synthetic Oligonucleotide; TIM-3 exon 5; Set C
auaagagccagagccagcccagcacagaucccugcuccga

SEQ ID NO: 68263 - RNA, 40 nt, Artificial Sequence
  Synthetic Oligonucleotide; TIM-3 exon 5; Set C
gauaagagccagagccagcccagcacagaucccugcuccg

SEQ ID NO: 68264 - RNA, 39 nt, Artificial Sequence
  Synthetic Oligonucleotide; TIM-3 exon 5; Set C
gauaagagccagagccagcccagcacagaucccugcucc

SEQ ID NO: 68265 - RNA, 40 nt, Artificial Sequence
  Synthetic Oligonucleotide; TIM-3 exon 5; Set C
agauaagagccagagccagcccagcacagaucccugcucc

SEQ ID NO: 68266 - RNA, 34 nt, Artificial Sequence
  Synthetic Oligonucleotide; TIM-3 exon 5; Set C
gauaagagccagagccagcccagcacagaucccu

SEQ ID NO: 68267 - RNA, 33 nt, Artificial Sequence
  Synthetic Oligonucleotide; TIM-3 exon 5; Set C
gauaagagccagagccagcccagcacagauccc

SEQ ID NO: 68268 - RNA, 35 nt, Artificial Sequence
  Synthetic Oligonucleotide; TIM-3 exon 5; Set C
agauaagagccagagccagcccagcacagaucccu

SEQ ID NO: 68269 - RNA, 32 nt, Artificial Sequence
  Synthetic Oligonucleotide; TIM-3 exon 5; Set C
gauaagagccagagccagcccagcacagaucc

SEQ ID NO: 68270 - RNA, 34 nt, Artificial Sequence
  Synthetic Oligonucleotide; TIM-3 exon 5; Set C
agauaagagccagagccagcccagcacagauccc

SEQ ID NO: 68271 - RNA, 36 nt, Artificial Sequence
  Synthetic Oligonucleotide; TIM-3 exon 5; Set C
aagauaagagccagagccagcccagcacagaucccu

SEQ ID NO: 68272 - RNA, 31 nt, Artificial Sequence
  Synthetic Oligonucleotide; TIM-3 exon 5; Set C
gauaagagccagagccagcccagcacagauc

SEQ ID NO: 68273 - RNA, 33 nt, Artificial Sequence
  Synthetic Oligonucleotide; TIM-3 exon 5; Set C
agauaagagccagagccagcccagcacagaucc

SEQ ID NO: 68274 - RNA, 35 nt, Artificial Sequence
  Synthetic Oligonucleotide; TIM-3 exon 5; Set C
aagauaagagccagagccagcccagcacagauccc

SEQ ID NO: 68275 - RNA, 37 nt, Artificial Sequence
  Synthetic Oligonucleotide; TIM-3 exon 5; Set C
gaagauaagagccagagccagcccagcacagaucccu

SEQ ID NO: 68276 - RNA, 30 nt, Artificial Sequence
  Synthetic Oligonucleotide; TIM-3 exon 5; Set C
gauaagagccagagccagcccagcacagau

SEQ ID NO: 68277 - RNA, 32 nt, Artificial Sequence
  Synthetic Oligonucleotide; TIM-3 exon 5; Set C
agauaagagccagagccagcccagcacagauc

SEQ ID NO: 68278 - RNA, 34 nt, Artificial Sequence
  Synthetic Oligonucleotide; TIM-3 exon 5; Set C
aagauaagagccagagccagcccagcacagaucc

SEQ ID NO: 68279 - RNA, 36 nt, Artificial Sequence
  Synthetic Oligonucleotide; TIM-3 exon 5; Set C
gaagauaagagccagagccagcccagcacagauccc

SEQ ID NO: 68280 - RNA, 38 nt, Artificial Sequence
  Synthetic Oligonucleotide; TIM-3 exon 5; Set C
cgaagauaagagccagagccagcccagcacagaucccu

SEQ ID NO: 68281 - RNA, 31 nt, Artificial Sequence
  Synthetic Oligonucleotide; TIM-3 exon 5; Set C
agauaagagccagagccagcccagcacagau

SEQ ID NO: 68282 - RNA, 33 nt, Artificial Sequence
  Synthetic Oligonucleotide; TIM-3 exon 5; Set C
aagauaagagccagagccagcccagcacagauc

SEQ ID NO: 68283 - RNA, 35 nt, Artificial Sequence
  Synthetic Oligonucleotide; TIM-3 exon 5; Set C
gaagauaagagccagagccagcccagcacagaucc

SEQ ID NO: 68284 - RNA, 37 nt, Artificial Sequence
  Synthetic Oligonucleotide; TIM-3 exon 5; Set C
cgaagauaagagccagagccagcccagcacagauccc

SEQ ID NO: 68285 - RNA, 32 nt, Artificial Sequence
  Synthetic Oligonucleotide; TIM-3 exon 5; Set C
aagauaagagccagagccagcccagcacagau

SEQ ID NO: 68286 - RNA, 34 nt, Artificial Sequence
  Synthetic Oligonucleotide; TIM-3 exon 5; Set C
gaagauaagagccagagccagcccagcacagauc

SEQ ID NO: 68287 - RNA, 36 nt, Artificial Sequence
  Synthetic Oligonucleotide; TIM-3 exon 5; Set C
cgaagauaagagccagagccagcccagcacagaucc

SEQ ID NO: 68288 - RNA, 33 nt, Artificial Sequence
  Synthetic Oligonucleotide; TIM-3 exon 5; Set C
gaagauaagagccagagccagcccagcacagau

SEQ ID NO: 68289 - RNA, 35 nt, Artificial Sequence
  Synthetic Oligonucleotide; TIM-3 exon 5; Set C
cgaagauaagagccagagccagcccagcacagauc

SEQ ID NO: 68290 - RNA, 34 nt, Artificial Sequence
  Synthetic Oligonucleotide; TIM-3 exon 5; Set C
cgaagauaagagccagagccagcccagcacagau

SEQ ID NO: 68291 - RNA, 18 nt, Artificial Sequence
  Synthetic Oligonucleotide; TIM-3 exon 5; Set C
gauaagagccagagccag

SEQ ID NO: 68292 - RNA, 19 nt, Artificial Sequence
  Synthetic Oligonucleotide; TIM-3 exon 5; Set C
agauaagagccagagccag

SEQ ID NO: 68293 - RNA, 20 nt, Artificial Sequence
  Synthetic Oligonucleotide; TIM-3 exon 5; Set C
aagauaagagccagagccag

SEQ ID NO: 68294 - RNA, 21 nt, Artificial Sequence
  Synthetic Oligonucleotide; TIM-3 exon 5; Set C
gaagauaagagccagagccag

SEQ ID NO: 68295 - RNA, 22 nt, Artificial Sequence
  Synthetic Oligonucleotide; TIM-3 exon 5; Set C
cgaagauaagagccagagccag

SEQ ID NO: 68296 - RNA, 21 nt, Artificial Sequence
  Synthetic Oligonucleotide; TIM-3 exon 5; Set C
cgaagauaagagccagagcca

SEQ ID NO: 68297 - RNA, 20 nt, Artificial Sequence
  Synthetic Oligonucleotide; TIM-3 exon 5; Set C
cgaagauaagagccagagcc

SEQ ID NO: 68298 - RNA, 31 nt, Artificial Sequence
  Synthetic Oligonucleotide; TIM-3 exon 5; Set A
uuaaagcgccgaagauaagagccagagccag

SEQ ID NO: 68299 - RNA, 30 nt, Artificial Sequence
  Synthetic Oligonucleotide; TIM-3 exon 5; Set C
uuaaagcgccgaagauaagagccagagcca

SEQ ID NO: 68300 - RNA, 29 nt, Artificial Sequence
  Synthetic Oligonucleotide; TIM-3 exon 5; Set A
uuaaagcgccgaagauaagagccagagcc

SEQ ID NO: 68301 - RNA, 28 nt, Artificial Sequence
  Synthetic Oligonucleotide; TIM-3 exon 5; Set A
uuaaagcgccgaagauaagagccagagc

SEQ ID NO: 68302 - RNA, 35 nt, Artificial Sequence
  Synthetic Oligonucleotide; TIM-3 exon 5; Set A
gaaaauuaaagcgccgaagauaagagccagagcca

SEQ ID NO: 68303 - RNA, 38 nt, Artificial Sequence
  Synthetic Oligonucleotide; TIM-3 exon 5; Set A
uugaaaauuaaagcgccgaagauaagagccagagccag

SEQ ID NO: 68304 - RNA, 34 nt, Artificial Sequence
  Synthetic Oligonucleotide; TIM-3 exon 5; Set A
gaaaauuaaagcgccgaagauaagagccagagcc

SEQ ID NO: 68305 - RNA, 39 nt, Artificial Sequence
  Synthetic Oligonucleotide; TIM-3 exon 5; Set A
uuugaaaauuaaagcgccgaagauaagagccagagccag

SEQ ID NO: 68306 - RNA, 33 nt, Artificial Sequence
  Synthetic Oligonucleotide; TIM-3 exon 5; Set A
gaaaauuaaagcgccgaagauaagagccagagc

SEQ ID NO: 68307 - RNA, 37 nt, Artificial Sequence
  Synthetic Oligonucleotide; TIM-3 exon 5; Set A
uugaaaauuaaagcgccgaagauaagagccagagcca

SEQ ID NO: 68308 - RNA, 36 nt, Artificial Sequence
  Synthetic Oligonucleotide; TIM-3 exon 5; Set A
uugaaaauuaaagcgccgaagauaagagccagagcc

SEQ ID NO: 68309 - RNA, 34 nt, Artificial Sequence
  Synthetic Oligonucleotide; TIM-3 exon 5; Set A
ugaaaauuaaagcgccgaagauaagagccagagc

SEQ ID NO: 68310 - RNA, 38 nt, Artificial Sequence
  Synthetic Oligonucleotide; TIM-3 exon 5; Set A
uuugaaaauuaaagcgccgaagauaagagccagagcca

SEQ ID NO: 68311 - RNA, 37 nt, Artificial Sequence
  Synthetic Oligonucleotide; TIM-3 exon 5; Set A
uuugaaaauuaaagcgccgaagauaagagccagagcc

SEQ ID NO: 68312 - RNA, 35 nt, Artificial Sequence
  Synthetic Oligonucleotide; TIM-3 exon 5; Set A
uugaaaauuaaagcgccgaagauaagagccagagc

SEQ ID NO: 68313 - RNA, 36 nt, Artificial Sequence
  Synthetic Oligonucleotide; TIM-3 exon 5; Set A
uuugaaaauuaaagcgccgaagauaagagccagagc

SEQ ID NO: 68314 - RNA, 18 nt, Artificial Sequence
  Synthetic Oligonucleotide; TIM-3 exon 5; Set C
uuaaagcgccgaagauaa

SEQ ID NO: 68315 - RNA, 15 nt, Artificial Sequence
  Synthetic Oligonucleotide; TIM-3 exon 5; Set C
uaaagcgccgaagau

SEQ ID NO: 68316 - RNA, 17 nt, Artificial Sequence
  Synthetic Oligonucleotide; TIM-3 exon 5; Set C
uuaaagcgccgaagaua

SEQ ID NO: 68317 - RNA, 15 nt, Artificial Sequence
  Synthetic Oligonucleotide; TIM-3 exon 5; Set C
uuaaagcgccgaaga

SEQ ID NO: 68318 - RNA, 17 nt, Artificial Sequence
  Synthetic Oligonucleotide; TIM-3 exon 5; Set C
auuaaagcgccgaagau

SEQ ID NO: 68319 - RNA, 16 nt, Artificial Sequence
  Synthetic Oligonucleotide; TIM-3 exon 5; Set C
auuaaagcgccgaaga

SEQ ID NO: 68320 - RNA, 24 nt, Artificial Sequence
  Synthetic Oligonucleotide; TIM-3 exon 5; Set C
gaaaauuaaagcgccgaagauaag

SEQ ID NO: 68321 - RNA, 25 nt, Artificial Sequence
  Synthetic Oligonucleotide; TIM-3 exon 5; Set C
ugaaaauuaaagcgccgaagauaag

SEQ ID NO: 68322 - RNA, 25 nt, Artificial Sequence
  Synthetic Oligonucleotide; TIM-3 exon 5; Set C
uugaaaauuaaagcgccgaagauaa

SEQ ID NO: 68323 - RNA, 24 nt, Artificial Sequence
  Synthetic Oligonucleotide; TIM-3 exon 5; Set C
uugaaaauuaaagcgccgaagaua

SEQ ID NO: 68324 - RNA, 26 nt, Artificial Sequence
  Synthetic Oligonucleotide; TIM-3 exon 5; Set C
uuugaaaauuaaagcgccgaagauaa

SEQ ID NO: 68325 - RNA, 25 nt, Artificial Sequence
  Synthetic Oligonucleotide; TIM-3 exon 5; Set C
uuugaaaauuaaagcgccgaagaua

SEQ ID NO: 68326 - RNA, 21 nt, Artificial Sequence
  Synthetic Oligonucleotide; TIM-3 exon 5; Set C
uugaaaauuaaagcgccgaag

SEQ ID NO: 68327 - RNA, 20 nt, Artificial Sequence
  Synthetic Oligonucleotide; TIM-3 exon 5; Set C
uugaaaauuaaagcgccgaa

SEQ ID NO: 68328 - RNA, 22 nt, Artificial Sequence
  Synthetic Oligonucleotide; TIM-3 exon 5; Set C
uuugaaaauuaaagcgccgaag

SEQ ID NO: 68329 - RNA, 21 nt, Artificial Sequence
  Synthetic Oligonucleotide; TIM-3 exon 5; Set C
uuugaaaauuaaagcgccgaa

SEQ ID NO: 68330 - RNA, 20 nt, Artificial Sequence
  Synthetic Oligonucleotide; TIM-3 exon 5; Set C
uuugaaaauuaaagcgccga

SEQ ID NO: 68331 - RNA, 38 nt, Artificial Sequence
  Synthetic Oligonucleotide; TIM-3 exon 5; Set C
aaaacacuuacauuugaaaauuaaagcgccgaagauaa

SEQ ID NO: 68332 - RNA, 39 nt, Artificial Sequence
  Synthetic Oligonucleotide; TIM-3 exon 5; Set C
aaaaacacuuacauuugaaaauuaaagcgccgaagauaa

SEQ ID NO: 68333 - RNA, 37 nt, Artificial Sequence
  Synthetic Oligonucleotide; TIM-3 exon 5; Set B
aaaacacuuacauuugaaaauuaaagcgccgaagaua

SEQ ID NO: 68334 - RNA, 40 nt, Artificial Sequence
  Synthetic Oligonucleotide; TIM-3 exon 5; Set B
caaaaacacuuacauuugaaaauuaaagcgccgaagauaa

SEQ ID NO: 68335 - RNA, 38 nt, Artificial Sequence
  Synthetic Oligonucleotide; TIM-3 exon 5; Set C
aaaaacacuuacauuugaaaauuaaagcgccgaagaua

SEQ ID NO: 68336 - RNA, 39 nt, Artificial Sequence
  Synthetic Oligonucleotide; TIM-3 exon 5; Set B
caaaaacacuuacauuugaaaauuaaagcgccgaagaua

SEQ ID NO: 68337 - RNA, 40 nt, Artificial Sequence
  Synthetic Oligonucleotide; TIM-3 exon 5; Set B
acaaaaacacuuacauuugaaaauuaaagcgccgaagaua

SEQ ID NO: 68338 - RNA, 40 nt, Artificial Sequence
  Synthetic Oligonucleotide; TIM-3 exon 5; Set B
aaacaaaaacacuuacauuugaaaauuaaagcgccgaaga

SEQ ID NO: 68339 - RNA, 39 nt, Artificial Sequence
  Synthetic Oligonucleotide; TIM-3 exon 5; Set C
aaacaaaaacacuuacauuugaaaauuaaagcgccgaag

SEQ ID NO: 68340 - RNA, 40 nt, Artificial Sequence
  Synthetic Oligonucleotide; TIM-3 exon 5; Set B
gaaacaaaaacacuuacauuugaaaauuaaagcgccgaag

SEQ ID NO: 68341 - RNA, 38 nt, Artificial Sequence
  Synthetic Oligonucleotide; TIM-3 exon 5; Set C
aaacaaaaacacuuacauuugaaaauuaaagcgccgaa

SEQ ID NO: 68342 - RNA, 37 nt, Artificial Sequence
  Synthetic Oligonucleotide; TIM-3 exon 5; Set C
aaacaaaaacacuuacauuugaaaauuaaagcgccga

SEQ ID NO: 68343 - RNA, 39 nt, Artificial Sequence
  Synthetic Oligonucleotide; TIM-3 exon 5; Set B
gaaacaaaaacacuuacauuugaaaauuaaagcgccgaa

SEQ ID NO: 68344 - RNA, 38 nt, Artificial Sequence
  Synthetic Oligonucleotide; TIM-3 exon 5; Set B
gaaacaaaaacacuuacauuugaaaauuaaagcgccga

SEQ ID NO: 68345 - RNA, 40 nt, Artificial Sequence
  Synthetic Oligonucleotide; TIM-3 exon 5; Set B
agaaacaaaaacacuuacauuugaaaauuaaagcgccgaa

SEQ ID NO: 68346 - RNA, 39 nt, Artificial Sequence
  Synthetic Oligonucleotide; TIM-3 exon 5; Set B
agaaacaaaaacacuuacauuugaaaauuaaagcgccga

SEQ ID NO: 68347 - RNA, 25 nt, Artificial Sequence
  Synthetic Oligonucleotide; TIM-3 exon 5; Set C
aaaacacuuacauuugaaaauuaaa

SEQ ID NO: 68348 - RNA, 40 nt, Artificial Sequence
  Synthetic Oligonucleotide; TIM-3 exon 5; Set B
gagaaacaaaaacacuuacauuugaaaauuaaagcgccga

SEQ ID NO: 68349 - RNA, 24 nt, Artificial Sequence
  Synthetic Oligonucleotide; TIM-3 exon 5; Set C
aaaacacuuacauuugaaaauuaa

SEQ ID NO: 68350 - RNA, 26 nt, Artificial Sequence
  Synthetic Oligonucleotide; TIM-3 exon 5; Set C
aaaaacacuuacauuugaaaauuaaa

SEQ ID NO: 68351 - RNA, 25 nt, Artificial Sequence
  Synthetic Oligonucleotide; TIM-3 exon 5; Set C
aaaaacacuuacauuugaaaauuaa

SEQ ID NO: 68352 - RNA, 27 nt, Artificial Sequence
  Synthetic Oligonucleotide; TIM-3 exon 5; Set C
caaaaacacuuacauuugaaaauuaaa

SEQ ID NO: 68353 - RNA, 26 nt, Artificial Sequence
  Synthetic Oligonucleotide; TIM-3 exon 5; Set C
caaaaacacuuacauuugaaaauuaa

SEQ ID NO: 68354 - RNA, 28 nt, Artificial Sequence
  Synthetic Oligonucleotide; TIM-3 exon 5; Set C
acaaaaacacuuacauuugaaaauuaaa

SEQ ID NO: 68355 - RNA, 22 nt, Artificial Sequence
  Synthetic Oligonucleotide; TIM-3 exon 5; Set C
aaaacacuuacauuugaaaauu

SEQ ID NO: 68356 - RNA, 23 nt, Artificial Sequence
  Synthetic Oligonucleotide; TIM-3 exon 5; Set C
aaaaacacuuacauuugaaaauu

SEQ ID NO: 68357 - RNA, 24 nt, Artificial Sequence
  Synthetic Oligonucleotide; TIM-3 exon 5; Set C
caaaaacacuuacauuugaaaauu

SEQ ID NO: 68358 - RNA, 29 nt, Artificial Sequence
  Synthetic Oligonucleotide; TIM-3 exon 5; Set C
aaacaaaaacacuuacauuugaaaauuaa

SEQ ID NO: 68359 - RNA, 31 nt, Artificial Sequence
  Synthetic Oligonucleotide; TIM-3 exon 5; Set C
gaaacaaaaacacuuacauuugaaaauuaaa

SEQ ID NO: 68360 - RNA, 25 nt, Artificial Sequence
  Synthetic Oligonucleotide; TIM-3 exon 5; Set C
acaaaaacacuuacauuugaaaauu

SEQ ID NO: 68361 - RNA, 28 nt, Artificial Sequence
  Synthetic Oligonucleotide; TIM-3 exon 5; Set C
aaacaaaaacacuuacauuugaaaauua

SEQ ID NO: 68362 - RNA, 30 nt, Artificial Sequence
  Synthetic Oligonucleotide; TIM-3 exon 5; Set C
gaaacaaaaacacuuacauuugaaaauuaa

SEQ ID NO: 68363 - RNA, 32 nt, Artificial Sequence
  Synthetic Oligonucleotide; TIM-3 exon 5; Set C
agaaacaaaaacacuuacauuugaaaauuaaa

SEQ ID NO: 68364 - RNA, 26 nt, Artificial Sequence
  Synthetic Oligonucleotide; TIM-3 exon 5; Set C
aacaaaaacacuuacauuugaaaauu

SEQ ID NO: 68365 - RNA, 29 nt, Artificial Sequence
  Synthetic Oligonucleotide; TIM-3 exon 5; Set C
gaaacaaaaacacuuacauuugaaaauua

SEQ ID NO: 68366 - RNA, 31 nt, Artificial Sequence
  Synthetic Oligonucleotide; TIM-3 exon 5; Set C
agaaacaaaaacacuuacauuugaaaauuaa

SEQ ID NO: 68367 - RNA, 33 nt, Artificial Sequence
  Synthetic Oligonucleotide; TIM-3 exon 5; Set C
gagaaacaaaaacacuuacauuugaaaauuaaa

SEQ ID NO: 68368 - RNA, 25 nt, Artificial Sequence
  Synthetic Oligonucleotide; TIM-3 exon 5; Set C
aacaaaaacacuuacauuugaaaau

SEQ ID NO: 68369 - RNA, 30 nt, Artificial Sequence
  Synthetic Oligonucleotide; TIM-3 exon 5; Set C
agaaacaaaaacacuuacauuugaaaauua

SEQ ID NO: 68370 - RNA, 16 nt, Artificial Sequence
  Synthetic Oligonucleotide; TIM-3 exon 5; Set C
aaaacacuuacauuug

SEQ ID NO: 68371 - RNA, 32 nt, Artificial Sequence
  Synthetic Oligonucleotide; TIM-3 exon 5; Set C
gagaaacaaaaacacuuacauuugaaaauuaa

SEQ ID NO: 68372 - RNA, 34 nt, Artificial Sequence
  Synthetic Oligonucleotide; TIM-3 exon 5; Set C
agagaaacaaaaacacuuacauuugaaaauuaaa

SEQ ID NO: 68373 - RNA, 31 nt, Artificial Sequence
  Synthetic Oligonucleotide; TIM-3 exon 5; Set C
gagaaacaaaaacacuuacauuugaaaauua

SEQ ID NO: 68374 - RNA, 17 nt, Artificial Sequence
  Synthetic Oligonucleotide; TIM-3 exon 5; Set C
aaaaacacuuacauuug

SEQ ID NO: 68375 - RNA, 15 nt, Artificial Sequence
  Synthetic Oligonucleotide; TIM-3 exon 5; Set C
aaaacacuuacauuu

SEQ ID NO: 68376 - RNA, 23 nt, Artificial Sequence
  Synthetic Oligonucleotide; TIM-3 exon 5; Set C
aacaaaaacacuuacauuugaaa

SEQ ID NO: 68377 - RNA, 16 nt, Artificial Sequence
  Synthetic Oligonucleotide; TIM-3 exon 5; Set C
aaaaacacuuacauuu

SEQ ID NO: 68378 - RNA, 33 nt, Artificial Sequence
  Synthetic Oligonucleotide; TIM-3 exon 5; Set C
gagagaaacaaaaacacuuacauuugaaaauua

SEQ ID NO: 68379 - RNA, 17 nt, Artificial Sequence
  Synthetic Oligonucleotide; TIM-3 exon 5; Set C
caaaaacacuuacauuu

SEQ ID NO: 68380 - RNA, 31 nt, Artificial Sequence
  Synthetic Oligonucleotide; TIM-3 exon 5; Set C
agagaaacaaaaacacuuacauuugaaaauu

SEQ ID NO: 68381 - RNA, 34 nt, Artificial Sequence
  Synthetic Oligonucleotide; TIM-3 exon 5; Set C
agagagaaacaaaaacacuuacauuugaaaauua

SEQ ID NO: 68382 - RNA, 35 nt, Artificial Sequence
  Synthetic Oligonucleotide; TIM-3 exon 5; Set C
gagagagaaacaaaaacacuuacauuugaaaauua

SEQ ID NO: 68383 - RNA, 21 nt, Artificial Sequence
  Synthetic Oligonucleotide; TIM-3 exon 5; Set C
aaacaaaaacacuuacauuug

SEQ ID NO: 68384 - RNA, 22 nt, Artificial Sequence
  Synthetic Oligonucleotide; TIM-3 exon 5; Set C
gaaacaaaaacacuuacauuug

SEQ ID NO: 68385 - RNA, 20 nt, Artificial Sequence
  Synthetic Oligonucleotide; TIM-3 exon 5; Set C
aaacaaaaacacuuacauuu

SEQ ID NO: 68386 - RNA, 28 nt, Artificial Sequence
  Synthetic Oligonucleotide; TIM-3 exon 5; Set C
agagaaacaaaaacacuuacauuugaaa

SEQ ID NO: 68387 - RNA, 23 nt, Artificial Sequence
  Synthetic Oligonucleotide; TIM-3 exon 5; Set C
agaaacaaaaacacuuacauuug

SEQ ID NO: 68388 - RNA, 21 nt, Artificial Sequence
  Synthetic Oligonucleotide; TIM-3 exon 5; Set C
gaaacaaaaacacuuacauuu

SEQ ID NO: 68389 - RNA, 35 nt, Artificial Sequence
  Synthetic Oligonucleotide; TIM-3 exon 5; Set C
ggagagagaaacaaaaacacuuacauuugaaaauu

SEQ ID NO: 68390 - RNA, 28 nt, Artificial Sequence
  Synthetic Oligonucleotide; TIM-3 exon 5; Set C
gagagaaacaaaaacacuuacauuugaa

SEQ ID NO: 68391 - RNA, 24 nt, Artificial Sequence
  Synthetic Oligonucleotide; TIM-3 exon 5; Set C
gagaaacaaaaacacuuacauuug

SEQ ID NO: 68392 - RNA, 22 nt, Artificial Sequence
  Synthetic Oligonucleotide; TIM-3 exon 5; Set C
agaaacaaaaacacuuacauuu

SEQ ID NO: 68393 - RNA, 40 nt, Artificial Sequence
  Synthetic Oligonucleotide; TIM-3 exon 5; Set B
gagggagagagaaacaaaaacacuuacauuugaaaauuaa

SEQ ID NO: 68394 - RNA, 36 nt, Artificial Sequence
  Synthetic Oligonucleotide; TIM-3 exon 5; Set C
gggagagagaaacaaaaacacuuacauuugaaaauu

SEQ ID NO: 68395 - RNA, 34 nt, Artificial Sequence
  Synthetic Oligonucleotide; TIM-3 exon 5; Set C
ggagagagaaacaaaaacacuuacauuugaaaau

SEQ ID NO: 68396 - RNA, 27 nt, Artificial Sequence
  Synthetic Oligonucleotide; TIM-3 exon 5; Set C
gagagaaacaaaaacacuuacauuuga

SEQ ID NO: 68397 - RNA, 29 nt, Artificial Sequence
  Synthetic Oligonucleotide; TIM-3 exon 5; Set C
agagagaaacaaaaacacuuacauuugaa

SEQ ID NO: 68398 - RNA, 39 nt, Artificial Sequence
  Synthetic Oligonucleotide; TIM-3 exon 5; Set B
gagggagagagaaacaaaaacacuuacauuugaaaauua

SEQ ID NO: 68399 - RNA, 23 nt, Artificial Sequence
  Synthetic Oligonucleotide; TIM-3 exon 5; Set C
gagaaacaaaaacacuuacauuu

SEQ ID NO: 68400 - RNA, 35 nt, Artificial Sequence
  Synthetic Oligonucleotide; TIM-3 exon 5; Set C
gggagagagaaacaaaaacacuuacauuugaaaau

SEQ ID NO: 68401 - RNA, 33 nt, Artificial Sequence
  Synthetic Oligonucleotide; TIM-3 exon 5; Set C
ggagagagaaacaaaaacacuuacauuugaaaa

SEQ ID NO: 68402 - RNA, 28 nt, Artificial Sequence
  Synthetic Oligonucleotide; TIM-3 exon 5; Set C
agagagaaacaaaaacacuuacauuuga

SEQ ID NO: 68403 - RNA, 30 nt, Artificial Sequence
  Synthetic Oligonucleotide; TIM-3 exon 5; Set C
gagagagaaacaaaaacacuuacauuugaa

SEQ ID NO: 68404 - RNA, 40 nt, Artificial Sequence
  Synthetic Oligonucleotide; TIM-3 exon 5; Set B
agagggagagagaaacaaaaacacuuacauuugaaaauua

SEQ ID NO: 68405 - RNA, 26 nt, Artificial Sequence
  Synthetic Oligonucleotide; TIM-3 exon 5; Set C
gagagaaacaaaaacacuuacauuug

SEQ ID NO: 68406 - RNA, 32 nt, Artificial Sequence
  Synthetic Oligonucleotide; TIM-3 exon 5; Set C
ggagagagaaacaaaaacacuuacauuugaaa

SEQ ID NO: 68407 - RNA, 36 nt, Artificial Sequence
  Synthetic Oligonucleotide; TIM-3 exon 5; Set C
agggagagagaaacaaaaacacuuacauuugaaaau

SEQ ID NO: 68408 - RNA, 34 nt, Artificial Sequence
  Synthetic Oligonucleotide; TIM-3 exon 5; Set C
gggagagagaaacaaaaacacuuacauuugaaaa

SEQ ID NO: 68409 - RNA, 29 nt, Artificial Sequence
  Synthetic Oligonucleotide; TIM-3 exon 5; Set C
gagagagaaacaaaaacacuuacauuuga

SEQ ID NO: 68410 - RNA, 27 nt, Artificial Sequence
  Synthetic Oligonucleotide; TIM-3 exon 5; Set C
agagagaaacaaaaacacuuacauuug

SEQ ID NO: 68411 - RNA, 33 nt, Artificial Sequence
  Synthetic Oligonucleotide; TIM-3 exon 5; Set C
gggagagagaaacaaaaacacuuacauuugaaa

SEQ ID NO: 68412 - RNA, 35 nt, Artificial Sequence
  Synthetic Oligonucleotide; TIM-3 exon 5; Set C
agggagagagaaacaaaaacacuuacauuugaaaa

SEQ ID NO: 68413 - RNA, 28 nt, Artificial Sequence
  Synthetic Oligonucleotide; TIM-3 exon 5; Set C
gagagagaaacaaaaacacuuacauuug

SEQ ID NO: 68414 - RNA, 34 nt, Artificial Sequence
  Synthetic Oligonucleotide; TIM-3 exon 5; Set C
agggagagagaaacaaaaacacuuacauuugaaa

SEQ ID NO: 68415 - RNA, 27 nt, Artificial Sequence
  Synthetic Oligonucleotide; TIM-3 exon 5; Set C
ggagagagaaacaaaaacacuuacauu

SEQ ID NO: 68416 - RNA, 32 nt, Artificial Sequence
  Synthetic Oligonucleotide; TIM-3 exon 5; Set C
gagggagagagaaacaaaaacacuuacauuug

SEQ ID NO: 68417 - RNA, 28 nt, Artificial Sequence
  Synthetic Oligonucleotide; TIM-3 exon 5; Set C
gggagagagaaacaaaaacacuuacauu

SEQ ID NO: 68418 - RNA, 26 nt, Artificial Sequence
  Synthetic Oligonucleotide; TIM-3 exon 5; Set C
ggagagagaaacaaaaacacuuacau

SEQ ID NO: 68419 - RNA, 33 nt, Artificial Sequence
  Synthetic Oligonucleotide; TIM-3 exon 5; Set B
agagggagagagaaacaaaaacacuuacauuug

SEQ ID NO: 68420 - RNA, 31 nt, Artificial Sequence
  Synthetic Oligonucleotide; TIM-3 exon 5; Set C
gagggagagagaaacaaaaacacuuacauuu

SEQ ID NO: 68421 - RNA, 25 nt, Artificial Sequence
  Synthetic Oligonucleotide; TIM-3 exon 5; Set C
ggagagagaaacaaaaacacuuaca

SEQ ID NO: 68422 - RNA, 29 nt, Artificial Sequence
  Synthetic Oligonucleotide; TIM-3 exon 5; Set C
agggagagagaaacaaaaacacuuacauu

SEQ ID NO: 68423 - RNA, 27 nt, Artificial Sequence
  Synthetic Oligonucleotide; TIM-3 exon 5; Set C
gggagagagaaacaaaaacacuuacau

SEQ ID NO: 68424 - RNA, 32 nt, Artificial Sequence
  Synthetic Oligonucleotide; TIM-3 exon 5; Set C
agagggagagagaaacaaaaacacuuacauuu

SEQ ID NO: 68425 - RNA, 26 nt, Artificial Sequence
  Synthetic Oligonucleotide; TIM-3 exon 5; Set C
gggagagagaaacaaaaacacuuaca

SEQ ID NO: 68426 - RNA, 28 nt, Artificial Sequence
  Synthetic Oligonucleotide; TIM-3 exon 5; Set C
agggagagagaaacaaaaacacuuacau

SEQ ID NO: 68427 - RNA, 27 nt, Artificial Sequence
  Synthetic Oligonucleotide; TIM-3 exon 5; Set C
agggagagagaaacaaaaacacuuaca

SEQ ID NO: 68428 - RNA, 36 nt, Artificial Sequence
  Synthetic Oligonucleotide; TIM-3 exon 5; Set B
uuaucagagggagagagaaacaaaaacacuuacauu

SEQ ID NO: 68429 - RNA, 37 nt, Artificial Sequence
  Synthetic Oligonucleotide; TIM-3 exon 5; Set B
guuaucagagggagagagaaacaaaaacacuuacauu

SEQ ID NO: 68430 - RNA, 35 nt, Artificial Sequence
  Synthetic Oligonucleotide; TIM-3 exon 5; Set B
uuaucagagggagagagaaacaaaaacacuuacau

SEQ ID NO: 68431 - RNA, 34 nt, Artificial Sequence
  Synthetic Oligonucleotide; TIM-3 exon 5; Set B
uuaucagagggagagagaaacaaaaacacuuaca

SEQ ID NO: 68432 - RNA, 38 nt, Artificial Sequence
  Synthetic Oligonucleotide; TIM-3 exon 5; Set B
uguuaucagagggagagagaaacaaaaacacuuacauu

SEQ ID NO: 68433 - RNA, 36 nt, Artificial Sequence
  Synthetic Oligonucleotide; TIM-3 exon 5; Set B
guuaucagagggagagagaaacaaaaacacuuacau

SEQ ID NO: 68434 - RNA, 35 nt, Artificial Sequence
  Synthetic Oligonucleotide; TIM-3 exon 5; Set B
guuaucagagggagagagaaacaaaaacacuuaca

SEQ ID NO: 68435 - RNA, 39 nt, Artificial Sequence
  Synthetic Oligonucleotide; TIM-3 exon 5; Set B
uuguuaucagagggagagagaaacaaaaacacuuacauu

SEQ ID NO: 68436 - RNA, 37 nt, Artificial Sequence
  Synthetic Oligonucleotide; TIM-3 exon 5; Set B
uguuaucagagggagagagaaacaaaaacacuuacau

SEQ ID NO: 68437 - RNA, 36 nt, Artificial Sequence
  Synthetic Oligonucleotide; TIM-3 exon 5; Set B
uguuaucagagggagagagaaacaaaaacacuuaca

SEQ ID NO: 68438 - RNA, 40 nt, Artificial Sequence
  Synthetic Oligonucleotide; TIM-3 exon 5; Set B
uuuguuaucagagggagagagaaacaaaaacacuuacauu

SEQ ID NO: 68439 - RNA, 38 nt, Artificial Sequence
  Synthetic Oligonucleotide; TIM-3 exon 5; Set B
uuguuaucagagggagagagaaacaaaaacacuuacau

SEQ ID NO: 68440 - RNA, 37 nt, Artificial Sequence
  Synthetic Oligonucleotide; TIM-3 exon 5; Set B
uuguuaucagagggagagagaaacaaaaacacuuaca

SEQ ID NO: 68441 - RNA, 39 nt, Artificial Sequence
  Synthetic Oligonucleotide; TIM-3 exon 5; Set B
uuuguuaucagagggagagagaaacaaaaacacuuacau

SEQ ID NO: 68442 - RNA, 38 nt, Artificial Sequence
  Synthetic Oligonucleotide; TIM-3 exon 5; Set B
uuuguuaucagagggagagagaaacaaaaacacuuaca

SEQ ID NO: 68443 - RNA, 40 nt, Artificial Sequence
  Synthetic Oligonucleotide; TIM-3 exon 5; Set B
auuuguuaucagagggagagagaaacaaaaacacuuacau

SEQ ID NO: 68444 - RNA, 39 nt, Artificial Sequence
  Synthetic Oligonucleotide; TIM-3 exon 5; Set B
auuuguuaucagagggagagagaaacaaaaacacuuaca

SEQ ID NO: 68445 - RNA, 40 nt, Artificial Sequence
  Synthetic Oligonucleotide; TIM-3 exon 5; Set B
aauuuguuaucagagggagagagaaacaaaaacacuuaca

SEQ ID NO: 68446 - RNA, 15 nt, Artificial Sequence
  Synthetic Oligonucleotide; TIM-3 exon 5; Set C
agagggagagagaaa

SEQ ID NO: 68447 - RNA, 32 nt, Artificial Sequence
  Synthetic Oligonucleotide; TIM-3 exon 5; Set B
cugaagaauuuguuaucagagggagagagaaa

SEQ ID NO: 68448 - RNA, 31 nt, Artificial Sequence
  Synthetic Oligonucleotide; TIM-3 exon 5; Set B
cugaagaauuuguuaucagagggagagagaa

SEQ ID NO: 68449 - RNA, 33 nt, Artificial Sequence
  Synthetic Oligonucleotide; TIM-3 exon 5; Set B
acugaagaauuuguuaucagagggagagagaaa

SEQ ID NO: 68450 - RNA, 32 nt, Artificial Sequence
  Synthetic Oligonucleotide; TIM-3 exon 5; Set B
acugaagaauuuguuaucagagggagagagaa

SEQ ID NO: 68451 - RNA, 30 nt, Artificial Sequence
  Synthetic Oligonucleotide; TIM-3 exon 5; Set B
cugaagaauuuguuaucagagggagagaga

SEQ ID NO: 68452 - RNA, 29 nt, Artificial Sequence
  Synthetic Oligonucleotide; TIM-3 exon 5; Set C
cugaagaauuuguuaucagagggagagag

SEQ ID NO: 68453 - RNA, 31 nt, Artificial Sequence
  Synthetic Oligonucleotide; TIM-3 exon 5; Set B
acugaagaauuuguuaucagagggagagaga

SEQ ID NO: 68454 - RNA, 30 nt, Artificial Sequence
  Synthetic Oligonucleotide; TIM-3 exon 5; Set B
acugaagaauuuguuaucagagggagagag

SEQ ID NO: 68455 - RNA, 26 nt, Artificial Sequence
  Synthetic Oligonucleotide; TIM-3 exon 5; Set C
ugaagaauuuguuaucagagggagag

SEQ ID NO: 68456 - RNA, 27 nt, Artificial Sequence
  Synthetic Oligonucleotide; TIM-3 exon 5; Set C
cugaagaauuuguuaucagagggagag

SEQ ID NO: 68457 - RNA, 25 nt, Artificial Sequence
  Synthetic Oligonucleotide; TIM-3 exon 5; Set C
ugaagaauuuguuaucagagggaga

SEQ ID NO: 68458 - RNA, 28 nt, Artificial Sequence
  Synthetic Oligonucleotide; TIM-3 exon 5; Set C
acugaagaauuuguuaucagagggagag

SEQ ID NO: 68459 - RNA, 26 nt, Artificial Sequence
  Synthetic Oligonucleotide; TIM-3 exon 5; Set C
cugaagaauuuguuaucagagggaga

SEQ ID NO: 68460 - RNA, 24 nt, Artificial Sequence
  Synthetic Oligonucleotide; TIM-3 exon 5; Set C
ugaagaauuuguuaucagagggag

SEQ ID NO: 68461 - RNA, 25 nt, Artificial Sequence
  Synthetic Oligonucleotide; TIM-3 exon 5; Set C
cugaagaauuuguuaucagagggag

SEQ ID NO: 68462 - RNA, 21 nt, Artificial Sequence
  Synthetic Oligonucleotide; TIM-3 exon 5; Set C
cugaagaauuuguuaucagag

SEQ ID NO: 68463 - RNA, 22 nt, Artificial Sequence
  Synthetic Oligonucleotide; TIM-3 exon 5; Set C
acugaagaauuuguuaucagag

SEQ ID NO: 68464 - RNA, 20 nt, Artificial Sequence
  Synthetic Oligonucleotide; TIM-3 exon 5; Set C
cugaagaauuuguuaucaga

SEQ ID NO: 68465 - RNA, 21 nt, Artificial Sequence
  Synthetic Oligonucleotide; TIM-3 exon 5; Set C
acugaagaauuuguuaucaga

SEQ ID NO: 68466 - RNA, 15 nt, Artificial Sequence
  Synthetic Oligonucleotide; TIM-3 exon 5; Set C
agaaaacagcuagaa

SEQ ID NO: 68467 - RNA, 30 nt, Artificial Sequence
  Synthetic Oligonucleotide; TIM-3 exon 5; Set C
gaaacacaaacaggauuuaagcagaaaaca

SEQ ID NO: 68468 - RNA, 29 nt, Artificial Sequence
  Synthetic Oligonucleotide; TIM-3 exon 5; Set C
gaaacacaaacaggauuuaagcagaaaac

SEQ ID NO: 68469 - RNA, 28 nt, Artificial Sequence
  Synthetic Oligonucleotide; TIM-3 exon 5; Set C
gaaacacaaacaggauuuaagcagaaaa

SEQ ID NO: 68470 - RNA, 29 nt, Artificial Sequence
  Synthetic Oligonucleotide; TIM-3 exon 5; Set C
ggaaacacaaacaggauuuaagcagaaaa

SEQ ID NO: 68471 - RNA, 27 nt, Artificial Sequence
  Synthetic Oligonucleotide; TIM-3 exon 5; Set C
gaaacacaaacaggauuuaagcagaaa

SEQ ID NO: 68472 - RNA, 28 nt, Artificial Sequence
  Synthetic Oligonucleotide; TIM-3 exon 5; Set C
ggaaacacaaacaggauuuaagcagaaa

SEQ ID NO: 68473 - RNA, 26 nt, Artificial Sequence
  Synthetic Oligonucleotide; TIM-3 exon 5; Set C
gaaacacaaacaggauuuaagcagaa

SEQ ID NO: 68474 - RNA, 31 nt, Artificial Sequence
  Synthetic Oligonucleotide; TIM-3 exon 5; Set C
auggaaacacaaacaggauuuaagcagaaaa

SEQ ID NO: 68475 - RNA, 29 nt, Artificial Sequence
  Synthetic Oligonucleotide; TIM-3 exon 5; Set C
uggaaacacaaacaggauuuaagcagaaa

SEQ ID NO: 68476 - RNA, 27 nt, Artificial Sequence
  Synthetic Oligonucleotide; TIM-3 exon 5; Set C
ggaaacacaaacaggauuuaagcagaa

SEQ ID NO: 68477 - RNA, 25 nt, Artificial Sequence
  Synthetic Oligonucleotide; TIM-3 exon 5; Set C
gaaacacaaacaggauuuaagcaga

SEQ ID NO: 68478 - RNA, 28 nt, Artificial Sequence
  Synthetic Oligonucleotide; TIM-3 exon 5; Set C
uggaaacacaaacaggauuuaagcagaa

SEQ ID NO: 68479 - RNA, 30 nt, Artificial Sequence
  Synthetic Oligonucleotide; TIM-3 exon 5; Set C
auggaaacacaaacaggauuuaagcagaaa

SEQ ID NO: 68480 - RNA, 26 nt, Artificial Sequence
  Synthetic Oligonucleotide; TIM-3 exon 5; Set C
ggaaacacaaacaggauuuaagcaga

SEQ ID NO: 68481 - RNA, 29 nt, Artificial Sequence
  Synthetic Oligonucleotide; TIM-3 exon 5; Set C
auggaaacacaaacaggauuuaagcagaa

SEQ ID NO: 68482 - RNA, 27 nt, Artificial Sequence
  Synthetic Oligonucleotide; TIM-3 exon 5; Set C
uggaaacacaaacaggauuuaagcaga

SEQ ID NO: 68483 - RNA, 28 nt, Artificial Sequence
  Synthetic Oligonucleotide; TIM-3 exon 5; Set C
auggaaacacaaacaggauuuaagcaga

SEQ ID NO: 68484 - RNA, 37 nt, Artificial Sequence
  Synthetic Oligonucleotide; TIM-3 exon 5; Set C
ccguaacucauuggccaauguggauauuugcuaugga

SEQ ID NO: 68485 - RNA, 27 nt, Artificial Sequence
  Synthetic Oligonucleotide; TIM-3 exon 5; Set A
gagucccguaagucauuggccaaucua

SEQ ID NO: 68486 - RNA, 33 nt, Artificial Sequence
  Synthetic Oligonucleotide; TIM-3 exon 5; Set C
gcuccagagucccguaagucauuggccaaucua

SEQ ID NO: 68487 - RNA, 34 nt, Artificial Sequence
  Synthetic Oligonucleotide; TIM-3 exon 5; Set C
ugcuccagagucccguaagucauuggccaaucua

SEQ ID NO: 68488 - RNA, 35 nt, Artificial Sequence
  Synthetic Oligonucleotide; TIM-3 exon 5; Set C
uugcuccagagucccguaagucauuggccaaucua

SEQ ID NO: 68489 - RNA, 21 nt, Artificial Sequence
  Synthetic Oligonucleotide; TIM-3 exon 5; Set A
augguugcuccagagucccgu

SEQ ID NO: 68490 - RNA, 20 nt, Artificial Sequence
  Synthetic Oligonucleotide; TIM-3 exon 5; Set A
augguugcuccagagucccg

SEQ ID NO: 68491 - RNA, 34 nt, Artificial Sequence
  Synthetic Oligonucleotide; TIM-3 exon 5; Set C
ccuauucugaugguugcuccagagucccguaagu

SEQ ID NO: 68492 - RNA, 16 nt, Artificial Sequence
  Synthetic Oligonucleotide; TIM-3 exon 5; Set C
augguugcuccagagu

SEQ ID NO: 68493 - RNA, 33 nt, Artificial Sequence
  Synthetic Oligonucleotide; TIM-3 exon 5; Set C
ccuauucugaugguugcuccagagucccguaag

SEQ ID NO: 68494 - RNA, 35 nt, Artificial Sequence
  Synthetic Oligonucleotide; TIM-3 exon 5; Set C
gccuauucugaugguugcuccagagucccguaagu

SEQ ID NO: 68495 - RNA, 36 nt, Artificial Sequence
  Synthetic Oligonucleotide; TIM-3 exon 5; Set C
ugccuauucugaugguugcuccagagucccguaagu

SEQ ID NO: 68496 - RNA, 34 nt, Artificial Sequence
  Synthetic Oligonucleotide; TIM-3 exon 5; Set C
gccuauucugaugguugcuccagagucccguaag

SEQ ID NO: 68497 - RNA, 32 nt, Artificial Sequence
  Synthetic Oligonucleotide; TIM-3 exon 5; Set C
ccuauucugaugguugcuccagagucccguaa

SEQ ID NO: 68498 - RNA, 35 nt, Artificial Sequence
  Synthetic Oligonucleotide; TIM-3 exon 5; Set C
ugccuauucugaugguugcuccagagucccguaag

SEQ ID NO: 68499 - RNA, 33 nt, Artificial Sequence
  Synthetic Oligonucleotide; TIM-3 exon 5; Set C
gccuauucugaugguugcuccagagucccguaa

SEQ ID NO: 68500 - RNA, 31 nt, Artificial Sequence
  Synthetic Oligonucleotide; TIM-3 exon 5; Set C
ccuauucugaugguugcuccagagucccgua

SEQ ID NO: 68501 - RNA, 34 nt, Artificial Sequence
  Synthetic Oligonucleotide; TIM-3 exon 5; Set C
ugccuauucugaugguugcuccagagucccguaa

SEQ ID NO: 68502 - RNA, 33 nt, Artificial Sequence
  Synthetic Oligonucleotide; TIM-3 exon 5; Set C
ugccuauucugaugguugcuccagagucccgua

SEQ ID NO: 68503 - RNA, 34 nt, Artificial Sequence
  Synthetic Oligonucleotide; TIM-3 exon 5; Set C
augccuauucugaugguugcuccagagucccgua

SEQ ID NO: 68504 - RNA, 33 nt, Artificial Sequence
  Synthetic Oligonucleotide; TIM-3 exon 5; Set C
augccuauucugaugguugcuccagagucccgu

SEQ ID NO: 68505 - RNA, 17 nt, Artificial Sequence
  Synthetic Oligonucleotide; TIM-3 exon 5; Set C
ucugaugguugcuccag

SEQ ID NO: 68506 - RNA, 18 nt, Artificial Sequence
  Synthetic Oligonucleotide; TIM-3 exon 5; Set C
uucugaugguugcuccag

SEQ ID NO: 68507 - RNA, 19 nt, Artificial Sequence
  Synthetic Oligonucleotide; TIM-3 exon 5; Set C
auucugaugguugcuccag

SEQ ID NO: 68508 - RNA, 24 nt, Artificial Sequence
  Synthetic Oligonucleotide; TIM-3 exon 5; Set A
ccuauucugaugguugcuccagag

SEQ ID NO: 68509 - RNA, 25 nt, Artificial Sequence
  Synthetic Oligonucleotide; TIM-3 exon 5; Set A
gccuauucugaugguugcuccagag

SEQ ID NO: 68510 - RNA, 21 nt, Artificial Sequence
  Synthetic Oligonucleotide; TIM-3 exon 5; Set C
cuauucugaugguugcuccag

SEQ ID NO: 68511 - RNA, 26 nt, Artificial Sequence
  Synthetic Oligonucleotide; TIM-3 exon 5; Set A
ugccuauucugaugguugcuccagag

SEQ ID NO: 68512 - RNA, 27 nt, Artificial Sequence
  Synthetic Oligonucleotide; TIM-3 exon 5; Set A
augccuauucugaugguugcuccagag

SEQ ID NO: 68513 - RNA, 18 nt, Artificial Sequence
  Synthetic Oligonucleotide; TIM-3 exon 5; Set C
ccuauucugaugguugcu

SEQ ID NO: 68514 - RNA, 17 nt, Artificial Sequence
  Synthetic Oligonucleotide; TIM-3 exon 5; Set C
ccuauucugaugguugc

SEQ ID NO: 68515 - RNA, 19 nt, Artificial Sequence
  Synthetic Oligonucleotide; TIM-3 exon 5; Set C
gccuauucugaugguugcu

SEQ ID NO: 68516 - RNA, 16 nt, Artificial Sequence
  Synthetic Oligonucleotide; TIM-3 exon 5; Set C
ccuauucugaugguug

SEQ ID NO: 68517 - RNA, 18 nt, Artificial Sequence
  Synthetic Oligonucleotide; TIM-3 exon 5; Set C
gccuauucugaugguugc

SEQ ID NO: 68518 - RNA, 20 nt, Artificial Sequence
  Synthetic Oligonucleotide; TIM-3 exon 5; Set C
ugccuauucugaugguugcu

SEQ ID NO: 68519 - RNA, 15 nt, Artificial Sequence
  Synthetic Oligonucleotide; TIM-3 exon 5; Set C
ccuauucugaugguu

SEQ ID NO: 68520 - RNA, 17 nt, Artificial Sequence
  Synthetic Oligonucleotide; TIM-3 exon 5; Set C
gccuauucugaugguug

SEQ ID NO: 68521 - RNA, 19 nt, Artificial Sequence
  Synthetic Oligonucleotide; TIM-3 exon 5; Set C
ugccuauucugaugguugc

SEQ ID NO: 68522 - RNA, 21 nt, Artificial Sequence
  Synthetic Oligonucleotide; TIM-3 exon 5; Set C
augccuauucugaugguugcu

SEQ ID NO: 68523 - RNA, 16 nt, Artificial Sequence
  Synthetic Oligonucleotide; TIM-3 exon 5; Set C
gccuauucugaugguu

SEQ ID NO: 68524 - RNA, 18 nt, Artificial Sequence
  Synthetic Oligonucleotide; TIM-3 exon 5; Set C
ugccuauucugaugguug

SEQ ID NO: 68525 - RNA, 17 nt, Artificial Sequence
  Synthetic Oligonucleotide; TIM-3 exon 5; Set C
ugccuauucugaugguu

SEQ ID NO: 68526 - RNA, 15 nt, Artificial Sequence
  Synthetic Oligonucleotide; TIM-3 exon 5; Set C
gccuauucugauggu

SEQ ID NO: 68527 - RNA, 16 nt, Artificial Sequence
  Synthetic Oligonucleotide; TIM-3 exon 5; Set C
ugccuauucugauggu

SEQ ID NO: 68528 - RNA, 17 nt, Artificial Sequence
  Synthetic Oligonucleotide; TIM-3 exon 5; Set C
augccuauucugauggu

SEQ ID NO: 68529 - RNA, 15 nt, Artificial Sequence
  Synthetic Oligonucleotide; TIM-3 exon 5; Set C
ugccuauucugaugg

SEQ ID NO: 68530 - RNA, 16 nt, Artificial Sequence
  Synthetic Oligonucleotide; TIM-3 exon 5; Set C
augccuauucugaugg

SEQ ID NO: 68531 - RNA, 35 nt, Artificial Sequence
  Synthetic Oligonucleotide; TIM-3 exon 5; Set C
uccgauguagaugccuauucugaugguugcuccag

SEQ ID NO: 68532 - RNA, 40 nt, Artificial Sequence
  Synthetic Oligonucleotide; TIM-3 exon 5; Set C
ccugcuccgauguagaugccuauucugaugguugcuccag

SEQ ID NO: 68533 - RNA, 33 nt, Artificial Sequence
  Synthetic Oligonucleotide; TIM-3 exon 5; Set C
cugcuccgauguagaugccuauucugaugguug

SEQ ID NO: 68534 - RNA, 32 nt, Artificial Sequence
  Synthetic Oligonucleotide; TIM-3 exon 5; Set C
cugcuccgauguagaugccuauucugaugguu

SEQ ID NO: 68535 - RNA, 40 nt, Artificial Sequence
  Synthetic Oligonucleotide; TIM-3 exon 5; Set C
agaucccugcuccgauguagaugccuauucugaugguugc

SEQ ID NO: 68536 - RNA, 30 nt, Artificial Sequence
  Synthetic Oligonucleotide; TIM-3 exon 5; Set C
ccugcuccgauguagaugccuauucugaug

SEQ ID NO: 68537 - RNA, 39 nt, Artificial Sequence
  Synthetic Oligonucleotide; TIM-3 exon 5; Set C
agaucccugcuccgauguagaugccuauucugaugguug

SEQ ID NO: 68538 - RNA, 31 nt, Artificial Sequence
  Synthetic Oligonucleotide; TIM-3 exon 5; Set C
cccugcuccgauguagaugccuauucugaug

SEQ ID NO: 68539 - RNA, 38 nt, Artificial Sequence
  Synthetic Oligonucleotide; TIM-3 exon 5; Set C
agaucccugcuccgauguagaugccuauucugaugguu

SEQ ID NO: 68540 - RNA, 40 nt, Artificial Sequence
  Synthetic Oligonucleotide; TIM-3 exon 5; Set C
cagaucccugcuccgauguagaugccuauucugaugguug

SEQ ID NO: 68541 - RNA, 39 nt, Artificial Sequence
  Synthetic Oligonucleotide; TIM-3 exon 5; Set C
cagaucccugcuccgauguagaugccuauucugaugguu

SEQ ID NO: 68542 - RNA, 37 nt, Artificial Sequence
  Synthetic Oligonucleotide; TIM-3 exon 5; Set C
agaucccugcuccgauguagaugccuauucugauggu

SEQ ID NO: 68543 - RNA, 15 nt, Artificial Sequence
  Synthetic Oligonucleotide; TIM-3 exon 5; Set C
ccgauguagaugccu

SEQ ID NO: 68544 - RNA, 40 nt, Artificial Sequence
  Synthetic Oligonucleotide; TIM-3 exon 5; Set C
acagaucccugcuccgauguagaugccuauucugaugguu

SEQ ID NO: 68545 - RNA, 38 nt, Artificial Sequence
  Synthetic Oligonucleotide; TIM-3 exon 5; Set C
cagaucccugcuccgauguagaugccuauucugauggu

SEQ ID NO: 68546 - RNA, 36 nt, Artificial Sequence
  Synthetic Oligonucleotide; TIM-3 exon 5; Set C
agaucccugcuccgauguagaugccuauucugaugg

SEQ ID NO: 68547 - RNA, 16 nt, Artificial Sequence
  Synthetic Oligonucleotide; TIM-3 exon 5; Set C
uccgauguagaugccu

SEQ ID NO: 68548 - RNA, 39 nt, Artificial Sequence
  Synthetic Oligonucleotide; TIM-3 exon 5; Set C
acagaucccugcuccgauguagaugccuauucugauggu

SEQ ID NO: 68549 - RNA, 37 nt, Artificial Sequence
  Synthetic Oligonucleotide; TIM-3 exon 5; Set C
cagaucccugcuccgauguagaugccuauucugaugg

SEQ ID NO: 68550 - RNA, 15 nt, Artificial Sequence
  Synthetic Oligonucleotide; TIM-3 exon 5; Set C
uccgauguagaugcc

SEQ ID NO: 68551 - RNA, 40 nt, Artificial Sequence
  Synthetic Oligonucleotide; TIM-3 exon 5; Set C
cacagaucccugcuccgauguagaugccuauucugauggu

SEQ ID NO: 68552 - RNA, 38 nt, Artificial Sequence
  Synthetic Oligonucleotide; TIM-3 exon 5; Set C
acagaucccugcuccgauguagaugccuauucugaugg

SEQ ID NO: 68553 - RNA, 39 nt, Artificial Sequence
  Synthetic Oligonucleotide; TIM-3 exon 5; Set C
cacagaucccugcuccgauguagaugccuauucugaugg

SEQ ID NO: 68554 - RNA, 31 nt, Artificial Sequence
  Synthetic Oligonucleotide; TIM-3 exon 5; Set C
agaucccugcuccgauguagaugccuauucu

SEQ ID NO: 68555 - RNA, 32 nt, Artificial Sequence
  Synthetic Oligonucleotide; TIM-3 exon 5; Set C
cagaucccugcuccgauguagaugccuauucu

SEQ ID NO: 68556 - RNA, 30 nt, Artificial Sequence
  Synthetic Oligonucleotide; TIM-3 exon 5; Set C
agaucccugcuccgauguagaugccuauuc

SEQ ID NO: 68557 - RNA, 22 nt, Artificial Sequence
  Synthetic Oligonucleotide; TIM-3 exon 5; Set A
cccugcuccgauguagaugccu

SEQ ID NO: 68558 - RNA, 29 nt, Artificial Sequence
  Synthetic Oligonucleotide; TIM-3 exon 5; Set C
agaucccugcuccgauguagaugccuauu

SEQ ID NO: 68559 - RNA, 33 nt, Artificial Sequence
  Synthetic Oligonucleotide; TIM-3 exon 5; Set C
acagaucccugcuccgauguagaugccuauucu

SEQ ID NO: 68560 - RNA, 31 nt, Artificial Sequence
  Synthetic Oligonucleotide; TIM-3 exon 5; Set C
cagaucccugcuccgauguagaugccuauuc

SEQ ID NO: 68561 - RNA, 23 nt, Artificial Sequence
  Synthetic Oligonucleotide; TIM-3 exon 5; Set C
ucccugcuccgauguagaugccu

SEQ ID NO: 68562 - RNA, 28 nt, Artificial Sequence
  Synthetic Oligonucleotide; TIM-3 exon 5; Set C
agaucccugcuccgauguagaugccuau

SEQ ID NO: 68563 - RNA, 30 nt, Artificial Sequence
  Synthetic Oligonucleotide; TIM-3 exon 5; Set C
cagaucccugcuccgauguagaugccuauu

SEQ ID NO: 68564 - RNA, 34 nt, Artificial Sequence
  Synthetic Oligonucleotide; TIM-3 exon 5; Set C
cacagaucccugcuccgauguagaugccuauucu

SEQ ID NO: 68565 - RNA, 32 nt, Artificial Sequence
  Synthetic Oligonucleotide; TIM-3 exon 5; Set C
acagaucccugcuccgauguagaugccuauuc

SEQ ID NO: 68566 - RNA, 18 nt, Artificial Sequence
  Synthetic Oligonucleotide; TIM-3 exon 5; Set C
ccugcuccgauguagaug

SEQ ID NO: 68567 - RNA, 24 nt, Artificial Sequence
  Synthetic Oligonucleotide; TIM-3 exon 5; Set C
aucccugcuccgauguagaugccu

SEQ ID NO: 68568 - RNA, 22 nt, Artificial Sequence
  Synthetic Oligonucleotide; TIM-3 exon 5; Set A
ucccugcuccgauguagaugcc

SEQ ID NO: 68569 - RNA, 29 nt, Artificial Sequence
  Synthetic Oligonucleotide; TIM-3 exon 5; Set C
cagaucccugcuccgauguagaugccuau

SEQ ID NO: 68570 - RNA, 31 nt, Artificial Sequence
  Synthetic Oligonucleotide; TIM-3 exon 5; Set C
acagaucccugcuccgauguagaugccuauu

SEQ ID NO: 68571 - RNA, 33 nt, Artificial Sequence
  Synthetic Oligonucleotide; TIM-3 exon 5; Set C
cacagaucccugcuccgauguagaugccuauuc

SEQ ID NO: 68572 - RNA, 19 nt, Artificial Sequence
  Synthetic Oligonucleotide; TIM-3 exon 5; Set C
cccugcuccgauguagaug

SEQ ID NO: 68573 - RNA, 25 nt, Artificial Sequence
  Synthetic Oligonucleotide; TIM-3 exon 5; Set C
gaucccugcuccgauguagaugccu

SEQ ID NO: 68574 - RNA, 21 nt, Artificial Sequence
  Synthetic Oligonucleotide; TIM-3 exon 5; Set A
ucccugcuccgauguagaugc

SEQ ID NO: 68575 - RNA, 23 nt, Artificial Sequence
  Synthetic Oligonucleotide; TIM-3 exon 5; Set A
aucccugcuccgauguagaugcc

SEQ ID NO: 68576 - RNA, 30 nt, Artificial Sequence
  Synthetic Oligonucleotide; TIM-3 exon 5; Set C
acagaucccugcuccgauguagaugccuau

SEQ ID NO: 68577 - RNA, 32 nt, Artificial Sequence
  Synthetic Oligonucleotide; TIM-3 exon 5; Set C
cacagaucccugcuccgauguagaugccuauu

SEQ ID NO: 68578 - RNA, 20 nt, Artificial Sequence
  Synthetic Oligonucleotide; TIM-3 exon 5; Set A
ucccugcuccgauguagaug

SEQ ID NO: 68579 - RNA, 22 nt, Artificial Sequence
  Synthetic Oligonucleotide; TIM-3 exon 5; Set A
aucccugcuccgauguagaugc

SEQ ID NO: 68580 - RNA, 24 nt, Artificial Sequence
  Synthetic Oligonucleotide; TIM-3 exon 5; Set C
gaucccugcuccgauguagaugcc

SEQ ID NO: 68581 - RNA, 31 nt, Artificial Sequence
  Synthetic Oligonucleotide; TIM-3 exon 5; Set C
cacagaucccugcuccgauguagaugccuau

SEQ ID NO: 68582 - RNA, 21 nt, Artificial Sequence
  Synthetic Oligonucleotide; TIM-3 exon 5; Set A
aucccugcuccgauguagaug

SEQ ID NO: 68583 - RNA, 23 nt, Artificial Sequence
  Synthetic Oligonucleotide; TIM-3 exon 5; Set A
gaucccugcuccgauguagaugc

SEQ ID NO: 68584 - RNA, 30 nt, Artificial Sequence
  Synthetic Oligonucleotide; TIM-3 exon 5; Set C
cacagaucccugcuccgauguagaugccua

SEQ ID NO: 68585 - RNA, 22 nt, Artificial Sequence
  Synthetic Oligonucleotide; TIM-3 exon 5; Set A
agaucccugcuccgauguagau

SEQ ID NO: 68586 - RNA, 21 nt, Artificial Sequence
  Synthetic Oligonucleotide; TIM-3 exon 5; Set A
agaucccugcuccgauguaga

SEQ ID NO: 68587 - RNA, 23 nt, Artificial Sequence
  Synthetic Oligonucleotide; TIM-3 exon 5; Set A
cagaucccugcuccgauguagau

SEQ ID NO: 68588 - RNA, 20 nt, Artificial Sequence
  Synthetic Oligonucleotide; TIM-3 exon 5; Set A
agaucccugcuccgauguag

SEQ ID NO: 68589 - RNA, 22 nt, Artificial Sequence
  Synthetic Oligonucleotide; TIM-3 exon 5; Set A
cagaucccugcuccgauguaga

SEQ ID NO: 68590 - RNA, 24 nt, Artificial Sequence
  Synthetic Oligonucleotide; TIM-3 exon 5; Set A
acagaucccugcuccgauguagau

SEQ ID NO: 68591 - RNA, 21 nt, Artificial Sequence
  Synthetic Oligonucleotide; TIM-3 exon 5; Set A
cagaucccugcuccgauguag

SEQ ID NO: 68592 - RNA, 19 nt, Artificial Sequence
  Synthetic Oligonucleotide; TIM-3 exon 5; Set A
agaucccugcuccgaugua

SEQ ID NO: 68593 - RNA, 23 nt, Artificial Sequence
  Synthetic Oligonucleotide; TIM-3 exon 5; Set A
acagaucccugcuccgauguaga

SEQ ID NO: 68594 - RNA, 25 nt, Artificial Sequence
  Synthetic Oligonucleotide; TIM-3 exon 5; Set A
cacagaucccugcuccgauguagau

SEQ ID NO: 68595 - RNA, 22 nt, Artificial Sequence
  Synthetic Oligonucleotide; TIM-3 exon 5; Set A
acagaucccugcuccgauguag

SEQ ID NO: 68596 - RNA, 20 nt, Artificial Sequence
  Synthetic Oligonucleotide; TIM-3 exon 5; Set A
cagaucccugcuccgaugua

SEQ ID NO: 68597 - RNA, 18 nt, Artificial Sequence
  Synthetic Oligonucleotide; TIM-3 exon 5; Set A
agaucccugcuccgaugu

SEQ ID NO: 68598 - RNA, 24 nt, Artificial Sequence
  Synthetic Oligonucleotide; TIM-3 exon 5; Set A
cacagaucccugcuccgauguaga

SEQ ID NO: 68599 - RNA, 21 nt, Artificial Sequence
  Synthetic Oligonucleotide; TIM-3 exon 5; Set A
acagaucccugcuccgaugua

SEQ ID NO: 68600 - RNA, 17 nt, Artificial Sequence
  Synthetic Oligonucleotide; TIM-3 exon 5; Set C
agaucccugcuccgaug

SEQ ID NO: 68601 - RNA, 19 nt, Artificial Sequence
  Synthetic Oligonucleotide; TIM-3 exon 5; Set A
cagaucccugcuccgaugu

SEQ ID NO: 68602 - RNA, 16 nt, Artificial Sequence
  Synthetic Oligonucleotide; TIM-3 exon 5; Set C
agaucccugcuccgau

SEQ ID NO: 68603 - RNA, 22 nt, Artificial Sequence
  Synthetic Oligonucleotide; TIM-3 exon 5; Set A
cacagaucccugcuccgaugua

SEQ ID NO: 68604 - RNA, 18 nt, Artificial Sequence
  Synthetic Oligonucleotide; TIM-3 exon 5; Set C
cagaucccugcuccgaug

SEQ ID NO: 68605 - RNA, 20 nt, Artificial Sequence
  Synthetic Oligonucleotide; TIM-3 exon 5; Set A
acagaucccugcuccgaugu

SEQ ID NO: 68606 - RNA, 17 nt, Artificial Sequence
  Synthetic Oligonucleotide; TIM-3 exon 5; Set C
cagaucccugcuccgau

SEQ ID NO: 68607 - RNA, 19 nt, Artificial Sequence
  Synthetic Oligonucleotide; TIM-3 exon 5; Set A
acagaucccugcuccgaug

SEQ ID NO: 68608 - RNA, 21 nt, Artificial Sequence
  Synthetic Oligonucleotide; TIM-3 exon 5; Set A
cacagaucccugcuccgaugu

SEQ ID NO: 68609 - RNA, 15 nt, Artificial Sequence
  Synthetic Oligonucleotide; TIM-3 exon 5; Set C
agaucccugcuccga

SEQ ID NO: 68610 - RNA, 18 nt, Artificial Sequence
  Synthetic Oligonucleotide; TIM-3 exon 5; Set A
acagaucccugcuccgau

SEQ ID NO: 68611 - RNA, 20 nt, Artificial Sequence
  Synthetic Oligonucleotide; TIM-3 exon 5; Set A
cacagaucccugcuccgaug

SEQ ID NO: 68612 - RNA, 19 nt, Artificial Sequence
  Synthetic Oligonucleotide; TIM-3 exon 5; Set A
cacagaucccugcuccgau

SEQ ID NO: 68613 - RNA, 17 nt, Artificial Sequence
  Synthetic Oligonucleotide; TIM-3 exon 5; Set A
acagaucccugcuccga

SEQ ID NO: 68614 - RNA, 18 nt, Artificial Sequence
  Synthetic Oligonucleotide; TIM-3 exon 5; Set A
cacagaucccugcuccga

SEQ ID NO: 68615 - RNA, 17 nt, Artificial Sequence
  Synthetic Oligonucleotide; TIM-3 exon 5; Set A
cacagaucccugcuccg

SEQ ID NO: 68616 - RNA, 25 nt, Artificial Sequence
  Synthetic Oligonucleotide; TIM-3 exon 5; Set C
ccagcccagcacagaucccugcucc

SEQ ID NO: 68617 - RNA, 26 nt, Artificial Sequence
  Synthetic Oligonucleotide; TIM-3 exon 5; Set C
gccagcccagcacagaucccugcucc

SEQ ID NO: 68618 - RNA, 27 nt, Artificial Sequence
  Synthetic Oligonucleotide; TIM-3 exon 5; Set C
agccagcccagcacagaucccugcucc

SEQ ID NO: 68619 - RNA, 40 nt, Artificial Sequence
  Synthetic Oligonucleotide; TIM-3 exon 5; Set C
gagccagagccagcccagcacagaucccugcuccgaugua

SEQ ID NO: 68620 - RNA, 39 nt, Artificial Sequence
  Synthetic Oligonucleotide; TIM-3 exon 5; Set C
gagccagagccagcccagcacagaucccugcuccgaugu

SEQ ID NO: 68621 - RNA, 19 nt, Artificial Sequence
  Synthetic Oligonucleotide; TIM-3 exon 5; Set A
cagcccagcacagaucccu

SEQ ID NO: 68622 - RNA, 40 nt, Artificial Sequence
  Synthetic Oligonucleotide; TIM-3 exon 5; Set C
agagccagagccagcccagcacagaucccugcuccgaugu

SEQ ID NO: 68623 - RNA, 20 nt, Artificial Sequence
  Synthetic Oligonucleotide; TIM-3 exon 5; Set C
ccagcccagcacagaucccu

SEQ ID NO: 68624 - RNA, 39 nt, Artificial Sequence
  Synthetic Oligonucleotide; TIM-3 exon 5; Set C
agagccagagccagcccagcacagaucccugcuccgaug

SEQ ID NO: 68625 - RNA, 19 nt, Artificial Sequence
  Synthetic Oligonucleotide; TIM-3 exon 5; Set A
ccagcccagcacagauccc

SEQ ID NO: 68626 - RNA, 21 nt, Artificial Sequence
  Synthetic Oligonucleotide; TIM-3 exon 5; Set C
gccagcccagcacagaucccu

SEQ ID NO: 68627 - RNA, 38 nt, Artificial Sequence
  Synthetic Oligonucleotide; TIM-3 exon 5; Set C
agagccagagccagcccagcacagaucccugcuccgau

SEQ ID NO: 68628 - RNA, 40 nt, Artificial Sequence
  Synthetic Oligonucleotide; TIM-3 exon 5; Set C
aagagccagagccagcccagcacagaucccugcuccgaug

SEQ ID NO: 68629 - RNA, 20 nt, Artificial Sequence
  Synthetic Oligonucleotide; TIM-3 exon 5; Set C
gccagcccagcacagauccc

SEQ ID NO: 68630 - RNA, 22 nt, Artificial Sequence
  Synthetic Oligonucleotide; TIM-3 exon 5; Set C
agccagcccagcacagaucccu

SEQ ID NO: 68631 - RNA, 39 nt, Artificial Sequence
  Synthetic Oligonucleotide; TIM-3 exon 5; Set C
aagagccagagccagcccagcacagaucccugcuccgau

SEQ ID NO: 68632 - RNA, 21 nt, Artificial Sequence
  Synthetic Oligonucleotide; TIM-3 exon 5; Set C
agccagcccagcacagauccc

SEQ ID NO: 68633 - RNA, 38 nt, Artificial Sequence
  Synthetic Oligonucleotide; TIM-3 exon 5; Set C
aagagccagagccagcccagcacagaucccugcuccga

SEQ ID NO: 68634 - RNA, 39 nt, Artificial Sequence
  Synthetic Oligonucleotide; TIM-3 exon 5; Set C
uaagagccagagccagcccagcacagaucccugcuccga

SEQ ID NO: 68635 - RNA, 38 nt, Artificial Sequence
  Synthetic Oligonucleotide; TIM-3 exon 5; Set C
uaagagccagagccagcccagcacagaucccugcuccg

SEQ ID NO: 68636 - RNA, 39 nt, Artificial Sequence
  Synthetic Oligonucleotide; TIM-3 exon 5; Set C
auaagagccagagccagcccagcacagaucccugcuccg

SEQ ID NO: 68637 - RNA, 37 nt, Artificial Sequence
  Synthetic Oligonucleotide; TIM-3 exon 5; Set C
uaagagccagagccagcccagcacagaucccugcucc

SEQ ID NO: 68638 - RNA, 38 nt, Artificial Sequence
  Synthetic Oligonucleotide; TIM-3 exon 5; Set C
auaagagccagagccagcccagcacagaucccugcucc

SEQ ID NO: 68639 - RNA, 32 nt, Artificial Sequence
  Synthetic Oligonucleotide; TIM-3 exon 5; Set C
uaagagccagagccagcccagcacagaucccu

SEQ ID NO: 68640 - RNA, 31 nt, Artificial Sequence
  Synthetic Oligonucleotide; TIM-3 exon 5; Set C
uaagagccagagccagcccagcacagauccc

SEQ ID NO: 68641 - RNA, 33 nt, Artificial Sequence
  Synthetic Oligonucleotide; TIM-3 exon 5; Set C
auaagagccagagccagcccagcacagaucccu

SEQ ID NO: 68642 - RNA, 30 nt, Artificial Sequence
  Synthetic Oligonucleotide; TIM-3 exon 5; Set C
uaagagccagagccagcccagcacagaucc

SEQ ID NO: 68643 - RNA, 32 nt, Artificial Sequence
  Synthetic Oligonucleotide; TIM-3 exon 5; Set C
auaagagccagagccagcccagcacagauccc

SEQ ID NO: 68644 - RNA, 27 nt, Artificial Sequence
  Synthetic Oligonucleotide; TIM-3 exon 5; Set C
aagagccagagccagcccagcacagau

SEQ ID NO: 68645 - RNA, 29 nt, Artificial Sequence
  Synthetic Oligonucleotide; TIM-3 exon 5; Set C
uaagagccagagccagcccagcacagauc

SEQ ID NO: 68646 - RNA, 31 nt, Artificial Sequence
  Synthetic Oligonucleotide; TIM-3 exon 5; Set C
auaagagccagagccagcccagcacagaucc

SEQ ID NO: 68647 - RNA, 28 nt, Artificial Sequence
  Synthetic Oligonucleotide; TIM-3 exon 5; Set C
uaagagccagagccagcccagcacagau

SEQ ID NO: 68648 - RNA, 30 nt, Artificial Sequence
  Synthetic Oligonucleotide; TIM-3 exon 5; Set C
auaagagccagagccagcccagcacagauc

SEQ ID NO: 68649 - RNA, 29 nt, Artificial Sequence
  Synthetic Oligonucleotide; TIM-3 exon 5; Set C
auaagagccagagccagcccagcacagau

SEQ ID NO: 68650 - RNA, 16 nt, Artificial Sequence
  Synthetic Oligonucleotide; TIM-3 exon 5; Set C
uaagagccagagccag

SEQ ID NO: 68651 - RNA, 17 nt, Artificial Sequence
  Synthetic Oligonucleotide; TIM-3 exon 5; Set C
auaagagccagagccag

SEQ ID NO: 68652 - RNA, 16 nt, Artificial Sequence
  Synthetic Oligonucleotide; TIM-3 exon 5; Set C
auaagagccagagcca

SEQ ID NO: 68653 - RNA, 17 nt, Artificial Sequence
  Synthetic Oligonucleotide; TIM-3 exon 5; Set C
gauaagagccagagcca

SEQ ID NO: 68654 - RNA, 16 nt, Artificial Sequence
  Synthetic Oligonucleotide; TIM-3 exon 5; Set C
gauaagagccagagcc

SEQ ID NO: 68655 - RNA, 18 nt, Artificial Sequence
  Synthetic Oligonucleotide; TIM-3 exon 5; Set C
agauaagagccagagcca

SEQ ID NO: 68656 - RNA, 17 nt, Artificial Sequence
  Synthetic Oligonucleotide; TIM-3 exon 5; Set C
agauaagagccagagcc

SEQ ID NO: 68657 - RNA, 15 nt, Artificial Sequence
  Synthetic Oligonucleotide; TIM-3 exon 5; Set C
gauaagagccagagc

SEQ ID NO: 68658 - RNA, 19 nt, Artificial Sequence
  Synthetic Oligonucleotide; TIM-3 exon 5; Set C
aagauaagagccagagcca

SEQ ID NO: 68659 - RNA, 18 nt, Artificial Sequence
  Synthetic Oligonucleotide; TIM-3 exon 5; Set C
aagauaagagccagagcc

SEQ ID NO: 68660 - RNA, 16 nt, Artificial Sequence
  Synthetic Oligonucleotide; TIM-3 exon 5; Set C
agauaagagccagagc

SEQ ID NO: 68661 - RNA, 20 nt, Artificial Sequence
  Synthetic Oligonucleotide; TIM-3 exon 5; Set C
gaagauaagagccagagcca

SEQ ID NO: 68662 - RNA, 19 nt, Artificial Sequence
  Synthetic Oligonucleotide; TIM-3 exon 5; Set C
gaagauaagagccagagcc

SEQ ID NO: 68663 - RNA, 17 nt, Artificial Sequence
  Synthetic Oligonucleotide; TIM-3 exon 5; Set C
aagauaagagccagagc

SEQ ID NO: 68664 - RNA, 18 nt, Artificial Sequence
  Synthetic Oligonucleotide; TIM-3 exon 5; Set C
gaagauaagagccagagc

SEQ ID NO: 68665 - RNA, 19 nt, Artificial Sequence
  Synthetic Oligonucleotide; TIM-3 exon 5; Set C
cgaagauaagagccagagc

SEQ ID NO: 68666 - RNA, 29 nt, Artificial Sequence
  Synthetic Oligonucleotide; TIM-3 exon 5; Set A
aaagcgccgaagauaagagccagagccag

SEQ ID NO: 68667 - RNA, 30 nt, Artificial Sequence
  Synthetic Oligonucleotide; TIM-3 exon 5; Set A
uaaagcgccgaagauaagagccagagccag

SEQ ID NO: 68668 - RNA, 28 nt, Artificial Sequence
  Synthetic Oligonucleotide; TIM-3 exon 5; Set C
aaagcgccgaagauaagagccagagcca

SEQ ID NO: 68669 - RNA, 27 nt, Artificial Sequence
  Synthetic Oligonucleotide; TIM-3 exon 5; Set A
aaagcgccgaagauaagagccagagcc

SEQ ID NO: 68670 - RNA, 29 nt, Artificial Sequence
  Synthetic Oligonucleotide; TIM-3 exon 5; Set C
uaaagcgccgaagauaagagccagagcca

SEQ ID NO: 68671 - RNA, 32 nt, Artificial Sequence
  Synthetic Oligonucleotide; TIM-3 exon 5; Set A
auuaaagcgccgaagauaagagccagagccag

SEQ ID NO: 68672 - RNA, 28 nt, Artificial Sequence
  Synthetic Oligonucleotide; TIM-3 exon 5; Set A
uaaagcgccgaagauaagagccagagcc

SEQ ID NO: 68673 - RNA, 26 nt, Artificial Sequence
  Synthetic Oligonucleotide; TIM-3 exon 5; Set A
aaagcgccgaagauaagagccagagc

SEQ ID NO: 68674 - RNA, 33 nt, Artificial Sequence
  Synthetic Oligonucleotide; TIM-3 exon 5; Set A
aauuaaagcgccgaagauaagagccagagccag

SEQ ID NO: 68675 - RNA, 27 nt, Artificial Sequence
  Synthetic Oligonucleotide; TIM-3 exon 5; Set A
uaaagcgccgaagauaagagccagagc

SEQ ID NO: 68676 - RNA, 31 nt, Artificial Sequence
  Synthetic Oligonucleotide; TIM-3 exon 5; Set C
auuaaagcgccgaagauaagagccagagcca

SEQ ID NO: 68677 - RNA, 34 nt, Artificial Sequence
  Synthetic Oligonucleotide; TIM-3 exon 5; Set A
aaauuaaagcgccgaagauaagagccagagccag

SEQ ID NO: 68678 - RNA, 30 nt, Artificial Sequence
  Synthetic Oligonucleotide; TIM-3 exon 5; Set A
auuaaagcgccgaagauaagagccagagcc

SEQ ID NO: 68679 - RNA, 35 nt, Artificial Sequence
  Synthetic Oligonucleotide; TIM-3 exon 5; Set A
aaaauuaaagcgccgaagauaagagccagagccag

SEQ ID NO: 68680 - RNA, 29 nt, Artificial Sequence
  Synthetic Oligonucleotide; TIM-3 exon 5; Set A
auuaaagcgccgaagauaagagccagagc

SEQ ID NO: 68681 - RNA, 40 nt, Artificial Sequence
  Synthetic Oligonucleotide; TIM-3 exon 5; Set A
auuugaaaauuaaagcgccgaagauaagagccagagccag

SEQ ID NO: 68682 - RNA, 40 nt, Artificial Sequence
  Synthetic Oligonucleotide; TIM-3 exon 5; Set C
cauuugaaaauuaaagcgccgaagauaagagccagagcca

SEQ ID NO: 68683 - RNA, 16 nt, Artificial Sequence
  Synthetic Oligonucleotide; TIM-3 exon 5; Set C
aaagcgccgaagauaa

SEQ ID NO: 68684 - RNA, 18 nt, Artificial Sequence
  Synthetic Oligonucleotide; TIM-3 exon 5; Set C
uaaagcgccgaagauaag

SEQ ID NO: 68685 - RNA, 39 nt, Artificial Sequence
  Synthetic Oligonucleotide; TIM-3 exon 5; Set A
cauuugaaaauuaaagcgccgaagauaagagccagagcc

SEQ ID NO: 68686 - RNA, 17 nt, Artificial Sequence
  Synthetic Oligonucleotide; TIM-3 exon 5; Set C
uaaagcgccgaagauaa

SEQ ID NO: 68687 - RNA, 15 nt, Artificial Sequence
  Synthetic Oligonucleotide; TIM-3 exon 5; Set C
aaagcgccgaagaua

SEQ ID NO: 68688 - RNA, 19 nt, Artificial Sequence
  Synthetic Oligonucleotide; TIM-3 exon 5; Set C
uuaaagcgccgaagauaag

SEQ ID NO: 68689 - RNA, 40 nt, Artificial Sequence
  Synthetic Oligonucleotide; TIM-3 exon 5; Set C
acauuugaaaauuaaagcgccgaagauaagagccagagcc

SEQ ID NO: 68690 - RNA, 16 nt, Artificial Sequence
  Synthetic Oligonucleotide; TIM-3 exon 5; Set C
uaaagcgccgaagaua

SEQ ID NO: 68691 - RNA, 39 nt, Artificial Sequence
  Synthetic Oligonucleotide; TIM-3 exon 5; Set A
acauuugaaaauuaaagcgccgaagauaagagccagagc

SEQ ID NO: 68692 - RNA, 19 nt, Artificial Sequence
  Synthetic Oligonucleotide; TIM-3 exon 5; Set C
auuaaagcgccgaagauaa

SEQ ID NO: 68693 - RNA, 18 nt, Artificial Sequence
  Synthetic Oligonucleotide; TIM-3 exon 5; Set C
auuaaagcgccgaagaua

SEQ ID NO: 68694 - RNA, 26 nt, Artificial Sequence
  Synthetic Oligonucleotide; TIM-3 exon 5; Set C
gaaaauuaaagcgccgaagauaagag

SEQ ID NO: 68695 - RNA, 25 nt, Artificial Sequence
  Synthetic Oligonucleotide; TIM-3 exon 5; Set C
gaaaauuaaagcgccgaagauaaga

SEQ ID NO: 68696 - RNA, 27 nt, Artificial Sequence
  Synthetic Oligonucleotide; TIM-3 exon 5; Set C
ugaaaauuaaagcgccgaagauaagag

SEQ ID NO: 68697 - RNA, 18 nt, Artificial Sequence
  Synthetic Oligonucleotide; TIM-3 exon 5; Set C
aauuaaagcgccgaagau

SEQ ID NO: 68698 - RNA, 26 nt, Artificial Sequence
  Synthetic Oligonucleotide; TIM-3 exon 5; Set C
ugaaaauuaaagcgccgaagauaaga

SEQ ID NO: 68699 - RNA, 19 nt, Artificial Sequence
  Synthetic Oligonucleotide; TIM-3 exon 5; Set C
aaauuaaagcgccgaagau

SEQ ID NO: 68700 - RNA, 17 nt, Artificial Sequence
  Synthetic Oligonucleotide; TIM-3 exon 5; Set C
aauuaaagcgccgaaga

SEQ ID NO: 68701 - RNA, 15 nt, Artificial Sequence
  Synthetic Oligonucleotide; TIM-3 exon 5; Set C
auuaaagcgccgaag

SEQ ID NO: 68702 - RNA, 20 nt, Artificial Sequence
  Synthetic Oligonucleotide; TIM-3 exon 5; Set C
aaaauuaaagcgccgaagau

SEQ ID NO: 68703 - RNA, 18 nt, Artificial Sequence
  Synthetic Oligonucleotide; TIM-3 exon 5; Set C
aaauuaaagcgccgaaga

SEQ ID NO: 68704 - RNA, 16 nt, Artificial Sequence
  Synthetic Oligonucleotide; TIM-3 exon 5; Set C
aauuaaagcgccgaag

SEQ ID NO: 68705 - RNA, 26 nt, Artificial Sequence
  Synthetic Oligonucleotide; TIM-3 exon 5; Set C
uugaaaauuaaagcgccgaagauaag

SEQ ID NO: 68706 - RNA, 19 nt, Artificial Sequence
  Synthetic Oligonucleotide; TIM-3 exon 5; Set C
aaaauuaaagcgccgaaga

SEQ ID NO: 68707 - RNA, 17 nt, Artificial Sequence
  Synthetic Oligonucleotide; TIM-3 exon 5; Set C
aaauuaaagcgccgaag

SEQ ID NO: 68708 - RNA, 15 nt, Artificial Sequence
  Synthetic Oligonucleotide; TIM-3 exon 5; Set C
aauuaaagcgccgaa

SEQ ID NO: 68709 - RNA, 27 nt, Artificial Sequence
  Synthetic Oligonucleotide; TIM-3 exon 5; Set C
uuugaaaauuaaagcgccgaagauaag

SEQ ID NO: 68710 - RNA, 18 nt, Artificial Sequence
  Synthetic Oligonucleotide; TIM-3 exon 5; Set C
aaaauuaaagcgccgaag

SEQ ID NO: 68711 - RNA, 16 nt, Artificial Sequence
  Synthetic Oligonucleotide; TIM-3 exon 5; Set C
aaauuaaagcgccgaa

SEQ ID NO: 68712 - RNA, 15 nt, Artificial Sequence
  Synthetic Oligonucleotide; TIM-3 exon 5; Set C
aaauuaaagcgccga

SEQ ID NO: 68713 - RNA, 17 nt, Artificial Sequence
  Synthetic Oligonucleotide; TIM-3 exon 5; Set C
aaaauuaaagcgccgaa

SEQ ID NO: 68714 - RNA, 27 nt, Artificial Sequence
  Synthetic Oligonucleotide; TIM-3 exon 5; Set C
auuugaaaauuaaagcgccgaagauaa

SEQ ID NO: 68715 - RNA, 16 nt, Artificial Sequence
  Synthetic Oligonucleotide; TIM-3 exon 5; Set C
aaaauuaaagcgccga

SEQ ID NO: 68716 - RNA, 28 nt, Artificial Sequence
  Synthetic Oligonucleotide; TIM-3 exon 5; Set C
cauuugaaaauuaaagcgccgaagauaa

SEQ ID NO: 68717 - RNA, 26 nt, Artificial Sequence
  Synthetic Oligonucleotide; TIM-3 exon 5; Set C
auuugaaaauuaaagcgccgaagaua

SEQ ID NO: 68718 - RNA, 25 nt, Artificial Sequence
  Synthetic Oligonucleotide; TIM-3 exon 5; Set C
auuugaaaauuaaagcgccgaagau

SEQ ID NO: 68719 - RNA, 29 nt, Artificial Sequence
  Synthetic Oligonucleotide; TIM-3 exon 5; Set C
acauuugaaaauuaaagcgccgaagauaa

SEQ ID NO: 68720 - RNA, 27 nt, Artificial Sequence
  Synthetic Oligonucleotide; TIM-3 exon 5; Set C
cauuugaaaauuaaagcgccgaagaua

SEQ ID NO: 68721 - RNA, 26 nt, Artificial Sequence
  Synthetic Oligonucleotide; TIM-3 exon 5; Set C
cauuugaaaauuaaagcgccgaagau

SEQ ID NO: 68722 - RNA, 24 nt, Artificial Sequence
  Synthetic Oligonucleotide; TIM-3 exon 5; Set C
auuugaaaauuaaagcgccgaaga

SEQ ID NO: 68723 - RNA, 28 nt, Artificial Sequence
  Synthetic Oligonucleotide; TIM-3 exon 5; Set C
acauuugaaaauuaaagcgccgaagaua

SEQ ID NO: 68724 - RNA, 16 nt, Artificial Sequence
  Synthetic Oligonucleotide; TIM-3 exon 5; Set C
gaaaauuaaagcgccg

SEQ ID NO: 68725 - RNA, 27 nt, Artificial Sequence
  Synthetic Oligonucleotide; TIM-3 exon 5; Set C
acauuugaaaauuaaagcgccgaagau

SEQ ID NO: 68726 - RNA, 25 nt, Artificial Sequence
  Synthetic Oligonucleotide; TIM-3 exon 5; Set C
cauuugaaaauuaaagcgccgaaga

SEQ ID NO: 68727 - RNA, 23 nt, Artificial Sequence
  Synthetic Oligonucleotide; TIM-3 exon 5; Set C
auuugaaaauuaaagcgccgaag

SEQ ID NO: 68728 - RNA, 15 nt, Artificial Sequence
  Synthetic Oligonucleotide; TIM-3 exon 5; Set C
gaaaauuaaagcgcc

SEQ ID NO: 68729 - RNA, 17 nt, Artificial Sequence
  Synthetic Oligonucleotide; TIM-3 exon 5; Set C
ugaaaauuaaagcgccg

SEQ ID NO: 68730 - RNA, 26 nt, Artificial Sequence
  Synthetic Oligonucleotide; TIM-3 exon 5; Set C
acauuugaaaauuaaagcgccgaaga

SEQ ID NO: 68731 - RNA, 24 nt, Artificial Sequence
  Synthetic Oligonucleotide; TIM-3 exon 5; Set C
cauuugaaaauuaaagcgccgaag

SEQ ID NO: 68732 - RNA, 22 nt, Artificial Sequence
  Synthetic Oligonucleotide; TIM-3 exon 5; Set C
auuugaaaauuaaagcgccgaa

SEQ ID NO: 68733 - RNA, 16 nt, Artificial Sequence
  Synthetic Oligonucleotide; TIM-3 exon 5; Set C
ugaaaauuaaagcgcc

SEQ ID NO: 68734 - RNA, 21 nt, Artificial Sequence
  Synthetic Oligonucleotide; TIM-3 exon 5; Set C
auuugaaaauuaaagcgccga

SEQ ID NO: 68735 - RNA, 25 nt, Artificial Sequence
  Synthetic Oligonucleotide; TIM-3 exon 5; Set C
acauuugaaaauuaaagcgccgaag

SEQ ID NO: 68736 - RNA, 23 nt, Artificial Sequence
  Synthetic Oligonucleotide; TIM-3 exon 5; Set C
cauuugaaaauuaaagcgccgaa

SEQ ID NO: 68737 - RNA, 22 nt, Artificial Sequence
  Synthetic Oligonucleotide; TIM-3 exon 5; Set C
cauuugaaaauuaaagcgccga

SEQ ID NO: 68738 - RNA, 24 nt, Artificial Sequence
  Synthetic Oligonucleotide; TIM-3 exon 5; Set C
acauuugaaaauuaaagcgccgaa

SEQ ID NO: 68739 - RNA, 23 nt, Artificial Sequence
  Synthetic Oligonucleotide; TIM-3 exon 5; Set C
acauuugaaaauuaaagcgccga

SEQ ID NO: 68740 - RNA, 40 nt, Artificial Sequence
  Synthetic Oligonucleotide; TIM-3 exon 5; Set B
aaaacacuuacauuugaaaauuaaagcgccgaagauaaga

SEQ ID NO: 68741 - RNA, 39 nt, Artificial Sequence
  Synthetic Oligonucleotide; TIM-3 exon 5; Set C
aaaacacuuacauuugaaaauuaaagcgccgaagauaag

SEQ ID NO: 68742 - RNA, 40 nt, Artificial Sequence
  Synthetic Oligonucleotide; TIM-3 exon 5; Set C
aaaaacacuuacauuugaaaauuaaagcgccgaagauaag

SEQ ID NO: 68743 - RNA, 15 nt, Artificial Sequence
  Synthetic Oligonucleotide; TIM-3 exon 5; Set C
cauuugaaaauuaaa

SEQ ID NO: 68744 - RNA, 16 nt, Artificial Sequence
  Synthetic Oligonucleotide; TIM-3 exon 5; Set C
acauuugaaaauuaaa

SEQ ID NO: 68745 - RNA, 15 nt, Artificial Sequence
  Synthetic Oligonucleotide; TIM-3 exon 5; Set C
acauuugaaaauuaa

SEQ ID NO: 68746 - RNA, 34 nt, Artificial Sequence
  Synthetic Oligonucleotide; TIM-3 exon 5; Set C
aacaaaaacacuuacauuugaaaauuaaagcgcc

SEQ ID NO: 68747 - RNA, 27 nt, Artificial Sequence
  Synthetic Oligonucleotide; TIM-3 exon 5; Set C
aaaaacacuuacauuugaaaauuaaag

SEQ ID NO: 68748 - RNA, 28 nt, Artificial Sequence
  Synthetic Oligonucleotide; TIM-3 exon 5; Set C
caaaaacacuuacauuugaaaauuaaag

SEQ ID NO: 68749 - RNA, 30 nt, Artificial Sequence
  Synthetic Oligonucleotide; TIM-3 exon 5; Set C
acaaaaacacuuacauuugaaaauuaaagc

SEQ ID NO: 68750 - RNA, 29 nt, Artificial Sequence
  Synthetic Oligonucleotide; TIM-3 exon 5; Set C
acaaaaacacuuacauuugaaaauuaaag

SEQ ID NO: 68751 - RNA, 31 nt, Artificial Sequence
  Synthetic Oligonucleotide; TIM-3 exon 5; Set C
aacaaaaacacuuacauuugaaaauuaaagc

SEQ ID NO: 68752 - RNA, 30 nt, Artificial Sequence
  Synthetic Oligonucleotide; TIM-3 exon 5; Set C
aacaaaaacacuuacauuugaaaauuaaag

SEQ ID NO: 68753 - RNA, 21 nt, Artificial Sequence
  Synthetic Oligonucleotide; TIM-3 exon 5; Set C
aaaacacuuacauuugaaaau

SEQ ID NO: 68754 - RNA, 30 nt, Artificial Sequence
  Synthetic Oligonucleotide; TIM-3 exon 5; Set C
aaacaaaaacacuuacauuugaaaauuaaa

SEQ ID NO: 68755 - RNA, 22 nt, Artificial Sequence
  Synthetic Oligonucleotide; TIM-3 exon 5; Set C
aaaaacacuuacauuugaaaau

SEQ ID NO: 68756 - RNA, 20 nt, Artificial Sequence
  Synthetic Oligonucleotide; TIM-3 exon 5; Set C
aaaacacuuacauuugaaaa

SEQ ID NO: 68757 - RNA, 19 nt, Artificial Sequence
  Synthetic Oligonucleotide; TIM-3 exon 5; Set C
aaaacacuuacauuugaaa

SEQ ID NO: 68758 - RNA, 23 nt, Artificial Sequence
  Synthetic Oligonucleotide; TIM-3 exon 5; Set C
caaaaacacuuacauuugaaaau

SEQ ID NO: 68759 - RNA, 21 nt, Artificial Sequence
  Synthetic Oligonucleotide; TIM-3 exon 5; Set C
aaaaacacuuacauuugaaaa

SEQ ID NO: 68760 - RNA, 20 nt, Artificial Sequence
  Synthetic Oligonucleotide; TIM-3 exon 5; Set C
aaaaacacuuacauuugaaa

SEQ ID NO: 68761 - RNA, 24 nt, Artificial Sequence
  Synthetic Oligonucleotide; TIM-3 exon 5; Set C
acaaaaacacuuacauuugaaaau

SEQ ID NO: 68762 - RNA, 22 nt, Artificial Sequence
  Synthetic Oligonucleotide; TIM-3 exon 5; Set C
caaaaacacuuacauuugaaaa

SEQ ID NO: 68763 - RNA, 27 nt, Artificial Sequence
  Synthetic Oligonucleotide; TIM-3 exon 5; Set C
aaacaaaaacacuuacauuugaaaauu

SEQ ID NO: 68764 - RNA, 21 nt, Artificial Sequence
  Synthetic Oligonucleotide; TIM-3 exon 5; Set C
caaaaacacuuacauuugaaa

SEQ ID NO: 68765 - RNA, 23 nt, Artificial Sequence
  Synthetic Oligonucleotide; TIM-3 exon 5; Set C
acaaaaacacuuacauuugaaaa

SEQ ID NO: 68766 - RNA, 35 nt, Artificial Sequence
  Synthetic Oligonucleotide; TIM-3 exon 5; Set C
agagaaacaaaaacacuuacauuugaaaauuaaag

SEQ ID NO: 68767 - RNA, 28 nt, Artificial Sequence
  Synthetic Oligonucleotide; TIM-3 exon 5; Set C
gaaacaaaaacacuuacauuugaaaauu

SEQ ID NO: 68768 - RNA, 22 nt, Artificial Sequence
  Synthetic Oligonucleotide; TIM-3 exon 5; Set C
acaaaaacacuuacauuugaaa

SEQ ID NO: 68769 - RNA, 24 nt, Artificial Sequence
  Synthetic Oligonucleotide; TIM-3 exon 5; Set C
aacaaaaacacuuacauuugaaaa

SEQ ID NO: 68770 - RNA, 35 nt, Artificial Sequence
  Synthetic Oligonucleotide; TIM-3 exon 5; Set C
gagagaaacaaaaacacuuacauuugaaaauuaaa

SEQ ID NO: 68771 - RNA, 29 nt, Artificial Sequence
  Synthetic Oligonucleotide; TIM-3 exon 5; Set C
agaaacaaaaacacuuacauuugaaaauu

SEQ ID NO: 68772 - RNA, 27 nt, Artificial Sequence
  Synthetic Oligonucleotide; TIM-3 exon 5; Set C
gaaacaaaaacacuuacauuugaaaau

SEQ ID NO: 68773 - RNA, 34 nt, Artificial Sequence
  Synthetic Oligonucleotide; TIM-3 exon 5; Set C
gagagaaacaaaaacacuuacauuugaaaauuaa

SEQ ID NO: 68774 - RNA, 36 nt, Artificial Sequence
  Synthetic Oligonucleotide; TIM-3 exon 5; Set C
agagagaaacaaaaacacuuacauuugaaaauuaaa

SEQ ID NO: 68775 - RNA, 30 nt, Artificial Sequence
  Synthetic Oligonucleotide; TIM-3 exon 5; Set C
gagaaacaaaaacacuuacauuugaaaauu

SEQ ID NO: 68776 - RNA, 26 nt, Artificial Sequence
  Synthetic Oligonucleotide; TIM-3 exon 5; Set C
gaaacaaaaacacuuacauuugaaaa

SEQ ID NO: 68777 - RNA, 28 nt, Artificial Sequence
  Synthetic Oligonucleotide; TIM-3 exon 5; Set C
agaaacaaaaacacuuacauuugaaaau

SEQ ID NO: 68778 - RNA, 40 nt, Artificial Sequence
  Synthetic Oligonucleotide; TIM-3 exon 5; Set C
ggagagagaaacaaaaacacuuacauuugaaaauuaaagc

SEQ ID NO: 68779 - RNA, 35 nt, Artificial Sequence
  Synthetic Oligonucleotide; TIM-3 exon 5; Set C
agagagaaacaaaaacacuuacauuugaaaauuaa

SEQ ID NO: 68780 - RNA, 37 nt, Artificial Sequence
  Synthetic Oligonucleotide; TIM-3 exon 5; Set C
gagagagaaacaaaaacacuuacauuugaaaauuaaa

SEQ ID NO: 68781 - RNA, 15 nt, Artificial Sequence
  Synthetic Oligonucleotide; TIM-3 exon 5; Set C
aaaaacacuuacauu

SEQ ID NO: 68782 - RNA, 25 nt, Artificial Sequence
  Synthetic Oligonucleotide; TIM-3 exon 5; Set C
gaaacaaaaacacuuacauuugaaa

SEQ ID NO: 68783 - RNA, 29 nt, Artificial Sequence
  Synthetic Oligonucleotide; TIM-3 exon 5; Set C
gagaaacaaaaacacuuacauuugaaaau

SEQ ID NO: 68784 - RNA, 27 nt, Artificial Sequence
  Synthetic Oligonucleotide; TIM-3 exon 5; Set C
agaaacaaaaacacuuacauuugaaaa

SEQ ID NO: 68785 - RNA, 39 nt, Artificial Sequence
  Synthetic Oligonucleotide; TIM-3 exon 5; Set C
ggagagagaaacaaaaacacuuacauuugaaaauuaaag

SEQ ID NO: 68786 - RNA, 36 nt, Artificial Sequence
  Synthetic Oligonucleotide; TIM-3 exon 5; Set C
gagagagaaacaaaaacacuuacauuugaaaauuaa

SEQ ID NO: 68787 - RNA, 32 nt, Artificial Sequence
  Synthetic Oligonucleotide; TIM-3 exon 5; Set C
gagagaaacaaaaacacuuacauuugaaaauu

SEQ ID NO: 68788 - RNA, 16 nt, Artificial Sequence
  Synthetic Oligonucleotide; TIM-3 exon 5; Set C
caaaaacacuuacauu

SEQ ID NO: 68789 - RNA, 26 nt, Artificial Sequence
  Synthetic Oligonucleotide; TIM-3 exon 5; Set C
agaaacaaaaacacuuacauuugaaa

SEQ ID NO: 68790 - RNA, 30 nt, Artificial Sequence
  Synthetic Oligonucleotide; TIM-3 exon 5; Set C
agagaaacaaaaacacuuacauuugaaaau

SEQ ID NO: 68791 - RNA, 28 nt, Artificial Sequence
  Synthetic Oligonucleotide; TIM-3 exon 5; Set C
gagaaacaaaaacacuuacauuugaaaa

SEQ ID NO: 68792 - RNA, 40 nt, Artificial Sequence
  Synthetic Oligonucleotide; TIM-3 exon 5; Set C
gggagagagaaacaaaaacacuuacauuugaaaauuaaag

SEQ ID NO: 68793 - RNA, 33 nt, Artificial Sequence
  Synthetic Oligonucleotide; TIM-3 exon 5; Set C
agagagaaacaaaaacacuuacauuugaaaauu

SEQ ID NO: 68794 - RNA, 17 nt, Artificial Sequence
  Synthetic Oligonucleotide; TIM-3 exon 5; Set C
acaaaaacacuuacauu

SEQ ID NO: 68795 - RNA, 15 nt, Artificial Sequence
  Synthetic Oligonucleotide; TIM-3 exon 5; Set C
caaaaacacuuacau

SEQ ID NO: 68796 - RNA, 27 nt, Artificial Sequence
  Synthetic Oligonucleotide; TIM-3 exon 5; Set C
gagaaacaaaaacacuuacauuugaaa

SEQ ID NO: 68797 - RNA, 29 nt, Artificial Sequence
  Synthetic Oligonucleotide; TIM-3 exon 5; Set C
agagaaacaaaaacacuuacauuugaaaa

SEQ ID NO: 68798 - RNA, 34 nt, Artificial Sequence
  Synthetic Oligonucleotide; TIM-3 exon 5; Set C
gagagagaaacaaaaacacuuacauuugaaaauu

SEQ ID NO: 68799 - RNA, 18 nt, Artificial Sequence
  Synthetic Oligonucleotide; TIM-3 exon 5; Set C
aacaaaaacacuuacauu

SEQ ID NO: 68800 - RNA, 16 nt, Artificial Sequence
  Synthetic Oligonucleotide; TIM-3 exon 5; Set C
acaaaaacacuuacau

SEQ ID NO: 68801 - RNA, 15 nt, Artificial Sequence
  Synthetic Oligonucleotide; TIM-3 exon 5; Set C
acaaaaacacuuaca

SEQ ID NO: 68802 - RNA, 17 nt, Artificial Sequence
  Synthetic Oligonucleotide; TIM-3 exon 5; Set C
aacaaaaacacuuacau

SEQ ID NO: 68803 - RNA, 16 nt, Artificial Sequence
  Synthetic Oligonucleotide; TIM-3 exon 5; Set C
aacaaaaacacuuaca

SEQ ID NO: 68804 - RNA, 38 nt, Artificial Sequence
  Synthetic Oligonucleotide; TIM-3 exon 5; Set B
gagggagagagaaacaaaaacacuuacauuugaaaauu

SEQ ID NO: 68805 - RNA, 22 nt, Artificial Sequence
  Synthetic Oligonucleotide; TIM-3 exon 5; Set C
gagaaacaaaaacacuuacauu

SEQ ID NO: 68806 - RNA, 25 nt, Artificial Sequence
  Synthetic Oligonucleotide; TIM-3 exon 5; Set C
gagagaaacaaaaacacuuacauuu

SEQ ID NO: 68807 - RNA, 39 nt, Artificial Sequence
  Synthetic Oligonucleotide; TIM-3 exon 5; Set B
agagggagagagaaacaaaaacacuuacauuugaaaauu

SEQ ID NO: 68808 - RNA, 23 nt, Artificial Sequence
  Synthetic Oligonucleotide; TIM-3 exon 5; Set C
agagaaacaaaaacacuuacauu

SEQ ID NO: 68809 - RNA, 21 nt, Artificial Sequence
  Synthetic Oligonucleotide; TIM-3 exon 5; Set C
gagaaacaaaaacacuuacau

SEQ ID NO: 68810 - RNA, 37 nt, Artificial Sequence
  Synthetic Oligonucleotide; TIM-3 exon 5; Set B
gagggagagagaaacaaaaacacuuacauuugaaaau

SEQ ID NO: 68811 - RNA, 26 nt, Artificial Sequence
  Synthetic Oligonucleotide; TIM-3 exon 5; Set C
agagagaaacaaaaacacuuacauuu

SEQ ID NO: 68812 - RNA, 20 nt, Artificial Sequence
  Synthetic Oligonucleotide; TIM-3 exon 5; Set C
gagaaacaaaaacacuuaca

SEQ ID NO: 68813 - RNA, 22 nt, Artificial Sequence
  Synthetic Oligonucleotide; TIM-3 exon 5; Set C
agagaaacaaaaacacuuacau

SEQ ID NO: 68814 - RNA, 36 nt, Artificial Sequence
  Synthetic Oligonucleotide; TIM-3 exon 5; Set B
gagggagagagaaacaaaaacacuuacauuugaaaa

SEQ ID NO: 68815 - RNA, 38 nt, Artificial Sequence
  Synthetic Oligonucleotide; TIM-3 exon 5; Set B
agagggagagagaaacaaaaacacuuacauuugaaaau

SEQ ID NO: 68816 - RNA, 27 nt, Artificial Sequence
  Synthetic Oligonucleotide; TIM-3 exon 5; Set C
gagagagaaacaaaaacacuuacauuu

SEQ ID NO: 68817 - RNA, 21 nt, Artificial Sequence
  Synthetic Oligonucleotide; TIM-3 exon 5; Set C
agagaaacaaaaacacuuaca

SEQ ID NO: 68818 - RNA, 35 nt, Artificial Sequence
  Synthetic Oligonucleotide; TIM-3 exon 5; Set B
gagggagagagaaacaaaaacacuuacauuugaaa

SEQ ID NO: 68819 - RNA, 37 nt, Artificial Sequence
  Synthetic Oligonucleotide; TIM-3 exon 5; Set B
agagggagagagaaacaaaaacacuuacauuugaaaa

SEQ ID NO: 68820 - RNA, 36 nt, Artificial Sequence
  Synthetic Oligonucleotide; TIM-3 exon 5; Set B
agagggagagagaaacaaaaacacuuacauuugaaa

SEQ ID NO: 68821 - RNA, 30 nt, Artificial Sequence
  Synthetic Oligonucleotide; TIM-3 exon 5; Set C
gagggagagagaaacaaaaacacuuacauu

SEQ ID NO: 68822 - RNA, 31 nt, Artificial Sequence
  Synthetic Oligonucleotide; TIM-3 exon 5; Set C
agagggagagagaaacaaaaacacuuacauu

SEQ ID NO: 68823 - RNA, 30 nt, Artificial Sequence
  Synthetic Oligonucleotide; TIM-3 exon 5; Set C
agagggagagagaaacaaaaacacuuacau

SEQ ID NO: 68824 - RNA, 29 nt, Artificial Sequence
  Synthetic Oligonucleotide; TIM-3 exon 5; Set C
agagggagagagaaacaaaaacacuuaca

SEQ ID NO: 68825 - RNA, 27 nt, Artificial Sequence
  Synthetic Oligonucleotide; TIM-3 exon 5; Set C
acugaagaauuuguuaucagagggaga

SEQ ID NO: 68826 - RNA, 26 nt, Artificial Sequence
  Synthetic Oligonucleotide; TIM-3 exon 5; Set C
acugaagaauuuguuaucagagggag

SEQ ID NO: 68827 - RNA, 15 nt, Artificial Sequence
  Synthetic Oligonucleotide; TIM-3 exon 6; Set C
aaagccaauaaaaau

SEQ ID NO: 68828 - RNA, 16 nt, Artificial Sequence
  Synthetic Oligonucleotide; TIM-3 exon 6; Set C
aaaagccaauaaaaau

SEQ ID NO: 68829 - RNA, 15 nt, Artificial Sequence
  Synthetic Oligonucleotide; TIM-3 exon 6; Set C
aaaagccaauaaaaa

SEQ ID NO: 68830 - RNA, 20 nt, Artificial Sequence
  Synthetic Oligonucleotide; TIM-3 exon 6; Set C
aaacaaaagccaauaaaaau

SEQ ID NO: 68831 - RNA, 22 nt, Artificial Sequence
  Synthetic Oligonucleotide; TIM-3 exon 6; Set C
gaaacaaaagccaauaaaaaug

SEQ ID NO: 68832 - RNA, 19 nt, Artificial Sequence
  Synthetic Oligonucleotide; TIM-3 exon 6; Set C
aaacaaaagccaauaaaaa

SEQ ID NO: 68833 - RNA, 21 nt, Artificial Sequence
  Synthetic Oligonucleotide; TIM-3 exon 6; Set C
gaaacaaaagccaauaaaaau

SEQ ID NO: 68834 - RNA, 23 nt, Artificial Sequence
  Synthetic Oligonucleotide; TIM-3 exon 6; Set C
ggaaacaaaagccaauaaaaaug

SEQ ID NO: 68835 - RNA, 20 nt, Artificial Sequence
  Synthetic Oligonucleotide; TIM-3 exon 6; Set C
gaaacaaaagccaauaaaaa

SEQ ID NO: 68836 - RNA, 18 nt, Artificial Sequence
  Synthetic Oligonucleotide; TIM-3 exon 6; Set C
aaacaaaagccaauaaaa

SEQ ID NO: 68837 - RNA, 22 nt, Artificial Sequence
  Synthetic Oligonucleotide; TIM-3 exon 6; Set C
ggaaacaaaagccaauaaaaau

SEQ ID NO: 68838 - RNA, 17 nt, Artificial Sequence
  Synthetic Oligonucleotide; TIM-3 exon 6; Set C
aaacaaaagccaauaaa

SEQ ID NO: 68839 - RNA, 21 nt, Artificial Sequence
  Synthetic Oligonucleotide; TIM-3 exon 6; Set C
ggaaacaaaagccaauaaaaa

SEQ ID NO: 68840 - RNA, 19 nt, Artificial Sequence
  Synthetic Oligonucleotide; TIM-3 exon 6; Set C
gaaacaaaagccaauaaaa

SEQ ID NO: 68841 - RNA, 18 nt, Artificial Sequence
  Synthetic Oligonucleotide; TIM-3 exon 6; Set C
gaaacaaaagccaauaaa

SEQ ID NO: 68842 - RNA, 20 nt, Artificial Sequence
  Synthetic Oligonucleotide; TIM-3 exon 6; Set C
ggaaacaaaagccaauaaaa

SEQ ID NO: 68843 - RNA, 19 nt, Artificial Sequence
  Synthetic Oligonucleotide; TIM-3 exon 6; Set C
ggaaacaaaagccaauaaa

SEQ ID NO: 68844 - RNA, 17 nt, Artificial Sequence
  Synthetic Oligonucleotide; TIM-3 exon 6; Set C
gaaacaaaagccaauaa

SEQ ID NO: 68845 - RNA, 18 nt, Artificial Sequence
  Synthetic Oligonucleotide; TIM-3 exon 6; Set C
ggaaacaaaagccaauaa

SEQ ID NO: 68846 - RNA, 16 nt, Artificial Sequence
  Synthetic Oligonucleotide; TIM-3 exon 6; Set C
gaaacaaaagccaaua

SEQ ID NO: 68847 - RNA, 17 nt, Artificial Sequence
  Synthetic Oligonucleotide; TIM-3 exon 6; Set C
ggaaacaaaagccaaua

SEQ ID NO: 68848 - RNA, 15 nt, Artificial Sequence
  Synthetic Oligonucleotide; TIM-3 exon 6; Set C
gaaacaaaagccaau

SEQ ID NO: 68849 - RNA, 16 nt, Artificial Sequence
  Synthetic Oligonucleotide; TIM-3 exon 6; Set C
ggaaacaaaagccaau

SEQ ID NO: 68850 - RNA, 30 nt, Artificial Sequence
  Synthetic Oligonucleotide; TIM-3 exon 6; Set C
aguaagggggaaacaaaagccaauaaaaau

SEQ ID NO: 68851 - RNA, 16 nt, Artificial Sequence
  Synthetic Oligonucleotide; TIM-3 exon 6; Set C
uuauucuuaccuuaaa

SEQ ID NO: 68852 - RNA, 15 nt, Artificial Sequence
  Synthetic Oligonucleotide; TIM-3 exon 6; Set C
uuauucuuaccuuaa

SEQ ID NO: 68853 - RNA, 17 nt, Artificial Sequence
  Synthetic Oligonucleotide; TIM-3 exon 6; Set C
auuauucuuaccuuaaa

SEQ ID NO: 68854 - RNA, 16 nt, Artificial Sequence
  Synthetic Oligonucleotide; TIM-3 exon 6; Set C
auuauucuuaccuuaa

SEQ ID NO: 68855 - RNA, 15 nt, Artificial Sequence
  Synthetic Oligonucleotide; TIM-3 exon 6; Set C
auuauucuuaccuua

SEQ ID NO: 68856 - RNA, 21 nt, Artificial Sequence
  Synthetic Oligonucleotide; TIM-3 exon 6; Set C
uuccauuauucuuaccuuaaa

SEQ ID NO: 68857 - RNA, 20 nt, Artificial Sequence
  Synthetic Oligonucleotide; TIM-3 exon 6; Set C
uuccauuauucuuaccuuaa

SEQ ID NO: 68858 - RNA, 19 nt, Artificial Sequence
  Synthetic Oligonucleotide; TIM-3 exon 6; Set C
uuccauuauucuuaccuua

SEQ ID NO: 68859 - RNA, 15 nt, Artificial Sequence
  Synthetic Oligonucleotide; TIM-3 exon 6; Set C
augcauucauaaaau

SEQ ID NO: 68860 - RNA, 16 nt, Artificial Sequence
  Synthetic Oligonucleotide; TIM-3 exon 6; Set C
aaugcauucauaaaau

SEQ ID NO: 68861 - RNA, 15 nt, Artificial Sequence
  Synthetic Oligonucleotide; TIM-3 exon 6; Set C
aaugcauucauaaaa

SEQ ID NO: 68862 - RNA, 17 nt, Artificial Sequence
  Synthetic Oligonucleotide; TIM-3 exon 6; Set C
aaaugcauucauaaaau

SEQ ID NO: 68863 - RNA, 16 nt, Artificial Sequence
  Synthetic Oligonucleotide; TIM-3 exon 6; Set C
aaaugcauucauaaaa

SEQ ID NO: 68864 - RNA, 18 nt, Artificial Sequence
  Synthetic Oligonucleotide; TIM-3 exon 6; Set C
aaaaugcauucauaaaau

SEQ ID NO: 68865 - RNA, 15 nt, Artificial Sequence
  Synthetic Oligonucleotide; TIM-3 exon 6; Set C
aaaugcauucauaaa

SEQ ID NO: 68866 - RNA, 17 nt, Artificial Sequence
  Synthetic Oligonucleotide; TIM-3 exon 6; Set C
aaaaugcauucauaaaa

SEQ ID NO: 68867 - RNA, 19 nt, Artificial Sequence
  Synthetic Oligonucleotide; TIM-3 exon 6; Set C
aaaaaugcauucauaaaau

SEQ ID NO: 68868 - RNA, 16 nt, Artificial Sequence
  Synthetic Oligonucleotide; TIM-3 exon 6; Set C
aaaaugcauucauaaa

SEQ ID NO: 68869 - RNA, 18 nt, Artificial Sequence
  Synthetic Oligonucleotide; TIM-3 exon 6; Set C
aaaaaugcauucauaaaa

SEQ ID NO: 68870 - RNA, 20 nt, Artificial Sequence
  Synthetic Oligonucleotide; TIM-3 exon 6; Set C
uaaaaaugcauucauaaaau

SEQ ID NO: 68871 - RNA, 17 nt, Artificial Sequence
  Synthetic Oligonucleotide; TIM-3 exon 6; Set C
aaaaaugcauucauaaa

SEQ ID NO: 68872 - RNA, 19 nt, Artificial Sequence
  Synthetic Oligonucleotide; TIM-3 exon 6; Set C
uaaaaaugcauucauaaaa

SEQ ID NO: 68873 - RNA, 21 nt, Artificial Sequence
  Synthetic Oligonucleotide; TIM-3 exon 6; Set C
auaaaaaugcauucauaaaau

SEQ ID NO: 68874 - RNA, 18 nt, Artificial Sequence
  Synthetic Oligonucleotide; TIM-3 exon 6; Set C
uaaaaaugcauucauaaa

SEQ ID NO: 68875 - RNA, 20 nt, Artificial Sequence
  Synthetic Oligonucleotide; TIM-3 exon 6; Set C
auaaaaaugcauucauaaaa

SEQ ID NO: 68876 - RNA, 22 nt, Artificial Sequence
  Synthetic Oligonucleotide; TIM-3 exon 6; Set C
aauaaaaaugcauucauaaaau

SEQ ID NO: 68877 - RNA, 19 nt, Artificial Sequence
  Synthetic Oligonucleotide; TIM-3 exon 6; Set C
auaaaaaugcauucauaaa

SEQ ID NO: 68878 - RNA, 21 nt, Artificial Sequence
  Synthetic Oligonucleotide; TIM-3 exon 6; Set C
aauaaaaaugcauucauaaaa

SEQ ID NO: 68879 - RNA, 23 nt, Artificial Sequence
  Synthetic Oligonucleotide; TIM-3 exon 6; Set C
caauaaaaaugcauucauaaaau

SEQ ID NO: 68880 - RNA, 20 nt, Artificial Sequence
  Synthetic Oligonucleotide; TIM-3 exon 6; Set C
aauaaaaaugcauucauaaa

SEQ ID NO: 68881 - RNA, 22 nt, Artificial Sequence
  Synthetic Oligonucleotide; TIM-3 exon 6; Set C
caauaaaaaugcauucauaaaa

SEQ ID NO: 68882 - RNA, 24 nt, Artificial Sequence
  Synthetic Oligonucleotide; TIM-3 exon 6; Set C
ccaauaaaaaugcauucauaaaau

SEQ ID NO: 68883 - RNA, 21 nt, Artificial Sequence
  Synthetic Oligonucleotide; TIM-3 exon 6; Set C
caauaaaaaugcauucauaaa

SEQ ID NO: 68884 - RNA, 23 nt, Artificial Sequence
  Synthetic Oligonucleotide; TIM-3 exon 6; Set C
ccaauaaaaaugcauucauaaaa

SEQ ID NO: 68885 - RNA, 25 nt, Artificial Sequence
  Synthetic Oligonucleotide; TIM-3 exon 6; Set C
gccaauaaaaaugcauucauaaaau

SEQ ID NO: 68886 - RNA, 22 nt, Artificial Sequence
  Synthetic Oligonucleotide; TIM-3 exon 6; Set C
ccaauaaaaaugcauucauaaa

SEQ ID NO: 68887 - RNA, 24 nt, Artificial Sequence
  Synthetic Oligonucleotide; TIM-3 exon 6; Set C
gccaauaaaaaugcauucauaaaa

SEQ ID NO: 68888 - RNA, 26 nt, Artificial Sequence
  Synthetic Oligonucleotide; TIM-3 exon 6; Set C
agccaauaaaaaugcauucauaaaau

SEQ ID NO: 68889 - RNA, 23 nt, Artificial Sequence
  Synthetic Oligonucleotide; TIM-3 exon 6; Set C
gccaauaaaaaugcauucauaaa

SEQ ID NO: 68890 - RNA, 27 nt, Artificial Sequence
  Synthetic Oligonucleotide; TIM-3 exon 6; Set C
aagccaauaaaaaugcauucauaaaau

SEQ ID NO: 68891 - RNA, 24 nt, Artificial Sequence
  Synthetic Oligonucleotide; TIM-3 exon 6; Set C
agccaauaaaaaugcauucauaaa

SEQ ID NO: 68892 - RNA, 26 nt, Artificial Sequence
  Synthetic Oligonucleotide; TIM-3 exon 6; Set C
aagccaauaaaaaugcauucauaaaa

SEQ ID NO: 68893 - RNA, 28 nt, Artificial Sequence
  Synthetic Oligonucleotide; TIM-3 exon 6; Set C
aaagccaauaaaaaugcauucauaaaau

SEQ ID NO: 68894 - RNA, 25 nt, Artificial Sequence
  Synthetic Oligonucleotide; TIM-3 exon 6; Set C
aagccaauaaaaaugcauucauaaa

SEQ ID NO: 68895 - RNA, 27 nt, Artificial Sequence
  Synthetic Oligonucleotide; TIM-3 exon 6; Set C
aaagccaauaaaaaugcauucauaaaa

SEQ ID NO: 68896 - RNA, 29 nt, Artificial Sequence
  Synthetic Oligonucleotide; TIM-3 exon 6; Set C
aaaagccaauaaaaaugcauucauaaaau

SEQ ID NO: 68897 - RNA, 26 nt, Artificial Sequence
  Synthetic Oligonucleotide; TIM-3 exon 6; Set C
aaagccaauaaaaaugcauucauaaa

SEQ ID NO: 68898 - RNA, 28 nt, Artificial Sequence
  Synthetic Oligonucleotide; TIM-3 exon 6; Set C
aaaagccaauaaaaaugcauucauaaaa

SEQ ID NO: 68899 - RNA, 30 nt, Artificial Sequence
  Synthetic Oligonucleotide; TIM-3 exon 6; Set C
caaaagccaauaaaaaugcauucauaaaau

SEQ ID NO: 68900 - RNA, 27 nt, Artificial Sequence
  Synthetic Oligonucleotide; TIM-3 exon 6; Set C
aaaagccaauaaaaaugcauucauaaa

SEQ ID NO: 68901 - RNA, 29 nt, Artificial Sequence
  Synthetic Oligonucleotide; TIM-3 exon 6; Set C
caaaagccaauaaaaaugcauucauaaaa

SEQ ID NO: 68902 - RNA, 31 nt, Artificial Sequence
  Synthetic Oligonucleotide; TIM-3 exon 6; Set C
acaaaagccaauaaaaaugcauucauaaaau

SEQ ID NO: 68903 - RNA, 28 nt, Artificial Sequence
  Synthetic Oligonucleotide; TIM-3 exon 6; Set C
caaaagccaauaaaaaugcauucauaaa

SEQ ID NO: 68904 - RNA, 30 nt, Artificial Sequence
  Synthetic Oligonucleotide; TIM-3 exon 6; Set C
acaaaagccaauaaaaaugcauucauaaaa

SEQ ID NO: 68905 - RNA, 32 nt, Artificial Sequence
  Synthetic Oligonucleotide; TIM-3 exon 6; Set C
aacaaaagccaauaaaaaugcauucauaaaau

SEQ ID NO: 68906 - RNA, 29 nt, Artificial Sequence
  Synthetic Oligonucleotide; TIM-3 exon 6; Set C
acaaaagccaauaaaaaugcauucauaaa

SEQ ID NO: 68907 - RNA, 31 nt, Artificial Sequence
  Synthetic Oligonucleotide; TIM-3 exon 6; Set C
aacaaaagccaauaaaaaugcauucauaaaa

SEQ ID NO: 68908 - RNA, 33 nt, Artificial Sequence
  Synthetic Oligonucleotide; TIM-3 exon 6; Set C
aaacaaaagccaauaaaaaugcauucauaaaau

SEQ ID NO: 68909 - RNA, 30 nt, Artificial Sequence
  Synthetic Oligonucleotide; TIM-3 exon 6; Set C
aacaaaagccaauaaaaaugcauucauaaa

SEQ ID NO: 68910 - RNA, 32 nt, Artificial Sequence
  Synthetic Oligonucleotide; TIM-3 exon 6; Set C
aaacaaaagccaauaaaaaugcauucauaaaa

SEQ ID NO: 68911 - RNA, 34 nt, Artificial Sequence
  Synthetic Oligonucleotide; TIM-3 exon 6; Set C
gaaacaaaagccaauaaaaaugcauucauaaaau

SEQ ID NO: 68912 - RNA, 31 nt, Artificial Sequence
  Synthetic Oligonucleotide; TIM-3 exon 6; Set C
aaacaaaagccaauaaaaaugcauucauaaa

SEQ ID NO: 68913 - RNA, 33 nt, Artificial Sequence
  Synthetic Oligonucleotide; TIM-3 exon 6; Set C
gaaacaaaagccaauaaaaaugcauucauaaaa

SEQ ID NO: 68914 - RNA, 35 nt, Artificial Sequence
  Synthetic Oligonucleotide; TIM-3 exon 6; Set C
ggaaacaaaagccaauaaaaaugcauucauaaaau

SEQ ID NO: 68915 - RNA, 32 nt, Artificial Sequence
  Synthetic Oligonucleotide; TIM-3 exon 6; Set C
gaaacaaaagccaauaaaaaugcauucauaaa

SEQ ID NO: 68916 - RNA, 34 nt, Artificial Sequence
  Synthetic Oligonucleotide; TIM-3 exon 6; Set C
ggaaacaaaagccaauaaaaaugcauucauaaaa

SEQ ID NO: 68917 - RNA, 33 nt, Artificial Sequence
  Synthetic Oligonucleotide; TIM-3 exon 6; Set C
ggaaacaaaagccaauaaaaaugcauucauaaa

SEQ ID NO: 68918 - RNA, 15 nt, Artificial Sequence
  Synthetic Oligonucleotide; TIM-3 exon 6; Set C
aagccaauaaaaaug

SEQ ID NO: 68919 - RNA, 16 nt, Artificial Sequence
  Synthetic Oligonucleotide; TIM-3 exon 6; Set C
aaagccaauaaaaaug

SEQ ID NO: 68920 - RNA, 17 nt, Artificial Sequence
  Synthetic Oligonucleotide; TIM-3 exon 6; Set C
aaaagccaauaaaaaug

SEQ ID NO: 68921 - RNA, 18 nt, Artificial Sequence
  Synthetic Oligonucleotide; TIM-3 exon 6; Set C
caaaagccaauaaaaaug

SEQ ID NO: 68922 - RNA, 17 nt, Artificial Sequence
  Synthetic Oligonucleotide; TIM-3 exon 6; Set C
caaaagccaauaaaaau

SEQ ID NO: 68923 - RNA, 19 nt, Artificial Sequence
  Synthetic Oligonucleotide; TIM-3 exon 6; Set C
acaaaagccaauaaaaaug

SEQ ID NO: 68924 - RNA, 40 nt, Artificial Sequence
  Synthetic Oligonucleotide; TIM-3 exon 6; Set A
guaagggggaaacaaaagccaauaaaaaugcauucauaaa

SEQ ID NO: 68925 - RNA, 16 nt, Artificial Sequence
  Synthetic Oligonucleotide; TIM-3 exon 6; Set C
caaaagccaauaaaaa

SEQ ID NO: 68926 - RNA, 18 nt, Artificial Sequence
  Synthetic Oligonucleotide; TIM-3 exon 6; Set C
acaaaagccaauaaaaau

SEQ ID NO: 68927 - RNA, 20 nt, Artificial Sequence
  Synthetic Oligonucleotide; TIM-3 exon 6; Set C
aacaaaagccaauaaaaaug

SEQ ID NO: 68928 - RNA, 15 nt, Artificial Sequence
  Synthetic Oligonucleotide; TIM-3 exon 6; Set C
caaaagccaauaaaa

SEQ ID NO: 68929 - RNA, 17 nt, Artificial Sequence
  Synthetic Oligonucleotide; TIM-3 exon 6; Set C
acaaaagccaauaaaaa

SEQ ID NO: 68930 - RNA, 19 nt, Artificial Sequence
  Synthetic Oligonucleotide; TIM-3 exon 6; Set C
aacaaaagccaauaaaaau

SEQ ID NO: 68931 - RNA, 21 nt, Artificial Sequence
  Synthetic Oligonucleotide; TIM-3 exon 6; Set C
aaacaaaagccaauaaaaaug

SEQ ID NO: 68932 - RNA, 18 nt, Artificial Sequence
  Synthetic Oligonucleotide; TIM-3 exon 6; Set C
aacaaaagccaauaaaaa

SEQ ID NO: 68933 - RNA, 16 nt, Artificial Sequence
  Synthetic Oligonucleotide; TIM-3 exon 6; Set C
acaaaagccaauaaaa

SEQ ID NO: 68934 - RNA, 15 nt, Artificial Sequence
  Synthetic Oligonucleotide; TIM-3 exon 6; Set C
acaaaagccaauaaa

SEQ ID NO: 68935 - RNA, 17 nt, Artificial Sequence
  Synthetic Oligonucleotide; TIM-3 exon 6; Set C
aacaaaagccaauaaaa

SEQ ID NO: 68936 - RNA, 16 nt, Artificial Sequence
  Synthetic Oligonucleotide; TIM-3 exon 6; Set C
aacaaaagccaauaaa

SEQ ID NO: 68937 - RNA, 15 nt, Artificial Sequence
  Synthetic Oligonucleotide; TIM-3 exon 6; Set C
aacaaaagccaauaa

SEQ ID NO: 68938 - RNA, 16 nt, Artificial Sequence
  Synthetic Oligonucleotide; TIM-3 exon 6; Set C
aaacaaaagccaauaa

SEQ ID NO: 68939 - RNA, 15 nt, Artificial Sequence
  Synthetic Oligonucleotide; TIM-3 exon 6; Set C
aaacaaaagccaaua

SEQ ID NO: 68940 - RNA, 29 nt, Artificial Sequence
  Synthetic Oligonucleotide; TIM-3 exon 6; Set C
uaagggggaaacaaaagccaauaaaaaug

SEQ ID NO: 68941 - RNA, 28 nt, Artificial Sequence
  Synthetic Oligonucleotide; TIM-3 exon 6; Set C
uaagggggaaacaaaagccaauaaaaau

SEQ ID NO: 68942 - RNA, 30 nt, Artificial Sequence
  Synthetic Oligonucleotide; TIM-3 exon 6; Set C
guaagggggaaacaaaagccaauaaaaaug

SEQ ID NO: 68943 - RNA, 27 nt, Artificial Sequence
  Synthetic Oligonucleotide; TIM-3 exon 6; Set C
uaagggggaaacaaaagccaauaaaaa

SEQ ID NO: 68944 - RNA, 29 nt, Artificial Sequence
  Synthetic Oligonucleotide; TIM-3 exon 6; Set C
guaagggggaaacaaaagccaauaaaaau

SEQ ID NO: 68945 - RNA, 31 nt, Artificial Sequence
  Synthetic Oligonucleotide; TIM-3 exon 6; Set C
aguaagggggaaacaaaagccaauaaaaaug

SEQ ID NO: 68946 - RNA, 15 nt, Artificial Sequence
  Synthetic Oligonucleotide; TIM-3 exon 6; Set C
ggaaacaaaagccaa

SEQ ID NO: 68947 - RNA, 28 nt, Artificial Sequence
  Synthetic Oligonucleotide; TIM-3 exon 6; Set C
guaagggggaaacaaaagccaauaaaaa

SEQ ID NO: 68948 - RNA, 26 nt, Artificial Sequence
  Synthetic Oligonucleotide; TIM-3 exon 6; Set C
uaagggggaaacaaaagccaauaaaa

SEQ ID NO: 68949 - RNA, 25 nt, Artificial Sequence
  Synthetic Oligonucleotide; TIM-3 exon 6; Set C
uaagggggaaacaaaagccaauaaa

SEQ ID NO: 68950 - RNA, 29 nt, Artificial Sequence
  Synthetic Oligonucleotide; TIM-3 exon 6; Set C
aguaagggggaaacaaaagccaauaaaaa

SEQ ID NO: 68951 - RNA, 27 nt, Artificial Sequence
  Synthetic Oligonucleotide; TIM-3 exon 6; Set C
guaagggggaaacaaaagccaauaaaa

SEQ ID NO: 68952 - RNA, 26 nt, Artificial Sequence
  Synthetic Oligonucleotide; TIM-3 exon 6; Set C
guaagggggaaacaaaagccaauaaa

SEQ ID NO: 68953 - RNA, 28 nt, Artificial Sequence
  Synthetic Oligonucleotide; TIM-3 exon 6; Set C
aguaagggggaaacaaaagccaauaaaa

SEQ ID NO: 68954 - RNA, 27 nt, Artificial Sequence
  Synthetic Oligonucleotide; TIM-3 exon 6; Set C
aguaagggggaaacaaaagccaauaaa

SEQ ID NO: 68955 - RNA, 25 nt, Artificial Sequence
  Synthetic Oligonucleotide; TIM-3 exon 6; Set C
guaagggggaaacaaaagccaauaa

SEQ ID NO: 68956 - RNA, 26 nt, Artificial Sequence
  Synthetic Oligonucleotide; TIM-3 exon 6; Set C
aguaagggggaaacaaaagccaauaa

SEQ ID NO: 68957 - RNA, 24 nt, Artificial Sequence
  Synthetic Oligonucleotide; TIM-3 exon 6; Set C
guaagggggaaacaaaagccaaua

SEQ ID NO: 68958 - RNA, 25 nt, Artificial Sequence
  Synthetic Oligonucleotide; TIM-3 exon 6; Set C
aguaagggggaaacaaaagccaaua

SEQ ID NO: 68959 - RNA, 23 nt, Artificial Sequence
  Synthetic Oligonucleotide; TIM-3 exon 6; Set C
guaagggggaaacaaaagccaau

SEQ ID NO: 68960 - RNA, 24 nt, Artificial Sequence
  Synthetic Oligonucleotide; TIM-3 exon 6; Set C
aguaagggggaaacaaaagccaau

SEQ ID NO: 68961 - RNA, 22 nt, Artificial Sequence
  Synthetic Oligonucleotide; TIM-3 exon 6; Set C
guaagggggaaacaaaagccaa

SEQ ID NO: 68962 - RNA, 23 nt, Artificial Sequence
  Synthetic Oligonucleotide; TIM-3 exon 6; Set C
aguaagggggaaacaaaagccaa

SEQ ID NO: 68963 - RNA, 21 nt, Artificial Sequence
  Synthetic Oligonucleotide; TIM-3 exon 6; Set C
guaagggggaaacaaaagcca

SEQ ID NO: 68964 - RNA, 22 nt, Artificial Sequence
  Synthetic Oligonucleotide; TIM-3 exon 6; Set C
aguaagggggaaacaaaagcca

SEQ ID NO: 68965 - RNA, 20 nt, Artificial Sequence
  Synthetic Oligonucleotide; TIM-3 exon 6; Set C
guaagggggaaacaaaagcc

SEQ ID NO: 68966 - RNA, 21 nt, Artificial Sequence
  Synthetic Oligonucleotide; TIM-3 exon 6; Set C
aguaagggggaaacaaaagcc

SEQ ID NO: 68967 - RNA, 15 nt, Artificial Sequence
  Synthetic Oligonucleotide; TIM-3 exon 6; Set C
uauucuuaccuuaaa

SEQ ID NO: 68968 - RNA, 18 nt, Artificial Sequence
  Synthetic Oligonucleotide; TIM-3 exon 6; Set C
uuccauuauucuuaccuu

SEQ ID NO: 68969 - RNA, 17 nt, Artificial Sequence
  Synthetic Oligonucleotide; TIM-3 exon 6; Set C
uuccauuauucuuaccu

SEQ ID NO: 68970 - RNA, 16 nt, Artificial Sequence
  Synthetic Oligonucleotide; TIM-3 exon 6; Set C
uuccauuauucuuacc

SEQ ID NO: 68971 - RNA, 15 nt, Artificial Sequence
  Synthetic Oligonucleotide; TIM-3 exon 6; Set C
uuccauuauucuuac

SEQ ID NO: 68972 - RNA, 18 nt, Artificial Sequence
  Synthetic Oligonucleotide; TIM-3 exon 6; Set C
gggacuuccaagauucuc

SEQ ID NO: 68973 - RNA, 17 nt, Artificial Sequence
  Synthetic Oligonucleotide; TIM-3 exon 6; Set C
gggacuuccaagauucu

SEQ ID NO: 68974 - RNA, 16 nt, Artificial Sequence
  Synthetic Oligonucleotide; TIM-3 exon 6; Set C
gggacuuccaagauuc

SEQ ID NO: 68975 - RNA, 15 nt, Artificial Sequence
  Synthetic Oligonucleotide; TIM-3 exon 6; Set C
gggacuuccaagauu

SEQ ID NO: 68976 - RNA, 21 nt, Artificial Sequence
  Synthetic Oligonucleotide; TIM-3 exon 6; Set C
aaaaaugcauucauaaaauaa

SEQ ID NO: 68977 - RNA, 20 nt, Artificial Sequence
  Synthetic Oligonucleotide; TIM-3 exon 6; Set C
aaaaaugcauucauaaaaua

SEQ ID NO: 68978 - RNA, 21 nt, Artificial Sequence
  Synthetic Oligonucleotide; TIM-3 exon 6; Set C
uaaaaaugcauucauaaaaua

SEQ ID NO: 68979 - RNA, 22 nt, Artificial Sequence
  Synthetic Oligonucleotide; TIM-3 exon 6; Set C
auaaaaaugcauucauaaaaua

SEQ ID NO: 68980 - RNA, 24 nt, Artificial Sequence
  Synthetic Oligonucleotide; TIM-3 exon 6; Set C
aauaaaaaugcauucauaaaauaa

SEQ ID NO: 68981 - RNA, 15 nt, Artificial Sequence
  Synthetic Oligonucleotide; TIM-3 exon 6; Set C
aaaaugcauucauaa

SEQ ID NO: 68982 - RNA, 23 nt, Artificial Sequence
  Synthetic Oligonucleotide; TIM-3 exon 6; Set C
aauaaaaaugcauucauaaaaua

SEQ ID NO: 68983 - RNA, 16 nt, Artificial Sequence
  Synthetic Oligonucleotide; TIM-3 exon 6; Set C
aaaaaugcauucauaa

SEQ ID NO: 68984 - RNA, 17 nt, Artificial Sequence
  Synthetic Oligonucleotide; TIM-3 exon 6; Set C
uaaaaaugcauucauaa

SEQ ID NO: 68985 - RNA, 15 nt, Artificial Sequence
  Synthetic Oligonucleotide; TIM-3 exon 6; Set C
aaaaaugcauucaua

SEQ ID NO: 68986 - RNA, 18 nt, Artificial Sequence
  Synthetic Oligonucleotide; TIM-3 exon 6; Set C
auaaaaaugcauucauaa

SEQ ID NO: 68987 - RNA, 16 nt, Artificial Sequence
  Synthetic Oligonucleotide; TIM-3 exon 6; Set C
uaaaaaugcauucaua

SEQ ID NO: 68988 - RNA, 19 nt, Artificial Sequence
  Synthetic Oligonucleotide; TIM-3 exon 6; Set C
aauaaaaaugcauucauaa

SEQ ID NO: 68989 - RNA, 17 nt, Artificial Sequence
  Synthetic Oligonucleotide; TIM-3 exon 6; Set C
auaaaaaugcauucaua

SEQ ID NO: 68990 - RNA, 15 nt, Artificial Sequence
  Synthetic Oligonucleotide; TIM-3 exon 6; Set C
uaaaaaugcauucau

SEQ ID NO: 68991 - RNA, 20 nt, Artificial Sequence
  Synthetic Oligonucleotide; TIM-3 exon 6; Set C
caauaaaaaugcauucauaa

SEQ ID NO: 68992 - RNA, 18 nt, Artificial Sequence
  Synthetic Oligonucleotide; TIM-3 exon 6; Set C
aauaaaaaugcauucaua

SEQ ID NO: 68993 - RNA, 16 nt, Artificial Sequence
  Synthetic Oligonucleotide; TIM-3 exon 6; Set C
auaaaaaugcauucau

SEQ ID NO: 68994 - RNA, 25 nt, Artificial Sequence
  Synthetic Oligonucleotide; TIM-3 exon 6; Set C
agccaauaaaaaugcauucauaaaa

SEQ ID NO: 68995 - RNA, 21 nt, Artificial Sequence
  Synthetic Oligonucleotide; TIM-3 exon 6; Set C
ccaauaaaaaugcauucauaa

SEQ ID NO: 68996 - RNA, 19 nt, Artificial Sequence
  Synthetic Oligonucleotide; TIM-3 exon 6; Set C
caauaaaaaugcauucaua

SEQ ID NO: 68997 - RNA, 17 nt, Artificial Sequence
  Synthetic Oligonucleotide; TIM-3 exon 6; Set C
aauaaaaaugcauucau

SEQ ID NO: 68998 - RNA, 22 nt, Artificial Sequence
  Synthetic Oligonucleotide; TIM-3 exon 6; Set C
gccaauaaaaaugcauucauaa

SEQ ID NO: 68999 - RNA, 20 nt, Artificial Sequence
  Synthetic Oligonucleotide; TIM-3 exon 6; Set C
ccaauaaaaaugcauucaua

SEQ ID NO: 69000 - RNA, 23 nt, Artificial Sequence
  Synthetic Oligonucleotide; TIM-3 exon 6; Set C
agccaauaaaaaugcauucauaa

SEQ ID NO: 69001 - RNA, 21 nt, Artificial Sequence
  Synthetic Oligonucleotide; TIM-3 exon 6; Set C
gccaauaaaaaugcauucaua

SEQ ID NO: 69002 - RNA, 24 nt, Artificial Sequence
  Synthetic Oligonucleotide; TIM-3 exon 6; Set C
aagccaauaaaaaugcauucauaa

SEQ ID NO: 69003 - RNA, 22 nt, Artificial Sequence
  Synthetic Oligonucleotide; TIM-3 exon 6; Set C
agccaauaaaaaugcauucaua

SEQ ID NO: 69004 - RNA, 25 nt, Artificial Sequence
  Synthetic Oligonucleotide; TIM-3 exon 6; Set C
aaagccaauaaaaaugcauucauaa

SEQ ID NO: 69005 - RNA, 23 nt, Artificial Sequence
  Synthetic Oligonucleotide; TIM-3 exon 6; Set C
aagccaauaaaaaugcauucaua

SEQ ID NO: 69006 - RNA, 26 nt, Artificial Sequence
  Synthetic Oligonucleotide; TIM-3 exon 6; Set C
aaaagccaauaaaaaugcauucauaa

SEQ ID NO: 69007 - RNA, 24 nt, Artificial Sequence
  Synthetic Oligonucleotide; TIM-3 exon 6; Set C
aaagccaauaaaaaugcauucaua

SEQ ID NO: 69008 - RNA, 27 nt, Artificial Sequence
  Synthetic Oligonucleotide; TIM-3 exon 6; Set C
caaaagccaauaaaaaugcauucauaa

SEQ ID NO: 69009 - RNA, 25 nt, Artificial Sequence
  Synthetic Oligonucleotide; TIM-3 exon 6; Set C
aaaagccaauaaaaaugcauucaua

SEQ ID NO: 69010 - RNA, 28 nt, Artificial Sequence
  Synthetic Oligonucleotide; TIM-3 exon 6; Set C
acaaaagccaauaaaaaugcauucauaa

SEQ ID NO: 69011 - RNA, 26 nt, Artificial Sequence
  Synthetic Oligonucleotide; TIM-3 exon 6; Set C
caaaagccaauaaaaaugcauucaua

SEQ ID NO: 69012 - RNA, 29 nt, Artificial Sequence
  Synthetic Oligonucleotide; TIM-3 exon 6; Set C
aacaaaagccaauaaaaaugcauucauaa

SEQ ID NO: 69013 - RNA, 27 nt, Artificial Sequence
  Synthetic Oligonucleotide; TIM-3 exon 6; Set C
acaaaagccaauaaaaaugcauucaua

SEQ ID NO: 69014 - RNA, 30 nt, Artificial Sequence
  Synthetic Oligonucleotide; TIM-3 exon 6; Set C
aaacaaaagccaauaaaaaugcauucauaa

SEQ ID NO: 69015 - RNA, 28 nt, Artificial Sequence
  Synthetic Oligonucleotide; TIM-3 exon 6; Set C
aacaaaagccaauaaaaaugcauucaua

SEQ ID NO: 69016 - RNA, 31 nt, Artificial Sequence
  Synthetic Oligonucleotide; TIM-3 exon 6; Set C
gaaacaaaagccaauaaaaaugcauucauaa

SEQ ID NO: 69017 - RNA, 29 nt, Artificial Sequence
  Synthetic Oligonucleotide; TIM-3 exon 6; Set C
aaacaaaagccaauaaaaaugcauucaua

SEQ ID NO: 69018 - RNA, 32 nt, Artificial Sequence
  Synthetic Oligonucleotide; TIM-3 exon 6; Set C
ggaaacaaaagccaauaaaaaugcauucauaa

SEQ ID NO: 69019 - RNA, 30 nt, Artificial Sequence
  Synthetic Oligonucleotide; TIM-3 exon 6; Set C
gaaacaaaagccaauaaaaaugcauucaua

SEQ ID NO: 69020 - RNA, 31 nt, Artificial Sequence
  Synthetic Oligonucleotide; TIM-3 exon 6; Set C
ggaaacaaaagccaauaaaaaugcauucaua

SEQ ID NO: 69021 - RNA, 29 nt, Artificial Sequence
  Synthetic Oligonucleotide; TIM-3 exon 6; Set C
gaaacaaaagccaauaaaaaugcauucau

SEQ ID NO: 69022 - RNA, 30 nt, Artificial Sequence
  Synthetic Oligonucleotide; TIM-3 exon 6; Set C
ggaaacaaaagccaauaaaaaugcauucau

SEQ ID NO: 69023 - RNA, 40 nt, Artificial Sequence
  Synthetic Oligonucleotide; TIM-3 exon 6; Set C
uaagggggaaacaaaagccaauaaaaaugcauucauaaaa

SEQ ID NO: 69024 - RNA, 39 nt, Artificial Sequence
  Synthetic Oligonucleotide; TIM-3 exon 6; Set C
uaagggggaaacaaaagccaauaaaaaugcauucauaaa

SEQ ID NO: 69025 - RNA, 38 nt, Artificial Sequence
  Synthetic Oligonucleotide; TIM-3 exon 6; Set A
uaagggggaaacaaaagccaauaaaaaugcauucauaa

SEQ ID NO: 69026 - RNA, 39 nt, Artificial Sequence
  Synthetic Oligonucleotide; TIM-3 exon 6; Set A
guaagggggaaacaaaagccaauaaaaaugcauucauaa

SEQ ID NO: 69027 - RNA, 37 nt, Artificial Sequence
  Synthetic Oligonucleotide; TIM-3 exon 6; Set A
uaagggggaaacaaaagccaauaaaaaugcauucaua

SEQ ID NO: 69028 - RNA, 40 nt, Artificial Sequence
  Synthetic Oligonucleotide; TIM-3 exon 6; Set A
aguaagggggaaacaaaagccaauaaaaaugcauucauaa

SEQ ID NO: 69029 - RNA, 38 nt, Artificial Sequence
  Synthetic Oligonucleotide; TIM-3 exon 6; Set A
guaagggggaaacaaaagccaauaaaaaugcauucaua

SEQ ID NO: 69030 - RNA, 39 nt, Artificial Sequence
  Synthetic Oligonucleotide; TIM-3 exon 6; Set A
aguaagggggaaacaaaagccaauaaaaaugcauucaua

SEQ ID NO: 69031 - RNA, 37 nt, Artificial Sequence
  Synthetic Oligonucleotide; TIM-3 exon 6; Set A
guaagggggaaacaaaagccaauaaaaaugcauucau

SEQ ID NO: 69032 - RNA, 38 nt, Artificial Sequence
  Synthetic Oligonucleotide; TIM-3 exon 6; Set A
aguaagggggaaacaaaagccaauaaaaaugcauucau

SEQ ID NO: 69033 - RNA, 24 nt, Artificial Sequence
  Synthetic Oligonucleotide; TIM-3 exon 6; Set C
uaagggggaaacaaaagccaauaa

SEQ ID NO: 69034 - RNA, 23 nt, Artificial Sequence
  Synthetic Oligonucleotide; TIM-3 exon 6; Set C
uaagggggaaacaaaagccaaua

SEQ ID NO: 69035 - RNA, 22 nt, Artificial Sequence
  Synthetic Oligonucleotide; TIM-3 exon 6; Set C
uaagggggaaacaaaagccaau

SEQ ID NO: 69036 - RNA, 21 nt, Artificial Sequence
  Synthetic Oligonucleotide; TIM-3 exon 6; Set C
uaagggggaaacaaaagccaa

SEQ ID NO: 69037 - RNA, 20 nt, Artificial Sequence
  Synthetic Oligonucleotide; TIM-3 exon 6; Set C
uaagggggaaacaaaagcca

SEQ ID NO: 69038 - RNA, 19 nt, Artificial Sequence
  Synthetic Oligonucleotide; TIM-3 exon 6; Set C
uaagggggaaacaaaagcc

SEQ ID NO: 69039 - RNA, 19 nt, Artificial Sequence
  Synthetic Oligonucleotide; TIM-3 exon 6; Set C
guaagggggaaacaaaagc

SEQ ID NO: 69040 - RNA, 18 nt, Artificial Sequence
  Synthetic Oligonucleotide; TIM-3 exon 6; Set C
guaagggggaaacaaaag

SEQ ID NO: 69041 - RNA, 20 nt, Artificial Sequence
  Synthetic Oligonucleotide; TIM-3 exon 6; Set C
aguaagggggaaacaaaagc

SEQ ID NO: 69042 - RNA, 17 nt, Artificial Sequence
  Synthetic Oligonucleotide; TIM-3 exon 6; Set C
guaagggggaaacaaaa

SEQ ID NO: 69043 - RNA, 19 nt, Artificial Sequence
  Synthetic Oligonucleotide; TIM-3 exon 6; Set C
aguaagggggaaacaaaag

SEQ ID NO: 69044 - RNA, 16 nt, Artificial Sequence
  Synthetic Oligonucleotide; TIM-3 exon 6; Set C
guaagggggaaacaaa

SEQ ID NO: 69045 - RNA, 18 nt, Artificial Sequence
  Synthetic Oligonucleotide; TIM-3 exon 6; Set C
aguaagggggaaacaaaa

SEQ ID NO: 69046 - RNA, 17 nt, Artificial Sequence
  Synthetic Oligonucleotide; TIM-3 exon 6; Set C
aguaagggggaaacaaa

SEQ ID NO: 69047 - RNA, 15 nt, Artificial Sequence
  Synthetic Oligonucleotide; TIM-3 exon 6; Set C
guaagggggaaacaa

SEQ ID NO: 69048 - RNA, 16 nt, Artificial Sequence
  Synthetic Oligonucleotide; TIM-3 exon 6; Set C
aguaagggggaaacaa

SEQ ID NO: 69049 - RNA, 15 nt, Artificial Sequence
  Synthetic Oligonucleotide; TIM-3 exon 6; Set C
aguaagggggaaaca

SEQ ID NO: 69050 - RNA, 40 nt, Artificial Sequence
  Synthetic Oligonucleotide; TIM-3 exon 6; Set A
uaugagaauacccuaguaagggggaaacaaaagccaauaa

SEQ ID NO: 69051 - RNA, 39 nt, Artificial Sequence
  Synthetic Oligonucleotide; TIM-3 exon 6; Set A
uaugagaauacccuaguaagggggaaacaaaagccaaua

SEQ ID NO: 69052 - RNA, 38 nt, Artificial Sequence
  Synthetic Oligonucleotide; TIM-3 exon 6; Set A
uaugagaauacccuaguaagggggaaacaaaagccaau

SEQ ID NO: 69053 - RNA, 40 nt, Artificial Sequence
  Synthetic Oligonucleotide; TIM-3 exon 6; Set A
cuaugagaauacccuaguaagggggaaacaaaagccaaua

SEQ ID NO: 69054 - RNA, 39 nt, Artificial Sequence
  Synthetic Oligonucleotide; TIM-3 exon 6; Set A
cuaugagaauacccuaguaagggggaaacaaaagccaau

SEQ ID NO: 69055 - RNA, 40 nt, Artificial Sequence
  Synthetic Oligonucleotide; TIM-3 exon 6; Set C
gcuaugagaauacccuaguaagggggaaacaaaagccaau

SEQ ID NO: 69056 - RNA, 38 nt, Artificial Sequence
  Synthetic Oligonucleotide; TIM-3 exon 6; Set A
cuaugagaauacccuaguaagggggaaacaaaagccaa

SEQ ID NO: 69057 - RNA, 39 nt, Artificial Sequence
  Synthetic Oligonucleotide; TIM-3 exon 6; Set C
gcuaugagaauacccuaguaagggggaaacaaaagccaa

SEQ ID NO: 69058 - RNA, 40 nt, Artificial Sequence
  Synthetic Oligonucleotide; TIM-3 exon 6; Set C
ugcuaugagaauacccuaguaagggggaaacaaaagccaa

SEQ ID NO: 69059 - RNA, 39 nt, Artificial Sequence
  Synthetic Oligonucleotide; TIM-3 exon 6; Set C
ugcuaugagaauacccuaguaagggggaaacaaaagcca

SEQ ID NO: 69060 - RNA, 40 nt, Artificial Sequence
  Synthetic Oligonucleotide; TIM-3 exon 6; Set C
uugcuaugagaauacccuaguaagggggaaacaaaagcca

SEQ ID NO: 69061 - RNA, 39 nt, Artificial Sequence
  Synthetic Oligonucleotide; TIM-3 exon 6; Set C
uugcuaugagaauacccuaguaagggggaaacaaaagcc

SEQ ID NO: 69062 - RNA, 40 nt, Artificial Sequence
  Synthetic Oligonucleotide; TIM-3 exon 6; Set C
uuugcuaugagaauacccuaguaagggggaaacaaaagcc

SEQ ID NO: 69063 - RNA, 23 nt, Artificial Sequence
  Synthetic Oligonucleotide; TIM-3 exon 6; Set C
uuugcuaugagaauacccuagua

SEQ ID NO: 69064 - RNA, 26 nt, Artificial Sequence
  Synthetic Oligonucleotide; TIM-3 exon 6; Set C
uaaauucuguaucuucucuuugcuau

SEQ ID NO: 69065 - RNA, 27 nt, Artificial Sequence
  Synthetic Oligonucleotide; TIM-3 exon 6; Set C
uuaaauucuguaucuucucuuugcuau

SEQ ID NO: 69066 - RNA, 32 nt, Artificial Sequence
  Synthetic Oligonucleotide; TIM-3 exon 6; Set A
uuaccuuaaauucuguaucuucucuuugcuau

SEQ ID NO: 69067 - RNA, 38 nt, Artificial Sequence
  Synthetic Oligonucleotide; TIM-3 exon 6; Set A
uuauucuuaccuuaaauucuguaucuucucuuugcuau

SEQ ID NO: 69068 - RNA, 39 nt, Artificial Sequence
  Synthetic Oligonucleotide; TIM-3 exon 6; Set A
auuauucuuaccuuaaauucuguaucuucucuuugcuau

SEQ ID NO: 69069 - RNA, 37 nt, Artificial Sequence
  Synthetic Oligonucleotide; TIM-3 exon 6; Set A
uuauucuuaccuuaaauucuguaucuucucuuugcua

SEQ ID NO: 69070 - RNA, 36 nt, Artificial Sequence
  Synthetic Oligonucleotide; TIM-3 exon 6; Set A
uuauucuuaccuuaaauucuguaucuucucuuugcu

SEQ ID NO: 69071 - RNA, 38 nt, Artificial Sequence
  Synthetic Oligonucleotide; TIM-3 exon 6; Set A
auuauucuuaccuuaaauucuguaucuucucuuugcua

SEQ ID NO: 69072 - RNA, 35 nt, Artificial Sequence
  Synthetic Oligonucleotide; TIM-3 exon 6; Set A
uuauucuuaccuuaaauucuguaucuucucuuugc

SEQ ID NO: 69073 - RNA, 37 nt, Artificial Sequence
  Synthetic Oligonucleotide; TIM-3 exon 6; Set A
auuauucuuaccuuaaauucuguaucuucucuuugcu

SEQ ID NO: 69074 - RNA, 34 nt, Artificial Sequence
  Synthetic Oligonucleotide; TIM-3 exon 6; Set C
uuauucuuaccuuaaauucuguaucuucucuuug

SEQ ID NO: 69075 - RNA, 36 nt, Artificial Sequence
  Synthetic Oligonucleotide; TIM-3 exon 6; Set A
auuauucuuaccuuaaauucuguaucuucucuuugc

SEQ ID NO: 69076 - RNA, 33 nt, Artificial Sequence
  Synthetic Oligonucleotide; TIM-3 exon 6; Set C
uuauucuuaccuuaaauucuguaucuucucuuu

SEQ ID NO: 69077 - RNA, 35 nt, Artificial Sequence
  Synthetic Oligonucleotide; TIM-3 exon 6; Set C
auuauucuuaccuuaaauucuguaucuucucuuug

SEQ ID NO: 69078 - RNA, 34 nt, Artificial Sequence
  Synthetic Oligonucleotide; TIM-3 exon 6; Set C
auuauucuuaccuuaaauucuguaucuucucuuu

SEQ ID NO: 69079 - RNA, 40 nt, Artificial Sequence
  Synthetic Oligonucleotide; TIM-3 exon 6; Set A
uuccauuauucuuaccuuaaauucuguaucuucucuuugc

SEQ ID NO: 69080 - RNA, 39 nt, Artificial Sequence
  Synthetic Oligonucleotide; TIM-3 exon 6; Set A
uuccauuauucuuaccuuaaauucuguaucuucucuuug

SEQ ID NO: 69081 - RNA, 38 nt, Artificial Sequence
  Synthetic Oligonucleotide; TIM-3 exon 6; Set A
uuccauuauucuuaccuuaaauucuguaucuucucuuu

SEQ ID NO: 69082 - RNA, 28 nt, Artificial Sequence
  Synthetic Oligonucleotide; TIM-3 exon 6; Set C
aaccccauuccauuauucuuaccuuaaa

SEQ ID NO: 69083 - RNA, 27 nt, Artificial Sequence
  Synthetic Oligonucleotide; TIM-3 exon 6; Set A
aaccccauuccauuauucuuaccuuaa

SEQ ID NO: 69084 - RNA, 29 nt, Artificial Sequence
  Synthetic Oligonucleotide; TIM-3 exon 6; Set A
caaccccauuccauuauucuuaccuuaaa

SEQ ID NO: 69085 - RNA, 28 nt, Artificial Sequence
  Synthetic Oligonucleotide; TIM-3 exon 6; Set A
caaccccauuccauuauucuuaccuuaa

SEQ ID NO: 69086 - RNA, 26 nt, Artificial Sequence
  Synthetic Oligonucleotide; TIM-3 exon 6; Set A
aaccccauuccauuauucuuaccuua

SEQ ID NO: 69087 - RNA, 27 nt, Artificial Sequence
  Synthetic Oligonucleotide; TIM-3 exon 6; Set A
caaccccauuccauuauucuuaccuua

SEQ ID NO: 69088 - RNA, 40 nt, Artificial Sequence
  Synthetic Oligonucleotide; TIM-3 exon 6; Set C
cucaccuuuucccaaccccauuccauuauucuuaccuuaa

SEQ ID NO: 69089 - RNA, 39 nt, Artificial Sequence
  Synthetic Oligonucleotide; TIM-3 exon 6; Set C
cucaccuuuucccaaccccauuccauuauucuuaccuua

SEQ ID NO: 69090 - RNA, 40 nt, Artificial Sequence
  Synthetic Oligonucleotide; TIM-3 exon 6; Set C
ucucaccuuuucccaaccccauuccauuauucuuaccuua

SEQ ID NO: 69091 - RNA, 40 nt, Artificial Sequence
  Synthetic Oligonucleotide; TIM-3 exon 6; Set C
uucucaccuuuucccaaccccauuccauuauucuuaccuu

SEQ ID NO: 69092 - RNA, 39 nt, Artificial Sequence
  Synthetic Oligonucleotide; TIM-3 exon 6; Set C
uucucaccuuuucccaaccccauuccauuauucuuaccu

SEQ ID NO: 69093 - RNA, 40 nt, Artificial Sequence
  Synthetic Oligonucleotide; TIM-3 exon 6; Set C
auucucaccuuuucccaaccccauuccauuauucuuaccu

SEQ ID NO: 69094 - RNA, 39 nt, Artificial Sequence
  Synthetic Oligonucleotide; TIM-3 exon 6; Set C
auucucaccuuuucccaaccccauuccauuauucuuacc

SEQ ID NO: 69095 - RNA, 40 nt, Artificial Sequence
  Synthetic Oligonucleotide; TIM-3 exon 6; Set C
gauucucaccuuuucccaaccccauuccauuauucuuacc

SEQ ID NO: 69096 - RNA, 38 nt, Artificial Sequence
  Synthetic Oligonucleotide; TIM-3 exon 6; Set C
auucucaccuuuucccaaccccauuccauuauucuuac

SEQ ID NO: 69097 - RNA, 39 nt, Artificial Sequence
  Synthetic Oligonucleotide; TIM-3 exon 6; Set C
gauucucaccuuuucccaaccccauuccauuauucuuac

SEQ ID NO: 69098 - RNA, 38 nt, Artificial Sequence
  Synthetic Oligonucleotide; TIM-3 exon 6; Set C
gauucucaccuuuucccaaccccauuccauuauucuua

SEQ ID NO: 69099 - RNA, 31 nt, Artificial Sequence
  Synthetic Oligonucleotide; TIM-3 exon 6; Set C
auucucaccuuuucccaaccccauuccauua

SEQ ID NO: 69100 - RNA, 32 nt, Artificial Sequence
  Synthetic Oligonucleotide; TIM-3 exon 6; Set C
gauucucaccuuuucccaaccccauuccauua

SEQ ID NO: 69101 - RNA, 31 nt, Artificial Sequence
  Synthetic Oligonucleotide; TIM-3 exon 6; Set C
gauucucaccuuuucccaaccccauuccauu

SEQ ID NO: 69102 - RNA, 37 nt, Artificial Sequence
  Synthetic Oligonucleotide; TIM-3 exon 6; Set C
uccaagauucucaccuuuucccaaccccauuccauua

SEQ ID NO: 69103 - RNA, 38 nt, Artificial Sequence
  Synthetic Oligonucleotide; TIM-3 exon 6; Set C
uuccaagauucucaccuuuucccaaccccauuccauua

SEQ ID NO: 69104 - RNA, 36 nt, Artificial Sequence
  Synthetic Oligonucleotide; TIM-3 exon 6; Set C
uccaagauucucaccuuuucccaaccccauuccauu

SEQ ID NO: 69105 - RNA, 39 nt, Artificial Sequence
  Synthetic Oligonucleotide; TIM-3 exon 6; Set C
cuuccaagauucucaccuuuucccaaccccauuccauua

SEQ ID NO: 69106 - RNA, 37 nt, Artificial Sequence
  Synthetic Oligonucleotide; TIM-3 exon 6; Set C
uuccaagauucucaccuuuucccaaccccauuccauu

SEQ ID NO: 69107 - RNA, 38 nt, Artificial Sequence
  Synthetic Oligonucleotide; TIM-3 exon 6; Set C
cuuccaagauucucaccuuuucccaaccccauuccauu

SEQ ID NO: 69108 - RNA, 38 nt, Artificial Sequence
  Synthetic Oligonucleotide; TIM-3 exon 6; Set C
gggacuuccaagauucucaccuuuucccaaccccauuc

SEQ ID NO: 69109 - RNA, 15 nt, Artificial Sequence
  Synthetic Oligonucleotide; TIM-3 exon 6; Set C
cuuccaagauucuca

SEQ ID NO: 69110 - RNA, 19 nt, Artificial Sequence
  Synthetic Oligonucleotide; TIM-3 exon 6; Set C
gggacuuccaagauucuca

SEQ ID NO: 69111 - RNA, 19 nt, Artificial Sequence
  Synthetic Oligonucleotide; TIM-3 exon 6; Set C
augcauucauaaaauaaau

SEQ ID NO: 69112 - RNA, 18 nt, Artificial Sequence
  Synthetic Oligonucleotide; TIM-3 exon 6; Set C
augcauucauaaaauaaa

SEQ ID NO: 69113 - RNA, 20 nt, Artificial Sequence
  Synthetic Oligonucleotide; TIM-3 exon 6; Set C
aaugcauucauaaaauaaau

SEQ ID NO: 69114 - RNA, 17 nt, Artificial Sequence
  Synthetic Oligonucleotide; TIM-3 exon 6; Set C
augcauucauaaaauaa

SEQ ID NO: 69115 - RNA, 19 nt, Artificial Sequence
  Synthetic Oligonucleotide; TIM-3 exon 6; Set C
aaugcauucauaaaauaaa

SEQ ID NO: 69116 - RNA, 21 nt, Artificial Sequence
  Synthetic Oligonucleotide; TIM-3 exon 6; Set C
aaaugcauucauaaaauaaau

SEQ ID NO: 69117 - RNA, 16 nt, Artificial Sequence
  Synthetic Oligonucleotide; TIM-3 exon 6; Set C
augcauucauaaaaua

SEQ ID NO: 69118 - RNA, 18 nt, Artificial Sequence
  Synthetic Oligonucleotide; TIM-3 exon 6; Set C
aaugcauucauaaaauaa

SEQ ID NO: 69119 - RNA, 20 nt, Artificial Sequence
  Synthetic Oligonucleotide; TIM-3 exon 6; Set C
aaaugcauucauaaaauaaa

SEQ ID NO: 69120 - RNA, 22 nt, Artificial Sequence
  Synthetic Oligonucleotide; TIM-3 exon 6; Set C
aaaaugcauucauaaaauaaau

SEQ ID NO: 69121 - RNA, 17 nt, Artificial Sequence
  Synthetic Oligonucleotide; TIM-3 exon 6; Set C
aaugcauucauaaaaua

SEQ ID NO: 69122 - RNA, 19 nt, Artificial Sequence
  Synthetic Oligonucleotide; TIM-3 exon 6; Set C
aaaugcauucauaaaauaa

SEQ ID NO: 69123 - RNA, 21 nt, Artificial Sequence
  Synthetic Oligonucleotide; TIM-3 exon 6; Set C
aaaaugcauucauaaaauaaa

SEQ ID NO: 69124 - RNA, 23 nt, Artificial Sequence
  Synthetic Oligonucleotide; TIM-3 exon 6; Set C
aaaaaugcauucauaaaauaaau

SEQ ID NO: 69125 - RNA, 18 nt, Artificial Sequence
  Synthetic Oligonucleotide; TIM-3 exon 6; Set C
aaaugcauucauaaaaua

SEQ ID NO: 69126 - RNA, 20 nt, Artificial Sequence
  Synthetic Oligonucleotide; TIM-3 exon 6; Set C
aaaaugcauucauaaaauaa

SEQ ID NO: 69127 - RNA, 22 nt, Artificial Sequence
  Synthetic Oligonucleotide; TIM-3 exon 6; Set C
aaaaaugcauucauaaaauaaa

SEQ ID NO: 69128 - RNA, 24 nt, Artificial Sequence
  Synthetic Oligonucleotide; TIM-3 exon 6; Set C
uaaaaaugcauucauaaaauaaau

SEQ ID NO: 69129 - RNA, 19 nt, Artificial Sequence
  Synthetic Oligonucleotide; TIM-3 exon 6; Set C
aaaaugcauucauaaaaua

SEQ ID NO: 69130 - RNA, 23 nt, Artificial Sequence
  Synthetic Oligonucleotide; TIM-3 exon 6; Set C
uaaaaaugcauucauaaaauaaa

SEQ ID NO: 69131 - RNA, 25 nt, Artificial Sequence
  Synthetic Oligonucleotide; TIM-3 exon 6; Set C
auaaaaaugcauucauaaaauaaau

SEQ ID NO: 69132 - RNA, 22 nt, Artificial Sequence
  Synthetic Oligonucleotide; TIM-3 exon 6; Set C
uaaaaaugcauucauaaaauaa

SEQ ID NO: 69133 - RNA, 24 nt, Artificial Sequence
  Synthetic Oligonucleotide; TIM-3 exon 6; Set C
auaaaaaugcauucauaaaauaaa

SEQ ID NO: 69134 - RNA, 26 nt, Artificial Sequence
  Synthetic Oligonucleotide; TIM-3 exon 6; Set C
aauaaaaaugcauucauaaaauaaau

SEQ ID NO: 69135 - RNA, 23 nt, Artificial Sequence
  Synthetic Oligonucleotide; TIM-3 exon 6; Set C
auaaaaaugcauucauaaaauaa

SEQ ID NO: 69136 - RNA, 25 nt, Artificial Sequence
  Synthetic Oligonucleotide; TIM-3 exon 6; Set C
aauaaaaaugcauucauaaaauaaa

SEQ ID NO: 69137 - RNA, 27 nt, Artificial Sequence
  Synthetic Oligonucleotide; TIM-3 exon 6; Set C
caauaaaaaugcauucauaaaauaaau

SEQ ID NO: 69138 - RNA, 26 nt, Artificial Sequence
  Synthetic Oligonucleotide; TIM-3 exon 6; Set C
caauaaaaaugcauucauaaaauaaa

SEQ ID NO: 69139 - RNA, 28 nt, Artificial Sequence
  Synthetic Oligonucleotide; TIM-3 exon 6; Set C
ccaauaaaaaugcauucauaaaauaaau

SEQ ID NO: 69140 - RNA, 25 nt, Artificial Sequence
  Synthetic Oligonucleotide; TIM-3 exon 6; Set C
caauaaaaaugcauucauaaaauaa

SEQ ID NO: 69141 - RNA, 27 nt, Artificial Sequence
  Synthetic Oligonucleotide; TIM-3 exon 6; Set C
ccaauaaaaaugcauucauaaaauaaa

SEQ ID NO: 69142 - RNA, 29 nt, Artificial Sequence
  Synthetic Oligonucleotide; TIM-3 exon 6; Set C
gccaauaaaaaugcauucauaaaauaaau

SEQ ID NO: 69143 - RNA, 24 nt, Artificial Sequence
  Synthetic Oligonucleotide; TIM-3 exon 6; Set C
caauaaaaaugcauucauaaaaua

SEQ ID NO: 69144 - RNA, 26 nt, Artificial Sequence
  Synthetic Oligonucleotide; TIM-3 exon 6; Set C
ccaauaaaaaugcauucauaaaauaa

SEQ ID NO: 69145 - RNA, 28 nt, Artificial Sequence
  Synthetic Oligonucleotide; TIM-3 exon 6; Set C
gccaauaaaaaugcauucauaaaauaaa

SEQ ID NO: 69146 - RNA, 25 nt, Artificial Sequence
  Synthetic Oligonucleotide; TIM-3 exon 6; Set C
ccaauaaaaaugcauucauaaaaua

SEQ ID NO: 69147 - RNA, 27 nt, Artificial Sequence
  Synthetic Oligonucleotide; TIM-3 exon 6; Set C
gccaauaaaaaugcauucauaaaauaa

SEQ ID NO: 69148 - RNA, 29 nt, Artificial Sequence
  Synthetic Oligonucleotide; TIM-3 exon 6; Set C
agccaauaaaaaugcauucauaaaauaaa

SEQ ID NO: 69149 - RNA, 26 nt, Artificial Sequence
  Synthetic Oligonucleotide; TIM-3 exon 6; Set C
gccaauaaaaaugcauucauaaaaua

SEQ ID NO: 69150 - RNA, 28 nt, Artificial Sequence
  Synthetic Oligonucleotide; TIM-3 exon 6; Set C
agccaauaaaaaugcauucauaaaauaa

SEQ ID NO: 69151 - RNA, 30 nt, Artificial Sequence
  Synthetic Oligonucleotide; TIM-3 exon 6; Set C
aagccaauaaaaaugcauucauaaaauaaa

SEQ ID NO: 69152 - RNA, 27 nt, Artificial Sequence
  Synthetic Oligonucleotide; TIM-3 exon 6; Set C
agccaauaaaaaugcauucauaaaaua

SEQ ID NO: 69153 - RNA, 29 nt, Artificial Sequence
  Synthetic Oligonucleotide; TIM-3 exon 6; Set C
aagccaauaaaaaugcauucauaaaauaa

SEQ ID NO: 69154 - RNA, 31 nt, Artificial Sequence
  Synthetic Oligonucleotide; TIM-3 exon 6; Set C
aaagccaauaaaaaugcauucauaaaauaaa

SEQ ID NO: 69155 - RNA, 33 nt, Artificial Sequence
  Synthetic Oligonucleotide; TIM-3 exon 6; Set C
aaaagccaauaaaaaugcauucauaaaauaaau

SEQ ID NO: 69156 - RNA, 28 nt, Artificial Sequence
  Synthetic Oligonucleotide; TIM-3 exon 6; Set C
aagccaauaaaaaugcauucauaaaaua

SEQ ID NO: 69157 - RNA, 30 nt, Artificial Sequence
  Synthetic Oligonucleotide; TIM-3 exon 6; Set C
aaagccaauaaaaaugcauucauaaaauaa

SEQ ID NO: 69158 - RNA, 32 nt, Artificial Sequence
  Synthetic Oligonucleotide; TIM-3 exon 6; Set C
aaaagccaauaaaaaugcauucauaaaauaaa

SEQ ID NO: 69159 - RNA, 29 nt, Artificial Sequence
  Synthetic Oligonucleotide; TIM-3 exon 6; Set C
aaagccaauaaaaaugcauucauaaaaua

SEQ ID NO: 69160 - RNA, 31 nt, Artificial Sequence
  Synthetic Oligonucleotide; TIM-3 exon 6; Set C
aaaagccaauaaaaaugcauucauaaaauaa

SEQ ID NO: 69161 - RNA, 15 nt, Artificial Sequence
  Synthetic Oligonucleotide; TIM-3 exon 6; Set C
auaaaaaugcauuca

SEQ ID NO: 69162 - RNA, 33 nt, Artificial Sequence
  Synthetic Oligonucleotide; TIM-3 exon 6; Set C
caaaagccaauaaaaaugcauucauaaaauaaa

SEQ ID NO: 69163 - RNA, 18 nt, Artificial Sequence
  Synthetic Oligonucleotide; TIM-3 exon 6; Set C
caauaaaaaugcauucau

SEQ ID NO: 69164 - RNA, 30 nt, Artificial Sequence
  Synthetic Oligonucleotide; TIM-3 exon 6; Set C
aaaagccaauaaaaaugcauucauaaaaua

SEQ ID NO: 69165 - RNA, 32 nt, Artificial Sequence
  Synthetic Oligonucleotide; TIM-3 exon 6; Set C
caaaagccaauaaaaaugcauucauaaaauaa

SEQ ID NO: 69166 - RNA, 16 nt, Artificial Sequence
  Synthetic Oligonucleotide; TIM-3 exon 6; Set C
aauaaaaaugcauuca

SEQ ID NO: 69167 - RNA, 34 nt, Artificial Sequence
  Synthetic Oligonucleotide; TIM-3 exon 6; Set C
acaaaagccaauaaaaaugcauucauaaaauaaa

SEQ ID NO: 69168 - RNA, 19 nt, Artificial Sequence
  Synthetic Oligonucleotide; TIM-3 exon 6; Set C
ccaauaaaaaugcauucau

SEQ ID NO: 69169 - RNA, 31 nt, Artificial Sequence
  Synthetic Oligonucleotide; TIM-3 exon 6; Set C
caaaagccaauaaaaaugcauucauaaaaua

SEQ ID NO: 69170 - RNA, 33 nt, Artificial Sequence
  Synthetic Oligonucleotide; TIM-3 exon 6; Set C
acaaaagccaauaaaaaugcauucauaaaauaa

SEQ ID NO: 69171 - RNA, 17 nt, Artificial Sequence
  Synthetic Oligonucleotide; TIM-3 exon 6; Set C
caauaaaaaugcauuca

SEQ ID NO: 69172 - RNA, 35 nt, Artificial Sequence
  Synthetic Oligonucleotide; TIM-3 exon 6; Set C
aacaaaagccaauaaaaaugcauucauaaaauaaa

SEQ ID NO: 69173 - RNA, 15 nt, Artificial Sequence
  Synthetic Oligonucleotide; TIM-3 exon 6; Set C
aauaaaaaugcauuc

SEQ ID NO: 69174 - RNA, 37 nt, Artificial Sequence
  Synthetic Oligonucleotide; TIM-3 exon 6; Set C
aaacaaaagccaauaaaaaugcauucauaaaauaaau

SEQ ID NO: 69175 - RNA, 20 nt, Artificial Sequence
  Synthetic Oligonucleotide; TIM-3 exon 6; Set C
gccaauaaaaaugcauucau

SEQ ID NO: 69176 - RNA, 32 nt, Artificial Sequence
  Synthetic Oligonucleotide; TIM-3 exon 6; Set C
acaaaagccaauaaaaaugcauucauaaaaua

SEQ ID NO: 69177 - RNA, 34 nt, Artificial Sequence
  Synthetic Oligonucleotide; TIM-3 exon 6; Set C
aacaaaagccaauaaaaaugcauucauaaaauaa

SEQ ID NO: 69178 - RNA, 18 nt, Artificial Sequence
  Synthetic Oligonucleotide; TIM-3 exon 6; Set C
ccaauaaaaaugcauuca

SEQ ID NO: 69179 - RNA, 36 nt, Artificial Sequence
  Synthetic Oligonucleotide; TIM-3 exon 6; Set C
aaacaaaagccaauaaaaaugcauucauaaaauaaa

SEQ ID NO: 69180 - RNA, 16 nt, Artificial Sequence
  Synthetic Oligonucleotide; TIM-3 exon 6; Set C
caauaaaaaugcauuc

SEQ ID NO: 69181 - RNA, 38 nt, Artificial Sequence
  Synthetic Oligonucleotide; TIM-3 exon 6; Set C
gaaacaaaagccaauaaaaaugcauucauaaaauaaau

SEQ ID NO: 69182 - RNA, 21 nt, Artificial Sequence
  Synthetic Oligonucleotide; TIM-3 exon 6; Set C
agccaauaaaaaugcauucau

SEQ ID NO: 69183 - RNA, 33 nt, Artificial Sequence
  Synthetic Oligonucleotide; TIM-3 exon 6; Set C
aacaaaagccaauaaaaaugcauucauaaaaua

SEQ ID NO: 69184 - RNA, 35 nt, Artificial Sequence
  Synthetic Oligonucleotide; TIM-3 exon 6; Set C
aaacaaaagccaauaaaaaugcauucauaaaauaa

SEQ ID NO: 69185 - RNA, 19 nt, Artificial Sequence
  Synthetic Oligonucleotide; TIM-3 exon 6; Set C
gccaauaaaaaugcauuca

SEQ ID NO: 69186 - RNA, 37 nt, Artificial Sequence
  Synthetic Oligonucleotide; TIM-3 exon 6; Set C
gaaacaaaagccaauaaaaaugcauucauaaaauaaa

SEQ ID NO: 69187 - RNA, 17 nt, Artificial Sequence
  Synthetic Oligonucleotide; TIM-3 exon 6; Set C
ccaauaaaaaugcauuc

SEQ ID NO: 69188 - RNA, 39 nt, Artificial Sequence
  Synthetic Oligonucleotide; TIM-3 exon 6; Set C
ggaaacaaaagccaauaaaaaugcauucauaaaauaaau

SEQ ID NO: 69189 - RNA, 22 nt, Artificial Sequence
  Synthetic Oligonucleotide; TIM-3 exon 6; Set C
aagccaauaaaaaugcauucau

SEQ ID NO: 69190 - RNA, 34 nt, Artificial Sequence
  Synthetic Oligonucleotide; TIM-3 exon 6; Set C
aaacaaaagccaauaaaaaugcauucauaaaaua

SEQ ID NO: 69191 - RNA, 36 nt, Artificial Sequence
  Synthetic Oligonucleotide; TIM-3 exon 6; Set C
gaaacaaaagccaauaaaaaugcauucauaaaauaa

SEQ ID NO: 69192 - RNA, 20 nt, Artificial Sequence
  Synthetic Oligonucleotide; TIM-3 exon 6; Set C
agccaauaaaaaugcauuca

SEQ ID NO: 69193 - RNA, 38 nt, Artificial Sequence
  Synthetic Oligonucleotide; TIM-3 exon 6; Set C
ggaaacaaaagccaauaaaaaugcauucauaaaauaaa

SEQ ID NO: 69194 - RNA, 18 nt, Artificial Sequence
  Synthetic Oligonucleotide; TIM-3 exon 6; Set C
gccaauaaaaaugcauuc

SEQ ID NO: 69195 - RNA, 23 nt, Artificial Sequence
  Synthetic Oligonucleotide; TIM-3 exon 6; Set C
aaagccaauaaaaaugcauucau

SEQ ID NO: 69196 - RNA, 35 nt, Artificial Sequence
  Synthetic Oligonucleotide; TIM-3 exon 6; Set C
gaaacaaaagccaauaaaaaugcauucauaaaaua

SEQ ID NO: 69197 - RNA, 37 nt, Artificial Sequence
  Synthetic Oligonucleotide; TIM-3 exon 6; Set C
ggaaacaaaagccaauaaaaaugcauucauaaaauaa

SEQ ID NO: 69198 - RNA, 21 nt, Artificial Sequence
  Synthetic Oligonucleotide; TIM-3 exon 6; Set C
aagccaauaaaaaugcauuca

SEQ ID NO: 69199 - RNA, 24 nt, Artificial Sequence
  Synthetic Oligonucleotide; TIM-3 exon 6; Set C
aaaagccaauaaaaaugcauucau

SEQ ID NO: 69200 - RNA, 36 nt, Artificial Sequence
  Synthetic Oligonucleotide; TIM-3 exon 6; Set C
ggaaacaaaagccaauaaaaaugcauucauaaaaua

SEQ ID NO: 69201 - RNA, 22 nt, Artificial Sequence
  Synthetic Oligonucleotide; TIM-3 exon 6; Set C
aaagccaauaaaaaugcauuca

SEQ ID NO: 69202 - RNA, 25 nt, Artificial Sequence
  Synthetic Oligonucleotide; TIM-3 exon 6; Set C
caaaagccaauaaaaaugcauucau

SEQ ID NO: 69203 - RNA, 23 nt, Artificial Sequence
  Synthetic Oligonucleotide; TIM-3 exon 6; Set C
aaaagccaauaaaaaugcauuca

SEQ ID NO: 69204 - RNA, 21 nt, Artificial Sequence
  Synthetic Oligonucleotide; TIM-3 exon 6; Set C
aaagccaauaaaaaugcauuc

SEQ ID NO: 69205 - RNA, 26 nt, Artificial Sequence
  Synthetic Oligonucleotide; TIM-3 exon 6; Set C
acaaaagccaauaaaaaugcauucau

SEQ ID NO: 69206 - RNA, 24 nt, Artificial Sequence
  Synthetic Oligonucleotide; TIM-3 exon 6; Set C
caaaagccaauaaaaaugcauuca

SEQ ID NO: 69207 - RNA, 22 nt, Artificial Sequence
  Synthetic Oligonucleotide; TIM-3 exon 6; Set C
aaaagccaauaaaaaugcauuc

SEQ ID NO: 69208 - RNA, 27 nt, Artificial Sequence
  Synthetic Oligonucleotide; TIM-3 exon 6; Set C
aacaaaagccaauaaaaaugcauucau

SEQ ID NO: 69209 - RNA, 25 nt, Artificial Sequence
  Synthetic Oligonucleotide; TIM-3 exon 6; Set C
acaaaagccaauaaaaaugcauuca

SEQ ID NO: 69210 - RNA, 28 nt, Artificial Sequence
  Synthetic Oligonucleotide; TIM-3 exon 6; Set C
aaacaaaagccaauaaaaaugcauucau

SEQ ID NO: 69211 - RNA, 26 nt, Artificial Sequence
  Synthetic Oligonucleotide; TIM-3 exon 6; Set C
aacaaaagccaauaaaaaugcauuca

SEQ ID NO: 69212 - RNA, 27 nt, Artificial Sequence
  Synthetic Oligonucleotide; TIM-3 exon 6; Set C
aaacaaaagccaauaaaaaugcauuca

SEQ ID NO: 69213 - RNA, 28 nt, Artificial Sequence
  Synthetic Oligonucleotide; TIM-3 exon 6; Set C
gaaacaaaagccaauaaaaaugcauuca

SEQ ID NO: 69214 - RNA, 26 nt, Artificial Sequence
  Synthetic Oligonucleotide; TIM-3 exon 6; Set C
aaacaaaagccaauaaaaaugcauuc

SEQ ID NO: 69215 - RNA, 29 nt, Artificial Sequence
  Synthetic Oligonucleotide; TIM-3 exon 6; Set C
ggaaacaaaagccaauaaaaaugcauuca

SEQ ID NO: 69216 - RNA, 27 nt, Artificial Sequence
  Synthetic Oligonucleotide; TIM-3 exon 6; Set C
gaaacaaaagccaauaaaaaugcauuc

SEQ ID NO: 69217 - RNA, 28 nt, Artificial Sequence
  Synthetic Oligonucleotide; TIM-3 exon 6; Set C
ggaaacaaaagccaauaaaaaugcauuc

SEQ ID NO: 69218 - RNA, 36 nt, Artificial Sequence
  Synthetic Oligonucleotide; TIM-3 exon 6; Set A
uaagggggaaacaaaagccaauaaaaaugcauucau

SEQ ID NO: 69219 - RNA, 36 nt, Artificial Sequence
  Synthetic Oligonucleotide; TIM-3 exon 6; Set A
guaagggggaaacaaaagccaauaaaaaugcauuca

SEQ ID NO: 69220 - RNA, 37 nt, Artificial Sequence
  Synthetic Oligonucleotide; TIM-3 exon 6; Set A
aguaagggggaaacaaaagccaauaaaaaugcauuca

SEQ ID NO: 69221 - RNA, 35 nt, Artificial Sequence
  Synthetic Oligonucleotide; TIM-3 exon 6; Set A
guaagggggaaacaaaagccaauaaaaaugcauuc

SEQ ID NO: 69222 - RNA, 36 nt, Artificial Sequence
  Synthetic Oligonucleotide; TIM-3 exon 6; Set A
aguaagggggaaacaaaagccaauaaaaaugcauuc

SEQ ID NO: 69223 - RNA, 18 nt, Artificial Sequence
  Synthetic Oligonucleotide; TIM-3 exon 6; Set C
uaagggggaaacaaaagc

SEQ ID NO: 69224 - RNA, 17 nt, Artificial Sequence
  Synthetic Oligonucleotide; TIM-3 exon 6; Set C
uaagggggaaacaaaag

SEQ ID NO: 69225 - RNA, 16 nt, Artificial Sequence
  Synthetic Oligonucleotide; TIM-3 exon 6; Set C
uaagggggaaacaaaa

SEQ ID NO: 69226 - RNA, 15 nt, Artificial Sequence
  Synthetic Oligonucleotide; TIM-3 exon 6; Set C
uaagggggaaacaaa

SEQ ID NO: 69227 - RNA, 37 nt, Artificial Sequence
  Synthetic Oligonucleotide; TIM-3 exon 6; Set A
uaugagaauacccuaguaagggggaaacaaaagccaa

SEQ ID NO: 69228 - RNA, 36 nt, Artificial Sequence
  Synthetic Oligonucleotide; TIM-3 exon 6; Set A
uaugagaauacccuaguaagggggaaacaaaagcca

SEQ ID NO: 69229 - RNA, 35 nt, Artificial Sequence
  Synthetic Oligonucleotide; TIM-3 exon 6; Set A
uaugagaauacccuaguaagggggaaacaaaagcc

SEQ ID NO: 69230 - RNA, 37 nt, Artificial Sequence
  Synthetic Oligonucleotide; TIM-3 exon 6; Set A
cuaugagaauacccuaguaagggggaaacaaaagcca

SEQ ID NO: 69231 - RNA, 38 nt, Artificial Sequence
  Synthetic Oligonucleotide; TIM-3 exon 6; Set C
gcuaugagaauacccuaguaagggggaaacaaaagcca

SEQ ID NO: 69232 - RNA, 36 nt, Artificial Sequence
  Synthetic Oligonucleotide; TIM-3 exon 6; Set A
cuaugagaauacccuaguaagggggaaacaaaagcc

SEQ ID NO: 69233 - RNA, 34 nt, Artificial Sequence
  Synthetic Oligonucleotide; TIM-3 exon 6; Set A
uaugagaauacccuaguaagggggaaacaaaagc

SEQ ID NO: 69234 - RNA, 37 nt, Artificial Sequence
  Synthetic Oligonucleotide; TIM-3 exon 6; Set C
gcuaugagaauacccuaguaagggggaaacaaaagcc

SEQ ID NO: 69235 - RNA, 33 nt, Artificial Sequence
  Synthetic Oligonucleotide; TIM-3 exon 6; Set A
uaugagaauacccuaguaagggggaaacaaaag

SEQ ID NO: 69236 - RNA, 35 nt, Artificial Sequence
  Synthetic Oligonucleotide; TIM-3 exon 6; Set A
cuaugagaauacccuaguaagggggaaacaaaagc

SEQ ID NO: 69237 - RNA, 38 nt, Artificial Sequence
  Synthetic Oligonucleotide; TIM-3 exon 6; Set C
ugcuaugagaauacccuaguaagggggaaacaaaagcc

SEQ ID NO: 69238 - RNA, 32 nt, Artificial Sequence
  Synthetic Oligonucleotide; TIM-3 exon 6; Set A
uaugagaauacccuaguaagggggaaacaaaa

SEQ ID NO: 69239 - RNA, 34 nt, Artificial Sequence
  Synthetic Oligonucleotide; TIM-3 exon 6; Set A
cuaugagaauacccuaguaagggggaaacaaaag

SEQ ID NO: 69240 - RNA, 36 nt, Artificial Sequence
  Synthetic Oligonucleotide; TIM-3 exon 6; Set A
gcuaugagaauacccuaguaagggggaaacaaaagc

SEQ ID NO: 69241 - RNA, 31 nt, Artificial Sequence
  Synthetic Oligonucleotide; TIM-3 exon 6; Set A
uaugagaauacccuaguaagggggaaacaaa

SEQ ID NO: 69242 - RNA, 33 nt, Artificial Sequence
  Synthetic Oligonucleotide; TIM-3 exon 6; Set A
cuaugagaauacccuaguaagggggaaacaaaa

SEQ ID NO: 69243 - RNA, 35 nt, Artificial Sequence
  Synthetic Oligonucleotide; TIM-3 exon 6; Set A
gcuaugagaauacccuaguaagggggaaacaaaag

SEQ ID NO: 69244 - RNA, 37 nt, Artificial Sequence
  Synthetic Oligonucleotide; TIM-3 exon 6; Set A
ugcuaugagaauacccuaguaagggggaaacaaaagc

SEQ ID NO: 69245 - RNA, 32 nt, Artificial Sequence
  Synthetic Oligonucleotide; TIM-3 exon 6; Set A
cuaugagaauacccuaguaagggggaaacaaa

SEQ ID NO: 69246 - RNA, 34 nt, Artificial Sequence
  Synthetic Oligonucleotide; TIM-3 exon 6; Set A
gcuaugagaauacccuaguaagggggaaacaaaa

SEQ ID NO: 69247 - RNA, 36 nt, Artificial Sequence
  Synthetic Oligonucleotide; TIM-3 exon 6; Set A
ugcuaugagaauacccuaguaagggggaaacaaaag

SEQ ID NO: 69248 - RNA, 38 nt, Artificial Sequence
  Synthetic Oligonucleotide; TIM-3 exon 6; Set A
uugcuaugagaauacccuaguaagggggaaacaaaagc

SEQ ID NO: 69249 - RNA, 33 nt, Artificial Sequence
  Synthetic Oligonucleotide; TIM-3 exon 6; Set A
gcuaugagaauacccuaguaagggggaaacaaa

SEQ ID NO: 69250 - RNA, 35 nt, Artificial Sequence
  Synthetic Oligonucleotide; TIM-3 exon 6; Set A
ugcuaugagaauacccuaguaagggggaaacaaaa

SEQ ID NO: 69251 - RNA, 37 nt, Artificial Sequence
  Synthetic Oligonucleotide; TIM-3 exon 6; Set A
uugcuaugagaauacccuaguaagggggaaacaaaag

SEQ ID NO: 69252 - RNA, 39 nt, Artificial Sequence
  Synthetic Oligonucleotide; TIM-3 exon 6; Set A
uuugcuaugagaauacccuaguaagggggaaacaaaagc

SEQ ID NO: 69253 - RNA, 34 nt, Artificial Sequence
  Synthetic Oligonucleotide; TIM-3 exon 6; Set A
ugcuaugagaauacccuaguaagggggaaacaaa

SEQ ID NO: 69254 - RNA, 36 nt, Artificial Sequence
  Synthetic Oligonucleotide; TIM-3 exon 6; Set A
uugcuaugagaauacccuaguaagggggaaacaaaa

SEQ ID NO: 69255 - RNA, 38 nt, Artificial Sequence
  Synthetic Oligonucleotide; TIM-3 exon 6; Set A
uuugcuaugagaauacccuaguaagggggaaacaaaag

SEQ ID NO: 69256 - RNA, 35 nt, Artificial Sequence
  Synthetic Oligonucleotide; TIM-3 exon 6; Set A
uugcuaugagaauacccuaguaagggggaaacaaa

SEQ ID NO: 69257 - RNA, 37 nt, Artificial Sequence
  Synthetic Oligonucleotide; TIM-3 exon 6; Set A
uuugcuaugagaauacccuaguaagggggaaacaaaa

SEQ ID NO: 69258 - RNA, 33 nt, Artificial Sequence
  Synthetic Oligonucleotide; TIM-3 exon 6; Set A
ugcuaugagaauacccuaguaagggggaaacaa

SEQ ID NO: 69259 - RNA, 36 nt, Artificial Sequence
  Synthetic Oligonucleotide; TIM-3 exon 6; Set A
uuugcuaugagaauacccuaguaagggggaaacaaa

SEQ ID NO: 69260 - RNA, 34 nt, Artificial Sequence
  Synthetic Oligonucleotide; TIM-3 exon 6; Set A
uugcuaugagaauacccuaguaagggggaaacaa

SEQ ID NO: 69261 - RNA, 27 nt, Artificial Sequence
  Synthetic Oligonucleotide; TIM-3 exon 6; Set A
cuaugagaauacccuaguaagggggaa

SEQ ID NO: 69262 - RNA, 29 nt, Artificial Sequence
  Synthetic Oligonucleotide; TIM-3 exon 6; Set A
gcuaugagaauacccuaguaagggggaaa

SEQ ID NO: 69263 - RNA, 35 nt, Artificial Sequence
  Synthetic Oligonucleotide; TIM-3 exon 6; Set A
uuugcuaugagaauacccuaguaagggggaaacaa

SEQ ID NO: 69264 - RNA, 33 nt, Artificial Sequence
  Synthetic Oligonucleotide; TIM-3 exon 6; Set A
uugcuaugagaauacccuaguaagggggaaaca

SEQ ID NO: 69265 - RNA, 28 nt, Artificial Sequence
  Synthetic Oligonucleotide; TIM-3 exon 6; Set A
gcuaugagaauacccuaguaagggggaa

SEQ ID NO: 69266 - RNA, 30 nt, Artificial Sequence
  Synthetic Oligonucleotide; TIM-3 exon 6; Set A
ugcuaugagaauacccuaguaagggggaaa

SEQ ID NO: 69267 - RNA, 34 nt, Artificial Sequence
  Synthetic Oligonucleotide; TIM-3 exon 6; Set A
uuugcuaugagaauacccuaguaagggggaaaca

SEQ ID NO: 69268 - RNA, 29 nt, Artificial Sequence
  Synthetic Oligonucleotide; TIM-3 exon 6; Set A
ugcuaugagaauacccuaguaagggggaa

SEQ ID NO: 69269 - RNA, 27 nt, Artificial Sequence
  Synthetic Oligonucleotide; TIM-3 exon 6; Set A
gcuaugagaauacccuaguaaggggga

SEQ ID NO: 69270 - RNA, 31 nt, Artificial Sequence
  Synthetic Oligonucleotide; TIM-3 exon 6; Set A
uugcuaugagaauacccuaguaagggggaaa

SEQ ID NO: 69271 - RNA, 33 nt, Artificial Sequence
  Synthetic Oligonucleotide; TIM-3 exon 6; Set A
uuugcuaugagaauacccuaguaagggggaaac

SEQ ID NO: 69272 - RNA, 30 nt, Artificial Sequence
  Synthetic Oligonucleotide; TIM-3 exon 6; Set A
uugcuaugagaauacccuaguaagggggaa

SEQ ID NO: 69273 - RNA, 28 nt, Artificial Sequence
  Synthetic Oligonucleotide; TIM-3 exon 6; Set A
ugcuaugagaauacccuaguaaggggga

SEQ ID NO: 69274 - RNA, 32 nt, Artificial Sequence
  Synthetic Oligonucleotide; TIM-3 exon 6; Set A
uuugcuaugagaauacccuaguaagggggaaa

SEQ ID NO: 69275 - RNA, 31 nt, Artificial Sequence
  Synthetic Oligonucleotide; TIM-3 exon 6; Set A
uuugcuaugagaauacccuaguaagggggaa

SEQ ID NO: 69276 - RNA, 29 nt, Artificial Sequence
  Synthetic Oligonucleotide; TIM-3 exon 6; Set A
uugcuaugagaauacccuaguaaggggga

SEQ ID NO: 69277 - RNA, 30 nt, Artificial Sequence
  Synthetic Oligonucleotide; TIM-3 exon 6; Set A
uuugcuaugagaauacccuaguaaggggga

SEQ ID NO: 69278 - RNA, 18 nt, Artificial Sequence
  Synthetic Oligonucleotide; TIM-3 exon 6; Set C
uaugagaauacccuagua

SEQ ID NO: 69279 - RNA, 19 nt, Artificial Sequence
  Synthetic Oligonucleotide; TIM-3 exon 6; Set C
cuaugagaauacccuagua

SEQ ID NO: 69280 - RNA, 20 nt, Artificial Sequence
  Synthetic Oligonucleotide; TIM-3 exon 6; Set C
gcuaugagaauacccuagua

SEQ ID NO: 69281 - RNA, 18 nt, Artificial Sequence
  Synthetic Oligonucleotide; TIM-3 exon 6; Set C
cuaugagaauacccuagu

SEQ ID NO: 69282 - RNA, 22 nt, Artificial Sequence
  Synthetic Oligonucleotide; TIM-3 exon 6; Set C
ugcuaugagaauacccuaguaa

SEQ ID NO: 69283 - RNA, 21 nt, Artificial Sequence
  Synthetic Oligonucleotide; TIM-3 exon 6; Set C
ugcuaugagaauacccuagua

SEQ ID NO: 69284 - RNA, 19 nt, Artificial Sequence
  Synthetic Oligonucleotide; TIM-3 exon 6; Set C
gcuaugagaauacccuagu

SEQ ID NO: 69285 - RNA, 23 nt, Artificial Sequence
  Synthetic Oligonucleotide; TIM-3 exon 6; Set C
uugcuaugagaauacccuaguaa

SEQ ID NO: 69286 - RNA, 22 nt, Artificial Sequence
  Synthetic Oligonucleotide; TIM-3 exon 6; Set C
uugcuaugagaauacccuagua

SEQ ID NO: 69287 - RNA, 20 nt, Artificial Sequence
  Synthetic Oligonucleotide; TIM-3 exon 6; Set C
ugcuaugagaauacccuagu

SEQ ID NO: 69288 - RNA, 24 nt, Artificial Sequence
  Synthetic Oligonucleotide; TIM-3 exon 6; Set C
uuugcuaugagaauacccuaguaa

SEQ ID NO: 69289 - RNA, 21 nt, Artificial Sequence
  Synthetic Oligonucleotide; TIM-3 exon 6; Set C
uugcuaugagaauacccuagu

SEQ ID NO: 69290 - RNA, 22 nt, Artificial Sequence
  Synthetic Oligonucleotide; TIM-3 exon 6; Set C
uuugcuaugagaauacccuagu

SEQ ID NO: 69291 - RNA, 40 nt, Artificial Sequence
  Synthetic Oligonucleotide; TIM-3 exon 6; Set A
aaauucuguaucuucucuuugcuaugagaauacccuagua

SEQ ID NO: 69292 - RNA, 39 nt, Artificial Sequence
  Synthetic Oligonucleotide; TIM-3 exon 6; Set A
aaauucuguaucuucucuuugcuaugagaauacccuagu

SEQ ID NO: 69293 - RNA, 40 nt, Artificial Sequence
  Synthetic Oligonucleotide; TIM-3 exon 6; Set A
uaaauucuguaucuucucuuugcuaugagaauacccuagu

SEQ ID NO: 69294 - RNA, 25 nt, Artificial Sequence
  Synthetic Oligonucleotide; TIM-3 exon 6; Set C
aaauucuguaucuucucuuugcuau

SEQ ID NO: 69295 - RNA, 24 nt, Artificial Sequence
  Synthetic Oligonucleotide; TIM-3 exon 6; Set C
aaauucuguaucuucucuuugcua

SEQ ID NO: 69296 - RNA, 25 nt, Artificial Sequence
  Synthetic Oligonucleotide; TIM-3 exon 6; Set C
uaaauucuguaucuucucuuugcua

SEQ ID NO: 69297 - RNA, 23 nt, Artificial Sequence
  Synthetic Oligonucleotide; TIM-3 exon 6; Set C
aaauucuguaucuucucuuugcu

SEQ ID NO: 69298 - RNA, 28 nt, Artificial Sequence
  Synthetic Oligonucleotide; TIM-3 exon 6; Set C
cuuaaauucuguaucuucucuuugcuau

SEQ ID NO: 69299 - RNA, 24 nt, Artificial Sequence
  Synthetic Oligonucleotide; TIM-3 exon 6; Set C
uaaauucuguaucuucucuuugcu

SEQ ID NO: 69300 - RNA, 22 nt, Artificial Sequence
  Synthetic Oligonucleotide; TIM-3 exon 6; Set C
aaauucuguaucuucucuuugc

SEQ ID NO: 69301 - RNA, 26 nt, Artificial Sequence
  Synthetic Oligonucleotide; TIM-3 exon 6; Set C
uuaaauucuguaucuucucuuugcua

SEQ ID NO: 69302 - RNA, 29 nt, Artificial Sequence
  Synthetic Oligonucleotide; TIM-3 exon 6; Set C
ccuuaaauucuguaucuucucuuugcuau

SEQ ID NO: 69303 - RNA, 21 nt, Artificial Sequence
  Synthetic Oligonucleotide; TIM-3 exon 6; Set C
aaauucuguaucuucucuuug

SEQ ID NO: 69304 - RNA, 23 nt, Artificial Sequence
  Synthetic Oligonucleotide; TIM-3 exon 6; Set C
uaaauucuguaucuucucuuugc

SEQ ID NO: 69305 - RNA, 25 nt, Artificial Sequence
  Synthetic Oligonucleotide; TIM-3 exon 6; Set C
uuaaauucuguaucuucucuuugcu

SEQ ID NO: 69306 - RNA, 27 nt, Artificial Sequence
  Synthetic Oligonucleotide; TIM-3 exon 6; Set C
cuuaaauucuguaucuucucuuugcua

SEQ ID NO: 69307 - RNA, 20 nt, Artificial Sequence
  Synthetic Oligonucleotide; TIM-3 exon 6; Set C
aaauucuguaucuucucuuu

SEQ ID NO: 69308 - RNA, 30 nt, Artificial Sequence
  Synthetic Oligonucleotide; TIM-3 exon 6; Set A
accuuaaauucuguaucuucucuuugcuau

SEQ ID NO: 69309 - RNA, 22 nt, Artificial Sequence
  Synthetic Oligonucleotide; TIM-3 exon 6; Set C
uaaauucuguaucuucucuuug

SEQ ID NO: 69310 - RNA, 24 nt, Artificial Sequence
  Synthetic Oligonucleotide; TIM-3 exon 6; Set C
uuaaauucuguaucuucucuuugc

SEQ ID NO: 69311 - RNA, 26 nt, Artificial Sequence
  Synthetic Oligonucleotide; TIM-3 exon 6; Set C
cuuaaauucuguaucuucucuuugcu

SEQ ID NO: 69312 - RNA, 28 nt, Artificial Sequence
  Synthetic Oligonucleotide; TIM-3 exon 6; Set C
ccuuaaauucuguaucuucucuuugcua

SEQ ID NO: 69313 - RNA, 21 nt, Artificial Sequence
  Synthetic Oligonucleotide; TIM-3 exon 6; Set C
uaaauucuguaucuucucuuu

SEQ ID NO: 69314 - RNA, 31 nt, Artificial Sequence
  Synthetic Oligonucleotide; TIM-3 exon 6; Set A
uaccuuaaauucuguaucuucucuuugcuau

SEQ ID NO: 69315 - RNA, 23 nt, Artificial Sequence
  Synthetic Oligonucleotide; TIM-3 exon 6; Set C
uuaaauucuguaucuucucuuug

SEQ ID NO: 69316 - RNA, 25 nt, Artificial Sequence
  Synthetic Oligonucleotide; TIM-3 exon 6; Set C
cuuaaauucuguaucuucucuuugc

SEQ ID NO: 69317 - RNA, 29 nt, Artificial Sequence
  Synthetic Oligonucleotide; TIM-3 exon 6; Set A
accuuaaauucuguaucuucucuuugcua

SEQ ID NO: 69318 - RNA, 27 nt, Artificial Sequence
  Synthetic Oligonucleotide; TIM-3 exon 6; Set C
ccuuaaauucuguaucuucucuuugcu

SEQ ID NO: 69319 - RNA, 22 nt, Artificial Sequence
  Synthetic Oligonucleotide; TIM-3 exon 6; Set C
uuaaauucuguaucuucucuuu

SEQ ID NO: 69320 - RNA, 24 nt, Artificial Sequence
  Synthetic Oligonucleotide; TIM-3 exon 6; Set C
cuuaaauucuguaucuucucuuug

SEQ ID NO: 69321 - RNA, 28 nt, Artificial Sequence
  Synthetic Oligonucleotide; TIM-3 exon 6; Set C
accuuaaauucuguaucuucucuuugcu

SEQ ID NO: 69322 - RNA, 26 nt, Artificial Sequence
  Synthetic Oligonucleotide; TIM-3 exon 6; Set C
ccuuaaauucuguaucuucucuuugc

SEQ ID NO: 69323 - RNA, 30 nt, Artificial Sequence
  Synthetic Oligonucleotide; TIM-3 exon 6; Set A
uaccuuaaauucuguaucuucucuuugcua

SEQ ID NO: 69324 - RNA, 23 nt, Artificial Sequence
  Synthetic Oligonucleotide; TIM-3 exon 6; Set C
cuuaaauucuguaucuucucuuu

SEQ ID NO: 69325 - RNA, 25 nt, Artificial Sequence
  Synthetic Oligonucleotide; TIM-3 exon 6; Set C
ccuuaaauucuguaucuucucuuug

SEQ ID NO: 69326 - RNA, 27 nt, Artificial Sequence
  Synthetic Oligonucleotide; TIM-3 exon 6; Set C
accuuaaauucuguaucuucucuuugc

SEQ ID NO: 69327 - RNA, 29 nt, Artificial Sequence
  Synthetic Oligonucleotide; TIM-3 exon 6; Set A
uaccuuaaauucuguaucuucucuuugcu

SEQ ID NO: 69328 - RNA, 31 nt, Artificial Sequence
  Synthetic Oligonucleotide; TIM-3 exon 6; Set A
uuaccuuaaauucuguaucuucucuuugcua

SEQ ID NO: 69329 - RNA, 24 nt, Artificial Sequence
  Synthetic Oligonucleotide; TIM-3 exon 6; Set C
ccuuaaauucuguaucuucucuuu

SEQ ID NO: 69330 - RNA, 34 nt, Artificial Sequence
  Synthetic Oligonucleotide; TIM-3 exon 6; Set A
ucuuaccuuaaauucuguaucuucucuuugcuau

SEQ ID NO: 69331 - RNA, 26 nt, Artificial Sequence
  Synthetic Oligonucleotide; TIM-3 exon 6; Set C
accuuaaauucuguaucuucucuuug

SEQ ID NO: 69332 - RNA, 28 nt, Artificial Sequence
  Synthetic Oligonucleotide; TIM-3 exon 6; Set C
uaccuuaaauucuguaucuucucuuugc

SEQ ID NO: 69333 - RNA, 30 nt, Artificial Sequence
  Synthetic Oligonucleotide; TIM-3 exon 6; Set A
uuaccuuaaauucuguaucuucucuuugcu

SEQ ID NO: 69334 - RNA, 25 nt, Artificial Sequence
  Synthetic Oligonucleotide; TIM-3 exon 6; Set C
accuuaaauucuguaucuucucuuu

SEQ ID NO: 69335 - RNA, 35 nt, Artificial Sequence
  Synthetic Oligonucleotide; TIM-3 exon 6; Set A
uucuuaccuuaaauucuguaucuucucuuugcuau

SEQ ID NO: 69336 - RNA, 27 nt, Artificial Sequence
  Synthetic Oligonucleotide; TIM-3 exon 6; Set C
uaccuuaaauucuguaucuucucuuug

SEQ ID NO: 69337 - RNA, 29 nt, Artificial Sequence
  Synthetic Oligonucleotide; TIM-3 exon 6; Set C
uuaccuuaaauucuguaucuucucuuugc

SEQ ID NO: 69338 - RNA, 33 nt, Artificial Sequence
  Synthetic Oligonucleotide; TIM-3 exon 6; Set A
ucuuaccuuaaauucuguaucuucucuuugcua

SEQ ID NO: 69339 - RNA, 26 nt, Artificial Sequence
  Synthetic Oligonucleotide; TIM-3 exon 6; Set C
uaccuuaaauucuguaucuucucuuu

SEQ ID NO: 69340 - RNA, 36 nt, Artificial Sequence
  Synthetic Oligonucleotide; TIM-3 exon 6; Set A
auucuuaccuuaaauucuguaucuucucuuugcuau

SEQ ID NO: 69341 - RNA, 28 nt, Artificial Sequence
  Synthetic Oligonucleotide; TIM-3 exon 6; Set C
uuaccuuaaauucuguaucuucucuuug

SEQ ID NO: 69342 - RNA, 32 nt, Artificial Sequence
  Synthetic Oligonucleotide; TIM-3 exon 6; Set A
ucuuaccuuaaauucuguaucuucucuuugcu

SEQ ID NO: 69343 - RNA, 27 nt, Artificial Sequence
  Synthetic Oligonucleotide; TIM-3 exon 6; Set C
uuaccuuaaauucuguaucuucucuuu

SEQ ID NO: 69344 - RNA, 37 nt, Artificial Sequence
  Synthetic Oligonucleotide; TIM-3 exon 6; Set A
uauucuuaccuuaaauucuguaucuucucuuugcuau

SEQ ID NO: 69345 - RNA, 31 nt, Artificial Sequence
  Synthetic Oligonucleotide; TIM-3 exon 6; Set A
ucuuaccuuaaauucuguaucuucucuuugc

SEQ ID NO: 69346 - RNA, 35 nt, Artificial Sequence
  Synthetic Oligonucleotide; TIM-3 exon 6; Set A
auucuuaccuuaaauucuguaucuucucuuugcua

SEQ ID NO: 69347 - RNA, 36 nt, Artificial Sequence
  Synthetic Oligonucleotide; TIM-3 exon 6; Set A
uauucuuaccuuaaauucuguaucuucucuuugcua

SEQ ID NO: 69348 - RNA, 34 nt, Artificial Sequence
  Synthetic Oligonucleotide; TIM-3 exon 6; Set A
auucuuaccuuaaauucuguaucuucucuuugcu

SEQ ID NO: 69349 - RNA, 35 nt, Artificial Sequence
  Synthetic Oligonucleotide; TIM-3 exon 6; Set A
uauucuuaccuuaaauucuguaucuucucuuugcu

SEQ ID NO: 69350 - RNA, 33 nt, Artificial Sequence
  Synthetic Oligonucleotide; TIM-3 exon 6; Set A
auucuuaccuuaaauucuguaucuucucuuugc

SEQ ID NO: 69351 - RNA, 34 nt, Artificial Sequence
  Synthetic Oligonucleotide; TIM-3 exon 6; Set A
uauucuuaccuuaaauucuguaucuucucuuugc

SEQ ID NO: 69352 - RNA, 33 nt, Artificial Sequence
  Synthetic Oligonucleotide; TIM-3 exon 6; Set C
uauucuuaccuuaaauucuguaucuucucuuug

SEQ ID NO: 69353 - RNA, 32 nt, Artificial Sequence
  Synthetic Oligonucleotide; TIM-3 exon 6; Set C
uauucuuaccuuaaauucuguaucuucucuuu

SEQ ID NO: 69354 - RNA, 18 nt, Artificial Sequence
  Synthetic Oligonucleotide; TIM-3 exon 6; Set C
cauuauucuuaccuuaaa

SEQ ID NO: 69355 - RNA, 17 nt, Artificial Sequence
  Synthetic Oligonucleotide; TIM-3 exon 6; Set C
cauuauucuuaccuuaa

SEQ ID NO: 69356 - RNA, 19 nt, Artificial Sequence
  Synthetic Oligonucleotide; TIM-3 exon 6; Set C
ccauuauucuuaccuuaaa

SEQ ID NO: 69357 - RNA, 20 nt, Artificial Sequence
  Synthetic Oligonucleotide; TIM-3 exon 6; Set C
uccauuauucuuaccuuaaa

SEQ ID NO: 69358 - RNA, 18 nt, Artificial Sequence
  Synthetic Oligonucleotide; TIM-3 exon 6; Set C
ccauuauucuuaccuuaa

SEQ ID NO: 69359 - RNA, 16 nt, Artificial Sequence
  Synthetic Oligonucleotide; TIM-3 exon 6; Set C
cauuauucuuaccuua

SEQ ID NO: 69360 - RNA, 19 nt, Artificial Sequence
  Synthetic Oligonucleotide; TIM-3 exon 6; Set C
uccauuauucuuaccuuaa

SEQ ID NO: 69361 - RNA, 17 nt, Artificial Sequence
  Synthetic Oligonucleotide; TIM-3 exon 6; Set C
ccauuauucuuaccuua

SEQ ID NO: 69362 - RNA, 18 nt, Artificial Sequence
  Synthetic Oligonucleotide; TIM-3 exon 6; Set C
uccauuauucuuaccuua

SEQ ID NO: 69363 - RNA, 25 nt, Artificial Sequence
  Synthetic Oligonucleotide; TIM-3 exon 6; Set A
aaccccauuccauuauucuuaccuu

SEQ ID NO: 69364 - RNA, 26 nt, Artificial Sequence
  Synthetic Oligonucleotide; TIM-3 exon 6; Set A
caaccccauuccauuauucuuaccuu

SEQ ID NO: 69365 - RNA, 24 nt, Artificial Sequence
  Synthetic Oligonucleotide; TIM-3 exon 6; Set A
aaccccauuccauuauucuuaccu

SEQ ID NO: 69366 - RNA, 23 nt, Artificial Sequence
  Synthetic Oligonucleotide; TIM-3 exon 6; Set C
aaccccauuccauuauucuuacc

SEQ ID NO: 69367 - RNA, 25 nt, Artificial Sequence
  Synthetic Oligonucleotide; TIM-3 exon 6; Set A
caaccccauuccauuauucuuaccu

SEQ ID NO: 69368 - RNA, 24 nt, Artificial Sequence
  Synthetic Oligonucleotide; TIM-3 exon 6; Set A
caaccccauuccauuauucuuacc

SEQ ID NO: 69369 - RNA, 22 nt, Artificial Sequence
  Synthetic Oligonucleotide; TIM-3 exon 6; Set C
aaccccauuccauuauucuuac

SEQ ID NO: 69370 - RNA, 23 nt, Artificial Sequence
  Synthetic Oligonucleotide; TIM-3 exon 6; Set C
caaccccauuccauuauucuuac

SEQ ID NO: 69371 - RNA, 21 nt, Artificial Sequence
  Synthetic Oligonucleotide; TIM-3 exon 6; Set C
aaccccauuccauuauucuua

SEQ ID NO: 69372 - RNA, 22 nt, Artificial Sequence
  Synthetic Oligonucleotide; TIM-3 exon 6; Set C
caaccccauuccauuauucuua

SEQ ID NO: 69373 - RNA, 40 nt, Artificial Sequence
  Synthetic Oligonucleotide; TIM-3 exon 6; Set C
ucaccuuuucccaaccccauuccauuauucuuaccuuaaa

SEQ ID NO: 69374 - RNA, 39 nt, Artificial Sequence
  Synthetic Oligonucleotide; TIM-3 exon 6; Set C
ucaccuuuucccaaccccauuccauuauucuuaccuuaa

SEQ ID NO: 69375 - RNA, 15 nt, Artificial Sequence
  Synthetic Oligonucleotide; TIM-3 exon 6; Set C
aaccccauuccauua

SEQ ID NO: 69376 - RNA, 38 nt, Artificial Sequence
  Synthetic Oligonucleotide; TIM-3 exon 6; Set C
ucaccuuuucccaaccccauuccauuauucuuaccuua

SEQ ID NO: 69377 - RNA, 16 nt, Artificial Sequence
  Synthetic Oligonucleotide; TIM-3 exon 6; Set C
caaccccauuccauua

SEQ ID NO: 69378 - RNA, 15 nt, Artificial Sequence
  Synthetic Oligonucleotide; TIM-3 exon 6; Set C
caaccccauuccauu

SEQ ID NO: 69379 - RNA, 38 nt, Artificial Sequence
  Synthetic Oligonucleotide; TIM-3 exon 6; Set C
cucaccuuuucccaaccccauuccauuauucuuaccuu

SEQ ID NO: 69380 - RNA, 39 nt, Artificial Sequence
  Synthetic Oligonucleotide; TIM-3 exon 6; Set C
ucucaccuuuucccaaccccauuccauuauucuuaccuu

SEQ ID NO: 69381 - RNA, 37 nt, Artificial Sequence
  Synthetic Oligonucleotide; TIM-3 exon 6; Set C
cucaccuuuucccaaccccauuccauuauucuuaccu

SEQ ID NO: 69382 - RNA, 38 nt, Artificial Sequence
  Synthetic Oligonucleotide; TIM-3 exon 6; Set C
ucucaccuuuucccaaccccauuccauuauucuuaccu

SEQ ID NO: 69383 - RNA, 36 nt, Artificial Sequence
  Synthetic Oligonucleotide; TIM-3 exon 6; Set C
cucaccuuuucccaaccccauuccauuauucuuacc

SEQ ID NO: 69384 - RNA, 37 nt, Artificial Sequence
  Synthetic Oligonucleotide; TIM-3 exon 6; Set C
ucucaccuuuucccaaccccauuccauuauucuuacc

SEQ ID NO: 69385 - RNA, 35 nt, Artificial Sequence
  Synthetic Oligonucleotide; TIM-3 exon 6; Set C
cucaccuuuucccaaccccauuccauuauucuuac

SEQ ID NO: 69386 - RNA, 38 nt, Artificial Sequence
  Synthetic Oligonucleotide; TIM-3 exon 6; Set C
uucucaccuuuucccaaccccauuccauuauucuuacc

SEQ ID NO: 69387 - RNA, 36 nt, Artificial Sequence
  Synthetic Oligonucleotide; TIM-3 exon 6; Set C
ucucaccuuuucccaaccccauuccauuauucuuac

SEQ ID NO: 69388 - RNA, 34 nt, Artificial Sequence
  Synthetic Oligonucleotide; TIM-3 exon 6; Set C
cucaccuuuucccaaccccauuccauuauucuua

SEQ ID NO: 69389 - RNA, 37 nt, Artificial Sequence
  Synthetic Oligonucleotide; TIM-3 exon 6; Set C
uucucaccuuuucccaaccccauuccauuauucuuac

SEQ ID NO: 69390 - RNA, 35 nt, Artificial Sequence
  Synthetic Oligonucleotide; TIM-3 exon 6; Set C
ucucaccuuuucccaaccccauuccauuauucuua

SEQ ID NO: 69391 - RNA, 36 nt, Artificial Sequence
  Synthetic Oligonucleotide; TIM-3 exon 6; Set C
uucucaccuuuucccaaccccauuccauuauucuua

SEQ ID NO: 69392 - RNA, 37 nt, Artificial Sequence
  Synthetic Oligonucleotide; TIM-3 exon 6; Set C
auucucaccuuuucccaaccccauuccauuauucuua

SEQ ID NO: 69393 - RNA, 40 nt, Artificial Sequence
  Synthetic Oligonucleotide; TIM-3 exon 6; Set C
agauucucaccuuuucccaaccccauuccauuauucuuac

SEQ ID NO: 69394 - RNA, 39 nt, Artificial Sequence
  Synthetic Oligonucleotide; TIM-3 exon 6; Set C
agauucucaccuuuucccaaccccauuccauuauucuua

SEQ ID NO: 69395 - RNA, 35 nt, Artificial Sequence
  Synthetic Oligonucleotide; TIM-3 exon 6; Set C
auucucaccuuuucccaaccccauuccauuauucu

SEQ ID NO: 69396 - RNA, 37 nt, Artificial Sequence
  Synthetic Oligonucleotide; TIM-3 exon 6; Set C
gauucucaccuuuucccaaccccauuccauuauucuu

SEQ ID NO: 69397 - RNA, 28 nt, Artificial Sequence
  Synthetic Oligonucleotide; TIM-3 exon 6; Set C
cucaccuuuucccaaccccauuccauua

SEQ ID NO: 69398 - RNA, 40 nt, Artificial Sequence
  Synthetic Oligonucleotide; TIM-3 exon 6; Set C
aagauucucaccuuuucccaaccccauuccauuauucuua

SEQ ID NO: 69399 - RNA, 36 nt, Artificial Sequence
  Synthetic Oligonucleotide; TIM-3 exon 6; Set C
gauucucaccuuuucccaaccccauuccauuauucu

SEQ ID NO: 69400 - RNA, 29 nt, Artificial Sequence
  Synthetic Oligonucleotide; TIM-3 exon 6; Set C
ucucaccuuuucccaaccccauuccauua

SEQ ID NO: 69401 - RNA, 27 nt, Artificial Sequence
  Synthetic Oligonucleotide; TIM-3 exon 6; Set C
cucaccuuuucccaaccccauuccauu

SEQ ID NO: 69402 - RNA, 35 nt, Artificial Sequence
  Synthetic Oligonucleotide; TIM-3 exon 6; Set C
gauucucaccuuuucccaaccccauuccauuauuc

SEQ ID NO: 69403 - RNA, 30 nt, Artificial Sequence
  Synthetic Oligonucleotide; TIM-3 exon 6; Set C
uucucaccuuuucccaaccccauuccauua

SEQ ID NO: 69404 - RNA, 28 nt, Artificial Sequence
  Synthetic Oligonucleotide; TIM-3 exon 6; Set C
ucucaccuuuucccaaccccauuccauu

SEQ ID NO: 69405 - RNA, 34 nt, Artificial Sequence
  Synthetic Oligonucleotide; TIM-3 exon 6; Set C
gauucucaccuuuucccaaccccauuccauuauu

SEQ ID NO: 69406 - RNA, 29 nt, Artificial Sequence
  Synthetic Oligonucleotide; TIM-3 exon 6; Set C
uucucaccuuuucccaaccccauuccauu

SEQ ID NO: 69407 - RNA, 33 nt, Artificial Sequence
  Synthetic Oligonucleotide; TIM-3 exon 6; Set C
gauucucaccuuuucccaaccccauuccauuau

SEQ ID NO: 69408 - RNA, 30 nt, Artificial Sequence
  Synthetic Oligonucleotide; TIM-3 exon 6; Set C
auucucaccuuuucccaaccccauuccauu

SEQ ID NO: 69409 - RNA, 33 nt, Artificial Sequence
  Synthetic Oligonucleotide; TIM-3 exon 6; Set C
agauucucaccuuuucccaaccccauuccauua

SEQ ID NO: 69410 - RNA, 23 nt, Artificial Sequence
  Synthetic Oligonucleotide; TIM-3 exon 6; Set B
cucaccuuuucccaaccccauuc

SEQ ID NO: 69411 - RNA, 34 nt, Artificial Sequence
  Synthetic Oligonucleotide; TIM-3 exon 6; Set C
aagauucucaccuuuucccaaccccauuccauua

SEQ ID NO: 69412 - RNA, 32 nt, Artificial Sequence
  Synthetic Oligonucleotide; TIM-3 exon 6; Set C
agauucucaccuuuucccaaccccauuccauu

SEQ ID NO: 69413 - RNA, 24 nt, Artificial Sequence
  Synthetic Oligonucleotide; TIM-3 exon 6; Set B
ucucaccuuuucccaaccccauuc

SEQ ID NO: 69414 - RNA, 35 nt, Artificial Sequence
  Synthetic Oligonucleotide; TIM-3 exon 6; Set C
caagauucucaccuuuucccaaccccauuccauua

SEQ ID NO: 69415 - RNA, 33 nt, Artificial Sequence
  Synthetic Oligonucleotide; TIM-3 exon 6; Set C
aagauucucaccuuuucccaaccccauuccauu

SEQ ID NO: 69416 - RNA, 25 nt, Artificial Sequence
  Synthetic Oligonucleotide; TIM-3 exon 6; Set B
uucucaccuuuucccaaccccauuc

SEQ ID NO: 69417 - RNA, 39 nt, Artificial Sequence
  Synthetic Oligonucleotide; TIM-3 exon 6; Set C
uccaagauucucaccuuuucccaaccccauuccauuauu

SEQ ID NO: 69418 - RNA, 36 nt, Artificial Sequence
  Synthetic Oligonucleotide; TIM-3 exon 6; Set C
ccaagauucucaccuuuucccaaccccauuccauua

SEQ ID NO: 69419 - RNA, 34 nt, Artificial Sequence
  Synthetic Oligonucleotide; TIM-3 exon 6; Set C
caagauucucaccuuuucccaaccccauuccauu

SEQ ID NO: 69420 - RNA, 26 nt, Artificial Sequence
  Synthetic Oligonucleotide; TIM-3 exon 6; Set B
auucucaccuuuucccaaccccauuc

SEQ ID NO: 69421 - RNA, 38 nt, Artificial Sequence
  Synthetic Oligonucleotide; TIM-3 exon 6; Set C
uccaagauucucaccuuuucccaaccccauuccauuau

SEQ ID NO: 69422 - RNA, 40 nt, Artificial Sequence
  Synthetic Oligonucleotide; TIM-3 exon 6; Set C
uuccaagauucucaccuuuucccaaccccauuccauuauu

SEQ ID NO: 69423 - RNA, 35 nt, Artificial Sequence
  Synthetic Oligonucleotide; TIM-3 exon 6; Set C
ccaagauucucaccuuuucccaaccccauuccauu

SEQ ID NO: 69424 - RNA, 27 nt, Artificial Sequence
  Synthetic Oligonucleotide; TIM-3 exon 6; Set B
gauucucaccuuuucccaaccccauuc

SEQ ID NO: 69425 - RNA, 39 nt, Artificial Sequence
  Synthetic Oligonucleotide; TIM-3 exon 6; Set C
uuccaagauucucaccuuuucccaaccccauuccauuau

SEQ ID NO: 69426 - RNA, 28 nt, Artificial Sequence
  Synthetic Oligonucleotide; TIM-3 exon 6; Set B
agauucucaccuuuucccaaccccauuc

SEQ ID NO: 69427 - RNA, 40 nt, Artificial Sequence
  Synthetic Oligonucleotide; TIM-3 exon 6; Set C
cuuccaagauucucaccuuuucccaaccccauuccauuau

SEQ ID NO: 69428 - RNA, 29 nt, Artificial Sequence
  Synthetic Oligonucleotide; TIM-3 exon 6; Set B
aagauucucaccuuuucccaaccccauuc

SEQ ID NO: 69429 - RNA, 31 nt, Artificial Sequence
  Synthetic Oligonucleotide; TIM-3 exon 6; Set C
ccaagauucucaccuuuucccaaccccauuc

SEQ ID NO: 69430 - RNA, 32 nt, Artificial Sequence
  Synthetic Oligonucleotide; TIM-3 exon 6; Set C
uccaagauucucaccuuuucccaaccccauuc

SEQ ID NO: 69431 - RNA, 33 nt, Artificial Sequence
  Synthetic Oligonucleotide; TIM-3 exon 6; Set C
uuccaagauucucaccuuuucccaaccccauuc

SEQ ID NO: 69432 - RNA, 34 nt, Artificial Sequence
  Synthetic Oligonucleotide; TIM-3 exon 6; Set C
cuuccaagauucucaccuuuucccaaccccauuc

SEQ ID NO: 69433 - RNA, 26 nt, Artificial Sequence
  Synthetic Oligonucleotide; TIM-3 exon 6; Set B
uuccaagauucucaccuuuucccaac

SEQ ID NO: 69434 - RNA, 27 nt, Artificial Sequence
  Synthetic Oligonucleotide; TIM-3 exon 6; Set B
cuuccaagauucucaccuuuucccaac

SEQ ID NO: 69435 - RNA, 31 nt, Artificial Sequence
  Synthetic Oligonucleotide; TIM-3 exon 6; Set C
gggacuuccaagauucucaccuuuucccaac

SEQ ID NO: 69436 - RNA, 30 nt, Artificial Sequence
  Synthetic Oligonucleotide; TIM-3 exon 6; Set C
gggacuuccaagauucucaccuuuucccaa

SEQ ID NO: 69437 - RNA, 30 nt, Artificial Sequence
  Synthetic Oligonucleotide; TIM-3 exon 6; Set C
agccaauaaaaaugcauucauaaaauaaau

SEQ ID NO: 69438 - RNA, 31 nt, Artificial Sequence
  Synthetic Oligonucleotide; TIM-3 exon 6; Set C
aagccaauaaaaaugcauucauaaaauaaau

SEQ ID NO: 69439 - RNA, 32 nt, Artificial Sequence
  Synthetic Oligonucleotide; TIM-3 exon 6; Set C
aaagccaauaaaaaugcauucauaaaauaaau

SEQ ID NO: 69440 - RNA, 34 nt, Artificial Sequence
  Synthetic Oligonucleotide; TIM-3 exon 6; Set C
caaaagccaauaaaaaugcauucauaaaauaaau

SEQ ID NO: 69441 - RNA, 35 nt, Artificial Sequence
  Synthetic Oligonucleotide; TIM-3 exon 6; Set C
acaaaagccaauaaaaaugcauucauaaaauaaau

SEQ ID NO: 69442 - RNA, 36 nt, Artificial Sequence
  Synthetic Oligonucleotide; TIM-3 exon 6; Set C
aacaaaagccaauaaaaaugcauucauaaaauaaau

SEQ ID NO: 69443 - RNA, 19 nt, Artificial Sequence
  Synthetic Oligonucleotide; TIM-3 exon 6; Set C
agccaauaaaaaugcauuc

SEQ ID NO: 69444 - RNA, 20 nt, Artificial Sequence
  Synthetic Oligonucleotide; TIM-3 exon 6; Set C
aagccaauaaaaaugcauuc

SEQ ID NO: 69445 - RNA, 23 nt, Artificial Sequence
  Synthetic Oligonucleotide; TIM-3 exon 6; Set C
caaaagccaauaaaaaugcauuc

SEQ ID NO: 69446 - RNA, 24 nt, Artificial Sequence
  Synthetic Oligonucleotide; TIM-3 exon 6; Set C
acaaaagccaauaaaaaugcauuc

SEQ ID NO: 69447 - RNA, 25 nt, Artificial Sequence
  Synthetic Oligonucleotide; TIM-3 exon 6; Set C
aacaaaagccaauaaaaaugcauuc

SEQ ID NO: 69448 - RNA, 35 nt, Artificial Sequence
  Synthetic Oligonucleotide; TIM-3 exon 6; Set A
uaagggggaaacaaaagccaauaaaaaugcauuca

SEQ ID NO: 69449 - RNA, 34 nt, Artificial Sequence
  Synthetic Oligonucleotide; TIM-3 exon 6; Set C
uaagggggaaacaaaagccaauaaaaaugcauuc

SEQ ID NO: 69450 - RNA, 30 nt, Artificial Sequence
  Synthetic Oligonucleotide; TIM-3 exon 6; Set A
uaugagaauacccuaguaagggggaaacaa

SEQ ID NO: 69451 - RNA, 31 nt, Artificial Sequence
  Synthetic Oligonucleotide; TIM-3 exon 6; Set A
cuaugagaauacccuaguaagggggaaacaa

SEQ ID NO: 69452 - RNA, 29 nt, Artificial Sequence
  Synthetic Oligonucleotide; TIM-3 exon 6; Set A
uaugagaauacccuaguaagggggaaaca

SEQ ID NO: 69453 - RNA, 32 nt, Artificial Sequence
  Synthetic Oligonucleotide; TIM-3 exon 6; Set A
gcuaugagaauacccuaguaagggggaaacaa

SEQ ID NO: 69454 - RNA, 28 nt, Artificial Sequence
  Synthetic Oligonucleotide; TIM-3 exon 6; Set A
uaugagaauacccuaguaagggggaaac

SEQ ID NO: 69455 - RNA, 30 nt, Artificial Sequence
  Synthetic Oligonucleotide; TIM-3 exon 6; Set A
cuaugagaauacccuaguaagggggaaaca

SEQ ID NO: 69456 - RNA, 27 nt, Artificial Sequence
  Synthetic Oligonucleotide; TIM-3 exon 6; Set A
uaugagaauacccuaguaagggggaaa

SEQ ID NO: 69457 - RNA, 31 nt, Artificial Sequence
  Synthetic Oligonucleotide; TIM-3 exon 6; Set A
gcuaugagaauacccuaguaagggggaaaca

SEQ ID NO: 69458 - RNA, 29 nt, Artificial Sequence
  Synthetic Oligonucleotide; TIM-3 exon 6; Set A
cuaugagaauacccuaguaagggggaaac

SEQ ID NO: 69459 - RNA, 26 nt, Artificial Sequence
  Synthetic Oligonucleotide; TIM-3 exon 6; Set A
uaugagaauacccuaguaagggggaa

SEQ ID NO: 69460 - RNA, 28 nt, Artificial Sequence
  Synthetic Oligonucleotide; TIM-3 exon 6; Set A
cuaugagaauacccuaguaagggggaaa

SEQ ID NO: 69461 - RNA, 32 nt, Artificial Sequence
  Synthetic Oligonucleotide; TIM-3 exon 6; Set A
ugcuaugagaauacccuaguaagggggaaaca

SEQ ID NO: 69462 - RNA, 30 nt, Artificial Sequence
  Synthetic Oligonucleotide; TIM-3 exon 6; Set A
gcuaugagaauacccuaguaagggggaaac

SEQ ID NO: 69463 - RNA, 25 nt, Artificial Sequence
  Synthetic Oligonucleotide; TIM-3 exon 6; Set A
uaugagaauacccuaguaaggggga

SEQ ID NO: 69464 - RNA, 31 nt, Artificial Sequence
  Synthetic Oligonucleotide; TIM-3 exon 6; Set A
ugcuaugagaauacccuaguaagggggaaac

SEQ ID NO: 69465 - RNA, 26 nt, Artificial Sequence
  Synthetic Oligonucleotide; TIM-3 exon 6; Set A
cuaugagaauacccuaguaaggggga

SEQ ID NO: 69466 - RNA, 32 nt, Artificial Sequence
  Synthetic Oligonucleotide; TIM-3 exon 6; Set A
uugcuaugagaauacccuaguaagggggaaac

SEQ ID NO: 69467 - RNA, 19 nt, Artificial Sequence
  Synthetic Oligonucleotide; TIM-3 exon 6; Set C
uaugagaauacccuaguaa

SEQ ID NO: 69468 - RNA, 20 nt, Artificial Sequence
  Synthetic Oligonucleotide; TIM-3 exon 6; Set C
cuaugagaauacccuaguaa

SEQ ID NO: 69469 - RNA, 17 nt, Artificial Sequence
  Synthetic Oligonucleotide; TIM-3 exon 6; Set C
uaugagaauacccuagu

SEQ ID NO: 69470 - RNA, 21 nt, Artificial Sequence
  Synthetic Oligonucleotide; TIM-3 exon 6; Set C
gcuaugagaauacccuaguaa

SEQ ID NO: 69471 - RNA, 33 nt, Artificial Sequence
  Synthetic Oligonucleotide; TIM-3 exon 6; Set A
cuuaccuuaaauucuguaucuucucuuugcuau

SEQ ID NO: 69472 - RNA, 32 nt, Artificial Sequence
  Synthetic Oligonucleotide; TIM-3 exon 6; Set A
cuuaccuuaaauucuguaucuucucuuugcua

SEQ ID NO: 69473 - RNA, 31 nt, Artificial Sequence
  Synthetic Oligonucleotide; TIM-3 exon 6; Set A
cuuaccuuaaauucuguaucuucucuuugcu

SEQ ID NO: 69474 - RNA, 34 nt, Artificial Sequence
  Synthetic Oligonucleotide; TIM-3 exon 6; Set A
uucuuaccuuaaauucuguaucuucucuuugcua

SEQ ID NO: 69475 - RNA, 30 nt, Artificial Sequence
  Synthetic Oligonucleotide; TIM-3 exon 6; Set A
cuuaccuuaaauucuguaucuucucuuugc

SEQ ID NO: 69476 - RNA, 29 nt, Artificial Sequence
  Synthetic Oligonucleotide; TIM-3 exon 6; Set C
cuuaccuuaaauucuguaucuucucuuug

SEQ ID NO: 69477 - RNA, 33 nt, Artificial Sequence
  Synthetic Oligonucleotide; TIM-3 exon 6; Set A
uucuuaccuuaaauucuguaucuucucuuugcu

SEQ ID NO: 69478 - RNA, 28 nt, Artificial Sequence
  Synthetic Oligonucleotide; TIM-3 exon 6; Set C
cuuaccuuaaauucuguaucuucucuuu

SEQ ID NO: 69479 - RNA, 30 nt, Artificial Sequence
  Synthetic Oligonucleotide; TIM-3 exon 6; Set C
ucuuaccuuaaauucuguaucuucucuuug

SEQ ID NO: 69480 - RNA, 32 nt, Artificial Sequence
  Synthetic Oligonucleotide; TIM-3 exon 6; Set A
uucuuaccuuaaauucuguaucuucucuuugc

SEQ ID NO: 69481 - RNA, 29 nt, Artificial Sequence
  Synthetic Oligonucleotide; TIM-3 exon 6; Set C
ucuuaccuuaaauucuguaucuucucuuu

SEQ ID NO: 69482 - RNA, 31 nt, Artificial Sequence
  Synthetic Oligonucleotide; TIM-3 exon 6; Set C
uucuuaccuuaaauucuguaucuucucuuug

SEQ ID NO: 69483 - RNA, 30 nt, Artificial Sequence
  Synthetic Oligonucleotide; TIM-3 exon 6; Set C
uucuuaccuuaaauucuguaucuucucuuu

SEQ ID NO: 69484 - RNA, 32 nt, Artificial Sequence
  Synthetic Oligonucleotide; TIM-3 exon 6; Set C
auucuuaccuuaaauucuguaucuucucuuug

SEQ ID NO: 69485 - RNA, 31 nt, Artificial Sequence
  Synthetic Oligonucleotide; TIM-3 exon 6; Set C
auucuuaccuuaaauucuguaucuucucuuu

SEQ ID NO: 69486 - RNA, 15 nt, Artificial Sequence
  Synthetic Oligonucleotide; TIM-3 exon 6; Set C
cauuauucuuaccuu

SEQ ID NO: 69487 - RNA, 22 nt, Artificial Sequence
  Synthetic Oligonucleotide; TIM-3 exon 6; Set C
auuccauuauucuuaccuuaaa

SEQ ID NO: 69488 - RNA, 16 nt, Artificial Sequence
  Synthetic Oligonucleotide; TIM-3 exon 6; Set C
ccauuauucuuaccuu

SEQ ID NO: 69489 - RNA, 21 nt, Artificial Sequence
  Synthetic Oligonucleotide; TIM-3 exon 6; Set C
auuccauuauucuuaccuuaa

SEQ ID NO: 69490 - RNA, 17 nt, Artificial Sequence
  Synthetic Oligonucleotide; TIM-3 exon 6; Set C
uccauuauucuuaccuu

SEQ ID NO: 69491 - RNA, 15 nt, Artificial Sequence
  Synthetic Oligonucleotide; TIM-3 exon 6; Set C
ccauuauucuuaccu

SEQ ID NO: 69492 - RNA, 20 nt, Artificial Sequence
  Synthetic Oligonucleotide; TIM-3 exon 6; Set C
auuccauuauucuuaccuua

SEQ ID NO: 69493 - RNA, 16 nt, Artificial Sequence
  Synthetic Oligonucleotide; TIM-3 exon 6; Set C
uccauuauucuuaccu

SEQ ID NO: 69494 - RNA, 19 nt, Artificial Sequence
  Synthetic Oligonucleotide; TIM-3 exon 6; Set C
auuccauuauucuuaccuu

SEQ ID NO: 69495 - RNA, 15 nt, Artificial Sequence
  Synthetic Oligonucleotide; TIM-3 exon 6; Set C
uccauuauucuuacc

SEQ ID NO: 69496 - RNA, 18 nt, Artificial Sequence
  Synthetic Oligonucleotide; TIM-3 exon 6; Set C
auuccauuauucuuaccu

SEQ ID NO: 69497 - RNA, 17 nt, Artificial Sequence
  Synthetic Oligonucleotide; TIM-3 exon 6; Set C
auuccauuauucuuacc

SEQ ID NO: 69498 - RNA, 16 nt, Artificial Sequence
  Synthetic Oligonucleotide; TIM-3 exon 6; Set C
auuccauuauucuuac

SEQ ID NO: 69499 - RNA, 15 nt, Artificial Sequence
  Synthetic Oligonucleotide; TIM-3 exon 6; Set C
auuccauuauucuua

SEQ ID NO: 69500 - RNA, 20 nt, Artificial Sequence
  Synthetic Oligonucleotide; TIM-3 exon 6; Set C
aaccccauuccauuauucuu

SEQ ID NO: 69501 - RNA, 19 nt, Artificial Sequence
  Synthetic Oligonucleotide; TIM-3 exon 6; Set C
aaccccauuccauuauucu

SEQ ID NO: 69502 - RNA, 21 nt, Artificial Sequence
  Synthetic Oligonucleotide; TIM-3 exon 6; Set C
caaccccauuccauuauucuu

SEQ ID NO: 69503 - RNA, 20 nt, Artificial Sequence
  Synthetic Oligonucleotide; TIM-3 exon 6; Set C
caaccccauuccauuauucu

SEQ ID NO: 69504 - RNA, 18 nt, Artificial Sequence
  Synthetic Oligonucleotide; TIM-3 exon 6; Set C
aaccccauuccauuauuc

SEQ ID NO: 69505 - RNA, 17 nt, Artificial Sequence
  Synthetic Oligonucleotide; TIM-3 exon 6; Set C
aaccccauuccauuauu

SEQ ID NO: 69506 - RNA, 19 nt, Artificial Sequence
  Synthetic Oligonucleotide; TIM-3 exon 6; Set C
caaccccauuccauuauuc

SEQ ID NO: 69507 - RNA, 16 nt, Artificial Sequence
  Synthetic Oligonucleotide; TIM-3 exon 6; Set C
aaccccauuccauuau

SEQ ID NO: 69508 - RNA, 18 nt, Artificial Sequence
  Synthetic Oligonucleotide; TIM-3 exon 6; Set C
caaccccauuccauuauu

SEQ ID NO: 69509 - RNA, 17 nt, Artificial Sequence
  Synthetic Oligonucleotide; TIM-3 exon 6; Set C
caaccccauuccauuau

SEQ ID NO: 69510 - RNA, 37 nt, Artificial Sequence
  Synthetic Oligonucleotide; TIM-3 exon 6; Set C
ucaccuuuucccaaccccauuccauuauucuuaccuu

SEQ ID NO: 69511 - RNA, 36 nt, Artificial Sequence
  Synthetic Oligonucleotide; TIM-3 exon 6; Set C
ucaccuuuucccaaccccauuccauuauucuuaccu

SEQ ID NO: 69512 - RNA, 35 nt, Artificial Sequence
  Synthetic Oligonucleotide; TIM-3 exon 6; Set C
ucaccuuuucccaaccccauuccauuauucuuacc

SEQ ID NO: 69513 - RNA, 34 nt, Artificial Sequence
  Synthetic Oligonucleotide; TIM-3 exon 6; Set C
ucaccuuuucccaaccccauuccauuauucuuac

SEQ ID NO: 69514 - RNA, 33 nt, Artificial Sequence
  Synthetic Oligonucleotide; TIM-3 exon 6; Set C
ucaccuuuucccaaccccauuccauuauucuua

SEQ ID NO: 69515 - RNA, 33 nt, Artificial Sequence
  Synthetic Oligonucleotide; TIM-3 exon 6; Set C
cucaccuuuucccaaccccauuccauuauucuu

SEQ ID NO: 69516 - RNA, 32 nt, Artificial Sequence
  Synthetic Oligonucleotide; TIM-3 exon 6; Set C
cucaccuuuucccaaccccauuccauuauucu

SEQ ID NO: 69517 - RNA, 34 nt, Artificial Sequence
  Synthetic Oligonucleotide; TIM-3 exon 6; Set C
ucucaccuuuucccaaccccauuccauuauucuu

SEQ ID NO: 69518 - RNA, 33 nt, Artificial Sequence
  Synthetic Oligonucleotide; TIM-3 exon 6; Set C
ucucaccuuuucccaaccccauuccauuauucu

SEQ ID NO: 69519 - RNA, 31 nt, Artificial Sequence
  Synthetic Oligonucleotide; TIM-3 exon 6; Set C
cucaccuuuucccaaccccauuccauuauuc

SEQ ID NO: 69520 - RNA, 35 nt, Artificial Sequence
  Synthetic Oligonucleotide; TIM-3 exon 6; Set C
uucucaccuuuucccaaccccauuccauuauucuu

SEQ ID NO: 69521 - RNA, 34 nt, Artificial Sequence
  Synthetic Oligonucleotide; TIM-3 exon 6; Set C
uucucaccuuuucccaaccccauuccauuauucu

SEQ ID NO: 69522 - RNA, 30 nt, Artificial Sequence
  Synthetic Oligonucleotide; TIM-3 exon 6; Set C
cucaccuuuucccaaccccauuccauuauu

SEQ ID NO: 69523 - RNA, 32 nt, Artificial Sequence
  Synthetic Oligonucleotide; TIM-3 exon 6; Set C
ucucaccuuuucccaaccccauuccauuauuc

SEQ ID NO: 69524 - RNA, 36 nt, Artificial Sequence
  Synthetic Oligonucleotide; TIM-3 exon 6; Set C
auucucaccuuuucccaaccccauuccauuauucuu

SEQ ID NO: 69525 - RNA, 27 nt, Artificial Sequence
  Synthetic Oligonucleotide; TIM-3 exon 6; Set C
ucaccuuuucccaaccccauuccauua

SEQ ID NO: 69526 - RNA, 29 nt, Artificial Sequence
  Synthetic Oligonucleotide; TIM-3 exon 6; Set C
cucaccuuuucccaaccccauuccauuau

SEQ ID NO: 69527 - RNA, 31 nt, Artificial Sequence
  Synthetic Oligonucleotide; TIM-3 exon 6; Set C
ucucaccuuuucccaaccccauuccauuauu

SEQ ID NO: 69528 - RNA, 33 nt, Artificial Sequence
  Synthetic Oligonucleotide; TIM-3 exon 6; Set C
uucucaccuuuucccaaccccauuccauuauuc

SEQ ID NO: 69529 - RNA, 26 nt, Artificial Sequence
  Synthetic Oligonucleotide; TIM-3 exon 6; Set C
ucaccuuuucccaaccccauuccauu

SEQ ID NO: 69530 - RNA, 30 nt, Artificial Sequence
  Synthetic Oligonucleotide; TIM-3 exon 6; Set C
ucucaccuuuucccaaccccauuccauuau

SEQ ID NO: 69531 - RNA, 32 nt, Artificial Sequence
  Synthetic Oligonucleotide; TIM-3 exon 6; Set C
uucucaccuuuucccaaccccauuccauuauu

SEQ ID NO: 69532 - RNA, 34 nt, Artificial Sequence
  Synthetic Oligonucleotide; TIM-3 exon 6; Set C
auucucaccuuuucccaaccccauuccauuauuc

SEQ ID NO: 69533 - RNA, 38 nt, Artificial Sequence
  Synthetic Oligonucleotide; TIM-3 exon 6; Set C
agauucucaccuuuucccaaccccauuccauuauucuu

SEQ ID NO: 69534 - RNA, 37 nt, Artificial Sequence
  Synthetic Oligonucleotide; TIM-3 exon 6; Set C
agauucucaccuuuucccaaccccauuccauuauucu

SEQ ID NO: 69535 - RNA, 31 nt, Artificial Sequence
  Synthetic Oligonucleotide; TIM-3 exon 6; Set C
uucucaccuuuucccaaccccauuccauuau

SEQ ID NO: 69536 - RNA, 33 nt, Artificial Sequence
  Synthetic Oligonucleotide; TIM-3 exon 6; Set C
auucucaccuuuucccaaccccauuccauuauu

SEQ ID NO: 69537 - RNA, 39 nt, Artificial Sequence
  Synthetic Oligonucleotide; TIM-3 exon 6; Set C
aagauucucaccuuuucccaaccccauuccauuauucuu

SEQ ID NO: 69538 - RNA, 38 nt, Artificial Sequence
  Synthetic Oligonucleotide; TIM-3 exon 6; Set C
aagauucucaccuuuucccaaccccauuccauuauucu

SEQ ID NO: 69539 - RNA, 32 nt, Artificial Sequence
  Synthetic Oligonucleotide; TIM-3 exon 6; Set C
auucucaccuuuucccaaccccauuccauuau

SEQ ID NO: 69540 - RNA, 36 nt, Artificial Sequence
  Synthetic Oligonucleotide; TIM-3 exon 6; Set C
agauucucaccuuuucccaaccccauuccauuauuc

SEQ ID NO: 69541 - RNA, 39 nt, Artificial Sequence
  Synthetic Oligonucleotide; TIM-3 exon 6; Set C
caagauucucaccuuuucccaaccccauuccauuauucu

SEQ ID NO: 69542 - RNA, 35 nt, Artificial Sequence
  Synthetic Oligonucleotide; TIM-3 exon 6; Set C
agauucucaccuuuucccaaccccauuccauuauu

SEQ ID NO: 69543 - RNA, 37 nt, Artificial Sequence
  Synthetic Oligonucleotide; TIM-3 exon 6; Set C
aagauucucaccuuuucccaaccccauuccauuauuc

SEQ ID NO: 69544 - RNA, 40 nt, Artificial Sequence
  Synthetic Oligonucleotide; TIM-3 exon 6; Set C
ccaagauucucaccuuuucccaaccccauuccauuauucu

SEQ ID NO: 69545 - RNA, 34 nt, Artificial Sequence
  Synthetic Oligonucleotide; TIM-3 exon 6; Set C
agauucucaccuuuucccaaccccauuccauuau

SEQ ID NO: 69546 - RNA, 36 nt, Artificial Sequence
  Synthetic Oligonucleotide; TIM-3 exon 6; Set C
aagauucucaccuuuucccaaccccauuccauuauu

SEQ ID NO: 69547 - RNA, 35 nt, Artificial Sequence
  Synthetic Oligonucleotide; TIM-3 exon 6; Set C
aagauucucaccuuuucccaaccccauuccauuau

SEQ ID NO: 69548 - RNA, 37 nt, Artificial Sequence
  Synthetic Oligonucleotide; TIM-3 exon 6; Set C
caagauucucaccuuuucccaaccccauuccauuauu

SEQ ID NO: 69549 - RNA, 39 nt, Artificial Sequence
  Synthetic Oligonucleotide; TIM-3 exon 6; Set C
ccaagauucucaccuuuucccaaccccauuccauuauuc

SEQ ID NO: 69550 - RNA, 36 nt, Artificial Sequence
  Synthetic Oligonucleotide; TIM-3 exon 6; Set C
caagauucucaccuuuucccaaccccauuccauuau

SEQ ID NO: 69551 - RNA, 38 nt, Artificial Sequence
  Synthetic Oligonucleotide; TIM-3 exon 6; Set C
ccaagauucucaccuuuucccaaccccauuccauuauu

SEQ ID NO: 69552 - RNA, 40 nt, Artificial Sequence
  Synthetic Oligonucleotide; TIM-3 exon 6; Set C
uccaagauucucaccuuuucccaaccccauuccauuauuc

SEQ ID NO: 69553 - RNA, 37 nt, Artificial Sequence
  Synthetic Oligonucleotide; TIM-3 exon 6; Set C
ccaagauucucaccuuuucccaaccccauuccauuau

SEQ ID NO: 69554 - RNA, 30 nt, Artificial Sequence
  Synthetic Oligonucleotide; TIM-3 exon 6; Set C
caagauucucaccuuuucccaaccccauuc

SEQ ID NO: 69555 - RNA, 17 nt, Artificial Sequence
  Synthetic Oligonucleotide; TIM-3 exon 6; Set C
ucucaccuuuucccaac

SEQ ID NO: 69556 - RNA, 18 nt, Artificial Sequence
  Synthetic Oligonucleotide; TIM-3 exon 6; Set C
uucucaccuuuucccaac

SEQ ID NO: 69557 - RNA, 19 nt, Artificial Sequence
  Synthetic Oligonucleotide; TIM-3 exon 6; Set C
auucucaccuuuucccaac

SEQ ID NO: 69558 - RNA, 20 nt, Artificial Sequence
  Synthetic Oligonucleotide; TIM-3 exon 6; Set C
gauucucaccuuuucccaac

SEQ ID NO: 69559 - RNA, 18 nt, Artificial Sequence
  Synthetic Oligonucleotide; TIM-3 exon 6; Set C
auucucaccuuuucccaa

SEQ ID NO: 69560 - RNA, 21 nt, Artificial Sequence
  Synthetic Oligonucleotide; TIM-3 exon 6; Set C
agauucucaccuuuucccaac

SEQ ID NO: 69561 - RNA, 19 nt, Artificial Sequence
  Synthetic Oligonucleotide; TIM-3 exon 6; Set C
gauucucaccuuuucccaa

SEQ ID NO: 69562 - RNA, 22 nt, Artificial Sequence
  Synthetic Oligonucleotide; TIM-3 exon 6; Set C
aagauucucaccuuuucccaac

SEQ ID NO: 69563 - RNA, 24 nt, Artificial Sequence
  Synthetic Oligonucleotide; TIM-3 exon 6; Set B
ccaagauucucaccuuuucccaac

SEQ ID NO: 69564 - RNA, 25 nt, Artificial Sequence
  Synthetic Oligonucleotide; TIM-3 exon 6; Set B
uccaagauucucaccuuuucccaac

SEQ ID NO: 69565 - RNA, 24 nt, Artificial Sequence
  Synthetic Oligonucleotide; TIM-3 exon 6; Set B
uccaagauucucaccuuuucccaa

SEQ ID NO: 69566 - RNA, 25 nt, Artificial Sequence
  Synthetic Oligonucleotide; TIM-3 exon 6; Set B
uuccaagauucucaccuuuucccaa

SEQ ID NO: 69567 - RNA, 26 nt, Artificial Sequence
  Synthetic Oligonucleotide; TIM-3 exon 6; Set B
cuuccaagauucucaccuuuucccaa

SEQ ID NO: 69568 - RNA, 15 nt, Artificial Sequence
  Synthetic Oligonucleotide; PD-1 target exon 3; Set C
ggucaggguggaggg

SEQ ID NO: 69569 - RNA, 16 nt, Artificial Sequence
  Synthetic Oligonucleotide; PD-1 target exon 3; Set A
gggucaggguggaggg

SEQ ID NO: 69570 - RNA, 17 nt, Artificial Sequence
  Synthetic Oligonucleotide; PD-1 target exon 3; Set A
ggggucaggguggaggg

SEQ ID NO: 69571 - RNA, 15 nt, Artificial Sequence
  Synthetic Oligonucleotide; PD-1 target exon 3; Set C
gggucaggguggagg

SEQ ID NO: 69572 - RNA, 16 nt, Artificial Sequence
  Synthetic Oligonucleotide; PD-1 target exon 3; Set A
ggggucaggguggagg

SEQ ID NO: 69573 - RNA, 15 nt, Artificial Sequence
  Synthetic Oligonucleotide; PD-1 target exon 3; Set C
ggggucaggguggag

SEQ ID NO: 69574 - RNA, 22 nt, Artificial Sequence
  Synthetic Oligonucleotide; PD-1 target exon 3; Set C
aggacggggucaggguggaggg

SEQ ID NO: 69575 - RNA, 23 nt, Artificial Sequence
  Synthetic Oligonucleotide; PD-1 target exon 3; Set C
uaggacggggucaggguggaggg

SEQ ID NO: 69576 - RNA, 21 nt, Artificial Sequence
  Synthetic Oligonucleotide; PD-1 target exon 3; Set C
aggacggggucaggguggagg

SEQ ID NO: 69577 - RNA, 20 nt, Artificial Sequence
  Synthetic Oligonucleotide; PD-1 target exon 3; Set A
aggacggggucaggguggag

SEQ ID NO: 69578 - RNA, 24 nt, Artificial Sequence
  Synthetic Oligonucleotide; PD-1 target exon 3; Set C
uuaggacggggucaggguggaggg

SEQ ID NO: 69579 - RNA, 22 nt, Artificial Sequence
  Synthetic Oligonucleotide; PD-1 target exon 3; Set C
uaggacggggucaggguggagg

SEQ ID NO: 69580 - RNA, 23 nt, Artificial Sequence
  Synthetic Oligonucleotide; PD-1 target exon 3; Set C
uuaggacggggucaggguggagg

SEQ ID NO: 69581 - RNA, 19 nt, Artificial Sequence
  Synthetic Oligonucleotide; PD-1 target exon 3; Set A
gggguuaggacggggucag

SEQ ID NO: 69582 - RNA, 20 nt, Artificial Sequence
  Synthetic Oligonucleotide; PD-1 target exon 3; Set A
agggguuaggacggggucag

SEQ ID NO: 69583 - RNA, 18 nt, Artificial Sequence
  Synthetic Oligonucleotide; PD-1 target exon 3; Set A
gggguuaggacgggguca

SEQ ID NO: 69584 - RNA, 21 nt, Artificial Sequence
  Synthetic Oligonucleotide; PD-1 target exon 3; Set A
cagggguuaggacggggucag

SEQ ID NO: 69585 - RNA, 19 nt, Artificial Sequence
  Synthetic Oligonucleotide; PD-1 target exon 3; Set A
agggguuaggacgggguca

SEQ ID NO: 69586 - RNA, 17 nt, Artificial Sequence
  Synthetic Oligonucleotide; PD-1 target exon 3; Set A
gggguuaggacgggguc

SEQ ID NO: 69587 - RNA, 22 nt, Artificial Sequence
  Synthetic Oligonucleotide; PD-1 target exon 3; Set C
ucagggguuaggacggggucag

SEQ ID NO: 69588 - RNA, 18 nt, Artificial Sequence
  Synthetic Oligonucleotide; PD-1 target exon 3; Set A
agggguuaggacgggguc

SEQ ID NO: 69589 - RNA, 23 nt, Artificial Sequence
  Synthetic Oligonucleotide; PD-1 target exon 3; Set C
gucagggguuaggacggggucag

SEQ ID NO: 69590 - RNA, 21 nt, Artificial Sequence
  Synthetic Oligonucleotide; PD-1 target exon 3; Set C
ucagggguuaggacgggguca

SEQ ID NO: 69591 - RNA, 22 nt, Artificial Sequence
  Synthetic Oligonucleotide; PD-1 target exon 3; Set C
gucagggguuaggacgggguca

SEQ ID NO: 69592 - RNA, 20 nt, Artificial Sequence
  Synthetic Oligonucleotide; PD-1 target exon 3; Set A
ucagggguuaggacgggguc

SEQ ID NO: 69593 - RNA, 21 nt, Artificial Sequence
  Synthetic Oligonucleotide; PD-1 target exon 3; Set C
gucagggguuaggacgggguc

SEQ ID NO: 69594 - RNA, 24 nt, Artificial Sequence
  Synthetic Oligonucleotide; PD-1 target exon 3; Set C
aggucagggguuaggacgggguca

SEQ ID NO: 69595 - RNA, 25 nt, Artificial Sequence
  Synthetic Oligonucleotide; PD-1 target exon 3; Set C
aaggucagggguuaggacgggguca

SEQ ID NO: 69596 - RNA, 23 nt, Artificial Sequence
  Synthetic Oligonucleotide; PD-1 target exon 3; Set C
aggucagggguuaggacgggguc

SEQ ID NO: 69597 - RNA, 24 nt, Artificial Sequence
  Synthetic Oligonucleotide; PD-1 target exon 3; Set C
aaggucagggguuaggacgggguc

SEQ ID NO: 69598 - RNA, 18 nt, Artificial Sequence
  Synthetic Oligonucleotide; PD-1 target exon 3; Set A
ggucagggguuaggacgg

SEQ ID NO: 69599 - RNA, 17 nt, Artificial Sequence
  Synthetic Oligonucleotide; PD-1 target exon 3; Set C
ggucagggguuaggacg

SEQ ID NO: 69600 - RNA, 19 nt, Artificial Sequence
  Synthetic Oligonucleotide; PD-1 target exon 3; Set A
aggucagggguuaggacgg

SEQ ID NO: 69601 - RNA, 16 nt, Artificial Sequence
  Synthetic Oligonucleotide; PD-1 target exon 3; Set C
ggucagggguuaggac

SEQ ID NO: 69602 - RNA, 18 nt, Artificial Sequence
  Synthetic Oligonucleotide; PD-1 target exon 3; Set C
aggucagggguuaggacg

SEQ ID NO: 69603 - RNA, 20 nt, Artificial Sequence
  Synthetic Oligonucleotide; PD-1 target exon 3; Set A
aaggucagggguuaggacgg

SEQ ID NO: 69604 - RNA, 15 nt, Artificial Sequence
  Synthetic Oligonucleotide; PD-1 target exon 3; Set C
ggucagggguuagga

SEQ ID NO: 69605 - RNA, 17 nt, Artificial Sequence
  Synthetic Oligonucleotide; PD-1 target exon 3; Set C
aggucagggguuaggac

SEQ ID NO: 69606 - RNA, 19 nt, Artificial Sequence
  Synthetic Oligonucleotide; PD-1 target exon 3; Set C
aaggucagggguuaggacg

SEQ ID NO: 69607 - RNA, 16 nt, Artificial Sequence
  Synthetic Oligonucleotide; PD-1 target exon 3; Set C
aggucagggguuagga

SEQ ID NO: 69608 - RNA, 18 nt, Artificial Sequence
  Synthetic Oligonucleotide; PD-1 target exon 3; Set C
aaggucagggguuaggac

SEQ ID NO: 69609 - RNA, 17 nt, Artificial Sequence
  Synthetic Oligonucleotide; PD-1 target exon 3; Set C
aaggucagggguuagga

SEQ ID NO: 69610 - RNA, 33 nt, Artificial Sequence
  Synthetic Oligonucleotide; PD-1 target exon 3; Set C
cuggaagggcacaaaggucagggguuaggacgg

SEQ ID NO: 69611 - RNA, 32 nt, Artificial Sequence
  Synthetic Oligonucleotide; PD-1 target exon 3; Set C
cuggaagggcacaaaggucagggguuaggacg

SEQ ID NO: 69612 - RNA, 34 nt, Artificial Sequence
  Synthetic Oligonucleotide; PD-1 target exon 3; Set C
ucuggaagggcacaaaggucagggguuaggacgg

SEQ ID NO: 69613 - RNA, 31 nt, Artificial Sequence
  Synthetic Oligonucleotide; PD-1 target exon 3; Set C
cuggaagggcacaaaggucagggguuaggac

SEQ ID NO: 69614 - RNA, 33 nt, Artificial Sequence
  Synthetic Oligonucleotide; PD-1 target exon 3; Set C
ucuggaagggcacaaaggucagggguuaggacg

SEQ ID NO: 69615 - RNA, 35 nt, Artificial Sequence
  Synthetic Oligonucleotide; PD-1 target exon 3; Set C
cucuggaagggcacaaaggucagggguuaggacgg

SEQ ID NO: 69616 - RNA, 30 nt, Artificial Sequence
  Synthetic Oligonucleotide; PD-1 target exon 3; Set C
cuggaagggcacaaaggucagggguuagga

SEQ ID NO: 69617 - RNA, 32 nt, Artificial Sequence
  Synthetic Oligonucleotide; PD-1 target exon 3; Set C
ucuggaagggcacaaaggucagggguuaggac

SEQ ID NO: 69618 - RNA, 34 nt, Artificial Sequence
  Synthetic Oligonucleotide; PD-1 target exon 3; Set C
cucuggaagggcacaaaggucagggguuaggacg

SEQ ID NO: 69619 - RNA, 36 nt, Artificial Sequence
  Synthetic Oligonucleotide; PD-1 target exon 3; Set C
ucucuggaagggcacaaaggucagggguuaggacgg

SEQ ID NO: 69620 - RNA, 31 nt, Artificial Sequence
  Synthetic Oligonucleotide; PD-1 target exon 3; Set C
ucuggaagggcacaaaggucagggguuagga

SEQ ID NO: 69621 - RNA, 33 nt, Artificial Sequence
  Synthetic Oligonucleotide; PD-1 target exon 3; Set C
cucuggaagggcacaaaggucagggguuaggac

SEQ ID NO: 69622 - RNA, 35 nt, Artificial Sequence
  Synthetic Oligonucleotide; PD-1 target exon 3; Set C
ucucuggaagggcacaaaggucagggguuaggacg

SEQ ID NO: 69623 - RNA, 32 nt, Artificial Sequence
  Synthetic Oligonucleotide; PD-1 target exon 3; Set C
cucuggaagggcacaaaggucagggguuagga

SEQ ID NO: 69624 - RNA, 34 nt, Artificial Sequence
  Synthetic Oligonucleotide; PD-1 target exon 3; Set C
ucucuggaagggcacaaaggucagggguuaggac

SEQ ID NO: 69625 - RNA, 33 nt, Artificial Sequence
  Synthetic Oligonucleotide; PD-1 target exon 3; Set C
ucucuggaagggcacaaaggucagggguuagga

SEQ ID NO: 69626 - RNA, 25 nt, Artificial Sequence
  Synthetic Oligonucleotide; PD-1 target exon 3; Set C
cuggaagggcacaaaggucaggggu

SEQ ID NO: 69627 - RNA, 26 nt, Artificial Sequence
  Synthetic Oligonucleotide; PD-1 target exon 3; Set C
ucuggaagggcacaaaggucaggggu

SEQ ID NO: 69628 - RNA, 24 nt, Artificial Sequence
  Synthetic Oligonucleotide; PD-1 target exon 3; Set A
cuggaagggcacaaaggucagggg

SEQ ID NO: 69629 - RNA, 25 nt, Artificial Sequence
  Synthetic Oligonucleotide; PD-1 target exon 3; Set A
ucuggaagggcacaaaggucagggg

SEQ ID NO: 69630 - RNA, 26 nt, Artificial Sequence
  Synthetic Oligonucleotide; PD-1 target exon 3; Set C
cucuggaagggcacaaaggucagggg

SEQ ID NO: 69631 - RNA, 27 nt, Artificial Sequence
  Synthetic Oligonucleotide; PD-1 target exon 3; Set C
ucucuggaagggcacaaaggucagggg

SEQ ID NO: 69632 - RNA, 23 nt, Artificial Sequence
  Synthetic Oligonucleotide; PD-1 target exon 3; Set A
ucuggaagggcacaaaggucagg

SEQ ID NO: 69633 - RNA, 24 nt, Artificial Sequence
  Synthetic Oligonucleotide; PD-1 target exon 3; Set A
cucuggaagggcacaaaggucagg

SEQ ID NO: 69634 - RNA, 26 nt, Artificial Sequence
  Synthetic Oligonucleotide; PD-1 target exon 3; Set A
ucucuggaagggcacaaaggucaggg

SEQ ID NO: 69635 - RNA, 25 nt, Artificial Sequence
  Synthetic Oligonucleotide; PD-1 target exon 3; Set A
ucucuggaagggcacaaaggucagg

SEQ ID NO: 69636 - RNA, 18 nt, Artificial Sequence
  Synthetic Oligonucleotide; PD-1 target exon 3; Set C
cuggaagggcacaaaggu

SEQ ID NO: 69637 - RNA, 19 nt, Artificial Sequence
  Synthetic Oligonucleotide; PD-1 target exon 3; Set C
ucuggaagggcacaaaggu

SEQ ID NO: 69638 - RNA, 20 nt, Artificial Sequence
  Synthetic Oligonucleotide; PD-1 target exon 3; Set C
cucuggaagggcacaaaggu

SEQ ID NO: 69639 - RNA, 21 nt, Artificial Sequence
  Synthetic Oligonucleotide; PD-1 target exon 3; Set A
ucucuggaagggcacaaaggu

SEQ ID NO: 69640 - RNA, 19 nt, Artificial Sequence
  Synthetic Oligonucleotide; PD-1 target exon 3; Set C
cucuggaagggcacaaagg

SEQ ID NO: 69641 - RNA, 20 nt, Artificial Sequence
  Synthetic Oligonucleotide; PD-1 target exon 3; Set C
ucucuggaagggcacaaagg

SEQ ID NO: 69642 - RNA, 26 nt, Artificial Sequence
  Synthetic Oligonucleotide; PD-1 target exon 3; Set C
ugugggcacuucugcccuucucucug

SEQ ID NO: 69643 - RNA, 25 nt, Artificial Sequence
  Synthetic Oligonucleotide; PD-1 target exon 3; Set C
ugugggcacuucugcccuucucucu

SEQ ID NO: 69644 - RNA, 24 nt, Artificial Sequence
  Synthetic Oligonucleotide; PD-1 target exon 3; Set C
ugugggcacuucugcccuucucuc

SEQ ID NO: 69645 - RNA, 25 nt, Artificial Sequence
  Synthetic Oligonucleotide; PD-1 target exon 3; Set C
ugggugaggggcuggggugggcugu

SEQ ID NO: 69646 - RNA, 26 nt, Artificial Sequence
  Synthetic Oligonucleotide; PD-1 target exon 3; Set C
cugggugaggggcuggggugggcugu

SEQ ID NO: 69647 - RNA, 17 nt, Artificial Sequence
  Synthetic Oligonucleotide; PD-1 target exon 3; Set A
ugggugaggggcugggg

SEQ ID NO: 69648 - RNA, 18 nt, Artificial Sequence
  Synthetic Oligonucleotide; PD-1 target exon 3; Set A
cugggugaggggcugggg

SEQ ID NO: 69649 - RNA, 36 nt, Artificial Sequence
  Synthetic Oligonucleotide; PD-1 target exon 3; Set C
uggaacuggccggcuggccugggugaggggcugggg

SEQ ID NO: 69650 - RNA, 37 nt, Artificial Sequence
  Synthetic Oligonucleotide; PD-1 target exon 3; Set C
uuggaacuggccggcuggccugggugaggggcugggg

SEQ ID NO: 69651 - RNA, 38 nt, Artificial Sequence
  Synthetic Oligonucleotide; PD-1 target exon 3; Set C
uuuggaacuggccggcuggccugggugaggggcugggg

SEQ ID NO: 69652 - RNA, 39 nt, Artificial Sequence
  Synthetic Oligonucleotide; PD-1 target exon 3; Set C
guuuggaacuggccggcuggccugggugaggggcugggg

SEQ ID NO: 69653 - RNA, 40 nt, Artificial Sequence
  Synthetic Oligonucleotide; PD-1 target exon 3; Set C
gguuuggaacuggccggcuggccugggugaggggcugggg

SEQ ID NO: 69654 - RNA, 25 nt, Artificial Sequence
  Synthetic Oligonucleotide; PD-1 target exon 3; Set C
gaacuggccggcuggccugggugag

SEQ ID NO: 69655 - RNA, 24 nt, Artificial Sequence
  Synthetic Oligonucleotide; PD-1 target exon 3; Set C
gaacuggccggcuggccuggguga

SEQ ID NO: 69656 - RNA, 26 nt, Artificial Sequence
  Synthetic Oligonucleotide; PD-1 target exon 3; Set C
ggaacuggccggcuggccugggugag

SEQ ID NO: 69657 - RNA, 25 nt, Artificial Sequence
  Synthetic Oligonucleotide; PD-1 target exon 3; Set C
ggaacuggccggcuggccuggguga

SEQ ID NO: 69658 - RNA, 23 nt, Artificial Sequence
  Synthetic Oligonucleotide; PD-1 target exon 3; Set C
gaacuggccggcuggccugggug

SEQ ID NO: 69659 - RNA, 27 nt, Artificial Sequence
  Synthetic Oligonucleotide; PD-1 target exon 3; Set C
uggaacuggccggcuggccugggugag

SEQ ID NO: 69660 - RNA, 24 nt, Artificial Sequence
  Synthetic Oligonucleotide; PD-1 target exon 3; Set C
ggaacuggccggcuggccugggug

SEQ ID NO: 69661 - RNA, 25 nt, Artificial Sequence
  Synthetic Oligonucleotide; PD-1 target exon 3; Set C
uggaacuggccggcuggccugggug

SEQ ID NO: 69662 - RNA, 32 nt, Artificial Sequence
  Synthetic Oligonucleotide; PD-1 target exon 3; Set C
gguuuggaacuggccggcuggccugggugagg

SEQ ID NO: 69663 - RNA, 23 nt, Artificial Sequence
  Synthetic Oligonucleotide; PD-1 target exon 3; Set A
acaccaaccaccaggguuuggaa

SEQ ID NO: 69664 - RNA, 19 nt, Artificial Sequence
  Synthetic Oligonucleotide; PD-1 target exon 3; Set A
gacaccaaccaccaggguu

SEQ ID NO: 69665 - RNA, 18 nt, Artificial Sequence
  Synthetic Oligonucleotide; PD-1 target exon 3; Set A
gacaccaaccaccagggu

SEQ ID NO: 69666 - RNA, 35 nt, Artificial Sequence
  Synthetic Oligonucleotide; PD-1 target exon 3; Set C
aggccgcccacgacaccaaccaccaggguuuggaa

SEQ ID NO: 69667 - RNA, 20 nt, Artificial Sequence
  Synthetic Oligonucleotide; PD-1 target exon 3; Set A
acggccaggacccagacuag

SEQ ID NO: 69668 - RNA, 21 nt, Artificial Sequence
  Synthetic Oligonucleotide; PD-1 target exon 3; Set C
gacggccaggacccagacuag

SEQ ID NO: 69669 - RNA, 18 nt, Artificial Sequence
  Synthetic Oligonucleotide; PD-1 target exon 3; Set A
ugacggccaggacccaga

SEQ ID NO: 69670 - RNA, 19 nt, Artificial Sequence
  Synthetic Oligonucleotide; PD-1 target exon 3; Set A
augacggccaggacccaga

SEQ ID NO: 69671 - RNA, 20 nt, Artificial Sequence
  Synthetic Oligonucleotide; PD-1 target exon 3; Set C
gaugacggccaggacccaga

SEQ ID NO: 69672 - RNA, 21 nt, Artificial Sequence
  Synthetic Oligonucleotide; PD-1 target exon 3; Set C
agaugacggccaggacccaga

SEQ ID NO: 69673 - RNA, 22 nt, Artificial Sequence
  Synthetic Oligonucleotide; PD-1 target exon 3; Set C
cagaugacggccaggacccaga

SEQ ID NO: 69674 - RNA, 23 nt, Artificial Sequence
  Synthetic Oligonucleotide; PD-1 target exon 3; Set C
gcagaugacggccaggacccaga

SEQ ID NO: 69675 - RNA, 24 nt, Artificial Sequence
  Synthetic Oligonucleotide; PD-1 target exon 3; Set C
agcagaugacggccaggacccaga

SEQ ID NO: 69676 - RNA, 25 nt, Artificial Sequence
  Synthetic Oligonucleotide; PD-1 target exon 3; Set C
gagcagaugacggccaggacccaga

SEQ ID NO: 69677 - RNA, 26 nt, Artificial Sequence
  Synthetic Oligonucleotide; PD-1 target exon 3; Set C
ggagcagaugacggccaggacccaga

SEQ ID NO: 69678 - RNA, 27 nt, Artificial Sequence
  Synthetic Oligonucleotide; PD-1 target exon 3; Set C
gggagcagaugacggccaggacccaga

SEQ ID NO: 69679 - RNA, 36 nt, Artificial Sequence
  Synthetic Oligonucleotide; PD-1 target exon 3; Set C
uuaccucgugcggcccgggagcagaugacggccagg

SEQ ID NO: 69680 - RNA, 15 nt, Artificial Sequence
  Synthetic Oligonucleotide; PD-1 target exon 3; Set C
gggaugacguuaccu

SEQ ID NO: 69681 - RNA, 16 nt, Artificial Sequence
  Synthetic Oligonucleotide; PD-1 target exon 3; Set C
ugggaugacguuaccu

SEQ ID NO: 69682 - RNA, 17 nt, Artificial Sequence
  Synthetic Oligonucleotide; PD-1 target exon 3; Set C
cugggaugacguuaccu

SEQ ID NO: 69683 - RNA, 15 nt, Artificial Sequence
  Synthetic Oligonucleotide; PD-1 target exon 3; Set C
ugggaugacguuacc

SEQ ID NO: 69684 - RNA, 18 nt, Artificial Sequence
  Synthetic Oligonucleotide; PD-1 target exon 3; Set B
gcugggaugacguuaccu

SEQ ID NO: 69685 - RNA, 16 nt, Artificial Sequence
  Synthetic Oligonucleotide; PD-1 target exon 3; Set C
cugggaugacguuacc

SEQ ID NO: 69686 - RNA, 19 nt, Artificial Sequence
  Synthetic Oligonucleotide; PD-1 target exon 3; Set B
ggcugggaugacguuaccu

SEQ ID NO: 69687 - RNA, 17 nt, Artificial Sequence
  Synthetic Oligonucleotide; PD-1 target exon 3; Set C
gcugggaugacguuacc

SEQ ID NO: 69688 - RNA, 18 nt, Artificial Sequence
  Synthetic Oligonucleotide; PD-1 target exon 3; Set B
ggcugggaugacguuacc

SEQ ID NO: 69689 - RNA, 26 nt, Artificial Sequence
  Synthetic Oligonucleotide; PD-1 target exon 3; Set C
caggccgaggggcugggaugacguua

SEQ ID NO: 69690 - RNA, 25 nt, Artificial Sequence
  Synthetic Oligonucleotide; PD-1 target exon 3; Set C
caggccgaggggcugggaugacguu

SEQ ID NO: 69691 - RNA, 24 nt, Artificial Sequence
  Synthetic Oligonucleotide; PD-1 target exon 3; Set C
caggccgaggggcugggaugacgu

SEQ ID NO: 69692 - RNA, 23 nt, Artificial Sequence
  Synthetic Oligonucleotide; PD-1 target exon 3; Set C
caggccgaggggcugggaugacg

SEQ ID NO: 69693 - RNA, 22 nt, Artificial Sequence
  Synthetic Oligonucleotide; PD-1 target exon 3; Set C
caggccgaggggcugggaugac

SEQ ID NO: 69694 - RNA, 21 nt, Artificial Sequence
  Synthetic Oligonucleotide; PD-1 target exon 3; Set C
caggccgaggggcugggauga

SEQ ID NO: 69695 - RNA, 37 nt, Artificial Sequence
  Synthetic Oligonucleotide; PD-1 target exon 3; Set C
gggcagggcaggccgaggggcugggaugacguuaccu

SEQ ID NO: 69696 - RNA, 20 nt, Artificial Sequence
  Synthetic Oligonucleotide; PD-1 target exon 3; Set C
caggccgaggggcugggaug

SEQ ID NO: 69697 - RNA, 38 nt, Artificial Sequence
  Synthetic Oligonucleotide; PD-1 target exon 3; Set C
agggcagggcaggccgaggggcugggaugacguuaccu

SEQ ID NO: 69698 - RNA, 36 nt, Artificial Sequence
  Synthetic Oligonucleotide; PD-1 target exon 3; Set C
gggcagggcaggccgaggggcugggaugacguuacc

SEQ ID NO: 69699 - RNA, 19 nt, Artificial Sequence
  Synthetic Oligonucleotide; PD-1 target exon 3; Set C
caggccgaggggcugggau

SEQ ID NO: 69700 - RNA, 35 nt, Artificial Sequence
  Synthetic Oligonucleotide; PD-1 target exon 3; Set C
gggcagggcaggccgaggggcugggaugacguuac

SEQ ID NO: 69701 - RNA, 39 nt, Artificial Sequence
  Synthetic Oligonucleotide; PD-1 target exon 3; Set C
uagggcagggcaggccgaggggcugggaugacguuaccu

SEQ ID NO: 69702 - RNA, 37 nt, Artificial Sequence
  Synthetic Oligonucleotide; PD-1 target exon 3; Set C
agggcagggcaggccgaggggcugggaugacguuacc

SEQ ID NO: 69703 - RNA, 36 nt, Artificial Sequence
  Synthetic Oligonucleotide; PD-1 target exon 3; Set C
agggcagggcaggccgaggggcugggaugacguuac

SEQ ID NO: 69704 - RNA, 40 nt, Artificial Sequence
  Synthetic Oligonucleotide; PD-1 target exon 3; Set C
uuagggcagggcaggccgaggggcugggaugacguuaccu

SEQ ID NO: 69705 - RNA, 38 nt, Artificial Sequence
  Synthetic Oligonucleotide; PD-1 target exon 3; Set C
uagggcagggcaggccgaggggcugggaugacguuacc

SEQ ID NO: 69706 - RNA, 37 nt, Artificial Sequence
  Synthetic Oligonucleotide; PD-1 target exon 3; Set C
uagggcagggcaggccgaggggcugggaugacguuac

SEQ ID NO: 69707 - RNA, 39 nt, Artificial Sequence
  Synthetic Oligonucleotide; PD-1 target exon 3; Set C
uuagggcagggcaggccgaggggcugggaugacguuacc

SEQ ID NO: 69708 - RNA, 38 nt, Artificial Sequence
  Synthetic Oligonucleotide; PD-1 target exon 3; Set C
uuagggcagggcaggccgaggggcugggaugacguuac

SEQ ID NO: 69709 - RNA, 40 nt, Artificial Sequence
  Synthetic Oligonucleotide; PD-1 target exon 3; Set C
guuagggcagggcaggccgaggggcugggaugacguuacc

SEQ ID NO: 69710 - RNA, 25 nt, Artificial Sequence
  Synthetic Oligonucleotide; PD-1 target exon 3; Set C
cagggcaggccgaggggcugggaug

SEQ ID NO: 69711 - RNA, 39 nt, Artificial Sequence
  Synthetic Oligonucleotide; PD-1 target exon 3; Set C
guuagggcagggcaggccgaggggcugggaugacguuac

SEQ ID NO: 69712 - RNA, 24 nt, Artificial Sequence
  Synthetic Oligonucleotide; PD-1 target exon 3; Set C
cagggcaggccgaggggcugggau

SEQ ID NO: 69713 - RNA, 23 nt, Artificial Sequence
  Synthetic Oligonucleotide; PD-1 target exon 3; Set C
cagggcaggccgaggggcuggga

SEQ ID NO: 69714 - RNA, 22 nt, Artificial Sequence
  Synthetic Oligonucleotide; PD-1 target exon 3; Set C
cagggcaggccgaggggcuggg

SEQ ID NO: 69715 - RNA, 21 nt, Artificial Sequence
  Synthetic Oligonucleotide; PD-1 target exon 3; Set C
cagggcaggccgaggggcugg

SEQ ID NO: 69716 - RNA, 20 nt, Artificial Sequence
  Synthetic Oligonucleotide; PD-1 target exon 3; Set C
gggcagggcaggccgagggg

SEQ ID NO: 69717 - RNA, 19 nt, Artificial Sequence
  Synthetic Oligonucleotide; PD-1 target exon 3; Set C
gggcagggcaggccgaggg

SEQ ID NO: 69718 - RNA, 21 nt, Artificial Sequence
  Synthetic Oligonucleotide; PD-1 target exon 3; Set C
agggcagggcaggccgagggg

SEQ ID NO: 69719 - RNA, 18 nt, Artificial Sequence
  Synthetic Oligonucleotide; PD-1 target exon 3; Set C
gggcagggcaggccgagg

SEQ ID NO: 69720 - RNA, 20 nt, Artificial Sequence
  Synthetic Oligonucleotide; PD-1 target exon 3; Set C
agggcagggcaggccgaggg

SEQ ID NO: 69721 - RNA, 22 nt, Artificial Sequence
  Synthetic Oligonucleotide; PD-1 target exon 3; Set C
uagggcagggcaggccgagggg

SEQ ID NO: 69722 - RNA, 17 nt, Artificial Sequence
  Synthetic Oligonucleotide; PD-1 target exon 3; Set C
gggcagggcaggccgag

SEQ ID NO: 69723 - RNA, 19 nt, Artificial Sequence
  Synthetic Oligonucleotide; PD-1 target exon 3; Set C
agggcagggcaggccgagg

SEQ ID NO: 69724 - RNA, 21 nt, Artificial Sequence
  Synthetic Oligonucleotide; PD-1 target exon 3; Set C
uagggcagggcaggccgaggg

SEQ ID NO: 69725 - RNA, 23 nt, Artificial Sequence
  Synthetic Oligonucleotide; PD-1 target exon 3; Set C
uuagggcagggcaggccgagggg

SEQ ID NO: 69726 - RNA, 18 nt, Artificial Sequence
  Synthetic Oligonucleotide; PD-1 target exon 3; Set C
agggcagggcaggccgag

SEQ ID NO: 69727 - RNA, 20 nt, Artificial Sequence
  Synthetic Oligonucleotide; PD-1 target exon 3; Set C
uagggcagggcaggccgagg

SEQ ID NO: 69728 - RNA, 22 nt, Artificial Sequence
  Synthetic Oligonucleotide; PD-1 target exon 3; Set C
uuagggcagggcaggccgaggg

SEQ ID NO: 69729 - RNA, 24 nt, Artificial Sequence
  Synthetic Oligonucleotide; PD-1 target exon 3; Set C
guuagggcagggcaggccgagggg

SEQ ID NO: 69730 - RNA, 19 nt, Artificial Sequence
  Synthetic Oligonucleotide; PD-1 target exon 3; Set C
uagggcagggcaggccgag

SEQ ID NO: 69731 - RNA, 21 nt, Artificial Sequence
  Synthetic Oligonucleotide; PD-1 target exon 3; Set C
uuagggcagggcaggccgagg

SEQ ID NO: 69732 - RNA, 23 nt, Artificial Sequence
  Synthetic Oligonucleotide; PD-1 target exon 3; Set C
guuagggcagggcaggccgaggg

SEQ ID NO: 69733 - RNA, 24 nt, Artificial Sequence
  Synthetic Oligonucleotide; PD-1 target exon 3; Set C
gguuagggcagggcaggccgaggg

SEQ ID NO: 69734 - RNA, 23 nt, Artificial Sequence
  Synthetic Oligonucleotide; PD-1 target exon 3; Set C
gguuagggcagggcaggccgagg

SEQ ID NO: 69735 - RNA, 22 nt, Artificial Sequence
  Synthetic Oligonucleotide; PD-1 target exon 3; Set C
gguuagggcagggcaggccgag

SEQ ID NO: 69736 - RNA, 24 nt, Artificial Sequence
  Synthetic Oligonucleotide; PD-1 target exon 3; Set C
ggguuagggcagggcaggccgagg

SEQ ID NO: 69737 - RNA, 35 nt, Artificial Sequence
  Synthetic Oligonucleotide; PD-1 target exon 3; Set C
ccagcaggguuagggcagggcaggccgaggggcug

SEQ ID NO: 69738 - RNA, 23 nt, Artificial Sequence
  Synthetic Oligonucleotide; PD-1 target exon 3; Set C
ggguuagggcagggcaggccgag

SEQ ID NO: 69739 - RNA, 36 nt, Artificial Sequence
  Synthetic Oligonucleotide; PD-1 target exon 3; Set C
gccagcaggguuagggcagggcaggccgaggggcug

SEQ ID NO: 69740 - RNA, 34 nt, Artificial Sequence
  Synthetic Oligonucleotide; PD-1 target exon 3; Set C
ccagcaggguuagggcagggcaggccgaggggcu

SEQ ID NO: 69741 - RNA, 24 nt, Artificial Sequence
  Synthetic Oligonucleotide; PD-1 target exon 3; Set C
aggguuagggcagggcaggccgag

SEQ ID NO: 69742 - RNA, 33 nt, Artificial Sequence
  Synthetic Oligonucleotide; PD-1 target exon 3; Set C
ccagcaggguuagggcagggcaggccgaggggc

SEQ ID NO: 69743 - RNA, 35 nt, Artificial Sequence
  Synthetic Oligonucleotide; PD-1 target exon 3; Set C
gccagcaggguuagggcagggcaggccgaggggcu

SEQ ID NO: 69744 - RNA, 34 nt, Artificial Sequence
  Synthetic Oligonucleotide; PD-1 target exon 3; Set C
gccagcaggguuagggcagggcaggccgaggggc

SEQ ID NO: 69745 - RNA, 15 nt, Artificial Sequence
  Synthetic Oligonucleotide; PD-1 target exon 3; Set C
guuagggcagggcag

SEQ ID NO: 69746 - RNA, 26 nt, Artificial Sequence
  Synthetic Oligonucleotide; PD-1 target exon 3; Set C
gguuaggacggggucaggguggaggg

SEQ ID NO: 69747 - RNA, 20 nt, Artificial Sequence
  Synthetic Oligonucleotide; PD-1 target exon 3; Set C
uaggacggggucagggugga

SEQ ID NO: 69748 - RNA, 25 nt, Artificial Sequence
  Synthetic Oligonucleotide; PD-1 target exon 3; Set C
gguuaggacggggucaggguggagg

SEQ ID NO: 69749 - RNA, 27 nt, Artificial Sequence
  Synthetic Oligonucleotide; PD-1 target exon 3; Set C
ggguuaggacggggucaggguggaggg

SEQ ID NO: 69750 - RNA, 21 nt, Artificial Sequence
  Synthetic Oligonucleotide; PD-1 target exon 3; Set C
uuaggacggggucagggugga

SEQ ID NO: 69751 - RNA, 24 nt, Artificial Sequence
  Synthetic Oligonucleotide; PD-1 target exon 3; Set C
gguuaggacggggucaggguggag

SEQ ID NO: 69752 - RNA, 26 nt, Artificial Sequence
  Synthetic Oligonucleotide; PD-1 target exon 3; Set C
ggguuaggacggggucaggguggagg

SEQ ID NO: 69753 - RNA, 22 nt, Artificial Sequence
  Synthetic Oligonucleotide; PD-1 target exon 3; Set C
guuaggacggggucagggugga

SEQ ID NO: 69754 - RNA, 25 nt, Artificial Sequence
  Synthetic Oligonucleotide; PD-1 target exon 3; Set C
ggguuaggacggggucaggguggag

SEQ ID NO: 69755 - RNA, 21 nt, Artificial Sequence
  Synthetic Oligonucleotide; PD-1 target exon 3; Set C
guuaggacggggucagggugg

SEQ ID NO: 69756 - RNA, 20 nt, Artificial Sequence
  Synthetic Oligonucleotide; PD-1 target exon 3; Set A
guuaggacggggucagggug

SEQ ID NO: 69757 - RNA, 27 nt, Artificial Sequence
  Synthetic Oligonucleotide; PD-1 target exon 3; Set C
agggguuaggacggggucaggguggag

SEQ ID NO: 69758 - RNA, 33 nt, Artificial Sequence
  Synthetic Oligonucleotide; PD-1 target exon 3; Set C
ggucagggguuaggacggggucaggguggaggg

SEQ ID NO: 69759 - RNA, 32 nt, Artificial Sequence
  Synthetic Oligonucleotide; PD-1 target exon 3; Set C
ggucagggguuaggacggggucaggguggagg

SEQ ID NO: 69760 - RNA, 31 nt, Artificial Sequence
  Synthetic Oligonucleotide; PD-1 target exon 3; Set C
ggucagggguuaggacggggucaggguggag

SEQ ID NO: 69761 - RNA, 32 nt, Artificial Sequence
  Synthetic Oligonucleotide; PD-1 target exon 3; Set C
aggucagggguuaggacggggucaggguggag

SEQ ID NO: 69762 - RNA, 33 nt, Artificial Sequence
  Synthetic Oligonucleotide; PD-1 target exon 3; Set C
aaggucagggguuaggacggggucaggguggag

SEQ ID NO: 69763 - RNA, 20 nt, Artificial Sequence
  Synthetic Oligonucleotide; PD-1 target exon 3; Set C
cagggguuaggacgggguca

SEQ ID NO: 69764 - RNA, 19 nt, Artificial Sequence
  Synthetic Oligonucleotide; PD-1 target exon 3; Set A
cagggguuaggacgggguc

SEQ ID NO: 69765 - RNA, 15 nt, Artificial Sequence
  Synthetic Oligonucleotide; PD-1 target exon 3; Set C
cagggguuaggacgg

SEQ ID NO: 69766 - RNA, 16 nt, Artificial Sequence
  Synthetic Oligonucleotide; PD-1 target exon 3; Set C
ucagggguuaggacgg

SEQ ID NO: 69767 - RNA, 15 nt, Artificial Sequence
  Synthetic Oligonucleotide; PD-1 target exon 3; Set C
ucagggguuaggacg

SEQ ID NO: 69768 - RNA, 17 nt, Artificial Sequence
  Synthetic Oligonucleotide; PD-1 target exon 3; Set C
gucagggguuaggacgg

SEQ ID NO: 69769 - RNA, 16 nt, Artificial Sequence
  Synthetic Oligonucleotide; PD-1 target exon 3; Set C
gucagggguuaggacg

SEQ ID NO: 69770 - RNA, 15 nt, Artificial Sequence
  Synthetic Oligonucleotide; PD-1 target exon 3; Set C
gucagggguuaggac

SEQ ID NO: 69771 - RNA, 23 nt, Artificial Sequence
  Synthetic Oligonucleotide; PD-1 target exon 3; Set A
cuggaagggcacaaaggucaggg

SEQ ID NO: 69772 - RNA, 22 nt, Artificial Sequence
  Synthetic Oligonucleotide; PD-1 target exon 3; Set A
cuggaagggcacaaaggucagg

SEQ ID NO: 69773 - RNA, 24 nt, Artificial Sequence
  Synthetic Oligonucleotide; PD-1 target exon 3; Set A
ucuggaagggcacaaaggucaggg

SEQ ID NO: 69774 - RNA, 25 nt, Artificial Sequence
  Synthetic Oligonucleotide; PD-1 target exon 3; Set A
cucuggaagggcacaaaggucaggg

SEQ ID NO: 69775 - RNA, 21 nt, Artificial Sequence
  Synthetic Oligonucleotide; PD-1 target exon 3; Set A
cuggaagggcacaaaggucag

SEQ ID NO: 69776 - RNA, 20 nt, Artificial Sequence
  Synthetic Oligonucleotide; PD-1 target exon 3; Set A
cuggaagggcacaaagguca

SEQ ID NO: 69777 - RNA, 22 nt, Artificial Sequence
  Synthetic Oligonucleotide; PD-1 target exon 3; Set A
ucuggaagggcacaaaggucag

SEQ ID NO: 69778 - RNA, 19 nt, Artificial Sequence
  Synthetic Oligonucleotide; PD-1 target exon 3; Set C
cuggaagggcacaaagguc

SEQ ID NO: 69779 - RNA, 21 nt, Artificial Sequence
  Synthetic Oligonucleotide; PD-1 target exon 3; Set A
ucuggaagggcacaaagguca

SEQ ID NO: 69780 - RNA, 23 nt, Artificial Sequence
  Synthetic Oligonucleotide; PD-1 target exon 3; Set A
cucuggaagggcacaaaggucag

SEQ ID NO: 69781 - RNA, 20 nt, Artificial Sequence
  Synthetic Oligonucleotide; PD-1 target exon 3; Set C
ucuggaagggcacaaagguc

SEQ ID NO: 69782 - RNA, 22 nt, Artificial Sequence
  Synthetic Oligonucleotide; PD-1 target exon 3; Set A
cucuggaagggcacaaagguca

SEQ ID NO: 69783 - RNA, 24 nt, Artificial Sequence
  Synthetic Oligonucleotide; PD-1 target exon 3; Set A
ucucuggaagggcacaaaggucag

SEQ ID NO: 69784 - RNA, 17 nt, Artificial Sequence
  Synthetic Oligonucleotide; PD-1 target exon 3; Set C
cuggaagggcacaaagg

SEQ ID NO: 69785 - RNA, 21 nt, Artificial Sequence
  Synthetic Oligonucleotide; PD-1 target exon 3; Set A
cucuggaagggcacaaagguc

SEQ ID NO: 69786 - RNA, 23 nt, Artificial Sequence
  Synthetic Oligonucleotide; PD-1 target exon 3; Set A
ucucuggaagggcacaaagguca

SEQ ID NO: 69787 - RNA, 18 nt, Artificial Sequence
  Synthetic Oligonucleotide; PD-1 target exon 3; Set C
ucuggaagggcacaaagg

SEQ ID NO: 69788 - RNA, 16 nt, Artificial Sequence
  Synthetic Oligonucleotide; PD-1 target exon 3; Set C
cuggaagggcacaaag

SEQ ID NO: 69789 - RNA, 22 nt, Artificial Sequence
  Synthetic Oligonucleotide; PD-1 target exon 3; Set A
ucucuggaagggcacaaagguc

SEQ ID NO: 69790 - RNA, 17 nt, Artificial Sequence
  Synthetic Oligonucleotide; PD-1 target exon 3; Set C
ucuggaagggcacaaag

SEQ ID NO: 69791 - RNA, 18 nt, Artificial Sequence
  Synthetic Oligonucleotide; PD-1 target exon 3; Set C
cucuggaagggcacaaag

SEQ ID NO: 69792 - RNA, 19 nt, Artificial Sequence
  Synthetic Oligonucleotide; PD-1 target exon 3; Set C
ucucuggaagggcacaaag

SEQ ID NO: 69793 - RNA, 25 nt, Artificial Sequence
  Synthetic Oligonucleotide; PD-1 target exon 3; Set C
gugggcacuucugcccuucucucug

SEQ ID NO: 69794 - RNA, 24 nt, Artificial Sequence
  Synthetic Oligonucleotide; PD-1 target exon 3; Set C
gugggcacuucugcccuucucucu

SEQ ID NO: 69795 - RNA, 23 nt, Artificial Sequence
  Synthetic Oligonucleotide; PD-1 target exon 3; Set C
gugggcacuucugcccuucucuc

SEQ ID NO: 69796 - RNA, 22 nt, Artificial Sequence
  Synthetic Oligonucleotide; PD-1 target exon 3; Set C
gugggcacuucugcccuucucu

SEQ ID NO: 69797 - RNA, 23 nt, Artificial Sequence
  Synthetic Oligonucleotide; PD-1 target exon 3; Set C
ugugggcacuucugcccuucucu

SEQ ID NO: 69798 - RNA, 34 nt, Artificial Sequence
  Synthetic Oligonucleotide; PD-1 target exon 3; Set C
gggugggcugugggcacuucugcccuucucucug

SEQ ID NO: 69799 - RNA, 33 nt, Artificial Sequence
  Synthetic Oligonucleotide; PD-1 target exon 3; Set C
gggugggcugugggcacuucugcccuucucucu

SEQ ID NO: 69800 - RNA, 32 nt, Artificial Sequence
  Synthetic Oligonucleotide; PD-1 target exon 3; Set C
gggugggcugugggcacuucugcccuucucuc

SEQ ID NO: 69801 - RNA, 40 nt, Artificial Sequence
  Synthetic Oligonucleotide; PD-1 target exon 3; Set C
gaggggcuggggugggcugugggcacuucugcccuucucu

SEQ ID NO: 69802 - RNA, 23 nt, Artificial Sequence
  Synthetic Oligonucleotide; PD-1 target exon 3; Set C
ggugaggggcuggggugggcugu

SEQ ID NO: 69803 - RNA, 24 nt, Artificial Sequence
  Synthetic Oligonucleotide; PD-1 target exon 3; Set C
gggugaggggcuggggugggcugu

SEQ ID NO: 69804 - RNA, 26 nt, Artificial Sequence
  Synthetic Oligonucleotide; PD-1 target exon 3; Set C
ugggugaggggcuggggugggcugug

SEQ ID NO: 69805 - RNA, 27 nt, Artificial Sequence
  Synthetic Oligonucleotide; PD-1 target exon 3; Set C
cugggugaggggcuggggugggcugug

SEQ ID NO: 69806 - RNA, 15 nt, Artificial Sequence
  Synthetic Oligonucleotide; PD-1 target exon 3; Set A
ggugaggggcugggg

SEQ ID NO: 69807 - RNA, 16 nt, Artificial Sequence
  Synthetic Oligonucleotide; PD-1 target exon 3; Set A
gggugaggggcugggg

SEQ ID NO: 69808 - RNA, 34 nt, Artificial Sequence
  Synthetic Oligonucleotide; PD-1 target exon 3; Set C
gaacuggccggcuggccugggugaggggcugggg

SEQ ID NO: 69809 - RNA, 35 nt, Artificial Sequence
  Synthetic Oligonucleotide; PD-1 target exon 3; Set C
ggaacuggccggcuggccugggugaggggcugggg

SEQ ID NO: 69810 - RNA, 26 nt, Artificial Sequence
  Synthetic Oligonucleotide; PD-1 target exon 3; Set C
gaacuggccggcuggccugggugagg

SEQ ID NO: 69811 - RNA, 27 nt, Artificial Sequence
  Synthetic Oligonucleotide; PD-1 target exon 3; Set C
ggaacuggccggcuggccugggugagg

SEQ ID NO: 69812 - RNA, 28 nt, Artificial Sequence
  Synthetic Oligonucleotide; PD-1 target exon 3; Set C
uggaacuggccggcuggccugggugagg

SEQ ID NO: 69813 - RNA, 32 nt, Artificial Sequence
  Synthetic Oligonucleotide; PD-1 target exon 3; Set C
uuuggaacuggccggcuggccugggugagggg

SEQ ID NO: 69814 - RNA, 29 nt, Artificial Sequence
  Synthetic Oligonucleotide; PD-1 target exon 3; Set C
uuggaacuggccggcuggccugggugagg

SEQ ID NO: 69815 - RNA, 33 nt, Artificial Sequence
  Synthetic Oligonucleotide; PD-1 target exon 3; Set C
guuuggaacuggccggcuggccugggugagggg

SEQ ID NO: 69816 - RNA, 30 nt, Artificial Sequence
  Synthetic Oligonucleotide; PD-1 target exon 3; Set C
uuuggaacuggccggcuggccugggugagg

SEQ ID NO: 69817 - RNA, 34 nt, Artificial Sequence
  Synthetic Oligonucleotide; PD-1 target exon 3; Set C
gguuuggaacuggccggcuggccugggugagggg

SEQ ID NO: 69818 - RNA, 31 nt, Artificial Sequence
  Synthetic Oligonucleotide; PD-1 target exon 3; Set C
guuuggaacuggccggcuggccugggugagg

SEQ ID NO: 69819 - RNA, 33 nt, Artificial Sequence
  Synthetic Oligonucleotide; PD-1 target exon 3; Set C
gguuuggaacuggccggcuggccugggugaggg

SEQ ID NO: 69820 - RNA, 16 nt, Artificial Sequence
  Synthetic Oligonucleotide; PD-1 target exon 3; Set A
uuggaacuggccggcu

SEQ ID NO: 69821 - RNA, 17 nt, Artificial Sequence
  Synthetic Oligonucleotide; PD-1 target exon 3; Set A
uuuggaacuggccggcu

SEQ ID NO: 69822 - RNA, 18 nt, Artificial Sequence
  Synthetic Oligonucleotide; PD-1 target exon 3; Set A
guuuggaacuggccggcu

SEQ ID NO: 69823 - RNA, 16 nt, Artificial Sequence
  Synthetic Oligonucleotide; PD-1 target exon 3; Set C
uuuggaacuggccggc

SEQ ID NO: 69824 - RNA, 19 nt, Artificial Sequence
  Synthetic Oligonucleotide; PD-1 target exon 3; Set A
gguuuggaacuggccggcu

SEQ ID NO: 69825 - RNA, 17 nt, Artificial Sequence
  Synthetic Oligonucleotide; PD-1 target exon 3; Set A
guuuggaacuggccggc

SEQ ID NO: 69826 - RNA, 18 nt, Artificial Sequence
  Synthetic Oligonucleotide; PD-1 target exon 3; Set A
gguuuggaacuggccggc

SEQ ID NO: 69827 - RNA, 40 nt, Artificial Sequence
  Synthetic Oligonucleotide; PD-1 target exon 3; Set C
acaccaaccaccaggguuuggaacuggccggcuggccugg

SEQ ID NO: 69828 - RNA, 39 nt, Artificial Sequence
  Synthetic Oligonucleotide; PD-1 target exon 3; Set C
acaccaaccaccaggguuuggaacuggccggcuggccug

SEQ ID NO: 69829 - RNA, 22 nt, Artificial Sequence
  Synthetic Oligonucleotide; PD-1 target exon 3; Set C
acaccaaccaccaggguuugga

SEQ ID NO: 69830 - RNA, 21 nt, Artificial Sequence
  Synthetic Oligonucleotide; PD-1 target exon 3; Set A
acaccaaccaccaggguuugg

SEQ ID NO: 69831 - RNA, 20 nt, Artificial Sequence
  Synthetic Oligonucleotide; PD-1 target exon 3; Set A
acaccaaccaccaggguuug

SEQ ID NO: 69832 - RNA, 19 nt, Artificial Sequence
  Synthetic Oligonucleotide; PD-1 target exon 3; Set A
acaccaaccaccaggguuu

SEQ ID NO: 69833 - RNA, 18 nt, Artificial Sequence
  Synthetic Oligonucleotide; PD-1 target exon 3; Set A
acaccaaccaccaggguu

SEQ ID NO: 69834 - RNA, 34 nt, Artificial Sequence
  Synthetic Oligonucleotide; PD-1 target exon 3; Set C
aggccgcccacgacaccaaccaccaggguuugga

SEQ ID NO: 69835 - RNA, 33 nt, Artificial Sequence
  Synthetic Oligonucleotide; PD-1 target exon 3; Set C
aggccgcccacgacaccaaccaccaggguuugg

SEQ ID NO: 69836 - RNA, 32 nt, Artificial Sequence
  Synthetic Oligonucleotide; PD-1 target exon 3; Set C
aggccgcccacgacaccaaccaccaggguuug

SEQ ID NO: 69837 - RNA, 31 nt, Artificial Sequence
  Synthetic Oligonucleotide; PD-1 target exon 3; Set C
aggccgcccacgacaccaaccaccaggguuu

SEQ ID NO: 69838 - RNA, 30 nt, Artificial Sequence
  Synthetic Oligonucleotide; PD-1 target exon 3; Set C
aggccgcccacgacaccaaccaccaggguu

SEQ ID NO: 69839 - RNA, 29 nt, Artificial Sequence
  Synthetic Oligonucleotide; PD-1 target exon 3; Set C
aggccgcccacgacaccaaccaccagggu

SEQ ID NO: 69840 - RNA, 36 nt, Artificial Sequence
  Synthetic Oligonucleotide; PD-1 target exon 3; Set C
uagcagcaccaggcugcccagcaggccgcccacgac

SEQ ID NO: 69841 - RNA, 40 nt, Artificial Sequence
  Synthetic Oligonucleotide; PD-1 target exon 3; Set C
agacuagcagcaccaggcugcccagcaggccgcccacgac

SEQ ID NO: 69842 - RNA, 16 nt, Artificial Sequence
  Synthetic Oligonucleotide; PD-1 target exon 3; Set A
acggccaggacccaga

SEQ ID NO: 69843 - RNA, 17 nt, Artificial Sequence
  Synthetic Oligonucleotide; PD-1 target exon 3; Set A
gacggccaggacccaga

SEQ ID NO: 69844 - RNA, 18 nt, Artificial Sequence
  Synthetic Oligonucleotide; PD-1 target exon 3; Set A
augacggccaggacccag

SEQ ID NO: 69845 - RNA, 19 nt, Artificial Sequence
  Synthetic Oligonucleotide; PD-1 target exon 3; Set A
gaugacggccaggacccag

SEQ ID NO: 69846 - RNA, 20 nt, Artificial Sequence
  Synthetic Oligonucleotide; PD-1 target exon 3; Set A
agaugacggccaggacccag

SEQ ID NO: 69847 - RNA, 21 nt, Artificial Sequence
  Synthetic Oligonucleotide; PD-1 target exon 3; Set C
cagaugacggccaggacccag

SEQ ID NO: 69848 - RNA, 29 nt, Artificial Sequence
  Synthetic Oligonucleotide; PD-1 target exon 3; Set C
ggagcagaugacggccaggacccagacua

SEQ ID NO: 69849 - RNA, 22 nt, Artificial Sequence
  Synthetic Oligonucleotide; PD-1 target exon 3; Set C
gcagaugacggccaggacccag

SEQ ID NO: 69850 - RNA, 30 nt, Artificial Sequence
  Synthetic Oligonucleotide; PD-1 target exon 3; Set C
gggagcagaugacggccaggacccagacua

SEQ ID NO: 69851 - RNA, 23 nt, Artificial Sequence
  Synthetic Oligonucleotide; PD-1 target exon 3; Set C
agcagaugacggccaggacccag

SEQ ID NO: 69852 - RNA, 24 nt, Artificial Sequence
  Synthetic Oligonucleotide; PD-1 target exon 3; Set C
gagcagaugacggccaggacccag

SEQ ID NO: 69853 - RNA, 25 nt, Artificial Sequence
  Synthetic Oligonucleotide; PD-1 target exon 3; Set C
ggagcagaugacggccaggacccag

SEQ ID NO: 69854 - RNA, 15 nt, Artificial Sequence
  Synthetic Oligonucleotide; PD-1 target exon 3; Set C
agaugacggccagga

SEQ ID NO: 69855 - RNA, 26 nt, Artificial Sequence
  Synthetic Oligonucleotide; PD-1 target exon 3; Set C
gggagcagaugacggccaggacccag

SEQ ID NO: 69856 - RNA, 16 nt, Artificial Sequence
  Synthetic Oligonucleotide; PD-1 target exon 3; Set C
cagaugacggccagga

SEQ ID NO: 69857 - RNA, 17 nt, Artificial Sequence
  Synthetic Oligonucleotide; PD-1 target exon 3; Set B
gcagaugacggccagga

SEQ ID NO: 69858 - RNA, 18 nt, Artificial Sequence
  Synthetic Oligonucleotide; PD-1 target exon 3; Set B
agcagaugacggccagga

SEQ ID NO: 69859 - RNA, 19 nt, Artificial Sequence
  Synthetic Oligonucleotide; PD-1 target exon 3; Set B
gagcagaugacggccagga

SEQ ID NO: 69860 - RNA, 20 nt, Artificial Sequence
  Synthetic Oligonucleotide; PD-1 target exon 3; Set C
ggagcagaugacggccagga

SEQ ID NO: 69861 - RNA, 21 nt, Artificial Sequence
  Synthetic Oligonucleotide; PD-1 target exon 3; Set C
gggagcagaugacggccagga

SEQ ID NO: 69862 - RNA, 38 nt, Artificial Sequence
  Synthetic Oligonucleotide; PD-1 target exon 3; Set C
guuaccucgugcggcccgggagcagaugacggccagga

SEQ ID NO: 69863 - RNA, 39 nt, Artificial Sequence
  Synthetic Oligonucleotide; PD-1 target exon 3; Set C
cguuaccucgugcggcccgggagcagaugacggccagga

SEQ ID NO: 69864 - RNA, 40 nt, Artificial Sequence
  Synthetic Oligonucleotide; PD-1 target exon 3; Set C
acguuaccucgugcggcccgggagcagaugacggccagga

SEQ ID NO: 69865 - RNA, 27 nt, Artificial Sequence
  Synthetic Oligonucleotide; PD-1 target exon 3; Set C
ccucgugcggcccgggagcagaugacg

SEQ ID NO: 69866 - RNA, 28 nt, Artificial Sequence
  Synthetic Oligonucleotide; PD-1 target exon 3; Set C
accucgugcggcccgggagcagaugacg

SEQ ID NO: 69867 - RNA, 26 nt, Artificial Sequence
  Synthetic Oligonucleotide; PD-1 target exon 3; Set C
ccucgugcggcccgggagcagaugac

SEQ ID NO: 69868 - RNA, 25 nt, Artificial Sequence
  Synthetic Oligonucleotide; PD-1 target exon 3; Set C
ccucgugcggcccgggagcagauga

SEQ ID NO: 69869 - RNA, 29 nt, Artificial Sequence
  Synthetic Oligonucleotide; PD-1 target exon 3; Set C
uaccucgugcggcccgggagcagaugacg

SEQ ID NO: 69870 - RNA, 27 nt, Artificial Sequence
  Synthetic Oligonucleotide; PD-1 target exon 3; Set C
accucgugcggcccgggagcagaugac

SEQ ID NO: 69871 - RNA, 24 nt, Artificial Sequence
  Synthetic Oligonucleotide; PD-1 target exon 3; Set C
ccucgugcggcccgggagcagaug

SEQ ID NO: 69872 - RNA, 26 nt, Artificial Sequence
  Synthetic Oligonucleotide; PD-1 target exon 3; Set C
accucgugcggcccgggagcagauga

SEQ ID NO: 69873 - RNA, 28 nt, Artificial Sequence
  Synthetic Oligonucleotide; PD-1 target exon 3; Set C
uaccucgugcggcccgggagcagaugac

SEQ ID NO: 69874 - RNA, 27 nt, Artificial Sequence
  Synthetic Oligonucleotide; PD-1 target exon 3; Set C
uaccucgugcggcccgggagcagauga

SEQ ID NO: 69875 - RNA, 25 nt, Artificial Sequence
  Synthetic Oligonucleotide; PD-1 target exon 3; Set C
accucgugcggcccgggagcagaug

SEQ ID NO: 69876 - RNA, 23 nt, Artificial Sequence
  Synthetic Oligonucleotide; PD-1 target exon 3; Set C
ccucgugcggcccgggagcagau

SEQ ID NO: 69877 - RNA, 26 nt, Artificial Sequence
  Synthetic Oligonucleotide; PD-1 target exon 3; Set C
uaccucgugcggcccgggagcagaug

SEQ ID NO: 69878 - RNA, 22 nt, Artificial Sequence
  Synthetic Oligonucleotide; PD-1 target exon 3; Set C
ccucgugcggcccgggagcaga

SEQ ID NO: 69879 - RNA, 24 nt, Artificial Sequence
  Synthetic Oligonucleotide; PD-1 target exon 3; Set C
accucgugcggcccgggagcagau

SEQ ID NO: 69880 - RNA, 25 nt, Artificial Sequence
  Synthetic Oligonucleotide; PD-1 target exon 3; Set C
uaccucgugcggcccgggagcagau

SEQ ID NO: 69881 - RNA, 23 nt, Artificial Sequence
  Synthetic Oligonucleotide; PD-1 target exon 3; Set C
accucgugcggcccgggagcaga

SEQ ID NO: 69882 - RNA, 24 nt, Artificial Sequence
  Synthetic Oligonucleotide; PD-1 target exon 3; Set C
uaccucgugcggcccgggagcaga

SEQ ID NO: 69883 - RNA, 22 nt, Artificial Sequence
  Synthetic Oligonucleotide; PD-1 target exon 3; Set C
accucgugcggcccgggagcag

SEQ ID NO: 69884 - RNA, 23 nt, Artificial Sequence
  Synthetic Oligonucleotide; PD-1 target exon 3; Set C
uaccucgugcggcccgggagcag

SEQ ID NO: 69885 - RNA, 22 nt, Artificial Sequence
  Synthetic Oligonucleotide; PD-1 target exon 3; Set C
uaccucgugcggcccgggagca

SEQ ID NO: 69886 - RNA, 21 nt, Artificial Sequence
  Synthetic Oligonucleotide; PD-1 target exon 3; Set B
gaggggcugggaugacguuac

SEQ ID NO: 69887 - RNA, 35 nt, Artificial Sequence
  Synthetic Oligonucleotide; PD-1 target exon 3; Set C
gcagggcaggccgaggggcugggaugacguuaccu

SEQ ID NO: 69888 - RNA, 36 nt, Artificial Sequence
  Synthetic Oligonucleotide; PD-1 target exon 3; Set C
ggcagggcaggccgaggggcugggaugacguuaccu

SEQ ID NO: 69889 - RNA, 34 nt, Artificial Sequence
  Synthetic Oligonucleotide; PD-1 target exon 3; Set C
gcagggcaggccgaggggcugggaugacguuacc

SEQ ID NO: 69890 - RNA, 33 nt, Artificial Sequence
  Synthetic Oligonucleotide; PD-1 target exon 3; Set C
gcagggcaggccgaggggcugggaugacguuac

SEQ ID NO: 69891 - RNA, 35 nt, Artificial Sequence
  Synthetic Oligonucleotide; PD-1 target exon 3; Set C
ggcagggcaggccgaggggcugggaugacguuacc

SEQ ID NO: 69892 - RNA, 34 nt, Artificial Sequence
  Synthetic Oligonucleotide; PD-1 target exon 3; Set C
ggcagggcaggccgaggggcugggaugacguuac

SEQ ID NO: 69893 - RNA, 18 nt, Artificial Sequence
  Synthetic Oligonucleotide; PD-1 target exon 3; Set C
caggccgaggggcuggga

SEQ ID NO: 69894 - RNA, 17 nt, Artificial Sequence
  Synthetic Oligonucleotide; PD-1 target exon 3; Set B
caggccgaggggcuggg

SEQ ID NO: 69895 - RNA, 16 nt, Artificial Sequence
  Synthetic Oligonucleotide; PD-1 target exon 3; Set B
caggccgaggggcugg

SEQ ID NO: 69896 - RNA, 40 nt, Artificial Sequence
  Synthetic Oligonucleotide; PD-1 target exon 3; Set C
gguuagggcagggcaggccgaggggcugggaugacguuac

SEQ ID NO: 69897 - RNA, 20 nt, Artificial Sequence
  Synthetic Oligonucleotide; PD-1 target exon 3; Set C
cagggcaggccgaggggcug

SEQ ID NO: 69898 - RNA, 19 nt, Artificial Sequence
  Synthetic Oligonucleotide; PD-1 target exon 3; Set C
cagggcaggccgaggggcu

SEQ ID NO: 69899 - RNA, 18 nt, Artificial Sequence
  Synthetic Oligonucleotide; PD-1 target exon 3; Set C
cagggcaggccgaggggc

SEQ ID NO: 69900 - RNA, 18 nt, Artificial Sequence
  Synthetic Oligonucleotide; PD-1 target exon 3; Set C
gcagggcaggccgagggg

SEQ ID NO: 69901 - RNA, 17 nt, Artificial Sequence
  Synthetic Oligonucleotide; PD-1 target exon 3; Set C
gcagggcaggccgaggg

SEQ ID NO: 69902 - RNA, 19 nt, Artificial Sequence
  Synthetic Oligonucleotide; PD-1 target exon 3; Set C
ggcagggcaggccgagggg

SEQ ID NO: 69903 - RNA, 16 nt, Artificial Sequence
  Synthetic Oligonucleotide; PD-1 target exon 3; Set B
gcagggcaggccgagg

SEQ ID NO: 69904 - RNA, 18 nt, Artificial Sequence
  Synthetic Oligonucleotide; PD-1 target exon 3; Set C
ggcagggcaggccgaggg

SEQ ID NO: 69905 - RNA, 15 nt, Artificial Sequence
  Synthetic Oligonucleotide; PD-1 target exon 3; Set B
gcagggcaggccgag

SEQ ID NO: 69906 - RNA, 17 nt, Artificial Sequence
  Synthetic Oligonucleotide; PD-1 target exon 3; Set C
ggcagggcaggccgagg

SEQ ID NO: 69907 - RNA, 16 nt, Artificial Sequence
  Synthetic Oligonucleotide; PD-1 target exon 3; Set B
ggcagggcaggccgag

SEQ ID NO: 69908 - RNA, 25 nt, Artificial Sequence
  Synthetic Oligonucleotide; PD-1 target exon 3; Set C
gguuagggcagggcaggccgagggg

SEQ ID NO: 69909 - RNA, 26 nt, Artificial Sequence
  Synthetic Oligonucleotide; PD-1 target exon 3; Set C
ggguuagggcagggcaggccgagggg

SEQ ID NO: 69910 - RNA, 25 nt, Artificial Sequence
  Synthetic Oligonucleotide; PD-1 target exon 3; Set C
ggguuagggcagggcaggccgaggg

SEQ ID NO: 69911 - RNA, 27 nt, Artificial Sequence
  Synthetic Oligonucleotide; PD-1 target exon 3; Set C
aggguuagggcagggcaggccgagggg

SEQ ID NO: 69912 - RNA, 26 nt, Artificial Sequence
  Synthetic Oligonucleotide; PD-1 target exon 3; Set C
aggguuagggcagggcaggccgaggg

SEQ ID NO: 69913 - RNA, 25 nt, Artificial Sequence
  Synthetic Oligonucleotide; PD-1 target exon 3; Set C
aggguuagggcagggcaggccgagg

SEQ ID NO: 69914 - RNA, 16 nt, Artificial Sequence
  Synthetic Oligonucleotide; PD-1 target exon 3; Set B
gguuagggcagggcag

SEQ ID NO: 69915 - RNA, 17 nt, Artificial Sequence
  Synthetic Oligonucleotide; PD-1 target exon 3; Set B
ggguuagggcagggcag

SEQ ID NO: 69916 - RNA, 18 nt, Artificial Sequence
  Synthetic Oligonucleotide; PD-1 target exon 3; Set B
aggguuagggcagggcag

SEQ ID NO: 69917 - RNA, 18 nt, Artificial Sequence
  Synthetic Oligonucleotide; PD-1 target exon 3; Set B
ccagcaggguuagggcag

SEQ ID NO: 69918 - RNA, 19 nt, Artificial Sequence
  Synthetic Oligonucleotide; PD-1 target exon 3; Set B
gccagcaggguuagggcag

SEQ ID NO: 69919 - RNA, 17 nt, Artificial Sequence
  Synthetic Oligonucleotide; PD-1 target exon 3; Set B
cgccagcaggguuaggg

SEQ ID NO: 69920 - RNA, 16 nt, Artificial Sequence
  Synthetic Oligonucleotide; PD-1 target exon 3; Set C
cgccagcaggguuagg

SEQ ID NO: 69921 - RNA, 15 nt, Artificial Sequence
  Synthetic Oligonucleotide; PD-1 target exon 3; Set C
cgccagcaggguuag

SEQ ID NO: 69922 - RNA, 18 nt, Artificial Sequence
  Synthetic Oligonucleotide; PD-1 target exon 3; Set A
cggggucaggguggaggg

SEQ ID NO: 69923 - RNA, 19 nt, Artificial Sequence
  Synthetic Oligonucleotide; PD-1 target exon 3; Set C
acggggucaggguggaggg

SEQ ID NO: 69924 - RNA, 17 nt, Artificial Sequence
  Synthetic Oligonucleotide; PD-1 target exon 3; Set A
cggggucaggguggagg

SEQ ID NO: 69925 - RNA, 16 nt, Artificial Sequence
  Synthetic Oligonucleotide; PD-1 target exon 3; Set A
cggggucaggguggag

SEQ ID NO: 69926 - RNA, 20 nt, Artificial Sequence
  Synthetic Oligonucleotide; PD-1 target exon 3; Set C
gacggggucaggguggaggg

SEQ ID NO: 69927 - RNA, 18 nt, Artificial Sequence
  Synthetic Oligonucleotide; PD-1 target exon 3; Set A
acggggucaggguggagg

SEQ ID NO: 69928 - RNA, 17 nt, Artificial Sequence
  Synthetic Oligonucleotide; PD-1 target exon 3; Set A
acggggucaggguggag

SEQ ID NO: 69929 - RNA, 21 nt, Artificial Sequence
  Synthetic Oligonucleotide; PD-1 target exon 3; Set C
ggacggggucaggguggaggg

SEQ ID NO: 69930 - RNA, 19 nt, Artificial Sequence
  Synthetic Oligonucleotide; PD-1 target exon 3; Set A
gacggggucaggguggagg

SEQ ID NO: 69931 - RNA, 18 nt, Artificial Sequence
  Synthetic Oligonucleotide; PD-1 target exon 3; Set A
gacggggucaggguggag

SEQ ID NO: 69932 - RNA, 20 nt, Artificial Sequence
  Synthetic Oligonucleotide; PD-1 target exon 3; Set C
ggacggggucaggguggagg

SEQ ID NO: 69933 - RNA, 19 nt, Artificial Sequence
  Synthetic Oligonucleotide; PD-1 target exon 3; Set A
ggacggggucaggguggag

SEQ ID NO: 69934 - RNA, 19 nt, Artificial Sequence
  Synthetic Oligonucleotide; PD-1 target exon 3; Set C
aggacggggucagggugga

SEQ ID NO: 69935 - RNA, 18 nt, Artificial Sequence
  Synthetic Oligonucleotide; PD-1 target exon 3; Set A
aggacggggucagggugg

SEQ ID NO: 69936 - RNA, 17 nt, Artificial Sequence
  Synthetic Oligonucleotide; PD-1 target exon 3; Set A
aggacggggucagggug

SEQ ID NO: 69937 - RNA, 19 nt, Artificial Sequence
  Synthetic Oligonucleotide; PD-1 target exon 3; Set A
uaggacggggucagggugg

SEQ ID NO: 69938 - RNA, 28 nt, Artificial Sequence
  Synthetic Oligonucleotide; PD-1 target exon 3; Set C
gggguuaggacggggucaggguggaggg

SEQ ID NO: 69939 - RNA, 18 nt, Artificial Sequence
  Synthetic Oligonucleotide; PD-1 target exon 3; Set A
uaggacggggucagggug

SEQ ID NO: 69940 - RNA, 20 nt, Artificial Sequence
  Synthetic Oligonucleotide; PD-1 target exon 3; Set A
uuaggacggggucagggugg

SEQ ID NO: 69941 - RNA, 29 nt, Artificial Sequence
  Synthetic Oligonucleotide; PD-1 target exon 3; Set C
agggguuaggacggggucaggguggaggg

SEQ ID NO: 69942 - RNA, 27 nt, Artificial Sequence
  Synthetic Oligonucleotide; PD-1 target exon 3; Set C
gggguuaggacggggucaggguggagg

SEQ ID NO: 69943 - RNA, 19 nt, Artificial Sequence
  Synthetic Oligonucleotide; PD-1 target exon 3; Set A
uuaggacggggucagggug

SEQ ID NO: 69944 - RNA, 26 nt, Artificial Sequence
  Synthetic Oligonucleotide; PD-1 target exon 3; Set C
gggguuaggacggggucaggguggag

SEQ ID NO: 69945 - RNA, 28 nt, Artificial Sequence
  Synthetic Oligonucleotide; PD-1 target exon 3; Set C
agggguuaggacggggucaggguggagg

SEQ ID NO: 69946 - RNA, 31 nt, Artificial Sequence
  Synthetic Oligonucleotide; PD-1 target exon 3; Set C
ucagggguuaggacggggucaggguggaggg

SEQ ID NO: 69947 - RNA, 28 nt, Artificial Sequence
  Synthetic Oligonucleotide; PD-1 target exon 3; Set C
cagggguuaggacggggucaggguggag

SEQ ID NO: 69948 - RNA, 32 nt, Artificial Sequence
  Synthetic Oligonucleotide; PD-1 target exon 3; Set C
gucagggguuaggacggggucaggguggaggg

SEQ ID NO: 69949 - RNA, 30 nt, Artificial Sequence
  Synthetic Oligonucleotide; PD-1 target exon 3; Set C
ucagggguuaggacggggucaggguggagg

SEQ ID NO: 69950 - RNA, 29 nt, Artificial Sequence
  Synthetic Oligonucleotide; PD-1 target exon 3; Set C
ucagggguuaggacggggucaggguggag

SEQ ID NO: 69951 - RNA, 31 nt, Artificial Sequence
  Synthetic Oligonucleotide; PD-1 target exon 3; Set C
gucagggguuaggacggggucaggguggagg

SEQ ID NO: 69952 - RNA, 30 nt, Artificial Sequence
  Synthetic Oligonucleotide; PD-1 target exon 3; Set C
gucagggguuaggacggggucaggguggag

SEQ ID NO: 69953 - RNA, 34 nt, Artificial Sequence
  Synthetic Oligonucleotide; PD-1 target exon 3; Set C
aggucagggguuaggacggggucaggguggaggg

SEQ ID NO: 69954 - RNA, 37 nt, Artificial Sequence
  Synthetic Oligonucleotide; PD-1 target exon 3; Set C
aaaggucagggguuaggacggggucaggguggagggu

SEQ ID NO: 69955 - RNA, 33 nt, Artificial Sequence
  Synthetic Oligonucleotide; PD-1 target exon 3; Set C
aggucagggguuaggacggggucaggguggagg

SEQ ID NO: 69956 - RNA, 35 nt, Artificial Sequence
  Synthetic Oligonucleotide; PD-1 target exon 3; Set C
aaggucagggguuaggacggggucaggguggaggg

SEQ ID NO: 69957 - RNA, 38 nt, Artificial Sequence
  Synthetic Oligonucleotide; PD-1 target exon 3; Set C
caaaggucagggguuaggacggggucaggguggagggu

SEQ ID NO: 69958 - RNA, 34 nt, Artificial Sequence
  Synthetic Oligonucleotide; PD-1 target exon 3; Set C
aaggucagggguuaggacggggucaggguggagg

SEQ ID NO: 69959 - RNA, 30 nt, Artificial Sequence
  Synthetic Oligonucleotide; PD-1 target exon 3; Set C
aaaggucagggguuaggacggggucagggu

SEQ ID NO: 69960 - RNA, 29 nt, Artificial Sequence
  Synthetic Oligonucleotide; PD-1 target exon 3; Set C
aaaggucagggguuaggacggggucaggg

SEQ ID NO: 69961 - RNA, 31 nt, Artificial Sequence
  Synthetic Oligonucleotide; PD-1 target exon 3; Set C
caaaggucagggguuaggacggggucagggu

SEQ ID NO: 69962 - RNA, 30 nt, Artificial Sequence
  Synthetic Oligonucleotide; PD-1 target exon 3; Set C
caaaggucagggguuaggacggggucaggg

SEQ ID NO: 69963 - RNA, 28 nt, Artificial Sequence
  Synthetic Oligonucleotide; PD-1 target exon 3; Set C
aaaggucagggguuaggacggggucagg

SEQ ID NO: 69964 - RNA, 29 nt, Artificial Sequence
  Synthetic Oligonucleotide; PD-1 target exon 3; Set C
caaaggucagggguuaggacggggucagg

SEQ ID NO: 69965 - RNA, 24 nt, Artificial Sequence
  Synthetic Oligonucleotide; PD-1 target exon 3; Set C
aaaggucagggguuaggacggggu

SEQ ID NO: 69966 - RNA, 23 nt, Artificial Sequence
  Synthetic Oligonucleotide; PD-1 target exon 3; Set A
aaaggucagggguuaggacgggg

SEQ ID NO: 69967 - RNA, 25 nt, Artificial Sequence
  Synthetic Oligonucleotide; PD-1 target exon 3; Set C
caaaggucagggguuaggacggggu

SEQ ID NO: 69968 - RNA, 22 nt, Artificial Sequence
  Synthetic Oligonucleotide; PD-1 target exon 3; Set A
aaaggucagggguuaggacggg

SEQ ID NO: 69969 - RNA, 24 nt, Artificial Sequence
  Synthetic Oligonucleotide; PD-1 target exon 3; Set A
caaaggucagggguuaggacgggg

SEQ ID NO: 69970 - RNA, 23 nt, Artificial Sequence
  Synthetic Oligonucleotide; PD-1 target exon 3; Set A
caaaggucagggguuaggacggg

SEQ ID NO: 69971 - RNA, 16 nt, Artificial Sequence
  Synthetic Oligonucleotide; PD-1 target exon 3; Set C
aaaggucagggguuag

SEQ ID NO: 69972 - RNA, 15 nt, Artificial Sequence
  Synthetic Oligonucleotide; PD-1 target exon 3; Set C
aaaggucagggguua

SEQ ID NO: 69973 - RNA, 17 nt, Artificial Sequence
  Synthetic Oligonucleotide; PD-1 target exon 3; Set C
caaaggucagggguuag

SEQ ID NO: 69974 - RNA, 16 nt, Artificial Sequence
  Synthetic Oligonucleotide; PD-1 target exon 3; Set C
caaaggucagggguua

SEQ ID NO: 69975 - RNA, 15 nt, Artificial Sequence
  Synthetic Oligonucleotide; PD-1 target exon 3; Set C
caaaggucagggguu

SEQ ID NO: 69976 - RNA, 19 nt, Artificial Sequence
  Synthetic Oligonucleotide; PD-1 target exon 3; Set C
acuucugcccuucucucug

SEQ ID NO: 69977 - RNA, 24 nt, Artificial Sequence
  Synthetic Oligonucleotide; PD-1 target exon 3; Set C
ugggcacuucugcccuucucucug

SEQ ID NO: 69978 - RNA, 23 nt, Artificial Sequence
  Synthetic Oligonucleotide; PD-1 target exon 3; Set C
ugggcacuucugcccuucucucu

SEQ ID NO: 69979 - RNA, 22 nt, Artificial Sequence
  Synthetic Oligonucleotide; PD-1 target exon 3; Set C
ugggcacuucugcccuucucuc

SEQ ID NO: 69980 - RNA, 27 nt, Artificial Sequence
  Synthetic Oligonucleotide; PD-1 target exon 3; Set C
cugugggcacuucugcccuucucucug

SEQ ID NO: 69981 - RNA, 31 nt, Artificial Sequence
  Synthetic Oligonucleotide; PD-1 target exon 3; Set C
gggugggcugugggcacuucugcccuucucu

SEQ ID NO: 69982 - RNA, 40 nt, Artificial Sequence
  Synthetic Oligonucleotide; PD-1 target exon 3; Set C
aggggcuggggugggcugugggcacuucugcccuucucuc

SEQ ID NO: 69983 - RNA, 39 nt, Artificial Sequence
  Synthetic Oligonucleotide; PD-1 target exon 3; Set C
aggggcuggggugggcugugggcacuucugcccuucucu

SEQ ID NO: 69984 - RNA, 32 nt, Artificial Sequence
  Synthetic Oligonucleotide; PD-1 target exon 3; Set C
ugggugaggggcuggggugggcugugggcacu

SEQ ID NO: 69985 - RNA, 33 nt, Artificial Sequence
  Synthetic Oligonucleotide; PD-1 target exon 3; Set C
cugggugaggggcuggggugggcugugggcacu

SEQ ID NO: 69986 - RNA, 20 nt, Artificial Sequence
  Synthetic Oligonucleotide; PD-1 target exon 3; Set C
gaggggcuggggugggcugu

SEQ ID NO: 69987 - RNA, 21 nt, Artificial Sequence
  Synthetic Oligonucleotide; PD-1 target exon 3; Set C
ugaggggcuggggugggcugu

SEQ ID NO: 69988 - RNA, 22 nt, Artificial Sequence
  Synthetic Oligonucleotide; PD-1 target exon 3; Set C
gugaggggcuggggugggcugu

SEQ ID NO: 69989 - RNA, 24 nt, Artificial Sequence
  Synthetic Oligonucleotide; PD-1 target exon 3; Set C
ggugaggggcuggggugggcugug

SEQ ID NO: 69990 - RNA, 25 nt, Artificial Sequence
  Synthetic Oligonucleotide; PD-1 target exon 3; Set C
gggugaggggcuggggugggcugug

SEQ ID NO: 69991 - RNA, 27 nt, Artificial Sequence
  Synthetic Oligonucleotide; PD-1 target exon 3; Set C
ugggugaggggcuggggugggcugugg

SEQ ID NO: 69992 - RNA, 28 nt, Artificial Sequence
  Synthetic Oligonucleotide; PD-1 target exon 3; Set C
cugggugaggggcuggggugggcugugg

SEQ ID NO: 69993 - RNA, 25 nt, Artificial Sequence
  Synthetic Oligonucleotide; PD-1 target exon 3; Set C
cugggugaggggcuggggugggcug

SEQ ID NO: 69994 - RNA, 28 nt, Artificial Sequence
  Synthetic Oligonucleotide; PD-1 target exon 3; Set C
gaacuggccggcuggccugggugagggg

SEQ ID NO: 69995 - RNA, 29 nt, Artificial Sequence
  Synthetic Oligonucleotide; PD-1 target exon 3; Set C
ggaacuggccggcuggccugggugagggg

SEQ ID NO: 69996 - RNA, 27 nt, Artificial Sequence
  Synthetic Oligonucleotide; PD-1 target exon 3; Set C
gaacuggccggcuggccugggugaggg

SEQ ID NO: 69997 - RNA, 30 nt, Artificial Sequence
  Synthetic Oligonucleotide; PD-1 target exon 3; Set C
uggaacuggccggcuggccugggugagggg

SEQ ID NO: 69998 - RNA, 28 nt, Artificial Sequence
  Synthetic Oligonucleotide; PD-1 target exon 3; Set C
ggaacuggccggcuggccugggugaggg

SEQ ID NO: 69999 - RNA, 31 nt, Artificial Sequence
  Synthetic Oligonucleotide; PD-1 target exon 3; Set C
uuggaacuggccggcuggccugggugagggg

SEQ ID NO: 70000 - RNA, 29 nt, Artificial Sequence
  Synthetic Oligonucleotide; PD-1 target exon 3; Set C
uggaacuggccggcuggccugggugaggg

SEQ ID NO: 70001 - RNA, 30 nt, Artificial Sequence
  Synthetic Oligonucleotide; PD-1 target exon 3; Set C
uuggaacuggccggcuggccugggugaggg

SEQ ID NO: 70002 - RNA, 31 nt, Artificial Sequence
  Synthetic Oligonucleotide; PD-1 target exon 3; Set C
uuuggaacuggccggcuggccugggugaggg

SEQ ID NO: 70003 - RNA, 18 nt, Artificial Sequence
  Synthetic Oligonucleotide; PD-1 target exon 3; Set C
acuggccggcuggccugg

SEQ ID NO: 70004 - RNA, 32 nt, Artificial Sequence
  Synthetic Oligonucleotide; PD-1 target exon 3; Set C
guuuggaacuggccggcuggccugggugaggg

SEQ ID NO: 70005 - RNA, 19 nt, Artificial Sequence
  Synthetic Oligonucleotide; PD-1 target exon 3; Set C
aacuggccggcuggccugg

SEQ ID NO: 70006 - RNA, 17 nt, Artificial Sequence
  Synthetic Oligonucleotide; PD-1 target exon 3; Set C
acuggccggcuggccug

SEQ ID NO: 70007 - RNA, 18 nt, Artificial Sequence
  Synthetic Oligonucleotide; PD-1 target exon 3; Set A
aacuggccggcuggccug

SEQ ID NO: 70008 - RNA, 15 nt, Artificial Sequence
  Synthetic Oligonucleotide; PD-1 target exon 3; Set A
uggaacuggccggcu

SEQ ID NO: 70009 - RNA, 15 nt, Artificial Sequence
  Synthetic Oligonucleotide; PD-1 target exon 3; Set C
uuggaacuggccggc

SEQ ID NO: 70010 - RNA, 26 nt, Artificial Sequence
  Synthetic Oligonucleotide; PD-1 target exon 3; Set C
gacaccaaccaccaggguuuggaacu

SEQ ID NO: 70011 - RNA, 25 nt, Artificial Sequence
  Synthetic Oligonucleotide; PD-1 target exon 3; Set C
gacaccaaccaccaggguuuggaac

SEQ ID NO: 70012 - RNA, 25 nt, Artificial Sequence
  Synthetic Oligonucleotide; PD-1 target exon 3; Set C
cgacaccaaccaccaggguuuggaa

SEQ ID NO: 70013 - RNA, 24 nt, Artificial Sequence
  Synthetic Oligonucleotide; PD-1 target exon 3; Set C
cgacaccaaccaccaggguuugga

SEQ ID NO: 70014 - RNA, 23 nt, Artificial Sequence
  Synthetic Oligonucleotide; PD-1 target exon 3; Set C
cgacaccaaccaccaggguuugg

SEQ ID NO: 70015 - RNA, 22 nt, Artificial Sequence
  Synthetic Oligonucleotide; PD-1 target exon 3; Set A
cgacaccaaccaccaggguuug

SEQ ID NO: 70016 - RNA, 21 nt, Artificial Sequence
  Synthetic Oligonucleotide; PD-1 target exon 3; Set A
cgacaccaaccaccaggguuu

SEQ ID NO: 70017 - RNA, 17 nt, Artificial Sequence
  Synthetic Oligonucleotide; PD-1 target exon 3; Set A
acaccaaccaccagggu

SEQ ID NO: 70018 - RNA, 15 nt, Artificial Sequence
  Synthetic Oligonucleotide; PD-1 target exon 3; Set A
aggccgcccacgaca

SEQ ID NO: 70019 - RNA, 37 nt, Artificial Sequence
  Synthetic Oligonucleotide; PD-1 target exon 3; Set C
uagcagcaccaggcugcccagcaggccgcccacgaca

SEQ ID NO: 70020 - RNA, 25 nt, Artificial Sequence
  Synthetic Oligonucleotide; PD-1 target exon 3; Set C
uagcagcaccaggcugcccagcagg

SEQ ID NO: 70021 - RNA, 35 nt, Artificial Sequence
  Synthetic Oligonucleotide; PD-1 target exon 3; Set C
agaugacggccaggacccagacuagcagcaccagg

SEQ ID NO: 70022 - RNA, 38 nt, Artificial Sequence
  Synthetic Oligonucleotide; PD-1 target exon 3; Set C
agcagaugacggccaggacccagacuagcagcaccagg

SEQ ID NO: 70023 - RNA, 39 nt, Artificial Sequence
  Synthetic Oligonucleotide; PD-1 target exon 3; Set C
gagcagaugacggccaggacccagacuagcagcaccagg

SEQ ID NO: 70024 - RNA, 40 nt, Artificial Sequence
  Synthetic Oligonucleotide; PD-1 target exon 3; Set C
ggagcagaugacggccaggacccagacuagcagcaccagg

SEQ ID NO: 70025 - RNA, 21 nt, Artificial Sequence
  Synthetic Oligonucleotide; PD-1 target exon 3; Set C
ugacggccaggacccagacua

SEQ ID NO: 70026 - RNA, 22 nt, Artificial Sequence
  Synthetic Oligonucleotide; PD-1 target exon 3; Set C
augacggccaggacccagacua

SEQ ID NO: 70027 - RNA, 20 nt, Artificial Sequence
  Synthetic Oligonucleotide; PD-1 target exon 3; Set C
ugacggccaggacccagacu

SEQ ID NO: 70028 - RNA, 23 nt, Artificial Sequence
  Synthetic Oligonucleotide; PD-1 target exon 3; Set C
gaugacggccaggacccagacua

SEQ ID NO: 70029 - RNA, 21 nt, Artificial Sequence
  Synthetic Oligonucleotide; PD-1 target exon 3; Set C
augacggccaggacccagacu

SEQ ID NO: 70030 - RNA, 24 nt, Artificial Sequence
  Synthetic Oligonucleotide; PD-1 target exon 3; Set C
agaugacggccaggacccagacua

SEQ ID NO: 70031 - RNA, 20 nt, Artificial Sequence
  Synthetic Oligonucleotide; PD-1 target exon 3; Set C
augacggccaggacccagac

SEQ ID NO: 70032 - RNA, 22 nt, Artificial Sequence
  Synthetic Oligonucleotide; PD-1 target exon 3; Set C
gaugacggccaggacccagacu

SEQ ID NO: 70033 - RNA, 17 nt, Artificial Sequence
  Synthetic Oligonucleotide; PD-1 target exon 3; Set A
ugacggccaggacccag

SEQ ID NO: 70034 - RNA, 25 nt, Artificial Sequence
  Synthetic Oligonucleotide; PD-1 target exon 3; Set C
cagaugacggccaggacccagacua

SEQ ID NO: 70035 - RNA, 23 nt, Artificial Sequence
  Synthetic Oligonucleotide; PD-1 target exon 3; Set C
agaugacggccaggacccagacu
